United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 69

SEQ ID NO: 3139500 - RNA, 16 nt, Human
uuugcuugaaagaaaa

SEQ ID NO: 3139501 - RNA, 14 nt, Human
uuugcuugaaagaa

SEQ ID NO: 3139502 - RNA, 14 nt, Human
uuuaauauuaaagc

SEQ ID NO: 3139503 - RNA, 15 nt, Human
uuuaauauuaaagcc

SEQ ID NO: 3139504 - RNA, 17 nt, Human
uuuaauauuaaagccau

SEQ ID NO: 3139505 - RNA, 20 nt, Human
uuuaauauuaaagccauguu

SEQ ID NO: 3139506 - RNA, 21 nt, Human
uuuaauauuaaagccauguuu

SEQ ID NO: 3139507 - RNA, 12 nt, Human
uuguuucuguac

SEQ ID NO: 3139508 - RNA, 14 nt, Human
uuguuucuguacuu

SEQ ID NO: 3139509 - RNA, 13 nt, Human
uuguuuguuuagu

SEQ ID NO: 3139510 - RNA, 14 nt, Human
uuguuuguuuaguc

SEQ ID NO: 3139511 - RNA, 20 nt, Human
uuuaaaaguauauaauaaaa

SEQ ID NO: 3139512 - RNA, 17 nt, Human
uuaucugaagucagauc

SEQ ID NO: 3139513 - RNA, 13 nt, Human
uuaugccaccccc

SEQ ID NO: 3139514 - RNA, 23 nt, Human
uuaugccacccccgcuggaggau

SEQ ID NO: 3139515 - RNA, 13 nt, Human
uuauuuuauuaug

SEQ ID NO: 3139516 - RNA, 11 nt, Human
uucaaaguugc

SEQ ID NO: 3139517 - RNA, 15 nt, Human
uucaaaguugccuaa

SEQ ID NO: 3139518 - RNA, 16 nt, Human
uucaaaguugccuaaa

SEQ ID NO: 3139519 - RNA, 17 nt, Human
uucaaaguugccuaaau

SEQ ID NO: 3139520 - RNA, 23 nt, Human
uucaaaguugccuaaauccauuu

SEQ ID NO: 3139521 - RNA, 16 nt, Human
uuauuggcuuuucuga

SEQ ID NO: 3139522 - RNA, 18 nt, Human
uuauuggcuuuucugauc

SEQ ID NO: 3139523 - RNA, 22 nt, Human
uuauuggcuuuucugauccagu

SEQ ID NO: 3139524 - RNA, 12 nt, Human
uuauuggcuuuu

SEQ ID NO: 3139525 - RNA, 21 nt, Human
uucacucuccauuuaauaauu

SEQ ID NO: 3139526 - RNA, 20 nt, Human
uucccugggaucuggugguc

SEQ ID NO: 3139527 - RNA, 15 nt, Human
uucccuggcggcccc

SEQ ID NO: 3139528 - RNA, 20 nt, Human
uucccuggcggccccaacuc

SEQ ID NO: 3139529 - RNA, 11 nt, Human
uucccuccucc

SEQ ID NO: 3139530 - RNA, 12 nt, Human
uucccuccuccc

SEQ ID NO: 3139531 - RNA, 13 nt, Human
uucccuccuccca

SEQ ID NO: 3139532 - RNA, 14 nt, Human
uucccuccucccau

SEQ ID NO: 3139533 - RNA, 22 nt, Human
uucccuccucccaugucacugc

SEQ ID NO: 3139534 - RNA, 20 nt, Human
uuaauauuaaagccauguuu

SEQ ID NO: 3139535 - RNA, 21 nt, Human
uuaauauuaaagccauguuua

SEQ ID NO: 3139536 - RNA, 22 nt, Human
uuaauauuaaagccauguuuau

SEQ ID NO: 3139537 - RNA, 19 nt, Human
uuaagcauauauuuuuaua

SEQ ID NO: 3139538 - RNA, 15 nt, Human
uuaagcauauauuuu

SEQ ID NO: 3139539 - RNA, 18 nt, Human
uuaagcauauauuuuuau

SEQ ID NO: 3139540 - RNA, 13 nt, Human
uuaagcauauauu

SEQ ID NO: 3139541 - RNA, 13 nt, Human
uuagagugucuua

SEQ ID NO: 3139542 - RNA, 18 nt, Human
uuagagaguguugaaacg

SEQ ID NO: 3139543 - RNA, 12 nt, Human
uuagagauuuuu

SEQ ID NO: 3139544 - RNA, 13 nt, Human
uuagaucuaguuc

SEQ ID NO: 3139545 - RNA, 14 nt, Human
uuagaucuaguuca

SEQ ID NO: 3139546 - RNA, 14 nt, Human
uuagagaguguuga

SEQ ID NO: 3139547 - RNA, 16 nt, Human
uuagagaguguugaaa

SEQ ID NO: 3139548 - RNA, 17 nt, Human
uuagagaguguugaaac

SEQ ID NO: 3139549 - RNA, 22 nt, Human
uauuauguaaaucccauuauuc

SEQ ID NO: 3139550 - RNA, 12 nt, Human
uauuauguaaau

SEQ ID NO: 3139551 - RNA, 15 nt, Human
uauuauguaaauccc

SEQ ID NO: 3139552 - RNA, 12 nt, Human
uauuaugaaacu

SEQ ID NO: 3139553 - RNA, 20 nt, Human
uauuaugaaacuuguguaaa

SEQ ID NO: 3139554 - RNA, 21 nt, Human
uauuaugaaacuuguguaaau

SEQ ID NO: 3139555 - RNA, 22 nt, Human
uauuaugaaacuuguguaaaua

SEQ ID NO: 3139556 - RNA, 16 nt, Human
uauuaagcauauauuu

SEQ ID NO: 3139557 - RNA, 23 nt, Human
uauugugcgcuaaacuuuucuga

SEQ ID NO: 3139558 - RNA, 19 nt, Human
uauugugcgcuaaacuuuu

SEQ ID NO: 3139559 - RNA, 22 nt, Human
uauugugcgcuaaacuuuucug

SEQ ID NO: 3139560 - RNA, 18 nt, Human
uauuucuauauuuucauu

SEQ ID NO: 3139561 - RNA, 13 nt, Human
ucaauaaaaaauu

SEQ ID NO: 3139562 - RNA, 14 nt, Human
ucaauaaaaaauua

SEQ ID NO: 3139563 - RNA, 16 nt, Human
ucaauaaaaaauuaug

SEQ ID NO: 3139564 - RNA, 18 nt, Human
ucacauugguguuguacu

SEQ ID NO: 3139565 - RNA, 19 nt, Human
ucaauaaaaaauuaugaca

SEQ ID NO: 3139566 - RNA, 17 nt, Human
uaucugaggaauucugu

SEQ ID NO: 3139567 - RNA, 16 nt, Human
uaucugaggaauucug

SEQ ID NO: 3139568 - RNA, 18 nt, Human
uaucugaggaauucugua

SEQ ID NO: 3139569 - RNA, 19 nt, Human
uaucugaggaauucuguau

SEQ ID NO: 3139570 - RNA, 21 nt, Human
uaucugaggaauucuguauag

SEQ ID NO: 3139571 - RNA, 22 nt, Human
uaucugaggaauucuguauaga

SEQ ID NO: 3139572 - RNA, 17 nt, Human
uaggcucgccuucccuc

SEQ ID NO: 3139573 - RNA, 22 nt, Human
uaggcucgccuucccuccugcu

SEQ ID NO: 3139574 - RNA, 22 nt, Human
uauaauuaacauguuaaaccau

SEQ ID NO: 3139575 - RNA, 15 nt, Human
uauaauuaacauguu

SEQ ID NO: 3139576 - RNA, 16 nt, Human
uauaauuaacauguua

SEQ ID NO: 3139577 - RNA, 18 nt, Human
uauaauuaacauguuaaa

SEQ ID NO: 3139578 - RNA, 19 nt, Human
uauaauuaacauguuaaac

SEQ ID NO: 3139579 - RNA, 13 nt, Human
uauaauuaacaug

SEQ ID NO: 3139580 - RNA, 14 nt, Human
uauaauuaacaugu

SEQ ID NO: 3139581 - RNA, 12 nt, Human
uauaauuaacau

SEQ ID NO: 3139582 - RNA, 18 nt, Human
uauaucugaggaauucug

SEQ ID NO: 3139583 - RNA, 19 nt, Human
uauaucugaggaauucugu

SEQ ID NO: 3139584 - RNA, 20 nt, Human
uauaucugaggaauucugua

SEQ ID NO: 3139585 - RNA, 21 nt, Human
uauaucugaggaauucuguau

SEQ ID NO: 3139586 - RNA, 22 nt, Human
uauaucugaggaauucuguaua

SEQ ID NO: 3139587 - RNA, 16 nt, Human
ucucccugcuuugguc

SEQ ID NO: 3139588 - RNA, 10 nt, Human
ucucccugga

SEQ ID NO: 3139589 - RNA, 21 nt, Human
ucucccuggaucuaccuggag

SEQ ID NO: 3139590 - RNA, 22 nt, Human
ucucccuggaucuaccuggagg

SEQ ID NO: 3139591 - RNA, 20 nt, Human
uccuaucaccugucuugccu

SEQ ID NO: 3139592 - RNA, 12 nt, Human
uccgagugguga

SEQ ID NO: 3139593 - RNA, 11 nt, Human
ucccuucccuc

SEQ ID NO: 3139594 - RNA, 13 nt, Human
ucccuucccuccu

SEQ ID NO: 3139595 - RNA, 14 nt, Human
ucccuucccuccuc

SEQ ID NO: 3139596 - RNA, 15 nt, Human
ucccuucccuccucc

SEQ ID NO: 3139597 - RNA, 16 nt, Human
ucccuucccuccuccc

SEQ ID NO: 3139598 - RNA, 20 nt, Human
ucauggaacgcguugaaauu

SEQ ID NO: 3139599 - RNA, 21 nt, Human
ucauggaacgcguugaaauug

SEQ ID NO: 3139600 - RNA, 22 nt, Human
ucauggaacgcguugaaauugu

SEQ ID NO: 3139601 - RNA, 20 nt, Human
uccaguuuuguuuggaccaa

SEQ ID NO: 3139602 - RNA, 15 nt, Human
uccaguuuuguuugg

SEQ ID NO: 3139603 - RNA, 17 nt, Human
uccaguuuuguuuggac

SEQ ID NO: 3139604 - RNA, 14 nt, Human
uccagcagauuauu

SEQ ID NO: 3139605 - RNA, 15 nt, Human
uccagcagauuauuc

SEQ ID NO: 3139606 - RNA, 16 nt, Human
uccagcagauuauuca

SEQ ID NO: 3139607 - RNA, 16 nt, Human
ucccauuauucaaagu

SEQ ID NO: 3139608 - RNA, 18 nt, Human
ucccauuauucaaaguug

SEQ ID NO: 3139609 - RNA, 19 nt, Human
ucccauuauucaaaguugc

SEQ ID NO: 3139610 - RNA, 15 nt, Human
ucccaugucacugca

SEQ ID NO: 3139611 - RNA, 13 nt, Human
ucccauuauucaa

SEQ ID NO: 3139612 - RNA, 14 nt, Human
ucccauuauucaaa

SEQ ID NO: 3139613 - RNA, 16 nt, Human
ugaggcuaaguuggga

SEQ ID NO: 3139614 - RNA, 15 nt, Human
ugauagaggaagccu

SEQ ID NO: 3139615 - RNA, 21 nt, Human
ugauucuucagcaaaaauauu

SEQ ID NO: 3139616 - RNA, 17 nt, Human
ugacauagucuggcugu

SEQ ID NO: 3139617 - RNA, 16 nt, Human
ugacauagucuggcug

SEQ ID NO: 3139618 - RNA, 20 nt, Human
ugaagucagaucugccuaag

SEQ ID NO: 3139619 - RNA, 23 nt, Human
ugaagucagaucugccuaaggac

SEQ ID NO: 3139620 - RNA, 13 nt, Human
ucucccuucccuc

SEQ ID NO: 3139621 - RNA, 15 nt, Human
ucucccuucccuccu

SEQ ID NO: 3139622 - RNA, 16 nt, Human
ucucccuucccuccuc

SEQ ID NO: 3139623 - RNA, 14 nt, Human
ucuugcugcccugc

SEQ ID NO: 3139624 - RNA, 15 nt, Human
ucuugcugcccugcc

SEQ ID NO: 3139625 - RNA, 18 nt, Human
ucuugcugcccugcccca

SEQ ID NO: 3139626 - RNA, 15 nt, Human
ucuugccuuuuucau

SEQ ID NO: 3139627 - RNA, 16 nt, Human
ucuugccuuuuucauu

SEQ ID NO: 3139628 - RNA, 17 nt, Human
ucuugccuuuuucauua

SEQ ID NO: 3139629 - RNA, 19 nt, Human
ucuugccuuuuucauuauu

SEQ ID NO: 3139630 - RNA, 23 nt, Human
ugaaagggaguauuacaaaaaca

SEQ ID NO: 3139631 - RNA, 17 nt, Human
ugcugggguuaucugaa

SEQ ID NO: 3139632 - RNA, 20 nt, Human
ugcugggguuaucugaaguc

SEQ ID NO: 3139633 - RNA, 13 nt, Human
ugcugguguaugu

SEQ ID NO: 3139634 - RNA, 22 nt, Human
ugcugguguaugugugaaguga

SEQ ID NO: 3139635 - RNA, 11 nt, Human
ugcugggcagc

SEQ ID NO: 3139636 - RNA, 12 nt, Human
ugcugggcagcc

SEQ ID NO: 3139637 - RNA, 13 nt, Human
ugcugggcagccc

SEQ ID NO: 3139638 - RNA, 14 nt, Human
ugcugggcagcccg

SEQ ID NO: 3139639 - RNA, 15 nt, Human
ugcugggcagcccgc

SEQ ID NO: 3139640 - RNA, 13 nt, Human
ugcugccuguccc

SEQ ID NO: 3139641 - RNA, 14 nt, Human
ugcugccugucccc

SEQ ID NO: 3139642 - RNA, 15 nt, Human
ugcugccugucccca

SEQ ID NO: 3139643 - RNA, 21 nt, Human
ugcgcuaaacuuuucugauag

SEQ ID NO: 3139644 - RNA, 14 nt, Human
ugcgccacugcucc

SEQ ID NO: 3139645 - RNA, 19 nt, Human
ugcgccacugcuccgugga

SEQ ID NO: 3139646 - RNA, 22 nt, Human
ugcgccacugcuccguggagga

SEQ ID NO: 3139647 - RNA, 19 nt, Human
ugcgcuaaacuuuucugau

SEQ ID NO: 3139648 - RNA, 20 nt, Human
ugcgcuaaacuuuucugaua

SEQ ID NO: 3139649 - RNA, 17 nt, Human
ugccccacaccuccucu

SEQ ID NO: 3139650 - RNA, 20 nt, Human
ugccccacaccuccucucac

SEQ ID NO: 3139651 - RNA, 23 nt, Human
ugccuaaauccauuuggaaaucu

SEQ ID NO: 3139652 - RNA, 20 nt, Human
ugccuaaauccauuuggaaa

SEQ ID NO: 3139653 - RNA, 22 nt, Human
ugccuaaauccauuuggaaauc

SEQ ID NO: 3139654 - RNA, 20 nt, Human
ugccucacccacccuuuuuu

SEQ ID NO: 3139655 - RNA, 13 nt, Human
ugccuaaauccau

SEQ ID NO: 3139656 - RNA, 15 nt, Human
ugccuaaauccauuu

SEQ ID NO: 3139657 - RNA, 19 nt, Human
ugccuaaauccauuuggaa

SEQ ID NO: 3139658 - RNA, 19 nt, Human
uggugacugauucuucagc

SEQ ID NO: 3139659 - RNA, 15 nt, Human
uggugacugauucuu

SEQ ID NO: 3139660 - RNA, 16 nt, Human
uggugacugauucuuc

SEQ ID NO: 3139661 - RNA, 18 nt, Human
uggugagccggucaggca

SEQ ID NO: 3139662 - RNA, 19 nt, Human
uggugacaggacgcugacc

SEQ ID NO: 3139663 - RNA, 17 nt, Human
ugguccgugcuaaggac

SEQ ID NO: 3139664 - RNA, 18 nt, Human
ugguccgugcuaaggacu

SEQ ID NO: 3139665 - RNA, 19 nt, Human
ugguccgugcuaaggacuu

SEQ ID NO: 3139666 - RNA, 20 nt, Human
ugguccgugcuaaggacuug

SEQ ID NO: 3139667 - RNA, 18 nt, Human
ugggggucagugcugccu

SEQ ID NO: 3139668 - RNA, 21 nt, Human
uggcggccccaacucgggcuc

SEQ ID NO: 3139669 - RNA, 23 nt, Human
uggcggccccaacucgggcuccc

SEQ ID NO: 3139670 - RNA, 16 nt, Human
uggcccccuuucccgg

SEQ ID NO: 3139671 - RNA, 17 nt, Human
uggcccccuuucccggg

SEQ ID NO: 3139672 - RNA, 18 nt, Human
uggcccccuuucccgggc

SEQ ID NO: 3139673 - RNA, 23 nt, Human
uggcccccuuucccgggcugucc

SEQ ID NO: 3139674 - RNA, 17 nt, Human
uggaggagguugggagg

SEQ ID NO: 3139675 - RNA, 16 nt, Human
uggaggaugugggcag

SEQ ID NO: 3139676 - RNA, 17 nt, Human
uggaggaugugggcagc

SEQ ID NO: 3139677 - RNA, 21 nt, Human
uggcaaaauaguucugcaggu

SEQ ID NO: 3139678 - RNA, 17 nt, Human
uggaccaaaaaccagua

SEQ ID NO: 3139679 - RNA, 22 nt, Human
uggaccaaaaaccaguauugua

SEQ ID NO: 3139680 - RNA, 19 nt, Human
gugaauggcuuuguauaga

SEQ ID NO: 3139681 - RNA, 17 nt, Human
gugaauggcuuuguaua

SEQ ID NO: 3139682 - RNA, 18 nt, Human
gugaauggcuuuguauag

SEQ ID NO: 3139683 - RNA, 13 nt, Human
gugaauggcuuug

SEQ ID NO: 3139684 - RNA, 14 nt, Human
gugaauggcuuugu

SEQ ID NO: 3139685 - RNA, 23 nt, Human
guggagcuuaagccacugccucu

SEQ ID NO: 3139686 - RNA, 14 nt, Human
guggaggagguugg

SEQ ID NO: 3139687 - RNA, 15 nt, Human
guggaggagguuggg

SEQ ID NO: 3139688 - RNA, 16 nt, Human
guggaggagguuggga

SEQ ID NO: 3139689 - RNA, 13 nt, Human
gucucagauuuua

SEQ ID NO: 3139690 - RNA, 21 nt, Human
gucucgucuuccgucuccccc

SEQ ID NO: 3139691 - RNA, 22 nt, Human
guaaauacaauuuuguuucugu

SEQ ID NO: 3139692 - RNA, 23 nt, Human
guaaauacaauuuuguuucugua

SEQ ID NO: 3139693 - RNA, 15 nt, Human
guaaaucccauuauu

SEQ ID NO: 3139694 - RNA, 21 nt, Human
guaaauacaauuuuguuucug

SEQ ID NO: 3139695 - RNA, 20 nt, Human
guaaaucccauuauucaaag

SEQ ID NO: 3139696 - RNA, 21 nt, Human
guaaaucccauuauucaaagu

SEQ ID NO: 3139697 - RNA, 16 nt, Human
guaaaucccauuauuc

SEQ ID NO: 3139698 - RNA, 17 nt, Human
guaaaucccauuauuca

SEQ ID NO: 3139699 - RNA, 18 nt, Human
guaaaucccauuauucaa

SEQ ID NO: 3139700 - RNA, 19 nt, Human
guaaaucccauuauucaaa

SEQ ID NO: 3139701 - RNA, 15 nt, Human
gguuuuggcaucucu

SEQ ID NO: 3139702 - RNA, 16 nt, Human
gguugaagccaugucu

SEQ ID NO: 3139703 - RNA, 17 nt, Human
gguugaagccaugucua

SEQ ID NO: 3139704 - RNA, 12 nt, Human
guacuuuuuggc

SEQ ID NO: 3139705 - RNA, 21 nt, Human
guacuuuuuggcauaacauaa

SEQ ID NO: 3139706 - RNA, 13 nt, Human
guaauuauaucug

SEQ ID NO: 3139707 - RNA, 14 nt, Human
ggucagcccuagga

SEQ ID NO: 3139708 - RNA, 22 nt, Human
ggguuggggugguugaggcuaa

SEQ ID NO: 3139709 - RNA, 16 nt, Human
gguccgugcuaaggac

SEQ ID NO: 3139710 - RNA, 17 nt, Human
gguccgugcuaaggacu

SEQ ID NO: 3139711 - RNA, 18 nt, Human
gguccgugcuaaggacuu

SEQ ID NO: 3139712 - RNA, 17 nt, Human
ggugaauggcuuuguau

SEQ ID NO: 3139713 - RNA, 20 nt, Human
ggugaauggcuuuguauaga

SEQ ID NO: 3139714 - RNA, 14 nt, Human
ggugaauggcuuug

SEQ ID NO: 3139715 - RNA, 19 nt, Human
ggugcccugcuuucagaua

SEQ ID NO: 3139716 - RNA, 15 nt, Human
ggggcagcagcagcc

SEQ ID NO: 3139717 - RNA, 16 nt, Human
ggggcagcagcagccc

SEQ ID NO: 3139718 - RNA, 18 nt, Human
ggggcagcagcagcccug

SEQ ID NO: 3139719 - RNA, 19 nt, Human
ggggcagcagcagcccugc

SEQ ID NO: 3139720 - RNA, 20 nt, Human
ggggcagcagcagcccugcc

SEQ ID NO: 3139721 - RNA, 16 nt, Human
ggggugcagaggcugu

SEQ ID NO: 3139722 - RNA, 19 nt, Human
gggcgccccccccucccca

SEQ ID NO: 3139723 - RNA, 20 nt, Human
gggcgccgugcugggcagcc

SEQ ID NO: 3139724 - RNA, 22 nt, Human
gggcgccgugcugggcagcccg

SEQ ID NO: 3139725 - RNA, 24 nt, Human
gggcgccgugcugggcagcccgcu

SEQ ID NO: 3139726 - RNA, 24 nt, Human
gggcuguccacuagaccagugagc

SEQ ID NO: 3139727 - RNA, 12 nt, Human
ggaauucuguau

SEQ ID NO: 3139728 - RNA, 15 nt, Human
ggaauucuguauaga

SEQ ID NO: 3139729 - RNA, 17 nt, Human
ggaauucuguauagauu

SEQ ID NO: 3139730 - RNA, 15 nt, Human
ggacuguggugacuu

SEQ ID NO: 3139731 - RNA, 17 nt, Human
ggacuguggugacuuug

SEQ ID NO: 3139732 - RNA, 21 nt, Human
ggacuguggugacuuuggaua

SEQ ID NO: 3139733 - RNA, 22 nt, Human
ggacuguggugacuuuggauaa

SEQ ID NO: 3139734 - RNA, 14 nt, Human
ggacuguggugacu

SEQ ID NO: 3139735 - RNA, 16 nt, Human
ggaccaaaaaccagua

SEQ ID NO: 3139736 - RNA, 23 nt, Human
ggaccaaaaaccaguauuguaca

SEQ ID NO: 3139737 - RNA, 14 nt, Human
ggaccaaaaaccag

SEQ ID NO: 3139738 - RNA, 12 nt, Human
gcuuagggcccu

SEQ ID NO: 3139739 - RNA, 15 nt, Human
gcuuagggcccugga

SEQ ID NO: 3139740 - RNA, 16 nt, Human
gcuuagggcccuggag

SEQ ID NO: 3139741 - RNA, 17 nt, Human
gcuuagggcccuggagg

SEQ ID NO: 3139742 - RNA, 18 nt, Human
gcuuagggcccuggaggc

SEQ ID NO: 3139743 - RNA, 16 nt, Human
ggaacaggaaacugau

SEQ ID NO: 3139744 - RNA, 14 nt, Human
ggaaaaguuuaaua

SEQ ID NO: 3139745 - RNA, 14 nt, Human
gcuuucagauacug

SEQ ID NO: 3139746 - RNA, 18 nt, Human
gcuuucagauacuggauu

SEQ ID NO: 3139747 - RNA, 23 nt, Human
gcuuucagauacuggauuguacu

SEQ ID NO: 3139748 - RNA, 20 nt, Human
gcuuuguauagaaccucuuu

SEQ ID NO: 3139749 - RNA, 16 nt, Human
ggcgccgugcugggca

SEQ ID NO: 3139750 - RNA, 17 nt, Human
ggcgccgugcugggcag

SEQ ID NO: 3139751 - RNA, 18 nt, Human
ggcgccgugcugggcagc

SEQ ID NO: 3139752 - RNA, 19 nt, Human
ggcgccgugcugggcagcc

SEQ ID NO: 3139753 - RNA, 20 nt, Human
ggcgccgugcugggcagccc

SEQ ID NO: 3139754 - RNA, 21 nt, Human
ggcgccgugcugggcagcccg

SEQ ID NO: 3139755 - RNA, 18 nt, Human
ggcggccccaacucgggc

SEQ ID NO: 3139756 - RNA, 12 nt, Human
ggcccuggaggc

SEQ ID NO: 3139757 - RNA, 18 nt, Human
ggauucuuaaaguugaau

SEQ ID NO: 3139758 - RNA, 19 nt, Human
ggauucuuaaaguugaauu

SEQ ID NO: 3139759 - RNA, 16 nt, Human
ggauucuuaaaguuga

SEQ ID NO: 3139760 - RNA, 20 nt, Human
ggauucuuaaaguugaauuu

SEQ ID NO: 3139761 - RNA, 15 nt, Human
ggcagcuuagggccc

SEQ ID NO: 3139762 - RNA, 16 nt, Human
ggcagcuuagggcccu

SEQ ID NO: 3139763 - RNA, 17 nt, Human
ggcagcuuagggcccug

SEQ ID NO: 3139764 - RNA, 18 nt, Human
ggcagcuuagggcccugg

SEQ ID NO: 3139765 - RNA, 19 nt, Human
ggcagcuuagggcccugga

SEQ ID NO: 3139766 - RNA, 21 nt, Human
ggcagcuuagggcccuggagg

SEQ ID NO: 3139767 - RNA, 22 nt, Human
ggcagcuuagggcccuggaggc

SEQ ID NO: 3139768 - RNA, 15 nt, Human
ggcaugaagacagau

SEQ ID NO: 3139769 - RNA, 18 nt, Human
gccucucccucugguccc

SEQ ID NO: 3139770 - RNA, 19 nt, Human
gccucucccucugguccca

SEQ ID NO: 3139771 - RNA, 20 nt, Human
gccucucccucuggucccac

SEQ ID NO: 3139772 - RNA, 13 nt, Human
gccugauuaaaga

SEQ ID NO: 3139773 - RNA, 16 nt, Human
gccugauuaaagaaug

SEQ ID NO: 3139774 - RNA, 23 nt, Human
gccugcacggugaauggcuuugu

SEQ ID NO: 3139775 - RNA, 14 nt, Human
gcccuggaggcggu

SEQ ID NO: 3139776 - RNA, 15 nt, Human
gcccuggaggcggug

SEQ ID NO: 3139777 - RNA, 22 nt, Human
gcccuggaggcggugcggcagg

SEQ ID NO: 3139778 - RNA, 13 nt, Human
gagaguguugaaa

SEQ ID NO: 3139779 - RNA, 17 nt, Human
gacuucuuuaauuuugg

SEQ ID NO: 3139780 - RNA, 18 nt, Human
gacuucuuuaauuuugga

SEQ ID NO: 3139781 - RNA, 16 nt, Human
gacuucuuuaauuuug

SEQ ID NO: 3139782 - RNA, 19 nt, Human
gacuucuuuaauuuuggaa

SEQ ID NO: 3139783 - RNA, 20 nt, Human
gacuucuuuaauuuuggaau

SEQ ID NO: 3139784 - RNA, 21 nt, Human
gacuucuuuaauuuuggaauu

SEQ ID NO: 3139785 - RNA, 14 nt, Human
gaauggcuuuguau

SEQ ID NO: 3139786 - RNA, 16 nt, Human
gaauggcuuuguauag

SEQ ID NO: 3139787 - RNA, 17 nt, Human
gaauggcuuuguauaga

SEQ ID NO: 3139788 - RNA, 22 nt, Human
gaauucuguauagauuagaauu

SEQ ID NO: 3139789 - RNA, 14 nt, Human
gaauucuguauaga

SEQ ID NO: 3139790 - RNA, 21 nt, Human
gaauucuguauagauuagaau

SEQ ID NO: 3139791 - RNA, 13 nt, Human
gaauucuguauag

SEQ ID NO: 3139792 - RNA, 11 nt, Human
gaauucuguau

SEQ ID NO: 3139793 - RNA, 19 nt, Human
gacaugcccucccuucucc

SEQ ID NO: 3139794 - RNA, 22 nt, Human
gacaugcccucccuucucccug

SEQ ID NO: 3139795 - RNA, 12 nt, Human
gaguguugaaac

SEQ ID NO: 3139796 - RNA, 16 nt, Human
gaguguugaaacggau

SEQ ID NO: 3139797 - RNA, 20 nt, Human
gauaaaugccaucaauaaaa

SEQ ID NO: 3139798 - RNA, 11 nt, Human
gauaaaugcca

SEQ ID NO: 3139799 - RNA, 15 nt, Human
gauaaaugccaucaa

SEQ ID NO: 3139800 - RNA, 12 nt, Human
gagguugggagg

SEQ ID NO: 3139801 - RNA, 17 nt, Human
gaggggugcagaggcug

SEQ ID NO: 3139802 - RNA, 18 nt, Human
gaggggugcagaggcugu

SEQ ID NO: 3139803 - RNA, 19 nt, Human
gaggggugcagaggcugug

SEQ ID NO: 3139804 - RNA, 13 nt, Human
gaggcugguuuug

SEQ ID NO: 3139805 - RNA, 15 nt, Human
gaggcuguggcuggu

SEQ ID NO: 3139806 - RNA, 18 nt, Human
gaggcuguggcuggugag

SEQ ID NO: 3139807 - RNA, 19 nt, Human
gauugagaccuacaggcug

SEQ ID NO: 3139808 - RNA, 20 nt, Human
gauugagaccuacaggcuga

SEQ ID NO: 3139809 - RNA, 21 nt, Human
gauugagaccuacaggcugac

SEQ ID NO: 3139810 - RNA, 12 nt, Human
gaugugggcagc

SEQ ID NO: 3139811 - RNA, 13 nt, Human
gaugugggcagcu

SEQ ID NO: 3139812 - RNA, 14 nt, Human
gaugugggcagcuu

SEQ ID NO: 3139813 - RNA, 21 nt, Human
gaucagacagaucuggaaugu

SEQ ID NO: 3139814 - RNA, 16 nt, Human
cuuucucuuucguuac

SEQ ID NO: 3139815 - RNA, 17 nt, Human
cuuucccgggcugucca

SEQ ID NO: 3139816 - RNA, 19 nt, Human
cuuucccgggcuguccacu

SEQ ID NO: 3139817 - RNA, 17 nt, Human
cuuugcgugcccggggc

SEQ ID NO: 3139818 - RNA, 19 nt, Human
cuuugcgugcccggggcag

SEQ ID NO: 3139819 - RNA, 21 nt, Human
cuuugcgugcccggggcagca

SEQ ID NO: 3139820 - RNA, 15 nt, Human
cuuugugcugggguu

SEQ ID NO: 3139821 - RNA, 20 nt, Human
cuuugugcugggguuaucug

SEQ ID NO: 3139822 - RNA, 22 nt, Human
cuuugugcugggguuaucugaa

SEQ ID NO: 3139823 - RNA, 20 nt, Human
cuuugucuacaccauuaugu

SEQ ID NO: 3139824 - RNA, 23 nt, Human
cuuugucuacaccauuaugugcg

SEQ ID NO: 3139825 - RNA, 16 nt, Human
cuuguuagaucuaguu

SEQ ID NO: 3139826 - RNA, 22 nt, Human
cuuguuagaucuaguucacucu

SEQ ID NO: 3139827 - RNA, 21 nt, Human
cuuguguaaauacaauuuugu

SEQ ID NO: 3139828 - RNA, 14 nt, Human
cuuguguaaauaca

SEQ ID NO: 3139829 - RNA, 16 nt, Human
cuuguguaaauacaau

SEQ ID NO: 3139830 - RNA, 12 nt, Human
cuuguguaaaua

SEQ ID NO: 3139831 - RNA, 23 nt, Human
gaaaaguuuaauauuaaagccau

SEQ ID NO: 3139832 - RNA, 15 nt, Human
gaaaaguuuaauauu

SEQ ID NO: 3139833 - RNA, 19 nt, Human
gaaaaguuuaauauuaaag

SEQ ID NO: 3139834 - RNA, 20 nt, Human
gaaaaguuuaauauuaaagc

SEQ ID NO: 3139835 - RNA, 21 nt, Human
gaaaaguuuaauauuaaagcc

SEQ ID NO: 3139836 - RNA, 22 nt, Human
gaaaaguuuaauauuaaagcca

SEQ ID NO: 3139837 - RNA, 22 nt, Human
cuuuuuggcauaacauaaaucu

SEQ ID NO: 3139838 - RNA, 16 nt, Human
cuuuuuggcauaacau

SEQ ID NO: 3139839 - RNA, 20 nt, Human
cuuuuuggcauaacauaaau

SEQ ID NO: 3139840 - RNA, 18 nt, Human
gaaacggaugauuucuau

SEQ ID NO: 3139841 - RNA, 17 nt, Human
gaaacggaugauuucua

SEQ ID NO: 3139842 - RNA, 13 nt, Human
cuucuugcugccc

SEQ ID NO: 3139843 - RNA, 14 nt, Human
cuucuugcugcccu

SEQ ID NO: 3139844 - RNA, 15 nt, Human
cuucuugcugcccug

SEQ ID NO: 3139845 - RNA, 20 nt, Human
cuucuugcugcccugcccca

SEQ ID NO: 3139846 - RNA, 23 nt, Human
cuucuugcugcccugccccaagu

SEQ ID NO: 3139847 - RNA, 15 nt, Human
cuucuuuaauuuugg

SEQ ID NO: 3139848 - RNA, 16 nt, Human
cuucuuuaauuuugga

SEQ ID NO: 3139849 - RNA, 17 nt, Human
cuucuuuaauuuuggaa

SEQ ID NO: 3139850 - RNA, 18 nt, Human
cuucuuuaauuuuggaau

SEQ ID NO: 3139851 - RNA, 19 nt, Human
cuucuuuaauuuuggaauu

SEQ ID NO: 3139852 - RNA, 11 nt, Human
cuucucccugg

SEQ ID NO: 3139853 - RNA, 12 nt, Human
cuucucccugga

SEQ ID NO: 3139854 - RNA, 13 nt, Human
cuucucccuggau

SEQ ID NO: 3139855 - RNA, 13 nt, Human
cuuccgucucccc

SEQ ID NO: 3139856 - RNA, 14 nt, Human
cuuccgucuccccc

SEQ ID NO: 3139857 - RNA, 16 nt, Human
cuuccgucucccccgu

SEQ ID NO: 3139858 - RNA, 14 nt, Human
cuguuccccucucc

SEQ ID NO: 3139859 - RNA, 15 nt, Human
cuguuccccucuccc

SEQ ID NO: 3139860 - RNA, 16 nt, Human
cuguuccccucucccu

SEQ ID NO: 3139861 - RNA, 17 nt, Human
cuguuccccucucccuu

SEQ ID NO: 3139862 - RNA, 18 nt, Human
cuguuccccucucccuuc

SEQ ID NO: 3139863 - RNA, 20 nt, Human
cuguuccccucucccuuccc

SEQ ID NO: 3139864 - RNA, 21 nt, Human
cuguuccccucucccuucccu

SEQ ID NO: 3139865 - RNA, 12 nt, Human
cuguggcuggug

SEQ ID NO: 3139866 - RNA, 14 nt, Human
cuguggcuggugag

SEQ ID NO: 3139867 - RNA, 16 nt, Human
cuguauagauuagaau

SEQ ID NO: 3139868 - RNA, 15 nt, Human
cugccuaaggacuuc

SEQ ID NO: 3139869 - RNA, 12 nt, Human
cugccuaaggac

SEQ ID NO: 3139870 - RNA, 13 nt, Human
cugccuaaggacu

SEQ ID NO: 3139871 - RNA, 14 nt, Human
cugccuaaggacuu

SEQ ID NO: 3139872 - RNA, 12 nt, Human
cuggcggcccca

SEQ ID NO: 3139873 - RNA, 15 nt, Human
cuggcggccccaacu

SEQ ID NO: 3139874 - RNA, 22 nt, Human
cuggcggccccaacucgggcuc

SEQ ID NO: 3139875 - RNA, 15 nt, Human
cuggcauagagcagc

SEQ ID NO: 3139876 - RNA, 20 nt, Human
ccagugagcgcuugggcgcc

SEQ ID NO: 3139877 - RNA, 14 nt, Human
ccagggcccgcacc

SEQ ID NO: 3139878 - RNA, 14 nt, Human
cccacacuucccug

SEQ ID NO: 3139879 - RNA, 15 nt, Human
cccacacuucccugg

SEQ ID NO: 3139880 - RNA, 16 nt, Human
cccacacuucccuggc

SEQ ID NO: 3139881 - RNA, 13 nt, Human
ccauuuggaaauc

SEQ ID NO: 3139882 - RNA, 11 nt, Human
ccauuauucaa

SEQ ID NO: 3139883 - RNA, 14 nt, Human
ccagccugggccca

SEQ ID NO: 3139884 - RNA, 18 nt, Human
ccagccugggcccaucuc

SEQ ID NO: 3139885 - RNA, 21 nt, Human
ccagccugggcccaucucccu

SEQ ID NO: 3139886 - RNA, 22 nt, Human
ccagccugggcccaucucccug

SEQ ID NO: 3139887 - RNA, 23 nt, Human
ccagccugggcccaucucccugc

SEQ ID NO: 3139888 - RNA, 12 nt, Human
cccaucucccug

SEQ ID NO: 3139889 - RNA, 13 nt, Human
cccaucucccugc

SEQ ID NO: 3139890 - RNA, 14 nt, Human
cccaucucccugcu

SEQ ID NO: 3139891 - RNA, 15 nt, Human
cccaucucccugcuu

SEQ ID NO: 3139892 - RNA, 17 nt, Human
cccaucucccugcuuug

SEQ ID NO: 3139893 - RNA, 22 nt, Human
cccaugcuuaacauacccgccu

SEQ ID NO: 3139894 - RNA, 12 nt, Human
cccauuauucaa

SEQ ID NO: 3139895 - RNA, 17 nt, Human
cccaugcaggugguguc

SEQ ID NO: 3139896 - RNA, 16 nt, Human
ccccacccugccucac

SEQ ID NO: 3139897 - RNA, 21 nt, Human
ccccaaguugggggucagugc

SEQ ID NO: 3139898 - RNA, 12 nt, Human
cccauucccugg

SEQ ID NO: 3139899 - RNA, 13 nt, Human
cccauucccuggg

SEQ ID NO: 3139900 - RNA, 14 nt, Human
cccauucccuggga

SEQ ID NO: 3139901 - RNA, 17 nt, Human
cccauucccugggaucu

SEQ ID NO: 3139902 - RNA, 19 nt, Human
cccauucccugggaucugg

SEQ ID NO: 3139903 - RNA, 18 nt, Human
cccauuauucaaaguugc

SEQ ID NO: 3139904 - RNA, 23 nt, Human
cccauuauucaaaguugccuaaa

SEQ ID NO: 3139905 - RNA, 13 nt, Human
ccccucucccuuc

SEQ ID NO: 3139906 - RNA, 16 nt, Human
ccccucucccuucccu

SEQ ID NO: 3139907 - RNA, 17 nt, Human
cccccacacuucccugg

SEQ ID NO: 3139908 - RNA, 20 nt, Human
cccccacacuucccuggcgg

SEQ ID NO: 3139909 - RNA, 13 nt, Human
ccccaucacugcg

SEQ ID NO: 3139910 - RNA, 19 nt, Human
ccccaucacugcgccacug

SEQ ID NO: 3139911 - RNA, 16 nt, Human
ccccuguuccccucuc

SEQ ID NO: 3139912 - RNA, 19 nt, Human
ccccuguuccccucucccu

SEQ ID NO: 3139913 - RNA, 21 nt, Human
cccgcuaggcucgccuucccu

SEQ ID NO: 3139914 - RNA, 12 nt, Human
cccuucccuccu

SEQ ID NO: 3139915 - RNA, 17 nt, Human
cccuucccuccucccau

SEQ ID NO: 3139916 - RNA, 13 nt, Human
cccucucccuucc

SEQ ID NO: 3139917 - RNA, 18 nt, Human
cccucucccuucccuccu

SEQ ID NO: 3139918 - RNA, 20 nt, Human
cccucucccuucccuccucc

SEQ ID NO: 3139919 - RNA, 13 nt, Human
cccucuugucucc

SEQ ID NO: 3139920 - RNA, 15 nt, Human
cccucuugucucccc

SEQ ID NO: 3139921 - RNA, 16 nt, Human
cccucuugucuccccu

SEQ ID NO: 3139922 - RNA, 17 nt, Human
cccucuugucuccccug

SEQ ID NO: 3139923 - RNA, 18 nt, Human
cccucuugucuccccugu

SEQ ID NO: 3139924 - RNA, 12 nt, Human
ccuacaggcuga

SEQ ID NO: 3139925 - RNA, 14 nt, Human
ccuacaggcugacg

SEQ ID NO: 3139926 - RNA, 21 nt, Human
ccuacaggcugacguuccggg

SEQ ID NO: 3139927 - RNA, 11 nt, Human
ccgcuggagga

SEQ ID NO: 3139928 - RNA, 12 nt, Human
ccgcuggaggau

SEQ ID NO: 3139929 - RNA, 21 nt, Human
ccgcuggaggaugugggcagc

SEQ ID NO: 3139930 - RNA, 15 nt, Human
ccgccuagcugcugu

SEQ ID NO: 3139931 - RNA, 12 nt, Human
ccuucucccugg

SEQ ID NO: 3139932 - RNA, 13 nt, Human
ccuucucccugga

SEQ ID NO: 3139933 - RNA, 14 nt, Human
ccuucucccuggau

SEQ ID NO: 3139934 - RNA, 22 nt, Human
cgcguugaaauuguaauuauau

SEQ ID NO: 3139935 - RNA, 24 nt, Human
cgcguugaaauuguaauuauaucu

SEQ ID NO: 3139936 - RNA, 17 nt, Human
cgcuaaacuuuucugau

SEQ ID NO: 3139937 - RNA, 18 nt, Human
cgcuaaacuuuucugaua

SEQ ID NO: 3139938 - RNA, 19 nt, Human
cgcuaaacuuuucugauag

SEQ ID NO: 3139939 - RNA, 13 nt, Human
ccuguccccaugc

SEQ ID NO: 3139940 - RNA, 20 nt, Human
cucccuggaucuaccuggag

SEQ ID NO: 3139941 - RNA, 21 nt, Human
cucccuggaucuaccuggagg

SEQ ID NO: 3139942 - RNA, 12 nt, Human
cucccugcuuug

SEQ ID NO: 3139943 - RNA, 20 nt, Human
cuccauuuaauaauuauaug

SEQ ID NO: 3139944 - RNA, 13 nt, Human
cuccauuuaauaa

SEQ ID NO: 3139945 - RNA, 16 nt, Human
cucccaugucacugca

SEQ ID NO: 3139946 - RNA, 17 nt, Human
cucccaugucacugcag

SEQ ID NO: 3139947 - RNA, 23 nt, Human
cucagauuuuauuauguaaaucc

SEQ ID NO: 3139948 - RNA, 22 nt, Human
cucagauuuuauuauguaaauc

SEQ ID NO: 3139949 - RNA, 14 nt, Human
cuagacuggugacu

SEQ ID NO: 3139950 - RNA, 15 nt, Human
cuagacuggugacug

SEQ ID NO: 3139951 - RNA, 17 nt, Human
cuagacuggugacugau

SEQ ID NO: 3139952 - RNA, 18 nt, Human
cuagacuggugacugauu

SEQ ID NO: 3139953 - RNA, 23 nt, Human
cuagacuggugacugauucuuca

SEQ ID NO: 3139954 - RNA, 19 nt, Human
cuagacuggugacugauuc

SEQ ID NO: 3139955 - RNA, 22 nt, Human
cuagacuggugacugauucuuc

SEQ ID NO: 3139956 - RNA, 14 nt, Human
cuaugcugaguuug

SEQ ID NO: 3139957 - RNA, 15 nt, Human
cuaugcugaguuugu

SEQ ID NO: 3139958 - RNA, 13 nt, Human
cuaugcugaguuu

SEQ ID NO: 3139959 - RNA, 19 nt, Human
cuauuucuauauuuucauu

SEQ ID NO: 3139960 - RNA, 20 nt, Human
cuauuucuauauuuucauuc

SEQ ID NO: 3139961 - RNA, 18 nt, Human
cuauuucuauauuuucau

SEQ ID NO: 3139962 - RNA, 15 nt, Human
cuaaccaagaggcug

SEQ ID NO: 3139963 - RNA, 16 nt, Human
cuaaccaagaggcugg

SEQ ID NO: 3139964 - RNA, 17 nt, Human
cuaaccaagaggcuggu

SEQ ID NO: 3139965 - RNA, 21 nt, Human
cuaaaauggacuguggugacu

SEQ ID NO: 3139966 - RNA, 22 nt, Human
cuaaaauggacuguggugacuu

SEQ ID NO: 3139967 - RNA, 14 nt, Human
cuaaggacuucuuu

SEQ ID NO: 3139968 - RNA, 15 nt, Human
cuaaggacuucuuua

SEQ ID NO: 3139969 - RNA, 16 nt, Human
cuaaggacuucuuuaa

SEQ ID NO: 3139970 - RNA, 15 nt, Human
cuccccaugcaggug

SEQ ID NO: 3139971 - RNA, 20 nt, Human
cuccccaugcaggugguguc

SEQ ID NO: 3139972 - RNA, 13 nt, Human
cgccuagcugcug

SEQ ID NO: 3139973 - RNA, 15 nt, Human
cgccuagcugcuguc

SEQ ID NO: 3139974 - RNA, 16 nt, Human
ccuuuuuuaaauaaau

SEQ ID NO: 3139975 - RNA, 19 nt, Human
cgcugauaagcguucaugg

SEQ ID NO: 3139976 - RNA, 11 nt, Human
cuaccuggagg

SEQ ID NO: 3139977 - RNA, 16 nt, Human
cuaccuggagggaaga

SEQ ID NO: 3139978 - RNA, 23 nt, Human
cuaccuggagggaagaguggagg

SEQ ID NO: 3139979 - RNA, 20 nt, Human
ccaguauuguacaaaguauu

SEQ ID NO: 3139980 - RNA, 22 nt, Human
ccaguauuguacaaaguauuaa

SEQ ID NO: 3139981 - RNA, 15 nt, Human
ccagcagauuauuca

SEQ ID NO: 3139982 - RNA, 16 nt, Human
ccaguuuuguuuggac

SEQ ID NO: 3139983 - RNA, 19 nt, Human
ccaguuuuguuuggaccaa

SEQ ID NO: 3139984 - RNA, 18 nt, Human
cccaggaauggagccugc

SEQ ID NO: 3139985 - RNA, 19 nt, Human
cccaggaauggagccugca

SEQ ID NO: 3139986 - RNA, 20 nt, Human
cccaggaauggagccugcac

SEQ ID NO: 3139987 - RNA, 22 nt, Human
cccaggaauggagccugcacgg

SEQ ID NO: 3139988 - RNA, 19 nt, Human
ccugucuugccuuuuucau

SEQ ID NO: 3139989 - RNA, 20 nt, Human
ccugucuugccuuuuucauu

SEQ ID NO: 3139990 - RNA, 17 nt, Human
ccugucuugccuuuuuc

SEQ ID NO: 3139991 - RNA, 11 nt, Human
ccugccccaca

SEQ ID NO: 3139992 - RNA, 19 nt, Human
ccugccccacaccuccucu

SEQ ID NO: 3139993 - RNA, 15 nt, Human
ccucccaugucacug

SEQ ID NO: 3139994 - RNA, 16 nt, Human
ccucccaugucacugc

SEQ ID NO: 3139995 - RNA, 18 nt, Human
ccucccaugucacugcag

SEQ ID NO: 3139996 - RNA, 22 nt, Human
auuguacaaaguauuaagcaua

SEQ ID NO: 3139997 - RNA, 20 nt, Human
auuguacaaaguauuaagca

SEQ ID NO: 3139998 - RNA, 23 nt, Human
auuguacaaaguauuaagcauau

SEQ ID NO: 3139999 - RNA, 18 nt, Human
auugagaccuacaggcug

SEQ ID NO: 3140000 - RNA, 19 nt, Human
auugagaccuacaggcuga

SEQ ID NO: 3140001 - RNA, 16 nt, Human
caaaguauuaagcaua

SEQ ID NO: 3140002 - RNA, 17 nt, Human
caaaguauuaagcauau

SEQ ID NO: 3140003 - RNA, 19 nt, Human
caaaguauuaagcauauau

SEQ ID NO: 3140004 - RNA, 21 nt, Human
caaaguauuaagcauauauuu

SEQ ID NO: 3140005 - RNA, 14 nt, Human
caaaguauuaagca

SEQ ID NO: 3140006 - RNA, 15 nt, Human
caaaguauuaagcau

SEQ ID NO: 3140007 - RNA, 15 nt, Human
cacuccccagccugg

SEQ ID NO: 3140008 - RNA, 19 nt, Human
cacuccccagccugggccc

SEQ ID NO: 3140009 - RNA, 16 nt, Human
caauaaaaaauuauga

SEQ ID NO: 3140010 - RNA, 17 nt, Human
caauaaaaaauuaugac

SEQ ID NO: 3140011 - RNA, 13 nt, Human
caauaaaaaauua

SEQ ID NO: 3140012 - RNA, 18 nt, Human
caucacugcgccacugcu

SEQ ID NO: 3140013 - RNA, 15 nt, Human
ccaacucgggcuccc

SEQ ID NO: 3140014 - RNA, 19 nt, Human
ccaacucgggcucccgggu

SEQ ID NO: 3140015 - RNA, 15 nt, Human
ccaaaagaaacugac

SEQ ID NO: 3140016 - RNA, 16 nt, Human
ccaaaagaaacugaca

SEQ ID NO: 3140017 - RNA, 19 nt, Human
caggcacacaaggggcccu

SEQ ID NO: 3140018 - RNA, 23 nt, Human
caggcacacaaggggcccuugga

SEQ ID NO: 3140019 - RNA, 23 nt, Human
cagauugagaccuacaggcugac

SEQ ID NO: 3140020 - RNA, 11 nt, Human
gcagaggcugu

SEQ ID NO: 3140021 - RNA, 15 nt, Human
gcagaggcuguggcu

SEQ ID NO: 3140022 - RNA, 18 nt, Human
gcagaggcuguggcuggu

SEQ ID NO: 3140023 - RNA, 19 nt, Human
gcagaggcuguggcuggug

SEQ ID NO: 3140024 - RNA, 13 nt, Human
gaugauuucuaug

SEQ ID NO: 3140025 - RNA, 23 nt, Human
gaugauuucuaugcugaguuugu

SEQ ID NO: 3140026 - RNA, 12 nt, Human
gaugauuucuau

SEQ ID NO: 3140027 - RNA, 19 nt, Human
gauccagcagauuauucac

SEQ ID NO: 3140028 - RNA, 18 nt, Human
gauccagcagauuauuca

SEQ ID NO: 3140029 - RNA, 12 nt, Human
gaucugccuaag

SEQ ID NO: 3140030 - RNA, 15 nt, Human
gaucugccuaaggac

SEQ ID NO: 3140031 - RNA, 16 nt, Human
gaucugccuaaggacu

SEQ ID NO: 3140032 - RNA, 16 nt, Human
gauacuggauuguacu

SEQ ID NO: 3140033 - RNA, 20 nt, Human
gauacuggauuguacuuugu

SEQ ID NO: 3140034 - RNA, 19 nt, Human
gcaaaauguuacagaaucu

SEQ ID NO: 3140035 - RNA, 15 nt, Human
gagaccuacaggcug

SEQ ID NO: 3140036 - RNA, 17 nt, Human
gagaccuacaggcugac

SEQ ID NO: 3140037 - RNA, 10 nt, Human
cuggaucuac

SEQ ID NO: 3140038 - RNA, 15 nt, Human
cuggaucuaccugga

SEQ ID NO: 3140039 - RNA, 16 nt, Human
cuggaucuaccuggag

SEQ ID NO: 3140040 - RNA, 17 nt, Human
cuggaucuaccuggagg

SEQ ID NO: 3140041 - RNA, 18 nt, Human
cuggaucuaccuggaggg

SEQ ID NO: 3140042 - RNA, 20 nt, Human
cuggagaacaagaaagggcc

SEQ ID NO: 3140043 - RNA, 12 nt, Human
cugccugucccc

SEQ ID NO: 3140044 - RNA, 14 nt, Human
cugccuguccccau

SEQ ID NO: 3140045 - RNA, 15 nt, Human
cugccuguccccaug

SEQ ID NO: 3140046 - RNA, 17 nt, Human
cugccuguccccaugcu

SEQ ID NO: 3140047 - RNA, 11 nt, Human
cugccucuccc

SEQ ID NO: 3140048 - RNA, 13 nt, Human
cuggugacugauu

SEQ ID NO: 3140049 - RNA, 14 nt, Human
cuggugacugauuc

SEQ ID NO: 3140050 - RNA, 15 nt, Human
cuggugacugauucu

SEQ ID NO: 3140051 - RNA, 17 nt, Human
cuggugacugauucuuc

SEQ ID NO: 3140052 - RNA, 18 nt, Human
cuggucuuauuuguaaag

SEQ ID NO: 3140053 - RNA, 15 nt, Human
cuggugcccugcuuu

SEQ ID NO: 3140054 - RNA, 16 nt, Human
cuggugcccugcuuuc

SEQ ID NO: 3140055 - RNA, 19 nt, Human
cuggugcccugcuuucaga

SEQ ID NO: 3140056 - RNA, 21 nt, Human
cuggugcccugcuuucagaua

SEQ ID NO: 3140057 - RNA, 23 nt, Human
cuggugcccugcuuucagauacu

SEQ ID NO: 3140058 - RNA, 14 nt, Human
cugguuuuggcauc

SEQ ID NO: 3140059 - RNA, 21 nt, Human
cugguuuuggcaucucugucc

SEQ ID NO: 3140060 - RNA, 23 nt, Human
cugguuuuggcaucucuguccca

SEQ ID NO: 3140061 - RNA, 16 nt, Human
cugugaacuugaaauu

SEQ ID NO: 3140062 - RNA, 17 nt, Human
cugugaacuugaaauuu

SEQ ID NO: 3140063 - RNA, 15 nt, Human
cugugaacuugaaau

SEQ ID NO: 3140064 - RNA, 12 nt, Human
cuugucuccccu

SEQ ID NO: 3140065 - RNA, 21 nt, Human
cuugucucagauuuuauuaug

SEQ ID NO: 3140066 - RNA, 14 nt, Human
gaaacuuguguaaa

SEQ ID NO: 3140067 - RNA, 16 nt, Human
gaaacuuguguaaaua

SEQ ID NO: 3140068 - RNA, 20 nt, Human
gaaacuuguguaaauacaau

SEQ ID NO: 3140069 - RNA, 15 nt, Human
ggaagccugauuaaa

SEQ ID NO: 3140070 - RNA, 16 nt, Human
gcuuugcgugcccggg

SEQ ID NO: 3140071 - RNA, 19 nt, Human
gcuuugcgugcccggggca

SEQ ID NO: 3140072 - RNA, 15 nt, Human
gcuuaagccacugcc

SEQ ID NO: 3140073 - RNA, 18 nt, Human
gcuuaagccacugccucu

SEQ ID NO: 3140074 - RNA, 14 nt, Human
gcugccugucccca

SEQ ID NO: 3140075 - RNA, 16 nt, Human
gcugccuguccccaug

SEQ ID NO: 3140076 - RNA, 22 nt, Human
gccauguuuauuacaguauaau

SEQ ID NO: 3140077 - RNA, 14 nt, Human
gccauguuuauuac

SEQ ID NO: 3140078 - RNA, 18 nt, Human
gccauguuuauuacagua

SEQ ID NO: 3140079 - RNA, 13 nt, Human
gccauguuuauua

SEQ ID NO: 3140080 - RNA, 11 nt, Human
gccauguuuau

SEQ ID NO: 3140081 - RNA, 15 nt, Human
gcguggacugguugg

SEQ ID NO: 3140082 - RNA, 22 nt, Human
gcguucauggaacgcguugaaa

SEQ ID NO: 3140083 - RNA, 23 nt, Human
gcuaaggacuuguuagaucuagu

SEQ ID NO: 3140084 - RNA, 12 nt, Human
gcguugaaauug

SEQ ID NO: 3140085 - RNA, 11 nt, Human
gcuaaggacuu

SEQ ID NO: 3140086 - RNA, 12 nt, Human
gcuaaggacuug

SEQ ID NO: 3140087 - RNA, 13 nt, Human
gcggcagggaaga

SEQ ID NO: 3140088 - RNA, 19 nt, Human
gcuaggcucgccuucccuc

SEQ ID NO: 3140089 - RNA, 21 nt, Human
gcuaggcucgccuucccuccu

SEQ ID NO: 3140090 - RNA, 22 nt, Human
gcuaggcucgccuucccuccug

SEQ ID NO: 3140091 - RNA, 20 nt, Human
gcuauuucuauauuuucauu

SEQ ID NO: 3140092 - RNA, 18 nt, Human
gcuauuucuauauuuuca

SEQ ID NO: 3140093 - RNA, 19 nt, Human
gcuauuucuauauuuucau

SEQ ID NO: 3140094 - RNA, 11 nt, Human
gcuauuucuau

SEQ ID NO: 3140095 - RNA, 13 nt, Human
gcuauuucuauau

SEQ ID NO: 3140096 - RNA, 15 nt, Human
gcuauuucuauauuu

SEQ ID NO: 3140097 - RNA, 16 nt, Human
gcuauuucuauauuuu

SEQ ID NO: 3140098 - RNA, 23 nt, Human
ggcuaaguugggaucuaggagag

SEQ ID NO: 3140099 - RNA, 17 nt, Human
aaaaagccagggcugga

SEQ ID NO: 3140100 - RNA, 17 nt, Human
ggcucccggguccuugg

SEQ ID NO: 3140101 - RNA, 14 nt, Human
ggcucgccuucccu

SEQ ID NO: 3140102 - RNA, 15 nt, Human
ggcucgccuucccuc

SEQ ID NO: 3140103 - RNA, 18 nt, Human
ggcucgccuucccuccug

SEQ ID NO: 3140104 - RNA, 22 nt, Human
ggcucgccuucccuccugcuuu

SEQ ID NO: 3140105 - RNA, 17 nt, Human
ggcugacguuccgggca

SEQ ID NO: 3140106 - RNA, 15 nt, Human
ggaucuaccuggagg

SEQ ID NO: 3140107 - RNA, 16 nt, Human
ggaucuaccuggaggg

SEQ ID NO: 3140108 - RNA, 17 nt, Human
ggaucuaccuggaggga

SEQ ID NO: 3140109 - RNA, 15 nt, Human
ggagggaagagugga

SEQ ID NO: 3140110 - RNA, 19 nt, Human
ggagggaagaguggaggug

SEQ ID NO: 3140111 - RNA, 20 nt, Human
ggagggaagaguggaggugg

SEQ ID NO: 3140112 - RNA, 16 nt, Human
ggaggcggugcggcag

SEQ ID NO: 3140113 - RNA, 20 nt, Human
ggcagggaagaggggugcag

SEQ ID NO: 3140114 - RNA, 19 nt, Human
gguguuguacucaauuuua

SEQ ID NO: 3140115 - RNA, 20 nt, Human
gguguuguacucaauuuuaa

SEQ ID NO: 3140116 - RNA, 13 nt, Human
aaagggccaggag

SEQ ID NO: 3140117 - RNA, 20 nt, Human
guacaaaguauuaagcauau

SEQ ID NO: 3140118 - RNA, 21 nt, Human
guacaaaguauuaagcauaua

SEQ ID NO: 3140119 - RNA, 14 nt, Human
ggucagugcugccu

SEQ ID NO: 3140120 - RNA, 15 nt, Human
ggucagugcugccug

SEQ ID NO: 3140121 - RNA, 21 nt, Human
ggucagugcugccugucccca

SEQ ID NO: 3140122 - RNA, 16 nt, Human
gguaacucuucuugau

SEQ ID NO: 3140123 - RNA, 13 nt, Human
gggucagugcugc

SEQ ID NO: 3140124 - RNA, 13 nt, Human
ggggucagugcug

SEQ ID NO: 3140125 - RNA, 18 nt, Human
aaaauauuuuaugaucca

SEQ ID NO: 3140126 - RNA, 15 nt, Human
aaaauauuuuaugau

SEQ ID NO: 3140127 - RNA, 13 nt, Human
aaaauaccaagga

SEQ ID NO: 3140128 - RNA, 19 nt, Human
gggcucccggguccuuggc

SEQ ID NO: 3140129 - RNA, 20 nt, Human
gggcucccggguccuuggcc

SEQ ID NO: 3140130 - RNA, 15 nt, Human
ugucuugccuuuuuc

SEQ ID NO: 3140131 - RNA, 16 nt, Human
ugucuugccuuuuuca

SEQ ID NO: 3140132 - RNA, 17 nt, Human
ugucuugccuuuuucau

SEQ ID NO: 3140133 - RNA, 21 nt, Human
ugucuugccuuuuucauuauu

SEQ ID NO: 3140134 - RNA, 21 nt, Human
agucagaucugccuaaggacu

SEQ ID NO: 3140135 - RNA, 22 nt, Human
agucagaucugccuaaggacuu

SEQ ID NO: 3140136 - RNA, 20 nt, Human
agucagaucugccuaaggac

SEQ ID NO: 3140137 - RNA, 17 nt, Human
agucagaucugccuaag

SEQ ID NO: 3140138 - RNA, 23 nt, Human
agucagaucugccuaaggacuuc

SEQ ID NO: 3140139 - RNA, 11 nt, Human
aguauuguaca

SEQ ID NO: 3140140 - RNA, 15 nt, Human
aguauuguacaaagu

SEQ ID NO: 3140141 - RNA, 20 nt, Human
aguauuguacaaaguauuaa

SEQ ID NO: 3140142 - RNA, 22 nt, Human
aguauuguacaaaguauuaagc

SEQ ID NO: 3140143 - RNA, 23 nt, Human
aguauuguacaaaguauuaagca

SEQ ID NO: 3140144 - RNA, 12 nt, Human
uguaugugugaa

SEQ ID NO: 3140145 - RNA, 16 nt, Human
uggucuuauuuguaaa

SEQ ID NO: 3140146 - RNA, 22 nt, Human
uggucucgucuuccgucucccc

SEQ ID NO: 3140147 - RNA, 13 nt, Human
uguacaaaguauu

SEQ ID NO: 3140148 - RNA, 16 nt, Human
uguaaauacaauuuug

SEQ ID NO: 3140149 - RNA, 17 nt, Human
uguaaauacaauuuugu

SEQ ID NO: 3140150 - RNA, 18 nt, Human
uguaaauacaauuuuguu

SEQ ID NO: 3140151 - RNA, 19 nt, Human
uguaaauacaauuuuguuu

SEQ ID NO: 3140152 - RNA, 10 nt, Human
uguaaauccc

SEQ ID NO: 3140153 - RNA, 21 nt, Human
uguaaauacaauuuuguuucu

SEQ ID NO: 3140154 - RNA, 17 nt, Human
auaauaaggaaaaguuu

SEQ ID NO: 3140155 - RNA, 18 nt, Human
auaauaaggaaaaguuua

SEQ ID NO: 3140156 - RNA, 19 nt, Human
auaauaaggaaaaguuuaa

SEQ ID NO: 3140157 - RNA, 22 nt, Human
auaauaaggaaaaguuuaauau

SEQ ID NO: 3140158 - RNA, 16 nt, Human
auaauaaggaaaaguu

SEQ ID NO: 3140159 - RNA, 21 nt, Human
auaauuauaugcuauuucuau

SEQ ID NO: 3140160 - RNA, 23 nt, Human
auaauuauaugcuauuucuauau

SEQ ID NO: 3140161 - RNA, 17 nt, Human
auaauuauaugcuauuu

SEQ ID NO: 3140162 - RNA, 19 nt, Human
auaauuauaugcuauuucu

SEQ ID NO: 3140163 - RNA, 21 nt, Human
uguuguacucaauuuuaacaa

SEQ ID NO: 3140164 - RNA, 23 nt, Human
uuaaaccaugggauaaaugccau

SEQ ID NO: 3140165 - RNA, 11 nt, Human
agccagggcug

SEQ ID NO: 3140166 - RNA, 16 nt, Human
ugauuucuaugcugag

SEQ ID NO: 3140167 - RNA, 12 nt, Human
ugauuucuaugc

SEQ ID NO: 3140168 - RNA, 15 nt, Human
ugauuucuaugcuga

SEQ ID NO: 3140169 - RNA, 14 nt, Human
agcccgcuaggcuc

SEQ ID NO: 3140170 - RNA, 21 nt, Human
agcccgcuaggcucgccuucc

SEQ ID NO: 3140171 - RNA, 23 nt, Human
agcccgcuaggcucgccuucccu

SEQ ID NO: 3140172 - RNA, 22 nt, Human
agcgcuugggcgccgugcuggg

SEQ ID NO: 3140173 - RNA, 23 nt, Human
agcgcuugggcgccgugcugggc

SEQ ID NO: 3140174 - RNA, 23 nt, Human
ugccucacccacccuuuuuuaaa

SEQ ID NO: 3140175 - RNA, 13 nt, Human
ugcccucccuucu

SEQ ID NO: 3140176 - RNA, 14 nt, Human
ugcccucccuucuc

SEQ ID NO: 3140177 - RNA, 19 nt, Human
ugcccucccuucucccugg

SEQ ID NO: 3140178 - RNA, 20 nt, Human
ugcccucccuucucccugga

SEQ ID NO: 3140179 - RNA, 17 nt, Human
aggacuuguuagaucua

SEQ ID NO: 3140180 - RNA, 14 nt, Human
aggacuuguuagau

SEQ ID NO: 3140181 - RNA, 16 nt, Human
aggacuuguuagaucu

SEQ ID NO: 3140182 - RNA, 17 nt, Human
ugcuuuggucuugcccc

SEQ ID NO: 3140183 - RNA, 19 nt, Human
aggauaaaaagccagggcu

SEQ ID NO: 3140184 - RNA, 20 nt, Human
aggauaaaaagccagggcug

SEQ ID NO: 3140185 - RNA, 21 nt, Human
aggauaaaaagccagggcugg

SEQ ID NO: 3140186 - RNA, 22 nt, Human
aggauaaaaagccagggcugga

SEQ ID NO: 3140187 - RNA, 18 nt, Human
ugcuguaacuuucugaaa

SEQ ID NO: 3140188 - RNA, 12 nt, Human
ugcuauuucuau

SEQ ID NO: 3140189 - RNA, 13 nt, Human
ugcuauuucuaua

SEQ ID NO: 3140190 - RNA, 14 nt, Human
ugcuauuucuauau

SEQ ID NO: 3140191 - RNA, 20 nt, Human
ugcuauuucuauauuuucau

SEQ ID NO: 3140192 - RNA, 15 nt, Human
aggcucgccuucccu

SEQ ID NO: 3140193 - RNA, 16 nt, Human
aggcucgccuucccuc

SEQ ID NO: 3140194 - RNA, 18 nt, Human
aggcucgccuucccuccu

SEQ ID NO: 3140195 - RNA, 19 nt, Human
aggcucgccuucccuccug

SEQ ID NO: 3140196 - RNA, 20 nt, Human
aggcucgccuucccuccugc

SEQ ID NO: 3140197 - RNA, 24 nt, Human
aggcucgccuucccuccugcuuug

SEQ ID NO: 3140198 - RNA, 17 nt, Human
uuuaaaaaaaaaauugg

SEQ ID NO: 3140199 - RNA, 20 nt, Human
uuguguguaugcugcuuuuc

SEQ ID NO: 3140200 - RNA, 18 nt, Human
uugggcgccgugcugggc

SEQ ID NO: 3140201 - RNA, 19 nt, Human
uugggcgccgugcugggca

SEQ ID NO: 3140202 - RNA, 20 nt, Human
uugggcgccgugcugggcag

SEQ ID NO: 3140203 - RNA, 21 nt, Human
uugggcgccgugcugggcagc

SEQ ID NO: 3140204 - RNA, 15 nt, Human
uuguaauuauaucug

SEQ ID NO: 3140205 - RNA, 21 nt, Human
uuuauuaugaaacuuguguaa

SEQ ID NO: 3140206 - RNA, 13 nt, Human
uuuauuaugaaac

SEQ ID NO: 3140207 - RNA, 15 nt, Human
uuuacuaaaauggac

SEQ ID NO: 3140208 - RNA, 17 nt, Human
uuuacuaaaauggacug

SEQ ID NO: 3140209 - RNA, 21 nt, Human
uuucuaugcugaguuugugcu

SEQ ID NO: 3140210 - RNA, 13 nt, Human
uuucuauauuuuc

SEQ ID NO: 3140211 - RNA, 15 nt, Human
uuucuauauuuucau

SEQ ID NO: 3140212 - RNA, 18 nt, Human
uuucuauauuuucauucu

SEQ ID NO: 3140213 - RNA, 14 nt, Human
uugacauagucugg

SEQ ID NO: 3140214 - RNA, 17 nt, Human
uugacauagucuggcug

SEQ ID NO: 3140215 - RNA, 11 nt, Human
uucucccugga

SEQ ID NO: 3140216 - RNA, 12 nt, Human
uucucccuggau

SEQ ID NO: 3140217 - RNA, 23 nt, Human
uucugcagguugaagccaugucu

SEQ ID NO: 3140218 - RNA, 13 nt, Human
uucuuaaaguuga

SEQ ID NO: 3140219 - RNA, 12 nt, Human
uucuugcugccc

SEQ ID NO: 3140220 - RNA, 14 nt, Human
uucuugcugcccug

SEQ ID NO: 3140221 - RNA, 15 nt, Human
uucuugcugcccugc

SEQ ID NO: 3140222 - RNA, 18 nt, Human
uucuugcugcccugcccc

SEQ ID NO: 3140223 - RNA, 15 nt, Human
auauguuuaaaagua

SEQ ID NO: 3140224 - RNA, 12 nt, Human
auauuaaagcca

SEQ ID NO: 3140225 - RNA, 17 nt, Human
uucagcaaaaauauuuu

SEQ ID NO: 3140226 - RNA, 13 nt, Human
auauauuuuuaua

SEQ ID NO: 3140227 - RNA, 19 nt, Human
uucauggaacgcguugaaa

SEQ ID NO: 3140228 - RNA, 20 nt, Human
uucauggaacgcguugaaau

SEQ ID NO: 3140229 - RNA, 21 nt, Human
uucauggaacgcguugaaauu

SEQ ID NO: 3140230 - RNA, 22 nt, Human
uucauggaacgcguugaaauug

SEQ ID NO: 3140231 - RNA, 22 nt, Human
uucauuauuuuauuaugaaacu

SEQ ID NO: 3140232 - RNA, 13 nt, Human
auuuuccuccuuu

SEQ ID NO: 3140233 - RNA, 17 nt, Human
auuuuccuccuuucucu

SEQ ID NO: 3140234 - RNA, 20 nt, Human
auuuuauuauguaaauccca

SEQ ID NO: 3140235 - RNA, 21 nt, Human
auuuuauuauguaaaucccau

SEQ ID NO: 3140236 - RNA, 15 nt, Human
auuuuauuauguaaa

SEQ ID NO: 3140237 - RNA, 16 nt, Human
auuuuauuauguaaau

SEQ ID NO: 3140238 - RNA, 17 nt, Human
auuuuauuauguaaauc

SEQ ID NO: 3140239 - RNA, 18 nt, Human
auuuuauuauguaaaucc

SEQ ID NO: 3140240 - RNA, 19 nt, Human
auuuuauuauguaaauccc

SEQ ID NO: 3140241 - RNA, 15 nt, Human
auucuucagcaaaaa

SEQ ID NO: 3140242 - RNA, 23 nt, Human
auucuucagcaaaaauauuuuau

SEQ ID NO: 3140243 - RNA, 21 nt, Human
auucuguauagauuagaauuc

SEQ ID NO: 3140244 - RNA, 15 nt, Human
auucuguauagauua

SEQ ID NO: 3140245 - RNA, 13 nt, Human
auucuuaaaguug

SEQ ID NO: 3140246 - RNA, 14 nt, Human
auucuuaaaguuga

SEQ ID NO: 3140247 - RNA, 15 nt, Human
auucuuaaaguugaa

SEQ ID NO: 3140248 - RNA, 16 nt, Human
auucuuaaaguugaau

SEQ ID NO: 3140249 - RNA, 23 nt, Human
auugguguuguacucaauuuuaa

SEQ ID NO: 3140250 - RNA, 14 nt, Human
auugguguuguacu

SEQ ID NO: 3140251 - RNA, 22 nt, Human
auugguguuguacucaauuuua

SEQ ID NO: 3140252 - RNA, 18 nt, Human
uuuuguuguuuguuuagu

SEQ ID NO: 3140253 - RNA, 12 nt, Human
uuuuguuucugu

SEQ ID NO: 3140254 - RNA, 13 nt, Human
uuuuguuucugua

SEQ ID NO: 3140255 - RNA, 12 nt, Human
uuuuguuuggac

SEQ ID NO: 3140256 - RNA, 22 nt, Human
uuuuguuuggaccaaaaaccag

SEQ ID NO: 3140257 - RNA, 23 nt, Human
uuuuguuuggaccaaaaaccagu

SEQ ID NO: 3140258 - RNA, 14 nt, Human
auuaagcauauauu

SEQ ID NO: 3140259 - RNA, 15 nt, Human
auuaagcauauauuu

SEQ ID NO: 3140260 - RNA, 21 nt, Human
auuaagcauauauuuuuauau

SEQ ID NO: 3140261 - RNA, 12 nt, Human
auuagaauucug

SEQ ID NO: 3140262 - RNA, 13 nt, Human
auuagaauucugu

SEQ ID NO: 3140263 - RNA, 14 nt, Human
auuagaauucugua

SEQ ID NO: 3140264 - RNA, 15 nt, Human
auuagaauucuguau

SEQ ID NO: 3140265 - RNA, 16 nt, Human
auuagaauucuguaua

SEQ ID NO: 3140266 - RNA, 17 nt, Human
auuagaauucuguauag

SEQ ID NO: 3140267 - RNA, 18 nt, Human
auuagaauucuguauaga

SEQ ID NO: 3140268 - RNA, 12 nt, Human
auguuaaaccau

SEQ ID NO: 3140269 - RNA, 13 nt, Human
auguuaaaccaug

SEQ ID NO: 3140270 - RNA, 20 nt, Human
auguuaaaccaugggauaaa

SEQ ID NO: 3140271 - RNA, 22 nt, Human
uuuucauucuccuaucaccugu

SEQ ID NO: 3140272 - RNA, 15 nt, Human
uuuucugauccaguu

SEQ ID NO: 3140273 - RNA, 21 nt, Human
uuuuauuaugaaacuugugua

SEQ ID NO: 3140274 - RNA, 22 nt, Human
uuuuauuaugaaacuuguguaa

SEQ ID NO: 3140275 - RNA, 12 nt, Human
uuuuauuaugaa

SEQ ID NO: 3140276 - RNA, 21 nt, Human
auucuccuaucaccugucuug

SEQ ID NO: 3140277 - RNA, 15 nt, Human
agauuagaauucugu

SEQ ID NO: 3140278 - RNA, 16 nt, Human
agauuagaauucugua

SEQ ID NO: 3140279 - RNA, 21 nt, Human
agauuagagaguguugaaacg

SEQ ID NO: 3140280 - RNA, 22 nt, Human
agauuagaauucuguauagauu

SEQ ID NO: 3140281 - RNA, 23 nt, Human
agauuagaauucuguauagauua

SEQ ID NO: 3140282 - RNA, 14 nt, Human
ugacaggacgcuga

SEQ ID NO: 3140283 - RNA, 16 nt, Human
ugacaggacgcugacc

SEQ ID NO: 3140284 - RNA, 23 nt, Human
ugacaggacgcugaccguggagc

SEQ ID NO: 3140285 - RNA, 15 nt, Human
ugaaauuguaauuau

SEQ ID NO: 3140286 - RNA, 16 nt, Human
ugaaauuguaauuaua

SEQ ID NO: 3140287 - RNA, 19 nt, Human
ugaaauuguaauuauaucu

SEQ ID NO: 3140288 - RNA, 13 nt, Human
ugaaauuguaauu

SEQ ID NO: 3140289 - RNA, 14 nt, Human
ugaaauuguaauua

SEQ ID NO: 3140290 - RNA, 17 nt, Human
ugaaauaacauggccuu

SEQ ID NO: 3140291 - RNA, 16 nt, Human
ugaaauaacauggccu

SEQ ID NO: 3140292 - RNA, 20 nt, Human
agacuggugacugauucuuc

SEQ ID NO: 3140293 - RNA, 21 nt, Human
agacuggugacugauucuuca

SEQ ID NO: 3140294 - RNA, 19 nt, Human
agacuggugacugauucuu

SEQ ID NO: 3140295 - RNA, 17 nt, Human
ucuuugucuacaccauu

SEQ ID NO: 3140296 - RNA, 15 nt, Human
agagaguguugaaac

SEQ ID NO: 3140297 - RNA, 16 nt, Human
agagaguguugaaacg

SEQ ID NO: 3140298 - RNA, 22 nt, Human
ugaaagaaaauaccaaggaaca

SEQ ID NO: 3140299 - RNA, 21 nt, Human
agaaugguccgugcuaaggac

SEQ ID NO: 3140300 - RNA, 23 nt, Human
agaaugguccgugcuaaggacuu

SEQ ID NO: 3140301 - RNA, 18 nt, Human
ucugugaacuugaaauuu

SEQ ID NO: 3140302 - RNA, 14 nt, Human
ucugugaacuugaa

SEQ ID NO: 3140303 - RNA, 17 nt, Human
ucugugaacuugaaauu

SEQ ID NO: 3140304 - RNA, 12 nt, Human
agaauucuguau

SEQ ID NO: 3140305 - RNA, 14 nt, Human
agaauucuguauag

SEQ ID NO: 3140306 - RNA, 11 nt, Human
ucugauccagu

SEQ ID NO: 3140307 - RNA, 14 nt, Human
ucugauccaguuuu

SEQ ID NO: 3140308 - RNA, 21 nt, Human
ucugauccaguuuuguuugga

SEQ ID NO: 3140309 - RNA, 10 nt, Human
acuucccugg

SEQ ID NO: 3140310 - RNA, 11 nt, Human
acuucccuggc

SEQ ID NO: 3140311 - RNA, 12 nt, Human
acuuuggauaau

SEQ ID NO: 3140312 - RNA, 17 nt, Human
acuuuggauaauaagga

SEQ ID NO: 3140313 - RNA, 19 nt, Human
acuuuggauaauaaggaaa

SEQ ID NO: 3140314 - RNA, 14 nt, Human
acuuucugaaauaa

SEQ ID NO: 3140315 - RNA, 20 nt, Human
acuuucugaaauaacauggc

SEQ ID NO: 3140316 - RNA, 19 nt, Human
ucucagauuuuauuaugua

SEQ ID NO: 3140317 - RNA, 22 nt, Human
ucucagauuuuauuauguaaau

SEQ ID NO: 3140318 - RNA, 23 nt, Human
ucucagauuuuauuauguaaauc

SEQ ID NO: 3140319 - RNA, 23 nt, Human
ucagauuuuauuauguaaauccc

SEQ ID NO: 3140320 - RNA, 22 nt, Human
ucagauuuuauuauguaaaucc

SEQ ID NO: 3140321 - RNA, 19 nt, Human
ucagcaaaaauauuuuaug

SEQ ID NO: 3140322 - RNA, 20 nt, Human
ucagcaaaaauauuuuauga

SEQ ID NO: 3140323 - RNA, 18 nt, Human
accuccucucacucccca

SEQ ID NO: 3140324 - RNA, 19 nt, Human
accuccucucacuccccag

SEQ ID NO: 3140325 - RNA, 19 nt, Human
ucaccugucuugccuuuuu

SEQ ID NO: 3140326 - RNA, 20 nt, Human
ucaccugucuugccuuuuuc

SEQ ID NO: 3140327 - RNA, 23 nt, Human
accaguauuguacaaaguauuaa

SEQ ID NO: 3140328 - RNA, 14 nt, Human
accaguauuguaca

SEQ ID NO: 3140329 - RNA, 15 nt, Human
accaguauuguacaa

SEQ ID NO: 3140330 - RNA, 20 nt, Human
accaguauuguacaaaguau

SEQ ID NO: 3140331 - RNA, 22 nt, Human
accaguauuguacaaaguauua

SEQ ID NO: 3140332 - RNA, 12 nt, Human
acauugucuccc

SEQ ID NO: 3140333 - RNA, 13 nt, Human
acauugucucccg

SEQ ID NO: 3140334 - RNA, 16 nt, Human
acauugucucccgccc

SEQ ID NO: 3140335 - RNA, 19 nt, Human
acauugucucccgcccccc

SEQ ID NO: 3140336 - RNA, 13 nt, Human
acggaugauuucu

SEQ ID NO: 3140337 - RNA, 19 nt, Human
acggugaauggcuuuguau

SEQ ID NO: 3140338 - RNA, 20 nt, Human
acggugaauggcuuuguaua

SEQ ID NO: 3140339 - RNA, 16 nt, Human
acggugaauggcuuug

SEQ ID NO: 3140340 - RNA, 12 nt, Human
acucaauuuuaa

SEQ ID NO: 3140341 - RNA, 15 nt, Human
acucaauuuuaacaa

SEQ ID NO: 3140342 - RNA, 13 nt, Human
uccucccauguca

SEQ ID NO: 3140343 - RNA, 19 nt, Human
uccucccaugucacugcag

SEQ ID NO: 3140344 - RNA, 20 nt, Human
uccucccaugucacugcaga

SEQ ID NO: 3140345 - RNA, 19 nt, Human
uccugcuuugcgugcccgg

SEQ ID NO: 3140346 - RNA, 12 nt, Human
uaacauaaaucu

SEQ ID NO: 3140347 - RNA, 16 nt, Human
uaacuuucugaaauaa

SEQ ID NO: 3140348 - RNA, 20 nt, Human
aaucugugaacuugaaauuu

SEQ ID NO: 3140349 - RNA, 21 nt, Human
aaucugugaacuugaaauuug

SEQ ID NO: 3140350 - RNA, 22 nt, Human
aaucugugaacuugaaauuuga

SEQ ID NO: 3140351 - RNA, 19 nt, Human
aauuaacauguuaaaccau

SEQ ID NO: 3140352 - RNA, 20 nt, Human
aauuaacauguuaaaccaug

SEQ ID NO: 3140353 - RNA, 23 nt, Human
aaugccaucaauaaaaaauuaug

SEQ ID NO: 3140354 - RNA, 11 nt, Human
aaugccagggc

SEQ ID NO: 3140355 - RNA, 12 nt, Human
aaugccagggcc

SEQ ID NO: 3140356 - RNA, 16 nt, Human
aaugccaucaauaaaa

SEQ ID NO: 3140357 - RNA, 21 nt, Human
aaugccaucaauaaaaaauua

SEQ ID NO: 3140358 - RNA, 14 nt, Human
uacuggauuguacu

SEQ ID NO: 3140359 - RNA, 23 nt, Human
uagagauuuuuuuguuguuuguu

SEQ ID NO: 3140360 - RNA, 18 nt, Human
uagcuagacuggugacug

SEQ ID NO: 3140361 - RNA, 21 nt, Human
uagcuagacuggugacugauu

SEQ ID NO: 3140362 - RNA, 22 nt, Human
uagcuagacuggugacugauuc

SEQ ID NO: 3140363 - RNA, 17 nt, Human
uaggagaggagaaccag

SEQ ID NO: 3140364 - RNA, 21 nt, Human
acaccauuaugugcgcugaua

SEQ ID NO: 3140365 - RNA, 17 nt, Human
acaccauuaugugcgcu

SEQ ID NO: 3140366 - RNA, 14 nt, Human
uaugugugaaguga

SEQ ID NO: 3140367 - RNA, 12 nt, Human
uaugugugaagu

SEQ ID NO: 3140368 - RNA, 21 nt, Human
acaggacgcugaccguggagc

SEQ ID NO: 3140369 - RNA, 12 nt, Human
uauucaaaguug

SEQ ID NO: 3140370 - RNA, 13 nt, Human
uauucaaaguugc

SEQ ID NO: 3140371 - RNA, 15 nt, Human
acaguauaauuaaca

SEQ ID NO: 3140372 - RNA, 20 nt, Human
acaguauaauuaacauguua

SEQ ID NO: 3140373 - RNA, 13 nt, Human
acaguauaauuaa

SEQ ID NO: 3140374 - RNA, 20 nt, Human
acaggcugacguuccgggca

SEQ ID NO: 3140375 - RNA, 19 nt, Human
uauauuuacuaaaauggac

SEQ ID NO: 3140376 - RNA, 20 nt, Human
uauauuuacuaaaauggacu

SEQ ID NO: 3140377 - RNA, 21 nt, Human
uauauuuacuaaaauggacug

SEQ ID NO: 3140378 - RNA, 12 nt, Human
uaugcugcuuuu

SEQ ID NO: 3140379 - RNA, 11 nt, Human
uaugcugcuuu

SEQ ID NO: 3140380 - RNA, 15 nt, Human
uaugcugaguuugug

SEQ ID NO: 3140381 - RNA, 13 nt, Human
aagccauguuuau

SEQ ID NO: 3140382 - RNA, 20 nt, Human
aagccauguuuauuacagua

SEQ ID NO: 3140383 - RNA, 21 nt, Human
aagccauguuuauuacaguau

SEQ ID NO: 3140384 - RNA, 22 nt, Human
aagccauguuuauuacaguaua

SEQ ID NO: 3140385 - RNA, 23 nt, Human
aagccauguuuauuacaguauaa

SEQ ID NO: 3140386 - RNA, 14 nt, Human
guuagagggaacag

SEQ ID NO: 3140387 - RNA, 18 nt, Human
guuagagauuuuuuuguu

SEQ ID NO: 3140388 - RNA, 22 nt, Human
guguaaauacaauuuuguuucu

SEQ ID NO: 3140389 - RNA, 18 nt, Human
guguaaauacaauuuugu

SEQ ID NO: 3140390 - RNA, 21 nt, Human
guguaaauacaauuuuguuuc

SEQ ID NO: 3140391 - RNA, 13 nt, Human
gugcugccugucc

SEQ ID NO: 3140392 - RNA, 13 nt, Human
aagaggcugguuu

SEQ ID NO: 3140393 - RNA, 21 nt, Human
aagaggcugguuuuggcaucu

SEQ ID NO: 3140394 - RNA, 11 nt, Human
aagaggcuggu

SEQ ID NO: 3140395 - RNA, 12 nt, Human
aagaggcugguu

SEQ ID NO: 3140396 - RNA, 21 nt, Human
gugguugaggcuaaguuggga

SEQ ID NO: 3140397 - RNA, 23 nt, Human
aagcauauauuuuuauauuuacu

SEQ ID NO: 3140398 - RNA, 16 nt, Human
aagccauguuuauuac

SEQ ID NO: 3140399 - RNA, 17 nt, Human
aagccauguuuauuaca

SEQ ID NO: 3140400 - RNA, 15 nt, Human
aagccauguuuauua

SEQ ID NO: 3140401 - RNA, 14 nt, Human
uaaaaaaaaaauug

SEQ ID NO: 3140402 - RNA, 18 nt, Human
uaaaaaaaaaauugggga

SEQ ID NO: 3140403 - RNA, 23 nt, Human
aagucagaucugccuaaggacuu

SEQ ID NO: 3140404 - RNA, 21 nt, Human
aagucagaucugccuaaggac

SEQ ID NO: 3140405 - RNA, 22 nt, Human
aagucagaucugccuaaggacu

SEQ ID NO: 3140406 - RNA, 18 nt, Human
aagucagaucugccuaag

SEQ ID NO: 3140407 - RNA, 18 nt, Human
guuuggaccaaaaaccag

SEQ ID NO: 3140408 - RNA, 13 nt, Human
guuuaauauuaaa

SEQ ID NO: 3140409 - RNA, 14 nt, Human
guuuaauauuaaag

SEQ ID NO: 3140410 - RNA, 15 nt, Human
guuuaauauuaaagc

SEQ ID NO: 3140411 - RNA, 18 nt, Human
guuuaauauuaaagccau

SEQ ID NO: 3140412 - RNA, 17 nt, Human
guuuauuacaguauaau

SEQ ID NO: 3140413 - RNA, 13 nt, Human
guuuauuacagua

SEQ ID NO: 3140414 - RNA, 12 nt, Human
guuguuuguuua

SEQ ID NO: 3140415 - RNA, 12 nt, Human
aaggaaaaguuu

SEQ ID NO: 3140416 - RNA, 16 nt, Human
aagaaaauaccaagga

SEQ ID NO: 3140417 - RNA, 19 nt, Human
aacuugaaauuugaauuuu

SEQ ID NO: 3140418 - RNA, 13 nt, Human
aacuugaaauuug

SEQ ID NO: 3140419 - RNA, 18 nt, Human
aacuugaaauuugaauuu

SEQ ID NO: 3140420 - RNA, 12 nt, Human
aacuugaaauuu

SEQ ID NO: 3140421 - RNA, 12 nt, Human
gugacuuuggau

SEQ ID NO: 3140422 - RNA, 15 nt, Human
gugacuuuggauaau

SEQ ID NO: 3140423 - RNA, 22 nt, Human
gucuugucucagauuuuauuau

SEQ ID NO: 3140424 - RNA, 23 nt, Human
gucuugucucagauuuuauuaug

SEQ ID NO: 3140425 - RNA, 19 nt, Human
guauuguacaaaguauuaa

SEQ ID NO: 3140426 - RNA, 21 nt, Human
guauuguacaaaguauuaagc

SEQ ID NO: 3140427 - RNA, 22 nt, Human
guauuguacaaaguauuaagca

SEQ ID NO: 3140428 - RNA, 23 nt, Human
guauuguacaaaguauuaagcau

SEQ ID NO: 3140429 - RNA, 13 nt, Human
gucagugcugccu

SEQ ID NO: 3140430 - RNA, 14 nt, Human
gucagugcugccug

SEQ ID NO: 3140431 - RNA, 15 nt, Human
gucagugcugccugu

SEQ ID NO: 3140432 - RNA, 16 nt, Human
gucagugcugccuguc

SEQ ID NO: 3140433 - RNA, 22 nt, Human
gucagugcugccuguccccaug

SEQ ID NO: 3140434 - RNA, 14 nt, Human
aacauguuaaacca

SEQ ID NO: 3140435 - RNA, 15 nt, Human
aacauguuaaaccau

SEQ ID NO: 3140436 - RNA, 18 nt, Human
aacaguccauugaaaggg

SEQ ID NO: 3140437 - RNA, 15 nt, Human
guccgugcuaaggac

SEQ ID NO: 3140438 - RNA, 16 nt, Human
guccgugcuaaggacu

SEQ ID NO: 3140439 - RNA, 17 nt, Human
guccgugcuaaggacuu

SEQ ID NO: 3140440 - RNA, 12 nt, Human
aaauuugaauuu

SEQ ID NO: 3140441 - RNA, 15 nt, Human
aaauuugaauuuugu

SEQ ID NO: 3140442 - RNA, 22 nt, Human
aaauuugaauuuuguguuagag

SEQ ID NO: 3140443 - RNA, 17 nt, Human
gucccacaaaugggcgc

SEQ ID NO: 3140444 - RNA, 18 nt, Human
gucccacaaaugggcgcc

SEQ ID NO: 3140445 - RNA, 23 nt, Human
aaaaaauuggggauucuuaaagu

SEQ ID NO: 3140446 - RNA, 19 nt, Human
aaaaauuggggauucuuaa

SEQ ID NO: 3140447 - RNA, 20 nt, Human
aaaaauuggggauucuuaaa

SEQ ID NO: 3140448 - RNA, 17 nt, Human
aaaaauuggggauucuu

SEQ ID NO: 3140449 - RNA, 18 nt, Human
aaaaauuggggauucuua

SEQ ID NO: 3140450 - RNA, 16 nt, Human
aaaaaccaguauugua

SEQ ID NO: 3140451 - RNA, 18 nt, Human
aaaaaccaguauuguaca

SEQ ID NO: 3140452 - RNA, 14 nt, Human
aaaaacauggccuu

SEQ ID NO: 3140453 - RNA, 21 nt, Human
aucuucuauauguuuaaaagu

SEQ ID NO: 3140454 - RNA, 12 nt, Human
aucaccugucuu

SEQ ID NO: 3140455 - RNA, 21 nt, Human
aucaccugucuugccuuuuuc

SEQ ID NO: 3140456 - RNA, 18 nt, Human
auggagccugcacgguga

SEQ ID NO: 3140457 - RNA, 22 nt, Human
auggagccugcacggugaaugg

SEQ ID NO: 3140458 - RNA, 14 nt, Human
auaugcuauuucua

SEQ ID NO: 3140459 - RNA, 17 nt, Human
auaauuaacauguuaaa

SEQ ID NO: 3140460 - RNA, 22 nt, Human
auaauuaacauguuaaaccaug

SEQ ID NO: 3140461 - RNA, 20 nt, Human
auaauuaacauguuaaacca

SEQ ID NO: 3140462 - RNA, 21 nt, Human
auaauuaacauguuaaaccau

SEQ ID NO: 3140463 - RNA, 18 nt, Human
auacaauuuuguuucugu

SEQ ID NO: 3140464 - RNA, 19 nt, Human
auacaauuuuguuucugua

SEQ ID NO: 3140465 - RNA, 20 nt, Human
auacaauuuuguuucuguac

SEQ ID NO: 3140466 - RNA, 18 nt, Human
auacccgccuagcugcug

SEQ ID NO: 3140467 - RNA, 11 nt, Human
aguugaauuua

SEQ ID NO: 3140468 - RNA, 13 nt, Human
aguugaauuuauu

SEQ ID NO: 3140469 - RNA, 17 nt, Human
aguugaauuuauuggcu

SEQ ID NO: 3140470 - RNA, 19 nt, Human
aguugaauuuauuggcuuu

SEQ ID NO: 3140471 - RNA, 20 nt, Human
aguugaauuuauuggcuuuu

SEQ ID NO: 3140472 - RNA, 13 nt, Human
aggggcccuugga

SEQ ID NO: 3140473 - RNA, 20 nt, Human
aggggcccuuggagcgugga

SEQ ID NO: 3140474 - RNA, 14 nt, Human
aggcuguggcuggu

SEQ ID NO: 3140475 - RNA, 15 nt, Human
aggcuguggcuggug

SEQ ID NO: 3140476 - RNA, 17 nt, Human
aggcuguggcuggugag

SEQ ID NO: 3140477 - RNA, 16 nt, Human
aggagaaccagauucu

SEQ ID NO: 3140478 - RNA, 13 nt, Human
agaguguugaaac

SEQ ID NO: 3140479 - RNA, 14 nt, Human
agaguguugaaacg

SEQ ID NO: 3140480 - RNA, 22 nt, Human
agccauguuuauuacaguauaa

SEQ ID NO: 3140481 - RNA, 17 nt, Human
agccauguuuauuacag

SEQ ID NO: 3140482 - RNA, 18 nt, Human
agcacgguggugaggcag

SEQ ID NO: 3140483 - RNA, 15 nt, Human
acaauuuuguuucug

SEQ ID NO: 3140484 - RNA, 17 nt, Human
acaauuuuguuucugua

SEQ ID NO: 3140485 - RNA, 14 nt, Human
acaauuuuguuucu

SEQ ID NO: 3140486 - RNA, 15 nt, Human
acauaaaucugugaa

SEQ ID NO: 3140487 - RNA, 18 nt, Human
acauaaaucugugaacuu

SEQ ID NO: 3140488 - RNA, 14 nt, Human
acauaaaucuguga

SEQ ID NO: 3140489 - RNA, 12 nt, Human
acuuuucugaua

SEQ ID NO: 3140490 - RNA, 21 nt, Human
acuucuuuaauuuuggaauuu

SEQ ID NO: 3140491 - RNA, 20 nt, Human
acuucuuuaauuuuggaauu

SEQ ID NO: 3140492 - RNA, 17 nt, Human
acuccccagccugggcc

SEQ ID NO: 3140493 - RNA, 19 nt, Human
acuccccagccugggccca

SEQ ID NO: 3140494 - RNA, 18 nt, Human
aaaauuggggauucuuaa

SEQ ID NO: 3140495 - RNA, 19 nt, Human
aaaauuggggauucuuaaa

SEQ ID NO: 3140496 - RNA, 17 nt, Human
aaaauuggggauucuua

SEQ ID NO: 3140497 - RNA, 19 nt, Human
aaacugacaugcccucccu

SEQ ID NO: 3140498 - RNA, 20 nt, Human
aaacugacaugcccucccuu

SEQ ID NO: 3140499 - RNA, 22 nt, Human
aaacugacaugcccucccuucu

SEQ ID NO: 3140500 - RNA, 18 nt, Human
aaauauuuuaugauccag

SEQ ID NO: 3140501 - RNA, 19 nt, Human
aaauauuuuaugauccagc

SEQ ID NO: 3140502 - RNA, 14 nt, Human
aaauauuuuaugau

SEQ ID NO: 3140503 - RNA, 19 nt, Human
aaauggacuguggugacuu

SEQ ID NO: 3140504 - RNA, 12 nt, Human
aacuuuucugau

SEQ ID NO: 3140505 - RNA, 13 nt, Human
aacuuuucugaua

SEQ ID NO: 3140506 - RNA, 14 nt, Human
aacuuuucugauag

SEQ ID NO: 3140507 - RNA, 18 nt, Human
aacugacaugcccucccu

SEQ ID NO: 3140508 - RNA, 23 nt, Human
aacugacaugcccucccuucucc

SEQ ID NO: 3140509 - RNA, 16 nt, Human
aaauuggggauucuua

SEQ ID NO: 3140510 - RNA, 20 nt, Human
aaccaguauuguacaaagua

SEQ ID NO: 3140511 - RNA, 15 nt, Human
aaccaguauuguaca

SEQ ID NO: 3140512 - RNA, 21 nt, Human
aaccaguauuguacaaaguau

SEQ ID NO: 3140513 - RNA, 22 nt, Human
aaccaguauuguacaaaguauu

SEQ ID NO: 3140514 - RNA, 14 nt, Human
aauccauuuggaaa

SEQ ID NO: 3140515 - RNA, 15 nt, Human
aauccauuuggaaau

SEQ ID NO: 3140516 - RNA, 22 nt, Human
aauccauuuggaaaucuuuaaa

SEQ ID NO: 3140517 - RNA, 17 nt, Human
aauccauuuggaaaucu

SEQ ID NO: 3140518 - RNA, 18 nt, Human
aauccauuuggaaaucuu

SEQ ID NO: 3140519 - RNA, 22 nt, Human
aaugguccgugcuaaggacuug

SEQ ID NO: 3140520 - RNA, 18 nt, Human
aaugggcgccccccccuc

SEQ ID NO: 3140521 - RNA, 21 nt, Human
aaugggcgccccccccucccc

SEQ ID NO: 3140522 - RNA, 13 nt, Human
aauggcuuuguau

SEQ ID NO: 3140523 - RNA, 18 nt, Human
aauggcuuuguauagaac

SEQ ID NO: 3140524 - RNA, 15 nt, Human
aauggcuuuguauag

SEQ ID NO: 3140525 - RNA, 16 nt, Human
aauggcuuuguauaga

SEQ ID NO: 3140526 - RNA, 18 nt, Human
aauuaguggcacuugcuu

SEQ ID NO: 3140527 - RNA, 22 nt, Human
aagccacugccucucccucugg

SEQ ID NO: 3140528 - RNA, 11 nt, Human
caagaggcugg

SEQ ID NO: 3140529 - RNA, 12 nt, Human
caagaggcuggu

SEQ ID NO: 3140530 - RNA, 13 nt, Human
caagaggcugguu

SEQ ID NO: 3140531 - RNA, 14 nt, Human
caagaggcugguuu

SEQ ID NO: 3140532 - RNA, 16 nt, Human
caagaggcugguuuug

SEQ ID NO: 3140533 - RNA, 22 nt, Human
caaggggcccuuggagcgugga

SEQ ID NO: 3140534 - RNA, 22 nt, Human
caaaaauauuuuaugauccagc

SEQ ID NO: 3140535 - RNA, 23 nt, Human
caaaaauauuuuaugauccagca

SEQ ID NO: 3140536 - RNA, 14 nt, Human
caaaaauauuuuau

SEQ ID NO: 3140537 - RNA, 15 nt, Human
caaaaauauuuuaug

SEQ ID NO: 3140538 - RNA, 17 nt, Human
caaaaauauuuuaugau

SEQ ID NO: 3140539 - RNA, 21 nt, Human
caaaaauauuuuaugauccag

SEQ ID NO: 3140540 - RNA, 19 nt, Human
caaaaaccaguauuguaca

SEQ ID NO: 3140541 - RNA, 20 nt, Human
caaaaaccaguauuguacaa

SEQ ID NO: 3140542 - RNA, 18 nt, Human
caaaaaccaguauuguac

SEQ ID NO: 3140543 - RNA, 20 nt, Human
caaaaacauggccuuugcuu

SEQ ID NO: 3140544 - RNA, 12 nt, Human
uauuacaguaua

SEQ ID NO: 3140545 - RNA, 13 nt, Human
uauuacaguauaa

SEQ ID NO: 3140546 - RNA, 12 nt, Human
uauguaaauccc

SEQ ID NO: 3140547 - RNA, 15 nt, Human
uauguaaaucccauu

SEQ ID NO: 3140548 - RNA, 19 nt, Human
uauguaaaucccauuauuc

SEQ ID NO: 3140549 - RNA, 20 nt, Human
uauguaaaucccauuauuca

SEQ ID NO: 3140550 - RNA, 21 nt, Human
uauguaaaucccauuauucaa

SEQ ID NO: 3140551 - RNA, 23 nt, Human
uauguaaaucccauuauucaaag

SEQ ID NO: 3140552 - RNA, 15 nt, Human
uauuuucauucuccu

SEQ ID NO: 3140553 - RNA, 13 nt, Human
uauuuuauuauga

SEQ ID NO: 3140554 - RNA, 18 nt, Human
uauuuuauuaugaaacuu

SEQ ID NO: 3140555 - RNA, 23 nt, Human
uauuuuauuaugaaacuugugua

SEQ ID NO: 3140556 - RNA, 23 nt, Human
ucauuauuuuauuaugaaacuug

SEQ ID NO: 3140557 - RNA, 22 nt, Human
ucauuauuuuauuaugaaacuu

SEQ ID NO: 3140558 - RNA, 16 nt, Human
ucacugcgccacugcu

SEQ ID NO: 3140559 - RNA, 23 nt, Human
ucacugcgccacugcuccgugga

SEQ ID NO: 3140560 - RNA, 22 nt, Human
ucagacagaucuggaaugugaa

SEQ ID NO: 3140561 - RNA, 20 nt, Human
ucaggcacacaaggggcccu

SEQ ID NO: 3140562 - RNA, 21 nt, Human
ucaggcacacaaggggcccuu

SEQ ID NO: 3140563 - RNA, 21 nt, Human
ucuucagcaaaaauauuuuau

SEQ ID NO: 3140564 - RNA, 22 nt, Human
ucuucagcaaaaauauuuuaug

SEQ ID NO: 3140565 - RNA, 23 nt, Human
ucuucagcaaaaauauuuuauga

SEQ ID NO: 3140566 - RNA, 16 nt, Human
ucuuaaaguugaauuu

SEQ ID NO: 3140567 - RNA, 19 nt, Human
ucuuaaaguugaauuuauu

SEQ ID NO: 3140568 - RNA, 20 nt, Human
ucuuaaaguugaauuuauug

SEQ ID NO: 3140569 - RNA, 21 nt, Human
ucuuaaaguugaauuuauugg

SEQ ID NO: 3140570 - RNA, 22 nt, Human
ucuuaaaguugaauuuauuggc

SEQ ID NO: 3140571 - RNA, 16 nt, Human
ucuuaaaauguuucaa

SEQ ID NO: 3140572 - RNA, 20 nt, Human
ucuuaaaauguuucaaaugg

SEQ ID NO: 3140573 - RNA, 12 nt, Human
ucuuaaaguuga

SEQ ID NO: 3140574 - RNA, 13 nt, Human
ucuuaaaguugaa

SEQ ID NO: 3140575 - RNA, 14 nt, Human
ucuuaaaguugaau

SEQ ID NO: 3140576 - RNA, 16 nt, Human
ucugguggucagcccu

SEQ ID NO: 3140577 - RNA, 20 nt, Human
ucugguggucagcccuagga

SEQ ID NO: 3140578 - RNA, 15 nt, Human
ucucugucccauucc

SEQ ID NO: 3140579 - RNA, 19 nt, Human
ucucugucccauucccugg

SEQ ID NO: 3140580 - RNA, 20 nt, Human
ucucugucccauucccuggg

SEQ ID NO: 3140581 - RNA, 21 nt, Human
ucucugucccauucccuggga

SEQ ID NO: 3140582 - RNA, 17 nt, Human
ucucgucuuccgucucc

SEQ ID NO: 3140583 - RNA, 18 nt, Human
ucucgucuuccgucuccc

SEQ ID NO: 3140584 - RNA, 19 nt, Human
ucucgucuuccgucucccc

SEQ ID NO: 3140585 - RNA, 14 nt, Human
ucugaggaauucug

SEQ ID NO: 3140586 - RNA, 15 nt, Human
ucugaggaauucugu

SEQ ID NO: 3140587 - RNA, 16 nt, Human
ucugaggaauucugua

SEQ ID NO: 3140588 - RNA, 17 nt, Human
ucugaggaauucuguau

SEQ ID NO: 3140589 - RNA, 18 nt, Human
ucugaggaauucuguaua

SEQ ID NO: 3140590 - RNA, 20 nt, Human
ucuaugcugaguuugugcug

SEQ ID NO: 3140591 - RNA, 16 nt, Human
ucuaugcugaguuugu

SEQ ID NO: 3140592 - RNA, 19 nt, Human
ucuauauuuucauucuccu

SEQ ID NO: 3140593 - RNA, 13 nt, Human
ucuaggagaggag

SEQ ID NO: 3140594 - RNA, 17 nt, Human
ucuaaccaagaggcugg

SEQ ID NO: 3140595 - RNA, 19 nt, Human
ucccuggaucuaccuggag

SEQ ID NO: 3140596 - RNA, 20 nt, Human
ucccuggaucuaccuggagg

SEQ ID NO: 3140597 - RNA, 21 nt, Human
ucccuggaucuaccuggaggg

SEQ ID NO: 3140598 - RNA, 22 nt, Human
ucccuggaucuaccuggaggga

SEQ ID NO: 3140599 - RNA, 14 nt, Human
ucccuucucccugg

SEQ ID NO: 3140600 - RNA, 15 nt, Human
ucccuucucccugga

SEQ ID NO: 3140601 - RNA, 16 nt, Human
ucccuucucccuggau

SEQ ID NO: 3140602 - RNA, 18 nt, Human
ucccugcuuuggucuugc

SEQ ID NO: 3140603 - RNA, 15 nt, Human
ucccggguccuuggc

SEQ ID NO: 3140604 - RNA, 17 nt, Human
ucccggguccuuggccc

SEQ ID NO: 3140605 - RNA, 19 nt, Human
ucccggguccuuggccccc

SEQ ID NO: 3140606 - RNA, 15 nt, Human
ucccgggcuguccac

SEQ ID NO: 3140607 - RNA, 16 nt, Human
ucccuccucccauguc

SEQ ID NO: 3140608 - RNA, 20 nt, Human
ucccuccucccaugucacug

SEQ ID NO: 3140609 - RNA, 14 nt, Human
ucccuccugcuuug

SEQ ID NO: 3140610 - RNA, 22 nt, Human
ucccuccugcuuugcgugcccg

SEQ ID NO: 3140611 - RNA, 10 nt, Human
ucccuccucc

SEQ ID NO: 3140612 - RNA, 22 nt, Human
ugcagauugagaccuacaggcu

SEQ ID NO: 3140613 - RNA, 23 nt, Human
ugcagauugagaccuacaggcug

SEQ ID NO: 3140614 - RNA, 12 nt, Human
ugccagggcccg

SEQ ID NO: 3140615 - RNA, 12 nt, Human
ugccuaaggacu

SEQ ID NO: 3140616 - RNA, 13 nt, Human
ugccuaaggacuu

SEQ ID NO: 3140617 - RNA, 14 nt, Human
ugccuaaggacuuc

SEQ ID NO: 3140618 - RNA, 15 nt, Human
ugccuaaggacuucu

SEQ ID NO: 3140619 - RNA, 16 nt, Human
ugccuaaggacuucuu

SEQ ID NO: 3140620 - RNA, 20 nt, Human
ugccuaaggacuucuuuaau

SEQ ID NO: 3140621 - RNA, 14 nt, Human
ugcccggggcagca

SEQ ID NO: 3140622 - RNA, 22 nt, Human
ugcccggggcagcagcagcccu

SEQ ID NO: 3140623 - RNA, 23 nt, Human
ugcccggggcagcagcagcccug

SEQ ID NO: 3140624 - RNA, 16 nt, Human
ugcccugcuuucagau

SEQ ID NO: 3140625 - RNA, 17 nt, Human
ugcccugcuuucagaua

SEQ ID NO: 3140626 - RNA, 12 nt, Human
ugcccugcuuuc

SEQ ID NO: 3140627 - RNA, 17 nt, Human
ugacugauucuucagca

SEQ ID NO: 3140628 - RNA, 13 nt, Human
ugacugauucuuc

SEQ ID NO: 3140629 - RNA, 14 nt, Human
ugacugauucuuca

SEQ ID NO: 3140630 - RNA, 15 nt, Human
ugacugauucuucag

SEQ ID NO: 3140631 - RNA, 16 nt, Human
ugacugauucuucagc

SEQ ID NO: 3140632 - RNA, 17 nt, Human
ugagaccuacaggcuga

SEQ ID NO: 3140633 - RNA, 18 nt, Human
ugagaccuacaggcugac

SEQ ID NO: 3140634 - RNA, 19 nt, Human
ugagaccuacaggcugacg

SEQ ID NO: 3140635 - RNA, 19 nt, Human
ugagccggucaggcacaca

SEQ ID NO: 3140636 - RNA, 23 nt, Human
uguauagauuagagaguguugaa

SEQ ID NO: 3140637 - RNA, 23 nt, Human
uguauagaaccucuuugucuaca

SEQ ID NO: 3140638 - RNA, 15 nt, Human
uguauagauuagaau

SEQ ID NO: 3140639 - RNA, 21 nt, Human
uguauagauuagaauucugua

SEQ ID NO: 3140640 - RNA, 12 nt, Human
uguaugcugcuu

SEQ ID NO: 3140641 - RNA, 13 nt, Human
uguaugcugcuuu

SEQ ID NO: 3140642 - RNA, 16 nt, Human
uguaugcugcuuuucu

SEQ ID NO: 3140643 - RNA, 18 nt, Human
ugucuacaccauuaugug

SEQ ID NO: 3140644 - RNA, 17 nt, Human
ugucuacaccauuaugu

SEQ ID NO: 3140645 - RNA, 22 nt, Human
ugucucagauuuuauuauguaa

SEQ ID NO: 3140646 - RNA, 16 nt, Human
ugucucagauuuuauu

SEQ ID NO: 3140647 - RNA, 20 nt, Human
ugucucagauuuuauuaugu

SEQ ID NO: 3140648 - RNA, 21 nt, Human
ugucuacaugaaaguccucag

SEQ ID NO: 3140649 - RNA, 14 nt, Human
uguacaaaguauua

SEQ ID NO: 3140650 - RNA, 21 nt, Human
uguacaaaguauuaagcauau

SEQ ID NO: 3140651 - RNA, 15 nt, Human
uguacaaaguauuaa

SEQ ID NO: 3140652 - RNA, 17 nt, Human
uguacaaaguauuaagc

SEQ ID NO: 3140653 - RNA, 18 nt, Human
uguacaaaguauuaagca

SEQ ID NO: 3140654 - RNA, 19 nt, Human
uguacaaaguauuaagcau

SEQ ID NO: 3140655 - RNA, 20 nt, Human
uguacaaaguauuaagcaua

SEQ ID NO: 3140656 - RNA, 15 nt, Human
uggugacuuuggaua

SEQ ID NO: 3140657 - RNA, 16 nt, Human
uggugacuuuggauaa

SEQ ID NO: 3140658 - RNA, 18 nt, Human
uggugacuuuggauaaua

SEQ ID NO: 3140659 - RNA, 19 nt, Human
uggugacuuuggauaauaa

SEQ ID NO: 3140660 - RNA, 23 nt, Human
uggugacuuuggauaauaaggaa

SEQ ID NO: 3140661 - RNA, 15 nt, Human
ugguggucagcccua

SEQ ID NO: 3140662 - RNA, 22 nt, Human
ugcuuugcgugcccggggcagc

SEQ ID NO: 3140663 - RNA, 14 nt, Human
uggaacgcguugaa

SEQ ID NO: 3140664 - RNA, 15 nt, Human
uggaacgcguugaaa

SEQ ID NO: 3140665 - RNA, 16 nt, Human
uggaacgcguugaaau

SEQ ID NO: 3140666 - RNA, 14 nt, Human
ugcuuaacauaccc

SEQ ID NO: 3140667 - RNA, 17 nt, Human
ugccuguccccaugcuu

SEQ ID NO: 3140668 - RNA, 17 nt, Human
uggacugguugguuuug

SEQ ID NO: 3140669 - RNA, 15 nt, Human
uggaccaaaaaccag

SEQ ID NO: 3140670 - RNA, 14 nt, Human
uggggugguugagg

SEQ ID NO: 3140671 - RNA, 23 nt, Human
ugggguuaucugaagucagaucu

SEQ ID NO: 3140672 - RNA, 23 nt, Human
ugggaucugguggucagcccuag

SEQ ID NO: 3140673 - RNA, 12 nt, Human
ugggauaaaugc

SEQ ID NO: 3140674 - RNA, 13 nt, Human
ugggauaaaugcc

SEQ ID NO: 3140675 - RNA, 14 nt, Human
ugggauaaaugcca

SEQ ID NO: 3140676 - RNA, 11 nt, Human
ugggcagcccg

SEQ ID NO: 3140677 - RNA, 12 nt, Human
ugggcagcccgc

SEQ ID NO: 3140678 - RNA, 18 nt, Human
ugggcagcuuagggcccu

SEQ ID NO: 3140679 - RNA, 19 nt, Human
ugggcagcuuagggcccug

SEQ ID NO: 3140680 - RNA, 21 nt, Human
ugggcagcuuagggcccugga

SEQ ID NO: 3140681 - RNA, 22 nt, Human
ugggcagcuuagggcccuggag

SEQ ID NO: 3140682 - RNA, 23 nt, Human
ugggcagcuuagggcccuggagg

SEQ ID NO: 3140683 - RNA, 14 nt, Human
uuuaauaauuauau

SEQ ID NO: 3140684 - RNA, 18 nt, Human
uuuaauaauuauaugcua

SEQ ID NO: 3140685 - RNA, 21 nt, Human
uuuaauaauuauaugcuauuu

SEQ ID NO: 3140686 - RNA, 21 nt, Human
uuguuuggaccaaaaaccagu

SEQ ID NO: 3140687 - RNA, 16 nt, Human
uuuaacaacagcuggu

SEQ ID NO: 3140688 - RNA, 13 nt, Human
uuucagauacugg

SEQ ID NO: 3140689 - RNA, 21 nt, Human
uuucagauacuggauuguacu

SEQ ID NO: 3140690 - RNA, 14 nt, Human
uuuauuauguaaau

SEQ ID NO: 3140691 - RNA, 16 nt, Human
uuuauuauguaaaucc

SEQ ID NO: 3140692 - RNA, 17 nt, Human
uuuauuauguaaauccc

SEQ ID NO: 3140693 - RNA, 22 nt, Human
uugugcgcuaaacuuuucugau

SEQ ID NO: 3140694 - RNA, 23 nt, Human
uugugcgcuaaacuuuucugaua

SEQ ID NO: 3140695 - RNA, 19 nt, Human
uugugcugggguuaucuga

SEQ ID NO: 3140696 - RNA, 17 nt, Human
uuguuagaucuaguuca

SEQ ID NO: 3140697 - RNA, 17 nt, Human
uuguuguuuguuuaguc

SEQ ID NO: 3140698 - RNA, 16 nt, Human
uuggguguauugugcg

SEQ ID NO: 3140699 - RNA, 13 nt, Human
uuggguguauugu

SEQ ID NO: 3140700 - RNA, 15 nt, Human
uuggguguauugugc

SEQ ID NO: 3140701 - RNA, 18 nt, Human
uuggucuugccccaucac

SEQ ID NO: 3140702 - RNA, 14 nt, Human
uuguacucaauuuu

SEQ ID NO: 3140703 - RNA, 15 nt, Human
uuguacucaauuuua

SEQ ID NO: 3140704 - RNA, 19 nt, Human
uugucuacaccauuaugug

SEQ ID NO: 3140705 - RNA, 18 nt, Human
uugucuccccuguucccc

SEQ ID NO: 3140706 - RNA, 22 nt, Human
uugucuccccuguuccccucuc

SEQ ID NO: 3140707 - RNA, 23 nt, Human
uugucuccccuguuccccucucc

SEQ ID NO: 3140708 - RNA, 21 nt, Human
uugucucccgccccccacacu

SEQ ID NO: 3140709 - RNA, 22 nt, Human
uugucucagauuuuauuaugua

SEQ ID NO: 3140710 - RNA, 20 nt, Human
uugucuacaccauuaugugc

SEQ ID NO: 3140711 - RNA, 13 nt, Human
uugucucagauuu

SEQ ID NO: 3140712 - RNA, 16 nt, Human
uugucucagauuuuau

SEQ ID NO: 3140713 - RNA, 20 nt, Human
uugucucagauuuuauuaug

SEQ ID NO: 3140714 - RNA, 22 nt, Human
uugaauuuauuggcuuuucuga

SEQ ID NO: 3140715 - RNA, 15 nt, Human
uugaauuuauuggcu

SEQ ID NO: 3140716 - RNA, 18 nt, Human
uugaauuuauuggcuuuu

SEQ ID NO: 3140717 - RNA, 17 nt, Human
uugaauuuuguguuaga

SEQ ID NO: 3140718 - RNA, 21 nt, Human
uugaauuuuguguuagagauu

SEQ ID NO: 3140719 - RNA, 13 nt, Human
uucugauagagga

SEQ ID NO: 3140720 - RNA, 21 nt, Human
uucugauagaggaagccugau

SEQ ID NO: 3140721 - RNA, 15 nt, Human
uucuauccucaucuu

SEQ ID NO: 3140722 - RNA, 19 nt, Human
uucaaaugguuuaacaaaa

SEQ ID NO: 3140723 - RNA, 18 nt, Human
uucaaaugcuguaacuuu

SEQ ID NO: 3140724 - RNA, 20 nt, Human
uuauuuuauuaugaaacuug

SEQ ID NO: 3140725 - RNA, 15 nt, Human
uuauuuuauuaugaa

SEQ ID NO: 3140726 - RNA, 16 nt, Human
uuauuuuauuaugaaa

SEQ ID NO: 3140727 - RNA, 14 nt, Human
uuauuuuauuauga

SEQ ID NO: 3140728 - RNA, 16 nt, Human
uucagauacuggauug

SEQ ID NO: 3140729 - RNA, 20 nt, Human
uucagauacuggauuguacu

SEQ ID NO: 3140730 - RNA, 16 nt, Human
uuauaugcuauuucua

SEQ ID NO: 3140731 - RNA, 18 nt, Human
uuauaugcuauuucuaua

SEQ ID NO: 3140732 - RNA, 22 nt, Human
uuauaucugaggaauucuguau

SEQ ID NO: 3140733 - RNA, 23 nt, Human
uuauaucugaggaauucuguaua

SEQ ID NO: 3140734 - RNA, 14 nt, Human
uuauaucugaggaa

SEQ ID NO: 3140735 - RNA, 20 nt, Human
uuauaucugaggaauucugu

SEQ ID NO: 3140736 - RNA, 21 nt, Human
uuauaucugaggaauucugua

SEQ ID NO: 3140737 - RNA, 14 nt, Human
uuauuacaguauaa

SEQ ID NO: 3140738 - RNA, 16 nt, Human
uuauuacaguauaauu

SEQ ID NO: 3140739 - RNA, 13 nt, Human
uuuuauauuuacu

SEQ ID NO: 3140740 - RNA, 18 nt, Human
uuuggaccaaaaaccagu

SEQ ID NO: 3140741 - RNA, 21 nt, Human
uuuggaccaaaaaccaguauu

SEQ ID NO: 3140742 - RNA, 22 nt, Human
uuuggaccaaaaaccaguauug

SEQ ID NO: 3140743 - RNA, 24 nt, Human
uuuggaccaaaaaccaguauugua

SEQ ID NO: 3140744 - RNA, 13 nt, Human
uuuuucauuauuu

SEQ ID NO: 3140745 - RNA, 22 nt, Human
uuuuucauuauuuuauuaugaa

SEQ ID NO: 3140746 - RNA, 11 nt, Human
cauuuggaaau

SEQ ID NO: 3140747 - RNA, 17 nt, Human
cauuuggaaaucuuuaa

SEQ ID NO: 3140748 - RNA, 18 nt, Human
cauuuggaaaucuuuaaa

SEQ ID NO: 3140749 - RNA, 10 nt, Human
cauucccugg

SEQ ID NO: 3140750 - RNA, 12 nt, Human
cauucccuggga

SEQ ID NO: 3140751 - RNA, 15 nt, Human
cauucccugggaucu

SEQ ID NO: 3140752 - RNA, 17 nt, Human
cauuauuuuauuaugaa

SEQ ID NO: 3140753 - RNA, 16 nt, Human
cauuauucaaaguugc

SEQ ID NO: 3140754 - RNA, 22 nt, Human
cauuauucaaaguugccuaaau

SEQ ID NO: 3140755 - RNA, 18 nt, Human
cauuauucaaaguugccu

SEQ ID NO: 3140756 - RNA, 21 nt, Human
cauuauucaaaguugccuaaa

SEQ ID NO: 3140757 - RNA, 17 nt, Human
cauucuggucucgucuu

SEQ ID NO: 3140758 - RNA, 18 nt, Human
cauucuggucucgucuuc

SEQ ID NO: 3140759 - RNA, 22 nt, Human
cauucuggucucgucuuccguc

SEQ ID NO: 3140760 - RNA, 22 nt, Human
cauguuuauuacaguauaauua

SEQ ID NO: 3140761 - RNA, 22 nt, Human
cauguuaaaccaugggauaaau

SEQ ID NO: 3140762 - RNA, 23 nt, Human
cauguuuauuacaguauaauuaa

SEQ ID NO: 3140763 - RNA, 13 nt, Human
cauguuaaaccau

SEQ ID NO: 3140764 - RNA, 16 nt, Human
caugggauaaaugcca

SEQ ID NO: 3140765 - RNA, 17 nt, Human
caugggauaaaugccau

SEQ ID NO: 3140766 - RNA, 18 nt, Human
caugggauaaaugccauc

SEQ ID NO: 3140767 - RNA, 23 nt, Human
caugggauaaaugccaucaauaa

SEQ ID NO: 3140768 - RNA, 20 nt, Human
cauauauuuuuauauuuacu

SEQ ID NO: 3140769 - RNA, 21 nt, Human
cauauauuuuuauauuuacua

SEQ ID NO: 3140770 - RNA, 18 nt, Human
cauauauuuuuauauuua

SEQ ID NO: 3140771 - RNA, 19 nt, Human
cauagucuggcuguaccca

SEQ ID NO: 3140772 - RNA, 12 nt, Human
cagugcugccug

SEQ ID NO: 3140773 - RNA, 13 nt, Human
cagugcugccugu

SEQ ID NO: 3140774 - RNA, 14 nt, Human
cagugcugccuguc

SEQ ID NO: 3140775 - RNA, 15 nt, Human
cagugcugccugucc

SEQ ID NO: 3140776 - RNA, 22 nt, Human
cagugcugccuguccccaugcu

SEQ ID NO: 3140777 - RNA, 16 nt, Human
caucacugcgccacug

SEQ ID NO: 3140778 - RNA, 12 nt, Human
caucucccugcu

SEQ ID NO: 3140779 - RNA, 14 nt, Human
caucucccugcuuu

SEQ ID NO: 3140780 - RNA, 15 nt, Human
caucucccugcuuug

SEQ ID NO: 3140781 - RNA, 11 nt, Human
caucucccugc

SEQ ID NO: 3140782 - RNA, 12 nt, Human
caugaagacaga

SEQ ID NO: 3140783 - RNA, 13 nt, Human
ccaugggauaaau

SEQ ID NO: 3140784 - RNA, 17 nt, Human
ccauuauucaaaguugc

SEQ ID NO: 3140785 - RNA, 22 nt, Human
ccauuauucaaaguugccuaaa

SEQ ID NO: 3140786 - RNA, 14 nt, Human
ccauuauucaaagu

SEQ ID NO: 3140787 - RNA, 13 nt, Human
ccauguuuauuac

SEQ ID NO: 3140788 - RNA, 20 nt, Human
ccauguuuauuacaguauaa

SEQ ID NO: 3140789 - RNA, 18 nt, Human
ccaaacccaaaagaaacu

SEQ ID NO: 3140790 - RNA, 13 nt, Human
ccacaccuccucu

SEQ ID NO: 3140791 - RNA, 11 nt, Human
ccacugccucu

SEQ ID NO: 3140792 - RNA, 13 nt, Human
ccacugccucucc

SEQ ID NO: 3140793 - RNA, 15 nt, Human
ccacugccucucccu

SEQ ID NO: 3140794 - RNA, 16 nt, Human
ccacugccucucccuc

SEQ ID NO: 3140795 - RNA, 17 nt, Human
ccacugccucucccucu

SEQ ID NO: 3140796 - RNA, 19 nt, Human
ccacugccucucccucugg

SEQ ID NO: 3140797 - RNA, 16 nt, Human
ccacugcuccguggag

SEQ ID NO: 3140798 - RNA, 19 nt, Human
ccacugcuccguggaggag

SEQ ID NO: 3140799 - RNA, 20 nt, Human
ccagauucuauccucaucuu

SEQ ID NO: 3140800 - RNA, 21 nt, Human
ccugcacggugaauggcuuug

SEQ ID NO: 3140801 - RNA, 20 nt, Human
ccugcacggugaauggcuuu

SEQ ID NO: 3140802 - RNA, 17 nt, Human
ccugggcccaucucccu

SEQ ID NO: 3140803 - RNA, 18 nt, Human
ccugggcccaucucccug

SEQ ID NO: 3140804 - RNA, 20 nt, Human
ccugggcccaucucccugcu

SEQ ID NO: 3140805 - RNA, 22 nt, Human
ccugggcccaucucccugcuuu

SEQ ID NO: 3140806 - RNA, 21 nt, Human
cgaaagaacaguccauugaaa

SEQ ID NO: 3140807 - RNA, 12 nt, Human
cgaaagaacagu

SEQ ID NO: 3140808 - RNA, 19 nt, Human
ccuuuuauuuuuuucuaau

SEQ ID NO: 3140809 - RNA, 14 nt, Human
ccuucuugcugccc

SEQ ID NO: 3140810 - RNA, 16 nt, Human
ccuucuugcugcccug

SEQ ID NO: 3140811 - RNA, 21 nt, Human
ccuucuugcugcccugcccca

SEQ ID NO: 3140812 - RNA, 14 nt, Human
cccugcuuucagau

SEQ ID NO: 3140813 - RNA, 17 nt, Human
cccugcuuucagauacu

SEQ ID NO: 3140814 - RNA, 22 nt, Human
cccuccccaugcaggugguguc

SEQ ID NO: 3140815 - RNA, 15 nt, Human
cccucuggucccaca

SEQ ID NO: 3140816 - RNA, 23 nt, Human
cccguguuccccucuugucuccc

SEQ ID NO: 3140817 - RNA, 22 nt, Human
cccuaggauaaaaagccagggc

SEQ ID NO: 3140818 - RNA, 23 nt, Human
cccuaggauaaaaagccagggcu

SEQ ID NO: 3140819 - RNA, 12 nt, Human
cccggggcagca

SEQ ID NO: 3140820 - RNA, 20 nt, Human
cccggggcagcagcagcccu

SEQ ID NO: 3140821 - RNA, 14 nt, Human
cccgccccccacac

SEQ ID NO: 3140822 - RNA, 20 nt, Human
cccgccccccacacuucccu

SEQ ID NO: 3140823 - RNA, 23 nt, Human
cccgccccccacacuucccuggc

SEQ ID NO: 3140824 - RNA, 16 nt, Human
cccgccuagcugcugu

SEQ ID NO: 3140825 - RNA, 12 nt, Human
cccgcuggagga

SEQ ID NO: 3140826 - RNA, 13 nt, Human
cccgcuggaggau

SEQ ID NO: 3140827 - RNA, 21 nt, Human
cccgcuggaggaugugggcag

SEQ ID NO: 3140828 - RNA, 22 nt, Human
cccgcuggaggaugugggcagc

SEQ ID NO: 3140829 - RNA, 23 nt, Human
cccgcuggaggaugugggcagcu

SEQ ID NO: 3140830 - RNA, 12 nt, Human
ccuccccaugca

SEQ ID NO: 3140831 - RNA, 12 nt, Human
ccuccugcuuug

SEQ ID NO: 3140832 - RNA, 12 nt, Human
ccuaaauccauu

SEQ ID NO: 3140833 - RNA, 17 nt, Human
ccuaaauccauuuggaa

SEQ ID NO: 3140834 - RNA, 23 nt, Human
ccgcaccgaccacggggccgaca

SEQ ID NO: 3140835 - RNA, 20 nt, Human
ccgcuaggcucgccuucccu

SEQ ID NO: 3140836 - RNA, 21 nt, Human
ccgcuaggcucgccuucccuc

SEQ ID NO: 3140837 - RNA, 22 nt, Human
ccgcuaggcucgccuucccucc

SEQ ID NO: 3140838 - RNA, 18 nt, Human
ccggguccuuggcccccu

SEQ ID NO: 3140839 - RNA, 12 nt, Human
ccgugcugggca

SEQ ID NO: 3140840 - RNA, 14 nt, Human
ccgugcugggcagc

SEQ ID NO: 3140841 - RNA, 15 nt, Human
ccgugcugggcagcc

SEQ ID NO: 3140842 - RNA, 16 nt, Human
ccgugcugggcagccc

SEQ ID NO: 3140843 - RNA, 15 nt, Human
ccggucaggcacaca

SEQ ID NO: 3140844 - RNA, 23 nt, Human
ccggucaggcacacaaggggccc

SEQ ID NO: 3140845 - RNA, 14 nt, Human
ccgugcuaaggacu

SEQ ID NO: 3140846 - RNA, 15 nt, Human
ccgugcuaaggacuu

SEQ ID NO: 3140847 - RNA, 16 nt, Human
ccgugcuaaggacuug

SEQ ID NO: 3140848 - RNA, 21 nt, Human
cugucuugccuuuuucauuau

SEQ ID NO: 3140849 - RNA, 23 nt, Human
cugucuugccuuuuucauuauuu

SEQ ID NO: 3140850 - RNA, 13 nt, Human
cuguggugacuuu

SEQ ID NO: 3140851 - RNA, 14 nt, Human
cuguggugacuuug

SEQ ID NO: 3140852 - RNA, 12 nt, Human
cuguggugacuu

SEQ ID NO: 3140853 - RNA, 23 nt, Human
cuguggugacuuuggauaauaag

SEQ ID NO: 3140854 - RNA, 15 nt, Human
cuguggugacuuugg

SEQ ID NO: 3140855 - RNA, 17 nt, Human
cuguggugacuuuggau

SEQ ID NO: 3140856 - RNA, 18 nt, Human
cuguggugacuuuggaua

SEQ ID NO: 3140857 - RNA, 20 nt, Human
cuguggugacuuuggauaau

SEQ ID NO: 3140858 - RNA, 15 nt, Human
cuguggcuggugagc

SEQ ID NO: 3140859 - RNA, 24 nt, Human
cuggggugggggugggaggccagc

SEQ ID NO: 3140860 - RNA, 14 nt, Human
cugggguuaucuga

SEQ ID NO: 3140861 - RNA, 15 nt, Human
cugguguauguguga

SEQ ID NO: 3140862 - RNA, 19 nt, Human
cuuagaauuaguggcacuu

SEQ ID NO: 3140863 - RNA, 20 nt, Human
cuucagcaaaaauauuuuau

SEQ ID NO: 3140864 - RNA, 23 nt, Human
cuucagcaaaaauauuuuaugau

SEQ ID NO: 3140865 - RNA, 17 nt, Human
cuucagcaaaaauauuu

SEQ ID NO: 3140866 - RNA, 10 nt, Human
cuucccuggc

SEQ ID NO: 3140867 - RNA, 11 nt, Human
cuucccuggcg

SEQ ID NO: 3140868 - RNA, 21 nt, Human
cuucccuggcggccccaacuc

SEQ ID NO: 3140869 - RNA, 12 nt, Human
gaagccaugucu

SEQ ID NO: 3140870 - RNA, 16 nt, Human
gaacgcguugaaauug

SEQ ID NO: 3140871 - RNA, 15 nt, Human
gaacgcguugaaauu

SEQ ID NO: 3140872 - RNA, 23 nt, Human
cuuggagggcaugaagacagaua

SEQ ID NO: 3140873 - RNA, 12 nt, Human
cuuggagggcau

SEQ ID NO: 3140874 - RNA, 14 nt, Human
cuugccccaucacu

SEQ ID NO: 3140875 - RNA, 16 nt, Human
cuugccccaucacugc

SEQ ID NO: 3140876 - RNA, 17 nt, Human
cuugccccaucacugcg

SEQ ID NO: 3140877 - RNA, 11 nt, Human
cuuuucugaua

SEQ ID NO: 3140878 - RNA, 16 nt, Human
cuauuucuauauuuuc

SEQ ID NO: 3140879 - RNA, 14 nt, Human
cuauuucuauauuu

SEQ ID NO: 3140880 - RNA, 12 nt, Human
cucacuccccag

SEQ ID NO: 3140881 - RNA, 19 nt, Human
cucacuccccagccugggc

SEQ ID NO: 3140882 - RNA, 20 nt, Human
cucacuccccagccugggcc

SEQ ID NO: 3140883 - RNA, 18 nt, Human
cucagauuuuauuaugua

SEQ ID NO: 3140884 - RNA, 15 nt, Human
cucagauuuuauuau

SEQ ID NO: 3140885 - RNA, 17 nt, Human
cucagauuuuauuaugu

SEQ ID NO: 3140886 - RNA, 13 nt, Human
cucagauuuuauu

SEQ ID NO: 3140887 - RNA, 18 nt, Human
cuaugcugaguuugugcu

SEQ ID NO: 3140888 - RNA, 15 nt, Human
cuauauuuucauucu

SEQ ID NO: 3140889 - RNA, 17 nt, Human
cuccccuguuccccucu

SEQ ID NO: 3140890 - RNA, 18 nt, Human
cuccccuguuccccucuc

SEQ ID NO: 3140891 - RNA, 21 nt, Human
cuccccuguuccccucucccu

SEQ ID NO: 3140892 - RNA, 22 nt, Human
cuccccuguuccccucucccuu

SEQ ID NO: 3140893 - RNA, 13 nt, Human
cucccgcccccca

SEQ ID NO: 3140894 - RNA, 21 nt, Human
cucccgccccccacacuuccc

SEQ ID NO: 3140895 - RNA, 22 nt, Human
cucccgccccccacacuucccu

SEQ ID NO: 3140896 - RNA, 23 nt, Human
cucccgccccccacacuucccug

SEQ ID NO: 3140897 - RNA, 16 nt, Human
cucccggguccuuggc

SEQ ID NO: 3140898 - RNA, 17 nt, Human
cucccggguccuuggcc

SEQ ID NO: 3140899 - RNA, 13 nt, Human
cucgccuucccuc

SEQ ID NO: 3140900 - RNA, 15 nt, Human
cucgccuucccuccu

SEQ ID NO: 3140901 - RNA, 16 nt, Human
cucgccuucccuccug

SEQ ID NO: 3140902 - RNA, 17 nt, Human
cucgccuucccuccugc

SEQ ID NO: 3140903 - RNA, 20 nt, Human
cucgccuucccuccugcuuu

SEQ ID NO: 3140904 - RNA, 22 nt, Human
cugauuugacauagucuggcug

SEQ ID NO: 3140905 - RNA, 23 nt, Human
cugauuugacauagucuggcugu

SEQ ID NO: 3140906 - RNA, 21 nt, Human
cugauuugacauagucuggcu

SEQ ID NO: 3140907 - RNA, 13 nt, Human
cugaguuugugcu

SEQ ID NO: 3140908 - RNA, 18 nt, Human
cugaguuugugcuggugu

SEQ ID NO: 3140909 - RNA, 13 nt, Human
cugacguuccggg

SEQ ID NO: 3140910 - RNA, 15 nt, Human
cugacguuccgggca

SEQ ID NO: 3140911 - RNA, 23 nt, Human
cugacguuccgggcaaaugccag

SEQ ID NO: 3140912 - RNA, 21 nt, Human
cugaagucagaucugccuaag

SEQ ID NO: 3140913 - RNA, 17 nt, Human
cugaaguucagcugcau

SEQ ID NO: 3140914 - RNA, 23 nt, Human
cucuuugucuacaccauuaugug

SEQ ID NO: 3140915 - RNA, 18 nt, Human
gauaaaaagccagggcug

SEQ ID NO: 3140916 - RNA, 19 nt, Human
gauaaaaagccagggcugg

SEQ ID NO: 3140917 - RNA, 20 nt, Human
gauaaaaagccagggcugga

SEQ ID NO: 3140918 - RNA, 15 nt, Human
gauagaggaagccug

SEQ ID NO: 3140919 - RNA, 21 nt, Human
gauagaggaagccugauuaaa

SEQ ID NO: 3140920 - RNA, 22 nt, Human
gauagaggaagccugauuaaag

SEQ ID NO: 3140921 - RNA, 14 nt, Human
gauagaggaagccu

SEQ ID NO: 3140922 - RNA, 17 nt, Human
gagccugcacggugaau

SEQ ID NO: 3140923 - RNA, 22 nt, Human
gagccugcacggugaauggcuu

SEQ ID NO: 3140924 - RNA, 23 nt, Human
gagccugcacggugaauggcuuu

SEQ ID NO: 3140925 - RNA, 22 nt, Human
gagcguggacugguugguuuug

SEQ ID NO: 3140926 - RNA, 15 nt, Human
gagcuuaagccacug

SEQ ID NO: 3140927 - RNA, 17 nt, Human
gagcuuaagccacugcc

SEQ ID NO: 3140928 - RNA, 22 nt, Human
gagcuuaagccacugccucucc

SEQ ID NO: 3140929 - RNA, 23 nt, Human
gagcuuaagccacugccucuccc

SEQ ID NO: 3140930 - RNA, 14 nt, Human
gaggaugugggcag

SEQ ID NO: 3140931 - RNA, 15 nt, Human
gaggaugugggcagc

SEQ ID NO: 3140932 - RNA, 16 nt, Human
gaggaugugggcagcu

SEQ ID NO: 3140933 - RNA, 13 nt, Human
gaggagguuggga

SEQ ID NO: 3140934 - RNA, 14 nt, Human
gaggaauucuguau

SEQ ID NO: 3140935 - RNA, 16 nt, Human
gaggaauucuguauag

SEQ ID NO: 3140936 - RNA, 17 nt, Human
gaggaauucuguauaga

SEQ ID NO: 3140937 - RNA, 20 nt, Human
gaggcguauguggcaaaaug

SEQ ID NO: 3140938 - RNA, 15 nt, Human
gaggcuaaguuggga

SEQ ID NO: 3140939 - RNA, 18 nt, Human
gaggcuaaguugggaucu

SEQ ID NO: 3140940 - RNA, 19 nt, Human
gagggaagaguggaggugg

SEQ ID NO: 3140941 - RNA, 20 nt, Human
gagggaagaguggaggugga

SEQ ID NO: 3140942 - RNA, 13 nt, Human
gcagcagcagccc

SEQ ID NO: 3140943 - RNA, 14 nt, Human
gcagcagcagcccu

SEQ ID NO: 3140944 - RNA, 15 nt, Human
gcagcagcagcccug

SEQ ID NO: 3140945 - RNA, 16 nt, Human
gcagcagcagcccugc

SEQ ID NO: 3140946 - RNA, 13 nt, Human
gcagauuauucac

SEQ ID NO: 3140947 - RNA, 11 nt, Human
gcagcagcccu

SEQ ID NO: 3140948 - RNA, 13 nt, Human
gcagcagcccugc

SEQ ID NO: 3140949 - RNA, 14 nt, Human
gcagcagcccugcc

SEQ ID NO: 3140950 - RNA, 20 nt, Human
gcaucucugucccauucccu

SEQ ID NO: 3140951 - RNA, 21 nt, Human
gcaucucugucccauucccug

SEQ ID NO: 3140952 - RNA, 22 nt, Human
gcaucucugucccauucccugg

SEQ ID NO: 3140953 - RNA, 23 nt, Human
gcaucucugucccauucccuggg

SEQ ID NO: 3140954 - RNA, 13 nt, Human
gcuguggcuggug

SEQ ID NO: 3140955 - RNA, 15 nt, Human
gcuguggcuggugag

SEQ ID NO: 3140956 - RNA, 21 nt, Human
gcugguguaugugugaaguga

SEQ ID NO: 3140957 - RNA, 14 nt, Human
gcugcccugcccca

SEQ ID NO: 3140958 - RNA, 14 nt, Human
gcuuuguauagaac

SEQ ID NO: 3140959 - RNA, 12 nt, Human
gcuuuguauaga

SEQ ID NO: 3140960 - RNA, 13 nt, Human
gcuuuguauagaa

SEQ ID NO: 3140961 - RNA, 12 nt, Human
gcucgccuuccc

SEQ ID NO: 3140962 - RNA, 13 nt, Human
gcucgccuucccu

SEQ ID NO: 3140963 - RNA, 15 nt, Human
gcucgccuucccucc

SEQ ID NO: 3140964 - RNA, 17 nt, Human
gcucgccuucccuccug

SEQ ID NO: 3140965 - RNA, 16 nt, Human
gcugacguuccgggca

SEQ ID NO: 3140966 - RNA, 16 nt, Human
gcuggcauagagcagc

SEQ ID NO: 3140967 - RNA, 12 nt, Human
gcugcuuuucuu

SEQ ID NO: 3140968 - RNA, 19 nt, Human
gcugcuuuucuuuucuaac

SEQ ID NO: 3140969 - RNA, 13 nt, Human
gccuucccuccug

SEQ ID NO: 3140970 - RNA, 17 nt, Human
gccuucccuccugcuuu

SEQ ID NO: 3140971 - RNA, 19 nt, Human
gcgccccccccuccccaug

SEQ ID NO: 3140972 - RNA, 15 nt, Human
gccugggcccaucuc

SEQ ID NO: 3140973 - RNA, 16 nt, Human
gccugggcccaucucc

SEQ ID NO: 3140974 - RNA, 18 nt, Human
gccugggcccaucucccu

SEQ ID NO: 3140975 - RNA, 21 nt, Human
gccugggcccaucucccugcu

SEQ ID NO: 3140976 - RNA, 23 nt, Human
gccugggcccaucucccugcuuu

SEQ ID NO: 3140977 - RNA, 15 nt, Human
gcggugcggcaggga

SEQ ID NO: 3140978 - RNA, 13 nt, Human
gcuccguggagga

SEQ ID NO: 3140979 - RNA, 16 nt, Human
gcuccguggaggaggu

SEQ ID NO: 3140980 - RNA, 18 nt, Human
ggcgccccccccucccca

SEQ ID NO: 3140981 - RNA, 15 nt, Human
ggcuuuguauagaac

SEQ ID NO: 3140982 - RNA, 16 nt, Human
ggcuguggcuggugag

SEQ ID NO: 3140983 - RNA, 13 nt, Human
ggauucuuaaagu

SEQ ID NO: 3140984 - RNA, 14 nt, Human
ggccaggagaugga

SEQ ID NO: 3140985 - RNA, 15 nt, Human
ggagcguggacuggu

SEQ ID NO: 3140986 - RNA, 19 nt, Human
ggagcguggacugguuggu

SEQ ID NO: 3140987 - RNA, 17 nt, Human
ggacgcugaccguggag

SEQ ID NO: 3140988 - RNA, 18 nt, Human
ggacgcugaccguggagc

SEQ ID NO: 3140989 - RNA, 21 nt, Human
cacugauuugacauagucugg

SEQ ID NO: 3140990 - RNA, 23 nt, Human
cacugauuugacauagucuggcu

SEQ ID NO: 3140991 - RNA, 17 nt, Human
cacugcuccguggagga

SEQ ID NO: 3140992 - RNA, 15 nt, Human
cacugcgccacugcu

SEQ ID NO: 3140993 - RNA, 17 nt, Human
cacugcgccacugcucc

SEQ ID NO: 3140994 - RNA, 13 nt, Human
cacugccucuccc

SEQ ID NO: 3140995 - RNA, 14 nt, Human
cacugccucucccu

SEQ ID NO: 3140996 - RNA, 16 nt, Human
cacugccucucccucu

SEQ ID NO: 3140997 - RNA, 11 nt, Human
cacuucccugg

SEQ ID NO: 3140998 - RNA, 12 nt, Human
cacuucccuggc

SEQ ID NO: 3140999 - RNA, 13 nt, Human
cacuucccuggcg

SEQ ID NO: 3141000 - RNA, 19 nt, Human
cacuucccuggcggcccca

SEQ ID NO: 3141001 - RNA, 10 nt, Human
cacuucccug

SEQ ID NO: 3141002 - RNA, 22 nt, Human
cacggggccgacauugucuccc

SEQ ID NO: 3141003 - RNA, 20 nt, Human
cacggugaauggcuuuguau

SEQ ID NO: 3141004 - RNA, 23 nt, Human
cacggugaauggcuuuguauaga

SEQ ID NO: 3141005 - RNA, 20 nt, Human
caccugucuugccuuuuuca

SEQ ID NO: 3141006 - RNA, 17 nt, Human
caccugucuugccuuuu

SEQ ID NO: 3141007 - RNA, 15 nt, Human
cacucuccauuuaau

SEQ ID NO: 3141008 - RNA, 17 nt, Human
cacucuccauuuaauaa

SEQ ID NO: 3141009 - RNA, 13 nt, Human
caccuccucucac

SEQ ID NO: 3141010 - RNA, 18 nt, Human
caccuccucucacucccc

SEQ ID NO: 3141011 - RNA, 23 nt, Human
cagaaucuaacugguggacaugg

SEQ ID NO: 3141012 - RNA, 16 nt, Human
cagaucuggaauguga

SEQ ID NO: 3141013 - RNA, 19 nt, Human
cagaucugccuaaggacuu

SEQ ID NO: 3141014 - RNA, 20 nt, Human
cagaucugccuaaggacuuc

SEQ ID NO: 3141015 - RNA, 21 nt, Human
cagaucugccuaaggacuucu

SEQ ID NO: 3141016 - RNA, 23 nt, Human
cagaucugccuaaggacuucuuu

SEQ ID NO: 3141017 - RNA, 16 nt, Human
cagaucugccuaagga

SEQ ID NO: 3141018 - RNA, 17 nt, Human
cagaucugccuaaggac

SEQ ID NO: 3141019 - RNA, 14 nt, Human
cagaucugccuaag

SEQ ID NO: 3141020 - RNA, 14 nt, Human
cagaggcuguggcu

SEQ ID NO: 3141021 - RNA, 17 nt, Human
cagaggcuguggcuggu

SEQ ID NO: 3141022 - RNA, 18 nt, Human
cagauucuauccucaucu

SEQ ID NO: 3141023 - RNA, 23 nt, Human
cagauuauucacugauuugacau

SEQ ID NO: 3141024 - RNA, 12 nt, Human
cagauuauucac

SEQ ID NO: 3141025 - RNA, 18 nt, Human
cagauuauucacugauuu

SEQ ID NO: 3141026 - RNA, 13 nt, Human
cagauuuuauuau

SEQ ID NO: 3141027 - RNA, 15 nt, Human
cagauuuuauuaugu

SEQ ID NO: 3141028 - RNA, 16 nt, Human
cagauuuuauuaugua

SEQ ID NO: 3141029 - RNA, 18 nt, Human
cagauuuuauuauguaaa

SEQ ID NO: 3141030 - RNA, 20 nt, Human
cagauuuuauuauguaaauc

SEQ ID NO: 3141031 - RNA, 21 nt, Human
cagauuuuauuauguaaaucc

SEQ ID NO: 3141032 - RNA, 22 nt, Human
cagauuuuauuauguaaauccc

SEQ ID NO: 3141033 - RNA, 17 nt, Human
cagcaaaaauauuuuau

SEQ ID NO: 3141034 - RNA, 14 nt, Human
cagcagauuauuca

SEQ ID NO: 3141035 - RNA, 15 nt, Human
cagcagauuauucac

SEQ ID NO: 3141036 - RNA, 19 nt, Human
cagcagauuauucacugau

SEQ ID NO: 3141037 - RNA, 13 nt, Human
cagcagcagcccu

SEQ ID NO: 3141038 - RNA, 14 nt, Human
cagcagcagcccug

SEQ ID NO: 3141039 - RNA, 15 nt, Human
cagcagcagcccugc

SEQ ID NO: 3141040 - RNA, 16 nt, Human
cagcagcagcccugcc

SEQ ID NO: 3141041 - RNA, 19 nt, Human
cagcagcccugccccacac

SEQ ID NO: 3141042 - RNA, 20 nt, Human
cagcagcccugccccacacc

SEQ ID NO: 3141043 - RNA, 18 nt, Human
cagcuggugcccugcuuu

SEQ ID NO: 3141044 - RNA, 19 nt, Human
cagcuggugcccugcuuuc

SEQ ID NO: 3141045 - RNA, 20 nt, Human
cagcuggugcccugcuuuca

SEQ ID NO: 3141046 - RNA, 21 nt, Human
cagcuggugcccugcuuucag

SEQ ID NO: 3141047 - RNA, 23 nt, Human
cagcuggugcccugcuuucagau

SEQ ID NO: 3141048 - RNA, 19 nt, Human
caggacgcugaccguggag

SEQ ID NO: 3141049 - RNA, 17 nt, Human
caggaauggagccugca

SEQ ID NO: 3141050 - RNA, 23 nt, Human
caggaauggagccugcacgguga

SEQ ID NO: 3141051 - RNA, 12 nt, Human
cagccugggccc

SEQ ID NO: 3141052 - RNA, 13 nt, Human
cagccugggccca

SEQ ID NO: 3141053 - RNA, 14 nt, Human
cagccugggcccau

SEQ ID NO: 3141054 - RNA, 18 nt, Human
cagccugggcccaucucc

SEQ ID NO: 3141055 - RNA, 21 nt, Human
cagccugggcccaucucccug

SEQ ID NO: 3141056 - RNA, 22 nt, Human
cagccugggcccaucucccugc

SEQ ID NO: 3141057 - RNA, 11 nt, Human
cagccugggcc

SEQ ID NO: 3141058 - RNA, 11 nt, Human
cagcccuagga

SEQ ID NO: 3141059 - RNA, 17 nt, Human
cagcccgcuaggcucgc

SEQ ID NO: 3141060 - RNA, 19 nt, Human
cagcccgcuaggcucgccu

SEQ ID NO: 3141061 - RNA, 20 nt, Human
cagcccugccccacaccucc

SEQ ID NO: 3141062 - RNA, 21 nt, Human
cagcccugccccacaccuccu

SEQ ID NO: 3141063 - RNA, 23 nt, Human
cagcccugccccacaccuccucu

SEQ ID NO: 3141064 - RNA, 14 nt, Human
cagggaagaggggu

SEQ ID NO: 3141065 - RNA, 19 nt, Human
cagggaagaggggugcaga

SEQ ID NO: 3141066 - RNA, 23 nt, Human
cagggaagaggggugcagaggcu

SEQ ID NO: 3141067 - RNA, 17 nt, Human
caggcugacguuccggg

SEQ ID NO: 3141068 - RNA, 18 nt, Human
caggcugacguuccgggc

SEQ ID NO: 3141069 - RNA, 19 nt, Human
caggcugacguuccgggca

SEQ ID NO: 3141070 - RNA, 16 nt, Human
cagugagcgcuugggc

SEQ ID NO: 3141071 - RNA, 14 nt, Human
caguccauugaaag

SEQ ID NO: 3141072 - RNA, 14 nt, Human
caguauaauuaaca

SEQ ID NO: 3141073 - RNA, 15 nt, Human
caguauaauuaacau

SEQ ID NO: 3141074 - RNA, 17 nt, Human
caguauaauuaacaugu

SEQ ID NO: 3141075 - RNA, 21 nt, Human
caguauaauuaacauguuaaa

SEQ ID NO: 3141076 - RNA, 21 nt, Human
caguaaguguuagagggaaca

SEQ ID NO: 3141077 - RNA, 19 nt, Human
cagguggugucgggcccuu

SEQ ID NO: 3141078 - RNA, 20 nt, Human
aaaauuggggauucuuaaag

SEQ ID NO: 3141079 - RNA, 22 nt, Human
cccaaguugggggucagugcug

SEQ ID NO: 3141080 - RNA, 15 nt, Human
cagggaagaggggug

SEQ ID NO: 3141081 - RNA, 13 nt, Human
cguggaggagguu

SEQ ID NO: 3141082 - RNA, 19 nt, Human
uguuagagggaacagggcg

SEQ ID NO: 3141083 - RNA, 23 nt, Human
ccuaggauaaaaagccagggcug

SEQ ID NO: 3141084 - RNA, 19 nt, Human
ccgggcaaaugccagggcc

SEQ ID NO: 3141085 - RNA, 22 nt, Human
aaggaaaaguuuaauauuaaag

SEQ ID NO: 3141086 - RNA, 16 nt, Human
augaugggucaguugu

SEQ ID NO: 3141087 - RNA, 19 nt, Human
auccagagucccugccugg

SEQ ID NO: 3141088 - RNA, 21 nt, Human
auccagagucccugccuggac

SEQ ID NO: 3141089 - RNA, 20 nt, Human
auccagagucccugccugga

SEQ ID NO: 3141090 - RNA, 16 nt, Human
agucugagagaggcca

SEQ ID NO: 3141091 - RNA, 23 nt, Human
agucugagagaggccauucuuuc

SEQ ID NO: 3141092 - RNA, 22 nt, Human
aggaacugcugggcuuggcagc

SEQ ID NO: 3141093 - RNA, 16 nt, Human
aggaaccgaggcaggg

SEQ ID NO: 3141094 - RNA, 16 nt, Human
aggaacugcugggcuu

SEQ ID NO: 3141095 - RNA, 19 nt, Human
agcuaauucuuugaccugu

SEQ ID NO: 3141096 - RNA, 17 nt, Human
agcuccuuaaggcucuu

SEQ ID NO: 3141097 - RNA, 16 nt, Human
agcuccuuaaggcucu

SEQ ID NO: 3141098 - RNA, 10 nt, Human
agagggcugc

SEQ ID NO: 3141099 - RNA, 13 nt, Human
aagggagggggag

SEQ ID NO: 3141100 - RNA, 18 nt, Human
aagagaagggcagggcug

SEQ ID NO: 3141101 - RNA, 19 nt, Human
accggggccugggcaggag

SEQ ID NO: 3141102 - RNA, 14 nt, Human
aauugugauguguc

SEQ ID NO: 3141103 - RNA, 15 nt, Human
aauugugaugugucc

SEQ ID NO: 3141104 - RNA, 11 nt, Human
aauugugaugu

SEQ ID NO: 3141105 - RNA, 23 nt, Human
acagaggacaguauuugugggga

SEQ ID NO: 3141106 - RNA, 14 nt, Human
accaucucuuuacc

SEQ ID NO: 3141107 - RNA, 16 nt, Human
aauuccacacccucac

SEQ ID NO: 3141108 - RNA, 14 nt, Human
uagaagaagugugu

SEQ ID NO: 3141109 - RNA, 21 nt, Human
uagacauuugcuaugagcugg

SEQ ID NO: 3141110 - RNA, 20 nt, Human
uaugccaccugaauaaagaa

SEQ ID NO: 3141111 - RNA, 21 nt, Human
uaugguaggaacugcugggcu

SEQ ID NO: 3141112 - RNA, 14 nt, Human
uaucagcacgugug

SEQ ID NO: 3141113 - RNA, 19 nt, Human
uaauuuaaaauugugaugu

SEQ ID NO: 3141114 - RNA, 20 nt, Human
uaauuuaaaauugugaugug

SEQ ID NO: 3141115 - RNA, 19 nt, Human
uaccagagaaaaagggagg

SEQ ID NO: 3141116 - RNA, 13 nt, Human
uaccucuuggcug

SEQ ID NO: 3141117 - RNA, 15 nt, Human
uacccccugugccuu

SEQ ID NO: 3141118 - RNA, 14 nt, Human
aaggcucuuuugua

SEQ ID NO: 3141119 - RNA, 19 nt, Human
gugggguagguugggagaa

SEQ ID NO: 3141120 - RNA, 14 nt, Human
gugugggucugugu

SEQ ID NO: 3141121 - RNA, 20 nt, Human
gugugucacccuuaggccag

SEQ ID NO: 3141122 - RNA, 13 nt, Human
guguguauguggg

SEQ ID NO: 3141123 - RNA, 15 nt, Human
guguguauguggggg

SEQ ID NO: 3141124 - RNA, 22 nt, Human
guggccuaaccugccgagaguc

SEQ ID NO: 3141125 - RNA, 21 nt, Human
guggccuaaccugccgagagu

SEQ ID NO: 3141126 - RNA, 15 nt, Human
aaauugugauguguc

SEQ ID NO: 3141127 - RNA, 12 nt, Human
aaauugugaugu

SEQ ID NO: 3141128 - RNA, 12 nt, Human
aaauuuauguga

SEQ ID NO: 3141129 - RNA, 15 nt, Human
aaauuuaugugaugg

SEQ ID NO: 3141130 - RNA, 13 nt, Human
gucaguuguauca

SEQ ID NO: 3141131 - RNA, 21 nt, Human
gucaguauguggaaguguggg

SEQ ID NO: 3141132 - RNA, 17 nt, Human
gucaguauguggaagug

SEQ ID NO: 3141133 - RNA, 19 nt, Human
gucuggcacagccuggcug

SEQ ID NO: 3141134 - RNA, 17 nt, Human
gucuggcacagccuggc

SEQ ID NO: 3141135 - RNA, 19 nt, Human
gucucccuccucugcccgg

SEQ ID NO: 3141136 - RNA, 22 nt, Human
agagggacuguucuuuuguccc

SEQ ID NO: 3141137 - RNA, 17 nt, Human
agagacgggcccuggug

SEQ ID NO: 3141138 - RNA, 23 nt, Human
ucuuggggaguuuaggguggggg

SEQ ID NO: 3141139 - RNA, 22 nt, Human
ucuuggggaguuuagggugggg

SEQ ID NO: 3141140 - RNA, 22 nt, Human
ucuggcacagccuggcuguggc

SEQ ID NO: 3141141 - RNA, 15 nt, Human
ucuaccucuuggcug

SEQ ID NO: 3141142 - RNA, 20 nt, Human
ucggggagccgggagccuga

SEQ ID NO: 3141143 - RNA, 16 nt, Human
acuggggcaggggccg

SEQ ID NO: 3141144 - RNA, 23 nt, Human
acucgugucuggcacagccuggc

SEQ ID NO: 3141145 - RNA, 22 nt, Human
acucgugucuggcacagccugg

SEQ ID NO: 3141146 - RNA, 13 nt, Human
uccucuccugucu

SEQ ID NO: 3141147 - RNA, 22 nt, Human
uccucugcccgggagcucagga

SEQ ID NO: 3141148 - RNA, 16 nt, Human
uccucugcccgggagc

SEQ ID NO: 3141149 - RNA, 20 nt, Human
uccauccuacccccugugcc

SEQ ID NO: 3141150 - RNA, 16 nt, Human
uccauccuacccccug

SEQ ID NO: 3141151 - RNA, 16 nt, Human
ucaguauguggaagug

SEQ ID NO: 3141152 - RNA, 18 nt, Human
uaugugggggucugugug

SEQ ID NO: 3141153 - RNA, 19 nt, Human
uaugugggggucugugugu

SEQ ID NO: 3141154 - RNA, 20 nt, Human
uaugugggggucuguguguu

SEQ ID NO: 3141155 - RNA, 16 nt, Human
uuagccuuugucccag

SEQ ID NO: 3141156 - RNA, 16 nt, Human
agugugggucugugug

SEQ ID NO: 3141157 - RNA, 17 nt, Human
agugugggucugugugu

SEQ ID NO: 3141158 - RNA, 15 nt, Human
agugugggucugugu

SEQ ID NO: 3141159 - RNA, 19 nt, Human
agugugggucugugugugu

SEQ ID NO: 3141160 - RNA, 23 nt, Human
agugugggucuguguguguguau

SEQ ID NO: 3141161 - RNA, 14 nt, Human
uguuguguguggga

SEQ ID NO: 3141162 - RNA, 15 nt, Human
uguugugugugggag

SEQ ID NO: 3141163 - RNA, 16 nt, Human
uguugugugugggagu

SEQ ID NO: 3141164 - RNA, 19 nt, Human
uguggcacuggggcagggg

SEQ ID NO: 3141165 - RNA, 16 nt, Human
uguguguguguaugug

SEQ ID NO: 3141166 - RNA, 13 nt, Human
uguguguguguau

SEQ ID NO: 3141167 - RNA, 23 nt, Human
agguugggagaaugucaguaugu

SEQ ID NO: 3141168 - RNA, 17 nt, Human
uguaauuuaaaauugug

SEQ ID NO: 3141169 - RNA, 18 nt, Human
uguaauuuaaaauuguga

SEQ ID NO: 3141170 - RNA, 20 nt, Human
uguaauuuaaaauugugaug

SEQ ID NO: 3141171 - RNA, 21 nt, Human
uguaauuuaaaauugugaugu

SEQ ID NO: 3141172 - RNA, 22 nt, Human
uguaauuuaaaauugugaugug

SEQ ID NO: 3141173 - RNA, 14 nt, Human
agucccugccugga

SEQ ID NO: 3141174 - RNA, 21 nt, Human
agucccugccuggaccagccu

SEQ ID NO: 3141175 - RNA, 15 nt, Human
agucccugccuggac

SEQ ID NO: 3141176 - RNA, 23 nt, Human
agucccugccuggaccagccucu

SEQ ID NO: 3141177 - RNA, 22 nt, Human
agucccugccuggaccagccuc

SEQ ID NO: 3141178 - RNA, 19 nt, Human
aguauguggaagugugggu

SEQ ID NO: 3141179 - RNA, 15 nt, Human
aguauguggaagugu

SEQ ID NO: 3141180 - RNA, 17 nt, Human
aguauguggaagugugg

SEQ ID NO: 3141181 - RNA, 22 nt, Human
ugucaguauguggaaguguggg

SEQ ID NO: 3141182 - RNA, 19 nt, Human
ugucaguauguggaagugu

SEQ ID NO: 3141183 - RNA, 20 nt, Human
ugucaguauguggaagugug

SEQ ID NO: 3141184 - RNA, 18 nt, Human
ugucaguauguggaagug

SEQ ID NO: 3141185 - RNA, 14 nt, Human
uggggcugauugua

SEQ ID NO: 3141186 - RNA, 21 nt, Human
ugggguagguugggagaaugu

SEQ ID NO: 3141187 - RNA, 15 nt, Human
ugggguagguuggga

SEQ ID NO: 3141188 - RNA, 19 nt, Human
uggggaguuuagggugggg

SEQ ID NO: 3141189 - RNA, 18 nt, Human
uggggaguuuaggguggg

SEQ ID NO: 3141190 - RNA, 12 nt, Human
ugggucugugug

SEQ ID NO: 3141191 - RNA, 13 nt, Human
ugguaggaacugc

SEQ ID NO: 3141192 - RNA, 20 nt, Human
ugguaggaacugcugggcuu

SEQ ID NO: 3141193 - RNA, 16 nt, Human
agggggagagggcugc

SEQ ID NO: 3141194 - RNA, 15 nt, Human
agggggagagggcug

SEQ ID NO: 3141195 - RNA, 21 nt, Human
agcugggacaccccgacuuuu

SEQ ID NO: 3141196 - RNA, 15 nt, Human
ugcuguagacauuug

SEQ ID NO: 3141197 - RNA, 23 nt, Human
ugcuguauccauccauggggcug

SEQ ID NO: 3141198 - RNA, 19 nt, Human
aggaucccaugagcuccuu

SEQ ID NO: 3141199 - RNA, 12 nt, Human
aggacaguauuu

SEQ ID NO: 3141200 - RNA, 19 nt, Human
aggacaguauuugugggga

SEQ ID NO: 3141201 - RNA, 23 nt, Human
uggccaguggcuggaucugugag

SEQ ID NO: 3141202 - RNA, 21 nt, Human
uggccuguucuucuauggguu

SEQ ID NO: 3141203 - RNA, 20 nt, Human
agcucaggaaccgaggcagg

SEQ ID NO: 3141204 - RNA, 22 nt, Human
agcucaggaaccgaggcaggga

SEQ ID NO: 3141205 - RNA, 21 nt, Human
agcucaggaaccgaggcaggg

SEQ ID NO: 3141206 - RNA, 18 nt, Human
agccugacccucaucuuu

SEQ ID NO: 3141207 - RNA, 17 nt, Human
agcauuucccuuccuuc

SEQ ID NO: 3141208 - RNA, 21 nt, Human
ugauagaaggcuauggggaua

SEQ ID NO: 3141209 - RNA, 24 nt, Human
ugauaagcagucauccucagauca

SEQ ID NO: 3141210 - RNA, 18 nt, Human
ugaguucauaaauuuaug

SEQ ID NO: 3141211 - RNA, 15 nt, Human
uucuaguucugccag

SEQ ID NO: 3141212 - RNA, 11 nt, Human
uuuaugugugu

SEQ ID NO: 3141213 - RNA, 13 nt, Human
uuuaugugugugu

SEQ ID NO: 3141214 - RNA, 12 nt, Human
uuuaugugaugg

SEQ ID NO: 3141215 - RNA, 16 nt, Human
auggccugggggaugu

SEQ ID NO: 3141216 - RNA, 21 nt, Human
auggaaugaugggucaguugu

SEQ ID NO: 3141217 - RNA, 16 nt, Human
aucuguaccucugccu

SEQ ID NO: 3141218 - RNA, 20 nt, Human
aucugagaggccacagugca

SEQ ID NO: 3141219 - RNA, 17 nt, Human
uuuguaaauuuauguga

SEQ ID NO: 3141220 - RNA, 19 nt, Human
uuugcuaugagcuggggau

SEQ ID NO: 3141221 - RNA, 14 nt, Human
augucaguaugugg

SEQ ID NO: 3141222 - RNA, 13 nt, Human
augucaguaugug

SEQ ID NO: 3141223 - RNA, 15 nt, Human
auguuuacagaggac

SEQ ID NO: 3141224 - RNA, 17 nt, Human
auguuuacagaggacag

SEQ ID NO: 3141225 - RNA, 19 nt, Human
auguuuacagaggacagua

SEQ ID NO: 3141226 - RNA, 19 nt, Human
auuuaaaauugugaugugu

SEQ ID NO: 3141227 - RNA, 20 nt, Human
auuuaaaauugugauguguc

SEQ ID NO: 3141228 - RNA, 23 nt, Human
auugcaggagucccugccaucau

SEQ ID NO: 3141229 - RNA, 18 nt, Human
cuuauuggcagcucuacu

SEQ ID NO: 3141230 - RNA, 17 nt, Human
cuggggaugucucucau

SEQ ID NO: 3141231 - RNA, 22 nt, Human
cuggggaugucucucaugacca

SEQ ID NO: 3141232 - RNA, 23 nt, Human
cugccaucauguuuacagaggac

SEQ ID NO: 3141233 - RNA, 17 nt, Human
cugccaucauguuuaca

SEQ ID NO: 3141234 - RNA, 22 nt, Human
cugccaucauguuuacagagga

SEQ ID NO: 3141235 - RNA, 19 nt, Human
gcaccggggccugggcagg

SEQ ID NO: 3141236 - RNA, 20 nt, Human
gcaccggggccugggcagga

SEQ ID NO: 3141237 - RNA, 16 nt, Human
gaucccaacacugcca

SEQ ID NO: 3141238 - RNA, 12 nt, Human
gaucccaacacu

SEQ ID NO: 3141239 - RNA, 13 nt, Human
gaguuggcuggga

SEQ ID NO: 3141240 - RNA, 15 nt, Human
gaguuuagggugggg

SEQ ID NO: 3141241 - RNA, 14 nt, Human
gaguuuaggguggg

SEQ ID NO: 3141242 - RNA, 18 nt, Human
gagugaggaugucugggc

SEQ ID NO: 3141243 - RNA, 16 nt, Human
gaguccaucagccucc

SEQ ID NO: 3141244 - RNA, 15 nt, Human
gaguccaucagccuc

SEQ ID NO: 3141245 - RNA, 14 nt, Human
gaguccaucagccu

SEQ ID NO: 3141246 - RNA, 13 nt, Human
gaguccaucagcc

SEQ ID NO: 3141247 - RNA, 19 nt, Human
gaagggcagggcugaggcc

SEQ ID NO: 3141248 - RNA, 15 nt, Human
gaaggcuauggggau

SEQ ID NO: 3141249 - RNA, 19 nt, Human
gaagugugggucugugugu

SEQ ID NO: 3141250 - RNA, 17 nt, Human
gaagugugggucugugu

SEQ ID NO: 3141251 - RNA, 18 nt, Human
gaagugugggucugugug

SEQ ID NO: 3141252 - RNA, 16 nt, Human
gacagguuagcugcuc

SEQ ID NO: 3141253 - RNA, 15 nt, Human
gacaguauuuguggg

SEQ ID NO: 3141254 - RNA, 19 nt, Human
gagcuggggaugucucuca

SEQ ID NO: 3141255 - RNA, 16 nt, Human
guaaauuuaugugaug

SEQ ID NO: 3141256 - RNA, 17 nt, Human
guaaauuuaugugaugg

SEQ ID NO: 3141257 - RNA, 21 nt, Human
gguggggagagacgggcccug

SEQ ID NO: 3141258 - RNA, 21 nt, Human
ggugcuucuaguucugccagg

SEQ ID NO: 3141259 - RNA, 20 nt, Human
ggucuguguguguguaugug

SEQ ID NO: 3141260 - RNA, 21 nt, Human
ggucuguguguguguaugugg

SEQ ID NO: 3141261 - RNA, 11 nt, Human
ggucugugugu

SEQ ID NO: 3141262 - RNA, 17 nt, Human
ggucuguguguguguau

SEQ ID NO: 3141263 - RNA, 23 nt, Human
ggguguccugcaccggggccugg

SEQ ID NO: 3141264 - RNA, 22 nt, Human
gggcccuggugguggcucggga

SEQ ID NO: 3141265 - RNA, 18 nt, Human
gggcucagagugggguag

SEQ ID NO: 3141266 - RNA, 14 nt, Human
aaaagggaggggga

SEQ ID NO: 3141267 - RNA, 14 nt, Human
gggaugucucucau

SEQ ID NO: 3141268 - RNA, 22 nt, Human
gggagaaugucaguauguggaa

SEQ ID NO: 3141269 - RNA, 19 nt, Human
gggagaaugucaguaugug

SEQ ID NO: 3141270 - RNA, 22 nt, Human
ggcauccagagucccugccugg

SEQ ID NO: 3141271 - RNA, 15 nt, Human
ggcacuggggcaggg

SEQ ID NO: 3141272 - RNA, 19 nt, Human
ggccaguggcuggaucugu

SEQ ID NO: 3141273 - RNA, 17 nt, Human
ggcccugugccuuggug

SEQ ID NO: 3141274 - RNA, 22 nt, Human
ggcgaagcguuguccucagccc

SEQ ID NO: 3141275 - RNA, 12 nt, Human
ggcacagccugg

SEQ ID NO: 3141276 - RNA, 13 nt, Human
ggcacagccuggc

SEQ ID NO: 3141277 - RNA, 14 nt, Human
ggaacugcugggcu

SEQ ID NO: 3141278 - RNA, 15 nt, Human
ggaacugcugggcuu

SEQ ID NO: 3141279 - RNA, 20 nt, Human
gcuguagacauuugcuauga

SEQ ID NO: 3141280 - RNA, 13 nt, Human
gcuggaucuguga

SEQ ID NO: 3141281 - RNA, 19 nt, Human
gcuuuccucaucaggccau

SEQ ID NO: 3141282 - RNA, 18 nt, Human
gcuccucgagaucccaac

SEQ ID NO: 3141283 - RNA, 14 nt, Human
gcugaggccucuca

SEQ ID NO: 3141284 - RNA, 22 nt, Human
gcugcuccccacgucagcuggg

SEQ ID NO: 3141285 - RNA, 13 nt, Human
gcugcuccccacg

SEQ ID NO: 3141286 - RNA, 14 nt, Human
gccaguggcuggau

SEQ ID NO: 3141287 - RNA, 23 nt, Human
gccaguggcuggaucugugaggg

SEQ ID NO: 3141288 - RNA, 14 nt, Human
gccaggauggaaug

SEQ ID NO: 3141289 - RNA, 14 nt, Human
gcggcugggaggag

SEQ ID NO: 3141290 - RNA, 13 nt, Human
gcggcugggagga

SEQ ID NO: 3141291 - RNA, 22 nt, Human
gcggcugggaggagggcaggca

SEQ ID NO: 3141292 - RNA, 19 nt, Human
gcggcugggaggagggcag

SEQ ID NO: 3141293 - RNA, 18 nt, Human
gcggcugggaggagggca

SEQ ID NO: 3141294 - RNA, 17 nt, Human
gcggcugggaggagggc

SEQ ID NO: 3141295 - RNA, 15 nt, Human
caguauuugugggga

SEQ ID NO: 3141296 - RNA, 23 nt, Human
cagaucauuaucagccugugcca

SEQ ID NO: 3141297 - RNA, 24 nt, Human
cagccucuccacucaugugacucu

SEQ ID NO: 3141298 - RNA, 24 nt, Human
cagccccgcguggaacucgugucu

SEQ ID NO: 3141299 - RNA, 15 nt, Human
caaacaggcucagag

SEQ ID NO: 3141300 - RNA, 14 nt, Human
caaacaggcucaga

SEQ ID NO: 3141301 - RNA, 22 nt, Human
auuuguggggagggauuugggg

SEQ ID NO: 3141302 - RNA, 16 nt, Human
auuugcuaugagcugg

SEQ ID NO: 3141303 - RNA, 20 nt, Human
auuugcuaugagcuggggau

SEQ ID NO: 3141304 - RNA, 19 nt, Human
auucuuucccaacaccucu

SEQ ID NO: 3141305 - RNA, 16 nt, Human
auucuuucccaacacc

SEQ ID NO: 3141306 - RNA, 13 nt, Human
auucuuucccaac

SEQ ID NO: 3141307 - RNA, 22 nt, Human
cacugccagcauuucccuuccu

SEQ ID NO: 3141308 - RNA, 18 nt, Human
cacugccagcauuucccu

SEQ ID NO: 3141309 - RNA, 19 nt, Human
cacuggggcaggggccggg

SEQ ID NO: 3141310 - RNA, 24 nt, Human
cccugugccuuggugugcuguauc

SEQ ID NO: 3141311 - RNA, 15 nt, Human
cccugugccuuguca

SEQ ID NO: 3141312 - RNA, 22 nt, Human
cccugugccuugucacgccaga

SEQ ID NO: 3141313 - RNA, 20 nt, Human
cccugugccuugucacgcca

SEQ ID NO: 3141314 - RNA, 22 nt, Human
ccugacccucaucuuucuucca

SEQ ID NO: 3141315 - RNA, 14 nt, Human
ccugacucucagca

SEQ ID NO: 3141316 - RNA, 16 nt, Human
ccagagucccugccug

SEQ ID NO: 3141317 - RNA, 22 nt, Human
ccagagucccugccuggaccag

SEQ ID NO: 3141318 - RNA, 19 nt, Human
ccagagucccugccuggac

SEQ ID NO: 3141319 - RNA, 18 nt, Human
ccagagucccugccugga

SEQ ID NO: 3141320 - RNA, 17 nt, Human
ccagagucccugccugg

SEQ ID NO: 3141321 - RNA, 14 nt, Human
cccgggagcucagg

SEQ ID NO: 3141322 - RNA, 14 nt, Human
ccccgacuuuuguu

SEQ ID NO: 3141323 - RNA, 23 nt, Human
cggcuccucgagaucccaacacu

SEQ ID NO: 3141324 - RNA, 21 nt, Human
cgugucuggcacagccuggcu

SEQ ID NO: 3141325 - RNA, 13 nt, Human
cgugucuggcaca

SEQ ID NO: 3141326 - RNA, 14 nt, Human
cgugucuggcacag

SEQ ID NO: 3141327 - RNA, 12 nt, Human
cuaaccugccga

SEQ ID NO: 3141328 - RNA, 21 nt, Human
cuaaccugccgagaguccauc

SEQ ID NO: 3141329 - RNA, 19 nt, Human
cuaaccugccgagagucca

SEQ ID NO: 3141330 - RNA, 16 nt, Human
cucaucuuucuuccaa

SEQ ID NO: 3141331 - RNA, 13 nt, Human
cucccuccucugc

SEQ ID NO: 3141332 - RNA, 14 nt, Human
cucccuccucugcc

SEQ ID NO: 3141333 - RNA, 17 nt, Human
caagccuuggcucuacc

SEQ ID NO: 3141334 - RNA, 15 nt, Human
ccggggccugggcag

SEQ ID NO: 3141335 - RNA, 19 nt, Human
ccggggccugggcaggagg

SEQ ID NO: 3141336 - RNA, 15 nt, Human
ccgggagcucaggaa

SEQ ID NO: 3141337 - RNA, 13 nt, Human
ccgggagcucagg

SEQ ID NO: 3141338 - RNA, 16 nt, Human
ccggcuuuguggcacu

SEQ ID NO: 3141339 - RNA, 19 nt, Human
ccggcuuuguggcacuggg

SEQ ID NO: 3141340 - RNA, 17 nt, Human
ccggcuuuguggcacug

SEQ ID NO: 3141341 - RNA, 18 nt, Human
ccucagccccgcguggaa

SEQ ID NO: 3141342 - RNA, 23 nt, Human
ccuccauccuacccccugugccu

SEQ ID NO: 3141343 - RNA, 22 nt, Human
ccuccauccuacccccugugcc

SEQ ID NO: 3141344 - RNA, 17 nt, Human
ccuccauccuacccccu

SEQ ID NO: 3141345 - RNA, 18 nt, Human
cccugccuggaccagccu

SEQ ID NO: 3141346 - RNA, 13 nt, Human
cccugccuggacc

SEQ ID NO: 3141347 - RNA, 12 nt, Human
cccugccuggac

SEQ ID NO: 3141348 - RNA, 20 nt, Human
cccugccaucauguuuacag

SEQ ID NO: 3141349 - RNA, 14 nt, Human
cccucaucuuucuu

SEQ ID NO: 3141350 - RNA, 18 nt, Human
cccagaaugccuccugca

SEQ ID NO: 3141351 - RNA, 21 nt, Human
cccagcuaugguucucucgca

SEQ ID NO: 3141352 - RNA, 20 nt, Human
ccaucauguuuacagaggac

SEQ ID NO: 3141353 - RNA, 22 nt, Human
ccaucauguuuacagaggacag

SEQ ID NO: 3141354 - RNA, 21 nt, Human
cauuaccucagugagaagcca

SEQ ID NO: 3141355 - RNA, 22 nt, Human
cauuaccucagugagaagccag

SEQ ID NO: 3141356 - RNA, 19 nt, Human
cauggggcugauuguauuu

SEQ ID NO: 3141357 - RNA, 15 nt, Human
cauaccuggcccugu

SEQ ID NO: 3141358 - RNA, 18 nt, Human
cauaaucacaacccuuca

SEQ ID NO: 3141359 - RNA, 18 nt, Human
caguggcuggaucuguga

SEQ ID NO: 3141360 - RNA, 20 nt, Human
caguggcuggaucugugagg

SEQ ID NO: 3141361 - RNA, 16 nt, Human
caguggcuggaucugu

SEQ ID NO: 3141362 - RNA, 19 nt, Human
cauccuacccccugugccu

SEQ ID NO: 3141363 - RNA, 15 nt, Human
gcccgggagcucagg

SEQ ID NO: 3141364 - RNA, 19 nt, Human
gcccgggagcucaggaacc

SEQ ID NO: 3141365 - RNA, 17 nt, Human
gcccgggagcucaggaa

SEQ ID NO: 3141366 - RNA, 17 nt, Human
gccaucauguuuacaga

SEQ ID NO: 3141367 - RNA, 21 nt, Human
gccaucauguuuacagaggac

SEQ ID NO: 3141368 - RNA, 19 nt, Human
gccucucauuccagaggaa

SEQ ID NO: 3141369 - RNA, 24 nt, Human
gccucuccacucaugugacucuuu

SEQ ID NO: 3141370 - RNA, 20 nt, Human
gccucucauuccagaggaag

SEQ ID NO: 3141371 - RNA, 21 nt, Human
gccucuccacucaugugacuc

SEQ ID NO: 3141372 - RNA, 17 nt, Human
gccugacccucaucuuu

SEQ ID NO: 3141373 - RNA, 12 nt, Human
gcgcggcuggga

SEQ ID NO: 3141374 - RNA, 18 nt, Human
gcgcggcugggaggaggg

SEQ ID NO: 3141375 - RNA, 18 nt, Human
gccuuuggacuugucccg

SEQ ID NO: 3141376 - RNA, 20 nt, Human
gcaggggccgggggcagucu

SEQ ID NO: 3141377 - RNA, 19 nt, Human
gcaggggccgggggcaguc

SEQ ID NO: 3141378 - RNA, 18 nt, Human
gcauuauauuuguaaauu

SEQ ID NO: 3141379 - RNA, 20 nt, Human
gauuuggggcucagaguggg

SEQ ID NO: 3141380 - RNA, 20 nt, Human
gauggcaaagaaggagagca

SEQ ID NO: 3141381 - RNA, 21 nt, Human
gaucugugaggggcucucuca

SEQ ID NO: 3141382 - RNA, 14 nt, Human
gaucauuaucagcc

SEQ ID NO: 3141383 - RNA, 15 nt, Human
gaucccaugagcucc

SEQ ID NO: 3141384 - RNA, 17 nt, Human
gaucccaugagcuccuu

SEQ ID NO: 3141385 - RNA, 13 nt, Human
gauagaugugugg

SEQ ID NO: 3141386 - RNA, 20 nt, Human
gagcuccuuaaggcucuuuu

SEQ ID NO: 3141387 - RNA, 20 nt, Human
gagcucaggaaccgaggcag

SEQ ID NO: 3141388 - RNA, 21 nt, Human
gagcucaggaaccgaggcagg

SEQ ID NO: 3141389 - RNA, 21 nt, Human
gagccugacccucaucuuucu

SEQ ID NO: 3141390 - RNA, 18 nt, Human
gacuugucccgggacacc

SEQ ID NO: 3141391 - RNA, 22 nt, Human
gagaagccagcuuuccucauca

SEQ ID NO: 3141392 - RNA, 21 nt, Human
gagagaggccauucuuuccca

SEQ ID NO: 3141393 - RNA, 13 nt, Human
gagagaggccauu

SEQ ID NO: 3141394 - RNA, 20 nt, Human
gacaccuaggcuaggguggg

SEQ ID NO: 3141395 - RNA, 16 nt, Human
gacaccuaggcuaggg

SEQ ID NO: 3141396 - RNA, 15 nt, Human
gacaccuaggcuagg

SEQ ID NO: 3141397 - RNA, 17 nt, Human
gaccuuuccugaggaag

SEQ ID NO: 3141398 - RNA, 21 nt, Human
cuuggggaguuuagggugggg

SEQ ID NO: 3141399 - RNA, 20 nt, Human
cuuggggaguuuaggguggg

SEQ ID NO: 3141400 - RNA, 23 nt, Human
cuugucacgccagacuucccacg

SEQ ID NO: 3141401 - RNA, 18 nt, Human
cuugucacgccagacuuc

SEQ ID NO: 3141402 - RNA, 12 nt, Human
cuuuggacuugu

SEQ ID NO: 3141403 - RNA, 13 nt, Human
cuuucuuccaaac

SEQ ID NO: 3141404 - RNA, 19 nt, Human
cuuucuuccaaacaggcuc

SEQ ID NO: 3141405 - RNA, 21 nt, Human
gaaggaucccaugagcuccuu

SEQ ID NO: 3141406 - RNA, 13 nt, Human
gaagaaguguguc

SEQ ID NO: 3141407 - RNA, 18 nt, Human
cugcccgggagcucagga

SEQ ID NO: 3141408 - RNA, 19 nt, Human
cugcccgggagcucaggaa

SEQ ID NO: 3141409 - RNA, 11 nt, Human
cugccaggaga

SEQ ID NO: 3141410 - RNA, 19 nt, Human
cugggaggagggcaggcau

SEQ ID NO: 3141411 - RNA, 18 nt, Human
cuggcuguggccuaaccu

SEQ ID NO: 3141412 - RNA, 23 nt, Human
cuggcacagccuggcuguggccu

SEQ ID NO: 3141413 - RNA, 15 nt, Human
cuggcacagccuggc

SEQ ID NO: 3141414 - RNA, 21 nt, Human
cuggcacagccuggcuguggc

SEQ ID NO: 3141415 - RNA, 16 nt, Human
cuggcacagccuggcu

SEQ ID NO: 3141416 - RNA, 14 nt, Human
cuguaccucugccu

SEQ ID NO: 3141417 - RNA, 17 nt, Human
cuccucgagaucccaac

SEQ ID NO: 3141418 - RNA, 24 nt, Human
cuccucgagaucccaacacugcca

SEQ ID NO: 3141419 - RNA, 21 nt, Human
cuccucgagaucccaacacug

SEQ ID NO: 3141420 - RNA, 18 nt, Human
cuccauccuacccccugu

SEQ ID NO: 3141421 - RNA, 23 nt, Human
cuccauccuacccccugugccuu

SEQ ID NO: 3141422 - RNA, 22 nt, Human
cuccauccuacccccugugccu

SEQ ID NO: 3141423 - RNA, 20 nt, Human
cuccauccuacccccugugc

SEQ ID NO: 3141424 - RNA, 17 nt, Human
cucuccugucucccucc

SEQ ID NO: 3141425 - RNA, 15 nt, Human
cucuccugucucccu

SEQ ID NO: 3141426 - RNA, 18 nt, Human
cucuccugucucccuccu

SEQ ID NO: 3141427 - RNA, 21 nt, Human
cucuccacucaugugacucuu

SEQ ID NO: 3141428 - RNA, 22 nt, Human
cucuccacucaugugacucuuu

SEQ ID NO: 3141429 - RNA, 21 nt, Human
cucuuggggaguuuagggugg

SEQ ID NO: 3141430 - RNA, 23 nt, Human
cucuuggggaguuuagggugggg

SEQ ID NO: 3141431 - RNA, 12 nt, Human
cggcugggagga

SEQ ID NO: 3141432 - RNA, 17 nt, Human
cgggagccugacccuca

SEQ ID NO: 3141433 - RNA, 17 nt, Human
cgggggcagucugagag

SEQ ID NO: 3141434 - RNA, 21 nt, Human
cgggggcagucugagagaggc

SEQ ID NO: 3141435 - RNA, 18 nt, Human
cgggggcagucugagaga

SEQ ID NO: 3141436 - RNA, 17 nt, Human
cggggccugggcaggag

SEQ ID NO: 3141437 - RNA, 19 nt, Human
cggggccugggcaggaggg

SEQ ID NO: 3141438 - RNA, 22 nt, Human
cgggucaucuguaccucugccu

SEQ ID NO: 3141439 - RNA, 15 nt, Human
cgggucaucuguacc

SEQ ID NO: 3141440 - RNA, 23 nt, Human
cguggcuguggcauccagagucc

SEQ ID NO: 3141441 - RNA, 16 nt, Human
cguuguccucagcccc

SEQ ID NO: 3141442 - RNA, 14 nt, Human
cuacccccugugcc

SEQ ID NO: 3141443 - RNA, 13 nt, Human
cuacccccugugc

SEQ ID NO: 3141444 - RNA, 16 nt, Human
gucccugaagagaagg

SEQ ID NO: 3141445 - RNA, 22 nt, Human
gucagcugggacaccccgacuu

SEQ ID NO: 3141446 - RNA, 19 nt, Human
guagugauuuuuaugccac

SEQ ID NO: 3141447 - RNA, 14 nt, Human
guagguugggagaa

SEQ ID NO: 3141448 - RNA, 21 nt, Human
gugauuuuuaugccaccugaa

SEQ ID NO: 3141449 - RNA, 14 nt, Human
gugccuuuugccau

SEQ ID NO: 3141450 - RNA, 21 nt, Human
gugccaggauggaaugauggg

SEQ ID NO: 3141451 - RNA, 21 nt, Human
gugacuauggagcugagcagg

SEQ ID NO: 3141452 - RNA, 11 nt, Human
gucugugugug

SEQ ID NO: 3141453 - RNA, 12 nt, Human
gucugugugugu

SEQ ID NO: 3141454 - RNA, 16 nt, Human
gucuguguguguguau

SEQ ID NO: 3141455 - RNA, 20 nt, Human
gucuguguguguguaugugg

SEQ ID NO: 3141456 - RNA, 11 nt, Human
gucuguguguu

SEQ ID NO: 3141457 - RNA, 21 nt, Human
gucuguguguuuaugugugug

SEQ ID NO: 3141458 - RNA, 22 nt, Human
gucuguguguuuaugugugugu

SEQ ID NO: 3141459 - RNA, 18 nt, Human
gucugagagaggccauuc

SEQ ID NO: 3141460 - RNA, 15 nt, Human
gucugagagaggcca

SEQ ID NO: 3141461 - RNA, 14 nt, Human
gucugagagaggcc

SEQ ID NO: 3141462 - RNA, 13 nt, Human
gucugagagaggc

SEQ ID NO: 3141463 - RNA, 13 nt, Human
gucccugccugga

SEQ ID NO: 3141464 - RNA, 12 nt, Human
guucugccagga

SEQ ID NO: 3141465 - RNA, 14 nt, Human
guucugccaggaga

SEQ ID NO: 3141466 - RNA, 13 nt, Human
guucugccaggag

SEQ ID NO: 3141467 - RNA, 21 nt, Human
guguccugcaccggggccugg

SEQ ID NO: 3141468 - RNA, 17 nt, Human
gugucuggcacagccug

SEQ ID NO: 3141469 - RNA, 17 nt, Human
gugugggaguguguaau

SEQ ID NO: 3141470 - RNA, 16 nt, Human
guguguuuaugugugu

SEQ ID NO: 3141471 - RNA, 14 nt, Human
guguguuuaugugu

SEQ ID NO: 3141472 - RNA, 15 nt, Human
guguguuuaugugug

SEQ ID NO: 3141473 - RNA, 12 nt, Human
guguguugugug

SEQ ID NO: 3141474 - RNA, 14 nt, Human
guguguugugugug

SEQ ID NO: 3141475 - RNA, 17 nt, Human
guguguuguguguggga

SEQ ID NO: 3141476 - RNA, 17 nt, Human
guggcuggaucugugag

SEQ ID NO: 3141477 - RNA, 21 nt, Human
guggggagagacgggcccugg

SEQ ID NO: 3141478 - RNA, 22 nt, Human
guguaauuuaaaauugugaugu

SEQ ID NO: 3141479 - RNA, 23 nt, Human
guguaauuuaaaauugugaugug

SEQ ID NO: 3141480 - RNA, 20 nt, Human
guguaauuuaaaauugugau

SEQ ID NO: 3141481 - RNA, 22 nt, Human
uauaaacaugcuugcauuauau

SEQ ID NO: 3141482 - RNA, 20 nt, Human
uauauuuguaaauuuaugug

SEQ ID NO: 3141483 - RNA, 16 nt, Human
guuuagaagaagugug

SEQ ID NO: 3141484 - RNA, 12 nt, Human
guuguguguggg

SEQ ID NO: 3141485 - RNA, 13 nt, Human
guuguguguggga

SEQ ID NO: 3141486 - RNA, 14 nt, Human
guugugugugggag

SEQ ID NO: 3141487 - RNA, 16 nt, Human
guugugugugggagug

SEQ ID NO: 3141488 - RNA, 22 nt, Human
guugugugugggaguguguaau

SEQ ID NO: 3141489 - RNA, 23 nt, Human
guuguccucagccccgcguggaa

SEQ ID NO: 3141490 - RNA, 17 nt, Human
guuguccucagccccgc

SEQ ID NO: 3141491 - RNA, 13 nt, Human
uaaauuuauguga

SEQ ID NO: 3141492 - RNA, 22 nt, Human
uaagugccaggauggaaugaug

SEQ ID NO: 3141493 - RNA, 11 nt, Human
uguguaugugg

SEQ ID NO: 3141494 - RNA, 12 nt, Human
uguguauguggg

SEQ ID NO: 3141495 - RNA, 14 nt, Human
ugugugggagugug

SEQ ID NO: 3141496 - RNA, 15 nt, Human
ugugugggagugugu

SEQ ID NO: 3141497 - RNA, 16 nt, Human
ugugugggagugugua

SEQ ID NO: 3141498 - RNA, 16 nt, Human
uguucuuuugucccag

SEQ ID NO: 3141499 - RNA, 11 nt, Human
uguguaauuua

SEQ ID NO: 3141500 - RNA, 18 nt, Human
uguguaauuuaaaauugu

SEQ ID NO: 3141501 - RNA, 19 nt, Human
uguguaauuuaaaauugug

SEQ ID NO: 3141502 - RNA, 22 nt, Human
uguguaauuuaaaauugugaug

SEQ ID NO: 3141503 - RNA, 23 nt, Human
uguguaauuuaaaauugugaugu

SEQ ID NO: 3141504 - RNA, 14 nt, Human
ugugggagugugua

SEQ ID NO: 3141505 - RNA, 15 nt, Human
ugugggaguguguaa

SEQ ID NO: 3141506 - RNA, 15 nt, Human
uguggaagugugggu

SEQ ID NO: 3141507 - RNA, 15 nt, Human
uguggccuaaccugc

SEQ ID NO: 3141508 - RNA, 16 nt, Human
ugugccuuuugccauc

SEQ ID NO: 3141509 - RNA, 20 nt, Human
ugugccuugucacgccagac

SEQ ID NO: 3141510 - RNA, 19 nt, Human
ugugccuugucacgccaga

SEQ ID NO: 3141511 - RNA, 17 nt, Human
ugugccuuggugugcug

SEQ ID NO: 3141512 - RNA, 17 nt, Human
ugugccuugucacgcca

SEQ ID NO: 3141513 - RNA, 17 nt, Human
ugucuggcacagccugg

SEQ ID NO: 3141514 - RNA, 22 nt, Human
ugucacccuuaggccagcacca

SEQ ID NO: 3141515 - RNA, 21 nt, Human
uguccucagccccgcguggaa

SEQ ID NO: 3141516 - RNA, 14 nt, Human
uguaccucugccuc

SEQ ID NO: 3141517 - RNA, 12 nt, Human
ugcaccggggcc

SEQ ID NO: 3141518 - RNA, 22 nt, Human
ugcaccggggccugggcaggag

SEQ ID NO: 3141519 - RNA, 16 nt, Human
ugcaccggggccuggg

SEQ ID NO: 3141520 - RNA, 18 nt, Human
ugccaggauggaaugaug

SEQ ID NO: 3141521 - RNA, 21 nt, Human
ugggagugaggaugucugggc

SEQ ID NO: 3141522 - RNA, 21 nt, Human
ugggacaccccgacuuuuguu

SEQ ID NO: 3141523 - RNA, 18 nt, Human
ugggggucuguguguuua

SEQ ID NO: 3141524 - RNA, 15 nt, Human
ugggggucugugugu

SEQ ID NO: 3141525 - RNA, 11 nt, Human
ugggggaugua

SEQ ID NO: 3141526 - RNA, 18 nt, Human
uggaacucgugucuggca

SEQ ID NO: 3141527 - RNA, 20 nt, Human
uggaaugaugggucaguugu

SEQ ID NO: 3141528 - RNA, 23 nt, Human
uccucgagaucccaacacugcca

SEQ ID NO: 3141529 - RNA, 16 nt, Human
uccucgagaucccaac

SEQ ID NO: 3141530 - RNA, 23 nt, Human
ucccaugagcuccuuaaggcucu

SEQ ID NO: 3141531 - RNA, 19 nt, Human
uccugucccucauccauag

SEQ ID NO: 3141532 - RNA, 20 nt, Human
ucagaucauuaucagccugu

SEQ ID NO: 3141533 - RNA, 23 nt, Human
ucagccuccauccuacccccugu

SEQ ID NO: 3141534 - RNA, 17 nt, Human
ucaucuuucuuccaaac

SEQ ID NO: 3141535 - RNA, 14 nt, Human
ucaucuuucuucca

SEQ ID NO: 3141536 - RNA, 12 nt, Human
ucaucuuucuuc

SEQ ID NO: 3141537 - RNA, 16 nt, Human
ucccaacacugccagc

SEQ ID NO: 3141538 - RNA, 15 nt, Human
ucccaacacugccag

SEQ ID NO: 3141539 - RNA, 14 nt, Human
ucccaacacugcca

SEQ ID NO: 3141540 - RNA, 15 nt, Human
uccagagucccugcc

SEQ ID NO: 3141541 - RNA, 22 nt, Human
ucuucauuaccucagugagaag

SEQ ID NO: 3141542 - RNA, 11 nt, Human
ucugugugugu

SEQ ID NO: 3141543 - RNA, 19 nt, Human
ucuuuccaaccggcuuugu

SEQ ID NO: 3141544 - RNA, 16 nt, Human
ugacucuuuccaaccg

SEQ ID NO: 3141545 - RNA, 14 nt, Human
ugacucuuuccaac

SEQ ID NO: 3141546 - RNA, 13 nt, Human
ugacucuuuccaa

SEQ ID NO: 3141547 - RNA, 19 nt, Human
ugacucuuuccaaccggcu

SEQ ID NO: 3141548 - RNA, 20 nt, Human
ugaagagaagggcagggcug

SEQ ID NO: 3141549 - RNA, 22 nt, Human
ugaagagaagggcagggcugag

SEQ ID NO: 3141550 - RNA, 13 nt, Human
aggaugucugggc

SEQ ID NO: 3141551 - RNA, 15 nt, Human
aggagggcaggcauc

SEQ ID NO: 3141552 - RNA, 13 nt, Human
aggagggcaggca

SEQ ID NO: 3141553 - RNA, 15 nt, Human
aggagggaggugcuu

SEQ ID NO: 3141554 - RNA, 20 nt, Human
aggagacagguuagcugcuc

SEQ ID NO: 3141555 - RNA, 19 nt, Human
aggcaucggggagccggga

SEQ ID NO: 3141556 - RNA, 22 nt, Human
agggauuuggggcucagagugg

SEQ ID NO: 3141557 - RNA, 19 nt, Human
aggcuaggguggggagaga

SEQ ID NO: 3141558 - RNA, 16 nt, Human
aggcuaggguggggag

SEQ ID NO: 3141559 - RNA, 15 nt, Human
aggcuagggugggga

SEQ ID NO: 3141560 - RNA, 14 nt, Human
aggcuagggugggg

SEQ ID NO: 3141561 - RNA, 19 nt, Human
agagugggguagguuggga

SEQ ID NO: 3141562 - RNA, 13 nt, Human
agcaucucccagu

SEQ ID NO: 3141563 - RNA, 23 nt, Human
agagaggccauucuuucccaaca

SEQ ID NO: 3141564 - RNA, 22 nt, Human
agagaggccauucuuucccaac

SEQ ID NO: 3141565 - RNA, 12 nt, Human
agagaggccauu

SEQ ID NO: 3141566 - RNA, 13 nt, Human
accggggccuggg

SEQ ID NO: 3141567 - RNA, 14 nt, Human
acccucaucuuucu

SEQ ID NO: 3141568 - RNA, 13 nt, Human
acccucaucuuuc

SEQ ID NO: 3141569 - RNA, 19 nt, Human
acccucaucuuucuuccaa

SEQ ID NO: 3141570 - RNA, 16 nt, Human
acccucaucuuucuuc

SEQ ID NO: 3141571 - RNA, 14 nt, Human
aacaggcucagagg

SEQ ID NO: 3141572 - RNA, 16 nt, Human
cugcaccggggccugg

SEQ ID NO: 3141573 - RNA, 14 nt, Human
cugcaccggggccu

SEQ ID NO: 3141574 - RNA, 19 nt, Human
cugcaccggggccugggca

SEQ ID NO: 3141575 - RNA, 18 nt, Human
cugcaccggggccugggc

SEQ ID NO: 3141576 - RNA, 13 nt, Human
cugggcaggaggg

SEQ ID NO: 3141577 - RNA, 13 nt, Human
cuggcccugugcc

SEQ ID NO: 3141578 - RNA, 14 nt, Human
cuggaucugugagg

SEQ ID NO: 3141579 - RNA, 17 nt, Human
gaacugcugggcuuggc

SEQ ID NO: 3141580 - RNA, 20 nt, Human
gaacugcugggcuuggcagc

SEQ ID NO: 3141581 - RNA, 15 nt, Human
gaaccgaggcaggga

SEQ ID NO: 3141582 - RNA, 12 nt, Human
gaaccgaggcag

SEQ ID NO: 3141583 - RNA, 21 nt, Human
gaagugugggucugugugugu

SEQ ID NO: 3141584 - RNA, 24 nt, Human
gaagugugggucugugugugugua

SEQ ID NO: 3141585 - RNA, 14 nt, Human
gcaccggggccugg

SEQ ID NO: 3141586 - RNA, 16 nt, Human
gcaccggggccugggc

SEQ ID NO: 3141587 - RNA, 23 nt, Human
gaggugcuucuaguucugccagg

SEQ ID NO: 3141588 - RNA, 22 nt, Human
gaggugcuucuaguucugccag

SEQ ID NO: 3141589 - RNA, 18 nt, Human
gagucagggagagcugaa

SEQ ID NO: 3141590 - RNA, 17 nt, Human
gaguccaucagccucca

SEQ ID NO: 3141591 - RNA, 16 nt, Human
gagggcugccuuugga

SEQ ID NO: 3141592 - RNA, 9 nt, Human
gagggcugc

SEQ ID NO: 3141593 - RNA, 23 nt, Human
ggggucuguguguuuaugugugu

SEQ ID NO: 3141594 - RNA, 12 nt, Human
ggggccugggca

SEQ ID NO: 3141595 - RNA, 15 nt, Human
ggggccugggcagga

SEQ ID NO: 3141596 - RNA, 16 nt, Human
aaaauugugauguguc

SEQ ID NO: 3141597 - RNA, 14 nt, Human
gggagggggagagg

SEQ ID NO: 3141598 - RNA, 15 nt, Human
aaaaagggaggggga

SEQ ID NO: 3141599 - RNA, 17 nt, Human
ggcuggaucugugaggg

SEQ ID NO: 3141600 - RNA, 20 nt, Human
ggcuccucgagaucccaaca

SEQ ID NO: 3141601 - RNA, 17 nt, Human
ggagagacgggcccugg

SEQ ID NO: 3141602 - RNA, 15 nt, Human
ggagagacgggcccu

SEQ ID NO: 3141603 - RNA, 13 nt, Human
ggaugucugggcc

SEQ ID NO: 3141604 - RNA, 23 nt, Human
ggcaggcaucggggagccgggag

SEQ ID NO: 3141605 - RNA, 18 nt, Human
ggccagcaccaucucuuu

SEQ ID NO: 3141606 - RNA, 21 nt, Human
gcuauggggauagaugugugg

SEQ ID NO: 3141607 - RNA, 19 nt, Human
gcuauggggauagaugugu

SEQ ID NO: 3141608 - RNA, 14 nt, Human
cucaugugacucuu

SEQ ID NO: 3141609 - RNA, 16 nt, Human
cuccugucucccuccu

SEQ ID NO: 3141610 - RNA, 24 nt, Human
cuccucugcccgggagcucaggaa

SEQ ID NO: 3141611 - RNA, 22 nt, Human
cuccucugcccgggagcucagg

SEQ ID NO: 3141612 - RNA, 23 nt, Human
cucaugauagaaggcuaugggga

SEQ ID NO: 3141613 - RNA, 20 nt, Human
cucaggccugacucucagca

SEQ ID NO: 3141614 - RNA, 23 nt, Human
cucaggccgaaggaggagucagg

SEQ ID NO: 3141615 - RNA, 22 nt, Human
ccucugcccgggagcucaggaa

SEQ ID NO: 3141616 - RNA, 21 nt, Human
ccucugcccgggagcucagga

SEQ ID NO: 3141617 - RNA, 12 nt, Human
ccugccuggacc

SEQ ID NO: 3141618 - RNA, 19 nt, Human
ccugccuggaccagccucu

SEQ ID NO: 3141619 - RNA, 23 nt, Human
ccucuuggggaguuuaggguggg

SEQ ID NO: 3141620 - RNA, 15 nt, Human
ccucuuggcugccuu

SEQ ID NO: 3141621 - RNA, 22 nt, Human
ccucuuggggaguuuagggugg

SEQ ID NO: 3141622 - RNA, 21 nt, Human
ccaugagcuccuuaaggcucu

SEQ ID NO: 3141623 - RNA, 12 nt, Human
ccaugagcuccu

SEQ ID NO: 3141624 - RNA, 13 nt, Human
ccauugguguuga

SEQ ID NO: 3141625 - RNA, 22 nt, Human
cccccugugccuugucacgcca

SEQ ID NO: 3141626 - RNA, 21 nt, Human
ccccgcguggaacucgugucu

SEQ ID NO: 3141627 - RNA, 18 nt, Human
ccagagaaaaagggaggg

SEQ ID NO: 3141628 - RNA, 23 nt, Human
ccagacuucccacggcuccucga

SEQ ID NO: 3141629 - RNA, 17 nt, Human
cagcacguguggccugu

SEQ ID NO: 3141630 - RNA, 17 nt, Human
caucuguaccucugccu

SEQ ID NO: 3141631 - RNA, 17 nt, Human
auucauggccuggggga

SEQ ID NO: 3141632 - RNA, 17 nt, Human
auuuuuaugccaccuga

SEQ ID NO: 3141633 - RNA, 17 nt, Human
caccuaggcuagggugg

SEQ ID NO: 3141634 - RNA, 19 nt, Human
caccuaggcuagggugggg

SEQ ID NO: 3141635 - RNA, 18 nt, Human
caccuaggcuaggguggg

SEQ ID NO: 3141636 - RNA, 14 nt, Human
uacagaggacagua

SEQ ID NO: 3141637 - RNA, 18 nt, Human
uacagaggacaguauuug

SEQ ID NO: 3141638 - RNA, 15 nt, Human
uaauuuaaaauugug

SEQ ID NO: 3141639 - RNA, 16 nt, Human
uaauuuaaaauuguga

SEQ ID NO: 3141640 - RNA, 17 nt, Human
acaccccgacuuuuguu

SEQ ID NO: 3141641 - RNA, 16 nt, Human
guuuucuuaacuuaaa

SEQ ID NO: 3141642 - RNA, 23 nt, Human
aaggcuauggggauagaugugug

SEQ ID NO: 3141643 - RNA, 13 nt, Human
guuuaugugugug

SEQ ID NO: 3141644 - RNA, 16 nt, Human
guuuaugugugugugu

SEQ ID NO: 3141645 - RNA, 18 nt, Human
guuguaucagcacgugug

SEQ ID NO: 3141646 - RNA, 14 nt, Human
guggcacuggggca

SEQ ID NO: 3141647 - RNA, 21 nt, Human
guggaagugugggucugugug

SEQ ID NO: 3141648 - RNA, 22 nt, Human
guggaagugugggucugugugu

SEQ ID NO: 3141649 - RNA, 23 nt, Human
gugcuauuguagagccagagguc

SEQ ID NO: 3141650 - RNA, 14 nt, Human
guggaagugugggu

SEQ ID NO: 3141651 - RNA, 15 nt, Human
guggaaguguggguc

SEQ ID NO: 3141652 - RNA, 19 nt, Human
guggaagugugggucugug

SEQ ID NO: 3141653 - RNA, 20 nt, Human
guggaagugugggucugugu

SEQ ID NO: 3141654 - RNA, 13 nt, Human
gugggagugugua

SEQ ID NO: 3141655 - RNA, 14 nt, Human
gugggaguguguaa

SEQ ID NO: 3141656 - RNA, 14 nt, Human
gugguggcucggga

SEQ ID NO: 3141657 - RNA, 13 nt, Human
gugggucugugug

SEQ ID NO: 3141658 - RNA, 16 nt, Human
gugggucugugugugu

SEQ ID NO: 3141659 - RNA, 23 nt, Human
guggggggggggcgcggcuggga

SEQ ID NO: 3141660 - RNA, 12 nt, Human
guguguaugugg

SEQ ID NO: 3141661 - RNA, 15 nt, Human
guguuguguguggga

SEQ ID NO: 3141662 - RNA, 14 nt, Human
guguguaauuuaaa

SEQ ID NO: 3141663 - RNA, 16 nt, Human
guaggaacugcugggc

SEQ ID NO: 3141664 - RNA, 18 nt, Human
guauguggaagugugggu

SEQ ID NO: 3141665 - RNA, 21 nt, Human
guauguggaagugugggucug

SEQ ID NO: 3141666 - RNA, 19 nt, Human
guaugugggggucugugug

SEQ ID NO: 3141667 - RNA, 20 nt, Human
guaugugggggucugugugu

SEQ ID NO: 3141668 - RNA, 16 nt, Human
guauguggaagugugg

SEQ ID NO: 3141669 - RNA, 17 nt, Human
guauguggaaguguggg

SEQ ID NO: 3141670 - RNA, 15 nt, Human
guauguggaagugug

SEQ ID NO: 3141671 - RNA, 19 nt, Human
aacucgugucuggcacagc

SEQ ID NO: 3141672 - RNA, 16 nt, Human
gucucccuccucugcc

SEQ ID NO: 3141673 - RNA, 12 nt, Human
gucucccuccuc

SEQ ID NO: 3141674 - RNA, 22 nt, Human
aacacugccagcauuucccuuc

SEQ ID NO: 3141675 - RNA, 12 nt, Human
aacacugccagc

SEQ ID NO: 3141676 - RNA, 19 nt, Human
agacuucccacggcuccuc

SEQ ID NO: 3141677 - RNA, 13 nt, Human
ucuuucuuccaaa

SEQ ID NO: 3141678 - RNA, 21 nt, Human
agacauuugcuaugagcuggg

SEQ ID NO: 3141679 - RNA, 17 nt, Human
agaaugucaguaugugg

SEQ ID NO: 3141680 - RNA, 19 nt, Human
agaaugucaguauguggaa

SEQ ID NO: 3141681 - RNA, 15 nt, Human
agaaugucaguaugu

SEQ ID NO: 3141682 - RNA, 16 nt, Human
agaaugucaguaugug

SEQ ID NO: 3141683 - RNA, 13 nt, Human
agaaugucaguau

SEQ ID NO: 3141684 - RNA, 23 nt, Human
agaguccaucagccuccauccua

SEQ ID NO: 3141685 - RNA, 17 nt, Human
agagucccugccuggac

SEQ ID NO: 3141686 - RNA, 14 nt, Human
agagucccugccug

SEQ ID NO: 3141687 - RNA, 18 nt, Human
agaucccaacacugccag

SEQ ID NO: 3141688 - RNA, 20 nt, Human
agaucccaacacugccagca

SEQ ID NO: 3141689 - RNA, 19 nt, Human
agaucccaacacugccagc

SEQ ID NO: 3141690 - RNA, 21 nt, Human
agaggccauucuuucccaaca

SEQ ID NO: 3141691 - RNA, 17 nt, Human
ucgagaucccaacacug

SEQ ID NO: 3141692 - RNA, 21 nt, Human
ucgagaucccaacacugccag

SEQ ID NO: 3141693 - RNA, 18 nt, Human
ucgagaucccaacacugc

SEQ ID NO: 3141694 - RNA, 23 nt, Human
acuggccaguggcuggaucugug

SEQ ID NO: 3141695 - RNA, 23 nt, Human
acuugucccgggacaccuaggcu

SEQ ID NO: 3141696 - RNA, 16 nt, Human
ucucauuccagaggaa

SEQ ID NO: 3141697 - RNA, 20 nt, Human
ucugagagaggccauucuuu

SEQ ID NO: 3141698 - RNA, 14 nt, Human
ucugagagaggcca

SEQ ID NO: 3141699 - RNA, 21 nt, Human
ucccgggacaccuaggcuagg

SEQ ID NO: 3141700 - RNA, 19 nt, Human
acucaugugacucuuucca

SEQ ID NO: 3141701 - RNA, 18 nt, Human
acucaugugacucuuucc

SEQ ID NO: 3141702 - RNA, 21 nt, Human
uccaaccggcuuuguggcacu

SEQ ID NO: 3141703 - RNA, 21 nt, Human
uccacucaugugacucuuucc

SEQ ID NO: 3141704 - RNA, 14 nt, Human
uccacucaugugac

SEQ ID NO: 3141705 - RNA, 17 nt, Human
uauuuguaaauuuaugu

SEQ ID NO: 3141706 - RNA, 22 nt, Human
uauuuguaaauuuaugugaugg

SEQ ID NO: 3141707 - RNA, 16 nt, Human
uauuuguaaauuuaug

SEQ ID NO: 3141708 - RNA, 12 nt, Human
ugugugugggag

SEQ ID NO: 3141709 - RNA, 20 nt, Human
ugugugugggaguguguaau

SEQ ID NO: 3141710 - RNA, 14 nt, Human
uguguguguaugug

SEQ ID NO: 3141711 - RNA, 16 nt, Human
uguggcauccagaguc

SEQ ID NO: 3141712 - RNA, 21 nt, Human
uguggcauccagagucccugc

SEQ ID NO: 3141713 - RNA, 19 nt, Human
uguggcauccagagucccu

SEQ ID NO: 3141714 - RNA, 14 nt, Human
ugugacucuuucca

SEQ ID NO: 3141715 - RNA, 12 nt, Human
ugugacucuuuc

SEQ ID NO: 3141716 - RNA, 17 nt, Human
ugugacucuuuccaacc

SEQ ID NO: 3141717 - RNA, 15 nt, Human
ugugacucuuuccaa

SEQ ID NO: 3141718 - RNA, 16 nt, Human
uuagaagaaguguguc

SEQ ID NO: 3141719 - RNA, 14 nt, Human
uuagaagaagugug

SEQ ID NO: 3141720 - RNA, 15 nt, Human
uuagaagaagugugu

SEQ ID NO: 3141721 - RNA, 14 nt, Human
aguuuagggugggg

SEQ ID NO: 3141722 - RNA, 13 nt, Human
aguuuaggguggg

SEQ ID NO: 3141723 - RNA, 12 nt, Human
aguuuagggugg

SEQ ID NO: 3141724 - RNA, 13 nt, Human
uuaaaauugugau

SEQ ID NO: 3141725 - RNA, 18 nt, Human
uuaaaauugugauguguc

SEQ ID NO: 3141726 - RNA, 16 nt, Human
uguuuaugugugugug

SEQ ID NO: 3141727 - RNA, 13 nt, Human
uguuuaugugugu

SEQ ID NO: 3141728 - RNA, 12 nt, Human
aguucugccagg

SEQ ID NO: 3141729 - RNA, 20 nt, Human
aguucugccaggagacaggu

SEQ ID NO: 3141730 - RNA, 14 nt, Human
aguucugccaggag

SEQ ID NO: 3141731 - RNA, 13 nt, Human
aguucugccagga

SEQ ID NO: 3141732 - RNA, 22 nt, Human
agggaaggaucccaugagcucc

SEQ ID NO: 3141733 - RNA, 15 nt, Human
agggaaggaucccau

SEQ ID NO: 3141734 - RNA, 23 nt, Human
agggaaggaucccaugagcuccu

SEQ ID NO: 3141735 - RNA, 19 nt, Human
ugggagaaugucaguaugu

SEQ ID NO: 3141736 - RNA, 20 nt, Human
ugggagaaugucaguaugug

SEQ ID NO: 3141737 - RNA, 22 nt, Human
ugggagaaugucaguaugugga

SEQ ID NO: 3141738 - RNA, 21 nt, Human
aggguggggggggggcgcggc

SEQ ID NO: 3141739 - RNA, 15 nt, Human
uggggcucagagugg

SEQ ID NO: 3141740 - RNA, 22 nt, Human
uggggagggauuuggggcucag

SEQ ID NO: 3141741 - RNA, 13 nt, Human
uggggagagacgg

SEQ ID NO: 3141742 - RNA, 14 nt, Human
uggggagggauuug

SEQ ID NO: 3141743 - RNA, 12 nt, Human
uguauguggggg

SEQ ID NO: 3141744 - RNA, 19 nt, Human
agguuuuuguagugauuuu

SEQ ID NO: 3141745 - RNA, 23 nt, Human
agguuuguuuagaagaagugugu

SEQ ID NO: 3141746 - RNA, 21 nt, Human
uguagugauuuuuaugccacc

SEQ ID NO: 3141747 - RNA, 15 nt, Human
ugccuugucacgcca

SEQ ID NO: 3141748 - RNA, 16 nt, Human
ugccuuggugugcugu

SEQ ID NO: 3141749 - RNA, 22 nt, Human
ugcuaugagcuggggaugucuc

SEQ ID NO: 3141750 - RNA, 19 nt, Human
ugcuaugagcuggggaugu

SEQ ID NO: 3141751 - RNA, 20 nt, Human
ugcuaugagcuggggauguc

SEQ ID NO: 3141752 - RNA, 16 nt, Human
ugcuaugagcugggga

SEQ ID NO: 3141753 - RNA, 16 nt, Human
ugccaucauguuuaca

SEQ ID NO: 3141754 - RNA, 22 nt, Human
ugccgagaguccaucagccucc

SEQ ID NO: 3141755 - RNA, 23 nt, Human
agccccgcguggaacucgugucu

SEQ ID NO: 3141756 - RNA, 16 nt, Human
agccucuccacucaug

SEQ ID NO: 3141757 - RNA, 15 nt, Human
ugaugggucaguugu

SEQ ID NO: 3141758 - RNA, 17 nt, Human
auuguagagccagaggu

SEQ ID NO: 3141759 - RNA, 18 nt, Human
auuguagagccagagguc

SEQ ID NO: 3141760 - RNA, 15 nt, Human
auuuaaaauugugau

SEQ ID NO: 3141761 - RNA, 18 nt, Human
auguguguguguugugug

SEQ ID NO: 3141762 - RNA, 22 nt, Human
auguguguguguuguguguggg

SEQ ID NO: 3141763 - RNA, 23 nt, Human
auguguguguguuguguguggga

SEQ ID NO: 3141764 - RNA, 17 nt, Human
auguauauaaacaugcu

SEQ ID NO: 3141765 - RNA, 19 nt, Human
uuucccuuccuuccucucc

SEQ ID NO: 3141766 - RNA, 23 nt, Human
uuugaccuguugggagugaggau

SEQ ID NO: 3141767 - RNA, 15 nt, Human
uuuguagugauuuuu

SEQ ID NO: 3141768 - RNA, 22 nt, Human
uuuguagugauuuuuaugccac

SEQ ID NO: 3141769 - RNA, 18 nt, Human
uuuguaagguuuuuguag

SEQ ID NO: 3141770 - RNA, 20 nt, Human
auauuuguaaauuuauguga

SEQ ID NO: 3141771 - RNA, 12 nt, Human
uucugccaggag

SEQ ID NO: 3141772 - RNA, 17 nt, Human
aucccaacacugccagc

SEQ ID NO: 3141773 - RNA, 16 nt, Human
aucccaacacugccag

SEQ ID NO: 3141774 - RNA, 15 nt, Human
aucccaacacugcca

SEQ ID NO: 3141775 - RNA, 11 nt, Human
aucccaacacu

SEQ ID NO: 3141776 - RNA, 18 nt, Human
aucauguuuacagaggac

SEQ ID NO: 3141777 - RNA, 23 nt, Human
aucauguuuacagaggacaguau

SEQ ID NO: 3141778 - RNA, 17 nt, Human
uucuaguucugccagga

SEQ ID NO: 3141779 - RNA, 16 nt, Human
uucuaguucugccagg

SEQ ID NO: 3141780 - RNA, 19 nt, Human
uuguaaauuuaugugaugg

SEQ ID NO: 3141781 - RNA, 16 nt, Human
uuggacuugucccggg

SEQ ID NO: 3141782 - RNA, 21 nt, Human
aucugugaggggcucucucau

SEQ ID NO: 3141783 - RNA, 22 nt, Human
aucugugaggggcucucucaug

SEQ ID NO: 3141784 - RNA, 18 nt, Human
augaguuggcugggaaua

SEQ ID NO: 3141785 - RNA, 12 nt, Human
uugugauguguc

SEQ ID NO: 3141786 - RNA, 15 nt, Human
gggaaggaucccaug

SEQ ID NO: 3141787 - RNA, 13 nt, Human
gggauagaugugu

SEQ ID NO: 3141788 - RNA, 14 nt, Human
gggauagaugugug

SEQ ID NO: 3141789 - RNA, 11 nt, Human
gggagugugua

SEQ ID NO: 3141790 - RNA, 16 nt, Human
gggaguuuaggguggg

SEQ ID NO: 3141791 - RNA, 23 nt, Human
gggaggugcuucuaguucugcca

SEQ ID NO: 3141792 - RNA, 17 nt, Human
gggcagucugagagagg

SEQ ID NO: 3141793 - RNA, 19 nt, Human
gggcagucugagagaggcc

SEQ ID NO: 3141794 - RNA, 18 nt, Human
gggcagucugagagaggc

SEQ ID NO: 3141795 - RNA, 12 nt, Human
gggccugggcag

SEQ ID NO: 3141796 - RNA, 15 nt, Human
gggccugggcaggag

SEQ ID NO: 3141797 - RNA, 13 nt, Human
gggccugggcagg

SEQ ID NO: 3141798 - RNA, 21 nt, Human
gggcagucugagagaggccau

SEQ ID NO: 3141799 - RNA, 20 nt, Human
gggcagucugagagaggcca

SEQ ID NO: 3141800 - RNA, 17 nt, Human
gggccugggcaggaggg

SEQ ID NO: 3141801 - RNA, 16 nt, Human
gggccugggcaggagg

SEQ ID NO: 3141802 - RNA, 19 nt, Human
ggggcagucugagagaggc

SEQ ID NO: 3141803 - RNA, 15 nt, Human
ggggcagucugagag

SEQ ID NO: 3141804 - RNA, 18 nt, Human
ggggcagucugagagagg

SEQ ID NO: 3141805 - RNA, 16 nt, Human
ggggcgcggcugggag

SEQ ID NO: 3141806 - RNA, 15 nt, Human
ggggcgcggcuggga

SEQ ID NO: 3141807 - RNA, 15 nt, Human
gggggagagggcugc

SEQ ID NO: 3141808 - RNA, 15 nt, Human
ggugguggcucggga

SEQ ID NO: 3141809 - RNA, 21 nt, Human
gguguccugcaccggggccug

SEQ ID NO: 3141810 - RNA, 12 nt, Human
ggagggauuugg

SEQ ID NO: 3141811 - RNA, 13 nt, Human
ggagggcaggcau

SEQ ID NO: 3141812 - RNA, 16 nt, Human
ggagccgggagccuga

SEQ ID NO: 3141813 - RNA, 20 nt, Human
ggaggagggcaggcaucggg

SEQ ID NO: 3141814 - RNA, 15 nt, Human
ggaggagggcaggca

SEQ ID NO: 3141815 - RNA, 14 nt, Human
ggaggagggcaggc

SEQ ID NO: 3141816 - RNA, 13 nt, Human
ggauagaugugug

SEQ ID NO: 3141817 - RNA, 14 nt, Human
ggauagaugugugg

SEQ ID NO: 3141818 - RNA, 15 nt, Human
ggauagaugugugga

SEQ ID NO: 3141819 - RNA, 17 nt, Human
ggaaggaucccaugagc

SEQ ID NO: 3141820 - RNA, 20 nt, Human
ggcagucugagagaggccau

SEQ ID NO: 3141821 - RNA, 20 nt, Human
ggaucccaugagcuccuuaa

SEQ ID NO: 3141822 - RNA, 17 nt, Human
ggaucccaugagcuccu

SEQ ID NO: 3141823 - RNA, 19 nt, Human
gcugggaggagggcaggca

SEQ ID NO: 3141824 - RNA, 17 nt, Human
gcugggaggagggcagg

SEQ ID NO: 3141825 - RNA, 20 nt, Human
gcugccuuuggacuuguccc

SEQ ID NO: 3141826 - RNA, 15 nt, Human
gcugccuuuggacuu

SEQ ID NO: 3141827 - RNA, 23 nt, Human
gcugggacaccccgacuuuuguu

SEQ ID NO: 3141828 - RNA, 20 nt, Human
ggaaccgaggcagggaagga

SEQ ID NO: 3141829 - RNA, 16 nt, Human
ggaaccgaggcaggga

SEQ ID NO: 3141830 - RNA, 15 nt, Human
ggaaccgaggcaggg

SEQ ID NO: 3141831 - RNA, 17 nt, Human
ggaacucgugucuggca

SEQ ID NO: 3141832 - RNA, 18 nt, Human
gcuucuaguucugccagg

SEQ ID NO: 3141833 - RNA, 21 nt, Human
gcuucuaguucugccaggaga

SEQ ID NO: 3141834 - RNA, 20 nt, Human
gcuucuaguucugccaggag

SEQ ID NO: 3141835 - RNA, 19 nt, Human
gcuucuaguucugccagga

SEQ ID NO: 3141836 - RNA, 13 nt, Human
gccccgcguggaa

SEQ ID NO: 3141837 - RNA, 21 nt, Human
gccgagaguccaucagccucc

SEQ ID NO: 3141838 - RNA, 14 nt, Human
gccgggagccugac

SEQ ID NO: 3141839 - RNA, 13 nt, Human
gccgggagccuga

SEQ ID NO: 3141840 - RNA, 19 nt, Human
gccgggagccugacccuca

SEQ ID NO: 3141841 - RNA, 17 nt, Human
gccuaaccugccgagag

SEQ ID NO: 3141842 - RNA, 15 nt, Human
gcaggagggaggugc

SEQ ID NO: 3141843 - RNA, 19 nt, Human
gcacagccuggcuguggcc

SEQ ID NO: 3141844 - RNA, 12 nt, Human
gcacagccuggc

SEQ ID NO: 3141845 - RNA, 21 nt, Human
gaguguguaauuuaaaauugu

SEQ ID NO: 3141846 - RNA, 22 nt, Human
gaguguguaauuuaaaauugug

SEQ ID NO: 3141847 - RNA, 18 nt, Human
gacuucccacggcuccuc

SEQ ID NO: 3141848 - RNA, 17 nt, Human
gaagagaagggcagggc

SEQ ID NO: 3141849 - RNA, 19 nt, Human
gaagcguuguccucagccc

SEQ ID NO: 3141850 - RNA, 13 nt, Human
gaagcguuguccu

SEQ ID NO: 3141851 - RNA, 20 nt, Human
gaagcguuguccucagcccc

SEQ ID NO: 3141852 - RNA, 14 nt, Human
cuuccuuccucucc

SEQ ID NO: 3141853 - RNA, 19 nt, Human
cucuccacucaugugacuc

SEQ ID NO: 3141854 - RNA, 21 nt, Human
cugaagagaagggcagggcug

SEQ ID NO: 3141855 - RNA, 13 nt, Human
cuccuuaaggcuc

SEQ ID NO: 3141856 - RNA, 22 nt, Human
cuccuuaaggcucuuuuguaag

SEQ ID NO: 3141857 - RNA, 17 nt, Human
cucauuccagaggaagg

SEQ ID NO: 3141858 - RNA, 15 nt, Human
cucauuccagaggaa

SEQ ID NO: 3141859 - RNA, 17 nt, Human
cuccauugguguugaca

SEQ ID NO: 3141860 - RNA, 12 nt, Human
cuggaccagccu

SEQ ID NO: 3141861 - RNA, 14 nt, Human
cuggcacagccugg

SEQ ID NO: 3141862 - RNA, 16 nt, Human
cugccaggagacaggu

SEQ ID NO: 3141863 - RNA, 20 nt, Human
cugccagcauuucccuuccu

SEQ ID NO: 3141864 - RNA, 14 nt, Human
ccuggaccagccuc

SEQ ID NO: 3141865 - RNA, 16 nt, Human
ccuggaccagccucuc

SEQ ID NO: 3141866 - RNA, 15 nt, Human
ccuggaccagccucu

SEQ ID NO: 3141867 - RNA, 19 nt, Human
cgucagcugggacaccccg

SEQ ID NO: 3141868 - RNA, 16 nt, Human
cgggagcucaggaacc

SEQ ID NO: 3141869 - RNA, 23 nt, Human
cggcugggaggagggcaggcauc

SEQ ID NO: 3141870 - RNA, 18 nt, Human
cggcugggaggagggcag

SEQ ID NO: 3141871 - RNA, 22 nt, Human
cggcugggaggagggcaggcau

SEQ ID NO: 3141872 - RNA, 21 nt, Human
cgauugcaggagucccugcca

SEQ ID NO: 3141873 - RNA, 23 nt, Human
cgauugcaggagucccugccauc

SEQ ID NO: 3141874 - RNA, 15 nt, Human
ccuccucugcccggg

SEQ ID NO: 3141875 - RNA, 14 nt, Human
ccuccucugcccgg

SEQ ID NO: 3141876 - RNA, 23 nt, Human
ccucuccacucaugugacucuuu

SEQ ID NO: 3141877 - RNA, 22 nt, Human
ccgacuuuuguuuaccagagaa

SEQ ID NO: 3141878 - RNA, 19 nt, Human
cauugucccugaagagaag

SEQ ID NO: 3141879 - RNA, 16 nt, Human
ccaaacaggcucagag

SEQ ID NO: 3141880 - RNA, 13 nt, Human
ccaacacugccag

SEQ ID NO: 3141881 - RNA, 16 nt, Human
ccaacacugccagcau

SEQ ID NO: 3141882 - RNA, 15 nt, Human
ccaacacugccagca

SEQ ID NO: 3141883 - RNA, 14 nt, Human
ccaacacugccagc

SEQ ID NO: 3141884 - RNA, 19 nt, Human
ccaagccuuggcucuaccc

SEQ ID NO: 3141885 - RNA, 16 nt, Human
ccacacccucacugcu

SEQ ID NO: 3141886 - RNA, 20 nt, Human
ccacacagacuugggcaggg

SEQ ID NO: 3141887 - RNA, 21 nt, Human
ccacgucagcugggacacccc

SEQ ID NO: 3141888 - RNA, 13 nt, Human
cccaacaccucuu

SEQ ID NO: 3141889 - RNA, 13 nt, Human
ccaucagccucca

SEQ ID NO: 3141890 - RNA, 19 nt, Human
uuuagaagaagugugucac

SEQ ID NO: 3141891 - RNA, 17 nt, Human
uuuagaagaaguguguc

SEQ ID NO: 3141892 - RNA, 11 nt, Human
uguguguaugu

SEQ ID NO: 3141893 - RNA, 15 nt, Human
uguguuuaugugugu

SEQ ID NO: 3141894 - RNA, 13 nt, Human
uguguuuaugugu

SEQ ID NO: 3141895 - RNA, 14 nt, Human
uguguugugugugg

SEQ ID NO: 3141896 - RNA, 23 nt, Human
uguguugugugugggagugugua

SEQ ID NO: 3141897 - RNA, 23 nt, Human
uguguaugugggggucugugugu

SEQ ID NO: 3141898 - RNA, 14 nt, Human
uguguauguggggg

SEQ ID NO: 3141899 - RNA, 13 nt, Human
uguguaugugggg

SEQ ID NO: 3141900 - RNA, 14 nt, Human
uguuuacagaggac

SEQ ID NO: 3141901 - RNA, 21 nt, Human
uguuuacagaggacaguauuu

SEQ ID NO: 3141902 - RNA, 15 nt, Human
uuacagaggacagua

SEQ ID NO: 3141903 - RNA, 16 nt, Human
ugugggggucugugug

SEQ ID NO: 3141904 - RNA, 14 nt, Human
ugugggucugugug

SEQ ID NO: 3141905 - RNA, 16 nt, Human
ugugggucugugugug

SEQ ID NO: 3141906 - RNA, 20 nt, Human
ugugggucugugugugugua

SEQ ID NO: 3141907 - RNA, 18 nt, Human
ugugaggggcucucucau

SEQ ID NO: 3141908 - RNA, 15 nt, Human
uguaaauuuauguga

SEQ ID NO: 3141909 - RNA, 16 nt, Human
uguaaauuuaugugau

SEQ ID NO: 3141910 - RNA, 14 nt, Human
ugucacgccagacu

SEQ ID NO: 3141911 - RNA, 20 nt, Human
ugcuucuaguucugccagga

SEQ ID NO: 3141912 - RNA, 19 nt, Human
ugcuucuaguucugccagg

SEQ ID NO: 3141913 - RNA, 18 nt, Human
ugcuucuaguucugccag

SEQ ID NO: 3141914 - RNA, 21 nt, Human
uggaagugugggucugugugu

SEQ ID NO: 3141915 - RNA, 23 nt, Human
uggaagugugggucugugugugu

SEQ ID NO: 3141916 - RNA, 18 nt, Human
uggggcaggggccggggg

SEQ ID NO: 3141917 - RNA, 16 nt, Human
uggggcaggggccggg

SEQ ID NO: 3141918 - RNA, 19 nt, Human
gguugggagaaugucagua

SEQ ID NO: 3141919 - RNA, 19 nt, Human
uaauucuuugaccuguugg

SEQ ID NO: 3141920 - RNA, 11 nt, Human
uagaugugugg

SEQ ID NO: 3141921 - RNA, 15 nt, Human
uaggaacugcugggc

SEQ ID NO: 3141922 - RNA, 18 nt, Human
uaggaacugcugggcuug

SEQ ID NO: 3141923 - RNA, 15 nt, Human
uaucagcacgugugg

SEQ ID NO: 3141924 - RNA, 13 nt, Human
uaggcuagggugg

SEQ ID NO: 3141925 - RNA, 22 nt, Human
uagugauuuuuaugccaccuga

SEQ ID NO: 3141926 - RNA, 21 nt, Human
uagugauuuuuaugccaccug

SEQ ID NO: 3141927 - RNA, 20 nt, Human
uagugauuuuuaugccaccu

SEQ ID NO: 3141928 - RNA, 15 nt, Human
ucuguguguuuaugu

SEQ ID NO: 3141929 - RNA, 16 nt, Human
ucuguguguuuaugug

SEQ ID NO: 3141930 - RNA, 22 nt, Human
ucuguguguguguauguggggg

SEQ ID NO: 3141931 - RNA, 19 nt, Human
ucuguguguuuaugugugu

SEQ ID NO: 3141932 - RNA, 20 nt, Human
ucuguguguuuaugugugug

SEQ ID NO: 3141933 - RNA, 15 nt, Human
ucuguguguguguau

SEQ ID NO: 3141934 - RNA, 18 nt, Human
ucuguguguguguaugug

SEQ ID NO: 3141935 - RNA, 19 nt, Human
ucuguguguguguaugugg

SEQ ID NO: 3141936 - RNA, 21 nt, Human
ucuguguguguguaugugggg

SEQ ID NO: 3141937 - RNA, 13 nt, Human
ucugugugugugu

SEQ ID NO: 3141938 - RNA, 19 nt, Human
ucuuuuguaagguuuuugu

SEQ ID NO: 3141939 - RNA, 19 nt, Human
uccuuaaggcucuuuugua

SEQ ID NO: 3141940 - RNA, 16 nt, Human
uccuuaaggcucuuuu

SEQ ID NO: 3141941 - RNA, 18 nt, Human
ucacgccagacuucccac

SEQ ID NO: 3141942 - RNA, 18 nt, Human
cugaggaagagggacugu

SEQ ID NO: 3141943 - RNA, 23 nt, Human
cugaggaagagggacuguucuuu

SEQ ID NO: 3141944 - RNA, 18 nt, Human
cugacccucaucuuucuu

SEQ ID NO: 3141945 - RNA, 15 nt, Human
cuaggcuaggguggg

SEQ ID NO: 3141946 - RNA, 16 nt, Human
cuaguucugccaggag

SEQ ID NO: 3141947 - RNA, 15 nt, Human
cuaguucugccagga

SEQ ID NO: 3141948 - RNA, 14 nt, Human
cuaguucugccagg

SEQ ID NO: 3141949 - RNA, 15 nt, Human
cuaggguggggagag

SEQ ID NO: 3141950 - RNA, 13 nt, Human
cuaguucugccag

SEQ ID NO: 3141951 - RNA, 12 nt, Human
ccauucuuuccc

SEQ ID NO: 3141952 - RNA, 20 nt, Human
ccauucuuucccaacaccuc

SEQ ID NO: 3141953 - RNA, 14 nt, Human
ccauucuuucccaa

SEQ ID NO: 3141954 - RNA, 21 nt, Human
ccuggugguggcucgggaggc

SEQ ID NO: 3141955 - RNA, 18 nt, Human
ccuggugguggcucggga

SEQ ID NO: 3141956 - RNA, 21 nt, Human
ccugucucccuccucugcccg

SEQ ID NO: 3141957 - RNA, 18 nt, Human
ccugccaucauguuuaca

SEQ ID NO: 3141958 - RNA, 20 nt, Human
ccugccaucauguuuacaga

SEQ ID NO: 3141959 - RNA, 19 nt, Human
ccugacccucaucuuucuu

SEQ ID NO: 3141960 - RNA, 18 nt, Human
ccugacccucaucuuucu

SEQ ID NO: 3141961 - RNA, 18 nt, Human
cagucugagagaggccau

SEQ ID NO: 3141962 - RNA, 15 nt, Human
caggccugacucuca

SEQ ID NO: 3141963 - RNA, 19 nt, Human
cauccauggggcugauugu

SEQ ID NO: 3141964 - RNA, 14 nt, Human
cuuugaccuguugg

SEQ ID NO: 3141965 - RNA, 16 nt, Human
cuucuaguucugccag

SEQ ID NO: 3141966 - RNA, 18 nt, Human
cuucuaguucugccagga

SEQ ID NO: 3141967 - RNA, 17 nt, Human
cuucuaguucugccagg

SEQ ID NO: 3141968 - RNA, 19 nt, Human
cuucuaguucugccaggag

SEQ ID NO: 3141969 - RNA, 16 nt, Human
cuggggaugucucuca

SEQ ID NO: 3141970 - RNA, 18 nt, Human
cugggaauaagugccagg

SEQ ID NO: 3141971 - RNA, 15 nt, Human
cuuaggccagcacca

SEQ ID NO: 3141972 - RNA, 16 nt, Human
cugugccuuuugccau

SEQ ID NO: 3141973 - RNA, 20 nt, Human
cugugccuugucacgccaga

SEQ ID NO: 3141974 - RNA, 18 nt, Human
gcauuucccuuccuuccu

SEQ ID NO: 3141975 - RNA, 20 nt, Human
gacccucaucuuucuuccaa

SEQ ID NO: 3141976 - RNA, 19 nt, Human
gacccucaucuuucuucca

SEQ ID NO: 3141977 - RNA, 15 nt, Human
gacccucaucuuucu

SEQ ID NO: 3141978 - RNA, 15 nt, Human
gacuauggagcugag

SEQ ID NO: 3141979 - RNA, 23 nt, Human
guaauuuaaaauugugauguguc

SEQ ID NO: 3141980 - RNA, 19 nt, Human
guaauuuaaaauugugaug

SEQ ID NO: 3141981 - RNA, 20 nt, Human
guaauuuaaaauugugaugu

SEQ ID NO: 3141982 - RNA, 15 nt, Human
guagagccagagguc

SEQ ID NO: 3141983 - RNA, 17 nt, Human
ggggccgggggcagucu

SEQ ID NO: 3141984 - RNA, 18 nt, Human
gggggcgcggcugggagg

SEQ ID NO: 3141985 - RNA, 14 nt, Human
ggguggggagagac

SEQ ID NO: 3141986 - RNA, 13 nt, Human
ggguggggagaga

SEQ ID NO: 3141987 - RNA, 18 nt, Human
ggguggggagagacgggc

SEQ ID NO: 3141988 - RNA, 22 nt, Human
ggugcuucuaguucugccagga

SEQ ID NO: 3141989 - RNA, 22 nt, Human
gggacaccuaggcuaggguggg

SEQ ID NO: 3141990 - RNA, 14 nt, Human
ggcucagagugggg

SEQ ID NO: 3141991 - RNA, 20 nt, Human
ggcucagaggguguccugca

SEQ ID NO: 3141992 - RNA, 15 nt, Human
ggcagggcugaggcc

SEQ ID NO: 3141993 - RNA, 20 nt, Human
ggaacugcugggcuuggcag

SEQ ID NO: 3141994 - RNA, 21 nt, Human
ggaagugugggucugugugug

SEQ ID NO: 3141995 - RNA, 22 nt, Human
ggaagugugggucugugugugu

SEQ ID NO: 3141996 - RNA, 12 nt, Human
ggaagugugggu

SEQ ID NO: 3141997 - RNA, 17 nt, Human
gcuucuaguucugccag

SEQ ID NO: 3141998 - RNA, 16 nt, Human
gcuucuaguucugcca

SEQ ID NO: 3141999 - RNA, 23 nt, Human
gccuccauccuacccccugugcc

SEQ ID NO: 3142000 - RNA, 22 nt, Human
gcuaauucuuugaccuguuggg

SEQ ID NO: 3142001 - RNA, 19 nt, Human
gcucaggaaccgaggcagg

SEQ ID NO: 3142002 - RNA, 16 nt, Human
gcucaggaaccgaggc

SEQ ID NO: 3142003 - RNA, 21 nt, Human
gcucaggaaccgaggcaggga

SEQ ID NO: 3142004 - RNA, 20 nt, Human
gcucaggaaccgaggcaggg

SEQ ID NO: 3142005 - RNA, 14 nt, Human
aauuuaugugaugg

SEQ ID NO: 3142006 - RNA, 18 nt, Human
aauucuuugaccuguugg

SEQ ID NO: 3142007 - RNA, 22 nt, Human
aauucuuugaccuguugggagu

SEQ ID NO: 3142008 - RNA, 14 nt, Human
uauguguguguguu

SEQ ID NO: 3142009 - RNA, 22 nt, Human
uauguguguguguugugugugg

SEQ ID NO: 3142010 - RNA, 11 nt, Human
uaugugugugu

SEQ ID NO: 3142011 - RNA, 23 nt, Human
uauguguguguguuguguguggg

SEQ ID NO: 3142012 - RNA, 21 nt, Human
acagacacucccacuuggcau

SEQ ID NO: 3142013 - RNA, 17 nt, Human
uauggggauagaugugu

SEQ ID NO: 3142014 - RNA, 18 nt, Human
uauggggauagaugugug

SEQ ID NO: 3142015 - RNA, 19 nt, Human
uauggggauagaugugugg

SEQ ID NO: 3142016 - RNA, 12 nt, Human
acagccuggcug

SEQ ID NO: 3142017 - RNA, 13 nt, Human
uaguucugccagg

SEQ ID NO: 3142018 - RNA, 14 nt, Human
uaguucugccagga

SEQ ID NO: 3142019 - RNA, 20 nt, Human
acaccuaggcuagggugggg

SEQ ID NO: 3142020 - RNA, 23 nt, Human
acaccuaggcuaggguggggaga

SEQ ID NO: 3142021 - RNA, 13 nt, Human
guguguguaugug

SEQ ID NO: 3142022 - RNA, 16 nt, Human
gugugugggagugugu

SEQ ID NO: 3142023 - RNA, 17 nt, Human
guguguguugugugugg

SEQ ID NO: 3142024 - RNA, 14 nt, Human
guguguguaugugg

SEQ ID NO: 3142025 - RNA, 15 nt, Human
gugggggucugugug

SEQ ID NO: 3142026 - RNA, 16 nt, Human
gugggggucugugugu

SEQ ID NO: 3142027 - RNA, 14 nt, Human
gugggggucugugu

SEQ ID NO: 3142028 - RNA, 18 nt, Human
guggcacuggggcagggg

SEQ ID NO: 3142029 - RNA, 17 nt, Human
guggcacuggggcaggg

SEQ ID NO: 3142030 - RNA, 20 nt, Human
guccugcaccggggccuggg

SEQ ID NO: 3142031 - RNA, 19 nt, Human
guccugcaccggggccugg

SEQ ID NO: 3142032 - RNA, 15 nt, Human
guccugcaccggggc

SEQ ID NO: 3142033 - RNA, 14 nt, Human
guugggagaauguc

SEQ ID NO: 3142034 - RNA, 21 nt, Human
guugggagaaugucaguaugu

SEQ ID NO: 3142035 - RNA, 16 nt, Human
guguuuaugugugugu

SEQ ID NO: 3142036 - RNA, 12 nt, Human
guguuuaugugu

SEQ ID NO: 3142037 - RNA, 21 nt, Human
uccugcaccggggccugggca

SEQ ID NO: 3142038 - RNA, 20 nt, Human
uccugcaccggggccugggc

SEQ ID NO: 3142039 - RNA, 23 nt, Human
ucgagaucccaacacugccagca

SEQ ID NO: 3142040 - RNA, 22 nt, Human
ucgagaucccaacacugccagc

SEQ ID NO: 3142041 - RNA, 14 nt, Human
acuggggcaggggc

SEQ ID NO: 3142042 - RNA, 11 nt, Human
uccucagcccc

SEQ ID NO: 3142043 - RNA, 21 nt, Human
acucuggagguuuguuuagaa

SEQ ID NO: 3142044 - RNA, 17 nt, Human
acucaugugacucuuuc

SEQ ID NO: 3142045 - RNA, 16 nt, Human
acucaugugacucuuu

SEQ ID NO: 3142046 - RNA, 15 nt, Human
acucaugugacucuu

SEQ ID NO: 3142047 - RNA, 16 nt, Human
ucagccccgcguggaa

SEQ ID NO: 3142048 - RNA, 22 nt, Human
acccagcuaugguucucucgca

SEQ ID NO: 3142049 - RNA, 22 nt, Human
ucagauuugccuuauuggcagc

SEQ ID NO: 3142050 - RNA, 15 nt, Human
ucaggccgaaggagg

SEQ ID NO: 3142051 - RNA, 18 nt, Human
ucaggaaccgaggcaggg

SEQ ID NO: 3142052 - RNA, 17 nt, Human
ucaggaaccgaggcagg

SEQ ID NO: 3142053 - RNA, 18 nt, Human
accagagaaaaagggagg

SEQ ID NO: 3142054 - RNA, 20 nt, Human
accagagaaaaagggagggg

SEQ ID NO: 3142055 - RNA, 22 nt, Human
ucaugauagaaggcuaugggga

SEQ ID NO: 3142056 - RNA, 18 nt, Human
accugaauaaagaaugaa

SEQ ID NO: 3142057 - RNA, 11 nt, Human
ucuggcccuau

SEQ ID NO: 3142058 - RNA, 14 nt, Human
agacuuaucaacau

SEQ ID NO: 3142059 - RNA, 17 nt, Human
ugaggaagagggacugu

SEQ ID NO: 3142060 - RNA, 22 nt, Human
ugagggugacuauggagcugag

SEQ ID NO: 3142061 - RNA, 18 nt, Human
auaaucacaacccuucag

SEQ ID NO: 3142062 - RNA, 12 nt, Human
uuaugugugugu

SEQ ID NO: 3142063 - RNA, 14 nt, Human
uuaugugugugugu

SEQ ID NO: 3142064 - RNA, 10 nt, Human
uuaugugugu

SEQ ID NO: 3142065 - RNA, 19 nt, Human
auagaaggcuauggggaua

SEQ ID NO: 3142066 - RNA, 14 nt, Human
auagauguguggac

SEQ ID NO: 3142067 - RNA, 12 nt, Human
auagaugugugg

SEQ ID NO: 3142068 - RNA, 13 nt, Human
auagaugugugga

SEQ ID NO: 3142069 - RNA, 11 nt, Human
auagaugugug

SEQ ID NO: 3142070 - RNA, 14 nt, Human
aguauuugugggga

SEQ ID NO: 3142071 - RNA, 16 nt, Human
aguccaucagccucca

SEQ ID NO: 3142072 - RNA, 20 nt, Human
uguagugauuuuuaugccac

SEQ ID NO: 3142073 - RNA, 14 nt, Human
agugaggaugucug

SEQ ID NO: 3142074 - RNA, 21 nt, Human
agugauuuuuaugccaccuga

SEQ ID NO: 3142075 - RNA, 20 nt, Human
agugauuuuuaugccaccug

SEQ ID NO: 3142076 - RNA, 16 nt, Human
agugauuuuuaugcca

SEQ ID NO: 3142077 - RNA, 18 nt, Human
agugccaggauggaauga

SEQ ID NO: 3142078 - RNA, 16 nt, Human
agugggguagguuggg

SEQ ID NO: 3142079 - RNA, 18 nt, Human
uguguguuguguguggga

SEQ ID NO: 3142080 - RNA, 9 nt, Human
aguguguaa

SEQ ID NO: 3142081 - RNA, 17 nt, Human
uggcuguggcauccaga

SEQ ID NO: 3142082 - RNA, 20 nt, Human
uggcuguggccuaaccugcc

SEQ ID NO: 3142083 - RNA, 20 nt, Human
uggaagugugggucugugug

SEQ ID NO: 3142084 - RNA, 13 nt, Human
uggaagugugggu

SEQ ID NO: 3142085 - RNA, 14 nt, Human
uggaaguguggguc

SEQ ID NO: 3142086 - RNA, 16 nt, Human
aggccugacucucagc

SEQ ID NO: 3142087 - RNA, 20 nt, Human
uggcauccagagucccugcc

SEQ ID NO: 3142088 - RNA, 22 nt, Human
uggcauccagagucccugccug

SEQ ID NO: 3142089 - RNA, 21 nt, Human
uggcauccagagucccugccu

SEQ ID NO: 3142090 - RNA, 22 nt, Human
uggcacagccuggcuguggccu

SEQ ID NO: 3142091 - RNA, 14 nt, Human
aggccauucuuucc

SEQ ID NO: 3142092 - RNA, 20 nt, Human
aggcucagaggguguccugc

SEQ ID NO: 3142093 - RNA, 19 nt, Human
aggcucagaggguguccug

SEQ ID NO: 3142094 - RNA, 18 nt, Human
aggcucagaggguguccu

SEQ ID NO: 3142095 - RNA, 18 nt, Human
aggcgaagcguuguccuc

SEQ ID NO: 3142096 - RNA, 19 nt, Human
ugccuugugaaggaauuau

SEQ ID NO: 3142097 - RNA, 17 nt, Human
ugccuugucacgccaga

SEQ ID NO: 3142098 - RNA, 15 nt, Human
agcuggggaugucuc

SEQ ID NO: 3142099 - RNA, 19 nt, Human
agccugacccucaucuuuc

SEQ ID NO: 3142100 - RNA, 12 nt, Human
auuccagaggaa

SEQ ID NO: 3142101 - RNA, 12 nt, Human
auuuuucucaug

SEQ ID NO: 3142102 - RNA, 19 nt, Human
auuuguaaauuuaugugau

SEQ ID NO: 3142103 - RNA, 18 nt, Human
auuuguaaauuuauguga

SEQ ID NO: 3142104 - RNA, 16 nt, Human
auuucccuuccuuccu

SEQ ID NO: 3142105 - RNA, 19 nt, Human
auccauagcaccuccacau

SEQ ID NO: 3142106 - RNA, 13 nt, Human
uucugccaggaga

SEQ ID NO: 3142107 - RNA, 16 nt, Human
auccuacccccugugc

SEQ ID NO: 3142108 - RNA, 14 nt, Human
auccuacccccugu

SEQ ID NO: 3142109 - RNA, 13 nt, Human
aucaggccauugu

SEQ ID NO: 3142110 - RNA, 16 nt, Human
aucaggccauuguccc

SEQ ID NO: 3142111 - RNA, 20 nt, Human
auggggauagauguguggac

SEQ ID NO: 3142112 - RNA, 16 nt, Human
augguucucaggccug

SEQ ID NO: 3142113 - RNA, 16 nt, Human
augucaguauguggaa

SEQ ID NO: 3142114 - RNA, 21 nt, Human
augugacucuuuccaaccggc

SEQ ID NO: 3142115 - RNA, 16 nt, Human
augugacucuuuccaa

SEQ ID NO: 3142116 - RNA, 12 nt, Human
augugacucuuu

SEQ ID NO: 3142117 - RNA, 18 nt, Human
aguucauaaauuuauggu

SEQ ID NO: 3142118 - RNA, 16 nt, Human
aguggcuggaucugug

SEQ ID NO: 3142119 - RNA, 19 nt, Human
augagcuccuuaaggcucu

SEQ ID NO: 3142120 - RNA, 14 nt, Human
aucagccugugcca

SEQ ID NO: 3142121 - RNA, 21 nt, Human
aggagucccugccaucauguu

SEQ ID NO: 3142122 - RNA, 14 nt, Human
agcugagcaggugu

SEQ ID NO: 3142123 - RNA, 18 nt, Human
agcuccuuaaggcucuuu

SEQ ID NO: 3142124 - RNA, 22 nt, Human
agcuccuuaaggcucuuuugua

SEQ ID NO: 3142125 - RNA, 17 nt, Human
agcugcuccccacguca

SEQ ID NO: 3142126 - RNA, 14 nt, Human
agcugcuccccacg

SEQ ID NO: 3142127 - RNA, 20 nt, Human
agaggacaguauuugugggg

SEQ ID NO: 3142128 - RNA, 14 nt, Human
agccgggagccuga

SEQ ID NO: 3142129 - RNA, 11 nt, Human
acacugccagc

SEQ ID NO: 3142130 - RNA, 13 nt, Human
acccccugugccu

SEQ ID NO: 3142131 - RNA, 12 nt, Human
acugccagcauu

SEQ ID NO: 3142132 - RNA, 23 nt, Human
accugccgagaguccaucagccu

SEQ ID NO: 3142133 - RNA, 16 nt, Human
accugccgagagucca

SEQ ID NO: 3142134 - RNA, 13 nt, Human
aaugucaguaugu

SEQ ID NO: 3142135 - RNA, 15 nt, Human
aaugucaguaugugg

SEQ ID NO: 3142136 - RNA, 16 nt, Human
caccccgacuuuuguu

SEQ ID NO: 3142137 - RNA, 19 nt, Human
cuauggggauagaugugug

SEQ ID NO: 3142138 - RNA, 20 nt, Human
cuauggggauagaugugugg

SEQ ID NO: 3142139 - RNA, 21 nt, Human
cuauggggauagaugugugga

SEQ ID NO: 3142140 - RNA, 22 nt, Human
cuacucuggagguuuguuuaga

SEQ ID NO: 3142141 - RNA, 16 nt, Human
cucagaggguguccug

SEQ ID NO: 3142142 - RNA, 17 nt, Human
cucagccccgcguggaa

SEQ ID NO: 3142143 - RNA, 17 nt, Human
cucaggaaccgaggcag

SEQ ID NO: 3142144 - RNA, 19 nt, Human
cucaggaaccgaggcaggg

SEQ ID NO: 3142145 - RNA, 18 nt, Human
cucaggaaccgaggcagg

SEQ ID NO: 3142146 - RNA, 20 nt, Human
cuccccacgucagcugggac

SEQ ID NO: 3142147 - RNA, 16 nt, Human
cuccacucaugugacu

SEQ ID NO: 3142148 - RNA, 22 nt, Human
cuccacucaugugacucuuucc

SEQ ID NO: 3142149 - RNA, 14 nt, Human
ccugccgagagucc

SEQ ID NO: 3142150 - RNA, 23 nt, Human
ccugccgagaguccaucagccuc

SEQ ID NO: 3142151 - RNA, 22 nt, Human
ccugccgagaguccaucagccu

SEQ ID NO: 3142152 - RNA, 19 nt, Human
ccugaagagaagggcaggg

SEQ ID NO: 3142153 - RNA, 15 nt, Human
ccugcaccggggccu

SEQ ID NO: 3142154 - RNA, 17 nt, Human
ccugcaccggggccugg

SEQ ID NO: 3142155 - RNA, 16 nt, Human
cgcggcugggaggagg

SEQ ID NO: 3142156 - RNA, 12 nt, Human
cgcggcugggag

SEQ ID NO: 3142157 - RNA, 11 nt, Human
cgcggcuggga

SEQ ID NO: 3142158 - RNA, 19 nt, Human
cgggacaccuaggcuaggg

SEQ ID NO: 3142159 - RNA, 18 nt, Human
cgggacaccuaggcuagg

SEQ ID NO: 3142160 - RNA, 17 nt, Human
ccugugccuuuugccau

SEQ ID NO: 3142161 - RNA, 21 nt, Human
cgaagcguuguccucagcccc

SEQ ID NO: 3142162 - RNA, 17 nt, Human
cgaagcguuguccucag

SEQ ID NO: 3142163 - RNA, 16 nt, Human
cgaagcguuguccuca

SEQ ID NO: 3142164 - RNA, 15 nt, Human
cgaagcguuguccuc

SEQ ID NO: 3142165 - RNA, 14 nt, Human
ccuuugucccagaa

SEQ ID NO: 3142166 - RNA, 21 nt, Human
ccgagaguccaucagccucca

SEQ ID NO: 3142167 - RNA, 20 nt, Human
ccgagaguccaucagccucc

SEQ ID NO: 3142168 - RNA, 20 nt, Human
ccggggccugggcaggaggg

SEQ ID NO: 3142169 - RNA, 21 nt, Human
ccgggggcagucugagagagg

SEQ ID NO: 3142170 - RNA, 13 nt, Human
ccuaaccugccga

SEQ ID NO: 3142171 - RNA, 12 nt, Human
ccuaaccugccg

SEQ ID NO: 3142172 - RNA, 23 nt, Human
ccguggcuguggcauccagaguc

SEQ ID NO: 3142173 - RNA, 16 nt, Human
ccuaggcuaggguggg

SEQ ID NO: 3142174 - RNA, 14 nt, Human
ccccugugccuugu

SEQ ID NO: 3142175 - RNA, 13 nt, Human
cccaugagcuccu

SEQ ID NO: 3142176 - RNA, 22 nt, Human
cccaugagcuccuuaaggcucu

SEQ ID NO: 3142177 - RNA, 15 nt, Human
cccaugagcuccuua

SEQ ID NO: 3142178 - RNA, 14 nt, Human
cccaugagcuccuu

SEQ ID NO: 3142179 - RNA, 14 nt, Human
cccaacacugccag

SEQ ID NO: 3142180 - RNA, 16 nt, Human
cccaacacugccagca

SEQ ID NO: 3142181 - RNA, 15 nt, Human
cccaacacugccagc

SEQ ID NO: 3142182 - RNA, 15 nt, Human
cccacggcuccucga

SEQ ID NO: 3142183 - RNA, 15 nt, Human
cccacgucagcuggg

SEQ ID NO: 3142184 - RNA, 21 nt, Human
cuggccaguggcuggaucugu

SEQ ID NO: 3142185 - RNA, 12 nt, Human
cuggagguuugu

SEQ ID NO: 3142186 - RNA, 17 nt, Human
cuggagguuuguuuaga

SEQ ID NO: 3142187 - RNA, 18 nt, Human
cuggaccagccucuccac

SEQ ID NO: 3142188 - RNA, 14 nt, Human
cuggaccagccucu

SEQ ID NO: 3142189 - RNA, 22 nt, Human
cugccgagaguccaucagccuc

SEQ ID NO: 3142190 - RNA, 23 nt, Human
cugccgagaguccaucagccucc

SEQ ID NO: 3142191 - RNA, 11 nt, Human
cugcugggcuu

SEQ ID NO: 3142192 - RNA, 21 nt, Human
cugucucccuccucugcccgg

SEQ ID NO: 3142193 - RNA, 19 nt, Human
cugugaggggcucucucau

SEQ ID NO: 3142194 - RNA, 21 nt, Human
cuguguguguguauguggggg

SEQ ID NO: 3142195 - RNA, 16 nt, Human
cuguguguuuaugugu

SEQ ID NO: 3142196 - RNA, 17 nt, Human
cuguguguuuaugugug

SEQ ID NO: 3142197 - RNA, 14 nt, Human
cuuuguggcacugg

SEQ ID NO: 3142198 - RNA, 13 nt, Human
cuugucacgccag

SEQ ID NO: 3142199 - RNA, 16 nt, Human
cuugucacgccagacu

SEQ ID NO: 3142200 - RNA, 22 nt, Human
cuuucuuccaaacaggcucaga

SEQ ID NO: 3142201 - RNA, 15 nt, Human
gaugggucaguugua

SEQ ID NO: 3142202 - RNA, 21 nt, Human
gaugggucaguuguaucagca

SEQ ID NO: 3142203 - RNA, 23 nt, Human
gauugcaggagucccugccauca

SEQ ID NO: 3142204 - RNA, 18 nt, Human
gcacuggggcaggggccg

SEQ ID NO: 3142205 - RNA, 15 nt, Human
gcacuggggcagggg

SEQ ID NO: 3142206 - RNA, 23 nt, Human
gcacuggggcaggggccgggggc

SEQ ID NO: 3142207 - RNA, 14 nt, Human
gagggggagagggc

SEQ ID NO: 3142208 - RNA, 13 nt, Human
gaggguguccugc

SEQ ID NO: 3142209 - RNA, 22 nt, Human
gaggccucucauuccagaggaa

SEQ ID NO: 3142210 - RNA, 20 nt, Human
gaggcgaagcguuguccuca

SEQ ID NO: 3142211 - RNA, 21 nt, Human
gaggcgaagcguuguccucag

SEQ ID NO: 3142212 - RNA, 14 nt, Human
gaggcagggaagga

SEQ ID NO: 3142213 - RNA, 23 nt, Human
gagucccugccuggaccagccuc

SEQ ID NO: 3142214 - RNA, 21 nt, Human
gagucccugccuggaccagcc

SEQ ID NO: 3142215 - RNA, 13 nt, Human
gaguguguaauuu

SEQ ID NO: 3142216 - RNA, 14 nt, Human
gauagaugugugga

SEQ ID NO: 3142217 - RNA, 22 nt, Human
gauagauguguggacacauugg

SEQ ID NO: 3142218 - RNA, 14 nt, Human
gaccagccucucca

SEQ ID NO: 3142219 - RNA, 16 nt, Human
gaaugucaguaugugg

SEQ ID NO: 3142220 - RNA, 18 nt, Human
gaaugucaguauguggaa

SEQ ID NO: 3142221 - RNA, 13 nt, Human
gaaugucaguaug

SEQ ID NO: 3142222 - RNA, 19 nt, Human
gaaugucaguauguggaag

SEQ ID NO: 3142223 - RNA, 13 nt, Human
gagagacgggccc

SEQ ID NO: 3142224 - RNA, 17 nt, Human
gagaaugucaguaugug

SEQ ID NO: 3142225 - RNA, 20 nt, Human
gagaucccaacacugccagc

SEQ ID NO: 3142226 - RNA, 19 nt, Human
gagaucccaacacugccag

SEQ ID NO: 3142227 - RNA, 18 nt, Human
gagaucccaacacugcca

SEQ ID NO: 3142228 - RNA, 23 nt, Human
gcccuggugguggcucgggaggc

SEQ ID NO: 3142229 - RNA, 17 nt, Human
gcuaugagcuggggaug

SEQ ID NO: 3142230 - RNA, 21 nt, Human
gcucagaggguguccugcacc

SEQ ID NO: 3142231 - RNA, 20 nt, Human
ggccauucuuucccaacacc

SEQ ID NO: 3142232 - RNA, 17 nt, Human
ggauggaaugauggguc

SEQ ID NO: 3142233 - RNA, 22 nt, Human
ggccuaaccugccgagagucca

SEQ ID NO: 3142234 - RNA, 21 nt, Human
ggccuaaccugccgagagucc

SEQ ID NO: 3142235 - RNA, 12 nt, Human
ggcccugugccu

SEQ ID NO: 3142236 - RNA, 16 nt, Human
ggcgcggcugggagga

SEQ ID NO: 3142237 - RNA, 14 nt, Human
ggccugggcaggag

SEQ ID NO: 3142238 - RNA, 13 nt, Human
ggccugggcagga

SEQ ID NO: 3142239 - RNA, 21 nt, Human
ggcuauggggauagaugugug

SEQ ID NO: 3142240 - RNA, 16 nt, Human
ggcuaggguggggaga

SEQ ID NO: 3142241 - RNA, 14 nt, Human
gcuuuguggcacug

SEQ ID NO: 3142242 - RNA, 22 nt, Human
gcuuuguggcacuggggcaggg

SEQ ID NO: 3142243 - RNA, 22 nt, Human
ggagaaugucaguauguggaag

SEQ ID NO: 3142244 - RNA, 23 nt, Human
ggaagggacaccaagccuuggcu

SEQ ID NO: 3142245 - RNA, 22 nt, Human
ggaaggaucccaugagcuccuu

SEQ ID NO: 3142246 - RNA, 14 nt, Human
gggcgcggcuggga

SEQ ID NO: 3142247 - RNA, 13 nt, Human
ggggauagaugug

SEQ ID NO: 3142248 - RNA, 18 nt, Human
ggggaguuuagggugggg

SEQ ID NO: 3142249 - RNA, 14 nt, Human
gucccugccuggac

SEQ ID NO: 3142250 - RNA, 21 nt, Human
gucccugccuggaccagccuc

SEQ ID NO: 3142251 - RNA, 20 nt, Human
gucccugccuggaccagccu

SEQ ID NO: 3142252 - RNA, 23 nt, Human
gucccugccuggaccagccucuc

SEQ ID NO: 3142253 - RNA, 22 nt, Human
gucccugccuggaccagccucu

SEQ ID NO: 3142254 - RNA, 12 nt, Human
guccucagcccc

SEQ ID NO: 3142255 - RNA, 20 nt, Human
gucccagaaugccuccugca

SEQ ID NO: 3142256 - RNA, 14 nt, Human
gucacgccagacuu

SEQ ID NO: 3142257 - RNA, 14 nt, Human
guggcauccagagu

SEQ ID NO: 3142258 - RNA, 18 nt, Human
guggcucgggaggcgaag

SEQ ID NO: 3142259 - RNA, 16 nt, Human
guggcucgggaggcga

SEQ ID NO: 3142260 - RNA, 19 nt, Human
gugccuugucacgccagac

SEQ ID NO: 3142261 - RNA, 20 nt, Human
gugcuucuaguucugccagg

SEQ ID NO: 3142262 - RNA, 22 nt, Human
gugcuucuaguucugccaggag

SEQ ID NO: 3142263 - RNA, 21 nt, Human
gugcuucuaguucugccagga

SEQ ID NO: 3142264 - RNA, 12 nt, Human
gugacucuuucc

SEQ ID NO: 3142265 - RNA, 15 nt, Human
gugaggaugucuggg

SEQ ID NO: 3142266 - RNA, 16 nt, Human
gugauuuuuaugccac

SEQ ID NO: 3142267 - RNA, 20 nt, Human
gugauuuuuaugccaccuga

SEQ ID NO: 3142268 - RNA, 19 nt, Human
gugauuuuuaugccaccug

SEQ ID NO: 3142269 - RNA, 17 nt, Human
gugauuuuuaugccacc

SEQ ID NO: 3142270 - RNA, 15 nt, Human
uggaccagccucucc

SEQ ID NO: 3142271 - RNA, 19 nt, Human
uggaucugugaggggcucu

SEQ ID NO: 3142272 - RNA, 15 nt, Human
uggaucugugagggg

SEQ ID NO: 3142273 - RNA, 20 nt, Human
uggcuccauugguguugaca

SEQ ID NO: 3142274 - RNA, 14 nt, Human
ugggggucugugug

SEQ ID NO: 3142275 - RNA, 16 nt, Human
uggggauagaugugug

SEQ ID NO: 3142276 - RNA, 17 nt, Human
uggggauagaugugugg

SEQ ID NO: 3142277 - RNA, 18 nt, Human
uggggauagaugugugga

SEQ ID NO: 3142278 - RNA, 20 nt, Human
uggggauagauguguggaca

SEQ ID NO: 3142279 - RNA, 20 nt, Human
uggggaguuuaggguggggg

SEQ ID NO: 3142280 - RNA, 11 nt, Human
ugggagugugu

SEQ ID NO: 3142281 - RNA, 13 nt, Human
ugggaguguguaa

SEQ ID NO: 3142282 - RNA, 22 nt, Human
ugggagugaggaugucugggcc

SEQ ID NO: 3142283 - RNA, 13 nt, Human
ugggcaggaggga

SEQ ID NO: 3142284 - RNA, 18 nt, Human
ugggcaggagggaggugc

SEQ ID NO: 3142285 - RNA, 16 nt, Human
ugggcaggagggaggu

SEQ ID NO: 3142286 - RNA, 15 nt, Human
ugggcaggagggagg

SEQ ID NO: 3142287 - RNA, 17 nt, Human
ugacauacauccaacau

SEQ ID NO: 3142288 - RNA, 20 nt, Human
ugagcuggggaugucucuca

SEQ ID NO: 3142289 - RNA, 21 nt, Human
ugagcuccuuaaggcucuuuu

SEQ ID NO: 3142290 - RNA, 19 nt, Human
ugagcuccuuaaggcucuu

SEQ ID NO: 3142291 - RNA, 21 nt, Human
uccagagucccugccuggacc

SEQ ID NO: 3142292 - RNA, 20 nt, Human
uccagagucccugccuggac

SEQ ID NO: 3142293 - RNA, 19 nt, Human
uccagagucccugccugga

SEQ ID NO: 3142294 - RNA, 18 nt, Human
uccagagucccugccugg

SEQ ID NO: 3142295 - RNA, 14 nt, Human
uccaaacaggcuca

SEQ ID NO: 3142296 - RNA, 22 nt, Human
ucagucuuuaaucugagaggcc

SEQ ID NO: 3142297 - RNA, 17 nt, Human
uccuacccccugugccu

SEQ ID NO: 3142298 - RNA, 16 nt, Human
uccuacccccugugcc

SEQ ID NO: 3142299 - RNA, 15 nt, Human
uccuacccccugugc

SEQ ID NO: 3142300 - RNA, 13 nt, Human
uccuacccccugu

SEQ ID NO: 3142301 - RNA, 15 nt, Human
uccugucucccuccu

SEQ ID NO: 3142302 - RNA, 23 nt, Human
uccugucucccuccucugcccgg

SEQ ID NO: 3142303 - RNA, 18 nt, Human
ucucccuccucugcccgg

SEQ ID NO: 3142304 - RNA, 16 nt, Human
uaggcuagggugggga

SEQ ID NO: 3142305 - RNA, 15 nt, Human
uaggcuagggugggg

SEQ ID NO: 3142306 - RNA, 23 nt, Human
uaugagcuggggaugucucucau

SEQ ID NO: 3142307 - RNA, 12 nt, Human
uuaacucagucu

SEQ ID NO: 3142308 - RNA, 19 nt, Human
uguuuagaagaaguguguc

SEQ ID NO: 3142309 - RNA, 16 nt, Human
uguuuagaagaagugu

SEQ ID NO: 3142310 - RNA, 13 nt, Human
uuaugccaccuga

SEQ ID NO: 3142311 - RNA, 16 nt, Human
uuaugccaccugaaua

SEQ ID NO: 3142312 - RNA, 16 nt, Human
uuuaaaauugugaugu

SEQ ID NO: 3142313 - RNA, 15 nt, Human
uuguuuagaagaagu

SEQ ID NO: 3142314 - RNA, 18 nt, Human
uuguuuagaagaagugug

SEQ ID NO: 3142315 - RNA, 20 nt, Human
uuuacagaggacaguauuug

SEQ ID NO: 3142316 - RNA, 14 nt, Human
uuuaugccaccuga

SEQ ID NO: 3142317 - RNA, 16 nt, Human
uuggcagcucuacucu

SEQ ID NO: 3142318 - RNA, 11 nt, Human
uuuguggggag

SEQ ID NO: 3142319 - RNA, 12 nt, Human
caacacugccag

SEQ ID NO: 3142320 - RNA, 14 nt, Human
caacacugccagca

SEQ ID NO: 3142321 - RNA, 13 nt, Human
caacacugccagc

SEQ ID NO: 3142322 - RNA, 22 nt, Human
caaccggcuuuguggcacuggg

SEQ ID NO: 3142323 - RNA, 13 nt, Human
caaccggcuuugu

SEQ ID NO: 3142324 - RNA, 17 nt, Human
aauaagugccaggaugg

SEQ ID NO: 3142325 - RNA, 16 nt, Human
aaugucaguaugugga

SEQ ID NO: 3142326 - RNA, 22 nt, Human
aaugucaguauguggaagugug

SEQ ID NO: 3142327 - RNA, 13 nt, Human
acucagucuuuaa

SEQ ID NO: 3142328 - RNA, 22 nt, Human
acgccagacuucccacggcucc

SEQ ID NO: 3142329 - RNA, 16 nt, Human
acgccagacuucccac

SEQ ID NO: 3142330 - RNA, 15 nt, Human
acagguuagcugcuc

SEQ ID NO: 3142331 - RNA, 15 nt, Human
accccgacuuuuguu

SEQ ID NO: 3142332 - RNA, 12 nt, Human
accccgacuuuu

SEQ ID NO: 3142333 - RNA, 13 nt, Human
agccagaggucug

SEQ ID NO: 3142334 - RNA, 16 nt, Human
agaggguguccugcac

SEQ ID NO: 3142335 - RNA, 14 nt, Human
agacgggcccuggu

SEQ ID NO: 3142336 - RNA, 21 nt, Human
aggcuauggggauagaugugu

SEQ ID NO: 3142337 - RNA, 22 nt, Human
aggcuauggggauagaugugug

SEQ ID NO: 3142338 - RNA, 19 nt, Human
aggcuauggggauagaugu

SEQ ID NO: 3142339 - RNA, 22 nt, Human
aggugcuucuaguucugccagg

SEQ ID NO: 3142340 - RNA, 21 nt, Human
aggugcuucuaguucugccag

SEQ ID NO: 3142341 - RNA, 23 nt, Human
aggugcuucuaguucugccagga

SEQ ID NO: 3142342 - RNA, 17 nt, Human
aggggccgggggcaguc

SEQ ID NO: 3142343 - RNA, 20 nt, Human
aguuguaucagcacgugugg

SEQ ID NO: 3142344 - RNA, 23 nt, Human
aguuguaucagcacguguggccu

SEQ ID NO: 3142345 - RNA, 17 nt, Human
augugggggucugugug

SEQ ID NO: 3142346 - RNA, 18 nt, Human
augugggggucugugugu

SEQ ID NO: 3142347 - RNA, 16 nt, Human
augugggggucugugu

SEQ ID NO: 3142348 - RNA, 15 nt, Human
guccaucagccucca

SEQ ID NO: 3142349 - RNA, 22 nt, Human
gucccgggacaccuaggcuagg

SEQ ID NO: 3142350 - RNA, 10 nt, Human
gugauguguc

SEQ ID NO: 3142351 - RNA, 19 nt, Human
aagaagugugucacccuua

SEQ ID NO: 3142352 - RNA, 21 nt, Human
aagucacuggccaguggcugg

SEQ ID NO: 3142353 - RNA, 15 nt, Human
uaaaauugugaugug

SEQ ID NO: 3142354 - RNA, 16 nt, Human
uaaaauugugaugugu

SEQ ID NO: 3142355 - RNA, 20 nt, Human
aagugugggucugugugugu

SEQ ID NO: 3142356 - RNA, 10 nt, Human
aagugugggu

SEQ ID NO: 3142357 - RNA, 17 nt, Human
aagugugggucugugug

SEQ ID NO: 3142358 - RNA, 18 nt, Human
aagugugggucugugugu

SEQ ID NO: 3142359 - RNA, 13 nt, Human
guguauguggggg

SEQ ID NO: 3142360 - RNA, 21 nt, Human
guguaugugggggucugugug

SEQ ID NO: 3142361 - RNA, 20 nt, Human
uauggggauagaugugugga

SEQ ID NO: 3142362 - RNA, 12 nt, Human
uauguggaagug

SEQ ID NO: 3142363 - RNA, 16 nt, Human
uauguggaaguguggg

SEQ ID NO: 3142364 - RNA, 16 nt, Human
acaccucuuggggagu

SEQ ID NO: 3142365 - RNA, 22 nt, Human
uaacuuaaaagaacauguauau

SEQ ID NO: 3142366 - RNA, 19 nt, Human
uccugcaccggggccuggg

SEQ ID NO: 3142367 - RNA, 18 nt, Human
uccugcaccggggccugg

SEQ ID NO: 3142368 - RNA, 23 nt, Human
ucacagcaagucacuggccagug

SEQ ID NO: 3142369 - RNA, 17 nt, Human
accuaggcuaggguggg

SEQ ID NO: 3142370 - RNA, 12 nt, Human
accuaggcuagg

SEQ ID NO: 3142371 - RNA, 17 nt, Human
ucaugugacucuuucca

SEQ ID NO: 3142372 - RNA, 14 nt, Human
ucaugugacucuuu

SEQ ID NO: 3142373 - RNA, 17 nt, Human
ucauguuuacagaggac

SEQ ID NO: 3142374 - RNA, 19 nt, Human
ucaugugacucuuuccaac

SEQ ID NO: 3142375 - RNA, 18 nt, Human
ucaugugacucuuuccaa

SEQ ID NO: 3142376 - RNA, 14 nt, Human
ucaguauguggaag

SEQ ID NO: 3142377 - RNA, 12 nt, Human
ucaguaugugga

SEQ ID NO: 3142378 - RNA, 16 nt, Human
ucauaaauuuaugguu

SEQ ID NO: 3142379 - RNA, 13 nt, Human
accgaggcaggga

SEQ ID NO: 3142380 - RNA, 17 nt, Human
ucagauuugccuuauug

SEQ ID NO: 3142381 - RNA, 14 nt, Human
ucuaguucugccag

SEQ ID NO: 3142382 - RNA, 17 nt, Human
ucuaguucugccaggag

SEQ ID NO: 3142383 - RNA, 16 nt, Human
ucuaguucugccagga

SEQ ID NO: 3142384 - RNA, 15 nt, Human
ucuaguucugccagg

SEQ ID NO: 3142385 - RNA, 14 nt, Human
agaagaaguguguc

SEQ ID NO: 3142386 - RNA, 13 nt, Human
ugagagaggccau

SEQ ID NO: 3142387 - RNA, 22 nt, Human
auguggaagugugggucugugu

SEQ ID NO: 3142388 - RNA, 23 nt, Human
auguggaagugugggucugugug

SEQ ID NO: 3142389 - RNA, 15 nt, Human
auguggaaguguggg

SEQ ID NO: 3142390 - RNA, 16 nt, Human
auguggaagugugggu

SEQ ID NO: 3142391 - RNA, 13 nt, Human
auguggaagugug

SEQ ID NO: 3142392 - RNA, 10 nt, Human
augugugugu

SEQ ID NO: 3142393 - RNA, 16 nt, Human
uuuuguuuaccagaga

SEQ ID NO: 3142394 - RNA, 12 nt, Human
auugguguugac

SEQ ID NO: 3142395 - RNA, 13 nt, Human
auugugauguguc

SEQ ID NO: 3142396 - RNA, 14 nt, Human
auugugaugugucc

SEQ ID NO: 3142397 - RNA, 15 nt, Human
auugugauguguccu

SEQ ID NO: 3142398 - RNA, 20 nt, Human
auuucccuuccuuccucucc

SEQ ID NO: 3142399 - RNA, 16 nt, Human
uucagauuugccuuau

SEQ ID NO: 3142400 - RNA, 20 nt, Human
auccauggggcugauuguau

SEQ ID NO: 3142401 - RNA, 20 nt, Human
aucauuaucagccugugcca

SEQ ID NO: 3142402 - RNA, 18 nt, Human
aucggggagccgggagcc

SEQ ID NO: 3142403 - RNA, 16 nt, Human
aucggggagccgggag

SEQ ID NO: 3142404 - RNA, 20 nt, Human
uugcuaugagcuggggaugu

SEQ ID NO: 3142405 - RNA, 10 nt, Human
uugugugugg

SEQ ID NO: 3142406 - RNA, 13 nt, Human
uugugugugggag

SEQ ID NO: 3142407 - RNA, 16 nt, Human
uugugugugggagugu

SEQ ID NO: 3142408 - RNA, 20 nt, Human
uugucacgccagacuuccca

SEQ ID NO: 3142409 - RNA, 13 nt, Human
uugucacgccaga

SEQ ID NO: 3142410 - RNA, 18 nt, Human
uugucccugaagagaagg

SEQ ID NO: 3142411 - RNA, 22 nt, Human
uuguccucagccccgcguggaa

SEQ ID NO: 3142412 - RNA, 22 nt, Human
uggcugccuugugaaggaauua

SEQ ID NO: 3142413 - RNA, 16 nt, Human
uggccaguggcuggau

SEQ ID NO: 3142414 - RNA, 14 nt, Human
uggccaguggcugg

SEQ ID NO: 3142415 - RNA, 15 nt, Human
uggccaguggcugga

SEQ ID NO: 3142416 - RNA, 19 nt, Human
aggccauucuuucccaaca

SEQ ID NO: 3142417 - RNA, 18 nt, Human
aggccauucuuucccaac

SEQ ID NO: 3142418 - RNA, 17 nt, Human
aggccauucuuucccaa

SEQ ID NO: 3142419 - RNA, 21 nt, Human
aggccucucauuccagaggaa

SEQ ID NO: 3142420 - RNA, 15 nt, Human
aggccauucuuuccc

SEQ ID NO: 3142421 - RNA, 22 nt, Human
uggaccuuuccugaggaagagg

SEQ ID NO: 3142422 - RNA, 22 nt, Human
ugcuauuguagagccagagguc

SEQ ID NO: 3142423 - RNA, 18 nt, Human
ugcuauuguagagccaga

SEQ ID NO: 3142424 - RNA, 13 nt, Human
ugcuccccacguc

SEQ ID NO: 3142425 - RNA, 22 nt, Human
uggaccagccucuccacucaug

SEQ ID NO: 3142426 - RNA, 16 nt, Human
uggaccagccucucca

SEQ ID NO: 3142427 - RNA, 14 nt, Human
agcugccugugccu

SEQ ID NO: 3142428 - RNA, 18 nt, Human
uguugggagugaggaugu

SEQ ID NO: 3142429 - RNA, 14 nt, Human
uuaucaacauuugu

SEQ ID NO: 3142430 - RNA, 15 nt, Human
ugggucugugugugu

SEQ ID NO: 3142431 - RNA, 13 nt, Human
ugggucugugugu

SEQ ID NO: 3142432 - RNA, 23 nt, Human
ugggaauaagugccaggauggaa

SEQ ID NO: 3142433 - RNA, 20 nt, Human
uguaugugggggucugugug

SEQ ID NO: 3142434 - RNA, 21 nt, Human
uguaugugggggucugugugu

SEQ ID NO: 3142435 - RNA, 22 nt, Human
uguaugugggggucuguguguu

SEQ ID NO: 3142436 - RNA, 22 nt, Human
uguauccauccauggggcugau

SEQ ID NO: 3142437 - RNA, 14 nt, Human
aguccaucagccuc

SEQ ID NO: 3142438 - RNA, 13 nt, Human
aguccaucagccu

SEQ ID NO: 3142439 - RNA, 13 nt, Human
agucccugccugg

SEQ ID NO: 3142440 - RNA, 11 nt, Human
ugugauguguc

SEQ ID NO: 3142441 - RNA, 22 nt, Human
gggggcagucugagagaggcca

SEQ ID NO: 3142442 - RNA, 21 nt, Human
gggucaucuguaccucugccu

SEQ ID NO: 3142443 - RNA, 18 nt, Human
gggucauucauggccugg

SEQ ID NO: 3142444 - RNA, 16 nt, Human
gguaggaacugcuggg

SEQ ID NO: 3142445 - RNA, 18 nt, Human
gguaggaacugcugggcu

SEQ ID NO: 3142446 - RNA, 21 nt, Human
ggguguccugcaccggggccu

SEQ ID NO: 3142447 - RNA, 17 nt, Human
ggguguccugcaccggg

SEQ ID NO: 3142448 - RNA, 22 nt, Human
gguggggggggggcgcggcugg

SEQ ID NO: 3142449 - RNA, 22 nt, Human
gguuuguuuagaagaagugugu

SEQ ID NO: 3142450 - RNA, 14 nt, Human
ggcaggagggaggu

SEQ ID NO: 3142451 - RNA, 12 nt, Human
ggcaggggccgg

SEQ ID NO: 3142452 - RNA, 23 nt, Human
ggcaucggggagccgggagccug

SEQ ID NO: 3142453 - RNA, 18 nt, Human
ggcauccagagucccugc

SEQ ID NO: 3142454 - RNA, 16 nt, Human
ggcauccagagucccu

SEQ ID NO: 3142455 - RNA, 22 nt, Human
ggcaucggggagccgggagccu

SEQ ID NO: 3142456 - RNA, 14 nt, Human
ggagggggagaggg

SEQ ID NO: 3142457 - RNA, 11 nt, Human
ggaguguguaa

SEQ ID NO: 3142458 - RNA, 22 nt, Human
ggaguguguaauuuaaaauugu

SEQ ID NO: 3142459 - RNA, 18 nt, Human
gcuaggguggggagagac

SEQ ID NO: 3142460 - RNA, 17 nt, Human
gcuaggguggggagaga

SEQ ID NO: 3142461 - RNA, 19 nt, Human
gcucagaggguguccugca

SEQ ID NO: 3142462 - RNA, 18 nt, Human
gcucagaggguguccugc

SEQ ID NO: 3142463 - RNA, 21 nt, Human
gcguggaacucgugucuggca

SEQ ID NO: 3142464 - RNA, 12 nt, Human
gccauucuuucc

SEQ ID NO: 3142465 - RNA, 19 nt, Human
gccauucuuucccaacacc

SEQ ID NO: 3142466 - RNA, 20 nt, Human
gcugggaauaagugccagga

SEQ ID NO: 3142467 - RNA, 22 nt, Human
gcuuuuccucaaagggagagag

SEQ ID NO: 3142468 - RNA, 16 nt, Human
ggacaccccgacuuuu

SEQ ID NO: 3142469 - RNA, 16 nt, Human
ggacaccuaggcuagg

SEQ ID NO: 3142470 - RNA, 19 nt, Human
ggacaguauuuguggggag

SEQ ID NO: 3142471 - RNA, 18 nt, Human
ggacaguauuugugggga

SEQ ID NO: 3142472 - RNA, 14 nt, Human
cuuuugucccagaa

SEQ ID NO: 3142473 - RNA, 17 nt, Human
cuucuaccucuuggcug

SEQ ID NO: 3142474 - RNA, 19 nt, Human
cuuccucuccugucucccu

SEQ ID NO: 3142475 - RNA, 15 nt, Human
cuuccucuccugucu

SEQ ID NO: 3142476 - RNA, 23 nt, Human
cuggcccuaugcuuccggccucc

SEQ ID NO: 3142477 - RNA, 16 nt, Human
gagacgggcccuggug

SEQ ID NO: 3142478 - RNA, 22 nt, Human
gaggacaguauuuguggggagg

SEQ ID NO: 3142479 - RNA, 13 nt, Human
gauggaaugaugg

SEQ ID NO: 3142480 - RNA, 17 nt, Human
gaucccaacacugccag

SEQ ID NO: 3142481 - RNA, 19 nt, Human
gaucccaacacugccagca

SEQ ID NO: 3142482 - RNA, 18 nt, Human
gaucccaacacugccagc

SEQ ID NO: 3142483 - RNA, 21 nt, Human
gcauccagagucccugccugg

SEQ ID NO: 3142484 - RNA, 23 nt, Human
gcauccagagucccugccuggac

SEQ ID NO: 3142485 - RNA, 22 nt, Human
gcauccagagucccugccugga

SEQ ID NO: 3142486 - RNA, 17 nt, Human
gcaucggggagccggga

SEQ ID NO: 3142487 - RNA, 17 nt, Human
cagaggguguccugcac

SEQ ID NO: 3142488 - RNA, 16 nt, Human
cagggcugaggccucu

SEQ ID NO: 3142489 - RNA, 18 nt, Human
cagggcugaggccucuca

SEQ ID NO: 3142490 - RNA, 17 nt, Human
cagucugagagaggcca

SEQ ID NO: 3142491 - RNA, 15 nt, Human
cacuggggcaggggc

SEQ ID NO: 3142492 - RNA, 13 nt, Human
cacuggggcaggg

SEQ ID NO: 3142493 - RNA, 18 nt, Human
caacaccucuuggggagu

SEQ ID NO: 3142494 - RNA, 19 nt, Human
auucuuugaccuguuggga

SEQ ID NO: 3142495 - RNA, 21 nt, Human
cuaauucuuugaccuguuggg

SEQ ID NO: 3142496 - RNA, 22 nt, Human
cuaauucuuugaccuguuggga

SEQ ID NO: 3142497 - RNA, 18 nt, Human
cucaugugacucuuucca

SEQ ID NO: 3142498 - RNA, 15 nt, Human
cucgugucuggcaca

SEQ ID NO: 3142499 - RNA, 12 nt, Human
cugagaggccac

SEQ ID NO: 3142500 - RNA, 13 nt, Human
cugagagaggcca

SEQ ID NO: 3142501 - RNA, 22 nt, Human
cugagagaggccauucuuuccc

SEQ ID NO: 3142502 - RNA, 21 nt, Human
cugagagaggccauucuuucc

SEQ ID NO: 3142503 - RNA, 14 nt, Human
cugagagaggccau

SEQ ID NO: 3142504 - RNA, 12 nt, Human
cagguguucuuc

SEQ ID NO: 3142505 - RNA, 12 nt, Human
caguauguggaa

SEQ ID NO: 3142506 - RNA, 22 nt, Human
cagucuuuaaucugagaggcca

SEQ ID NO: 3142507 - RNA, 11 nt, Human
caggcucagag

SEQ ID NO: 3142508 - RNA, 15 nt, Human
caggcucagagggug

SEQ ID NO: 3142509 - RNA, 18 nt, Human
cagggaaggaucccauga

SEQ ID NO: 3142510 - RNA, 13 nt, Human
cagggaaggaucc

SEQ ID NO: 3142511 - RNA, 23 nt, Human
caggagacagguuagcugcuccc

SEQ ID NO: 3142512 - RNA, 15 nt, Human
caggagucccugcca

SEQ ID NO: 3142513 - RNA, 21 nt, Human
caggagucccugccaucaugu

SEQ ID NO: 3142514 - RNA, 14 nt, Human
caggagucccugcc

SEQ ID NO: 3142515 - RNA, 21 nt, Human
caggcaucggggagccgggag

SEQ ID NO: 3142516 - RNA, 20 nt, Human
caggcaucggggagccggga

SEQ ID NO: 3142517 - RNA, 21 nt, Human
cagccuccauccuacccccug

SEQ ID NO: 3142518 - RNA, 18 nt, Human
cagccuccauccuacccc

SEQ ID NO: 3142519 - RNA, 23 nt, Human
cagccucuccacucaugugacuc

SEQ ID NO: 3142520 - RNA, 23 nt, Human
cagccuggcuguggccuaaccug

SEQ ID NO: 3142521 - RNA, 18 nt, Human
caggaaccgaggcaggga

SEQ ID NO: 3142522 - RNA, 17 nt, Human
caggaaccgaggcaggg

SEQ ID NO: 3142523 - RNA, 15 nt, Human
caggaaccgaggcag

SEQ ID NO: 3142524 - RNA, 15 nt, Human
cagcauuucccuucc

SEQ ID NO: 3142525 - RNA, 18 nt, Human
cagagucccugccuggac

SEQ ID NO: 3142526 - RNA, 14 nt, Human
cagagucccugccu

SEQ ID NO: 3142527 - RNA, 22 nt, Human
cagaggacaguauuugugggga

SEQ ID NO: 3142528 - RNA, 12 nt, Human
cagagaaaaagg

SEQ ID NO: 3142529 - RNA, 18 nt, Human
cagagaaaaagggagggg

SEQ ID NO: 3142530 - RNA, 17 nt, Human
cagagaaaaagggaggg

SEQ ID NO: 3142531 - RNA, 22 nt, Human
cagacuucccacggcuccucga

SEQ ID NO: 3142532 - RNA, 12 nt, Human
cagacuucccac

SEQ ID NO: 3142533 - RNA, 22 nt, Human
caccggggccugggcaggaggg

SEQ ID NO: 3142534 - RNA, 21 nt, Human
caccggggccugggcaggagg

SEQ ID NO: 3142535 - RNA, 14 nt, Human
caccggggccuggg

SEQ ID NO: 3142536 - RNA, 22 nt, Human
cacucaugugacucuuuccaac

SEQ ID NO: 3142537 - RNA, 16 nt, Human
cacucaugugacucuu

SEQ ID NO: 3142538 - RNA, 22 nt, Human
cacggcuccucgagaucccaac

SEQ ID NO: 3142539 - RNA, 20 nt, Human
cacggcuccucgagauccca

SEQ ID NO: 3142540 - RNA, 19 nt, Human
cacguguggccuguucuuc

SEQ ID NO: 3142541 - RNA, 19 nt, Human
ggagacagguuagcugcuc

SEQ ID NO: 3142542 - RNA, 12 nt, Human
ggaccagccucu

SEQ ID NO: 3142543 - RNA, 21 nt, Human
ggagcucaggaaccgaggcag

SEQ ID NO: 3142544 - RNA, 14 nt, Human
ggagggcaggcauc

SEQ ID NO: 3142545 - RNA, 23 nt, Human
ggcuguggcauccagagucccug

SEQ ID NO: 3142546 - RNA, 21 nt, Human
ggcuguggcauccagaguccc

SEQ ID NO: 3142547 - RNA, 13 nt, Human
ggcugggaggagg

SEQ ID NO: 3142548 - RNA, 21 nt, Human
ggcugggaggagggcaggcau

SEQ ID NO: 3142549 - RNA, 20 nt, Human
ggcugggaggagggcaggca

SEQ ID NO: 3142550 - RNA, 20 nt, Human
gggacaccaagccuuggcuc

SEQ ID NO: 3142551 - RNA, 14 nt, Human
gggacaccuaggcu

SEQ ID NO: 3142552 - RNA, 16 nt, Human
gggaggagggcaggca

SEQ ID NO: 3142553 - RNA, 12 nt, Human
gggaggagggca

SEQ ID NO: 3142554 - RNA, 13 nt, Human
gggagccgggagc

SEQ ID NO: 3142555 - RNA, 23 nt, Human
gggagcucaggaaccgaggcagg

SEQ ID NO: 3142556 - RNA, 22 nt, Human
gggagcucaggaaccgaggcag

SEQ ID NO: 3142557 - RNA, 12 nt, Human
gggagcucagga

SEQ ID NO: 3142558 - RNA, 20 nt, Human
ggccucucauuccagaggaa

SEQ ID NO: 3142559 - RNA, 16 nt, Human
ggccuaaccugccgag

SEQ ID NO: 3142560 - RNA, 15 nt, Human
ggccuaaccugccga

SEQ ID NO: 3142561 - RNA, 16 nt, Human
ggccugacucucagca

SEQ ID NO: 3142562 - RNA, 17 nt, Human
ggccugggcaggaggga

SEQ ID NO: 3142563 - RNA, 15 nt, Human
ggccugggcaggagg

SEQ ID NO: 3142564 - RNA, 19 nt, Human
ggccugggcaggagggagg

SEQ ID NO: 3142565 - RNA, 21 nt, Human
gcuccuuaaggcucuuuugua

SEQ ID NO: 3142566 - RNA, 17 nt, Human
gcuccuuaaggcucuuu

SEQ ID NO: 3142567 - RNA, 15 nt, Human
gcuccuuaaggcucu

SEQ ID NO: 3142568 - RNA, 16 nt, Human
gccugggcaggaggga

SEQ ID NO: 3142569 - RNA, 16 nt, Human
gccuggaccagccucu

SEQ ID NO: 3142570 - RNA, 17 nt, Human
gccuggaccagccucuc

SEQ ID NO: 3142571 - RNA, 17 nt, Human
gccuugucacgccagac

SEQ ID NO: 3142572 - RNA, 16 nt, Human
gccuugucacgccaga

SEQ ID NO: 3142573 - RNA, 15 nt, Human
gccuugucacgccag

SEQ ID NO: 3142574 - RNA, 17 nt, Human
gcgaagcguuguccuca

SEQ ID NO: 3142575 - RNA, 14 nt, Human
gcugauuguauuua

SEQ ID NO: 3142576 - RNA, 20 nt, Human
gcuguggccuaaccugccga

SEQ ID NO: 3142577 - RNA, 19 nt, Human
gcuguggccuaaccugccg

SEQ ID NO: 3142578 - RNA, 14 nt, Human
gcuggggaugucuc

SEQ ID NO: 3142579 - RNA, 22 nt, Human
gcugggcuuggcagcccggguc

SEQ ID NO: 3142580 - RNA, 21 nt, Human
gcugggaggagggcaggcauc

SEQ ID NO: 3142581 - RNA, 22 nt, Human
gcaggcaucggggagccgggag

SEQ ID NO: 3142582 - RNA, 21 nt, Human
gcaggcaucggggagccggga

SEQ ID NO: 3142583 - RNA, 23 nt, Human
gcaggcaucggggagccgggagc

SEQ ID NO: 3142584 - RNA, 15 nt, Human
gccacgauugcagga

SEQ ID NO: 3142585 - RNA, 16 nt, Human
gccaccugaauaaaga

SEQ ID NO: 3142586 - RNA, 21 nt, Human
gccagacuucccacggcuccu

SEQ ID NO: 3142587 - RNA, 15 nt, Human
gaggagggcaggcau

SEQ ID NO: 3142588 - RNA, 14 nt, Human
gaggagggcaggca

SEQ ID NO: 3142589 - RNA, 13 nt, Human
gaggagggcaggc

SEQ ID NO: 3142590 - RNA, 15 nt, Human
gaggaugucugggcc

SEQ ID NO: 3142591 - RNA, 22 nt, Human
gagcucaggaaccgaggcaggg

SEQ ID NO: 3142592 - RNA, 23 nt, Human
gagcucaggaaccgaggcaggga

SEQ ID NO: 3142593 - RNA, 14 nt, Human
gagucccugccauc

SEQ ID NO: 3142594 - RNA, 15 nt, Human
gagucccugccugga

SEQ ID NO: 3142595 - RNA, 14 nt, Human
gagucccugccugg

SEQ ID NO: 3142596 - RNA, 19 nt, Human
gagucccugccuggaccag

SEQ ID NO: 3142597 - RNA, 16 nt, Human
gagucccugccuggac

SEQ ID NO: 3142598 - RNA, 22 nt, Human
gagguuuguuuagaagaagugu

SEQ ID NO: 3142599 - RNA, 21 nt, Human
gauguguccugauaagcugag

SEQ ID NO: 3142600 - RNA, 12 nt, Human
cugagcaggugu

SEQ ID NO: 3142601 - RNA, 14 nt, Human
cucugcccgggagc

SEQ ID NO: 3142602 - RNA, 20 nt, Human
cucugcccgggagcucagga

SEQ ID NO: 3142603 - RNA, 13 nt, Human
cugauuguauuua

SEQ ID NO: 3142604 - RNA, 17 nt, Human
cugccuggaccagccuc

SEQ ID NO: 3142605 - RNA, 23 nt, Human
cucgagaucccaacacugccagc

SEQ ID NO: 3142606 - RNA, 22 nt, Human
cucgagaucccaacacugccag

SEQ ID NO: 3142607 - RNA, 21 nt, Human
cucgagaucccaacacugcca

SEQ ID NO: 3142608 - RNA, 13 nt, Human
cucgagaucccaa

SEQ ID NO: 3142609 - RNA, 14 nt, Human
cuauuguagagcca

SEQ ID NO: 3142610 - RNA, 17 nt, Human
cuuucccaacaccucuu

SEQ ID NO: 3142611 - RNA, 13 nt, Human
cuuucccaacacc

SEQ ID NO: 3142612 - RNA, 13 nt, Human
gaacuauuagagc

SEQ ID NO: 3142613 - RNA, 19 nt, Human
gaaggaucccaugagcucc

SEQ ID NO: 3142614 - RNA, 17 nt, Human
gaauaaagaaugaaugg

SEQ ID NO: 3142615 - RNA, 20 nt, Human
gaauaagugccaggauggaa

SEQ ID NO: 3142616 - RNA, 14 nt, Human
gaaugccuccugca

SEQ ID NO: 3142617 - RNA, 19 nt, Human
cuuccaaacaggcucagag

SEQ ID NO: 3142618 - RNA, 15 nt, Human
cuuaaggcucuuuug

SEQ ID NO: 3142619 - RNA, 22 nt, Human
cuggugguggcucgggaggcga

SEQ ID NO: 3142620 - RNA, 14 nt, Human
cuggugguggcucg

SEQ ID NO: 3142621 - RNA, 18 nt, Human
cuguggccuaaccugccg

SEQ ID NO: 3142622 - RNA, 18 nt, Human
cuguguguguguaugugg

SEQ ID NO: 3142623 - RNA, 20 nt, Human
cuguguguguguaugugggg

SEQ ID NO: 3142624 - RNA, 18 nt, Human
cuguguguuuaugugugu

SEQ ID NO: 3142625 - RNA, 20 nt, Human
cuguguguuuaugugugugu

SEQ ID NO: 3142626 - RNA, 15 nt, Human
cuguguguguguaug

SEQ ID NO: 3142627 - RNA, 16 nt, Human
cuguguguguguaugu

SEQ ID NO: 3142628 - RNA, 14 nt, Human
cuguguguguguau

SEQ ID NO: 3142629 - RNA, 22 nt, Human
ccgggucaucuguaccucugcc

SEQ ID NO: 3142630 - RNA, 20 nt, Human
ccgggacaccuaggcuaggg

SEQ ID NO: 3142631 - RNA, 19 nt, Human
ccgggacaccuaggcuagg

SEQ ID NO: 3142632 - RNA, 15 nt, Human
ccgaggcagggaagg

SEQ ID NO: 3142633 - RNA, 18 nt, Human
ccucucauuccagaggaa

SEQ ID NO: 3142634 - RNA, 18 nt, Human
ccucuccacucaugugac

SEQ ID NO: 3142635 - RNA, 18 nt, Human
ccuugucacgccagacuu

SEQ ID NO: 3142636 - RNA, 15 nt, Human
ccuugucacgccaga

SEQ ID NO: 3142637 - RNA, 13 nt, Human
ccuuaaggcucuu

SEQ ID NO: 3142638 - RNA, 18 nt, Human
ccuuaaggcucuuuugua

SEQ ID NO: 3142639 - RNA, 16 nt, Human
ccuuaaggcucuuuug

SEQ ID NO: 3142640 - RNA, 13 nt, Human
cgagaucccaaca

SEQ ID NO: 3142641 - RNA, 21 nt, Human
cgagaucccaacacugccagc

SEQ ID NO: 3142642 - RNA, 15 nt, Human
cgagaucccaacacu

SEQ ID NO: 3142643 - RNA, 22 nt, Human
cgagaucccaacacugccagca

SEQ ID NO: 3142644 - RNA, 14 nt, Human
ccugggcaggaggg

SEQ ID NO: 3142645 - RNA, 12 nt, Human
ccugggcaggag

SEQ ID NO: 3142646 - RNA, 19 nt, Human
ccugaggaagagggacugu

SEQ ID NO: 3142647 - RNA, 21 nt, Human
ccagcauuucccuuccuuccu

SEQ ID NO: 3142648 - RNA, 16 nt, Human
ccagcauuucccuucc

SEQ ID NO: 3142649 - RNA, 19 nt, Human
ccacucaugugacucuuuc

SEQ ID NO: 3142650 - RNA, 22 nt, Human
ccacucaugugacucuuuccaa

SEQ ID NO: 3142651 - RNA, 20 nt, Human
ccaccugaauaaagaaugaa

SEQ ID NO: 3142652 - RNA, 17 nt, Human
ccauccuacccccugug

SEQ ID NO: 3142653 - RNA, 18 nt, Human
ccauccuacccccugugc

SEQ ID NO: 3142654 - RNA, 13 nt, Human
ccaggagacaggu

SEQ ID NO: 3142655 - RNA, 19 nt, Human
caugaguuggcugggaaua

SEQ ID NO: 3142656 - RNA, 23 nt, Human
caugagcuccuuaaggcucuuuu

SEQ ID NO: 3142657 - RNA, 18 nt, Human
cauccuacccccugugcc

SEQ ID NO: 3142658 - RNA, 15 nt, Human
cauccuacccccugu

SEQ ID NO: 3142659 - RNA, 19 nt, Human
caucauguuuacagaggac

SEQ ID NO: 3142660 - RNA, 21 nt, Human
caucauguuuacagaggacag

SEQ ID NO: 3142661 - RNA, 13 nt, Human
caucauguuuaca

SEQ ID NO: 3142662 - RNA, 20 nt, Human
cauccagagucccugccugg

SEQ ID NO: 3142663 - RNA, 18 nt, Human
cauccagagucccugccu

SEQ ID NO: 3142664 - RNA, 17 nt, Human
cauccagagucccugcc

SEQ ID NO: 3142665 - RNA, 13 nt, Human
cauccagaguccc

SEQ ID NO: 3142666 - RNA, 21 nt, Human
cauccagagucccugccugga

SEQ ID NO: 3142667 - RNA, 14 nt, Human
caugugacucuuuc

SEQ ID NO: 3142668 - RNA, 17 nt, Human
caugugacucuuuccaa

SEQ ID NO: 3142669 - RNA, 16 nt, Human
caugugacucuuucca

SEQ ID NO: 3142670 - RNA, 12 nt, Human
cauucuuuccca

SEQ ID NO: 3142671 - RNA, 14 nt, Human
cauucuuucccaac

SEQ ID NO: 3142672 - RNA, 14 nt, Human
cauuccagaggaag

SEQ ID NO: 3142673 - RNA, 13 nt, Human
cauuccagaggaa

SEQ ID NO: 3142674 - RNA, 21 nt, Human
uuuuauuuuucucaugaugag

SEQ ID NO: 3142675 - RNA, 21 nt, Human
uuccugaggaagagggacugu

SEQ ID NO: 3142676 - RNA, 19 nt, Human
uuuccaaccggcuuugugg

SEQ ID NO: 3142677 - RNA, 18 nt, Human
ugggaggagggcaggcau

SEQ ID NO: 3142678 - RNA, 17 nt, Human
ugggaggagggcaggca

SEQ ID NO: 3142679 - RNA, 14 nt, Human
ugggaggagggcag

SEQ ID NO: 3142680 - RNA, 23 nt, Human
uggccuaaccugccgagagucca

SEQ ID NO: 3142681 - RNA, 16 nt, Human
uggccuaaccugccga

SEQ ID NO: 3142682 - RNA, 17 nt, Human
uguaaauuuaugugaug

SEQ ID NO: 3142683 - RNA, 18 nt, Human
uguccugcaccggggccu

SEQ ID NO: 3142684 - RNA, 13 nt, Human
uguccucagcccc

SEQ ID NO: 3142685 - RNA, 21 nt, Human
ugacccucaucuuucuuccaa

SEQ ID NO: 3142686 - RNA, 14 nt, Human
ugaguuggcuggga

SEQ ID NO: 3142687 - RNA, 16 nt, Human
ugaguuggcugggaau

SEQ ID NO: 3142688 - RNA, 17 nt, Human
ugaguuggcugggaaua

SEQ ID NO: 3142689 - RNA, 17 nt, Human
ugcccgggagcucagga

SEQ ID NO: 3142690 - RNA, 18 nt, Human
ugcccgggagcucaggaa

SEQ ID NO: 3142691 - RNA, 22 nt, Human
ugccaucauguuuacagaggac

SEQ ID NO: 3142692 - RNA, 21 nt, Human
ugcauuauauuuguaaauuua

SEQ ID NO: 3142693 - RNA, 18 nt, Human
ugauuuuuaugccaccug

SEQ ID NO: 3142694 - RNA, 16 nt, Human
ucccuccucugcccgg

SEQ ID NO: 3142695 - RNA, 13 nt, Human
ucccugccuggac

SEQ ID NO: 3142696 - RNA, 19 nt, Human
ucccuuccuuccucuccug

SEQ ID NO: 3142697 - RNA, 16 nt, Human
ucccuuccuuccucuc

SEQ ID NO: 3142698 - RNA, 21 nt, Human
ucgugucuggcacagccuggc

SEQ ID NO: 3142699 - RNA, 14 nt, Human
ucgugucuggcaca

SEQ ID NO: 3142700 - RNA, 15 nt, Human
ucugccaggagacag

SEQ ID NO: 3142701 - RNA, 19 nt, Human
ucagaggguguccugcacc

SEQ ID NO: 3142702 - RNA, 14 nt, Human
ucauuccagaggaa

SEQ ID NO: 3142703 - RNA, 12 nt, Human
uauucccaugag

SEQ ID NO: 3142704 - RNA, 15 nt, Human
cugaaacaacaaaua

SEQ ID NO: 3142705 - RNA, 16 nt, Human
cucuccccuucucugu

SEQ ID NO: 3142706 - RNA, 15 nt, Human
cucuggggugggcag

SEQ ID NO: 3142707 - RNA, 23 nt, Human
cucuggugagucaccacuucagg

SEQ ID NO: 3142708 - RNA, 14 nt, Human
cucuguccagggcc

SEQ ID NO: 3142709 - RNA, 20 nt, Human
cucuguccagggcccugagc

SEQ ID NO: 3142710 - RNA, 21 nt, Human
cucuuagaugcaguucugaag

SEQ ID NO: 3142711 - RNA, 21 nt, Human
cucuguccagggcccugagcu

SEQ ID NO: 3142712 - RNA, 22 nt, Human
cucuuagaugcaguucugaaga

SEQ ID NO: 3142713 - RNA, 14 nt, Human
cucguuaauuugua

SEQ ID NO: 3142714 - RNA, 12 nt, Human
cuccugggcagc

SEQ ID NO: 3142715 - RNA, 22 nt, Human
cuccugggcagcugccuccccu

SEQ ID NO: 3142716 - RNA, 18 nt, Human
cuccugggcagcugccuc

SEQ ID NO: 3142717 - RNA, 19 nt, Human
cuccugggcagcugccucc

SEQ ID NO: 3142718 - RNA, 14 nt, Human
cuccugggcagcug

SEQ ID NO: 3142719 - RNA, 15 nt, Human
cuccugggcagcugc

SEQ ID NO: 3142720 - RNA, 16 nt, Human
cuccugggcagcugcc

SEQ ID NO: 3142721 - RNA, 17 nt, Human
cuccugggcagcugccu

SEQ ID NO: 3142722 - RNA, 21 nt, Human
cuccucugcuugccaucccuc

SEQ ID NO: 3142723 - RNA, 15 nt, Human
cuccucugcuugcca

SEQ ID NO: 3142724 - RNA, 16 nt, Human
cuccucugcuugccau

SEQ ID NO: 3142725 - RNA, 17 nt, Human
cuccucugcuugccauc

SEQ ID NO: 3142726 - RNA, 20 nt, Human
cuccucugcuugccaucccu

SEQ ID NO: 3142727 - RNA, 12 nt, Human
cuccucugcuug

SEQ ID NO: 3142728 - RNA, 14 nt, Human
cuccucugcuugcc

SEQ ID NO: 3142729 - RNA, 22 nt, Human
cuccacuuggucugugagaugc

SEQ ID NO: 3142730 - RNA, 21 nt, Human
cuccacuuggucugugagaug

SEQ ID NO: 3142731 - RNA, 17 nt, Human
cuccacuuggucuguga

SEQ ID NO: 3142732 - RNA, 16 nt, Human
cuccacuuggucugug

SEQ ID NO: 3142733 - RNA, 15 nt, Human
cuccacuuggucugu

SEQ ID NO: 3142734 - RNA, 13 nt, Human
cuccacuuggucu

SEQ ID NO: 3142735 - RNA, 13 nt, Human
cucaguaccccau

SEQ ID NO: 3142736 - RNA, 19 nt, Human
cuccccaugauguuuagaa

SEQ ID NO: 3142737 - RNA, 21 nt, Human
cucccaccugacacaccaggc

SEQ ID NO: 3142738 - RNA, 14 nt, Human
cucccaccugacac

SEQ ID NO: 3142739 - RNA, 20 nt, Human
cucccaccugacacaccagg

SEQ ID NO: 3142740 - RNA, 15 nt, Human
cucccaccugacaca

SEQ ID NO: 3142741 - RNA, 23 nt, Human
cuccacuuggucugugagaugcu

SEQ ID NO: 3142742 - RNA, 11 nt, Human
cuaauaaaaag

SEQ ID NO: 3142743 - RNA, 13 nt, Human
cuaauaaaaaggu

SEQ ID NO: 3142744 - RNA, 14 nt, Human
cuaauaaaaaggug

SEQ ID NO: 3142745 - RNA, 17 nt, Human
cuaaguaaauaggaauu

SEQ ID NO: 3142746 - RNA, 22 nt, Human
cuaaguaaaaccacagcaguug

SEQ ID NO: 3142747 - RNA, 23 nt, Human
cuaaguaaaaccacagcaguuga

SEQ ID NO: 3142748 - RNA, 20 nt, Human
cuaaguaaaaccacagcagu

SEQ ID NO: 3142749 - RNA, 20 nt, Human
cgugugugugcguccugucg

SEQ ID NO: 3142750 - RNA, 18 nt, Human
cuacaugagguacugaga

SEQ ID NO: 3142751 - RNA, 20 nt, Human
cuacaugagguacugagagu

SEQ ID NO: 3142752 - RNA, 18 nt, Human
cuacaaaaacacagcaag

SEQ ID NO: 3142753 - RNA, 16 nt, Human
cuacaaaaacacagca

SEQ ID NO: 3142754 - RNA, 17 nt, Human
cuacaaaaacacagcaa

SEQ ID NO: 3142755 - RNA, 15 nt, Human
cuacaaaaacacagc

SEQ ID NO: 3142756 - RNA, 18 nt, Human
cuacauacuauggaauuu

SEQ ID NO: 3142757 - RNA, 12 nt, Human
cuagaacucccu

SEQ ID NO: 3142758 - RNA, 23 nt, Human
cucaaaauaccaugccauuuaaa

SEQ ID NO: 3142759 - RNA, 17 nt, Human
cucaaaacugcacuguc

SEQ ID NO: 3142760 - RNA, 22 nt, Human
cguggugauuuagcaggaagcu

SEQ ID NO: 3142761 - RNA, 15 nt, Human
cguggugauuuagca

SEQ ID NO: 3142762 - RNA, 22 nt, Human
ccuugcugcaagcacagcccuu

SEQ ID NO: 3142763 - RNA, 22 nt, Human
ccuugcccagggcucagccugg

SEQ ID NO: 3142764 - RNA, 21 nt, Human
ccuugcccagggcucagccug

SEQ ID NO: 3142765 - RNA, 20 nt, Human
ccuugcccagggcucagccu

SEQ ID NO: 3142766 - RNA, 18 nt, Human
ccuuuugacacugcucua

SEQ ID NO: 3142767 - RNA, 15 nt, Human
ccuuuugacacugcu

SEQ ID NO: 3142768 - RNA, 13 nt, Human
ccuuuugacacug

SEQ ID NO: 3142769 - RNA, 17 nt, Human
cgccugaggcaauuaga

SEQ ID NO: 3142770 - RNA, 18 nt, Human
cgcaggcccccaggugcc

SEQ ID NO: 3142771 - RNA, 21 nt, Human
ccucauuuuuauaaugucccu

SEQ ID NO: 3142772 - RNA, 23 nt, Human
ccucauggaauuggagcucgugg

SEQ ID NO: 3142773 - RNA, 21 nt, Human
ccucaugcugccaauauccua

SEQ ID NO: 3142774 - RNA, 20 nt, Human
ccucaugcugccaauauccu

SEQ ID NO: 3142775 - RNA, 16 nt, Human
ccucaaagaaagugua

SEQ ID NO: 3142776 - RNA, 14 nt, Human
ccucaaagaaagug

SEQ ID NO: 3142777 - RNA, 11 nt, Human
ccucagccugu

SEQ ID NO: 3142778 - RNA, 12 nt, Human
ccucagccugug

SEQ ID NO: 3142779 - RNA, 22 nt, Human
ccucagccuuccccuugcccag

SEQ ID NO: 3142780 - RNA, 16 nt, Human
ccucagccugugcugc

SEQ ID NO: 3142781 - RNA, 19 nt, Human
cccugucuccucucucugu

SEQ ID NO: 3142782 - RNA, 21 nt, Human
ccugucugccagccagcagcc

SEQ ID NO: 3142783 - RNA, 23 nt, Human
ccugucugccagccagcagccag

SEQ ID NO: 3142784 - RNA, 15 nt, Human
ccugucucaccugga

SEQ ID NO: 3142785 - RNA, 22 nt, Human
ccugucggagcccugucuccuc

SEQ ID NO: 3142786 - RNA, 14 nt, Human
ccugucugccagcc

SEQ ID NO: 3142787 - RNA, 15 nt, Human
ccugucugccagcca

SEQ ID NO: 3142788 - RNA, 16 nt, Human
ccugucugccagccag

SEQ ID NO: 3142789 - RNA, 17 nt, Human
ccugucugccagccagc

SEQ ID NO: 3142790 - RNA, 19 nt, Human
ccugucugccagccagcag

SEQ ID NO: 3142791 - RNA, 20 nt, Human
ccugucugccagccagcagc

SEQ ID NO: 3142792 - RNA, 12 nt, Human
ccuggggccucg

SEQ ID NO: 3142793 - RNA, 22 nt, Human
ccuggggccucggagccucauc

SEQ ID NO: 3142794 - RNA, 15 nt, Human
ccuguaaucacagcu

SEQ ID NO: 3142795 - RNA, 17 nt, Human
ccugucggagcccuguc

SEQ ID NO: 3142796 - RNA, 21 nt, Human
ccugucggagcccugucuccu

SEQ ID NO: 3142797 - RNA, 16 nt, Human
ccugucggagcccugu

SEQ ID NO: 3142798 - RNA, 14 nt, Human
ccuggugggccucc

SEQ ID NO: 3142799 - RNA, 18 nt, Human
ccuggugggccuccucug

SEQ ID NO: 3142800 - RNA, 20 nt, Human
ccuggugggccuccucuguc

SEQ ID NO: 3142801 - RNA, 14 nt, Human
cccagggcucagcc

SEQ ID NO: 3142802 - RNA, 15 nt, Human
cccagggcucagccu

SEQ ID NO: 3142803 - RNA, 16 nt, Human
cccagggcucagccug

SEQ ID NO: 3142804 - RNA, 17 nt, Human
cccagggcucagccugg

SEQ ID NO: 3142805 - RNA, 18 nt, Human
cccagggcucagccuggu

SEQ ID NO: 3142806 - RNA, 20 nt, Human
cccagggcucagccuggugg

SEQ ID NO: 3142807 - RNA, 18 nt, Human
ccccugcacuccagccug

SEQ ID NO: 3142808 - RNA, 13 nt, Human
ccauacauuugug

SEQ ID NO: 3142809 - RNA, 22 nt, Human
ccauuuaaagcuuauuaaaacu

SEQ ID NO: 3142810 - RNA, 18 nt, Human
ccaguauuuagaagccaa

SEQ ID NO: 3142811 - RNA, 17 nt, Human
ccaguauuuagaagcca

SEQ ID NO: 3142812 - RNA, 17 nt, Human
auucuugccaaauauaa

SEQ ID NO: 3142813 - RNA, 18 nt, Human
auugacuuuuuauggcac

SEQ ID NO: 3142814 - RNA, 16 nt, Human
auucaaggaauuucuu

SEQ ID NO: 3142815 - RNA, 18 nt, Human
auucacaagacccaaaag

SEQ ID NO: 3142816 - RNA, 18 nt, Human
auucaaggaauuucuuaa

SEQ ID NO: 3142817 - RNA, 17 nt, Human
auucaaggaauuucuua

SEQ ID NO: 3142818 - RNA, 19 nt, Human
auucaaggaauuucuuaac

SEQ ID NO: 3142819 - RNA, 17 nt, Human
auucauuuuuuaaauuc

SEQ ID NO: 3142820 - RNA, 15 nt, Human
auuguuuaaaaucau

SEQ ID NO: 3142821 - RNA, 19 nt, Human
auuguuuaaaaucauuucu

SEQ ID NO: 3142822 - RNA, 14 nt, Human
auuguaaaugugcu

SEQ ID NO: 3142823 - RNA, 15 nt, Human
auuguaaaugugcuu

SEQ ID NO: 3142824 - RNA, 17 nt, Human
auuguaaaugugcuuuu

SEQ ID NO: 3142825 - RNA, 14 nt, Human
auuucuaugaaaua

SEQ ID NO: 3142826 - RNA, 18 nt, Human
auuucuaugaaauauuau

SEQ ID NO: 3142827 - RNA, 15 nt, Human
auuucuaugaaauau

SEQ ID NO: 3142828 - RNA, 15 nt, Human
caaauccuugaagau

SEQ ID NO: 3142829 - RNA, 21 nt, Human
caacuaucucauuuccaagca

SEQ ID NO: 3142830 - RNA, 19 nt, Human
caacccaaauguucaucaa

SEQ ID NO: 3142831 - RNA, 20 nt, Human
cacuuggucugugagaugcu

SEQ ID NO: 3142832 - RNA, 17 nt, Human
cacuuggucugugagau

SEQ ID NO: 3142833 - RNA, 23 nt, Human
cacucccaccugacacaccaggc

SEQ ID NO: 3142834 - RNA, 22 nt, Human
cacucccaccugacacaccagg

SEQ ID NO: 3142835 - RNA, 17 nt, Human
cacucccaccugacaca

SEQ ID NO: 3142836 - RNA, 23 nt, Human
caccucaaaauaccaugccauuu

SEQ ID NO: 3142837 - RNA, 21 nt, Human
caccguuggggauuggggaag

SEQ ID NO: 3142838 - RNA, 21 nt, Human
caccuacaugagguacugaga

SEQ ID NO: 3142839 - RNA, 22 nt, Human
caccuugcagcucuccccuucu

SEQ ID NO: 3142840 - RNA, 13 nt, Human
caccuugcagcuc

SEQ ID NO: 3142841 - RNA, 15 nt, Human
caccuugcagcucuc

SEQ ID NO: 3142842 - RNA, 14 nt, Human
caaguauuagaaua

SEQ ID NO: 3142843 - RNA, 20 nt, Human
caaguauuagaauaccacag

SEQ ID NO: 3142844 - RNA, 23 nt, Human
caaugcuguauuuuaaaagaaug

SEQ ID NO: 3142845 - RNA, 14 nt, Human
caaugcuguauuuu

SEQ ID NO: 3142846 - RNA, 20 nt, Human
caauauuucagauaaucaca

SEQ ID NO: 3142847 - RNA, 12 nt, Human
caauauuucaga

SEQ ID NO: 3142848 - RNA, 12 nt, Human
caauuuaaaaaa

SEQ ID NO: 3142849 - RNA, 23 nt, Human
cacaagacccaaaaggcagaagc

SEQ ID NO: 3142850 - RNA, 16 nt, Human
cacaagacugcacauc

SEQ ID NO: 3142851 - RNA, 17 nt, Human
caccaggcgcuaauuca

SEQ ID NO: 3142852 - RNA, 23 nt, Human
caccaggcgcuaauucaaggaau

SEQ ID NO: 3142853 - RNA, 20 nt, Human
cagucugacuguuuccauca

SEQ ID NO: 3142854 - RNA, 19 nt, Human
caggugccaguuauggcua

SEQ ID NO: 3142855 - RNA, 16 nt, Human
cagucaccucauggaa

SEQ ID NO: 3142856 - RNA, 15 nt, Human
cagucacauuccaag

SEQ ID NO: 3142857 - RNA, 19 nt, Human
cagucaccucauggaauug

SEQ ID NO: 3142858 - RNA, 15 nt, Human
cagucaccucaugga

SEQ ID NO: 3142859 - RNA, 15 nt, Human
caggcacacuucuuc

SEQ ID NO: 3142860 - RNA, 16 nt, Human
cagagguugcagugag

SEQ ID NO: 3142861 - RNA, 17 nt, Human
cagagguugcagugagc

SEQ ID NO: 3142862 - RNA, 12 nt, Human
cagauccuggaa

SEQ ID NO: 3142863 - RNA, 22 nt, Human
cagcaguugaaaagacuccaaa

SEQ ID NO: 3142864 - RNA, 13 nt, Human
cagcaguucagag

SEQ ID NO: 3142865 - RNA, 21 nt, Human
cagccagcucucagccaacga

SEQ ID NO: 3142866 - RNA, 17 nt, Human
cagccagcucucagcca

SEQ ID NO: 3142867 - RNA, 18 nt, Human
cagccagcucucagccaa

SEQ ID NO: 3142868 - RNA, 12 nt, Human
cagccagcucuc

SEQ ID NO: 3142869 - RNA, 15 nt, Human
cagccagcucucagc

SEQ ID NO: 3142870 - RNA, 16 nt, Human
cagccagcucucagcc

SEQ ID NO: 3142871 - RNA, 12 nt, Human
cagcuguggcag

SEQ ID NO: 3142872 - RNA, 16 nt, Human
cagcuguggcagaguu

SEQ ID NO: 3142873 - RNA, 21 nt, Human
cagcuccccucggagaagagc

SEQ ID NO: 3142874 - RNA, 22 nt, Human
cagcuccccucggagaagagcu

SEQ ID NO: 3142875 - RNA, 20 nt, Human
cagcuccccucggagaagag

SEQ ID NO: 3142876 - RNA, 20 nt, Human
cagccgcuccugucugccag

SEQ ID NO: 3142877 - RNA, 21 nt, Human
cagccgcuccugucugccagc

SEQ ID NO: 3142878 - RNA, 22 nt, Human
cagccgcuccugucugccagcc

SEQ ID NO: 3142879 - RNA, 23 nt, Human
cagccgcuccugucugccagcca

SEQ ID NO: 3142880 - RNA, 14 nt, Human
cagccgcuccuguc

SEQ ID NO: 3142881 - RNA, 12 nt, Human
cagccgcuccug

SEQ ID NO: 3142882 - RNA, 16 nt, Human
cagccgcuccugucug

SEQ ID NO: 3142883 - RNA, 17 nt, Human
cagccgcuccugucugc

SEQ ID NO: 3142884 - RNA, 18 nt, Human
cagccgcuccugucugcc

SEQ ID NO: 3142885 - RNA, 19 nt, Human
cagccgcuccugucugcca

SEQ ID NO: 3142886 - RNA, 20 nt, Human
cagcccuucuuuccacagaa

SEQ ID NO: 3142887 - RNA, 17 nt, Human
cauuuguauaaaauaau

SEQ ID NO: 3142888 - RNA, 20 nt, Human
cauuuguauaaaauaauuuu

SEQ ID NO: 3142889 - RNA, 19 nt, Human
cauuuguauaaaauaauuu

SEQ ID NO: 3142890 - RNA, 17 nt, Human
ccaaauguucaucaaug

SEQ ID NO: 3142891 - RNA, 12 nt, Human
ccaccaguucuc

SEQ ID NO: 3142892 - RNA, 12 nt, Human
ccacagcaguug

SEQ ID NO: 3142893 - RNA, 17 nt, Human
ccacagcaguugaaaag

SEQ ID NO: 3142894 - RNA, 18 nt, Human
ccacagcaguugaaaaga

SEQ ID NO: 3142895 - RNA, 23 nt, Human
ccacagcaguugaaaagacucca

SEQ ID NO: 3142896 - RNA, 14 nt, Human
caugauguuuagaa

SEQ ID NO: 3142897 - RNA, 24 nt, Human
cauguuaguuaccuuauaguuacu

SEQ ID NO: 3142898 - RNA, 22 nt, Human
cauguuaguuaccuuauaguua

SEQ ID NO: 3142899 - RNA, 21 nt, Human
cauguuaguuaccuuauaguu

SEQ ID NO: 3142900 - RNA, 14 nt, Human
cauguuaguuaccu

SEQ ID NO: 3142901 - RNA, 17 nt, Human
caugucccuacaccccu

SEQ ID NO: 3142902 - RNA, 22 nt, Human
cauguccugccuauuaucuguc

SEQ ID NO: 3142903 - RNA, 13 nt, Human
cauguccugccua

SEQ ID NO: 3142904 - RNA, 22 nt, Human
gcaguuguugcccacagcugua

SEQ ID NO: 3142905 - RNA, 13 nt, Human
gcagugaugucac

SEQ ID NO: 3142906 - RNA, 22 nt, Human
gcagaacagugauuaccaggga

SEQ ID NO: 3142907 - RNA, 18 nt, Human
gcagaacagugauuacca

SEQ ID NO: 3142908 - RNA, 23 nt, Human
gcagaacagccgcuccugucugc

SEQ ID NO: 3142909 - RNA, 13 nt, Human
gcagaacagugau

SEQ ID NO: 3142910 - RNA, 12 nt, Human
gcagaacaguga

SEQ ID NO: 3142911 - RNA, 15 nt, Human
gcagcucuccccuuc

SEQ ID NO: 3142912 - RNA, 15 nt, Human
gcagccagcucucag

SEQ ID NO: 3142913 - RNA, 16 nt, Human
gcagccagcucucagc

SEQ ID NO: 3142914 - RNA, 17 nt, Human
gcagccagcucucagcc

SEQ ID NO: 3142915 - RNA, 18 nt, Human
gcagccagcucucagcca

SEQ ID NO: 3142916 - RNA, 13 nt, Human
gcagccagcucuc

SEQ ID NO: 3142917 - RNA, 17 nt, Human
gauggaaaauucauuuu

SEQ ID NO: 3142918 - RNA, 20 nt, Human
gaggacgcucucuggccuuc

SEQ ID NO: 3142919 - RNA, 21 nt, Human
gaggacgcucucuggccuucg

SEQ ID NO: 3142920 - RNA, 14 nt, Human
gaggagaaacugga

SEQ ID NO: 3142921 - RNA, 12 nt, Human
gaggagaaacug

SEQ ID NO: 3142922 - RNA, 18 nt, Human
gaggggcagaacagccgc

SEQ ID NO: 3142923 - RNA, 12 nt, Human
gaggcuccacuu

SEQ ID NO: 3142924 - RNA, 15 nt, Human
gaggcuccacuuggu

SEQ ID NO: 3142925 - RNA, 17 nt, Human
gaggcuccacuuggucu

SEQ ID NO: 3142926 - RNA, 18 nt, Human
gaggcugagaugggagaa

SEQ ID NO: 3142927 - RNA, 14 nt, Human
gagcagucaggaaa

SEQ ID NO: 3142928 - RNA, 16 nt, Human
gagccccacccucaga

SEQ ID NO: 3142929 - RNA, 17 nt, Human
gagcuguucacagccag

SEQ ID NO: 3142930 - RNA, 20 nt, Human
gagcuguucacagccagacu

SEQ ID NO: 3142931 - RNA, 22 nt, Human
gagcuguucacagccagacugg

SEQ ID NO: 3142932 - RNA, 21 nt, Human
gagacucagggccccagcacu

SEQ ID NO: 3142933 - RNA, 17 nt, Human
gagacucagggccccag

SEQ ID NO: 3142934 - RNA, 16 nt, Human
gagaugcuagaacucc

SEQ ID NO: 3142935 - RNA, 20 nt, Human
gagaugcuagaacucccuuu

SEQ ID NO: 3142936 - RNA, 21 nt, Human
gagauugugccccugcacucc

SEQ ID NO: 3142937 - RNA, 22 nt, Human
gacuuuuuauggcacuaguauu

SEQ ID NO: 3142938 - RNA, 14 nt, Human
gacgcucucuggcc

SEQ ID NO: 3142939 - RNA, 23 nt, Human
gacccucaugcugccaauauccu

SEQ ID NO: 3142940 - RNA, 22 nt, Human
gacccucaugcugccaauaucc

SEQ ID NO: 3142941 - RNA, 21 nt, Human
gacccucaugcugccaauauc

SEQ ID NO: 3142942 - RNA, 18 nt, Human
gacccucaugcugccaau

SEQ ID NO: 3142943 - RNA, 17 nt, Human
gacccucaugcugccaa

SEQ ID NO: 3142944 - RNA, 16 nt, Human
gacccucaugcugcca

SEQ ID NO: 3142945 - RNA, 14 nt, Human
gacccucaugcugc

SEQ ID NO: 3142946 - RNA, 12 nt, Human
gacccucaugcu

SEQ ID NO: 3142947 - RNA, 17 nt, Human
gacauuugcucauggaa

SEQ ID NO: 3142948 - RNA, 12 nt, Human
gacagcucugca

SEQ ID NO: 3142949 - RNA, 18 nt, Human
gacagucaccucauggaa

SEQ ID NO: 3142950 - RNA, 17 nt, Human
gacagucaccucaugga

SEQ ID NO: 3142951 - RNA, 14 nt, Human
gacaugugguggga

SEQ ID NO: 3142952 - RNA, 16 nt, Human
gacauguggugggaca

SEQ ID NO: 3142953 - RNA, 22 nt, Human
gacauguggugggacagggacc

SEQ ID NO: 3142954 - RNA, 21 nt, Human
gacacugcucuaacagcccuc

SEQ ID NO: 3142955 - RNA, 20 nt, Human
gacacugcucuaacagcccu

SEQ ID NO: 3142956 - RNA, 14 nt, Human
gacacugcucuaac

SEQ ID NO: 3142957 - RNA, 23 nt, Human
gaauuaggcuguaacuacuuuau

SEQ ID NO: 3142958 - RNA, 19 nt, Human
gaauuaggcuguaacuacu

SEQ ID NO: 3142959 - RNA, 18 nt, Human
gaauuaggcuguaacuac

SEQ ID NO: 3142960 - RNA, 17 nt, Human
gaauuaggcuguaacua

SEQ ID NO: 3142961 - RNA, 16 nt, Human
gaauuaggcuguaacu

SEQ ID NO: 3142962 - RNA, 15 nt, Human
gaauuaggcuguaac

SEQ ID NO: 3142963 - RNA, 22 nt, Human
gaaugauuaugaauuacauuug

SEQ ID NO: 3142964 - RNA, 14 nt, Human
gaaugauuaugaau

SEQ ID NO: 3142965 - RNA, 15 nt, Human
gaaugaauggcuaag

SEQ ID NO: 3142966 - RNA, 15 nt, Human
gaauuaacacaugau

SEQ ID NO: 3142967 - RNA, 14 nt, Human
gaauuaacacauga

SEQ ID NO: 3142968 - RNA, 13 nt, Human
gaauuacauuugu

SEQ ID NO: 3142969 - RNA, 18 nt, Human
gaauuacauuuguauaaa

SEQ ID NO: 3142970 - RNA, 15 nt, Human
gaauuacauuuguau

SEQ ID NO: 3142971 - RNA, 20 nt, Human
gaauuacauuuguauaaaau

SEQ ID NO: 3142972 - RNA, 14 nt, Human
gaaugaauggcuaa

SEQ ID NO: 3142973 - RNA, 23 nt, Human
cuggaaaaguauguuagugcaaa

SEQ ID NO: 3142974 - RNA, 19 nt, Human
cugccuccccuccucugcu

SEQ ID NO: 3142975 - RNA, 20 nt, Human
cugccuccccuccucugcuu

SEQ ID NO: 3142976 - RNA, 14 nt, Human
cugccuccccuccu

SEQ ID NO: 3142977 - RNA, 17 nt, Human
cugccuccccuccucug

SEQ ID NO: 3142978 - RNA, 18 nt, Human
cugccuccccuccucugc

SEQ ID NO: 3142979 - RNA, 17 nt, Human
cugcuaccucacugggg

SEQ ID NO: 3142980 - RNA, 18 nt, Human
cugcuaccucacuggggu

SEQ ID NO: 3142981 - RNA, 21 nt, Human
cugcuagcacuuggagccaag

SEQ ID NO: 3142982 - RNA, 14 nt, Human
cugcuagcacuugg

SEQ ID NO: 3142983 - RNA, 23 nt, Human
cugugagaugcuagaacucccuu

SEQ ID NO: 3142984 - RNA, 21 nt, Human
cugugagaugcuagaacuccc

SEQ ID NO: 3142985 - RNA, 19 nt, Human
cuguuauaaucuuucacag

SEQ ID NO: 3142986 - RNA, 22 nt, Human
cuguucacagccagacuggcac

SEQ ID NO: 3142987 - RNA, 12 nt, Human
cuguucacagcc

SEQ ID NO: 3142988 - RNA, 19 nt, Human
cuguucacagccagacugg

SEQ ID NO: 3142989 - RNA, 12 nt, Human
cuuaaaaauggu

SEQ ID NO: 3142990 - RNA, 20 nt, Human
cuuaaaaaugguuuaaaugg

SEQ ID NO: 3142991 - RNA, 13 nt, Human
cuuaaaaaugguu

SEQ ID NO: 3142992 - RNA, 20 nt, Human
cuguaagaaaauaucacuug

SEQ ID NO: 3142993 - RNA, 23 nt, Human
cugucggagcccugucuccucuc

SEQ ID NO: 3142994 - RNA, 18 nt, Human
cuguagcauuacaguggg

SEQ ID NO: 3142995 - RNA, 17 nt, Human
cuguagcauuacagugg

SEQ ID NO: 3142996 - RNA, 12 nt, Human
cugucagcugca

SEQ ID NO: 3142997 - RNA, 22 nt, Human
cuucucuguauuccuagaaacu

SEQ ID NO: 3142998 - RNA, 23 nt, Human
cuuggucucagugucaaugcagc

SEQ ID NO: 3142999 - RNA, 15 nt, Human
cuuggcccaggaguu

SEQ ID NO: 3143000 - RNA, 14 nt, Human
cuuggcccaggagu

SEQ ID NO: 3143001 - RNA, 23 nt, Human
cuuggcccaggaguuuggccaga

SEQ ID NO: 3143002 - RNA, 22 nt, Human
cuuggcccaggaguuuggccag

SEQ ID NO: 3143003 - RNA, 20 nt, Human
cuuggcccaggaguuuggcc

SEQ ID NO: 3143004 - RNA, 16 nt, Human
cuuggcccaggaguuu

SEQ ID NO: 3143005 - RNA, 20 nt, Human
cuuuuuuucuguaccaguua

SEQ ID NO: 3143006 - RNA, 20 nt, Human
gaaaagacuccaaagaaaug

SEQ ID NO: 3143007 - RNA, 18 nt, Human
gaaaagacuccaaagaaa

SEQ ID NO: 3143008 - RNA, 21 nt, Human
gaaaagacuccaaagaaaugu

SEQ ID NO: 3143009 - RNA, 23 nt, Human
gaaacuucagcgguuuauauaag

SEQ ID NO: 3143010 - RNA, 16 nt, Human
gaaaucaaauaugcaa

SEQ ID NO: 3143011 - RNA, 21 nt, Human
gaaaucaaauaugcaaagcac

SEQ ID NO: 3143012 - RNA, 22 nt, Human
gaaauauuuauuuuaauaaugu

SEQ ID NO: 3143013 - RNA, 23 nt, Human
gaacaaauuuacagagacagaaa

SEQ ID NO: 3143014 - RNA, 18 nt, Human
gaacaaauuuacagagac

SEQ ID NO: 3143015 - RNA, 17 nt, Human
gaacaaauuuacagaga

SEQ ID NO: 3143016 - RNA, 17 nt, Human
gaaaugaaagcagggac

SEQ ID NO: 3143017 - RNA, 23 nt, Human
gaaaucaaauaugcaaagcacug

SEQ ID NO: 3143018 - RNA, 18 nt, Human
gaaaugaaagcagggacu

SEQ ID NO: 3143019 - RNA, 21 nt, Human
ggacagucaccucauggaauu

SEQ ID NO: 3143020 - RNA, 18 nt, Human
ggacagucaccucaugga

SEQ ID NO: 3143021 - RNA, 17 nt, Human
ggacagucaccucaugg

SEQ ID NO: 3143022 - RNA, 13 nt, Human
ggacaccaggagu

SEQ ID NO: 3143023 - RNA, 19 nt, Human
ggaaaucaggguuaguauu

SEQ ID NO: 3143024 - RNA, 13 nt, Human
ggaaacugccagc

SEQ ID NO: 3143025 - RNA, 16 nt, Human
ggaaaaaauaacaaug

SEQ ID NO: 3143026 - RNA, 16 nt, Human
gcuguuuauuaaucuu

SEQ ID NO: 3143027 - RNA, 13 nt, Human
gcugcugaaacaa

SEQ ID NO: 3143028 - RNA, 18 nt, Human
gcuguauuuuaaaagaau

SEQ ID NO: 3143029 - RNA, 20 nt, Human
gcuguauuuuaaaagaauga

SEQ ID NO: 3143030 - RNA, 21 nt, Human
gcuguauuuuaaaagaaugau

SEQ ID NO: 3143031 - RNA, 21 nt, Human
gcugcccgucuucagccuagc

SEQ ID NO: 3143032 - RNA, 16 nt, Human
gcugcccgucuucagc

SEQ ID NO: 3143033 - RNA, 19 nt, Human
gcugcccgucuucagccua

SEQ ID NO: 3143034 - RNA, 20 nt, Human
gcugcccgucuucagccuag

SEQ ID NO: 3143035 - RNA, 18 nt, Human
gcugcaagcacagcccuu

SEQ ID NO: 3143036 - RNA, 20 nt, Human
gcugcaagguacucugguga

SEQ ID NO: 3143037 - RNA, 12 nt, Human
gcugcaagguac

SEQ ID NO: 3143038 - RNA, 12 nt, Human
gcauuuagaugu

SEQ ID NO: 3143039 - RNA, 13 nt, Human
gcauuuagaugua

SEQ ID NO: 3143040 - RNA, 19 nt, Human
gcauuuaggccaugggaca

SEQ ID NO: 3143041 - RNA, 20 nt, Human
gcccaggaguuuggccagaa

SEQ ID NO: 3143042 - RNA, 19 nt, Human
gcccaggaguuuggccaga

SEQ ID NO: 3143043 - RNA, 18 nt, Human
gcccaggaguuuggccag

SEQ ID NO: 3143044 - RNA, 11 nt, Human
gccccaaaagg

SEQ ID NO: 3143045 - RNA, 22 nt, Human
gccucauguccacugguucuuc

SEQ ID NO: 3143046 - RNA, 22 nt, Human
gccucauccgaggcagggucag

SEQ ID NO: 3143047 - RNA, 12 nt, Human
gccuccauccug

SEQ ID NO: 3143048 - RNA, 13 nt, Human
gccuccucugucc

SEQ ID NO: 3143049 - RNA, 16 nt, Human
gccuccucuguccagg

SEQ ID NO: 3143050 - RNA, 14 nt, Human
gccuccauccugag

SEQ ID NO: 3143051 - RNA, 13 nt, Human
gccuccauccuga

SEQ ID NO: 3143052 - RNA, 17 nt, Human
gcccgucuucagccuag

SEQ ID NO: 3143053 - RNA, 18 nt, Human
gcccgucuucagccuagc

SEQ ID NO: 3143054 - RNA, 14 nt, Human
gcccgucuucagcc

SEQ ID NO: 3143055 - RNA, 15 nt, Human
gcccgucuucagccu

SEQ ID NO: 3143056 - RNA, 16 nt, Human
gcccgucuucagccua

SEQ ID NO: 3143057 - RNA, 20 nt, Human
gccgcuccugucugccagcc

SEQ ID NO: 3143058 - RNA, 21 nt, Human
gccgcuccugucugccagcca

SEQ ID NO: 3143059 - RNA, 15 nt, Human
gccgcuccugucugc

SEQ ID NO: 3143060 - RNA, 19 nt, Human
gccgcuccugucugccagc

SEQ ID NO: 3143061 - RNA, 13 nt, Human
gcgggaaggaggg

SEQ ID NO: 3143062 - RNA, 14 nt, Human
gcgggaaggagggu

SEQ ID NO: 3143063 - RNA, 23 nt, Human
gccuucggccuccauccugaggc

SEQ ID NO: 3143064 - RNA, 14 nt, Human
gccugugcugcccg

SEQ ID NO: 3143065 - RNA, 15 nt, Human
gccugugcugcccgu

SEQ ID NO: 3143066 - RNA, 16 nt, Human
gccugugcugcccguc

SEQ ID NO: 3143067 - RNA, 23 nt, Human
gccugugcugcccgucuucagcc

SEQ ID NO: 3143068 - RNA, 17 nt, Human
ggcucuaauucacagug

SEQ ID NO: 3143069 - RNA, 19 nt, Human
ggcucuaauucacagugcu

SEQ ID NO: 3143070 - RNA, 13 nt, Human
aaaaauacaaaaa

SEQ ID NO: 3143071 - RNA, 16 nt, Human
ggccuucggccuccau

SEQ ID NO: 3143072 - RNA, 18 nt, Human
ggccuucggccuccaucc

SEQ ID NO: 3143073 - RNA, 20 nt, Human
ggcuaagcuucacuguaaaa

SEQ ID NO: 3143074 - RNA, 21 nt, Human
ggccccagcacuaaagcagug

SEQ ID NO: 3143075 - RNA, 13 nt, Human
ggccccagcacua

SEQ ID NO: 3143076 - RNA, 16 nt, Human
ggccccagcacuaaag

SEQ ID NO: 3143077 - RNA, 19 nt, Human
gguuuuauuguuuaaaauc

SEQ ID NO: 3143078 - RNA, 16 nt, Human
gguuucauguuaguua

SEQ ID NO: 3143079 - RNA, 20 nt, Human
aaagggauggcaagaugugg

SEQ ID NO: 3143080 - RNA, 22 nt, Human
aaagggcuguuauaaucuuuca

SEQ ID NO: 3143081 - RNA, 20 nt, Human
aaagggcuguuauaaucuuu

SEQ ID NO: 3143082 - RNA, 19 nt, Human
aaacuuuaugcuaagugaa

SEQ ID NO: 3143083 - RNA, 12 nt, Human
aaacuuuaugcu

SEQ ID NO: 3143084 - RNA, 12 nt, Human
gguggacccagg

SEQ ID NO: 3143085 - RNA, 14 nt, Human
gguggacccaggga

SEQ ID NO: 3143086 - RNA, 16 nt, Human
aaagcagaacagugau

SEQ ID NO: 3143087 - RNA, 13 nt, Human
guaauaaacucau

SEQ ID NO: 3143088 - RNA, 14 nt, Human
guaacuacuuuaua

SEQ ID NO: 3143089 - RNA, 12 nt, Human
guaacuacuuua

SEQ ID NO: 3143090 - RNA, 23 nt, Human
aaaguguauuuggaaauaaaguc

SEQ ID NO: 3143091 - RNA, 20 nt, Human
aaauauguuagcaaagaguu

SEQ ID NO: 3143092 - RNA, 13 nt, Human
aaauaugcaaagc

SEQ ID NO: 3143093 - RNA, 15 nt, Human
aaauaugcaaagcac

SEQ ID NO: 3143094 - RNA, 16 nt, Human
aaauaugcaaagcacu

SEQ ID NO: 3143095 - RNA, 17 nt, Human
aaauaugcaaagcacug

SEQ ID NO: 3143096 - RNA, 18 nt, Human
aaauauaugcuaagucuu

SEQ ID NO: 3143097 - RNA, 22 nt, Human
aaauaucacuugucaauaaaau

SEQ ID NO: 3143098 - RNA, 21 nt, Human
aaauaccaugccauuuaaagc

SEQ ID NO: 3143099 - RNA, 20 nt, Human
ggguuuuauuguuuaaaauc

SEQ ID NO: 3143100 - RNA, 24 nt, Human
gguaacuuuugugaauuaggcugu

SEQ ID NO: 3143101 - RNA, 14 nt, Human
ggucagugcaaaua

SEQ ID NO: 3143102 - RNA, 22 nt, Human
gggguaaaauuccuuagcuuag

SEQ ID NO: 3143103 - RNA, 16 nt, Human
gggcucagccuggugg

SEQ ID NO: 3143104 - RNA, 20 nt, Human
gggcucagccuggugggccu

SEQ ID NO: 3143105 - RNA, 11 nt, Human
gggcucagccu

SEQ ID NO: 3143106 - RNA, 12 nt, Human
gggcucagccug

SEQ ID NO: 3143107 - RNA, 13 nt, Human
gggcucagccugg

SEQ ID NO: 3143108 - RNA, 16 nt, Human
aaaauggguuuuacug

SEQ ID NO: 3143109 - RNA, 18 nt, Human
aaaaugguuuaaaugguc

SEQ ID NO: 3143110 - RNA, 16 nt, Human
aaaaugguuuaaaugg

SEQ ID NO: 3143111 - RNA, 17 nt, Human
gggccucggagccucau

SEQ ID NO: 3143112 - RNA, 15 nt, Human
gggccucggagccuc

SEQ ID NO: 3143113 - RNA, 17 nt, Human
aaaauaauuuuuauauu

SEQ ID NO: 3143114 - RNA, 16 nt, Human
aaaauaauuuuuauau

SEQ ID NO: 3143115 - RNA, 14 nt, Human
aaaauacacacuca

SEQ ID NO: 3143116 - RNA, 11 nt, Human
aaaauaauuuu

SEQ ID NO: 3143117 - RNA, 17 nt, Human
aaaaucucaauauuuca

SEQ ID NO: 3143118 - RNA, 21 nt, Human
agugagcagucaggaaagaga

SEQ ID NO: 3143119 - RNA, 16 nt, Human
agugagccgagauugu

SEQ ID NO: 3143120 - RNA, 22 nt, Human
agugaaagaggcagcuugaaac

SEQ ID NO: 3143121 - RNA, 14 nt, Human
agugagacagcucu

SEQ ID NO: 3143122 - RNA, 16 nt, Human
agugaaagaggcagcu

SEQ ID NO: 3143123 - RNA, 17 nt, Human
agugaaagaaaauaaca

SEQ ID NO: 3143124 - RNA, 14 nt, Human
ugugaagcaaaauu

SEQ ID NO: 3143125 - RNA, 22 nt, Human
ugugagaugcuagaacucccuu

SEQ ID NO: 3143126 - RNA, 23 nt, Human
agucucucuucucuccagcugac

SEQ ID NO: 3143127 - RNA, 21 nt, Human
agucucucuucucuccagcug

SEQ ID NO: 3143128 - RNA, 15 nt, Human
ugucuccucucucug

SEQ ID NO: 3143129 - RNA, 17 nt, Human
ugucucuacuaaaaaua

SEQ ID NO: 3143130 - RNA, 14 nt, Human
ugucuuaauuaaaa

SEQ ID NO: 3143131 - RNA, 12 nt, Human
ugucuuaauuaa

SEQ ID NO: 3143132 - RNA, 14 nt, Human
ugucuucacaacag

SEQ ID NO: 3143133 - RNA, 23 nt, Human
agucaucuugcuaccaguauuua

SEQ ID NO: 3143134 - RNA, 19 nt, Human
agucaucuugcuaccagua

SEQ ID NO: 3143135 - RNA, 13 nt, Human
agucaucuugcua

SEQ ID NO: 3143136 - RNA, 11 nt, Human
agucaucuugc

SEQ ID NO: 3143137 - RNA, 20 nt, Human
agucagauggaaaauucauu

SEQ ID NO: 3143138 - RNA, 23 nt, Human
agucagauggaaaauucauuuuu

SEQ ID NO: 3143139 - RNA, 22 nt, Human
agucagauggaaaauucauuuu

SEQ ID NO: 3143140 - RNA, 20 nt, Human
ugucagcuccccucggagaa

SEQ ID NO: 3143141 - RNA, 21 nt, Human
ugucagcuccccucggagaag

SEQ ID NO: 3143142 - RNA, 23 nt, Human
ugucagcuccccucggagaagag

SEQ ID NO: 3143143 - RNA, 12 nt, Human
ugucccuacacc

SEQ ID NO: 3143144 - RNA, 19 nt, Human
ugucccuacaccccucccc

SEQ ID NO: 3143145 - RNA, 21 nt, Human
aguauguuagugcaaauuguc

SEQ ID NO: 3143146 - RNA, 18 nt, Human
aguauguuagugcaaauu

SEQ ID NO: 3143147 - RNA, 21 nt, Human
aguauuagaauaccacaggaa

SEQ ID NO: 3143148 - RNA, 20 nt, Human
agucacauuccaagccucau

SEQ ID NO: 3143149 - RNA, 16 nt, Human
aguauuguccaggucu

SEQ ID NO: 3143150 - RNA, 15 nt, Human
aguauuguccagguc

SEQ ID NO: 3143151 - RNA, 16 nt, Human
aggggaauugaggaca

SEQ ID NO: 3143152 - RNA, 23 nt, Human
aggguaccuugaacacuggggga

SEQ ID NO: 3143153 - RNA, 19 nt, Human
aggguaccuugaacacugg

SEQ ID NO: 3143154 - RNA, 21 nt, Human
agggugaugggaaagcauugu

SEQ ID NO: 3143155 - RNA, 22 nt, Human
agggugaugggaaagcauugua

SEQ ID NO: 3143156 - RNA, 22 nt, Human
ugguccaugggccauaugaaaa

SEQ ID NO: 3143157 - RNA, 22 nt, Human
uggucugugagaugcuagaacu

SEQ ID NO: 3143158 - RNA, 17 nt, Human
aggguuaugauuaagua

SEQ ID NO: 3143159 - RNA, 16 nt, Human
aggguucagagacuca

SEQ ID NO: 3143160 - RNA, 18 nt, Human
aggguucagagacucagg

SEQ ID NO: 3143161 - RNA, 20 nt, Human
aggguuuauguuuaggaugu

SEQ ID NO: 3143162 - RNA, 15 nt, Human
aggucagugcaaaua

SEQ ID NO: 3143163 - RNA, 21 nt, Human
ugguuuaaagaaaguguauuu

SEQ ID NO: 3143164 - RNA, 15 nt, Human
ugguuucuagcauga

SEQ ID NO: 3143165 - RNA, 15 nt, Human
ugguuucauguuagu

SEQ ID NO: 3143166 - RNA, 12 nt, Human
ugguuucauguu

SEQ ID NO: 3143167 - RNA, 19 nt, Human
ugguuuaaagaaaguguau

SEQ ID NO: 3143168 - RNA, 17 nt, Human
ugguuuaaagaaagugu

SEQ ID NO: 3143169 - RNA, 16 nt, Human
ugguuuaaagaaagug

SEQ ID NO: 3143170 - RNA, 15 nt, Human
ugguuuaaagaaagu

SEQ ID NO: 3143171 - RNA, 23 nt, Human
uggugugaccacugcagaagaca

SEQ ID NO: 3143172 - RNA, 18 nt, Human
uguaagaaaauaucacuu

SEQ ID NO: 3143173 - RNA, 17 nt, Human
uguaagaaaauaucacu

SEQ ID NO: 3143174 - RNA, 20 nt, Human
auacaucccuuaccugggaa

SEQ ID NO: 3143175 - RNA, 21 nt, Human
auacaguucggugagcuacaa

SEQ ID NO: 3143176 - RNA, 19 nt, Human
uuauaacuaacauguccug

SEQ ID NO: 3143177 - RNA, 15 nt, Human
uuauaacuaacaugu

SEQ ID NO: 3143178 - RNA, 21 nt, Human
uuagccguggugauuuagcag

SEQ ID NO: 3143179 - RNA, 18 nt, Human
uuauauaagcuuguauuc

SEQ ID NO: 3143180 - RNA, 19 nt, Human
uuauaguuacuguguaauu

SEQ ID NO: 3143181 - RNA, 15 nt, Human
uuauaguuacugugu

SEQ ID NO: 3143182 - RNA, 14 nt, Human
uuauaguuacugug

SEQ ID NO: 3143183 - RNA, 13 nt, Human
uuauaguuacugu

SEQ ID NO: 3143184 - RNA, 22 nt, Human
auacaaaaaaaaaaaaaaauua

SEQ ID NO: 3143185 - RNA, 22 nt, Human
auaauuuuuauauuugaaauau

SEQ ID NO: 3143186 - RNA, 21 nt, Human
auaauuuuuauauuugaaaua

SEQ ID NO: 3143187 - RNA, 20 nt, Human
auaauuuugugaagcaaaau

SEQ ID NO: 3143188 - RNA, 15 nt, Human
auaauuuugugaagc

SEQ ID NO: 3143189 - RNA, 14 nt, Human
auaauuuugugaag

SEQ ID NO: 3143190 - RNA, 13 nt, Human
auaauuuugugaa

SEQ ID NO: 3143191 - RNA, 19 nt, Human
auaauuuuuauauuugaaa

SEQ ID NO: 3143192 - RNA, 16 nt, Human
auaauuuuuauauuug

SEQ ID NO: 3143193 - RNA, 14 nt, Human
auaauuuuuauauu

SEQ ID NO: 3143194 - RNA, 14 nt, Human
auaaugaauacuuu

SEQ ID NO: 3143195 - RNA, 21 nt, Human
auaaucuuucacaggggacag

SEQ ID NO: 3143196 - RNA, 22 nt, Human
uuagaugcaguucugaagaaga

SEQ ID NO: 3143197 - RNA, 23 nt, Human
uuagaugcaguucugaagaagau

SEQ ID NO: 3143198 - RNA, 20 nt, Human
auaauuggauuuccuaauac

SEQ ID NO: 3143199 - RNA, 18 nt, Human
auaauuggauuuccuaau

SEQ ID NO: 3143200 - RNA, 17 nt, Human
auaauuggauuuccuaa

SEQ ID NO: 3143201 - RNA, 16 nt, Human
auaauuggauuuccua

SEQ ID NO: 3143202 - RNA, 18 nt, Human
uuagcaggaagcugugag

SEQ ID NO: 3143203 - RNA, 18 nt, Human
uuaccuaagauuacaaau

SEQ ID NO: 3143204 - RNA, 14 nt, Human
uuaccuaagauuac

SEQ ID NO: 3143205 - RNA, 19 nt, Human
auaaaugugccuucauuuu

SEQ ID NO: 3143206 - RNA, 12 nt, Human
auaacuggaaac

SEQ ID NO: 3143207 - RNA, 12 nt, Human
aguuuucugaga

SEQ ID NO: 3143208 - RNA, 13 nt, Human
aguuuucugagaa

SEQ ID NO: 3143209 - RNA, 14 nt, Human
aguuuucugagaaa

SEQ ID NO: 3143210 - RNA, 17 nt, Human
aguuuucugagaaagac

SEQ ID NO: 3143211 - RNA, 14 nt, Human
auaaauaaaaauaa

SEQ ID NO: 3143212 - RNA, 15 nt, Human
auaaacucauuucua

SEQ ID NO: 3143213 - RNA, 14 nt, Human
aguucagagcugcc

SEQ ID NO: 3143214 - RNA, 15 nt, Human
aguucagagcugccc

SEQ ID NO: 3143215 - RNA, 16 nt, Human
aguucagagcugcccu

SEQ ID NO: 3143216 - RNA, 17 nt, Human
aguucagagcugcccuc

SEQ ID NO: 3143217 - RNA, 18 nt, Human
aguucagagcugcccucu

SEQ ID NO: 3143218 - RNA, 20 nt, Human
aguucggugagcuacaaaug

SEQ ID NO: 3143219 - RNA, 19 nt, Human
aguuauggcuauaggugcu

SEQ ID NO: 3143220 - RNA, 20 nt, Human
aguuauuauauuuacaaaug

SEQ ID NO: 3143221 - RNA, 22 nt, Human
aguuaccuuauaguuacugugu

SEQ ID NO: 3143222 - RNA, 21 nt, Human
aguuaccuuauaguuacugug

SEQ ID NO: 3143223 - RNA, 20 nt, Human
aguuaccuuauaguuacugu

SEQ ID NO: 3143224 - RNA, 17 nt, Human
aguuaccuuauaguuac

SEQ ID NO: 3143225 - RNA, 16 nt, Human
aguuaccuuauaguua

SEQ ID NO: 3143226 - RNA, 18 nt, Human
uuaaaaaagaaacauuug

SEQ ID NO: 3143227 - RNA, 15 nt, Human
uuaaaaaagaaacau

SEQ ID NO: 3143228 - RNA, 22 nt, Human
aguugcauagguuuaauaauuu

SEQ ID NO: 3143229 - RNA, 20 nt, Human
uuaaaaaugguuuaaauggu

SEQ ID NO: 3143230 - RNA, 12 nt, Human
aguuuggccaga

SEQ ID NO: 3143231 - RNA, 22 nt, Human
uuaaauucccguuuugucacuu

SEQ ID NO: 3143232 - RNA, 19 nt, Human
uuaaauucccguuuuguca

SEQ ID NO: 3143233 - RNA, 16 nt, Human
aguuugguuucuagca

SEQ ID NO: 3143234 - RNA, 11 nt, Human
aguuuggccag

SEQ ID NO: 3143235 - RNA, 14 nt, Human
aguuuggccagaag

SEQ ID NO: 3143236 - RNA, 13 nt, Human
aguuuggccagaa

SEQ ID NO: 3143237 - RNA, 20 nt, Human
uguuuuauaauuuugugaag

SEQ ID NO: 3143238 - RNA, 13 nt, Human
uguuuuauaauuu

SEQ ID NO: 3143239 - RNA, 14 nt, Human
uguuuuaggagcau

SEQ ID NO: 3143240 - RNA, 15 nt, Human
uguuugcuaagcauu

SEQ ID NO: 3143241 - RNA, 19 nt, Human
uguuugcuaagcauuccaa

SEQ ID NO: 3143242 - RNA, 21 nt, Human
aguugauaugccuuuucccaa

SEQ ID NO: 3143243 - RNA, 14 nt, Human
aguucugaagaaga

SEQ ID NO: 3143244 - RNA, 13 nt, Human
aguucugaagaag

SEQ ID NO: 3143245 - RNA, 15 nt, Human
aguucugaagaagau

SEQ ID NO: 3143246 - RNA, 23 nt, Human
aguucugugguuucauguuaguu

SEQ ID NO: 3143247 - RNA, 22 nt, Human
aguucugugguuucauguuagu

SEQ ID NO: 3143248 - RNA, 19 nt, Human
aguucugugguuucauguu

SEQ ID NO: 3143249 - RNA, 16 nt, Human
aguucugugguuucau

SEQ ID NO: 3143250 - RNA, 19 nt, Human
agcugcccucuccugggca

SEQ ID NO: 3143251 - RNA, 20 nt, Human
agcugcccucuccugggcag

SEQ ID NO: 3143252 - RNA, 17 nt, Human
agcugcccucuccuggg

SEQ ID NO: 3143253 - RNA, 18 nt, Human
agcugcccucuccugggc

SEQ ID NO: 3143254 - RNA, 16 nt, Human
agcugcccucuccugg

SEQ ID NO: 3143255 - RNA, 15 nt, Human
ugccucaccccuugc

SEQ ID NO: 3143256 - RNA, 11 nt, Human
ugccuccccuc

SEQ ID NO: 3143257 - RNA, 12 nt, Human
ugccuccccucc

SEQ ID NO: 3143258 - RNA, 13 nt, Human
ugccuccccuccu

SEQ ID NO: 3143259 - RNA, 14 nt, Human
ugccuccccuccuc

SEQ ID NO: 3143260 - RNA, 15 nt, Human
ugccuccccuccucu

SEQ ID NO: 3143261 - RNA, 18 nt, Human
ugccucagaaaacaagga

SEQ ID NO: 3143262 - RNA, 22 nt, Human
ugcccucuccugggcagcugcc

SEQ ID NO: 3143263 - RNA, 23 nt, Human
ugcccucuccugggcagcugccu

SEQ ID NO: 3143264 - RNA, 16 nt, Human
ugcccucuccugggca

SEQ ID NO: 3143265 - RNA, 17 nt, Human
ugcccucuccugggcag

SEQ ID NO: 3143266 - RNA, 18 nt, Human
ugcccucuccugggcagc

SEQ ID NO: 3143267 - RNA, 20 nt, Human
ugcccucuccugggcagcug

SEQ ID NO: 3143268 - RNA, 13 nt, Human
ugcccucuccugg

SEQ ID NO: 3143269 - RNA, 14 nt, Human
ugcccucuccuggg

SEQ ID NO: 3143270 - RNA, 15 nt, Human
ugcccucuccugggc

SEQ ID NO: 3143271 - RNA, 12 nt, Human
ugcccucuccug

SEQ ID NO: 3143272 - RNA, 23 nt, Human
agcucugcccauccugccccuga

SEQ ID NO: 3143273 - RNA, 20 nt, Human
agccuuccccuugcccaggg

SEQ ID NO: 3143274 - RNA, 22 nt, Human
agccuuccccuugcccagggcu

SEQ ID NO: 3143275 - RNA, 22 nt, Human
ugcagcucuccccuucucugua

SEQ ID NO: 3143276 - RNA, 20 nt, Human
ugcagcucuccccuucucug

SEQ ID NO: 3143277 - RNA, 11 nt, Human
ugccagccagc

SEQ ID NO: 3143278 - RNA, 12 nt, Human
ugccagccagca

SEQ ID NO: 3143279 - RNA, 19 nt, Human
agcuauggugucauaggcu

SEQ ID NO: 3143280 - RNA, 22 nt, Human
ugccauuuaaagcuuauuaaaa

SEQ ID NO: 3143281 - RNA, 16 nt, Human
ugccccauucaacauc

SEQ ID NO: 3143282 - RNA, 18 nt, Human
ugccccccuugccagaca

SEQ ID NO: 3143283 - RNA, 14 nt, Human
agccucauccgagg

SEQ ID NO: 3143284 - RNA, 17 nt, Human
agccucauccgaggcag

SEQ ID NO: 3143285 - RNA, 15 nt, Human
ugcagaagacaguau

SEQ ID NO: 3143286 - RNA, 14 nt, Human
ugcagaagacagua

SEQ ID NO: 3143287 - RNA, 11 nt, Human
agcccugucuc

SEQ ID NO: 3143288 - RNA, 18 nt, Human
agcccugucuccucucuc

SEQ ID NO: 3143289 - RNA, 20 nt, Human
ugauuuagcaggaagcugug

SEQ ID NO: 3143290 - RNA, 17 nt, Human
ugauuuagcaggaagcu

SEQ ID NO: 3143291 - RNA, 13 nt, Human
agccagcucucag

SEQ ID NO: 3143292 - RNA, 14 nt, Human
agccagcucucagc

SEQ ID NO: 3143293 - RNA, 15 nt, Human
agccagcucucagcc

SEQ ID NO: 3143294 - RNA, 19 nt, Human
ugaugggaaagcauuguaa

SEQ ID NO: 3143295 - RNA, 14 nt, Human
ugaugggaaagcau

SEQ ID NO: 3143296 - RNA, 11 nt, Human
ugaugaagaag

SEQ ID NO: 3143297 - RNA, 23 nt, Human
ugauuaaguaaugauaacuggaa

SEQ ID NO: 3143298 - RNA, 18 nt, Human
ugauuaaguaaugauaac

SEQ ID NO: 3143299 - RNA, 15 nt, Human
agccagcaguucaga

SEQ ID NO: 3143300 - RNA, 17 nt, Human
agccagcaguucagagc

SEQ ID NO: 3143301 - RNA, 19 nt, Human
agccagcaguucagagcug

SEQ ID NO: 3143302 - RNA, 19 nt, Human
agccagacuggcacaguuu

SEQ ID NO: 3143303 - RNA, 22 nt, Human
agccagcaguucagagcugccc

SEQ ID NO: 3143304 - RNA, 20 nt, Human
agccagcaguucagagcugc

SEQ ID NO: 3143305 - RNA, 21 nt, Human
agccagcaguucagagcugcc

SEQ ID NO: 3143306 - RNA, 20 nt, Human
uggacccagggaugacaugu

SEQ ID NO: 3143307 - RNA, 14 nt, Human
aggcaacugaggca

SEQ ID NO: 3143308 - RNA, 15 nt, Human
aggcaacugaggcag

SEQ ID NO: 3143309 - RNA, 16 nt, Human
aggcaacugaggcaga

SEQ ID NO: 3143310 - RNA, 18 nt, Human
uggaauuggagcucgugg

SEQ ID NO: 3143311 - RNA, 17 nt, Human
aggcaacugaggcagac

SEQ ID NO: 3143312 - RNA, 19 nt, Human
aggcaacugaggcagacag

SEQ ID NO: 3143313 - RNA, 14 nt, Human
aggaguuuggccag

SEQ ID NO: 3143314 - RNA, 13 nt, Human
aggaguuuggcca

SEQ ID NO: 3143315 - RNA, 18 nt, Human
aggaguuuggccagaagu

SEQ ID NO: 3143316 - RNA, 17 nt, Human
aggaguuuggccagaag

SEQ ID NO: 3143317 - RNA, 16 nt, Human
aggaguuuggccagaa

SEQ ID NO: 3143318 - RNA, 15 nt, Human
aggaguuuggccaga

SEQ ID NO: 3143319 - RNA, 11 nt, Human
aggagaaacug

SEQ ID NO: 3143320 - RNA, 17 nt, Human
aggagccaccaguucuc

SEQ ID NO: 3143321 - RNA, 15 nt, Human
aggagccaccaguuc

SEQ ID NO: 3143322 - RNA, 14 nt, Human
aggagccaccaguu

SEQ ID NO: 3143323 - RNA, 15 nt, Human
ugcuugccaucccuc

SEQ ID NO: 3143324 - RNA, 16 nt, Human
ugcuugccaucccucc

SEQ ID NO: 3143325 - RNA, 12 nt, Human
ugcuuggcccag

SEQ ID NO: 3143326 - RNA, 16 nt, Human
ugcuuggcccaggagu

SEQ ID NO: 3143327 - RNA, 15 nt, Human
ugcuuggcccaggag

SEQ ID NO: 3143328 - RNA, 23 nt, Human
ugcuuggcccaggaguuuggcca

SEQ ID NO: 3143329 - RNA, 18 nt, Human
ugcuuggcccaggaguuu

SEQ ID NO: 3143330 - RNA, 17 nt, Human
ugcuuuuaaaaaaaaau

SEQ ID NO: 3143331 - RNA, 18 nt, Human
aggaagcugugagagcag

SEQ ID NO: 3143332 - RNA, 23 nt, Human
aggaauugacccacaagaaauga

SEQ ID NO: 3143333 - RNA, 11 nt, Human
aggaauuuaaa

SEQ ID NO: 3143334 - RNA, 13 nt, Human
aggaauuucuuaa

SEQ ID NO: 3143335 - RNA, 23 nt, Human
ugcuguauuuuaaaagaaugauu

SEQ ID NO: 3143336 - RNA, 14 nt, Human
ugcuggagcucugc

SEQ ID NO: 3143337 - RNA, 13 nt, Human
ugcuggagcucug

SEQ ID NO: 3143338 - RNA, 23 nt, Human
aggaauuucuuaacuucuugcuu

SEQ ID NO: 3143339 - RNA, 19 nt, Human
aggaauuucuuaacuucuu

SEQ ID NO: 3143340 - RNA, 15 nt, Human
aggaauuucuuaacu

SEQ ID NO: 3143341 - RNA, 14 nt, Human
aggacacugauaug

SEQ ID NO: 3143342 - RNA, 23 nt, Human
aggacagcccuucuuuccacaga

SEQ ID NO: 3143343 - RNA, 18 nt, Human
uggacgagaaaacaauaa

SEQ ID NO: 3143344 - RNA, 22 nt, Human
uggcacaguuuucugagaaaga

SEQ ID NO: 3143345 - RNA, 20 nt, Human
uggcacaguuuucugagaaa

SEQ ID NO: 3143346 - RNA, 13 nt, Human
uggcugcuagcac

SEQ ID NO: 3143347 - RNA, 14 nt, Human
uggcugcuagcacu

SEQ ID NO: 3143348 - RNA, 15 nt, Human
uggcugcuagcacuu

SEQ ID NO: 3143349 - RNA, 20 nt, Human
ugggaaagggauuuucagcc

SEQ ID NO: 3143350 - RNA, 21 nt, Human
ugggaaagcauuguaaaugug

SEQ ID NO: 3143351 - RNA, 14 nt, Human
augauaacuggaaa

SEQ ID NO: 3143352 - RNA, 23 nt, Human
augagagacacacugaagaagca

SEQ ID NO: 3143353 - RNA, 18 nt, Human
uugugaagcaaaauuuuu

SEQ ID NO: 3143354 - RNA, 20 nt, Human
uuuaaaaaagaaacauuugg

SEQ ID NO: 3143355 - RNA, 22 nt, Human
uuguuuuuccuuguauuuaaau

SEQ ID NO: 3143356 - RNA, 13 nt, Human
uuguuuuuccuug

SEQ ID NO: 3143357 - RNA, 21 nt, Human
uuguuuuuccuuguauuuaaa

SEQ ID NO: 3143358 - RNA, 12 nt, Human
uugcucauggaa

SEQ ID NO: 3143359 - RNA, 11 nt, Human
uugcucaugga

SEQ ID NO: 3143360 - RNA, 23 nt, Human
uugcuaccaguauuuagaagcca

SEQ ID NO: 3143361 - RNA, 22 nt, Human
uugcuaccaguauuuagaagcc

SEQ ID NO: 3143362 - RNA, 20 nt, Human
uugcuaccaguauuuagaag

SEQ ID NO: 3143363 - RNA, 16 nt, Human
uugcuaccaguauuua

SEQ ID NO: 3143364 - RNA, 15 nt, Human
uugcuaccaguauuu

SEQ ID NO: 3143365 - RNA, 12 nt, Human
uugcuaccagua

SEQ ID NO: 3143366 - RNA, 20 nt, Human
augaaauauuauguuaaaac

SEQ ID NO: 3143367 - RNA, 21 nt, Human
augaaauauuauguuaaaacu

SEQ ID NO: 3143368 - RNA, 23 nt, Human
uuguaguguuggagaagaacuga

SEQ ID NO: 3143369 - RNA, 19 nt, Human
uuguauaaaauaauuuuua

SEQ ID NO: 3143370 - RNA, 13 nt, Human
uuguauaaaauaa

SEQ ID NO: 3143371 - RNA, 20 nt, Human
uuguauaauuggauuuccua

SEQ ID NO: 3143372 - RNA, 12 nt, Human
uuguauaauugg

SEQ ID NO: 3143373 - RNA, 11 nt, Human
uuguauaauug

SEQ ID NO: 3143374 - RNA, 21 nt, Human
uuguauaauuggauuuccuaa

SEQ ID NO: 3143375 - RNA, 21 nt, Human
augaauuaguuuuauaugcuu

SEQ ID NO: 3143376 - RNA, 22 nt, Human
augaauuacauuuguauaaaau

SEQ ID NO: 3143377 - RNA, 23 nt, Human
augaauuaguuuuauaugcuucu

SEQ ID NO: 3143378 - RNA, 17 nt, Human
augaauuacauuuguau

SEQ ID NO: 3143379 - RNA, 19 nt, Human
augaauuacauuuguauaa

SEQ ID NO: 3143380 - RNA, 18 nt, Human
augaauuacauuuguaua

SEQ ID NO: 3143381 - RNA, 20 nt, Human
uuucuaugaaauauuauguu

SEQ ID NO: 3143382 - RNA, 14 nt, Human
uuucuaugaaauau

SEQ ID NO: 3143383 - RNA, 13 nt, Human
uuucuaugaaaua

SEQ ID NO: 3143384 - RNA, 14 nt, Human
uuucugcaucagcu

SEQ ID NO: 3143385 - RNA, 14 nt, Human
uuugaaauauugac

SEQ ID NO: 3143386 - RNA, 11 nt, Human
uuugaaaaugg

SEQ ID NO: 3143387 - RNA, 16 nt, Human
auggcuauaggugcua

SEQ ID NO: 3143388 - RNA, 19 nt, Human
auggcuauaggugcuacaa

SEQ ID NO: 3143389 - RNA, 21 nt, Human
augggacauuugcucauggaa

SEQ ID NO: 3143390 - RNA, 22 nt, Human
augggacauuugcucauggaau

SEQ ID NO: 3143391 - RNA, 21 nt, Human
auggcuauaggugcuacaaaa

SEQ ID NO: 3143392 - RNA, 17 nt, Human
auggaauuucucccagu

SEQ ID NO: 3143393 - RNA, 15 nt, Human
auggcuauaggugcu

SEQ ID NO: 3143394 - RNA, 13 nt, Human
augcuaagugaaa

SEQ ID NO: 3143395 - RNA, 24 nt, Human
uuuaaagcuuauuaaaacucauuu

SEQ ID NO: 3143396 - RNA, 12 nt, Human
uuuaaagaaagu

SEQ ID NO: 3143397 - RNA, 16 nt, Human
uuuauuacuguaagaa

SEQ ID NO: 3143398 - RNA, 17 nt, Human
uuuauaugcuucuguuu

SEQ ID NO: 3143399 - RNA, 19 nt, Human
uuuauuacuguaagaaaau

SEQ ID NO: 3143400 - RNA, 14 nt, Human
augcuguauuuuaa

SEQ ID NO: 3143401 - RNA, 23 nt, Human
augcugucuacacuaagagagaa

SEQ ID NO: 3143402 - RNA, 16 nt, Human
uuuauuuuaauaaugu

SEQ ID NO: 3143403 - RNA, 16 nt, Human
auggaacauaaaauac

SEQ ID NO: 3143404 - RNA, 23 nt, Human
auggaauuggagcucgugggaca

SEQ ID NO: 3143405 - RNA, 18 nt, Human
auccugaggcuccacuug

SEQ ID NO: 3143406 - RNA, 16 nt, Human
auccugaggcuccacu

SEQ ID NO: 3143407 - RNA, 13 nt, Human
auccugaggcucc

SEQ ID NO: 3143408 - RNA, 11 nt, Human
auccugaggcu

SEQ ID NO: 3143409 - RNA, 16 nt, Human
auccugcaauuccacu

SEQ ID NO: 3143410 - RNA, 22 nt, Human
auccugaggcuccacuuggucu

SEQ ID NO: 3143411 - RNA, 13 nt, Human
auccugccccuga

SEQ ID NO: 3143412 - RNA, 23 nt, Human
uugacacugcucuaacagcccuc

SEQ ID NO: 3143413 - RNA, 19 nt, Human
uugacacuuaaaaaugguu

SEQ ID NO: 3143414 - RNA, 17 nt, Human
uugacacuuaaaaaugg

SEQ ID NO: 3143415 - RNA, 22 nt, Human
uugacacugcucuaacagcccu

SEQ ID NO: 3143416 - RNA, 16 nt, Human
uugacacugcucuaac

SEQ ID NO: 3143417 - RNA, 15 nt, Human
uugacacugcucuaa

SEQ ID NO: 3143418 - RNA, 14 nt, Human
uugacacugcucua

SEQ ID NO: 3143419 - RNA, 14 nt, Human
uugaaggaugcugu

SEQ ID NO: 3143420 - RNA, 16 nt, Human
uugaaggaugcugucu

SEQ ID NO: 3143421 - RNA, 17 nt, Human
uugaagggaaauuucag

SEQ ID NO: 3143422 - RNA, 23 nt, Human
aucacuugaacccgggaggcaga

SEQ ID NO: 3143423 - RNA, 14 nt, Human
uucugaagaagaug

SEQ ID NO: 3143424 - RNA, 18 nt, Human
uucuccucacuguaucca

SEQ ID NO: 3143425 - RNA, 14 nt, Human
aucccucccuccac

SEQ ID NO: 3143426 - RNA, 16 nt, Human
aucccucccuccaccu

SEQ ID NO: 3143427 - RNA, 17 nt, Human
aucccucccuccaccuc

SEQ ID NO: 3143428 - RNA, 18 nt, Human
aucccucccuccaccucc

SEQ ID NO: 3143429 - RNA, 20 nt, Human
aucccucccuccaccucccu

SEQ ID NO: 3143430 - RNA, 19 nt, Human
auccagguucccucccaga

SEQ ID NO: 3143431 - RNA, 15 nt, Human
auccagguucccucc

SEQ ID NO: 3143432 - RNA, 16 nt, Human
uucuguuuuauaauuu

SEQ ID NO: 3143433 - RNA, 17 nt, Human
uucuguuuuauaauuuu

SEQ ID NO: 3143434 - RNA, 17 nt, Human
uucagcgguuuauauaa

SEQ ID NO: 3143435 - RNA, 15 nt, Human
uucaucaaugaauga

SEQ ID NO: 3143436 - RNA, 13 nt, Human
auauaugcuaagu

SEQ ID NO: 3143437 - RNA, 16 nt, Human
uucauugacuaucaaa

SEQ ID NO: 3143438 - RNA, 14 nt, Human
uucauuaucucaaa

SEQ ID NO: 3143439 - RNA, 18 nt, Human
uuccaacuacuaauagaa

SEQ ID NO: 3143440 - RNA, 23 nt, Human
auauguaccuaacgaaguauccu

SEQ ID NO: 3143441 - RNA, 13 nt, Human
auaugcaaagcac

SEQ ID NO: 3143442 - RNA, 14 nt, Human
auaugcaaagcacu

SEQ ID NO: 3143443 - RNA, 13 nt, Human
auauuuacaaaug

SEQ ID NO: 3143444 - RNA, 14 nt, Human
auauuguuugcuaa

SEQ ID NO: 3143445 - RNA, 15 nt, Human
aucaaauaugcaaag

SEQ ID NO: 3143446 - RNA, 16 nt, Human
aucaaggguacacugc

SEQ ID NO: 3143447 - RNA, 16 nt, Human
aucaaauaugcaaagc

SEQ ID NO: 3143448 - RNA, 17 nt, Human
aucaaauaugcaaagca

SEQ ID NO: 3143449 - RNA, 18 nt, Human
aucaaauaugcaaagcac

SEQ ID NO: 3143450 - RNA, 14 nt, Human
aucaauuuuucuua

SEQ ID NO: 3143451 - RNA, 13 nt, Human
aucaauuuaaaaa

SEQ ID NO: 3143452 - RNA, 21 nt, Human
aucaaggguacacugccuucu

SEQ ID NO: 3143453 - RNA, 14 nt, Human
auuugaaauauuga

SEQ ID NO: 3143454 - RNA, 12 nt, Human
auuucauuucuu

SEQ ID NO: 3143455 - RNA, 20 nt, Human
auuuauuuuaauaauguuuc

SEQ ID NO: 3143456 - RNA, 19 nt, Human
auuuauuuuaauaauguuu

SEQ ID NO: 3143457 - RNA, 17 nt, Human
auuuauuuuaauaaugu

SEQ ID NO: 3143458 - RNA, 13 nt, Human
auuuagauguaua

SEQ ID NO: 3143459 - RNA, 12 nt, Human
auuuagaagcca

SEQ ID NO: 3143460 - RNA, 23 nt, Human
auuuagaagccaacuaugauuau

SEQ ID NO: 3143461 - RNA, 22 nt, Human
auuuagaagccaacuaugauua

SEQ ID NO: 3143462 - RNA, 21 nt, Human
auuuagaagccaacuaugauu

SEQ ID NO: 3143463 - RNA, 13 nt, Human
auuuagaagccaa

SEQ ID NO: 3143464 - RNA, 15 nt, Human
auuguauuacaaauc

SEQ ID NO: 3143465 - RNA, 18 nt, Human
auugacccacaagaaaug

SEQ ID NO: 3143466 - RNA, 22 nt, Human
auuuucaguuauuauauuuaca

SEQ ID NO: 3143467 - RNA, 17 nt, Human
auuuuaaaagaaugauu

SEQ ID NO: 3143468 - RNA, 18 nt, Human
auuuguauaaaauaauuu

SEQ ID NO: 3143469 - RNA, 15 nt, Human
auuuguauaaaauaa

SEQ ID NO: 3143470 - RNA, 19 nt, Human
auuuguauaaaauaauuuu

SEQ ID NO: 3143471 - RNA, 22 nt, Human
auuuuaaaagaaugauuaugaa

SEQ ID NO: 3143472 - RNA, 18 nt, Human
auuuuaaaagaaugauua

SEQ ID NO: 3143473 - RNA, 17 nt, Human
uuuuuauauuugaaaua

SEQ ID NO: 3143474 - RNA, 19 nt, Human
uuuuuauauuugaaauauu

SEQ ID NO: 3143475 - RNA, 20 nt, Human
auuagugccacuuaauguau

SEQ ID NO: 3143476 - RNA, 19 nt, Human
auuagugccacuuaaugua

SEQ ID NO: 3143477 - RNA, 18 nt, Human
auuagugccacuuaaugu

SEQ ID NO: 3143478 - RNA, 16 nt, Human
auuagugccacuuaau

SEQ ID NO: 3143479 - RNA, 22 nt, Human
auuagugccacuuaauguaugu

SEQ ID NO: 3143480 - RNA, 21 nt, Human
auuagugccacuuaauguaug

SEQ ID NO: 3143481 - RNA, 19 nt, Human
uuuuugugaaaagcuccau

SEQ ID NO: 3143482 - RNA, 23 nt, Human
auuaaguaaugauaacuggaaac

SEQ ID NO: 3143483 - RNA, 21 nt, Human
auuaaguaaugauaacuggaa

SEQ ID NO: 3143484 - RNA, 15 nt, Human
auuacagugggugcc

SEQ ID NO: 3143485 - RNA, 18 nt, Human
auuacauuuguauaaaau

SEQ ID NO: 3143486 - RNA, 17 nt, Human
auuacauuuguauaaaa

SEQ ID NO: 3143487 - RNA, 12 nt, Human
auuaccagggac

SEQ ID NO: 3143488 - RNA, 16 nt, Human
auuacauuuguauaaa

SEQ ID NO: 3143489 - RNA, 14 nt, Human
uuuuaauaauguuu

SEQ ID NO: 3143490 - RNA, 13 nt, Human
uuuuaauaauguu

SEQ ID NO: 3143491 - RNA, 12 nt, Human
uuuuaauaaugu

SEQ ID NO: 3143492 - RNA, 16 nt, Human
uuuuaauaauguuuca

SEQ ID NO: 3143493 - RNA, 19 nt, Human
augugcuaguaauuggaaa

SEQ ID NO: 3143494 - RNA, 15 nt, Human
auguuagcaaagagu

SEQ ID NO: 3143495 - RNA, 18 nt, Human
auguucaucaaugaauga

SEQ ID NO: 3143496 - RNA, 15 nt, Human
uuuucugagaaagac

SEQ ID NO: 3143497 - RNA, 18 nt, Human
uuuucugagaaagacuau

SEQ ID NO: 3143498 - RNA, 14 nt, Human
uuuucucuaggaaa

SEQ ID NO: 3143499 - RNA, 13 nt, Human
uuuucauuuaucu

SEQ ID NO: 3143500 - RNA, 21 nt, Human
uuuucuccucacuguauccag

SEQ ID NO: 3143501 - RNA, 21 nt, Human
auguuuucaggcuagauguau

SEQ ID NO: 3143502 - RNA, 17 nt, Human
auguuuucaggcuagau

SEQ ID NO: 3143503 - RNA, 15 nt, Human
auguuuucaggcuag

SEQ ID NO: 3143504 - RNA, 21 nt, Human
uuuucuguaccaguuaauuuu

SEQ ID NO: 3143505 - RNA, 14 nt, Human
uuuucuguaccagu

SEQ ID NO: 3143506 - RNA, 21 nt, Human
ugagagcaguuugguuucuag

SEQ ID NO: 3143507 - RNA, 23 nt, Human
ugagagcaguuugguuucuagca

SEQ ID NO: 3143508 - RNA, 22 nt, Human
ugagagacacacugaagaagca

SEQ ID NO: 3143509 - RNA, 21 nt, Human
ugagagacacacugaagaagc

SEQ ID NO: 3143510 - RNA, 20 nt, Human
ugagaugcuagaacucccuu

SEQ ID NO: 3143511 - RNA, 13 nt, Human
ugagaugugaaca

SEQ ID NO: 3143512 - RNA, 18 nt, Human
ugagaugugaacacauca

SEQ ID NO: 3143513 - RNA, 19 nt, Human
ugagaugugaacacaucag

SEQ ID NO: 3143514 - RNA, 24 nt, Human
ugagaugugaacacaucagcuugc

SEQ ID NO: 3143515 - RNA, 20 nt, Human
ugagacucugucucagucca

SEQ ID NO: 3143516 - RNA, 20 nt, Human
ugagagacacacugaagaag

SEQ ID NO: 3143517 - RNA, 19 nt, Human
ugagagacacacugaagaa

SEQ ID NO: 3143518 - RNA, 17 nt, Human
ugagagacacacugaag

SEQ ID NO: 3143519 - RNA, 16 nt, Human
ugagagacacacugaa

SEQ ID NO: 3143520 - RNA, 16 nt, Human
agauuuuccugaaaac

SEQ ID NO: 3143521 - RNA, 14 nt, Human
agauuuuccugaaa

SEQ ID NO: 3143522 - RNA, 15 nt, Human
agauuuuccugaaaa

SEQ ID NO: 3143523 - RNA, 20 nt, Human
agcaagggugaugggaaagc

SEQ ID NO: 3143524 - RNA, 22 nt, Human
agcaagggugaugggaaagcau

SEQ ID NO: 3143525 - RNA, 16 nt, Human
agcaagggugauggga

SEQ ID NO: 3143526 - RNA, 13 nt, Human
ugacacugcucua

SEQ ID NO: 3143527 - RNA, 16 nt, Human
ugacacugcucuaaca

SEQ ID NO: 3143528 - RNA, 15 nt, Human
ugacacugcucuaac

SEQ ID NO: 3143529 - RNA, 22 nt, Human
ugacacugcucuaacagcccuc

SEQ ID NO: 3143530 - RNA, 21 nt, Human
ugacacugcucuaacagcccu

SEQ ID NO: 3143531 - RNA, 19 nt, Human
ugacacugcucuaacagcc

SEQ ID NO: 3143532 - RNA, 15 nt, Human
ugacacuuaaaaaug

SEQ ID NO: 3143533 - RNA, 13 nt, Human
agauccuggaaau

SEQ ID NO: 3143534 - RNA, 19 nt, Human
agaugcuagaacucccuuu

SEQ ID NO: 3143535 - RNA, 21 nt, Human
agaugcaguucugaagaagau

SEQ ID NO: 3143536 - RNA, 20 nt, Human
agaugcaguucugaagaaga

SEQ ID NO: 3143537 - RNA, 16 nt, Human
agaugcacaugagcug

SEQ ID NO: 3143538 - RNA, 13 nt, Human
agaugcacaugag

SEQ ID NO: 3143539 - RNA, 15 nt, Human
agaugcuagaacucc

SEQ ID NO: 3143540 - RNA, 21 nt, Human
agaugcuagaacucccuuuca

SEQ ID NO: 3143541 - RNA, 14 nt, Human
agauguaguauuuu

SEQ ID NO: 3143542 - RNA, 20 nt, Human
agauuacaaaucagaaguca

SEQ ID NO: 3143543 - RNA, 21 nt, Human
agauugugccccugcacucca

SEQ ID NO: 3143544 - RNA, 16 nt, Human
ugacuaucaaacugaa

SEQ ID NO: 3143545 - RNA, 22 nt, Human
ugacuaucaaacugaagccaga

SEQ ID NO: 3143546 - RNA, 20 nt, Human
ugacuauugaaguugcagau

SEQ ID NO: 3143547 - RNA, 22 nt, Human
agaugugaacacaucagcuugc

SEQ ID NO: 3143548 - RNA, 22 nt, Human
agauguauguacuucaugcugu

SEQ ID NO: 3143549 - RNA, 17 nt, Human
agaugugaacacaucag

SEQ ID NO: 3143550 - RNA, 17 nt, Human
ugaaagaggaaugaagu

SEQ ID NO: 3143551 - RNA, 18 nt, Human
ugaaagaggaaugaagua

SEQ ID NO: 3143552 - RNA, 13 nt, Human
ugaaagaaaauaa

SEQ ID NO: 3143553 - RNA, 22 nt, Human
ugaaacugagaugugaacacau

SEQ ID NO: 3143554 - RNA, 21 nt, Human
ugaaaauauuuguaucacaaa

SEQ ID NO: 3143555 - RNA, 22 nt, Human
ugaaaauauuuguaucacaaau

SEQ ID NO: 3143556 - RNA, 20 nt, Human
ugaaaaucuuauaauuuaaa

SEQ ID NO: 3143557 - RNA, 16 nt, Human
ugaaaaugggcucaac

SEQ ID NO: 3143558 - RNA, 17 nt, Human
ugaaaauauuuguauca

SEQ ID NO: 3143559 - RNA, 16 nt, Human
agagacacacugaaga

SEQ ID NO: 3143560 - RNA, 14 nt, Human
agagacagaaagca

SEQ ID NO: 3143561 - RNA, 18 nt, Human
agacaggaccugacuauu

SEQ ID NO: 3143562 - RNA, 22 nt, Human
agacuccaaagaaauguaaggg

SEQ ID NO: 3143563 - RNA, 20 nt, Human
agacuggcacaguuuucuga

SEQ ID NO: 3143564 - RNA, 21 nt, Human
agacuggcacaguuuucugag

SEQ ID NO: 3143565 - RNA, 18 nt, Human
agacuggcacaguuuucu

SEQ ID NO: 3143566 - RNA, 23 nt, Human
agacuggcacaguuuucugagaa

SEQ ID NO: 3143567 - RNA, 15 nt, Human
agagcugcccucucc

SEQ ID NO: 3143568 - RNA, 19 nt, Human
agagcugcccucuccuggg

SEQ ID NO: 3143569 - RNA, 20 nt, Human
agagcugcccucuccugggc

SEQ ID NO: 3143570 - RNA, 16 nt, Human
agagcugcccucuccu

SEQ ID NO: 3143571 - RNA, 17 nt, Human
agagcugcccucuccug

SEQ ID NO: 3143572 - RNA, 18 nt, Human
agagcugcccucuccugg

SEQ ID NO: 3143573 - RNA, 13 nt, Human
ugaacaaauuuac

SEQ ID NO: 3143574 - RNA, 18 nt, Human
ugaacccgggaggcagag

SEQ ID NO: 3143575 - RNA, 22 nt, Human
ugaacccauauuuguacaccaa

SEQ ID NO: 3143576 - RNA, 22 nt, Human
ugaagaagcaccaaucaugaau

SEQ ID NO: 3143577 - RNA, 17 nt, Human
ugaaguacucauacaug

SEQ ID NO: 3143578 - RNA, 20 nt, Human
ugaagauuuaccacuugugu

SEQ ID NO: 3143579 - RNA, 17 nt, Human
ugaagauuuaccacuug

SEQ ID NO: 3143580 - RNA, 18 nt, Human
agagcuguucacagccag

SEQ ID NO: 3143581 - RNA, 14 nt, Human
agaagaacugaaau

SEQ ID NO: 3143582 - RNA, 13 nt, Human
agaagaacugaaa

SEQ ID NO: 3143583 - RNA, 18 nt, Human
agaagaugguaccaccag

SEQ ID NO: 3143584 - RNA, 23 nt, Human
agaagccaacuaugauuauuaac

SEQ ID NO: 3143585 - RNA, 18 nt, Human
agaagccaacuaugauua

SEQ ID NO: 3143586 - RNA, 14 nt, Human
ucugcuugccaucc

SEQ ID NO: 3143587 - RNA, 23 nt, Human
ucugcuugccaucccucccucca

SEQ ID NO: 3143588 - RNA, 17 nt, Human
ucugcuugccaucccuc

SEQ ID NO: 3143589 - RNA, 20 nt, Human
ucugcuugccaucccucccu

SEQ ID NO: 3143590 - RNA, 16 nt, Human
ucugcuugccaucccu

SEQ ID NO: 3143591 - RNA, 15 nt, Human
ucugcagauaaacag

SEQ ID NO: 3143592 - RNA, 18 nt, Human
ucugcagauaaacaguag

SEQ ID NO: 3143593 - RNA, 14 nt, Human
agaaaugaaagcag

SEQ ID NO: 3143594 - RNA, 14 nt, Human
ucugugagaugcua

SEQ ID NO: 3143595 - RNA, 22 nt, Human
ucugugagaugcuagaacuccc

SEQ ID NO: 3143596 - RNA, 17 nt, Human
ucugugagaugcuagaa

SEQ ID NO: 3143597 - RNA, 23 nt, Human
ucugugagaugcuagaacucccu

SEQ ID NO: 3143598 - RNA, 24 nt, Human
agacagagccccacccucagaugc

SEQ ID NO: 3143599 - RNA, 22 nt, Human
agacagagccccacccucagau

SEQ ID NO: 3143600 - RNA, 12 nt, Human
agacacacauga

SEQ ID NO: 3143601 - RNA, 15 nt, Human
agaauuaacacauga

SEQ ID NO: 3143602 - RNA, 17 nt, Human
ucuaggaaauauuuauu

SEQ ID NO: 3143603 - RNA, 16 nt, Human
ucuaggaaauauuuau

SEQ ID NO: 3143604 - RNA, 15 nt, Human
acuuaauguauguua

SEQ ID NO: 3143605 - RNA, 13 nt, Human
acuuaauguaugu

SEQ ID NO: 3143606 - RNA, 16 nt, Human
acuuaauguauguuac

SEQ ID NO: 3143607 - RNA, 13 nt, Human
uccugggcagcug

SEQ ID NO: 3143608 - RNA, 12 nt, Human
uccugggcagcu

SEQ ID NO: 3143609 - RNA, 14 nt, Human
ucuaaguaaaacca

SEQ ID NO: 3143610 - RNA, 15 nt, Human
ucuaaguaaaaccac

SEQ ID NO: 3143611 - RNA, 19 nt, Human
ucuaaguaaaaccacagca

SEQ ID NO: 3143612 - RNA, 12 nt, Human
ucucaggaaauc

SEQ ID NO: 3143613 - RNA, 15 nt, Human
ucucagccaacgagu

SEQ ID NO: 3143614 - RNA, 14 nt, Human
ucucaggaaaucaa

SEQ ID NO: 3143615 - RNA, 21 nt, Human
ucucaggaaaucaaauaugca

SEQ ID NO: 3143616 - RNA, 23 nt, Human
ucucaggaaaucaaauaugcaaa

SEQ ID NO: 3143617 - RNA, 15 nt, Human
ucucauuuccaagca

SEQ ID NO: 3143618 - RNA, 17 nt, Human
ucucauggguggcacuc

SEQ ID NO: 3143619 - RNA, 15 nt, Human
acuugucaauaaaau

SEQ ID NO: 3143620 - RNA, 15 nt, Human
ucuccucacuguauc

SEQ ID NO: 3143621 - RNA, 19 nt, Human
accccagacuagauguagu

SEQ ID NO: 3143622 - RNA, 14 nt, Human
ucagcccucagaau

SEQ ID NO: 3143623 - RNA, 13 nt, Human
ucagcccucagaa

SEQ ID NO: 3143624 - RNA, 21 nt, Human
ucagccuuccccuugcccagg

SEQ ID NO: 3143625 - RNA, 22 nt, Human
ucagccuuccccuugcccaggg

SEQ ID NO: 3143626 - RNA, 23 nt, Human
ucagccuuccccuugcccagggc

SEQ ID NO: 3143627 - RNA, 17 nt, Human
ucagccugugcugcccg

SEQ ID NO: 3143628 - RNA, 14 nt, Human
ucagccuggugggc

SEQ ID NO: 3143629 - RNA, 12 nt, Human
ucagccugugcu

SEQ ID NO: 3143630 - RNA, 16 nt, Human
ucagccugugcugccc

SEQ ID NO: 3143631 - RNA, 17 nt, Human
ucagccuggugggccuc

SEQ ID NO: 3143632 - RNA, 18 nt, Human
ucagccuggugggccucc

SEQ ID NO: 3143633 - RNA, 19 nt, Human
ucagccuggugggccuccu

SEQ ID NO: 3143634 - RNA, 17 nt, Human
acccgggaggcagaggu

SEQ ID NO: 3143635 - RNA, 15 nt, Human
acccgggaggcagag

SEQ ID NO: 3143636 - RNA, 17 nt, Human
ucaguuuuugugaaaag

SEQ ID NO: 3143637 - RNA, 15 nt, Human
ucaguuuuugugaaa

SEQ ID NO: 3143638 - RNA, 14 nt, Human
ucaugcagcugugg

SEQ ID NO: 3143639 - RNA, 12 nt, Human
ucaugcagcugu

SEQ ID NO: 3143640 - RNA, 21 nt, Human
ucacaacagauuauuaccuua

SEQ ID NO: 3143641 - RNA, 16 nt, Human
ucaauucuugccaaau

SEQ ID NO: 3143642 - RNA, 23 nt, Human
ucacuugaacccgggaggcagag

SEQ ID NO: 3143643 - RNA, 11 nt, Human
accaguauuua

SEQ ID NO: 3143644 - RNA, 19 nt, Human
accaguauuuagaagccaa

SEQ ID NO: 3143645 - RNA, 18 nt, Human
accaguauuuagaagcca

SEQ ID NO: 3143646 - RNA, 14 nt, Human
accaguauuuagaa

SEQ ID NO: 3143647 - RNA, 14 nt, Human
accagucugacugu

SEQ ID NO: 3143648 - RNA, 13 nt, Human
ucaccucauggaa

SEQ ID NO: 3143649 - RNA, 12 nt, Human
ucaccucaugga

SEQ ID NO: 3143650 - RNA, 23 nt, Human
accaaaaaucucaauauuucaga

SEQ ID NO: 3143651 - RNA, 23 nt, Human
ucaaugaaugaaugaauggcuaa

SEQ ID NO: 3143652 - RNA, 15 nt, Human
ucaauauuucagaua

SEQ ID NO: 3143653 - RNA, 19 nt, Human
ucaauauuucagauaauca

SEQ ID NO: 3143654 - RNA, 22 nt, Human
ucaauaucuuuuuuuuaauaaa

SEQ ID NO: 3143655 - RNA, 23 nt, Human
acaugagguacugagagugaaca

SEQ ID NO: 3143656 - RNA, 20 nt, Human
acaugagguacugagaguga

SEQ ID NO: 3143657 - RNA, 16 nt, Human
acaugagguacugaga

SEQ ID NO: 3143658 - RNA, 16 nt, Human
acaugaaguccaagca

SEQ ID NO: 3143659 - RNA, 20 nt, Human
acaugggacauuugcucaug

SEQ ID NO: 3143660 - RNA, 15 nt, Human
acaugggacauuugc

SEQ ID NO: 3143661 - RNA, 21 nt, Human
acaugggacauuugcucaugg

SEQ ID NO: 3143662 - RNA, 14 nt, Human
acaugggacauuug

SEQ ID NO: 3143663 - RNA, 11 nt, Human
acaugggacau

SEQ ID NO: 3143664 - RNA, 18 nt, Human
ucaaauugugugaaaggu

SEQ ID NO: 3143665 - RNA, 15 nt, Human
ucaaauugugugaaa

SEQ ID NO: 3143666 - RNA, 16 nt, Human
uccuggaaaucagggu

SEQ ID NO: 3143667 - RNA, 22 nt, Human
uccugaaaacccuugccaugug

SEQ ID NO: 3143668 - RNA, 18 nt, Human
acugagagugaacaaauu

SEQ ID NO: 3143669 - RNA, 17 nt, Human
acugagaugugaacaca

SEQ ID NO: 3143670 - RNA, 22 nt, Human
acugagaugugaacacaucagc

SEQ ID NO: 3143671 - RNA, 20 nt, Human
acugacucuuaagaagacug

SEQ ID NO: 3143672 - RNA, 18 nt, Human
acugacucuuaagaagac

SEQ ID NO: 3143673 - RNA, 17 nt, Human
acugacucuuaagaaga

SEQ ID NO: 3143674 - RNA, 13 nt, Human
acugacuucuaag

SEQ ID NO: 3143675 - RNA, 15 nt, Human
acugacuucuaagua

SEQ ID NO: 3143676 - RNA, 16 nt, Human
acugacuucuaaguaa

SEQ ID NO: 3143677 - RNA, 22 nt, Human
acugacuucuaaguaaaaccac

SEQ ID NO: 3143678 - RNA, 16 nt, Human
acugacucuuaagaag

SEQ ID NO: 3143679 - RNA, 15 nt, Human
acugacucuuaagaa

SEQ ID NO: 3143680 - RNA, 14 nt, Human
acugacucuuaaga

SEQ ID NO: 3143681 - RNA, 13 nt, Human
acugacucuuaag

SEQ ID NO: 3143682 - RNA, 21 nt, Human
acucuuaagaagacugcauua

SEQ ID NO: 3143683 - RNA, 20 nt, Human
acucuuaagaagacugcauu

SEQ ID NO: 3143684 - RNA, 19 nt, Human
acuccagugagacagcucu

SEQ ID NO: 3143685 - RNA, 15 nt, Human
acuaucucauuucca

SEQ ID NO: 3143686 - RNA, 14 nt, Human
acuaucaaacugaa

SEQ ID NO: 3143687 - RNA, 19 nt, Human
acuaucaaacugaagccag

SEQ ID NO: 3143688 - RNA, 17 nt, Human
acuaucucauuuccaag

SEQ ID NO: 3143689 - RNA, 16 nt, Human
acuaucucauuuccaa

SEQ ID NO: 3143690 - RNA, 17 nt, Human
acuauauuguuugcuaa

SEQ ID NO: 3143691 - RNA, 22 nt, Human
acuauauuguuugcuaagcauu

SEQ ID NO: 3143692 - RNA, 15 nt, Human
uccauccugaggcuc

SEQ ID NO: 3143693 - RNA, 12 nt, Human
uccauccugagg

SEQ ID NO: 3143694 - RNA, 11 nt, Human
uccauccugag

SEQ ID NO: 3143695 - RNA, 18 nt, Human
acuaaacuuuuuuucugu

SEQ ID NO: 3143696 - RNA, 17 nt, Human
acuaaacuuuuuuucug

SEQ ID NO: 3143697 - RNA, 22 nt, Human
acuaaacuuuuuuucuguacca

SEQ ID NO: 3143698 - RNA, 20 nt, Human
acuaaacuuuuuuucuguac

SEQ ID NO: 3143699 - RNA, 19 nt, Human
acuaaacuuuuuuucugua

SEQ ID NO: 3143700 - RNA, 15 nt, Human
acuaauuuuaaaaug

SEQ ID NO: 3143701 - RNA, 23 nt, Human
ucccagaggagccaccaguucuc

SEQ ID NO: 3143702 - RNA, 16 nt, Human
ucccagaggagccacc

SEQ ID NO: 3143703 - RNA, 21 nt, Human
ucccagaggagccaccaguuc

SEQ ID NO: 3143704 - RNA, 20 nt, Human
ucccagaggagccaccaguu

SEQ ID NO: 3143705 - RNA, 18 nt, Human
uccagugagacagcucug

SEQ ID NO: 3143706 - RNA, 11 nt, Human
acgcucucugg

SEQ ID NO: 3143707 - RNA, 19 nt, Human
acgccugaggcaauuagac

SEQ ID NO: 3143708 - RNA, 15 nt, Human
acgccugaggcaauu

SEQ ID NO: 3143709 - RNA, 19 nt, Human
accuugaaaacuuuaugcu

SEQ ID NO: 3143710 - RNA, 18 nt, Human
accuugaacacuggggga

SEQ ID NO: 3143711 - RNA, 21 nt, Human
accuugaacacugggggaggg

SEQ ID NO: 3143712 - RNA, 20 nt, Human
accuuuuggucuggagggaa

SEQ ID NO: 3143713 - RNA, 22 nt, Human
uccacugguucuucuuggucuc

SEQ ID NO: 3143714 - RNA, 14 nt, Human
uaacuacuuuauaa

SEQ ID NO: 3143715 - RNA, 20 nt, Human
uaacgauaaaagacagugaa

SEQ ID NO: 3143716 - RNA, 23 nt, Human
uaacuacuuuauaacuaacaugu

SEQ ID NO: 3143717 - RNA, 17 nt, Human
uaacuacuuuauaacua

SEQ ID NO: 3143718 - RNA, 16 nt, Human
uaacuacuuuauaacu

SEQ ID NO: 3143719 - RNA, 13 nt, Human
uaacuucuugcuu

SEQ ID NO: 3143720 - RNA, 12 nt, Human
uaacuucuugcu

SEQ ID NO: 3143721 - RNA, 20 nt, Human
uaacuucuugcuucuuucua

SEQ ID NO: 3143722 - RNA, 19 nt, Human
uaacuucuugcuucuuucu

SEQ ID NO: 3143723 - RNA, 15 nt, Human
uaacuucuugcuucu

SEQ ID NO: 3143724 - RNA, 18 nt, Human
uaagaagugaaaaucuac

SEQ ID NO: 3143725 - RNA, 20 nt, Human
aauaucacuugucaauaaaa

SEQ ID NO: 3143726 - RNA, 22 nt, Human
aauaucacuugucaauaaaauc

SEQ ID NO: 3143727 - RNA, 16 nt, Human
aauagucaaauugugu

SEQ ID NO: 3143728 - RNA, 18 nt, Human
aauauuuauuuuaauaau

SEQ ID NO: 3143729 - RNA, 19 nt, Human
aauauuuauuuuaauaaug

SEQ ID NO: 3143730 - RNA, 15 nt, Human
aauauuuauuuuaau

SEQ ID NO: 3143731 - RNA, 24 nt, Human
aauaugccccauucaacaucuagu

SEQ ID NO: 3143732 - RNA, 21 nt, Human
aauaugccccauucaacaucu

SEQ ID NO: 3143733 - RNA, 21 nt, Human
uaagcaaaaugugauauguac

SEQ ID NO: 3143734 - RNA, 22 nt, Human
aaucaggguuaguauuguccag

SEQ ID NO: 3143735 - RNA, 21 nt, Human
aaucaggguuaguauugucca

SEQ ID NO: 3143736 - RNA, 16 nt, Human
aaucaggguuaguauu

SEQ ID NO: 3143737 - RNA, 19 nt, Human
aaucuacacuccagugaga

SEQ ID NO: 3143738 - RNA, 19 nt, Human
aaucuuauaauuuaaaaua

SEQ ID NO: 3143739 - RNA, 23 nt, Human
aaucgcuccaccuugcagcucuc

SEQ ID NO: 3143740 - RNA, 19 nt, Human
uaaguaaaaccacagcagu

SEQ ID NO: 3143741 - RNA, 19 nt, Human
uaaguaaugauaacuggaa

SEQ ID NO: 3143742 - RNA, 16 nt, Human
uaagcuuguauuccuu

SEQ ID NO: 3143743 - RNA, 15 nt, Human
aaucaugaauuaguu

SEQ ID NO: 3143744 - RNA, 12 nt, Human
aaucaugaauua

SEQ ID NO: 3143745 - RNA, 12 nt, Human
uaauaaacucau

SEQ ID NO: 3143746 - RNA, 22 nt, Human
aaugaauggcuaagcaaaaugu

SEQ ID NO: 3143747 - RNA, 16 nt, Human
uaauguauguuaccaa

SEQ ID NO: 3143748 - RNA, 17 nt, Human
uaauguauguuaccaaa

SEQ ID NO: 3143749 - RNA, 16 nt, Human
aaucuuauaauuuaaa

SEQ ID NO: 3143750 - RNA, 21 nt, Human
aaucuuaguguaugauuacug

SEQ ID NO: 3143751 - RNA, 18 nt, Human
aaucuuaguguaugauua

SEQ ID NO: 3143752 - RNA, 13 nt, Human
uaaucuuucacag

SEQ ID NO: 3143753 - RNA, 13 nt, Human
uacuguaagaaaa

SEQ ID NO: 3143754 - RNA, 18 nt, Human
uacuggccuuuuucauuu

SEQ ID NO: 3143755 - RNA, 14 nt, Human
uacuguaagaaaau

SEQ ID NO: 3143756 - RNA, 21 nt, Human
aauugacccacaagaaaugaa

SEQ ID NO: 3143757 - RNA, 22 nt, Human
aauugacccacaagaaaugaaa

SEQ ID NO: 3143758 - RNA, 21 nt, Human
aauucccguuuugucacuuuu

SEQ ID NO: 3143759 - RNA, 20 nt, Human
aauucccguuuugucacuuu

SEQ ID NO: 3143760 - RNA, 15 nt, Human
aauuaggcuguaacu

SEQ ID NO: 3143761 - RNA, 17 nt, Human
aauuaggcuguaacuac

SEQ ID NO: 3143762 - RNA, 16 nt, Human
aauuaggcuguaacua

SEQ ID NO: 3143763 - RNA, 22 nt, Human
aauuaggcuguaacuacuuuau

SEQ ID NO: 3143764 - RNA, 21 nt, Human
aauuaggcuguaacuacuuua

SEQ ID NO: 3143765 - RNA, 19 nt, Human
aauuaggcuguaacuacuu

SEQ ID NO: 3143766 - RNA, 18 nt, Human
aauuaggcuguaacuacu

SEQ ID NO: 3143767 - RNA, 20 nt, Human
aauuagugccacuuaaugua

SEQ ID NO: 3143768 - RNA, 17 nt, Human
aauuagugccacuuaau

SEQ ID NO: 3143769 - RNA, 15 nt, Human
aauuagugccacuua

SEQ ID NO: 3143770 - RNA, 23 nt, Human
aauuaggcuguaacuacuuuaua

SEQ ID NO: 3143771 - RNA, 22 nt, Human
aauuccacuuauaggaauugac

SEQ ID NO: 3143772 - RNA, 18 nt, Human
aauuccaagugauugaaa

SEQ ID NO: 3143773 - RNA, 18 nt, Human
aauucauuuuuuaaauuc

SEQ ID NO: 3143774 - RNA, 20 nt, Human
aauucacagugcucuuuucu

SEQ ID NO: 3143775 - RNA, 16 nt, Human
aaugcuguauuuuaaa

SEQ ID NO: 3143776 - RNA, 14 nt, Human
uacacuaagagaga

SEQ ID NO: 3143777 - RNA, 18 nt, Human
uaccaccagucugacugu

SEQ ID NO: 3143778 - RNA, 21 nt, Human
aauguauguuaccaaaaauaa

SEQ ID NO: 3143779 - RNA, 17 nt, Human
aauguauguuaccaaaa

SEQ ID NO: 3143780 - RNA, 13 nt, Human
aauguauguuacc

SEQ ID NO: 3143781 - RNA, 18 nt, Human
acacucaaaucaagaaac

SEQ ID NO: 3143782 - RNA, 19 nt, Human
acacucaaaucaagaaacu

SEQ ID NO: 3143783 - RNA, 13 nt, Human
acacuaagagaga

SEQ ID NO: 3143784 - RNA, 18 nt, Human
acacaugauccugcaauu

SEQ ID NO: 3143785 - RNA, 15 nt, Human
acacaucagcuugcc

SEQ ID NO: 3143786 - RNA, 15 nt, Human
acacaugaaguccaa

SEQ ID NO: 3143787 - RNA, 23 nt, Human
uaguuaccuuauaguuacugugu

SEQ ID NO: 3143788 - RNA, 22 nt, Human
uaguuaccuuauaguuacugug

SEQ ID NO: 3143789 - RNA, 22 nt, Human
acaaugcuguauuuuaaaagaa

SEQ ID NO: 3143790 - RNA, 18 nt, Human
acaaugcuguauuuuaaa

SEQ ID NO: 3143791 - RNA, 15 nt, Human
acacacucaaaucaa

SEQ ID NO: 3143792 - RNA, 22 nt, Human
uagugaaacucguuaauuugua

SEQ ID NO: 3143793 - RNA, 17 nt, Human
uaguguuggagaagaac

SEQ ID NO: 3143794 - RNA, 23 nt, Human
uaguguuggagaagaacugaaau

SEQ ID NO: 3143795 - RNA, 14 nt, Human
uaguuaccuuauag

SEQ ID NO: 3143796 - RNA, 12 nt, Human
uaguuaccuuau

SEQ ID NO: 3143797 - RNA, 21 nt, Human
uaguuaccuuauaguuacugu

SEQ ID NO: 3143798 - RNA, 19 nt, Human
uaguuaccuuauaguuacu

SEQ ID NO: 3143799 - RNA, 18 nt, Human
uaguuaccuuauaguuac

SEQ ID NO: 3143800 - RNA, 17 nt, Human
uaguuaccuuauaguua

SEQ ID NO: 3143801 - RNA, 12 nt, Human
uaggagcaugag

SEQ ID NO: 3143802 - RNA, 18 nt, Human
uaggaaauauuuauuuua

SEQ ID NO: 3143803 - RNA, 19 nt, Human
uaggaaauauuuauuuuaa

SEQ ID NO: 3143804 - RNA, 14 nt, Human
uagggagagaagau

SEQ ID NO: 3143805 - RNA, 15 nt, Human
uagggagagaagaua

SEQ ID NO: 3143806 - RNA, 14 nt, Human
acaagacugcacau

SEQ ID NO: 3143807 - RNA, 13 nt, Human
acaagacugcaca

SEQ ID NO: 3143808 - RNA, 23 nt, Human
acaauacaucccuuaccugggaa

SEQ ID NO: 3143809 - RNA, 16 nt, Human
uagagcacacuguagc

SEQ ID NO: 3143810 - RNA, 17 nt, Human
uagagcacacuguagca

SEQ ID NO: 3143811 - RNA, 19 nt, Human
uagaggagaaacuggaacu

SEQ ID NO: 3143812 - RNA, 22 nt, Human
uagaggagaaacuggaacucuc

SEQ ID NO: 3143813 - RNA, 15 nt, Human
uagaugcaguucuga

SEQ ID NO: 3143814 - RNA, 19 nt, Human
acaaauuuacagagacaga

SEQ ID NO: 3143815 - RNA, 18 nt, Human
acaaauuuacagagacag

SEQ ID NO: 3143816 - RNA, 20 nt, Human
acaagacccaaaaggcagaa

SEQ ID NO: 3143817 - RNA, 21 nt, Human
uauguuuucaggcuagaugua

SEQ ID NO: 3143818 - RNA, 16 nt, Human
uauuaaaacucauuuu

SEQ ID NO: 3143819 - RNA, 22 nt, Human
acaggaaccacaagacugcaca

SEQ ID NO: 3143820 - RNA, 17 nt, Human
acaggaaguagaggagg

SEQ ID NO: 3143821 - RNA, 21 nt, Human
acagggaggacgcucucuggc

SEQ ID NO: 3143822 - RNA, 20 nt, Human
acagggaggacgcucucugg

SEQ ID NO: 3143823 - RNA, 12 nt, Human
acagggacccac

SEQ ID NO: 3143824 - RNA, 16 nt, Human
acagucaccucaugga

SEQ ID NO: 3143825 - RNA, 18 nt, Human
acagucaccucauggaau

SEQ ID NO: 3143826 - RNA, 17 nt, Human
acagucaccucauggaa

SEQ ID NO: 3143827 - RNA, 14 nt, Human
uauuacuguaagaa

SEQ ID NO: 3143828 - RNA, 15 nt, Human
uauucaaacagucuc

SEQ ID NO: 3143829 - RNA, 23 nt, Human
uauucaaacagucucaggaaauc

SEQ ID NO: 3143830 - RNA, 16 nt, Human
acagccucuuagaugc

SEQ ID NO: 3143831 - RNA, 13 nt, Human
uaugcgguuaauu

SEQ ID NO: 3143832 - RNA, 15 nt, Human
uaugccccauucaac

SEQ ID NO: 3143833 - RNA, 19 nt, Human
uaugccccauucaacaucu

SEQ ID NO: 3143834 - RNA, 20 nt, Human
uaugauuaaguaaugauaac

SEQ ID NO: 3143835 - RNA, 16 nt, Human
uaugauuaaguaauga

SEQ ID NO: 3143836 - RNA, 21 nt, Human
uaugaaauauuauguuaaaac

SEQ ID NO: 3143837 - RNA, 19 nt, Human
acagccgcuccugucugcc

SEQ ID NO: 3143838 - RNA, 20 nt, Human
acagccgcuccugucugcca

SEQ ID NO: 3143839 - RNA, 23 nt, Human
acagccgcuccugucugccagcc

SEQ ID NO: 3143840 - RNA, 24 nt, Human
acagccgcuccugucugccagcca

SEQ ID NO: 3143841 - RNA, 14 nt, Human
acagccgcuccugu

SEQ ID NO: 3143842 - RNA, 18 nt, Human
acagccgcuccugucugc

SEQ ID NO: 3143843 - RNA, 15 nt, Human
uauauuguuugcuaa

SEQ ID NO: 3143844 - RNA, 19 nt, Human
uauaauuuugugaagcaaa

SEQ ID NO: 3143845 - RNA, 19 nt, Human
uauccuaauaaaaagguga

SEQ ID NO: 3143846 - RNA, 18 nt, Human
uauccuaauaaaaaggug

SEQ ID NO: 3143847 - RNA, 15 nt, Human
uauccuaauaaaaag

SEQ ID NO: 3143848 - RNA, 12 nt, Human
uauccuaauaaa

SEQ ID NO: 3143849 - RNA, 19 nt, Human
uauccagguucccucccag

SEQ ID NO: 3143850 - RNA, 17 nt, Human
aagcaacccaaauguuc

SEQ ID NO: 3143851 - RNA, 19 nt, Human
aagauggcauaaccugucu

SEQ ID NO: 3143852 - RNA, 22 nt, Human
gugucuuaauuaaaagaauauu

SEQ ID NO: 3143853 - RNA, 15 nt, Human
aagauagcagggcau

SEQ ID NO: 3143854 - RNA, 14 nt, Human
aagauagcagggca

SEQ ID NO: 3143855 - RNA, 19 nt, Human
aagcauuguaaaugugcuu

SEQ ID NO: 3143856 - RNA, 19 nt, Human
aagcacugacuucuaagua

SEQ ID NO: 3143857 - RNA, 20 nt, Human
aagcacugacuucuaaguaa

SEQ ID NO: 3143858 - RNA, 18 nt, Human
aagcauuguaaaugugcu

SEQ ID NO: 3143859 - RNA, 16 nt, Human
aagcacuaaacaaaga

SEQ ID NO: 3143860 - RNA, 16 nt, Human
aagcacugacuucuaa

SEQ ID NO: 3143861 - RNA, 17 nt, Human
aagcacugacuucuaag

SEQ ID NO: 3143862 - RNA, 13 nt, Human
aagcacagcccuu

SEQ ID NO: 3143863 - RNA, 19 nt, Human
guuauuauauuuacaaaug

SEQ ID NO: 3143864 - RNA, 13 nt, Human
guuacuguguaau

SEQ ID NO: 3143865 - RNA, 17 nt, Human
guuauuauauuuacaaa

SEQ ID NO: 3143866 - RNA, 10 nt, Human
guuauuuaaa

SEQ ID NO: 3143867 - RNA, 17 nt, Human
guuaauuuugaagugcu

SEQ ID NO: 3143868 - RNA, 14 nt, Human
guuaauuuuuccaa

SEQ ID NO: 3143869 - RNA, 22 nt, Human
guuaauuuugaagugcuguuua

SEQ ID NO: 3143870 - RNA, 20 nt, Human
guuaauuuuuccaacuacua

SEQ ID NO: 3143871 - RNA, 18 nt, Human
guucccuugaugaagaag

SEQ ID NO: 3143872 - RNA, 19 nt, Human
aaggaaaaaauaacaauga

SEQ ID NO: 3143873 - RNA, 9 nt, Human
uaaaauggu

SEQ ID NO: 3143874 - RNA, 17 nt, Human
uaaaauggguuuuacug

SEQ ID NO: 3143875 - RNA, 23 nt, Human
aagucagauggaaaauucauuuu

SEQ ID NO: 3143876 - RNA, 20 nt, Human
aagucagauggaaaauucau

SEQ ID NO: 3143877 - RNA, 21 nt, Human
uaaaaaaaaaccugagcccca

SEQ ID NO: 3143878 - RNA, 15 nt, Human
uaaaaaggugaccau

SEQ ID NO: 3143879 - RNA, 13 nt, Human
uaaaaaggugacc

SEQ ID NO: 3143880 - RNA, 14 nt, Human
uaaaaccacagcag

SEQ ID NO: 3143881 - RNA, 15 nt, Human
uaaaaccacagcagu

SEQ ID NO: 3143882 - RNA, 13 nt, Human
uaaaaccacagca

SEQ ID NO: 3143883 - RNA, 13 nt, Human
uaaaagaauauuu

SEQ ID NO: 3143884 - RNA, 21 nt, Human
uaaaauacacacucaaaucaa

SEQ ID NO: 3143885 - RNA, 22 nt, Human
uaaaauaauuuuuauauuugaa

SEQ ID NO: 3143886 - RNA, 20 nt, Human
uaaaauaauuuuuauauuug

SEQ ID NO: 3143887 - RNA, 16 nt, Human
aaguacuguguacaga

SEQ ID NO: 3143888 - RNA, 19 nt, Human
aaguauguuagugcaaauu

SEQ ID NO: 3143889 - RNA, 18 nt, Human
aaguauguuagugcaaau

SEQ ID NO: 3143890 - RNA, 19 nt, Human
aaguaaugauaacuggaaa

SEQ ID NO: 3143891 - RNA, 21 nt, Human
guuuaaagaaaguguauuugg

SEQ ID NO: 3143892 - RNA, 18 nt, Human
guuuaaagaaaguguauu

SEQ ID NO: 3143893 - RNA, 17 nt, Human
guuuaaagaaaguguau

SEQ ID NO: 3143894 - RNA, 16 nt, Human
guuuaaagaaagugua

SEQ ID NO: 3143895 - RNA, 15 nt, Human
guuuaaagaaagugu

SEQ ID NO: 3143896 - RNA, 14 nt, Human
guuuaaagaaagug

SEQ ID NO: 3143897 - RNA, 23 nt, Human
guuuauuaaucuuaguguaugau

SEQ ID NO: 3143898 - RNA, 14 nt, Human
guuuaugauuccac

SEQ ID NO: 3143899 - RNA, 22 nt, Human
guuuauuaaucuuaguguauga

SEQ ID NO: 3143900 - RNA, 17 nt, Human
aaggggaauugaggaca

SEQ ID NO: 3143901 - RNA, 17 nt, Human
aagggcuguuauaaucu

SEQ ID NO: 3143902 - RNA, 15 nt, Human
aagggcuguuauaau

SEQ ID NO: 3143903 - RNA, 18 nt, Human
gugcuaguaauuggaaag

SEQ ID NO: 3143904 - RNA, 21 nt, Human
gugcuacaaaaacacagcaag

SEQ ID NO: 3143905 - RNA, 22 nt, Human
gugcuacaaaaacacagcaagg

SEQ ID NO: 3143906 - RNA, 11 nt, Human
aagaaacauuu

SEQ ID NO: 3143907 - RNA, 13 nt, Human
aagaaagaaaauc

SEQ ID NO: 3143908 - RNA, 14 nt, Human
aagaaagaaaauca

SEQ ID NO: 3143909 - RNA, 16 nt, Human
aagaaagaaaaucagg

SEQ ID NO: 3143910 - RNA, 16 nt, Human
gugauuaccagggacu

SEQ ID NO: 3143911 - RNA, 11 nt, Human
gugauuaccag

SEQ ID NO: 3143912 - RNA, 17 nt, Human
gugauuaccagggacug

SEQ ID NO: 3143913 - RNA, 19 nt, Human
aacuucuugcuucuuucua

SEQ ID NO: 3143914 - RNA, 22 nt, Human
aacuucuugcuucuuucuagaa

SEQ ID NO: 3143915 - RNA, 23 nt, Human
aacuuccuuggacucauuuuaaa

SEQ ID NO: 3143916 - RNA, 20 nt, Human
aacuucgaaagcaucauuau

SEQ ID NO: 3143917 - RNA, 20 nt, Human
aacuucuugcuucuuucuag

SEQ ID NO: 3143918 - RNA, 22 nt, Human
aacuuccuuggacucauuuuaa

SEQ ID NO: 3143919 - RNA, 18 nt, Human
aacuucagcgguuuauau

SEQ ID NO: 3143920 - RNA, 13 nt, Human
aacuucagacaua

SEQ ID NO: 3143921 - RNA, 14 nt, Human
gucuuauuuauuau

SEQ ID NO: 3143922 - RNA, 14 nt, Human
gucuuaauuaaaag

SEQ ID NO: 3143923 - RNA, 19 nt, Human
gucuuauauauuguagaua

SEQ ID NO: 3143924 - RNA, 24 nt, Human
aacucauuuuuguuuucauuaucu

SEQ ID NO: 3143925 - RNA, 21 nt, Human
aacucauuuuuguuuucauua

SEQ ID NO: 3143926 - RNA, 22 nt, Human
guccaugaagauguagaggaga

SEQ ID NO: 3143927 - RNA, 18 nt, Human
aacacagcaagggugaug

SEQ ID NO: 3143928 - RNA, 20 nt, Human
aacacagcaagggugauggg

SEQ ID NO: 3143929 - RNA, 17 nt, Human
aacacaacuauauuguu

SEQ ID NO: 3143930 - RNA, 17 nt, Human
aacacugggggagggga

SEQ ID NO: 3143931 - RNA, 16 nt, Human
aacacugggggagggg

SEQ ID NO: 3143932 - RNA, 13 nt, Human
aacagucucagga

SEQ ID NO: 3143933 - RNA, 14 nt, Human
aacauaaaauacaa

SEQ ID NO: 3143934 - RNA, 14 nt, Human
aacagucucaggaa

SEQ ID NO: 3143935 - RNA, 12 nt, Human
aacauauauaac

SEQ ID NO: 3143936 - RNA, 20 nt, Human
aacauguccugccuauuauc

SEQ ID NO: 3143937 - RNA, 19 nt, Human
aacauguccugccuauuau

SEQ ID NO: 3143938 - RNA, 20 nt, Human
guccuuuugacacugcucua

SEQ ID NO: 3143939 - RNA, 19 nt, Human
guccuuuugacacugcucu

SEQ ID NO: 3143940 - RNA, 17 nt, Human
guccuuuugacacugcu

SEQ ID NO: 3143941 - RNA, 16 nt, Human
guccuuuugacacugc

SEQ ID NO: 3143942 - RNA, 15 nt, Human
guccuuuugacacug

SEQ ID NO: 3143943 - RNA, 13 nt, Human
gucaggaaagaga

SEQ ID NO: 3143944 - RNA, 14 nt, Human
gucaggaaagagaa

SEQ ID NO: 3143945 - RNA, 14 nt, Human
gucacuuuuucuga

SEQ ID NO: 3143946 - RNA, 15 nt, Human
gucacaggaaguaga

SEQ ID NO: 3143947 - RNA, 13 nt, Human
gucacaggaagua

SEQ ID NO: 3143948 - RNA, 21 nt, Human
gucaauuuuguuauguauauu

SEQ ID NO: 3143949 - RNA, 20 nt, Human
gucacaggaaguagaggagg

SEQ ID NO: 3143950 - RNA, 14 nt, Human
guauuuagaagcca

SEQ ID NO: 3143951 - RNA, 17 nt, Human
aaauuccaagugauuga

SEQ ID NO: 3143952 - RNA, 23 nt, Human
aaauuccuuagcuuagaccucag

SEQ ID NO: 3143953 - RNA, 22 nt, Human
aaauuccuuagcuuagaccuca

SEQ ID NO: 3143954 - RNA, 17 nt, Human
aaauuguauuacaaauc

SEQ ID NO: 3143955 - RNA, 18 nt, Human
aaaugugccuucauuuuu

SEQ ID NO: 3143956 - RNA, 15 nt, Human
aaaugugcuuuuaaa

SEQ ID NO: 3143957 - RNA, 15 nt, Human
auguggugggacagg

SEQ ID NO: 3143958 - RNA, 21 nt, Human
auguggugggacagggaccca

SEQ ID NO: 3143959 - RNA, 20 nt, Human
auguaagggaaacugccagc

SEQ ID NO: 3143960 - RNA, 21 nt, Human
auguaagggaaacugccagca

SEQ ID NO: 3143961 - RNA, 22 nt, Human
auguaagggaaacugccagcaa

SEQ ID NO: 3143962 - RNA, 19 nt, Human
augucuuggguaggcggga

SEQ ID NO: 3143963 - RNA, 14 nt, Human
auggagcugggcua

SEQ ID NO: 3143964 - RNA, 16 nt, Human
aucuuauaauuuaaaa

SEQ ID NO: 3143965 - RNA, 22 nt, Human
aucuuauaauuuaaaauaugcu

SEQ ID NO: 3143966 - RNA, 18 nt, Human
aguuguaccgcaauguga

SEQ ID NO: 3143967 - RNA, 19 nt, Human
aguuguaccgcaaugugac

SEQ ID NO: 3143968 - RNA, 16 nt, Human
aguuacaguucugugg

SEQ ID NO: 3143969 - RNA, 15 nt, Human
aguuacaguucugug

SEQ ID NO: 3143970 - RNA, 14 nt, Human
aguuacaguucugu

SEQ ID NO: 3143971 - RNA, 13 nt, Human
aguuacaguucug

SEQ ID NO: 3143972 - RNA, 15 nt, Human
agugauuaccaggga

SEQ ID NO: 3143973 - RNA, 18 nt, Human
agugauuaccagggacug

SEQ ID NO: 3143974 - RNA, 21 nt, Human
agugucuuaauuaaaagaaua

SEQ ID NO: 3143975 - RNA, 16 nt, Human
agucaaggcuuagacc

SEQ ID NO: 3143976 - RNA, 14 nt, Human
agucaaggcuuaga

SEQ ID NO: 3143977 - RNA, 17 nt, Human
agucaaauugugugaaa

SEQ ID NO: 3143978 - RNA, 15 nt, Human
agucaaauuguguga

SEQ ID NO: 3143979 - RNA, 13 nt, Human
agucaaauugugu

SEQ ID NO: 3143980 - RNA, 21 nt, Human
aguccaagcauuuagauguau

SEQ ID NO: 3143981 - RNA, 11 nt, Human
aguccaagcau

SEQ ID NO: 3143982 - RNA, 16 nt, Human
aguccaagcauuuaga

SEQ ID NO: 3143983 - RNA, 14 nt, Human
auaauuacuauguc

SEQ ID NO: 3143984 - RNA, 19 nt, Human
auaaguacuguguacagaa

SEQ ID NO: 3143985 - RNA, 18 nt, Human
auaaguacuguguacaga

SEQ ID NO: 3143986 - RNA, 23 nt, Human
auaugcuucuguuuuauaauuuu

SEQ ID NO: 3143987 - RNA, 15 nt, Human
auaucaauuuaaaaa

SEQ ID NO: 3143988 - RNA, 18 nt, Human
auaucacuugucaauaaa

SEQ ID NO: 3143989 - RNA, 23 nt, Human
auauccuaauaaaaaggugacca

SEQ ID NO: 3143990 - RNA, 20 nt, Human
auauccuaauaaaaagguga

SEQ ID NO: 3143991 - RNA, 19 nt, Human
auauuuauuacuguaagaa

SEQ ID NO: 3143992 - RNA, 14 nt, Human
auauuuauuacugu

SEQ ID NO: 3143993 - RNA, 18 nt, Human
auauuuauuuuaauaaug

SEQ ID NO: 3143994 - RNA, 14 nt, Human
agguucccucccag

SEQ ID NO: 3143995 - RNA, 13 nt, Human
aggcagacagcag

SEQ ID NO: 3143996 - RNA, 14 nt, Human
aggcagacagcagc

SEQ ID NO: 3143997 - RNA, 15 nt, Human
aggcagacagcagcu

SEQ ID NO: 3143998 - RNA, 18 nt, Human
aggcagacagcagcucag

SEQ ID NO: 3143999 - RNA, 19 nt, Human
aggcagacagcagcucagg

SEQ ID NO: 3144000 - RNA, 20 nt, Human
aggcagacagcagcucaggc

SEQ ID NO: 3144001 - RNA, 21 nt, Human
aggcagacagcagcucaggca

SEQ ID NO: 3144002 - RNA, 14 nt, Human
aggggcagaacagc

SEQ ID NO: 3144003 - RNA, 13 nt, Human
aggagaggggcag

SEQ ID NO: 3144004 - RNA, 18 nt, Human
aggagaggggcagaacag

SEQ ID NO: 3144005 - RNA, 19 nt, Human
aggagaggggcagaacagc

SEQ ID NO: 3144006 - RNA, 14 nt, Human
aggauguugaaaaa

SEQ ID NO: 3144007 - RNA, 18 nt, Human
agcuucacuguaaaauaa

SEQ ID NO: 3144008 - RNA, 17 nt, Human
agacugcauuauauuua

SEQ ID NO: 3144009 - RNA, 15 nt, Human
agaggggcagaacag

SEQ ID NO: 3144010 - RNA, 16 nt, Human
agaggggcagaacagc

SEQ ID NO: 3144011 - RNA, 22 nt, Human
agaguuacaguucugugguuuc

SEQ ID NO: 3144012 - RNA, 17 nt, Human
agaguuacaguucugug

SEQ ID NO: 3144013 - RNA, 16 nt, Human
agaguuacaguucugu

SEQ ID NO: 3144014 - RNA, 15 nt, Human
agaguuacaguucug

SEQ ID NO: 3144015 - RNA, 11 nt, Human
agaguuacagu

SEQ ID NO: 3144016 - RNA, 20 nt, Human
agaguuaauauauagaaggg

SEQ ID NO: 3144017 - RNA, 17 nt, Human
agaggagccaccaguuc

SEQ ID NO: 3144018 - RNA, 21 nt, Human
agauaggucagugcaaauacu

SEQ ID NO: 3144019 - RNA, 19 nt, Human
agccagauuuuccugaaaa

SEQ ID NO: 3144020 - RNA, 15 nt, Human
agccagauuuuccug

SEQ ID NO: 3144021 - RNA, 12 nt, Human
agcaugaagaca

SEQ ID NO: 3144022 - RNA, 19 nt, Human
agcaguucagagcugcccu

SEQ ID NO: 3144023 - RNA, 13 nt, Human
agcacuaaagcag

SEQ ID NO: 3144024 - RNA, 14 nt, Human
agcacuaaagcagu

SEQ ID NO: 3144025 - RNA, 16 nt, Human
agcacuaaagcagugg

SEQ ID NO: 3144026 - RNA, 17 nt, Human
agcacuaaagcagugga

SEQ ID NO: 3144027 - RNA, 20 nt, Human
agcacuaaagcaguggacac

SEQ ID NO: 3144028 - RNA, 23 nt, Human
agcacuaaagcaguggacaccag

SEQ ID NO: 3144029 - RNA, 13 nt, Human
agcagccagcucu

SEQ ID NO: 3144030 - RNA, 14 nt, Human
agcagccagcucuc

SEQ ID NO: 3144031 - RNA, 15 nt, Human
agcagccagcucuca

SEQ ID NO: 3144032 - RNA, 16 nt, Human
agcagccagcucucag

SEQ ID NO: 3144033 - RNA, 17 nt, Human
agcagccagcucucagc

SEQ ID NO: 3144034 - RNA, 18 nt, Human
agcagccagcucucagcc

SEQ ID NO: 3144035 - RNA, 19 nt, Human
agcagccagcucucagcca

SEQ ID NO: 3144036 - RNA, 23 nt, Human
agcagccagcucucagccaacga

SEQ ID NO: 3144037 - RNA, 23 nt, Human
agcaguugaaaagacuccaaaga

SEQ ID NO: 3144038 - RNA, 21 nt, Human
agcaguugaaaagacuccaaa

SEQ ID NO: 3144039 - RNA, 16 nt, Human
agcaguucagagcugc

SEQ ID NO: 3144040 - RNA, 15 nt, Human
agcaguucagagcug

SEQ ID NO: 3144041 - RNA, 17 nt, Human
agcaguucagagcugcc

SEQ ID NO: 3144042 - RNA, 18 nt, Human
agcaguucagagcugccc

SEQ ID NO: 3144043 - RNA, 14 nt, Human
agauguagaggaga

SEQ ID NO: 3144044 - RNA, 21 nt, Human
agaugggagaaucacuugaac

SEQ ID NO: 3144045 - RNA, 21 nt, Human
agccgggcgugguggugagug

SEQ ID NO: 3144046 - RNA, 19 nt, Human
agccccacccucagaugca

SEQ ID NO: 3144047 - RNA, 23 nt, Human
agcccaaguucaugcagcugugg

SEQ ID NO: 3144048 - RNA, 21 nt, Human
agcccaaguucaugcagcugu

SEQ ID NO: 3144049 - RNA, 16 nt, Human
acccaaguccaagcau

SEQ ID NO: 3144050 - RNA, 13 nt, Human
acauguuacaaca

SEQ ID NO: 3144051 - RNA, 16 nt, Human
acauuugcucauggaa

SEQ ID NO: 3144052 - RNA, 18 nt, Human
acauuugcucauggaauu

SEQ ID NO: 3144053 - RNA, 20 nt, Human
aauuuugaagugcuguuuau

SEQ ID NO: 3144054 - RNA, 19 nt, Human
aauuuugaagugcuguuua

SEQ ID NO: 3144055 - RNA, 14 nt, Human
aauuuugaagugcu

SEQ ID NO: 3144056 - RNA, 13 nt, Human
acaacuauauugu

SEQ ID NO: 3144057 - RNA, 20 nt, Human
acagcucugcauacucauua

SEQ ID NO: 3144058 - RNA, 15 nt, Human
acagcaguugaaaag

SEQ ID NO: 3144059 - RNA, 13 nt, Human
acagccagacugg

SEQ ID NO: 3144060 - RNA, 15 nt, Human
acagccagacuggca

SEQ ID NO: 3144061 - RNA, 16 nt, Human
acagccagacuggcac

SEQ ID NO: 3144062 - RNA, 14 nt, Human
acacugcucuaaca

SEQ ID NO: 3144063 - RNA, 13 nt, Human
acacugcucuaac

SEQ ID NO: 3144064 - RNA, 19 nt, Human
acacugcucuaacagcccu

SEQ ID NO: 3144065 - RNA, 17 nt, Human
acacugcucuaacagcc

SEQ ID NO: 3144066 - RNA, 20 nt, Human
acacugcucuaacagcccuc

SEQ ID NO: 3144067 - RNA, 16 nt, Human
acgugcacgcacacug

SEQ ID NO: 3144068 - RNA, 16 nt, Human
acuaagagagaaugag

SEQ ID NO: 3144069 - RNA, 15 nt, Human
acuaagagagaauga

SEQ ID NO: 3144070 - RNA, 17 nt, Human
acuaauagaauaaaggc

SEQ ID NO: 3144071 - RNA, 16 nt, Human
acuaauagaauaaagg

SEQ ID NO: 3144072 - RNA, 23 nt, Human
acucagucucucuucucuccagc

SEQ ID NO: 3144073 - RNA, 19 nt, Human
acucagucucucuucucuc

SEQ ID NO: 3144074 - RNA, 13 nt, Human
acucagggcccca

SEQ ID NO: 3144075 - RNA, 14 nt, Human
acucagggccccag

SEQ ID NO: 3144076 - RNA, 17 nt, Human
acucagucucucuucuc

SEQ ID NO: 3144077 - RNA, 14 nt, Human
acuagcuauggugu

SEQ ID NO: 3144078 - RNA, 13 nt, Human
acucccuuucaac

SEQ ID NO: 3144079 - RNA, 12 nt, Human
acucccuuucaa

SEQ ID NO: 3144080 - RNA, 13 nt, Human
acuuggucuguga

SEQ ID NO: 3144081 - RNA, 14 nt, Human
acuuggucugugag

SEQ ID NO: 3144082 - RNA, 15 nt, Human
acuuggucugugaga

SEQ ID NO: 3144083 - RNA, 18 nt, Human
acuuguaaaggaauuuaa

SEQ ID NO: 3144084 - RNA, 20 nt, Human
acuuguaaaggaauuuaaaa

SEQ ID NO: 3144085 - RNA, 19 nt, Human
acuuguaaaggaauuuaaa

SEQ ID NO: 3144086 - RNA, 17 nt, Human
acuucacacacaggcaa

SEQ ID NO: 3144087 - RNA, 19 nt, Human
acuucacacacaggcaacu

SEQ ID NO: 3144088 - RNA, 16 nt, Human
acuucacacacaggca

SEQ ID NO: 3144089 - RNA, 12 nt, Human
acuggaacucuc

SEQ ID NO: 3144090 - RNA, 18 nt, Human
acuuuauaacuaacaugu

SEQ ID NO: 3144091 - RNA, 16 nt, Human
acuuuauaacuaacau

SEQ ID NO: 3144092 - RNA, 19 nt, Human
agaaauaaaguuggugaca

SEQ ID NO: 3144093 - RNA, 21 nt, Human
agaaauaaaguuggugacaga

SEQ ID NO: 3144094 - RNA, 16 nt, Human
aaugggcucaaccaga

SEQ ID NO: 3144095 - RNA, 20 nt, Human
aauuaguuuuauaugcuucu

SEQ ID NO: 3144096 - RNA, 17 nt, Human
aauuaguuuuauaugcu

SEQ ID NO: 3144097 - RNA, 14 nt, Human
aauuaguuuuauau

SEQ ID NO: 3144098 - RNA, 13 nt, Human
aauccauacauuu

SEQ ID NO: 3144099 - RNA, 20 nt, Human
aaugauaacuggaaacuuca

SEQ ID NO: 3144100 - RNA, 17 nt, Human
aaugauaacuggaaacu

SEQ ID NO: 3144101 - RNA, 16 nt, Human
aauauuauguuaaaac

SEQ ID NO: 3144102 - RNA, 13 nt, Human
aaucacaauacau

SEQ ID NO: 3144103 - RNA, 19 nt, Human
aauaaaauggguuuuacug

SEQ ID NO: 3144104 - RNA, 14 nt, Human
aauaaaauggguuu

SEQ ID NO: 3144105 - RNA, 15 nt, Human
aaguuguuucauuga

SEQ ID NO: 3144106 - RNA, 22 nt, Human
aagugcuguuuauuaaucuuag

SEQ ID NO: 3144107 - RNA, 21 nt, Human
aagugcuguuuauuaaucuua

SEQ ID NO: 3144108 - RNA, 21 nt, Human
aauaauccuaaacauaugaau

SEQ ID NO: 3144109 - RNA, 20 nt, Human
aagugcuguuuauuaaucuu

SEQ ID NO: 3144110 - RNA, 18 nt, Human
aagugcuguuuauuaauc

SEQ ID NO: 3144111 - RNA, 17 nt, Human
aagugcuguuuauuaau

SEQ ID NO: 3144112 - RNA, 16 nt, Human
aagugcuguuuauuaa

SEQ ID NO: 3144113 - RNA, 14 nt, Human
aagugcuguuuauu

SEQ ID NO: 3144114 - RNA, 13 nt, Human
aagccagauuuuc

SEQ ID NO: 3144115 - RNA, 16 nt, Human
aagauuuaccacuugu

SEQ ID NO: 3144116 - RNA, 15 nt, Human
aacacgagcaggcua

SEQ ID NO: 3144117 - RNA, 23 nt, Human
aacugacacaugcugaacaucac

SEQ ID NO: 3144118 - RNA, 19 nt, Human
aacuuuugugaauuaggcu

SEQ ID NO: 3144119 - RNA, 13 nt, Human
aacuuuugugaau

SEQ ID NO: 3144120 - RNA, 13 nt, Human
aagaaauguaagg

SEQ ID NO: 3144121 - RNA, 14 nt, Human
aagaaauguaaggg

SEQ ID NO: 3144122 - RNA, 21 nt, Human
aacuuuuuuucuguaccaguu

SEQ ID NO: 3144123 - RNA, 22 nt, Human
aacuuuuuuucuguaccaguua

SEQ ID NO: 3144124 - RNA, 18 nt, Human
aaaucaaauaugcaaagc

SEQ ID NO: 3144125 - RNA, 19 nt, Human
aaaucaaauaugcaaagca

SEQ ID NO: 3144126 - RNA, 16 nt, Human
aaaucaaauaugcaaa

SEQ ID NO: 3144127 - RNA, 12 nt, Human
aaauaacaauga

SEQ ID NO: 3144128 - RNA, 17 nt, Human
aaacugacucuuaagaa

SEQ ID NO: 3144129 - RNA, 14 nt, Human
aaacugccagcaac

SEQ ID NO: 3144130 - RNA, 15 nt, Human
aaacugccagcaacg

SEQ ID NO: 3144131 - RNA, 16 nt, Human
aaacugacucuuaaga

SEQ ID NO: 3144132 - RNA, 14 nt, Human
aaacugaagccaga

SEQ ID NO: 3144133 - RNA, 19 nt, Human
aaacugccagcaacgcagg

SEQ ID NO: 3144134 - RNA, 16 nt, Human
aaagaaaguguauuug

SEQ ID NO: 3144135 - RNA, 13 nt, Human
aaagaaaguguau

SEQ ID NO: 3144136 - RNA, 12 nt, Human
aaagaaagugua

SEQ ID NO: 3144137 - RNA, 10 nt, Human
aaagaaagug

SEQ ID NO: 3144138 - RNA, 13 nt, Human
aaagaugaaaaua

SEQ ID NO: 3144139 - RNA, 16 nt, Human
aaagaugaaaauauuu

SEQ ID NO: 3144140 - RNA, 17 nt, Human
aaagaugaaaauauuug

SEQ ID NO: 3144141 - RNA, 12 nt, Human
aaaauucauuuu

SEQ ID NO: 3144142 - RNA, 14 nt, Human
aaaacaaggaugaa

SEQ ID NO: 3144143 - RNA, 18 nt, Human
aaaacacagcaaggguga

SEQ ID NO: 3144144 - RNA, 12 nt, Human
aaaacacagcaa

SEQ ID NO: 3144145 - RNA, 13 nt, Human
aaaacacagcaag

SEQ ID NO: 3144146 - RNA, 17 nt, Human
aaaacaaggaugaauua

SEQ ID NO: 3144147 - RNA, 22 nt, Human
caacccgucuggcccaccaggg

SEQ ID NO: 3144148 - RNA, 21 nt, Human
caacccgucuggcccaccagg

SEQ ID NO: 3144149 - RNA, 20 nt, Human
caacccgucuggcccaccag

SEQ ID NO: 3144150 - RNA, 22 nt, Human
caacugaggcagacagcagcuc

SEQ ID NO: 3144151 - RNA, 13 nt, Human
caacugaggcaga

SEQ ID NO: 3144152 - RNA, 14 nt, Human
caacugaggcagac

SEQ ID NO: 3144153 - RNA, 16 nt, Human
caacugaggcagacag

SEQ ID NO: 3144154 - RNA, 17 nt, Human
caacugaggcagacagc

SEQ ID NO: 3144155 - RNA, 20 nt, Human
caacugaggcagacagcagc

SEQ ID NO: 3144156 - RNA, 21 nt, Human
caacugaggcagacagcagcu

SEQ ID NO: 3144157 - RNA, 14 nt, Human
caaggcuuagaccc

SEQ ID NO: 3144158 - RNA, 15 nt, Human
caaggcuuagacccu

SEQ ID NO: 3144159 - RNA, 18 nt, Human
caaggaauuucuuaacuu

SEQ ID NO: 3144160 - RNA, 16 nt, Human
caaggaauuucuuaac

SEQ ID NO: 3144161 - RNA, 15 nt, Human
caaggaauuucuuaa

SEQ ID NO: 3144162 - RNA, 12 nt, Human
caaggaauuucu

SEQ ID NO: 3144163 - RNA, 23 nt, Human
caaggaauuucuuaacuucuugc

SEQ ID NO: 3144164 - RNA, 21 nt, Human
caaggaauuucuuaacuucuu

SEQ ID NO: 3144165 - RNA, 17 nt, Human
caaggcugauuaaacca

SEQ ID NO: 3144166 - RNA, 21 nt, Human
caagccagauuuuccugaaaa

SEQ ID NO: 3144167 - RNA, 22 nt, Human
caaugugacuuaaugccacuaa

SEQ ID NO: 3144168 - RNA, 23 nt, Human
caauacaucccuuaccugggaaa

SEQ ID NO: 3144169 - RNA, 15 nt, Human
caaaaacacagcaag

SEQ ID NO: 3144170 - RNA, 17 nt, Human
caaaaacacagcaaggg

SEQ ID NO: 3144171 - RNA, 13 nt, Human
caaaaacacagca

SEQ ID NO: 3144172 - RNA, 14 nt, Human
caaaaacacagcaa

SEQ ID NO: 3144173 - RNA, 13 nt, Human
auuuuccugaaaa

SEQ ID NO: 3144174 - RNA, 19 nt, Human
caaaaaucucaauauuuca

SEQ ID NO: 3144175 - RNA, 23 nt, Human
caaaacuucagacauagaauuaa

SEQ ID NO: 3144176 - RNA, 22 nt, Human
caaaauuuuuucucuaggaaau

SEQ ID NO: 3144177 - RNA, 21 nt, Human
caaaauuuuuucucuaggaaa

SEQ ID NO: 3144178 - RNA, 16 nt, Human
caaaauuuuuucucua

SEQ ID NO: 3144179 - RNA, 19 nt, Human
caaauaugcaaagcacuga

SEQ ID NO: 3144180 - RNA, 21 nt, Human
caaauaugcaaagcacugacu

SEQ ID NO: 3144181 - RNA, 16 nt, Human
cacaguuuucugagaa

SEQ ID NO: 3144182 - RNA, 17 nt, Human
cacaguuuucugagaaa

SEQ ID NO: 3144183 - RNA, 19 nt, Human
cacaguuuucugagaaaga

SEQ ID NO: 3144184 - RNA, 15 nt, Human
cacaguuuucugaga

SEQ ID NO: 3144185 - RNA, 16 nt, Human
uauuauucccauucua

SEQ ID NO: 3144186 - RNA, 22 nt, Human
uauuguuuuuccuuguauuuaa

SEQ ID NO: 3144187 - RNA, 17 nt, Human
uauguacuucaugcugu

SEQ ID NO: 3144188 - RNA, 13 nt, Human
uauguacuucaug

SEQ ID NO: 3144189 - RNA, 18 nt, Human
uauuaaucuuaguguaug

SEQ ID NO: 3144190 - RNA, 17 nt, Human
uauuaaucuuaguguau

SEQ ID NO: 3144191 - RNA, 14 nt, Human
uauuaaucuuagug

SEQ ID NO: 3144192 - RNA, 17 nt, Human
uauuuuuuguauaauug

SEQ ID NO: 3144193 - RNA, 16 nt, Human
uauuuuuuguauaauu

SEQ ID NO: 3144194 - RNA, 14 nt, Human
uauuuuuuguauaa

SEQ ID NO: 3144195 - RNA, 14 nt, Human
ucaaauugugugaa

SEQ ID NO: 3144196 - RNA, 14 nt, Human
ucaaauaugcaaag

SEQ ID NO: 3144197 - RNA, 20 nt, Human
ucaaaucaagaaacuuaagg

SEQ ID NO: 3144198 - RNA, 13 nt, Human
ucacaagacccaa

SEQ ID NO: 3144199 - RNA, 17 nt, Human
ucacaagacccaaaagg

SEQ ID NO: 3144200 - RNA, 16 nt, Human
ucacagucacauucca

SEQ ID NO: 3144201 - RNA, 14 nt, Human
ucaccaaggcugau

SEQ ID NO: 3144202 - RNA, 20 nt, Human
ucacagugcucuuuucuccu

SEQ ID NO: 3144203 - RNA, 18 nt, Human
ucacagugcucuuuucuc

SEQ ID NO: 3144204 - RNA, 17 nt, Human
ucacagugcucuuuucu

SEQ ID NO: 3144205 - RNA, 13 nt, Human
ucaaugcagcccc

SEQ ID NO: 3144206 - RNA, 21 nt, Human
ucaauaaaauccauacauuug

SEQ ID NO: 3144207 - RNA, 14 nt, Human
ucaauaaaauccau

SEQ ID NO: 3144208 - RNA, 23 nt, Human
ucaugcugccaauauccuaauaa

SEQ ID NO: 3144209 - RNA, 21 nt, Human
ucaugcugccaauauccuaau

SEQ ID NO: 3144210 - RNA, 13 nt, Human
ucauuaucucaaa

SEQ ID NO: 3144211 - RNA, 19 nt, Human
ucauuaucucaaaacugca

SEQ ID NO: 3144212 - RNA, 20 nt, Human
ucauuaucucaaaacugcac

SEQ ID NO: 3144213 - RNA, 13 nt, Human
ucauuuccaagca

SEQ ID NO: 3144214 - RNA, 16 nt, Human
ucauuuccaagcaagu

SEQ ID NO: 3144215 - RNA, 20 nt, Human
ucaugcugccaauauccuaa

SEQ ID NO: 3144216 - RNA, 19 nt, Human
ucaugcugccaauauccua

SEQ ID NO: 3144217 - RNA, 17 nt, Human
ucaugcugccaauaucc

SEQ ID NO: 3144218 - RNA, 13 nt, Human
ucaugcugccaau

SEQ ID NO: 3144219 - RNA, 18 nt, Human
ucauaccuaucaucuuaa

SEQ ID NO: 3144220 - RNA, 12 nt, Human
uccaccucccug

SEQ ID NO: 3144221 - RNA, 13 nt, Human
uccaccucccugc

SEQ ID NO: 3144222 - RNA, 14 nt, Human
uccaccucccugca

SEQ ID NO: 3144223 - RNA, 19 nt, Human
uccacagaagcuccaggua

SEQ ID NO: 3144224 - RNA, 15 nt, Human
uccaccucccugcaa

SEQ ID NO: 3144225 - RNA, 16 nt, Human
uccaccucccugcaau

SEQ ID NO: 3144226 - RNA, 17 nt, Human
uccaccucccugcaaua

SEQ ID NO: 3144227 - RNA, 16 nt, Human
uccacuuggucuguga

SEQ ID NO: 3144228 - RNA, 15 nt, Human
uccacuuggucugug

SEQ ID NO: 3144229 - RNA, 14 nt, Human
uccacuuggucugu

SEQ ID NO: 3144230 - RNA, 22 nt, Human
ucagagcugcccucuccugggc

SEQ ID NO: 3144231 - RNA, 18 nt, Human
ucagagcugcccucuccu

SEQ ID NO: 3144232 - RNA, 19 nt, Human
ucagagcugcccucuccug

SEQ ID NO: 3144233 - RNA, 20 nt, Human
ucagagcugcccucuccugg

SEQ ID NO: 3144234 - RNA, 21 nt, Human
ucagagcugcccucuccuggg

SEQ ID NO: 3144235 - RNA, 21 nt, Human
ucacugggguccuggggccuc

SEQ ID NO: 3144236 - RNA, 16 nt, Human
ucacugggguccuggg

SEQ ID NO: 3144237 - RNA, 17 nt, Human
ucacugggguccugggg

SEQ ID NO: 3144238 - RNA, 19 nt, Human
ucacugggguccuggggcc

SEQ ID NO: 3144239 - RNA, 20 nt, Human
ucacugggguccuggggccu

SEQ ID NO: 3144240 - RNA, 17 nt, Human
ucaggcuagauguaugu

SEQ ID NO: 3144241 - RNA, 13 nt, Human
ucaggcuagaugu

SEQ ID NO: 3144242 - RNA, 20 nt, Human
ucagcugcaagguacucugg

SEQ ID NO: 3144243 - RNA, 22 nt, Human
ucagcugcaagguacucuggug

SEQ ID NO: 3144244 - RNA, 21 nt, Human
ucagcugcaagguacucuggu

SEQ ID NO: 3144245 - RNA, 23 nt, Human
ucagggccccagcacuaaagcag

SEQ ID NO: 3144246 - RNA, 14 nt, Human
ucagggccccagca

SEQ ID NO: 3144247 - RNA, 16 nt, Human
ucagggccccagcacu

SEQ ID NO: 3144248 - RNA, 18 nt, Human
ucagcuccccucggagaa

SEQ ID NO: 3144249 - RNA, 17 nt, Human
ucagcuccccucggaga

SEQ ID NO: 3144250 - RNA, 16 nt, Human
ucugccagccagcagc

SEQ ID NO: 3144251 - RNA, 17 nt, Human
ucugccagccagcagcc

SEQ ID NO: 3144252 - RNA, 13 nt, Human
ucugccagccagc

SEQ ID NO: 3144253 - RNA, 15 nt, Human
ucugccagccagcag

SEQ ID NO: 3144254 - RNA, 19 nt, Human
ucugccagccagcagccag

SEQ ID NO: 3144255 - RNA, 20 nt, Human
ucuggugagucaccacuuca

SEQ ID NO: 3144256 - RNA, 17 nt, Human
ucuggugagucaccacu

SEQ ID NO: 3144257 - RNA, 18 nt, Human
ucuggccuucggccucca

SEQ ID NO: 3144258 - RNA, 17 nt, Human
ucuggccuucggccucc

SEQ ID NO: 3144259 - RNA, 10 nt, Human
ucuggccuuc

SEQ ID NO: 3144260 - RNA, 15 nt, Human
ucuggcucuaauuca

SEQ ID NO: 3144261 - RNA, 12 nt, Human
ucuggcucuaau

SEQ ID NO: 3144262 - RNA, 16 nt, Human
ucuggcucuaauucac

SEQ ID NO: 3144263 - RNA, 15 nt, Human
ucugucuucacaaca

SEQ ID NO: 3144264 - RNA, 18 nt, Human
ucuuaagaagacugcauu

SEQ ID NO: 3144265 - RNA, 12 nt, Human
ucuuaagaagac

SEQ ID NO: 3144266 - RNA, 23 nt, Human
ucuuaacuucuugcuucuuucua

SEQ ID NO: 3144267 - RNA, 16 nt, Human
ucuuaacuucuugcuu

SEQ ID NO: 3144268 - RNA, 12 nt, Human
ucuuaacuucuu

SEQ ID NO: 3144269 - RNA, 11 nt, Human
ucuucagccua

SEQ ID NO: 3144270 - RNA, 12 nt, Human
ucuucagccuag

SEQ ID NO: 3144271 - RNA, 23 nt, Human
ucuucagccuagccgaccucagc

SEQ ID NO: 3144272 - RNA, 21 nt, Human
ucuucagccuagccgaccuca

SEQ ID NO: 3144273 - RNA, 22 nt, Human
ucuucagccuagccgaccucag

SEQ ID NO: 3144274 - RNA, 19 nt, Human
ucugcaucagcugcugaaa

SEQ ID NO: 3144275 - RNA, 21 nt, Human
ucugcaucagcugcugaaaca

SEQ ID NO: 3144276 - RNA, 14 nt, Human
ucugcaucagcugc

SEQ ID NO: 3144277 - RNA, 19 nt, Human
ucucuaggaaauauuuauu

SEQ ID NO: 3144278 - RNA, 22 nt, Human
ucucuguaauaaacucauuucu

SEQ ID NO: 3144279 - RNA, 18 nt, Human
ucucuguaauaaacucau

SEQ ID NO: 3144280 - RNA, 23 nt, Human
ucucuggccuucggccuccaucc

SEQ ID NO: 3144281 - RNA, 13 nt, Human
ucguuaauuugua

SEQ ID NO: 3144282 - RNA, 23 nt, Human
ucuaacagcccuccucugcacuc

SEQ ID NO: 3144283 - RNA, 22 nt, Human
ucuaacagcccuccucugcacu

SEQ ID NO: 3144284 - RNA, 21 nt, Human
ucuaacagcccuccucugcac

SEQ ID NO: 3144285 - RNA, 20 nt, Human
ucuaacagcccuccucugca

SEQ ID NO: 3144286 - RNA, 13 nt, Human
ucuaacagcccuc

SEQ ID NO: 3144287 - RNA, 12 nt, Human
ucuaacagcccu

SEQ ID NO: 3144288 - RNA, 17 nt, Human
ucggccuccauccugag

SEQ ID NO: 3144289 - RNA, 18 nt, Human
ucggccuccauccugagg

SEQ ID NO: 3144290 - RNA, 22 nt, Human
ucgugggacagucaccucaugg

SEQ ID NO: 3144291 - RNA, 21 nt, Human
ucguggaacaguuaccucugc

SEQ ID NO: 3144292 - RNA, 19 nt, Human
ucuagaaagagaaacaguu

SEQ ID NO: 3144293 - RNA, 19 nt, Human
ucuagugagcagucaggaa

SEQ ID NO: 3144294 - RNA, 22 nt, Human
ucuagugagcagucaggaaaga

SEQ ID NO: 3144295 - RNA, 16 nt, Human
ucuaauucacagugcu

SEQ ID NO: 3144296 - RNA, 14 nt, Human
ucuaugaaauauua

SEQ ID NO: 3144297 - RNA, 13 nt, Human
ucuaugaaauauu

SEQ ID NO: 3144298 - RNA, 17 nt, Human
ucuaugaaauauuaugu

SEQ ID NO: 3144299 - RNA, 15 nt, Human
ucucaacuccaaacu

SEQ ID NO: 3144300 - RNA, 19 nt, Human
uccugucggagcccugucu

SEQ ID NO: 3144301 - RNA, 19 nt, Human
uccugccuauuaucuguca

SEQ ID NO: 3144302 - RNA, 20 nt, Human
uccugccuaagugcagcccc

SEQ ID NO: 3144303 - RNA, 17 nt, Human
uccuggcaauagucaaa

SEQ ID NO: 3144304 - RNA, 16 nt, Human
uccuuggacucauuuu

SEQ ID NO: 3144305 - RNA, 15 nt, Human
ucccuugaugaagaa

SEQ ID NO: 3144306 - RNA, 16 nt, Human
ucccuugaugaagaag

SEQ ID NO: 3144307 - RNA, 16 nt, Human
ucccugcaauaaaaug

SEQ ID NO: 3144308 - RNA, 20 nt, Human
uccagguucccucccagagg

SEQ ID NO: 3144309 - RNA, 18 nt, Human
uccagguucccucccaga

SEQ ID NO: 3144310 - RNA, 17 nt, Human
uccagguucccucccag

SEQ ID NO: 3144311 - RNA, 15 nt, Human
uccuaauacugucau

SEQ ID NO: 3144312 - RNA, 14 nt, Human
uccuaauacuguca

SEQ ID NO: 3144313 - RNA, 17 nt, Human
uccuaauaaaaagguga

SEQ ID NO: 3144314 - RNA, 16 nt, Human
uccuaauaaaaaggug

SEQ ID NO: 3144315 - RNA, 18 nt, Human
uccuaauaaaaaggugac

SEQ ID NO: 3144316 - RNA, 15 nt, Human
uccuaauaaaaaggu

SEQ ID NO: 3144317 - RNA, 14 nt, Human
uccuaauaaaaagg

SEQ ID NO: 3144318 - RNA, 13 nt, Human
uccuaauaaaaag

SEQ ID NO: 3144319 - RNA, 12 nt, Human
uccuaauaaaaa

SEQ ID NO: 3144320 - RNA, 21 nt, Human
uccucugcuugccaucccucc

SEQ ID NO: 3144321 - RNA, 22 nt, Human
uccucugcuugccaucccuccc

SEQ ID NO: 3144322 - RNA, 20 nt, Human
uccucugcuugccaucccuc

SEQ ID NO: 3144323 - RNA, 19 nt, Human
uccucugcuugccaucccu

SEQ ID NO: 3144324 - RNA, 16 nt, Human
ugcacugucaagauga

SEQ ID NO: 3144325 - RNA, 16 nt, Human
ugcacgcacacugucu

SEQ ID NO: 3144326 - RNA, 21 nt, Human
ugcauuauauuuauuacugua

SEQ ID NO: 3144327 - RNA, 13 nt, Human
ugcagauucauuu

SEQ ID NO: 3144328 - RNA, 17 nt, Human
ugcagauaaacaguagu

SEQ ID NO: 3144329 - RNA, 19 nt, Human
ugcagauaaacaguaguga

SEQ ID NO: 3144330 - RNA, 17 nt, Human
ugcaugguuuagaaagc

SEQ ID NO: 3144331 - RNA, 19 nt, Human
ugcccgucuucagccuagc

SEQ ID NO: 3144332 - RNA, 17 nt, Human
ugcccgucuucagccua

SEQ ID NO: 3144333 - RNA, 18 nt, Human
ugcccgucuucagccuag

SEQ ID NO: 3144334 - RNA, 13 nt, Human
ugcccgucuucag

SEQ ID NO: 3144335 - RNA, 16 nt, Human
ugcccgucuucagccu

SEQ ID NO: 3144336 - RNA, 24 nt, Human
ugauaguuguaccgcaaugugacu

SEQ ID NO: 3144337 - RNA, 12 nt, Human
ugacucuuaaga

SEQ ID NO: 3144338 - RNA, 20 nt, Human
ugagcagucaggaaagagaa

SEQ ID NO: 3144339 - RNA, 15 nt, Human
ugagcagucaggaaa

SEQ ID NO: 3144340 - RNA, 17 nt, Human
ugagcagucaggaaaga

SEQ ID NO: 3144341 - RNA, 16 nt, Human
ugagaugcuagaacuc

SEQ ID NO: 3144342 - RNA, 14 nt, Human
ugagaugcuagaac

SEQ ID NO: 3144343 - RNA, 12 nt, Human
ugagacagcucu

SEQ ID NO: 3144344 - RNA, 16 nt, Human
ugagacagcucugcau

SEQ ID NO: 3144345 - RNA, 14 nt, Human
ugagacagcucugc

SEQ ID NO: 3144346 - RNA, 16 nt, Human
ugagaaagacuauuca

SEQ ID NO: 3144347 - RNA, 17 nt, Human
ugagaaagacuauucaa

SEQ ID NO: 3144348 - RNA, 18 nt, Human
ugagaaagacuauucaaa

SEQ ID NO: 3144349 - RNA, 15 nt, Human
ugagaaagacuauuc

SEQ ID NO: 3144350 - RNA, 23 nt, Human
ugucauccucaaagaaaguguau

SEQ ID NO: 3144351 - RNA, 22 nt, Human
ugucauccucaaagaaagugua

SEQ ID NO: 3144352 - RNA, 21 nt, Human
ugucauccucaaagaaagugu

SEQ ID NO: 3144353 - RNA, 20 nt, Human
ugucauccucaaagaaagug

SEQ ID NO: 3144354 - RNA, 19 nt, Human
ugucauccucaaagaaagu

SEQ ID NO: 3144355 - RNA, 24 nt, Human
uguccugccuauuaucugucagcu

SEQ ID NO: 3144356 - RNA, 17 nt, Human
uguccugccuauuaucu

SEQ ID NO: 3144357 - RNA, 17 nt, Human
ugucuacacuaagagag

SEQ ID NO: 3144358 - RNA, 22 nt, Human
ugucuacacuaagagagaauga

SEQ ID NO: 3144359 - RNA, 16 nt, Human
ugucucaccuggacuu

SEQ ID NO: 3144360 - RNA, 19 nt, Human
uguauuuuaaaagaaugau

SEQ ID NO: 3144361 - RNA, 18 nt, Human
uguauuuuaaaagaauga

SEQ ID NO: 3144362 - RNA, 16 nt, Human
ugucauccucaaagaa

SEQ ID NO: 3144363 - RNA, 21 nt, Human
uguaguguuggagaagaacug

SEQ ID NO: 3144364 - RNA, 20 nt, Human
uguaguguuggagaagaacu

SEQ ID NO: 3144365 - RNA, 19 nt, Human
uguaguguuggagaagaac

SEQ ID NO: 3144366 - RNA, 14 nt, Human
uguauaaaauaauu

SEQ ID NO: 3144367 - RNA, 13 nt, Human
uguauaaaauaau

SEQ ID NO: 3144368 - RNA, 21 nt, Human
uguacagaauucugcuaccuc

SEQ ID NO: 3144369 - RNA, 18 nt, Human
uguacagaauucugcuac

SEQ ID NO: 3144370 - RNA, 11 nt, Human
uguaaaauggu

SEQ ID NO: 3144371 - RNA, 12 nt, Human
uguaaaauggug

SEQ ID NO: 3144372 - RNA, 22 nt, Human
uggugauuuagcaggaagcugu

SEQ ID NO: 3144373 - RNA, 14 nt, Human
uggguagacacaca

SEQ ID NO: 3144374 - RNA, 20 nt, Human
ugguucccuugaugaagaag

SEQ ID NO: 3144375 - RNA, 17 nt, Human
ugguucccuugaugaag

SEQ ID NO: 3144376 - RNA, 16 nt, Human
ugguucccuugaugaa

SEQ ID NO: 3144377 - RNA, 23 nt, Human
uggccuucggccuccauccugag

SEQ ID NO: 3144378 - RNA, 20 nt, Human
uggccuucggccuccauccu

SEQ ID NO: 3144379 - RNA, 22 nt, Human
uggccuucggccuccauccuga

SEQ ID NO: 3144380 - RNA, 21 nt, Human
uggcuugaguuuaaauuguaa

SEQ ID NO: 3144381 - RNA, 14 nt, Human
ugggacagggagga

SEQ ID NO: 3144382 - RNA, 23 nt, Human
ugggcagcugccuccccuccucu

SEQ ID NO: 3144383 - RNA, 20 nt, Human
ugggcagcugccuccccucc

SEQ ID NO: 3144384 - RNA, 22 nt, Human
ugggcagcugccuccccuccuc

SEQ ID NO: 3144385 - RNA, 19 nt, Human
ugggcagcugccuccccuc

SEQ ID NO: 3144386 - RNA, 17 nt, Human
ugcuucuguuuuauaau

SEQ ID NO: 3144387 - RNA, 22 nt, Human
ugcuucuguuuuauaauuuugu

SEQ ID NO: 3144388 - RNA, 12 nt, Human
uuuccaacuacu

SEQ ID NO: 3144389 - RNA, 17 nt, Human
uuucauuuaucuauaau

SEQ ID NO: 3144390 - RNA, 19 nt, Human
uuuccaacuacuaauagaa

SEQ ID NO: 3144391 - RNA, 18 nt, Human
uuuccaacuacuaauaga

SEQ ID NO: 3144392 - RNA, 14 nt, Human
uuucauuuaucuau

SEQ ID NO: 3144393 - RNA, 21 nt, Human
uuucagauaaucacaauacau

SEQ ID NO: 3144394 - RNA, 17 nt, Human
uuuauggcacuaguauu

SEQ ID NO: 3144395 - RNA, 22 nt, Human
uuuauaauuuugugaagcaaaa

SEQ ID NO: 3144396 - RNA, 22 nt, Human
uuuauuguuuaaaaucauuucu

SEQ ID NO: 3144397 - RNA, 19 nt, Human
uuuaacucuauaauguguu

SEQ ID NO: 3144398 - RNA, 13 nt, Human
uuuaauaauguuu

SEQ ID NO: 3144399 - RNA, 13 nt, Human
uuuaccacuugug

SEQ ID NO: 3144400 - RNA, 19 nt, Human
uuggucuuauuuauuauug

SEQ ID NO: 3144401 - RNA, 15 nt, Human
uuggucuuauuuauu

SEQ ID NO: 3144402 - RNA, 16 nt, Human
uuggucugugagaugc

SEQ ID NO: 3144403 - RNA, 15 nt, Human
uuggucugugagaug

SEQ ID NO: 3144404 - RNA, 14 nt, Human
uuguuuaaaaucau

SEQ ID NO: 3144405 - RNA, 20 nt, Human
uuguuucauugacuaucaaa

SEQ ID NO: 3144406 - RNA, 18 nt, Human
uuguguuuugcaagccag

SEQ ID NO: 3144407 - RNA, 12 nt, Human
uugugccccugc

SEQ ID NO: 3144408 - RNA, 18 nt, Human
uucggugagcuacaaaug

SEQ ID NO: 3144409 - RNA, 15 nt, Human
uuccuuguauuuaaa

SEQ ID NO: 3144410 - RNA, 18 nt, Human
uuccuuguauuuaaauau

SEQ ID NO: 3144411 - RNA, 15 nt, Human
uucuacauacuaugg

SEQ ID NO: 3144412 - RNA, 14 nt, Human
uucuaugaaauauu

SEQ ID NO: 3144413 - RNA, 23 nt, Human
uucucuccucuccccaugauguu

SEQ ID NO: 3144414 - RNA, 19 nt, Human
uucugauaaaagauggcca

SEQ ID NO: 3144415 - RNA, 18 nt, Human
uucugauaaaagauggcc

SEQ ID NO: 3144416 - RNA, 16 nt, Human
uucugagaaagacuau

SEQ ID NO: 3144417 - RNA, 21 nt, Human
uucugagaaagacuauucaaa

SEQ ID NO: 3144418 - RNA, 15 nt, Human
uucugcuaccucacu

SEQ ID NO: 3144419 - RNA, 16 nt, Human
uucugcuaccucacug

SEQ ID NO: 3144420 - RNA, 21 nt, Human
uucugcuaccucacugggguc

SEQ ID NO: 3144421 - RNA, 17 nt, Human
uugacccacaagaaaug

SEQ ID NO: 3144422 - RNA, 14 nt, Human
uugacccacaagaa

SEQ ID NO: 3144423 - RNA, 14 nt, Human
uugaugaagaaguu

SEQ ID NO: 3144424 - RNA, 13 nt, Human
uugaugaagaagu

SEQ ID NO: 3144425 - RNA, 23 nt, Human
uugaugaagaaguugauaugccu

SEQ ID NO: 3144426 - RNA, 17 nt, Human
uucugucuucacaacag

SEQ ID NO: 3144427 - RNA, 22 nt, Human
uucugugguuucauguuaguua

SEQ ID NO: 3144428 - RNA, 18 nt, Human
uucugugguuucauguua

SEQ ID NO: 3144429 - RNA, 21 nt, Human
uuauuaacgauguccaacccg

SEQ ID NO: 3144430 - RNA, 18 nt, Human
uuauggcuauaggugcua

SEQ ID NO: 3144431 - RNA, 11 nt, Human
uuaucucaaaa

SEQ ID NO: 3144432 - RNA, 22 nt, Human
uuaugauuaaguaaugauaacu

SEQ ID NO: 3144433 - RNA, 13 nt, Human
uuauauuugaaau

SEQ ID NO: 3144434 - RNA, 20 nt, Human
uuauauuuauuacuguaaga

SEQ ID NO: 3144435 - RNA, 12 nt, Human
uuauauuugaaa

SEQ ID NO: 3144436 - RNA, 16 nt, Human
uuauauuuacaaaugg

SEQ ID NO: 3144437 - RNA, 17 nt, Human
uuauaauuuugugaagc

SEQ ID NO: 3144438 - RNA, 16 nt, Human
uuauaauuuugugaag

SEQ ID NO: 3144439 - RNA, 18 nt, Human
uuauaauuuugugaagca

SEQ ID NO: 3144440 - RNA, 11 nt, Human
uuauaaucuuu

SEQ ID NO: 3144441 - RNA, 15 nt, Human
uuauaauuuugugaa

SEQ ID NO: 3144442 - RNA, 14 nt, Human
uuauaauuuuguga

SEQ ID NO: 3144443 - RNA, 12 nt, Human
uuauaauuuaaa

SEQ ID NO: 3144444 - RNA, 19 nt, Human
uuagugccacuuaauguau

SEQ ID NO: 3144445 - RNA, 18 nt, Human
uuagugccacuuaaugua

SEQ ID NO: 3144446 - RNA, 18 nt, Human
uuaguguaugauuacugg

SEQ ID NO: 3144447 - RNA, 14 nt, Human
uucagagcugcccu

SEQ ID NO: 3144448 - RNA, 15 nt, Human
uucagagcugcccuc

SEQ ID NO: 3144449 - RNA, 17 nt, Human
uucagagcugcccucuc

SEQ ID NO: 3144450 - RNA, 20 nt, Human
uucagauaaucacaauacau

SEQ ID NO: 3144451 - RNA, 20 nt, Human
uucagagcugcccucuccug

SEQ ID NO: 3144452 - RNA, 18 nt, Human
uucagagcugcccucucc

SEQ ID NO: 3144453 - RNA, 19 nt, Human
uucagagcugcccucuccu

SEQ ID NO: 3144454 - RNA, 19 nt, Human
uucacgccugaggcaauua

SEQ ID NO: 3144455 - RNA, 20 nt, Human
uuauuuuaauaauguuucaa

SEQ ID NO: 3144456 - RNA, 19 nt, Human
uuauuuuaauaauguuuca

SEQ ID NO: 3144457 - RNA, 17 nt, Human
uuauuuuaauaauguuu

SEQ ID NO: 3144458 - RNA, 15 nt, Human
uuauuugcagagaca

SEQ ID NO: 3144459 - RNA, 18 nt, Human
uuauuugcagagacagga

SEQ ID NO: 3144460 - RNA, 17 nt, Human
uucaaauccuugaagau

SEQ ID NO: 3144461 - RNA, 18 nt, Human
uuccagauccuggaaauc

SEQ ID NO: 3144462 - RNA, 23 nt, Human
uucaguuauuauauuuacaaaug

SEQ ID NO: 3144463 - RNA, 18 nt, Human
uuuuauauuugaaauauu

SEQ ID NO: 3144464 - RNA, 13 nt, Human
uuuuauauuugaa

SEQ ID NO: 3144465 - RNA, 21 nt, Human
uuuuauaauuuugugaagcaa

SEQ ID NO: 3144466 - RNA, 23 nt, Human
uuuuauaauuuugugaagcaaaa

SEQ ID NO: 3144467 - RNA, 21 nt, Human
uuuuaaaguaacccuacaaaa

SEQ ID NO: 3144468 - RNA, 13 nt, Human
uuuucuuauuuca

SEQ ID NO: 3144469 - RNA, 18 nt, Human
uuuguauaaaauaauuuu

SEQ ID NO: 3144470 - RNA, 16 nt, Human
uuuguauaaaauaauu

SEQ ID NO: 3144471 - RNA, 17 nt, Human
uuuguauaaaauaauuu

SEQ ID NO: 3144472 - RNA, 15 nt, Human
uuuccacagaagcuc

SEQ ID NO: 3144473 - RNA, 23 nt, Human
uuuuuccaacuacuaauagaaua

SEQ ID NO: 3144474 - RNA, 21 nt, Human
uuuuuccaacuacuaauagaa

SEQ ID NO: 3144475 - RNA, 23 nt, Human
uuuuuuaaaaaagaaacauuugg

SEQ ID NO: 3144476 - RNA, 22 nt, Human
cauuccaacuaucucauuucca

SEQ ID NO: 3144477 - RNA, 21 nt, Human
cauuacagugggugccccccu

SEQ ID NO: 3144478 - RNA, 13 nt, Human
cauucuggaauaa

SEQ ID NO: 3144479 - RNA, 21 nt, Human
cauuguaaaugugcuuuuaaa

SEQ ID NO: 3144480 - RNA, 20 nt, Human
caugugcuaguaauuggaaa

SEQ ID NO: 3144481 - RNA, 23 nt, Human
caugggacagggaggacgcucuc

SEQ ID NO: 3144482 - RNA, 15 nt, Human
cauggagcugggcua

SEQ ID NO: 3144483 - RNA, 20 nt, Human
cauggaauuggagcucgugg

SEQ ID NO: 3144484 - RNA, 20 nt, Human
caucccucccuccaccuccc

SEQ ID NO: 3144485 - RNA, 21 nt, Human
caucauuauuugcagagacag

SEQ ID NO: 3144486 - RNA, 22 nt, Human
caucccucccuccaccucccug

SEQ ID NO: 3144487 - RNA, 23 nt, Human
caucccucccuccaccucccugc

SEQ ID NO: 3144488 - RNA, 18 nt, Human
caucccuuaccugggaaa

SEQ ID NO: 3144489 - RNA, 13 nt, Human
cauccgaggcagg

SEQ ID NO: 3144490 - RNA, 14 nt, Human
cauccgaggcaggg

SEQ ID NO: 3144491 - RNA, 15 nt, Human
cauccgaggcagggu

SEQ ID NO: 3144492 - RNA, 23 nt, Human
cauccgaggcagggucaggagag

SEQ ID NO: 3144493 - RNA, 16 nt, Human
cauccgaggcaggguc

SEQ ID NO: 3144494 - RNA, 22 nt, Human
cauccgaggcagggucaggaga

SEQ ID NO: 3144495 - RNA, 23 nt, Human
cagugcucuuuucuccucacugu

SEQ ID NO: 3144496 - RNA, 14 nt, Human
cagugcucuuuucu

SEQ ID NO: 3144497 - RNA, 16 nt, Human
cauagguuuaauaauu

SEQ ID NO: 3144498 - RNA, 13 nt, Human
cauauauaacaau

SEQ ID NO: 3144499 - RNA, 15 nt, Human
cauauauaacaaugc

SEQ ID NO: 3144500 - RNA, 16 nt, Human
caugagguacugagag

SEQ ID NO: 3144501 - RNA, 19 nt, Human
caugagguacugagaguga

SEQ ID NO: 3144502 - RNA, 19 nt, Human
caugaagauguagaggaga

SEQ ID NO: 3144503 - RNA, 18 nt, Human
caugaagauguagaggag

SEQ ID NO: 3144504 - RNA, 16 nt, Human
ccaggcgcuaauucaa

SEQ ID NO: 3144505 - RNA, 14 nt, Human
ccaguuauggcuau

SEQ ID NO: 3144506 - RNA, 18 nt, Human
ccaguuaauuuuuccaac

SEQ ID NO: 3144507 - RNA, 16 nt, Human
ccaguuaauuuuucca

SEQ ID NO: 3144508 - RNA, 19 nt, Human
ccaguguuuuaggagcaug

SEQ ID NO: 3144509 - RNA, 19 nt, Human
ccaugggacagggaggacg

SEQ ID NO: 3144510 - RNA, 16 nt, Human
ccaugggacagggagg

SEQ ID NO: 3144511 - RNA, 17 nt, Human
ccaccugacacaccagg

SEQ ID NO: 3144512 - RNA, 16 nt, Human
ccaccugacacaccag

SEQ ID NO: 3144513 - RNA, 23 nt, Human
ccaccugacacaccaggcgcuaa

SEQ ID NO: 3144514 - RNA, 20 nt, Human
ccaccugacacaccaggcgc

SEQ ID NO: 3144515 - RNA, 22 nt, Human
ccagccagcaguucagagcugc

SEQ ID NO: 3144516 - RNA, 13 nt, Human
ccagccagcagcc

SEQ ID NO: 3144517 - RNA, 15 nt, Human
ccagccagcagccag

SEQ ID NO: 3144518 - RNA, 16 nt, Human
ccagccagcagccagc

SEQ ID NO: 3144519 - RNA, 19 nt, Human
ccagccagcagccagcucu

SEQ ID NO: 3144520 - RNA, 23 nt, Human
ccagccagcagccagcucucagc

SEQ ID NO: 3144521 - RNA, 23 nt, Human
ccagcaguucagagcugcccucu

SEQ ID NO: 3144522 - RNA, 13 nt, Human
ccagcaguucaga

SEQ ID NO: 3144523 - RNA, 18 nt, Human
ccagcaguucagagcugc

SEQ ID NO: 3144524 - RNA, 19 nt, Human
ccagcaguucagagcugcc

SEQ ID NO: 3144525 - RNA, 20 nt, Human
ccagcaguucagagcugccc

SEQ ID NO: 3144526 - RNA, 21 nt, Human
ccagcaguucagagcugcccu

SEQ ID NO: 3144527 - RNA, 22 nt, Human
ccagcaguucagagcugcccuc

SEQ ID NO: 3144528 - RNA, 24 nt, Human
ccagcacuaaagcaguggacacca

SEQ ID NO: 3144529 - RNA, 18 nt, Human
ccagcacuaaagcagugg

SEQ ID NO: 3144530 - RNA, 17 nt, Human
ccagcacuaaagcagug

SEQ ID NO: 3144531 - RNA, 17 nt, Human
ccagaggagccaccagu

SEQ ID NO: 3144532 - RNA, 16 nt, Human
ccagaggagccaccag

SEQ ID NO: 3144533 - RNA, 21 nt, Human
ccagaggagccaccaguucuc

SEQ ID NO: 3144534 - RNA, 19 nt, Human
ccagaggagccaccaguuc

SEQ ID NO: 3144535 - RNA, 11 nt, Human
ccugagcccca

SEQ ID NO: 3144536 - RNA, 17 nt, Human
ccugacacaccaggcgc

SEQ ID NO: 3144537 - RNA, 15 nt, Human
ccugacacaccaggc

SEQ ID NO: 3144538 - RNA, 14 nt, Human
ccugacacaccagg

SEQ ID NO: 3144539 - RNA, 18 nt, Human
ccugacacaccaggcgcu

SEQ ID NO: 3144540 - RNA, 16 nt, Human
ccugcaauaaaauggg

SEQ ID NO: 3144541 - RNA, 22 nt, Human
ccugggcagcugccuccccucc

SEQ ID NO: 3144542 - RNA, 19 nt, Human
ccugccuauuaucugucag

SEQ ID NO: 3144543 - RNA, 23 nt, Human
ccuggaaaucaggguuaguauug

SEQ ID NO: 3144544 - RNA, 18 nt, Human
cgagcaggcuacugucag

SEQ ID NO: 3144545 - RNA, 20 nt, Human
ccuguuaaaagaugaaaaua

SEQ ID NO: 3144546 - RNA, 21 nt, Human
ccuguuaaaagaugaaaauau

SEQ ID NO: 3144547 - RNA, 21 nt, Human
ccuuguauuuaaauauuaaau

SEQ ID NO: 3144548 - RNA, 19 nt, Human
ccuuggggcugaugcaguu

SEQ ID NO: 3144549 - RNA, 14 nt, Human
ccuugaugaagaag

SEQ ID NO: 3144550 - RNA, 20 nt, Human
ccuugaaaacuuuaugcuaa

SEQ ID NO: 3144551 - RNA, 13 nt, Human
ccuugaacacugg

SEQ ID NO: 3144552 - RNA, 20 nt, Human
ccuugaacacugggggaggg

SEQ ID NO: 3144553 - RNA, 20 nt, Human
ccuucggccuccauccugag

SEQ ID NO: 3144554 - RNA, 19 nt, Human
ccuucggccuccauccuga

SEQ ID NO: 3144555 - RNA, 14 nt, Human
ccuucggccuccau

SEQ ID NO: 3144556 - RNA, 18 nt, Human
ccuccucugcuugccauc

SEQ ID NO: 3144557 - RNA, 16 nt, Human
ccuccucugcuugcca

SEQ ID NO: 3144558 - RNA, 13 nt, Human
ccuccucugcuug

SEQ ID NO: 3144559 - RNA, 18 nt, Human
ccuccucuguccagggcc

SEQ ID NO: 3144560 - RNA, 15 nt, Human
ccuccucuguccagg

SEQ ID NO: 3144561 - RNA, 16 nt, Human
ccuccucuguccaggg

SEQ ID NO: 3144562 - RNA, 12 nt, Human
ccuccucugucc

SEQ ID NO: 3144563 - RNA, 17 nt, Human
ccucccuccaccucccu

SEQ ID NO: 3144564 - RNA, 20 nt, Human
ccucccuccaccucccugca

SEQ ID NO: 3144565 - RNA, 14 nt, Human
ccuccauccugagg

SEQ ID NO: 3144566 - RNA, 17 nt, Human
ccuccaccucccugcaa

SEQ ID NO: 3144567 - RNA, 22 nt, Human
ccuccaccucccugcaauaaaa

SEQ ID NO: 3144568 - RNA, 13 nt, Human
ccuccaccucccu

SEQ ID NO: 3144569 - RNA, 14 nt, Human
ccuccaccucccug

SEQ ID NO: 3144570 - RNA, 15 nt, Human
ccuccaccucccugc

SEQ ID NO: 3144571 - RNA, 14 nt, Human
ccucauccgaggca

SEQ ID NO: 3144572 - RNA, 15 nt, Human
ccucauccgaggcag

SEQ ID NO: 3144573 - RNA, 17 nt, Human
ccucauccgaggcaggg

SEQ ID NO: 3144574 - RNA, 20 nt, Human
ccucauccgaggcaggguca

SEQ ID NO: 3144575 - RNA, 20 nt, Human
ccgaggcagggucaggagag

SEQ ID NO: 3144576 - RNA, 14 nt, Human
ccgaggcaggguca

SEQ ID NO: 3144577 - RNA, 16 nt, Human
ccgggcguggugguga

SEQ ID NO: 3144578 - RNA, 13 nt, Human
ccuacaccauucc

SEQ ID NO: 3144579 - RNA, 15 nt, Human
cccgugggguuccuc

SEQ ID NO: 3144580 - RNA, 17 nt, Human
cccgucuggcccaccag

SEQ ID NO: 3144581 - RNA, 18 nt, Human
cccuacaccccuccccug

SEQ ID NO: 3144582 - RNA, 19 nt, Human
cccuccaccucccugcaau

SEQ ID NO: 3144583 - RNA, 15 nt, Human
cccuccaccucccug

SEQ ID NO: 3144584 - RNA, 17 nt, Human
cccuccaccucccugca

SEQ ID NO: 3144585 - RNA, 14 nt, Human
cccuccaccucccu

SEQ ID NO: 3144586 - RNA, 12 nt, Human
cccuccaccucc

SEQ ID NO: 3144587 - RNA, 14 nt, Human
cccucuccugggca

SEQ ID NO: 3144588 - RNA, 11 nt, Human
cccucuccugg

SEQ ID NO: 3144589 - RNA, 12 nt, Human
cccucuccuggg

SEQ ID NO: 3144590 - RNA, 13 nt, Human
cccucuccugggc

SEQ ID NO: 3144591 - RNA, 23 nt, Human
cccugguaauaaguacuguguac

SEQ ID NO: 3144592 - RNA, 13 nt, Human
cccaccagggucc

SEQ ID NO: 3144593 - RNA, 18 nt, Human
cccaccugacacaccagg

SEQ ID NO: 3144594 - RNA, 13 nt, Human
cccacaagaaaug

SEQ ID NO: 3144595 - RNA, 20 nt, Human
cccacaagaaaugaaagcag

SEQ ID NO: 3144596 - RNA, 15 nt, Human
cuguuaaaagaugaa

SEQ ID NO: 3144597 - RNA, 16 nt, Human
cuguuaaaagaugaaa

SEQ ID NO: 3144598 - RNA, 19 nt, Human
cuguuaaaagaugaaaaua

SEQ ID NO: 3144599 - RNA, 18 nt, Human
cugugguuucauguuagu

SEQ ID NO: 3144600 - RNA, 17 nt, Human
cugugguuucauguuag

SEQ ID NO: 3144601 - RNA, 16 nt, Human
cugugguuucauguua

SEQ ID NO: 3144602 - RNA, 15 nt, Human
cugugguuucauguu

SEQ ID NO: 3144603 - RNA, 18 nt, Human
cugucuucacaacagauu

SEQ ID NO: 3144604 - RNA, 14 nt, Human
cugucugccagcca

SEQ ID NO: 3144605 - RNA, 15 nt, Human
cugucugccagccag

SEQ ID NO: 3144606 - RNA, 16 nt, Human
cugucugccagccagc

SEQ ID NO: 3144607 - RNA, 17 nt, Human
cugucugccagccagca

SEQ ID NO: 3144608 - RNA, 20 nt, Human
cugucugccagccagcagcc

SEQ ID NO: 3144609 - RNA, 21 nt, Human
cugucugccagccagcagcca

SEQ ID NO: 3144610 - RNA, 23 nt, Human
cugggguggguggggcagugcuu

SEQ ID NO: 3144611 - RNA, 23 nt, Human
cuuaagaagacugcauuauauuu

SEQ ID NO: 3144612 - RNA, 21 nt, Human
cuuaagaagacugcauuauau

SEQ ID NO: 3144613 - RNA, 16 nt, Human
cuuaauuaaaagaaua

SEQ ID NO: 3144614 - RNA, 17 nt, Human
cuuaauuaaaagaauau

SEQ ID NO: 3144615 - RNA, 19 nt, Human
cuuaauuaaaagaauauuu

SEQ ID NO: 3144616 - RNA, 20 nt, Human
cuuaauuaaaagaauauuuu

SEQ ID NO: 3144617 - RNA, 18 nt, Human
cuuagacccucaugcugc

SEQ ID NO: 3144618 - RNA, 22 nt, Human
cuuagacccucaugcugccaau

SEQ ID NO: 3144619 - RNA, 21 nt, Human
cuuagacccucaugcugccaa

SEQ ID NO: 3144620 - RNA, 20 nt, Human
cuuagacccucaugcugcca

SEQ ID NO: 3144621 - RNA, 19 nt, Human
cuuagacccucaugcugcc

SEQ ID NO: 3144622 - RNA, 23 nt, Human
cuuagacccucaugcugccaaua

SEQ ID NO: 3144623 - RNA, 12 nt, Human
cuuagaccucag

SEQ ID NO: 3144624 - RNA, 13 nt, Human
cuuagaccucagc

SEQ ID NO: 3144625 - RNA, 14 nt, Human
cuuagaccucagcc

SEQ ID NO: 3144626 - RNA, 15 nt, Human
cuuagaccucagccu

SEQ ID NO: 3144627 - RNA, 16 nt, Human
cuuagaccucagccug

SEQ ID NO: 3144628 - RNA, 20 nt, Human
cuuagaccucagccugugcu

SEQ ID NO: 3144629 - RNA, 17 nt, Human
cuuagaccucagccugu

SEQ ID NO: 3144630 - RNA, 18 nt, Human
cuuagaccucagccugug

SEQ ID NO: 3144631 - RNA, 15 nt, Human
cuguuuuauaauuuu

SEQ ID NO: 3144632 - RNA, 14 nt, Human
cuguuuuauaauuu

SEQ ID NO: 3144633 - RNA, 15 nt, Human
cuucagccugaaaga

SEQ ID NO: 3144634 - RNA, 12 nt, Human
cuucacaacaga

SEQ ID NO: 3144635 - RNA, 14 nt, Human
cuucacaacagauu

SEQ ID NO: 3144636 - RNA, 16 nt, Human
cuucacacacaggcaa

SEQ ID NO: 3144637 - RNA, 17 nt, Human
cuucacacacaggcaac

SEQ ID NO: 3144638 - RNA, 17 nt, Human
cuucaaauccuugaaga

SEQ ID NO: 3144639 - RNA, 20 nt, Human
cuuccuuggacucauuuuaa

SEQ ID NO: 3144640 - RNA, 20 nt, Human
cuucggccuccauccugagg

SEQ ID NO: 3144641 - RNA, 19 nt, Human
cuucggccuccauccugag

SEQ ID NO: 3144642 - RNA, 20 nt, Human
gaauaauccuaaacauauga

SEQ ID NO: 3144643 - RNA, 14 nt, Human
gaauacuuuauaaa

SEQ ID NO: 3144644 - RNA, 17 nt, Human
gaauaaaggcaguuuuc

SEQ ID NO: 3144645 - RNA, 16 nt, Human
gaauaaaggcaguuuu

SEQ ID NO: 3144646 - RNA, 15 nt, Human
gaauaaaggcaguuu

SEQ ID NO: 3144647 - RNA, 20 nt, Human
gaauaaaggcaguuuucuaa

SEQ ID NO: 3144648 - RNA, 19 nt, Human
gaauaaaggcaguuuucua

SEQ ID NO: 3144649 - RNA, 21 nt, Human
gaagccuuggggcugaugcag

SEQ ID NO: 3144650 - RNA, 22 nt, Human
gaacuagaguuuagcuggaaaa

SEQ ID NO: 3144651 - RNA, 21 nt, Human
gaacuagaguuuagcuggaaa

SEQ ID NO: 3144652 - RNA, 18 nt, Human
gaacacugggggagggga

SEQ ID NO: 3144653 - RNA, 20 nt, Human
gaacacugggggaggggaca

SEQ ID NO: 3144654 - RNA, 21 nt, Human
gaacuuguaaaggaauuuaaa

SEQ ID NO: 3144655 - RNA, 21 nt, Human
gaagaagcaccaaucaugaau

SEQ ID NO: 3144656 - RNA, 14 nt, Human
gaacucccuuucaa

SEQ ID NO: 3144657 - RNA, 22 nt, Human
gaacuuccagauccuggaaauc

SEQ ID NO: 3144658 - RNA, 16 nt, Human
gaacacugggggaggg

SEQ ID NO: 3144659 - RNA, 17 nt, Human
gaacacugggggagggg

SEQ ID NO: 3144660 - RNA, 18 nt, Human
gaaauuguauuacaaauc

SEQ ID NO: 3144661 - RNA, 16 nt, Human
gaaauauuauguuaaa

SEQ ID NO: 3144662 - RNA, 13 nt, Human
gaaauauuauguu

SEQ ID NO: 3144663 - RNA, 23 nt, Human
gaaacaguugguaacuuuuguga

SEQ ID NO: 3144664 - RNA, 21 nt, Human
gaaacaguugguaacuuuugu

SEQ ID NO: 3144665 - RNA, 20 nt, Human
gaaacaguugguaacuuuug

SEQ ID NO: 3144666 - RNA, 19 nt, Human
gaaacaguugguaacuuuu

SEQ ID NO: 3144667 - RNA, 18 nt, Human
gaaacaguugguaacuuu

SEQ ID NO: 3144668 - RNA, 18 nt, Human
gaaauaaaguuggugaca

SEQ ID NO: 3144669 - RNA, 19 nt, Human
gaaauaaagucagauggaa

SEQ ID NO: 3144670 - RNA, 14 nt, Human
gaaauaaagucaga

SEQ ID NO: 3144671 - RNA, 13 nt, Human
cuuuccacagaag

SEQ ID NO: 3144672 - RNA, 18 nt, Human
cuuuauaacuaacauguc

SEQ ID NO: 3144673 - RNA, 18 nt, Human
cuuuaaagggauggcaag

SEQ ID NO: 3144674 - RNA, 22 nt, Human
cuugccaucccucccuccaccu

SEQ ID NO: 3144675 - RNA, 19 nt, Human
cuugccaucccucccucca

SEQ ID NO: 3144676 - RNA, 21 nt, Human
cuugccaucccucccuccacc

SEQ ID NO: 3144677 - RNA, 16 nt, Human
cuugccagacaugugg

SEQ ID NO: 3144678 - RNA, 18 nt, Human
cuuguaaaggaauuuaaa

SEQ ID NO: 3144679 - RNA, 19 nt, Human
cuuguaaaggaauuuaaaa

SEQ ID NO: 3144680 - RNA, 17 nt, Human
cuuuucuccucacugua

SEQ ID NO: 3144681 - RNA, 12 nt, Human
gaaaauaucacu

SEQ ID NO: 3144682 - RNA, 19 nt, Human
gaaaaucuuauaauuuaaa

SEQ ID NO: 3144683 - RNA, 19 nt, Human
gaaaauaacgauaaaagac

SEQ ID NO: 3144684 - RNA, 19 nt, Human
gaaaauaacaauaaaagac

SEQ ID NO: 3144685 - RNA, 20 nt, Human
gaaaaucuuauaauuuaaaa

SEQ ID NO: 3144686 - RNA, 17 nt, Human
cuuuugacacugcucua

SEQ ID NO: 3144687 - RNA, 12 nt, Human
cuuuugacacug

SEQ ID NO: 3144688 - RNA, 18 nt, Human
cuuuugacacugcucuaa

SEQ ID NO: 3144689 - RNA, 14 nt, Human
gaaaacaaggauga

SEQ ID NO: 3144690 - RNA, 22 nt, Human
gaaaacaauaacgauaaaagac

SEQ ID NO: 3144691 - RNA, 13 nt, Human
cucacauuuauau

SEQ ID NO: 3144692 - RNA, 20 nt, Human
cuauaggugcuacaaaaaca

SEQ ID NO: 3144693 - RNA, 21 nt, Human
cuauaggugcuacaaaaacac

SEQ ID NO: 3144694 - RNA, 22 nt, Human
cuauaggugcuacaaaaacaca

SEQ ID NO: 3144695 - RNA, 15 nt, Human
cuauaggugcuacaa

SEQ ID NO: 3144696 - RNA, 13 nt, Human
cuauaauuuaaau

SEQ ID NO: 3144697 - RNA, 22 nt, Human
cuauaauuuaccuaagauuaca

SEQ ID NO: 3144698 - RNA, 18 nt, Human
cuauucaaacagucucag

SEQ ID NO: 3144699 - RNA, 16 nt, Human
cuauucaaacagucuc

SEQ ID NO: 3144700 - RNA, 23 nt, Human
cuauucaaacagucucaggaaau

SEQ ID NO: 3144701 - RNA, 21 nt, Human
cuagugagcagucaggaaaga

SEQ ID NO: 3144702 - RNA, 18 nt, Human
cuagugaaagaggcagcu

SEQ ID NO: 3144703 - RNA, 19 nt, Human
cuagugaaagaggcagcuu

SEQ ID NO: 3144704 - RNA, 20 nt, Human
cuagugaaacucguuaauuu

SEQ ID NO: 3144705 - RNA, 16 nt, Human
cuaguaauuggaaagg

SEQ ID NO: 3144706 - RNA, 20 nt, Human
cuccccuccucugcuugcca

SEQ ID NO: 3144707 - RNA, 13 nt, Human
cuccauccugagg

SEQ ID NO: 3144708 - RNA, 11 nt, Human
cuccccuccuc

SEQ ID NO: 3144709 - RNA, 13 nt, Human
cuccccuccucug

SEQ ID NO: 3144710 - RNA, 23 nt, Human
cuccaccucccugcaauaaaaug

SEQ ID NO: 3144711 - RNA, 13 nt, Human
cuccaaagaaaug

SEQ ID NO: 3144712 - RNA, 12 nt, Human
cuccaaagaaau

SEQ ID NO: 3144713 - RNA, 21 nt, Human
cuccaaacugacucuuaagaa

SEQ ID NO: 3144714 - RNA, 14 nt, Human
cucauuucuagcag

SEQ ID NO: 3144715 - RNA, 21 nt, Human
cucauuuccaagcaaguauua

SEQ ID NO: 3144716 - RNA, 17 nt, Human
cuccaccuugcagcucu

SEQ ID NO: 3144717 - RNA, 11 nt, Human
cuccauccuga

SEQ ID NO: 3144718 - RNA, 12 nt, Human
cuccauccugag

SEQ ID NO: 3144719 - RNA, 17 nt, Human
cucauccgaggcagggu

SEQ ID NO: 3144720 - RNA, 14 nt, Human
cucauccgaggcag

SEQ ID NO: 3144721 - RNA, 15 nt, Human
cucauccgaggcagg

SEQ ID NO: 3144722 - RNA, 23 nt, Human
cugccuauuaucugucagcugca

SEQ ID NO: 3144723 - RNA, 17 nt, Human
cugccuauuaucuguca

SEQ ID NO: 3144724 - RNA, 20 nt, Human
cugcaucagcugcugaaaca

SEQ ID NO: 3144725 - RNA, 22 nt, Human
cugcaauaaaauggguuuuacu

SEQ ID NO: 3144726 - RNA, 15 nt, Human
cugcaauaaaauggg

SEQ ID NO: 3144727 - RNA, 21 nt, Human
cugaggcuccacuuggucugu

SEQ ID NO: 3144728 - RNA, 15 nt, Human
cugaggcuccacuug

SEQ ID NO: 3144729 - RNA, 22 nt, Human
cucuggccuucggccuccaucc

SEQ ID NO: 3144730 - RNA, 19 nt, Human
cucuggccuucggccucca

SEQ ID NO: 3144731 - RNA, 21 nt, Human
cucuggccuucggccuccauc

SEQ ID NO: 3144732 - RNA, 13 nt, Human
cucuuaagaagac

SEQ ID NO: 3144733 - RNA, 19 nt, Human
cucuuaagaagacugcauu

SEQ ID NO: 3144734 - RNA, 16 nt, Human
cugagcaggauuuuaa

SEQ ID NO: 3144735 - RNA, 16 nt, Human
cugagaugugaacaca

SEQ ID NO: 3144736 - RNA, 20 nt, Human
cugagaugugaacacaucag

SEQ ID NO: 3144737 - RNA, 19 nt, Human
cugagaaagacuauucaaa

SEQ ID NO: 3144738 - RNA, 20 nt, Human
cugagaaagacuauucaaac

SEQ ID NO: 3144739 - RNA, 21 nt, Human
cugagaugugaacacaucagc

SEQ ID NO: 3144740 - RNA, 23 nt, Human
cugacgacuugagugcucaguag

SEQ ID NO: 3144741 - RNA, 12 nt, Human
cugagaaagacu

SEQ ID NO: 3144742 - RNA, 13 nt, Human
cugagaaagacua

SEQ ID NO: 3144743 - RNA, 15 nt, Human
cugagaaagacuauu

SEQ ID NO: 3144744 - RNA, 18 nt, Human
cugagaaagacuauucaa

SEQ ID NO: 3144745 - RNA, 22 nt, Human
cugacuaaacuuuuuuucugua

SEQ ID NO: 3144746 - RNA, 19 nt, Human
cugacuaaacuuuuuuucu

SEQ ID NO: 3144747 - RNA, 15 nt, Human
cugacuaaacuuuuu

SEQ ID NO: 3144748 - RNA, 14 nt, Human
cugacuaaacuuuu

SEQ ID NO: 3144749 - RNA, 17 nt, Human
cugaacaucacagcuua

SEQ ID NO: 3144750 - RNA, 13 nt, Human
gauugugccccug

SEQ ID NO: 3144751 - RNA, 13 nt, Human
gaucuuuaaaaua

SEQ ID NO: 3144752 - RNA, 14 nt, Human
gaucuuuaaaauac

SEQ ID NO: 3144753 - RNA, 18 nt, Human
gaugcaguucugaagaag

SEQ ID NO: 3144754 - RNA, 16 nt, Human
gaugggaaagcauugu

SEQ ID NO: 3144755 - RNA, 22 nt, Human
gaugcuagaacucccuuucaac

SEQ ID NO: 3144756 - RNA, 16 nt, Human
gaguaauuuauuguuu

SEQ ID NO: 3144757 - RNA, 13 nt, Human
gauagcagggcau

SEQ ID NO: 3144758 - RNA, 21 nt, Human
gaguugaaaaucuuauaauuu

SEQ ID NO: 3144759 - RNA, 17 nt, Human
gaguuacaguucugugg

SEQ ID NO: 3144760 - RNA, 19 nt, Human
gagugaacaaauuuacaga

SEQ ID NO: 3144761 - RNA, 22 nt, Human
gagugaacaaauuuacagagac

SEQ ID NO: 3144762 - RNA, 19 nt, Human
gagugucuuaauuaaaaga

SEQ ID NO: 3144763 - RNA, 14 nt, Human
gagcuacaaaugca

SEQ ID NO: 3144764 - RNA, 15 nt, Human
gagcugcccucuccu

SEQ ID NO: 3144765 - RNA, 16 nt, Human
gagcugcccucuccug

SEQ ID NO: 3144766 - RNA, 14 nt, Human
gagcugcccucucc

SEQ ID NO: 3144767 - RNA, 13 nt, Human
gagcuacaaaugc

SEQ ID NO: 3144768 - RNA, 12 nt, Human
gagcuacaaaug

SEQ ID NO: 3144769 - RNA, 13 nt, Human
gagcacacuguag

SEQ ID NO: 3144770 - RNA, 15 nt, Human
gagcacacuguagca

SEQ ID NO: 3144771 - RNA, 13 nt, Human
gagccaccaguuc

SEQ ID NO: 3144772 - RNA, 14 nt, Human
gagccaccaguucu

SEQ ID NO: 3144773 - RNA, 21 nt, Human
gagcaggcuacugucagcucc

SEQ ID NO: 3144774 - RNA, 19 nt, Human
gaggcagagguugcaguga

SEQ ID NO: 3144775 - RNA, 16 nt, Human
gaggcagacagcagcu

SEQ ID NO: 3144776 - RNA, 12 nt, Human
gaggcagacagc

SEQ ID NO: 3144777 - RNA, 15 nt, Human
gaggcagacagcagc

SEQ ID NO: 3144778 - RNA, 21 nt, Human
gaggcaauuagacacuuugga

SEQ ID NO: 3144779 - RNA, 16 nt, Human
gaggagccaccaguuc

SEQ ID NO: 3144780 - RNA, 18 nt, Human
gaggagccaccaguucuc

SEQ ID NO: 3144781 - RNA, 19 nt, Human
gccagacuggcacaguuuu

SEQ ID NO: 3144782 - RNA, 15 nt, Human
gccagacuggcacag

SEQ ID NO: 3144783 - RNA, 18 nt, Human
gccagacuggcacaguuu

SEQ ID NO: 3144784 - RNA, 23 nt, Human
gccaauauccuaauaaaaaggug

SEQ ID NO: 3144785 - RNA, 22 nt, Human
gccaauauccuaauaaaaaggu

SEQ ID NO: 3144786 - RNA, 20 nt, Human
gccaauauccuaauaaaaag

SEQ ID NO: 3144787 - RNA, 19 nt, Human
gccaauauccuaauaaaaa

SEQ ID NO: 3144788 - RNA, 18 nt, Human
gccaauauccuaauaaaa

SEQ ID NO: 3144789 - RNA, 13 nt, Human
gccaauauccuaa

SEQ ID NO: 3144790 - RNA, 17 nt, Human
gccaauauccuaauaaa

SEQ ID NO: 3144791 - RNA, 16 nt, Human
gccaauauccuaauaa

SEQ ID NO: 3144792 - RNA, 15 nt, Human
gccaauauccuaaua

SEQ ID NO: 3144793 - RNA, 14 nt, Human
gccaauauccuaau

SEQ ID NO: 3144794 - RNA, 23 nt, Human
gccaugggacagggaggacgcuc

SEQ ID NO: 3144795 - RNA, 22 nt, Human
gccaugggacagggaggacgcu

SEQ ID NO: 3144796 - RNA, 20 nt, Human
gcccaaguucaugcagcugu

SEQ ID NO: 3144797 - RNA, 19 nt, Human
gcccaaguucaugcagcug

SEQ ID NO: 3144798 - RNA, 14 nt, Human
gcagggucaggaga

SEQ ID NO: 3144799 - RNA, 15 nt, Human
gcagggucaggagag

SEQ ID NO: 3144800 - RNA, 16 nt, Human
gcagggucaggagagg

SEQ ID NO: 3144801 - RNA, 17 nt, Human
gcagggucaggagaggg

SEQ ID NO: 3144802 - RNA, 19 nt, Human
gcaguucagagcugcccuc

SEQ ID NO: 3144803 - RNA, 20 nt, Human
gcaguucagagcugcccucu

SEQ ID NO: 3144804 - RNA, 22 nt, Human
gcaguucagagcugcccucucc

SEQ ID NO: 3144805 - RNA, 23 nt, Human
gcaguucagagcugcccucuccu

SEQ ID NO: 3144806 - RNA, 21 nt, Human
gcaguugaaaagacuccaaag

SEQ ID NO: 3144807 - RNA, 16 nt, Human
gcaguugaaaagacuc

SEQ ID NO: 3144808 - RNA, 19 nt, Human
gcaguugaaaagacuccaa

SEQ ID NO: 3144809 - RNA, 15 nt, Human
gcaguugaaaagacu

SEQ ID NO: 3144810 - RNA, 12 nt, Human
gcaucagcugcu

SEQ ID NO: 3144811 - RNA, 23 nt, Human
gcaucagcugcugaaacaacaaa

SEQ ID NO: 3144812 - RNA, 22 nt, Human
gcaucagcugcugaaacaacaa

SEQ ID NO: 3144813 - RNA, 20 nt, Human
gcaucuagcaugucgucaaa

SEQ ID NO: 3144814 - RNA, 22 nt, Human
gcaucauuauuugcagagacag

SEQ ID NO: 3144815 - RNA, 16 nt, Human
gcaggaagcugugaga

SEQ ID NO: 3144816 - RNA, 18 nt, Human
gcagagguugcagugagc

SEQ ID NO: 3144817 - RNA, 23 nt, Human
gcagagguugcagugagccgaga

SEQ ID NO: 3144818 - RNA, 15 nt, Human
gcacagccucuuaga

SEQ ID NO: 3144819 - RNA, 11 nt, Human
gcacagcccuu

SEQ ID NO: 3144820 - RNA, 20 nt, Human
gcacuaaagcaguggacacc

SEQ ID NO: 3144821 - RNA, 14 nt, Human
gcacuaaagcagug

SEQ ID NO: 3144822 - RNA, 15 nt, Human
gcacgcacacugucu

SEQ ID NO: 3144823 - RNA, 16 nt, Human
gcacgcacacugucug

SEQ ID NO: 3144824 - RNA, 19 nt, Human
gcacuguggguagacacac

SEQ ID NO: 3144825 - RNA, 23 nt, Human
gcuggucccagccagcaguucag

SEQ ID NO: 3144826 - RNA, 18 nt, Human
gcuugcccuguuaaaaga

SEQ ID NO: 3144827 - RNA, 17 nt, Human
gcuuagaccucagccug

SEQ ID NO: 3144828 - RNA, 13 nt, Human
gcuuagaccucag

SEQ ID NO: 3144829 - RNA, 14 nt, Human
gcuuagaccucagc

SEQ ID NO: 3144830 - RNA, 15 nt, Human
gcuuagaccucagcc

SEQ ID NO: 3144831 - RNA, 16 nt, Human
gcuuagaccucagccu

SEQ ID NO: 3144832 - RNA, 21 nt, Human
gcuuagacccucaugcugcca

SEQ ID NO: 3144833 - RNA, 16 nt, Human
gcuuagacccucaugc

SEQ ID NO: 3144834 - RNA, 19 nt, Human
gcuucuguuuuauaauuuu

SEQ ID NO: 3144835 - RNA, 21 nt, Human
gcugauuaaaccaaggcuaga

SEQ ID NO: 3144836 - RNA, 12 nt, Human
gcugcccucucc

SEQ ID NO: 3144837 - RNA, 20 nt, Human
gcugacuaaacuuuuuuucu

SEQ ID NO: 3144838 - RNA, 21 nt, Human
gcuggaaaaguauguuagugc

SEQ ID NO: 3144839 - RNA, 23 nt, Human
gcuggaaaaguauguuagugcaa

SEQ ID NO: 3144840 - RNA, 23 nt, Human
gcugcccucuccugggcagcugc

SEQ ID NO: 3144841 - RNA, 13 nt, Human
gcugcccucuccu

SEQ ID NO: 3144842 - RNA, 14 nt, Human
gcugcccucuccug

SEQ ID NO: 3144843 - RNA, 15 nt, Human
gcugcccucuccugg

SEQ ID NO: 3144844 - RNA, 16 nt, Human
gcugcccucuccuggg

SEQ ID NO: 3144845 - RNA, 17 nt, Human
gcugcccucuccugggc

SEQ ID NO: 3144846 - RNA, 18 nt, Human
gcugcccucuccugggca

SEQ ID NO: 3144847 - RNA, 20 nt, Human
gcugcccucuccugggcagc

SEQ ID NO: 3144848 - RNA, 22 nt, Human
gcugcccucuccugggcagcug

SEQ ID NO: 3144849 - RNA, 18 nt, Human
gccuuggggcugaugcag

SEQ ID NO: 3144850 - RNA, 16 nt, Human
gccuuccccuugccca

SEQ ID NO: 3144851 - RNA, 18 nt, Human
gccuuccccuugcccagg

SEQ ID NO: 3144852 - RNA, 20 nt, Human
gccugagcgacagugagacu

SEQ ID NO: 3144853 - RNA, 17 nt, Human
gccugagcgacagugag

SEQ ID NO: 3144854 - RNA, 14 nt, Human
gcuccugucugcca

SEQ ID NO: 3144855 - RNA, 16 nt, Human
gcuccugucugccagc

SEQ ID NO: 3144856 - RNA, 17 nt, Human
gcuccugucugccagcc

SEQ ID NO: 3144857 - RNA, 18 nt, Human
gcuccugucugccagcca

SEQ ID NO: 3144858 - RNA, 19 nt, Human
gcuccugucugccagccag

SEQ ID NO: 3144859 - RNA, 20 nt, Human
gcuccugucugccagccagc

SEQ ID NO: 3144860 - RNA, 21 nt, Human
gcuccugucugccagccagca

SEQ ID NO: 3144861 - RNA, 20 nt, Human
gcuccauuuuuagugaaaua

SEQ ID NO: 3144862 - RNA, 21 nt, Human
gcuauaggugcuacaaaaaca

SEQ ID NO: 3144863 - RNA, 19 nt, Human
gcuauaggugcuacaaaaa

SEQ ID NO: 3144864 - RNA, 13 nt, Human
gcuagauguaugu

SEQ ID NO: 3144865 - RNA, 14 nt, Human
gcuagauguaugua

SEQ ID NO: 3144866 - RNA, 19 nt, Human
ggccuccucuguccagggc

SEQ ID NO: 3144867 - RNA, 18 nt, Human
ggccuccucuguccaggg

SEQ ID NO: 3144868 - RNA, 20 nt, Human
ggcuaguaucaaaagaaaga

SEQ ID NO: 3144869 - RNA, 23 nt, Human
ggcuauaggugcuacaaaaacac

SEQ ID NO: 3144870 - RNA, 16 nt, Human
ggcuccacuuggucug

SEQ ID NO: 3144871 - RNA, 20 nt, Human
gggaggacgcucucuggccu

SEQ ID NO: 3144872 - RNA, 17 nt, Human
gggaggacgcucucugg

SEQ ID NO: 3144873 - RNA, 21 nt, Human
gggacugaggggaggggagca

SEQ ID NO: 3144874 - RNA, 18 nt, Human
ggcuuagacccucaugcu

SEQ ID NO: 3144875 - RNA, 20 nt, Human
ggcuuagacccucaugcugc

SEQ ID NO: 3144876 - RNA, 23 nt, Human
ggcuuagacccucaugcugccaa

SEQ ID NO: 3144877 - RNA, 22 nt, Human
ggcuuagacccucaugcugcca

SEQ ID NO: 3144878 - RNA, 16 nt, Human
ggaggacgcucucugg

SEQ ID NO: 3144879 - RNA, 19 nt, Human
ggaggggagcaugggaagu

SEQ ID NO: 3144880 - RNA, 21 nt, Human
ggagccucauccgaggcaggg

SEQ ID NO: 3144881 - RNA, 19 nt, Human
ggagccucauccgaggcag

SEQ ID NO: 3144882 - RNA, 20 nt, Human
ggagccucauccgaggcagg

SEQ ID NO: 3144883 - RNA, 18 nt, Human
ggagcccugucuccucuc

SEQ ID NO: 3144884 - RNA, 20 nt, Human
ggacauuugcucauggaauu

SEQ ID NO: 3144885 - RNA, 17 nt, Human
ggacauuugcucaugga

SEQ ID NO: 3144886 - RNA, 16 nt, Human
ggacauuugcucaugg

SEQ ID NO: 3144887 - RNA, 23 nt, Human
ggagaagagcuguucacagccag

SEQ ID NO: 3144888 - RNA, 14 nt, Human
ggagaagaacugaa

SEQ ID NO: 3144889 - RNA, 11 nt, Human
ggagaagaacu

SEQ ID NO: 3144890 - RNA, 15 nt, Human
ggagaagagcuguuc

SEQ ID NO: 3144891 - RNA, 19 nt, Human
ggacgcucucuggccuucg

SEQ ID NO: 3144892 - RNA, 16 nt, Human
ggacgcucucuggccu

SEQ ID NO: 3144893 - RNA, 15 nt, Human
ggacgcucucuggcc

SEQ ID NO: 3144894 - RNA, 15 nt, Human
ggcccaccagggucc

SEQ ID NO: 3144895 - RNA, 14 nt, Human
ggcccaccaggguc

SEQ ID NO: 3144896 - RNA, 18 nt, Human
ggcagaguuacaguucug

SEQ ID NO: 3144897 - RNA, 13 nt, Human
ggcagaguuacag

SEQ ID NO: 3144898 - RNA, 19 nt, Human
ggcagaguuacaguucugu

SEQ ID NO: 3144899 - RNA, 12 nt, Human
ggcagcugccuc

SEQ ID NO: 3144900 - RNA, 13 nt, Human
ggcagcugccucc

SEQ ID NO: 3144901 - RNA, 11 nt, Human
ggcagcugccu

SEQ ID NO: 3144902 - RNA, 15 nt, Human
ggcagggucaggaga

SEQ ID NO: 3144903 - RNA, 17 nt, Human
ggcagggucaggagagg

SEQ ID NO: 3144904 - RNA, 16 nt, Human
ggcagugcuuggccca

SEQ ID NO: 3144905 - RNA, 23 nt, Human
ggcagugcuuggcccaggaguuu

SEQ ID NO: 3144906 - RNA, 22 nt, Human
ggcagugcuuggcccaggaguu

SEQ ID NO: 3144907 - RNA, 21 nt, Human
ggcagugcuuggcccaggagu

SEQ ID NO: 3144908 - RNA, 20 nt, Human
ggcagugcuuggcccaggag

SEQ ID NO: 3144909 - RNA, 19 nt, Human
ggcagugcuuggcccagga

SEQ ID NO: 3144910 - RNA, 18 nt, Human
ggcagugcuuggcccagg

SEQ ID NO: 3144911 - RNA, 17 nt, Human
ggcagugcuuggcccag

SEQ ID NO: 3144912 - RNA, 19 nt, Human
ggauugaaggaugcugucu

SEQ ID NO: 3144913 - RNA, 21 nt, Human
ggcagagguugcagugagccg

SEQ ID NO: 3144914 - RNA, 17 nt, Human
ggauuagggagagaaga

SEQ ID NO: 3144915 - RNA, 22 nt, Human
cacguucuuacuaguuucccuu

SEQ ID NO: 3144916 - RNA, 13 nt, Human
cacuaaacaaaga

SEQ ID NO: 3144917 - RNA, 15 nt, Human
cacgcacacugucug

SEQ ID NO: 3144918 - RNA, 19 nt, Human
cacgagcaggcuacuguca

SEQ ID NO: 3144919 - RNA, 20 nt, Human
cacgagcaggcuacugucag

SEQ ID NO: 3144920 - RNA, 17 nt, Human
cacgagcaggcuacugu

SEQ ID NO: 3144921 - RNA, 22 nt, Human
cacgagcaggcuacugucagcu

SEQ ID NO: 3144922 - RNA, 18 nt, Human
cacucagucucucuucuc

SEQ ID NO: 3144923 - RNA, 21 nt, Human
cacuaaauugacacuuaaaaa

SEQ ID NO: 3144924 - RNA, 13 nt, Human
cacuaaagcagug

SEQ ID NO: 3144925 - RNA, 17 nt, Human
cacuaagagagaaugag

SEQ ID NO: 3144926 - RNA, 19 nt, Human
cacuaguauuucuaugaaa

SEQ ID NO: 3144927 - RNA, 14 nt, Human
cacuaguauuucua

SEQ ID NO: 3144928 - RNA, 16 nt, Human
cacucaaaucaagaaa

SEQ ID NO: 3144929 - RNA, 19 nt, Human
cacuucagggcuuuacucc

SEQ ID NO: 3144930 - RNA, 18 nt, Human
cacuucacacacaggcaa

SEQ ID NO: 3144931 - RNA, 15 nt, Human
cacuuggucugugag

SEQ ID NO: 3144932 - RNA, 12 nt, Human
cacuuggagcca

SEQ ID NO: 3144933 - RNA, 23 nt, Human
cacuugaacccgggaggcagagg

SEQ ID NO: 3144934 - RNA, 21 nt, Human
cacuugaacccgggaggcaga

SEQ ID NO: 3144935 - RNA, 20 nt, Human
cacuugaacccgggaggcag

SEQ ID NO: 3144936 - RNA, 23 nt, Human
cacuucuucuuggucuuauuuau

SEQ ID NO: 3144937 - RNA, 14 nt, Human
cacugucaagauga

SEQ ID NO: 3144938 - RNA, 21 nt, Human
cacuguagcauuacagugggu

SEQ ID NO: 3144939 - RNA, 14 nt, Human
cacuguauccaggu

SEQ ID NO: 3144940 - RNA, 19 nt, Human
cacuguggguagacacaca

SEQ ID NO: 3144941 - RNA, 24 nt, Human
cacuguggguagacacacaugaag

SEQ ID NO: 3144942 - RNA, 22 nt, Human
cacuguggguagacacacauga

SEQ ID NO: 3144943 - RNA, 20 nt, Human
cacugccuucucaacuccaa

SEQ ID NO: 3144944 - RNA, 18 nt, Human
cacugcucuaacagcccu

SEQ ID NO: 3144945 - RNA, 15 nt, Human
cacugcucuaacagc

SEQ ID NO: 3144946 - RNA, 19 nt, Human
cacugcucuaacagcccuc

SEQ ID NO: 3144947 - RNA, 21 nt, Human
cacugacuucuaaguaaaacc

SEQ ID NO: 3144948 - RNA, 14 nt, Human
cacugacuucuaag

SEQ ID NO: 3144949 - RNA, 15 nt, Human
cacugacuucuaagu

SEQ ID NO: 3144950 - RNA, 16 nt, Human
cacugacuucuaagua

SEQ ID NO: 3144951 - RNA, 20 nt, Human
cacugacuucuaaguaaaac

SEQ ID NO: 3144952 - RNA, 14 nt, Human
caccucccugcaau

SEQ ID NO: 3144953 - RNA, 13 nt, Human
caccucccugcaa

SEQ ID NO: 3144954 - RNA, 14 nt, Human
caccucauggaauu

SEQ ID NO: 3144955 - RNA, 12 nt, Human
caccucauggaa

SEQ ID NO: 3144956 - RNA, 11 nt, Human
caccucaugga

SEQ ID NO: 3144957 - RNA, 10 nt, Human
caccucccug

SEQ ID NO: 3144958 - RNA, 17 nt, Human
caccugacacaccaggc

SEQ ID NO: 3144959 - RNA, 16 nt, Human
caccugacacaccagg

SEQ ID NO: 3144960 - RNA, 20 nt, Human
caccugacacaccaggcgcu

SEQ ID NO: 3144961 - RNA, 15 nt, Human
caccccuccccugcc

SEQ ID NO: 3144962 - RNA, 22 nt, Human
caccccuccccugcccuagagc

SEQ ID NO: 3144963 - RNA, 20 nt, Human
cacccucagaugcacaugag

SEQ ID NO: 3144964 - RNA, 21 nt, Human
cagacuagauguaguauuuuu

SEQ ID NO: 3144965 - RNA, 20 nt, Human
cagacuagauguaguauuuu

SEQ ID NO: 3144966 - RNA, 19 nt, Human
cagacuagauguaguauuu

SEQ ID NO: 3144967 - RNA, 15 nt, Human
cagacuagauguagu

SEQ ID NO: 3144968 - RNA, 14 nt, Human
cagacuagauguag

SEQ ID NO: 3144969 - RNA, 21 nt, Human
cagaauucugcuaccucacug

SEQ ID NO: 3144970 - RNA, 23 nt, Human
cagaauucugcuaccucacuggg

SEQ ID NO: 3144971 - RNA, 13 nt, Human
cagaauucugcua

SEQ ID NO: 3144972 - RNA, 14 nt, Human
cagaauucugcuac

SEQ ID NO: 3144973 - RNA, 19 nt, Human
cagacauagaauuaacaca

SEQ ID NO: 3144974 - RNA, 17 nt, Human
cagacauagaauuaaca

SEQ ID NO: 3144975 - RNA, 22 nt, Human
cagacauguggugggacaggga

SEQ ID NO: 3144976 - RNA, 18 nt, Human
cagacauguggugggaca

SEQ ID NO: 3144977 - RNA, 23 nt, Human
cagaaucgcuccaccuugcagcu

SEQ ID NO: 3144978 - RNA, 21 nt, Human
cagaaucgcuccaccuugcag

SEQ ID NO: 3144979 - RNA, 17 nt, Human
cagaagucaaggcuuag

SEQ ID NO: 3144980 - RNA, 16 nt, Human
cagaagucaaggcuua

SEQ ID NO: 3144981 - RNA, 18 nt, Human
cagaagucaaggcuuaga

SEQ ID NO: 3144982 - RNA, 14 nt, Human
cagaagucaucuug

SEQ ID NO: 3144983 - RNA, 22 nt, Human
cagaagucaucuugcuaccagu

SEQ ID NO: 3144984 - RNA, 20 nt, Human
cagaagucaucuugcuacca

SEQ ID NO: 3144985 - RNA, 17 nt, Human
cagaagucaucuugcua

SEQ ID NO: 3144986 - RNA, 16 nt, Human
cagaagucaucuugcu

SEQ ID NO: 3144987 - RNA, 20 nt, Human
cagaagcaacccaaauguuc

SEQ ID NO: 3144988 - RNA, 19 nt, Human
cagaagcaacccaaauguu

SEQ ID NO: 3144989 - RNA, 23 nt, Human
cagaacagugauuaccagggacu

SEQ ID NO: 3144990 - RNA, 18 nt, Human
cagaacagugauuaccag

SEQ ID NO: 3144991 - RNA, 19 nt, Human
cagaaagcagaacagugau

SEQ ID NO: 3144992 - RNA, 18 nt, Human
cagaaagcagaacaguga

SEQ ID NO: 3144993 - RNA, 20 nt, Human
cagaggagccaccaguucuc

SEQ ID NO: 3144994 - RNA, 19 nt, Human
cagaggagccaccaguucu

SEQ ID NO: 3144995 - RNA, 18 nt, Human
cagaggagccaccaguuc

SEQ ID NO: 3144996 - RNA, 20 nt, Human
cagagccccacccucagaug

SEQ ID NO: 3144997 - RNA, 20 nt, Human
cagagacucagggccccagc

SEQ ID NO: 3144998 - RNA, 21 nt, Human
cagagacucagggccccagca

SEQ ID NO: 3144999 - RNA, 22 nt, Human
cagagacucagggccccagcac

SEQ ID NO: 3145000 - RNA, 23 nt, Human
cagagacucagggccccagcacu

SEQ ID NO: 3145001 - RNA, 19 nt, Human
cagagacucagggccccag

SEQ ID NO: 3145002 - RNA, 14 nt, Human
cagauccuggaaau

SEQ ID NO: 3145003 - RNA, 13 nt, Human
cagauccuggaaa

SEQ ID NO: 3145004 - RNA, 17 nt, Human
cagaugcacaugagcug

SEQ ID NO: 3145005 - RNA, 14 nt, Human
cagauaaucacaau

SEQ ID NO: 3145006 - RNA, 14 nt, Human
cagauaaacaguag

SEQ ID NO: 3145007 - RNA, 23 nt, Human
cagauaaauaguuuaugauucca

SEQ ID NO: 3145008 - RNA, 13 nt, Human
cagaguuacaguu

SEQ ID NO: 3145009 - RNA, 12 nt, Human
cagaguuacagu

SEQ ID NO: 3145010 - RNA, 17 nt, Human
cagaguuacaguucugu

SEQ ID NO: 3145011 - RNA, 16 nt, Human
cagaguuacaguucug

SEQ ID NO: 3145012 - RNA, 15 nt, Human
cagaguuacaguucu

SEQ ID NO: 3145013 - RNA, 14 nt, Human
cagaguuacaguuc

SEQ ID NO: 3145014 - RNA, 19 nt, Human
cagaguuacaguucugugg

SEQ ID NO: 3145015 - RNA, 18 nt, Human
cagaguuacaguucugug

SEQ ID NO: 3145016 - RNA, 21 nt, Human
cagccaacgaguaauuuauug

SEQ ID NO: 3145017 - RNA, 12 nt, Human
cagcagcucagg

SEQ ID NO: 3145018 - RNA, 13 nt, Human
cagcagcucaggc

SEQ ID NO: 3145019 - RNA, 14 nt, Human
cagcagcucaggca

SEQ ID NO: 3145020 - RNA, 15 nt, Human
cagcagcucaggcac

SEQ ID NO: 3145021 - RNA, 16 nt, Human
cagcagcucaggcaca

SEQ ID NO: 3145022 - RNA, 20 nt, Human
cagcagccagcucucagcca

SEQ ID NO: 3145023 - RNA, 21 nt, Human
cagcagccagcucucagccaa

SEQ ID NO: 3145024 - RNA, 13 nt, Human
cagcagccagcuc

SEQ ID NO: 3145025 - RNA, 14 nt, Human
cagcagccagcucu

SEQ ID NO: 3145026 - RNA, 15 nt, Human
cagcagccagcucuc

SEQ ID NO: 3145027 - RNA, 17 nt, Human
cagcagccagcucucag

SEQ ID NO: 3145028 - RNA, 18 nt, Human
cagcagccagcucucagc

SEQ ID NO: 3145029 - RNA, 19 nt, Human
cagcagccagcucucagcc

SEQ ID NO: 3145030 - RNA, 22 nt, Human
cagcaagggugaugggaaagca

SEQ ID NO: 3145031 - RNA, 23 nt, Human
cagcaagggugaugggaaagcau

SEQ ID NO: 3145032 - RNA, 19 nt, Human
cagcaagggugaugggaaa

SEQ ID NO: 3145033 - RNA, 23 nt, Human
cagauuuuguuggcauagcucug

SEQ ID NO: 3145034 - RNA, 15 nt, Human
cagauuuuccugaaa

SEQ ID NO: 3145035 - RNA, 14 nt, Human
cagauuuuccugaa

SEQ ID NO: 3145036 - RNA, 23 nt, Human
cagcaacgcaggcccccaggugc

SEQ ID NO: 3145037 - RNA, 15 nt, Human
cagauucauuuuucu

SEQ ID NO: 3145038 - RNA, 21 nt, Human
cagauggaaaauucauuuuuu

SEQ ID NO: 3145039 - RNA, 19 nt, Human
cagauggaaaauucauuuu

SEQ ID NO: 3145040 - RNA, 22 nt, Human
caggaagcugugagagcaguuu

SEQ ID NO: 3145041 - RNA, 13 nt, Human
caggaagcuguga

SEQ ID NO: 3145042 - RNA, 14 nt, Human
caggaagcugugag

SEQ ID NO: 3145043 - RNA, 13 nt, Human
caggaccugacua

SEQ ID NO: 3145044 - RNA, 15 nt, Human
caggaaguagaggag

SEQ ID NO: 3145045 - RNA, 16 nt, Human
caggaaguagaggagg

SEQ ID NO: 3145046 - RNA, 18 nt, Human
cagcuugaaacugagaug

SEQ ID NO: 3145047 - RNA, 23 nt, Human
cagcuuuccucaaaacuucagac

SEQ ID NO: 3145048 - RNA, 18 nt, Human
caggaaccacaagacugc

SEQ ID NO: 3145049 - RNA, 18 nt, Human
cagcuguaugauucccag

SEQ ID NO: 3145050 - RNA, 20 nt, Human
cagcugcugaaacaacaaau

SEQ ID NO: 3145051 - RNA, 21 nt, Human
cagcugcugaaacaacaaaua

SEQ ID NO: 3145052 - RNA, 18 nt, Human
cagcugacuaaacuuuuu

SEQ ID NO: 3145053 - RNA, 13 nt, Human
cagcugacuaaac

SEQ ID NO: 3145054 - RNA, 23 nt, Human
cagcucaggcacacuucuucuug

SEQ ID NO: 3145055 - RNA, 12 nt, Human
cagcucaggcac

SEQ ID NO: 3145056 - RNA, 21 nt, Human
cagcucaggcacacuucuucu

SEQ ID NO: 3145057 - RNA, 20 nt, Human
cagcucugcauacucauuag

SEQ ID NO: 3145058 - RNA, 16 nt, Human
cagcucuccccuucuc

SEQ ID NO: 3145059 - RNA, 12 nt, Human
cagcucucagcc

SEQ ID NO: 3145060 - RNA, 13 nt, Human
cagcucucagcca

SEQ ID NO: 3145061 - RNA, 23 nt, Human
cagccuggugggccuccucuguc

SEQ ID NO: 3145062 - RNA, 16 nt, Human
cagccugugcugcccg

SEQ ID NO: 3145063 - RNA, 14 nt, Human
cagccugugcugcc

SEQ ID NO: 3145064 - RNA, 15 nt, Human
cagccuggugggccu

SEQ ID NO: 3145065 - RNA, 16 nt, Human
cagccuggugggccuc

SEQ ID NO: 3145066 - RNA, 17 nt, Human
cagccuggugggccucc

SEQ ID NO: 3145067 - RNA, 18 nt, Human
cagccuggugggccuccu

SEQ ID NO: 3145068 - RNA, 16 nt, Human
cagccuuccccuugcc

SEQ ID NO: 3145069 - RNA, 21 nt, Human
cagccuuccccuugcccaggg

SEQ ID NO: 3145070 - RNA, 23 nt, Human
cagccuuccccuugcccagggcu

SEQ ID NO: 3145071 - RNA, 19 nt, Human
cagcuacuugggaggcuga

SEQ ID NO: 3145072 - RNA, 16 nt, Human
cagccuaguugaucag

SEQ ID NO: 3145073 - RNA, 18 nt, Human
cagcccuccucugcacuc

SEQ ID NO: 3145074 - RNA, 17 nt, Human
cagcccuccucugcacu

SEQ ID NO: 3145075 - RNA, 19 nt, Human
cagccuagccgaccucagc

SEQ ID NO: 3145076 - RNA, 20 nt, Human
cagccuagccgaccucagcc

SEQ ID NO: 3145077 - RNA, 21 nt, Human
cagccuagccgaccucagccu

SEQ ID NO: 3145078 - RNA, 22 nt, Human
cagccuagccgaccucagccuu

SEQ ID NO: 3145079 - RNA, 17 nt, Human
cagccuagccgaccuca

SEQ ID NO: 3145080 - RNA, 18 nt, Human
cagccuagccgaccucag

SEQ ID NO: 3145081 - RNA, 15 nt, Human
cagccuagccgaccu

SEQ ID NO: 3145082 - RNA, 13 nt, Human
cagcccucagaau

SEQ ID NO: 3145083 - RNA, 16 nt, Human
caggauuuuaaucuuu

SEQ ID NO: 3145084 - RNA, 15 nt, Human
caggcaacugaggca

SEQ ID NO: 3145085 - RNA, 16 nt, Human
caggcaacugaggcag

SEQ ID NO: 3145086 - RNA, 17 nt, Human
caggcaacugaggcaga

SEQ ID NO: 3145087 - RNA, 18 nt, Human
caggcaacugaggcagac

SEQ ID NO: 3145088 - RNA, 19 nt, Human
caggcaacugaggcagaca

SEQ ID NO: 3145089 - RNA, 20 nt, Human
caggcaacugaggcagacag

SEQ ID NO: 3145090 - RNA, 22 nt, Human
caggcaacugaggcagacagca

SEQ ID NO: 3145091 - RNA, 23 nt, Human
caggaugguucccuugaugaaga

SEQ ID NO: 3145092 - RNA, 21 nt, Human
caggaugguucccuugaugaa

SEQ ID NO: 3145093 - RNA, 20 nt, Human
caggcccccaggugccaguu

SEQ ID NO: 3145094 - RNA, 14 nt, Human
caggcccccaggug

SEQ ID NO: 3145095 - RNA, 19 nt, Human
caggcccccaggugccagu

SEQ ID NO: 3145096 - RNA, 13 nt, Human
caggagucccugg

SEQ ID NO: 3145097 - RNA, 14 nt, Human
caggagucccuggu

SEQ ID NO: 3145098 - RNA, 15 nt, Human
caggagucccuggua

SEQ ID NO: 3145099 - RNA, 15 nt, Human
caggagaggggcaga

SEQ ID NO: 3145100 - RNA, 17 nt, Human
caggagaggggcagaac

SEQ ID NO: 3145101 - RNA, 14 nt, Human
caggaguuuggcca

SEQ ID NO: 3145102 - RNA, 13 nt, Human
caggaguuuggcc

SEQ ID NO: 3145103 - RNA, 17 nt, Human
caggaguuuggccagaa

SEQ ID NO: 3145104 - RNA, 16 nt, Human
caggaguuuggccaga

SEQ ID NO: 3145105 - RNA, 15 nt, Human
caggaguuuggccag

SEQ ID NO: 3145106 - RNA, 16 nt, Human
caggggacaggauggu

SEQ ID NO: 3145107 - RNA, 11 nt, Human
caggggacagg

SEQ ID NO: 3145108 - RNA, 18 nt, Human
cagggacaggauaagagg

SEQ ID NO: 3145109 - RNA, 22 nt, Human
cagggacccacuucacacacag

SEQ ID NO: 3145110 - RNA, 17 nt, Human
cagggcauggcugggaa

SEQ ID NO: 3145111 - RNA, 15 nt, Human
cagggcccugagcuc

SEQ ID NO: 3145112 - RNA, 21 nt, Human
cagggcccugagcucggugga

SEQ ID NO: 3145113 - RNA, 16 nt, Human
cagggccccagcacua

SEQ ID NO: 3145114 - RNA, 22 nt, Human
cagggccccagcacuaaagcag

SEQ ID NO: 3145115 - RNA, 14 nt, Human
cagggccccagcac

SEQ ID NO: 3145116 - RNA, 15 nt, Human
cagggccccagcacu

SEQ ID NO: 3145117 - RNA, 19 nt, Human
caggcuagauguauguacu

SEQ ID NO: 3145118 - RNA, 13 nt, Human
caggcuagaugua

SEQ ID NO: 3145119 - RNA, 14 nt, Human
caggcuacugucag

SEQ ID NO: 3145120 - RNA, 20 nt, Human
cagugaaagaaaauaacaau

SEQ ID NO: 3145121 - RNA, 16 nt, Human
cagugaaagaaaauaa

SEQ ID NO: 3145122 - RNA, 15 nt, Human
cagugagacagcucu

SEQ ID NO: 3145123 - RNA, 17 nt, Human
cagugauuaccagggac

SEQ ID NO: 3145124 - RNA, 18 nt, Human
cagugauuaccagggacu

SEQ ID NO: 3145125 - RNA, 18 nt, Human
cagucaggaaagagaacu

SEQ ID NO: 3145126 - RNA, 15 nt, Human
cagucaggaaagaga

SEQ ID NO: 3145127 - RNA, 22 nt, Human
cagucaggaaagagaacuucca

SEQ ID NO: 3145128 - RNA, 13 nt, Human
caguccaugaaga

SEQ ID NO: 3145129 - RNA, 12 nt, Human
caguagugauag

SEQ ID NO: 3145130 - RNA, 12 nt, Human
caguauggcagc

SEQ ID NO: 3145131 - RNA, 17 nt, Human
caguaccccauggagcu

SEQ ID NO: 3145132 - RNA, 23 nt, Human
caguaccccauggagcugggcua

SEQ ID NO: 3145133 - RNA, 23 nt, Human
cagguucccucccagaggagcca

SEQ ID NO: 3145134 - RNA, 18 nt, Human
cagguucccucccagagg

SEQ ID NO: 3145135 - RNA, 16 nt, Human
cagguucccucccaga

SEQ ID NO: 3145136 - RNA, 15 nt, Human
cagguucccucccag

SEQ ID NO: 3145137 - RNA, 21 nt, Human
caggguccuuuugacacugcu

SEQ ID NO: 3145138 - RNA, 19 nt, Human
caggguccuuuugacacug

SEQ ID NO: 3145139 - RNA, 14 nt, Human
caggguccuuuuga

SEQ ID NO: 3145140 - RNA, 23 nt, Human
caggguccuuuugacacugcucu

SEQ ID NO: 3145141 - RNA, 22 nt, Human
caggguccuuuugacacugcuc

SEQ ID NO: 3145142 - RNA, 14 nt, Human
cagggucaggagag

SEQ ID NO: 3145143 - RNA, 14 nt, Human
caaauaugcaaagc

SEQ ID NO: 3145144 - RNA, 22 nt, Human
caaaucagaagucaucuugcua

SEQ ID NO: 3145145 - RNA, 15 nt, Human
caaaucagaagucau

SEQ ID NO: 3145146 - RNA, 14 nt, Human
caaaucagaaguca

SEQ ID NO: 3145147 - RNA, 16 nt, Human
caaauaugcaaagcac

SEQ ID NO: 3145148 - RNA, 17 nt, Human
caaauaugcaaagcacu

SEQ ID NO: 3145149 - RNA, 18 nt, Human
caaauaugcaaagcacug

SEQ ID NO: 3145150 - RNA, 20 nt, Human
caaauguucaucaaugaaug

SEQ ID NO: 3145151 - RNA, 21 nt, Human
caaauguucaucaaugaauga

SEQ ID NO: 3145152 - RNA, 13 nt, Human
caaagaaagugua

SEQ ID NO: 3145153 - RNA, 15 nt, Human
caaauuuacagagac

SEQ ID NO: 3145154 - RNA, 14 nt, Human
caaauuuacagaga

SEQ ID NO: 3145155 - RNA, 15 nt, Human
caaauugugugaaag

SEQ ID NO: 3145156 - RNA, 17 nt, Human
caagcacuaaacaaaga

SEQ ID NO: 3145157 - RNA, 20 nt, Human
caaggaaaaaauaacaauga

SEQ ID NO: 3145158 - RNA, 14 nt, Human
cacaguuuucugag

SEQ ID NO: 3145159 - RNA, 20 nt, Human
cacaggaaccacaagacugc

SEQ ID NO: 3145160 - RNA, 15 nt, Human
cacaggaaguagagg

SEQ ID NO: 3145161 - RNA, 19 nt, Human
cacaggaaccacaagacug

SEQ ID NO: 3145162 - RNA, 22 nt, Human
cacaggcaacugaggcagacag

SEQ ID NO: 3145163 - RNA, 23 nt, Human
cacaggcaacugaggcagacagc

SEQ ID NO: 3145164 - RNA, 20 nt, Human
cacaggcaacugaggcagac

SEQ ID NO: 3145165 - RNA, 22 nt, Human
cacagcaguugaaaagacucca

SEQ ID NO: 3145166 - RNA, 19 nt, Human
cacacucaaaucaagaaac

SEQ ID NO: 3145167 - RNA, 14 nt, Human
cacacugaagaagc

SEQ ID NO: 3145168 - RNA, 23 nt, Human
cacacuguagcauuacagugggu

SEQ ID NO: 3145169 - RNA, 13 nt, Human
cacaacuauauug

SEQ ID NO: 3145170 - RNA, 13 nt, Human
cacacacaggcaa

SEQ ID NO: 3145171 - RNA, 21 nt, Human
cacacacaggcaacugaggca

SEQ ID NO: 3145172 - RNA, 11 nt, Human
cacaacagauu

SEQ ID NO: 3145173 - RNA, 22 nt, Human
caaugaaugaaugaauggcuaa

SEQ ID NO: 3145174 - RNA, 21 nt, Human
caauaucuuuuuuuuaauaaa

SEQ ID NO: 3145175 - RNA, 23 nt, Human
aauguuucaaacauauauaacaa

SEQ ID NO: 3145176 - RNA, 20 nt, Human
aauauaucuaccccagacua

SEQ ID NO: 3145177 - RNA, 16 nt, Human
aauagaauaaaggcag

SEQ ID NO: 3145178 - RNA, 15 nt, Human
aauagaauaaaggca

SEQ ID NO: 3145179 - RNA, 15 nt, Human
aaucaagaaacuuaa

SEQ ID NO: 3145180 - RNA, 21 nt, Human
aaugauuaugaauuacauuug

SEQ ID NO: 3145181 - RNA, 15 nt, Human
aaugauuaugaauua

SEQ ID NO: 3145182 - RNA, 23 nt, Human
aagggaaacugccagcaacgcag

SEQ ID NO: 3145183 - RNA, 16 nt, Human
aagggaaacugccagc

SEQ ID NO: 3145184 - RNA, 17 nt, Human
aagggaaacugccagca

SEQ ID NO: 3145185 - RNA, 21 nt, Human
aaguagggacuucugucuuca

SEQ ID NO: 3145186 - RNA, 17 nt, Human
aaguccaagcauaccaa

SEQ ID NO: 3145187 - RNA, 18 nt, Human
aaguccaagcauuuagau

SEQ ID NO: 3145188 - RNA, 20 nt, Human
aaggcagcucuaaaugucaa

SEQ ID NO: 3145189 - RNA, 20 nt, Human
aagauuacaaaucagaaguc

SEQ ID NO: 3145190 - RNA, 21 nt, Human
aagauuacaaaucagaaguca

SEQ ID NO: 3145191 - RNA, 22 nt, Human
aaccacuggaaaguuuaugguu

SEQ ID NO: 3145192 - RNA, 16 nt, Human
aacccgggaggcagag

SEQ ID NO: 3145193 - RNA, 15 nt, Human
aacccgucuggccca

SEQ ID NO: 3145194 - RNA, 17 nt, Human
aaaucuuauaauuuaaa

SEQ ID NO: 3145195 - RNA, 22 nt, Human
aaauguuguucucuucuuuaaa

SEQ ID NO: 3145196 - RNA, 19 nt, Human
aaauugacacuuaaaaaug

SEQ ID NO: 3145197 - RNA, 18 nt, Human
aacaaauuuacagagaca

SEQ ID NO: 3145198 - RNA, 12 nt, Human
aacacaucagcu

SEQ ID NO: 3145199 - RNA, 16 nt, Human
aacacaucagcuugcc

SEQ ID NO: 3145200 - RNA, 12 nt, Human
aacugaggcaga

SEQ ID NO: 3145201 - RNA, 20 nt, Human
aacugaggcagacagcagcu

SEQ ID NO: 3145202 - RNA, 20 nt, Human
aacugacucuuaagaagacu

SEQ ID NO: 3145203 - RNA, 19 nt, Human
aacugacucuuaagaagac

SEQ ID NO: 3145204 - RNA, 20 nt, Human
aacugagaugugaacacauc

SEQ ID NO: 3145205 - RNA, 18 nt, Human
aacugacucuuaagaaga

SEQ ID NO: 3145206 - RNA, 15 nt, Human
aacugacucuuaaga

SEQ ID NO: 3145207 - RNA, 20 nt, Human
aacuuuaugcuaagugaaau

SEQ ID NO: 3145208 - RNA, 21 nt, Human
aacuuuaugcuaagugaaaua

SEQ ID NO: 3145209 - RNA, 14 nt, Human
aaaggcagaagcaa

SEQ ID NO: 3145210 - RNA, 18 nt, Human
aaauaaaguuggugacag

SEQ ID NO: 3145211 - RNA, 15 nt, Human
aaaucaaauaugcaa

SEQ ID NO: 3145212 - RNA, 12 nt, Human
aaaucaaauaug

SEQ ID NO: 3145213 - RNA, 14 nt, Human
aaaucaaauaugca

SEQ ID NO: 3145214 - RNA, 15 nt, Human
aaauauuuauuuuaa

SEQ ID NO: 3145215 - RNA, 13 nt, Human
aaauauuuauuuu

SEQ ID NO: 3145216 - RNA, 20 nt, Human
aaauauuuauuuuaauaaug

SEQ ID NO: 3145217 - RNA, 15 nt, Human
aaagaaauguaaggg

SEQ ID NO: 3145218 - RNA, 21 nt, Human
aaacugagaugugaacacauc

SEQ ID NO: 3145219 - RNA, 23 nt, Human
aaacugagaugugaacacaucag

SEQ ID NO: 3145220 - RNA, 21 nt, Human
aaaaucuacacuccagugaga

SEQ ID NO: 3145221 - RNA, 18 nt, Human
aaaaguucugcagauaaa

SEQ ID NO: 3145222 - RNA, 16 nt, Human
aaaaagaaacauuugg

SEQ ID NO: 3145223 - RNA, 16 nt, Human
aaaaucucaauauuuc

SEQ ID NO: 3145224 - RNA, 18 nt, Human
accugucucaccuggacu

SEQ ID NO: 3145225 - RNA, 19 nt, Human
acgcaggcccccaggugcc

SEQ ID NO: 3145226 - RNA, 22 nt, Human
acgcaggcccccaggugccagu

SEQ ID NO: 3145227 - RNA, 13 nt, Human
acuaagagagaau

SEQ ID NO: 3145228 - RNA, 21 nt, Human
acuauucaaacagucucagga

SEQ ID NO: 3145229 - RNA, 18 nt, Human
acuauucaaacagucuca

SEQ ID NO: 3145230 - RNA, 19 nt, Human
acuaguauuucuaugaaau

SEQ ID NO: 3145231 - RNA, 20 nt, Human
acuaguauuucuaugaaaua

SEQ ID NO: 3145232 - RNA, 14 nt, Human
acucaaaucaagaa

SEQ ID NO: 3145233 - RNA, 18 nt, Human
acucagggccccagcacu

SEQ ID NO: 3145234 - RNA, 22 nt, Human
acucagggccccagcacuaaag

SEQ ID NO: 3145235 - RNA, 15 nt, Human
acucagggccccagc

SEQ ID NO: 3145236 - RNA, 13 nt, Human
acuagauguagua

SEQ ID NO: 3145237 - RNA, 12 nt, Human
acuagauguagu

SEQ ID NO: 3145238 - RNA, 17 nt, Human
acuagauguaguauuuu

SEQ ID NO: 3145239 - RNA, 16 nt, Human
acuagauguaguauuu

SEQ ID NO: 3145240 - RNA, 17 nt, Human
acucuauguucuaagaa

SEQ ID NO: 3145241 - RNA, 20 nt, Human
acucuggugagucaccacuu

SEQ ID NO: 3145242 - RNA, 13 nt, Human
acugccagcaacg

SEQ ID NO: 3145243 - RNA, 18 nt, Human
acucugucucaguccaug

SEQ ID NO: 3145244 - RNA, 20 nt, Human
acucugucucaguccaugaa

SEQ ID NO: 3145245 - RNA, 13 nt, Human
acuguaagaaaau

SEQ ID NO: 3145246 - RNA, 19 nt, Human
acuguaagaaaauaucacu

SEQ ID NO: 3145247 - RNA, 22 nt, Human
acuguaagaaaauaucacuugu

SEQ ID NO: 3145248 - RNA, 22 nt, Human
acuucugucuucacaacagauu

SEQ ID NO: 3145249 - RNA, 21 nt, Human
acuuggucugugagaugcuag

SEQ ID NO: 3145250 - RNA, 21 nt, Human
acuucugucuucacaacagau

SEQ ID NO: 3145251 - RNA, 11 nt, Human
agaaaguguau

SEQ ID NO: 3145252 - RNA, 16 nt, Human
agaaaguguauuugga

SEQ ID NO: 3145253 - RNA, 13 nt, Human
agaaaguguauuu

SEQ ID NO: 3145254 - RNA, 17 nt, Human
agaaaguguauuuggaa

SEQ ID NO: 3145255 - RNA, 16 nt, Human
agaaaaucaggcuggc

SEQ ID NO: 3145256 - RNA, 14 nt, Human
agaaaauaacaaua

SEQ ID NO: 3145257 - RNA, 22 nt, Human
acuuuauuuucuauaauuuaaa

SEQ ID NO: 3145258 - RNA, 21 nt, Human
acccacaagaaaugaaagcag

SEQ ID NO: 3145259 - RNA, 17 nt, Human
acccacaagaaaugaaa

SEQ ID NO: 3145260 - RNA, 15 nt, Human
acccacaagaaauga

SEQ ID NO: 3145261 - RNA, 22 nt, Human
acccaguguuuuaggagcauga

SEQ ID NO: 3145262 - RNA, 19 nt, Human
acccaguguuuuaggagca

SEQ ID NO: 3145263 - RNA, 21 nt, Human
acauuuguauaaaauaauuuu

SEQ ID NO: 3145264 - RNA, 22 nt, Human
acaggcaacugaggcagacagc

SEQ ID NO: 3145265 - RNA, 21 nt, Human
acagcaguugaaaagacucca

SEQ ID NO: 3145266 - RNA, 22 nt, Human
acagcaguugaaaagacuccaa

SEQ ID NO: 3145267 - RNA, 23 nt, Human
acagcaguugaaaagacuccaaa

SEQ ID NO: 3145268 - RNA, 18 nt, Human
acagcaguugaaaagacu

SEQ ID NO: 3145269 - RNA, 15 nt, Human
acagaauucugcuac

SEQ ID NO: 3145270 - RNA, 17 nt, Human
acagaauucugcuaccu

SEQ ID NO: 3145271 - RNA, 16 nt, Human
acaggcaacugaggca

SEQ ID NO: 3145272 - RNA, 18 nt, Human
acaggcaacugaggcaga

SEQ ID NO: 3145273 - RNA, 19 nt, Human
acaggcaacugaggcagac

SEQ ID NO: 3145274 - RNA, 21 nt, Human
acacgagcaggcuacugucag

SEQ ID NO: 3145275 - RNA, 14 nt, Human
acacgagcaggcua

SEQ ID NO: 3145276 - RNA, 19 nt, Human
acacgagcaggcuacuguc

SEQ ID NO: 3145277 - RNA, 14 nt, Human
agccgcuccugucu

SEQ ID NO: 3145278 - RNA, 22 nt, Human
agccgcuccugucugccagcca

SEQ ID NO: 3145279 - RNA, 16 nt, Human
agccgcuccugucugc

SEQ ID NO: 3145280 - RNA, 17 nt, Human
agccgcuccugucugcc

SEQ ID NO: 3145281 - RNA, 19 nt, Human
agccgcuccugucugccag

SEQ ID NO: 3145282 - RNA, 21 nt, Human
agccgcuccugucugccagcc

SEQ ID NO: 3145283 - RNA, 17 nt, Human
agcccuccucugcacuc

SEQ ID NO: 3145284 - RNA, 16 nt, Human
agcacugacuucuaag

SEQ ID NO: 3145285 - RNA, 14 nt, Human
agcacacuguagca

SEQ ID NO: 3145286 - RNA, 19 nt, Human
agcacacuguagcauuaca

SEQ ID NO: 3145287 - RNA, 21 nt, Human
agcagcucaggcacacuucuu

SEQ ID NO: 3145288 - RNA, 15 nt, Human
agcaugaagacagag

SEQ ID NO: 3145289 - RNA, 13 nt, Human
agcaguugaaaag

SEQ ID NO: 3145290 - RNA, 23 nt, Human
agcaguucagagcugcccucucc

SEQ ID NO: 3145291 - RNA, 20 nt, Human
agcaguucagagcugcccuc

SEQ ID NO: 3145292 - RNA, 16 nt, Human
agcaguugaaaagacu

SEQ ID NO: 3145293 - RNA, 21 nt, Human
agauggcauaaccugucucac

SEQ ID NO: 3145294 - RNA, 21 nt, Human
agacgugcacgcacacugucu

SEQ ID NO: 3145295 - RNA, 22 nt, Human
agacgugcacgcacacugucug

SEQ ID NO: 3145296 - RNA, 17 nt, Human
agagaacuuccagaucc

SEQ ID NO: 3145297 - RNA, 21 nt, Human
agacugcauuauauuuauuac

SEQ ID NO: 3145298 - RNA, 22 nt, Human
agcuccccucggagaagagcug

SEQ ID NO: 3145299 - RNA, 12 nt, Human
aggagucccugg

SEQ ID NO: 3145300 - RNA, 23 nt, Human
aggaugguucccuugaugaagaa

SEQ ID NO: 3145301 - RNA, 17 nt, Human
aggauguugaaaaaguu

SEQ ID NO: 3145302 - RNA, 12 nt, Human
aggcuguaacua

SEQ ID NO: 3145303 - RNA, 16 nt, Human
aggcuagauguaugua

SEQ ID NO: 3145304 - RNA, 15 nt, Human
aggcuagauguaugu

SEQ ID NO: 3145305 - RNA, 15 nt, Human
aggcuguaacuacuu

SEQ ID NO: 3145306 - RNA, 21 nt, Human
aggcuagaaccaccugccuau

SEQ ID NO: 3145307 - RNA, 17 nt, Human
aggcuacugucagcucc

SEQ ID NO: 3145308 - RNA, 20 nt, Human
agguaaaagcaucacaugaa

SEQ ID NO: 3145309 - RNA, 18 nt, Human
aggugcuacaaaaacaca

SEQ ID NO: 3145310 - RNA, 19 nt, Human
aggugcuacaaaaacacag

SEQ ID NO: 3145311 - RNA, 20 nt, Human
aggugcuacaaaaacacagc

SEQ ID NO: 3145312 - RNA, 21 nt, Human
aggugcuacaaaaacacagca

SEQ ID NO: 3145313 - RNA, 22 nt, Human
aggugcuacaaaaacacagcaa

SEQ ID NO: 3145314 - RNA, 23 nt, Human
aggugcuacaaaaacacagcaag

SEQ ID NO: 3145315 - RNA, 24 nt, Human
aggugcuacaaaaacacagcaagg

SEQ ID NO: 3145316 - RNA, 18 nt, Human
agggucaggagaggggca

SEQ ID NO: 3145317 - RNA, 14 nt, Human
agggucaggagagg

SEQ ID NO: 3145318 - RNA, 15 nt, Human
agggucaggagaggg

SEQ ID NO: 3145319 - RNA, 21 nt, Human
aucagcugcugaaacaacaaa

SEQ ID NO: 3145320 - RNA, 15 nt, Human
auauuuauuuuaaua

SEQ ID NO: 3145321 - RNA, 14 nt, Human
auauuuauuuuaau

SEQ ID NO: 3145322 - RNA, 17 nt, Human
auauuuauuuuaauaau

SEQ ID NO: 3145323 - RNA, 22 nt, Human
aucagcugcugaaacaacaaau

SEQ ID NO: 3145324 - RNA, 23 nt, Human
aucagcugcugaaacaacaaaua

SEQ ID NO: 3145325 - RNA, 17 nt, Human
aucagcugcugaaacaa

SEQ ID NO: 3145326 - RNA, 21 nt, Human
auccucaaagaaaguguauug

SEQ ID NO: 3145327 - RNA, 20 nt, Human
auccucaaagaaaguguauu

SEQ ID NO: 3145328 - RNA, 19 nt, Human
auccucaaagaaaguguau

SEQ ID NO: 3145329 - RNA, 18 nt, Human
auccucaaagaaagugua

SEQ ID NO: 3145330 - RNA, 16 nt, Human
auccucaaagaaagug

SEQ ID NO: 3145331 - RNA, 15 nt, Human
auccucaaagaaagu

SEQ ID NO: 3145332 - RNA, 18 nt, Human
augugggcagugauguca

SEQ ID NO: 3145333 - RNA, 17 nt, Human
auguucuaagaagugaa

SEQ ID NO: 3145334 - RNA, 21 nt, Human
auguuucaaacauauauaaca

SEQ ID NO: 3145335 - RNA, 20 nt, Human
auuaaauauguuagcaaaga

SEQ ID NO: 3145336 - RNA, 22 nt, Human
auuaaauauguuagcaaagagu

SEQ ID NO: 3145337 - RNA, 19 nt, Human
auguaagggaaacugccag

SEQ ID NO: 3145338 - RNA, 14 nt, Human
auguaagggaaacu

SEQ ID NO: 3145339 - RNA, 16 nt, Human
auguaagggaaacugc

SEQ ID NO: 3145340 - RNA, 23 nt, Human
augcugccaauauccuaauaaaa

SEQ ID NO: 3145341 - RNA, 22 nt, Human
augcugccaauauccuaauaaa

SEQ ID NO: 3145342 - RNA, 21 nt, Human
augcugccaauauccuaauaa

SEQ ID NO: 3145343 - RNA, 20 nt, Human
augcugccaauauccuaaua

SEQ ID NO: 3145344 - RNA, 13 nt, Human
augcugccaauau

SEQ ID NO: 3145345 - RNA, 19 nt, Human
augcugccaauauccuaau

SEQ ID NO: 3145346 - RNA, 18 nt, Human
augcugccaauauccuaa

SEQ ID NO: 3145347 - RNA, 17 nt, Human
augcugccaauauccua

SEQ ID NO: 3145348 - RNA, 14 nt, Human
augcugccaauauc

SEQ ID NO: 3145349 - RNA, 15 nt, Human
agugucuuaauuaaa

SEQ ID NO: 3145350 - RNA, 19 nt, Human
aguguaugauuacuggccu

SEQ ID NO: 3145351 - RNA, 15 nt, Human
aguguaugauuacug

SEQ ID NO: 3145352 - RNA, 14 nt, Human
aguguaugauuacu

SEQ ID NO: 3145353 - RNA, 23 nt, Human
aguguauuuggaaauaaagucag

SEQ ID NO: 3145354 - RNA, 14 nt, Human
aguguauuuggaaa

SEQ ID NO: 3145355 - RNA, 17 nt, Human
agugucuuaauuaaaag

SEQ ID NO: 3145356 - RNA, 18 nt, Human
agugucuuaauuaaaaga

SEQ ID NO: 3145357 - RNA, 22 nt, Human
aguucaugcagcuguggcagag

SEQ ID NO: 3145358 - RNA, 13 nt, Human
aguucaugcagcu

SEQ ID NO: 3145359 - RNA, 21 nt, Human
aguugaaaagacuccaaagaa

SEQ ID NO: 3145360 - RNA, 22 nt, Human
aguugaaaaucuuauaauuuaa

SEQ ID NO: 3145361 - RNA, 22 nt, Human
aguugaaaagacuccaaagaaa

SEQ ID NO: 3145362 - RNA, 23 nt, Human
aguugaaaaucuuauaauuuaaa

SEQ ID NO: 3145363 - RNA, 13 nt, Human
aguuguuucauug

SEQ ID NO: 3145364 - RNA, 15 nt, Human
aguuguuucauugac

SEQ ID NO: 3145365 - RNA, 16 nt, Human
aguuguuucauugacu

SEQ ID NO: 3145366 - RNA, 19 nt, Human
aguuguuucauugacuauc

SEQ ID NO: 3145367 - RNA, 19 nt, Human
agucaaauugugugaaagg

SEQ ID NO: 3145368 - RNA, 23 nt, Human
agucaaauugugugaaagguacu

SEQ ID NO: 3145369 - RNA, 12 nt, Human
aguccuguaaug

SEQ ID NO: 3145370 - RNA, 18 nt, Human
auauccuaauaaaaaggu

SEQ ID NO: 3145371 - RNA, 16 nt, Human
auauccuaauaaaaag

SEQ ID NO: 3145372 - RNA, 14 nt, Human
auauccuaauaaaa

SEQ ID NO: 3145373 - RNA, 13 nt, Human
auauccuaauaaa

SEQ ID NO: 3145374 - RNA, 12 nt, Human
auauccuaauaa

SEQ ID NO: 3145375 - RNA, 22 nt, Human
auaugcuucuguuuuauaauuu

SEQ ID NO: 3145376 - RNA, 20 nt, Human
auaugcuucuguuuuauaau

SEQ ID NO: 3145377 - RNA, 22 nt, Human
auauuuauuacuguaagaaaau

SEQ ID NO: 3145378 - RNA, 13 nt, Human
auauuuauuuuaa

SEQ ID NO: 3145379 - RNA, 16 nt, Human
auauuauguuaaaacu

SEQ ID NO: 3145380 - RNA, 14 nt, Human
auagucaaauugug

SEQ ID NO: 3145381 - RNA, 15 nt, Human
auagguuuaauaauu

SEQ ID NO: 3145382 - RNA, 14 nt, Human
auaggugcuacaaa

SEQ ID NO: 3145383 - RNA, 15 nt, Human
auaggugcuacaaaa

SEQ ID NO: 3145384 - RNA, 21 nt, Human
auaggugcuacaaaaacacag

SEQ ID NO: 3145385 - RNA, 23 nt, Human
auaggugcuacaaaaacacagca

SEQ ID NO: 3145386 - RNA, 18 nt, Human
auagcagcuuauucacaa

SEQ ID NO: 3145387 - RNA, 23 nt, Human
auaauguuucaaacauauauaac

SEQ ID NO: 3145388 - RNA, 15 nt, Human
auaaugucccuucac

SEQ ID NO: 3145389 - RNA, 17 nt, Human
auacacacucaaaucaa

SEQ ID NO: 3145390 - RNA, 18 nt, Human
auacacacucaaaucaag

SEQ ID NO: 3145391 - RNA, 18 nt, Human
auaaaggauuaaugucaa

SEQ ID NO: 3145392 - RNA, 17 nt, Human
auaaaggcaguuuucua

SEQ ID NO: 3145393 - RNA, 16 nt, Human
auaaaggcaguuuucu

SEQ ID NO: 3145394 - RNA, 18 nt, Human
auaaaggcaguuuucuaa

SEQ ID NO: 3145395 - RNA, 13 nt, Human
aaaaacacagcaa

SEQ ID NO: 3145396 - RNA, 18 nt, Human
aaaaacacagcaagggug

SEQ ID NO: 3145397 - RNA, 12 nt, Human
aaaaacacagca

SEQ ID NO: 3145398 - RNA, 22 nt, Human
uuugugaauuaggcuguaacua

SEQ ID NO: 3145399 - RNA, 15 nt, Human
uuugugaauuaggcu

SEQ ID NO: 3145400 - RNA, 17 nt, Human
uuugugaagcaaaauuu

SEQ ID NO: 3145401 - RNA, 21 nt, Human
uuuguaguguuggagaagaac

SEQ ID NO: 3145402 - RNA, 19 nt, Human
uuuguaguguuggagaaga

SEQ ID NO: 3145403 - RNA, 17 nt, Human
uuuguaguguuggagaa

SEQ ID NO: 3145404 - RNA, 14 nt, Human
auguauguuaccaa

SEQ ID NO: 3145405 - RNA, 13 nt, Human
auguauguuacca

SEQ ID NO: 3145406 - RNA, 12 nt, Human
auguauguuacc

SEQ ID NO: 3145407 - RNA, 17 nt, Human
auguccacugguucuuc

SEQ ID NO: 3145408 - RNA, 16 nt, Human
auguccacugguucuu

SEQ ID NO: 3145409 - RNA, 22 nt, Human
auguccugccuauuaucuguca

SEQ ID NO: 3145410 - RNA, 21 nt, Human
auguccugccuauuaucuguc

SEQ ID NO: 3145411 - RNA, 20 nt, Human
auguccugccuauuaucugu

SEQ ID NO: 3145412 - RNA, 16 nt, Human
auguccugccuauuau

SEQ ID NO: 3145413 - RNA, 16 nt, Human
auguacuucaugcugu

SEQ ID NO: 3145414 - RNA, 13 nt, Human
auguagaggagaa

SEQ ID NO: 3145415 - RNA, 12 nt, Human
auguagaggaga

SEQ ID NO: 3145416 - RNA, 19 nt, Human
auguagaggagaaacugga

SEQ ID NO: 3145417 - RNA, 17 nt, Human
auguagaggagaaacug

SEQ ID NO: 3145418 - RNA, 13 nt, Human
uuugcucauggaa

SEQ ID NO: 3145419 - RNA, 14 nt, Human
uuugcaagccagau

SEQ ID NO: 3145420 - RNA, 21 nt, Human
augguucccuugaugaagaag

SEQ ID NO: 3145421 - RNA, 15 nt, Human
uuugaaauauugacu

SEQ ID NO: 3145422 - RNA, 15 nt, Human
uuucuguaccaguua

SEQ ID NO: 3145423 - RNA, 14 nt, Human
uuucuguaccaguu

SEQ ID NO: 3145424 - RNA, 17 nt, Human
uuucucccagucauuua

SEQ ID NO: 3145425 - RNA, 18 nt, Human
uuucucccagucauuuaa

SEQ ID NO: 3145426 - RNA, 19 nt, Human
auggcuaagcaaaauguga

SEQ ID NO: 3145427 - RNA, 23 nt, Human
auggcuauaggugcuacaaaaac

SEQ ID NO: 3145428 - RNA, 17 nt, Human
auggcauaaccugucuc

SEQ ID NO: 3145429 - RNA, 16 nt, Human
auggcauaaccugucu

SEQ ID NO: 3145430 - RNA, 16 nt, Human
auggcacuaguauuuc

SEQ ID NO: 3145431 - RNA, 14 nt, Human
auggcacuaguauu

SEQ ID NO: 3145432 - RNA, 16 nt, Human
uuucaaacauauauaa

SEQ ID NO: 3145433 - RNA, 19 nt, Human
uuuauuaaucuuaguguau

SEQ ID NO: 3145434 - RNA, 13 nt, Human
uuuauuaaucuua

SEQ ID NO: 3145435 - RNA, 21 nt, Human
augcuagaacucccuuucaac

SEQ ID NO: 3145436 - RNA, 20 nt, Human
augcuagaacucccuuucaa

SEQ ID NO: 3145437 - RNA, 22 nt, Human
augcuagaacucccuuucaaca

SEQ ID NO: 3145438 - RNA, 19 nt, Human
augcuagaacucccuuuca

SEQ ID NO: 3145439 - RNA, 17 nt, Human
augccauuuaaagcuua

SEQ ID NO: 3145440 - RNA, 21 nt, Human
augccauuuaaagcuuauuaa

SEQ ID NO: 3145441 - RNA, 13 nt, Human
augcaguucugaa

SEQ ID NO: 3145442 - RNA, 19 nt, Human
augcgguuaauuuugaagu

SEQ ID NO: 3145443 - RNA, 15 nt, Human
augcagcuguggcag

SEQ ID NO: 3145444 - RNA, 14 nt, Human
augauuaaguaaug

SEQ ID NO: 3145445 - RNA, 18 nt, Human
augauuaaguaaugauaa

SEQ ID NO: 3145446 - RNA, 14 nt, Human
augauuacuggccu

SEQ ID NO: 3145447 - RNA, 15 nt, Human
augauaacuggaaac

SEQ ID NO: 3145448 - RNA, 16 nt, Human
uuuaaagaaaguguau

SEQ ID NO: 3145449 - RNA, 14 nt, Human
uuuaaagaaagugu

SEQ ID NO: 3145450 - RNA, 13 nt, Human
uuuaaagaaagug

SEQ ID NO: 3145451 - RNA, 19 nt, Human
augauuacuggccuuuuuc

SEQ ID NO: 3145452 - RNA, 15 nt, Human
augauuacuggccuu

SEQ ID NO: 3145453 - RNA, 22 nt, Human
augauuacuggccuuuuucauu

SEQ ID NO: 3145454 - RNA, 17 nt, Human
aucaggguuaguauugu

SEQ ID NO: 3145455 - RNA, 19 nt, Human
aucagaagucaucuugcua

SEQ ID NO: 3145456 - RNA, 22 nt, Human
aucacuugucaauaaaauccau

SEQ ID NO: 3145457 - RNA, 18 nt, Human
aucagaagucaucuugcu

SEQ ID NO: 3145458 - RNA, 13 nt, Human
uucuaagaaguga

SEQ ID NO: 3145459 - RNA, 23 nt, Human
uucuaagaagugaaaaucuacac

SEQ ID NO: 3145460 - RNA, 16 nt, Human
uucuaaguaaaaccac

SEQ ID NO: 3145461 - RNA, 15 nt, Human
uucuaaguaaaacca

SEQ ID NO: 3145462 - RNA, 19 nt, Human
uucuagcaugaagacagag

SEQ ID NO: 3145463 - RNA, 17 nt, Human
uucggccccauguaucu

SEQ ID NO: 3145464 - RNA, 15 nt, Human
uucggccuccauccu

SEQ ID NO: 3145465 - RNA, 18 nt, Human
uucggccccauguaucuc

SEQ ID NO: 3145466 - RNA, 14 nt, Human
uucggccuccaucc

SEQ ID NO: 3145467 - RNA, 19 nt, Human
uuccguagguuauuuucag

SEQ ID NO: 3145468 - RNA, 19 nt, Human
uucccucccagaggagcca

SEQ ID NO: 3145469 - RNA, 14 nt, Human
aucaacagauaaau

SEQ ID NO: 3145470 - RNA, 20 nt, Human
auauuuuuuguuaaaugauu

SEQ ID NO: 3145471 - RNA, 18 nt, Human
auauuuuuuguuaaauga

SEQ ID NO: 3145472 - RNA, 13 nt, Human
auccgaggcaggg

SEQ ID NO: 3145473 - RNA, 18 nt, Human
uugaacccgggaggcaga

SEQ ID NO: 3145474 - RNA, 17 nt, Human
uugaaauuguauuacaa

SEQ ID NO: 3145475 - RNA, 19 nt, Human
uugaacccgggaggcagag

SEQ ID NO: 3145476 - RNA, 12 nt, Human
auccgaggcagg

SEQ ID NO: 3145477 - RNA, 17 nt, Human
uucuuaacuucuugcuu

SEQ ID NO: 3145478 - RNA, 16 nt, Human
uucuuaacuucuugcu

SEQ ID NO: 3145479 - RNA, 13 nt, Human
uucuuaacuucuu

SEQ ID NO: 3145480 - RNA, 12 nt, Human
uucucuaggaaa

SEQ ID NO: 3145481 - RNA, 14 nt, Human
auccauacauuugu

SEQ ID NO: 3145482 - RNA, 21 nt, Human
uugaaggaugcugucuucgua

SEQ ID NO: 3145483 - RNA, 19 nt, Human
aucuacacuccagugagac

SEQ ID NO: 3145484 - RNA, 18 nt, Human
aucuacacuccagugaga

SEQ ID NO: 3145485 - RNA, 22 nt, Human
uugcaagccagauuuuccugaa

SEQ ID NO: 3145486 - RNA, 13 nt, Human
uugcaucaauuuu

SEQ ID NO: 3145487 - RNA, 20 nt, Human
uugcuucuuucuagaaagag

SEQ ID NO: 3145488 - RNA, 17 nt, Human
uugcuucuuucuagaaa

SEQ ID NO: 3145489 - RNA, 12 nt, Human
uugcuucuuucu

SEQ ID NO: 3145490 - RNA, 23 nt, Human
aucuugcuaccaguauuuagaag

SEQ ID NO: 3145491 - RNA, 14 nt, Human
aucuugcuaccagu

SEQ ID NO: 3145492 - RNA, 19 nt, Human
aucuugcuaccaguauuua

SEQ ID NO: 3145493 - RNA, 16 nt, Human
aucuugcuaccaguau

SEQ ID NO: 3145494 - RNA, 14 nt, Human
aucuuaguguauga

SEQ ID NO: 3145495 - RNA, 13 nt, Human
aucuuaguguaug

SEQ ID NO: 3145496 - RNA, 19 nt, Human
aucuuaguguaugauuacu

SEQ ID NO: 3145497 - RNA, 16 nt, Human
aucuuaguguaugauu

SEQ ID NO: 3145498 - RNA, 15 nt, Human
aucuuaguguaugau

SEQ ID NO: 3145499 - RNA, 16 nt, Human
augaauuacauuugua

SEQ ID NO: 3145500 - RNA, 15 nt, Human
augaauuacauuugu

SEQ ID NO: 3145501 - RNA, 15 nt, Human
augaauuaaguuuuu

SEQ ID NO: 3145502 - RNA, 23 nt, Human
augaauggcuaagcaaaauguga

SEQ ID NO: 3145503 - RNA, 14 nt, Human
auuuauuuuaauaa

SEQ ID NO: 3145504 - RNA, 14 nt, Human
auuuguauaaaaua

SEQ ID NO: 3145505 - RNA, 22 nt, Human
auuuguaguguuggagaagaac

SEQ ID NO: 3145506 - RNA, 19 nt, Human
auuuguaguguuggagaag

SEQ ID NO: 3145507 - RNA, 23 nt, Human
auuuuaaaagaaugauuaugaau

SEQ ID NO: 3145508 - RNA, 16 nt, Human
auuuuaaaagaaugau

SEQ ID NO: 3145509 - RNA, 23 nt, Human
auuggauuuccuaauacugucau

SEQ ID NO: 3145510 - RNA, 14 nt, Human
auuggauuuccuaa

SEQ ID NO: 3145511 - RNA, 22 nt, Human
auuggauuuccuaauacuguca

SEQ ID NO: 3145512 - RNA, 15 nt, Human
auuggauuuccuaau

SEQ ID NO: 3145513 - RNA, 15 nt, Human
auugguuuaaagaaa

SEQ ID NO: 3145514 - RNA, 18 nt, Human
auugguuuaaagaaagug

SEQ ID NO: 3145515 - RNA, 17 nt, Human
auugguuuaaagaaagu

SEQ ID NO: 3145516 - RNA, 13 nt, Human
auugacuuuuuau

SEQ ID NO: 3145517 - RNA, 19 nt, Human
auuggagcucgugggacag

SEQ ID NO: 3145518 - RNA, 19 nt, Human
auuggacaguaaaauccac

SEQ ID NO: 3145519 - RNA, 13 nt, Human
auugucuagugaa

SEQ ID NO: 3145520 - RNA, 21 nt, Human
auuuuuccaacuacuaauaga

SEQ ID NO: 3145521 - RNA, 13 nt, Human
auuuuuccaacua

SEQ ID NO: 3145522 - RNA, 15 nt, Human
auuuuucuuauuuca

SEQ ID NO: 3145523 - RNA, 19 nt, Human
auuuuucuuauuucauuuc

SEQ ID NO: 3145524 - RNA, 20 nt, Human
auuuuucuuauuucauuucu

SEQ ID NO: 3145525 - RNA, 22 nt, Human
auuuuugugauuuugugauuga

SEQ ID NO: 3145526 - RNA, 13 nt, Human
auuuuuuaaauuc

SEQ ID NO: 3145527 - RNA, 21 nt, Human
auuuuuguuuucauuaucuca

SEQ ID NO: 3145528 - RNA, 18 nt, Human
auuuuuuguuaaaugauu

SEQ ID NO: 3145529 - RNA, 15 nt, Human
auuuuuuguauaauu

SEQ ID NO: 3145530 - RNA, 14 nt, Human
auuuuuuguauaau

SEQ ID NO: 3145531 - RNA, 16 nt, Human
auuuuuuguauaauug

SEQ ID NO: 3145532 - RNA, 23 nt, Human
auuuuuucucuaggaaauauuua

SEQ ID NO: 3145533 - RNA, 20 nt, Human
auuuuuucucuaggaaauau

SEQ ID NO: 3145534 - RNA, 21 nt, Human
auuuuguuggcauagcucugg

SEQ ID NO: 3145535 - RNA, 15 nt, Human
auuuuguuggcauag

SEQ ID NO: 3145536 - RNA, 14 nt, Human
auuuuccugaaaac

SEQ ID NO: 3145537 - RNA, 15 nt, Human
auuuucuauaauuua

SEQ ID NO: 3145538 - RNA, 14 nt, Human
auuuucuauaauuu

SEQ ID NO: 3145539 - RNA, 21 nt, Human
auucccguuuugucacuuuuu

SEQ ID NO: 3145540 - RNA, 18 nt, Human
auucccguuuugucacuu

SEQ ID NO: 3145541 - RNA, 16 nt, Human
auucccguuuugucac

SEQ ID NO: 3145542 - RNA, 23 nt, Human
auucccguuuugucacuuuuucu

SEQ ID NO: 3145543 - RNA, 16 nt, Human
auucaaacagucucag

SEQ ID NO: 3145544 - RNA, 18 nt, Human
auucaaacagucucagga

SEQ ID NO: 3145545 - RNA, 19 nt, Human
auucaaacagucucaggaa

SEQ ID NO: 3145546 - RNA, 20 nt, Human
auucaaacagucucaggaaa

SEQ ID NO: 3145547 - RNA, 21 nt, Human
auuauguuaaaacugggacag

SEQ ID NO: 3145548 - RNA, 18 nt, Human
auuauauuuauuacugua

SEQ ID NO: 3145549 - RNA, 15 nt, Human
auuauauuuauuacu

SEQ ID NO: 3145550 - RNA, 20 nt, Human
auuauuaccuuacagaaguu

SEQ ID NO: 3145551 - RNA, 17 nt, Human
auuauauuuacaaaugg

SEQ ID NO: 3145552 - RNA, 19 nt, Human
auugacacuuaaaaauggu

SEQ ID NO: 3145553 - RNA, 18 nt, Human
auugacuaucaaacugaa

SEQ ID NO: 3145554 - RNA, 21 nt, Human
auugacuaucaaacugaagcc

SEQ ID NO: 3145555 - RNA, 17 nt, Human
auugacacuuaaaaaug

SEQ ID NO: 3145556 - RNA, 15 nt, Human
auugacacuuaaaaa

SEQ ID NO: 3145557 - RNA, 15 nt, Human
auucugcuaccucac

SEQ ID NO: 3145558 - RNA, 19 nt, Human
auucugcuaccucacuggg

SEQ ID NO: 3145559 - RNA, 18 nt, Human
agccugagcgacagugag

SEQ ID NO: 3145560 - RNA, 22 nt, Human
ugcagcuguggcagaguuacag

SEQ ID NO: 3145561 - RNA, 20 nt, Human
ugcagcuguggcagaguuac

SEQ ID NO: 3145562 - RNA, 14 nt, Human
ugcagugagccgag

SEQ ID NO: 3145563 - RNA, 15 nt, Human
ugcacucccaccuga

SEQ ID NO: 3145564 - RNA, 14 nt, Human
ugcacucccaccug

SEQ ID NO: 3145565 - RNA, 17 nt, Human
ugcagagacaggaccug

SEQ ID NO: 3145566 - RNA, 20 nt, Human
ugcagagacaggaccugacu

SEQ ID NO: 3145567 - RNA, 17 nt, Human
agcccuucuuuccacag

SEQ ID NO: 3145568 - RNA, 22 nt, Human
agcccuuaugcgguuaauuuug

SEQ ID NO: 3145569 - RNA, 21 nt, Human
agcccuuaugcgguuaauuuu

SEQ ID NO: 3145570 - RNA, 19 nt, Human
ugcacucccaccugacaca

SEQ ID NO: 3145571 - RNA, 17 nt, Human
ugcacucccaccugaca

SEQ ID NO: 3145572 - RNA, 19 nt, Human
agcccuucuuuccacagaa

SEQ ID NO: 3145573 - RNA, 18 nt, Human
agcccuucuuuccacaga

SEQ ID NO: 3145574 - RNA, 19 nt, Human
agcuacuaauuuuaaaaug

SEQ ID NO: 3145575 - RNA, 14 nt, Human
ugccacuuaaugua

SEQ ID NO: 3145576 - RNA, 18 nt, Human
ugccacuuaauguauguu

SEQ ID NO: 3145577 - RNA, 17 nt, Human
ugccacuuaauguaugu

SEQ ID NO: 3145578 - RNA, 23 nt, Human
ugccacuuaauguauguuaccaa

SEQ ID NO: 3145579 - RNA, 20 nt, Human
ugccacuuaauguauguuac

SEQ ID NO: 3145580 - RNA, 23 nt, Human
ugccaauauccuaauaaaaaggu

SEQ ID NO: 3145581 - RNA, 14 nt, Human
ugccaauauccuaa

SEQ ID NO: 3145582 - RNA, 21 nt, Human
ugccaauauccuaauaaaaag

SEQ ID NO: 3145583 - RNA, 19 nt, Human
ugccaauauccuaauaaaa

SEQ ID NO: 3145584 - RNA, 18 nt, Human
ugccaauauccuaauaaa

SEQ ID NO: 3145585 - RNA, 17 nt, Human
ugccaauauccuaauaa

SEQ ID NO: 3145586 - RNA, 16 nt, Human
ugccaauauccuaaua

SEQ ID NO: 3145587 - RNA, 15 nt, Human
ugccaauauccuaau

SEQ ID NO: 3145588 - RNA, 23 nt, Human
ugcccuagagcacacuguagcau

SEQ ID NO: 3145589 - RNA, 17 nt, Human
ugcccuagagcacacug

SEQ ID NO: 3145590 - RNA, 17 nt, Human
agcugggcuaaguaaau

SEQ ID NO: 3145591 - RNA, 13 nt, Human
agcuggaaaagua

SEQ ID NO: 3145592 - RNA, 17 nt, Human
agcugccuccccuccuc

SEQ ID NO: 3145593 - RNA, 18 nt, Human
agcugccuccccuccucu

SEQ ID NO: 3145594 - RNA, 19 nt, Human
agcugccuccccuccucug

SEQ ID NO: 3145595 - RNA, 20 nt, Human
agcugccuccccuccucugc

SEQ ID NO: 3145596 - RNA, 21 nt, Human
agcugccuccccuccucugcu

SEQ ID NO: 3145597 - RNA, 22 nt, Human
agcugccuccccuccucugcuu

SEQ ID NO: 3145598 - RNA, 23 nt, Human
agcugccuccccuccucugcuug

SEQ ID NO: 3145599 - RNA, 12 nt, Human
agcucucagcca

SEQ ID NO: 3145600 - RNA, 13 nt, Human
agcucucagccaa

SEQ ID NO: 3145601 - RNA, 14 nt, Human
ugcuaccucacugg

SEQ ID NO: 3145602 - RNA, 15 nt, Human
ugcuaccucacuggg

SEQ ID NO: 3145603 - RNA, 16 nt, Human
ugcuaccucacugggg

SEQ ID NO: 3145604 - RNA, 22 nt, Human
ugcuaccucacugggguccugg

SEQ ID NO: 3145605 - RNA, 20 nt, Human
agcuuauuaaaacucauuuu

SEQ ID NO: 3145606 - RNA, 15 nt, Human
agcuuauuaaaacuc

SEQ ID NO: 3145607 - RNA, 21 nt, Human
agcuuauugucuagugaaacu

SEQ ID NO: 3145608 - RNA, 14 nt, Human
ugcuaguaauugga

SEQ ID NO: 3145609 - RNA, 16 nt, Human
ugcuaguaauuggaaa

SEQ ID NO: 3145610 - RNA, 19 nt, Human
aggaaagagaacuuccaga

SEQ ID NO: 3145611 - RNA, 13 nt, Human
aggaaagagaacu

SEQ ID NO: 3145612 - RNA, 19 nt, Human
aggaauugacccacaagaa

SEQ ID NO: 3145613 - RNA, 22 nt, Human
ugcugccaauauccuaauaaaa

SEQ ID NO: 3145614 - RNA, 23 nt, Human
ugcugccaauauccuaauaaaaa

SEQ ID NO: 3145615 - RNA, 13 nt, Human
aggaaauauuuau

SEQ ID NO: 3145616 - RNA, 18 nt, Human
aggaaauauuuauuuuaa

SEQ ID NO: 3145617 - RNA, 14 nt, Human
aggaaauauuuauu

SEQ ID NO: 3145618 - RNA, 22 nt, Human
aggcuccacuuggucugugaga

SEQ ID NO: 3145619 - RNA, 21 nt, Human
aggcuccacuuggucugugag

SEQ ID NO: 3145620 - RNA, 17 nt, Human
aggcuccacuuggucug

SEQ ID NO: 3145621 - RNA, 11 nt, Human
aggcuccacuu

SEQ ID NO: 3145622 - RNA, 11 nt, Human
uggcccaggag

SEQ ID NO: 3145623 - RNA, 12 nt, Human
aggaguuuggcc

SEQ ID NO: 3145624 - RNA, 22 nt, Human
ugcugcccgucuucagccuagc

SEQ ID NO: 3145625 - RNA, 17 nt, Human
ugcugcccgucuucagc

SEQ ID NO: 3145626 - RNA, 20 nt, Human
ugcugcccgucuucagccua

SEQ ID NO: 3145627 - RNA, 21 nt, Human
ugcugcccgucuucagccuag

SEQ ID NO: 3145628 - RNA, 20 nt, Human
uggacaccaggagucccugg

SEQ ID NO: 3145629 - RNA, 21 nt, Human
uggacaccaggagucccuggu

SEQ ID NO: 3145630 - RNA, 22 nt, Human
uggaauuucucccagucauuua

SEQ ID NO: 3145631 - RNA, 21 nt, Human
uggagcucgugggacagucac

SEQ ID NO: 3145632 - RNA, 21 nt, Human
aggcaauuagacacuuuggaa

SEQ ID NO: 3145633 - RNA, 12 nt, Human
aggcaauuagac

SEQ ID NO: 3145634 - RNA, 14 nt, Human
uggagaagaacuga

SEQ ID NO: 3145635 - RNA, 16 nt, Human
uggagaagaacugaaa

SEQ ID NO: 3145636 - RNA, 18 nt, Human
ugggaaacaaaaggauaa

SEQ ID NO: 3145637 - RNA, 17 nt, Human
ugggaaagcauuguaaa

SEQ ID NO: 3145638 - RNA, 18 nt, Human
ugggaaagcauuguaaau

SEQ ID NO: 3145639 - RNA, 14 nt, Human
ugggaaagcauugu

SEQ ID NO: 3145640 - RNA, 16 nt, Human
ugggaaagcauuguaa

SEQ ID NO: 3145641 - RNA, 23 nt, Human
uggcuauaggugcuacaaaaaca

SEQ ID NO: 3145642 - RNA, 18 nt, Human
uggcuaagcaaaauguga

SEQ ID NO: 3145643 - RNA, 15 nt, Human
uggcuauaggugcua

SEQ ID NO: 3145644 - RNA, 19 nt, Human
uggcuauaggugcuacaaa

SEQ ID NO: 3145645 - RNA, 16 nt, Human
agggaaacugccagca

SEQ ID NO: 3145646 - RNA, 19 nt, Human
agggaaacugccagcaacg

SEQ ID NO: 3145647 - RNA, 21 nt, Human
agggaaacugccagcaacgca

SEQ ID NO: 3145648 - RNA, 23 nt, Human
agggaaacugccagcaacgcagg

SEQ ID NO: 3145649 - RNA, 14 nt, Human
agggaaacugccag

SEQ ID NO: 3145650 - RNA, 15 nt, Human
agggaaacugccagc

SEQ ID NO: 3145651 - RNA, 20 nt, Human
ugggaacccaaguccaagca

SEQ ID NO: 3145652 - RNA, 12 nt, Human
agggccccagca

SEQ ID NO: 3145653 - RNA, 14 nt, Human
agggccccagcacu

SEQ ID NO: 3145654 - RNA, 18 nt, Human
agggccccagcacuaaag

SEQ ID NO: 3145655 - RNA, 22 nt, Human
agggcuguuauaaucuuucaca

SEQ ID NO: 3145656 - RNA, 18 nt, Human
ugggcucaaccagaaaag

SEQ ID NO: 3145657 - RNA, 19 nt, Human
ugggaggcugagaugggag

SEQ ID NO: 3145658 - RNA, 13 nt, Human
agggagagaagau

SEQ ID NO: 3145659 - RNA, 14 nt, Human
agggagagaagaua

SEQ ID NO: 3145660 - RNA, 23 nt, Human
agggacuucugucuucacaacag

SEQ ID NO: 3145661 - RNA, 18 nt, Human
uguuccuagugaaagagg

SEQ ID NO: 3145662 - RNA, 22 nt, Human
uguugcccacagcuguaugauu

SEQ ID NO: 3145663 - RNA, 15 nt, Human
uguucuaagaaguga

SEQ ID NO: 3145664 - RNA, 23 nt, Human
aguguuggagaagaacugaaauc

SEQ ID NO: 3145665 - RNA, 17 nt, Human
agugccacuuaauguau

SEQ ID NO: 3145666 - RNA, 21 nt, Human
agugccacuuaauguauguua

SEQ ID NO: 3145667 - RNA, 20 nt, Human
agugccacuuaauguauguu

SEQ ID NO: 3145668 - RNA, 18 nt, Human
agugccacuuaauguaug

SEQ ID NO: 3145669 - RNA, 22 nt, Human
agugcaaauugucacaggacag

SEQ ID NO: 3145670 - RNA, 20 nt, Human
ugugcugcccgucuucagcc

SEQ ID NO: 3145671 - RNA, 16 nt, Human
agucuuucacauuuaa

SEQ ID NO: 3145672 - RNA, 21 nt, Human
agugaacaaauuuacagagac

SEQ ID NO: 3145673 - RNA, 20 nt, Human
agugaacaaauuuacagaga

SEQ ID NO: 3145674 - RNA, 23 nt, Human
agugaacaaauuuacagagacag

SEQ ID NO: 3145675 - RNA, 22 nt, Human
agugaacaaauuuacagagaca

SEQ ID NO: 3145676 - RNA, 16 nt, Human
uguaguguuggagaag

SEQ ID NO: 3145677 - RNA, 18 nt, Human
uguaguguuggagaagaa

SEQ ID NO: 3145678 - RNA, 17 nt, Human
uguaguguuggagaaga

SEQ ID NO: 3145679 - RNA, 13 nt, Human
aguaauuggaaag

SEQ ID NO: 3145680 - RNA, 12 nt, Human
aguaauuggaaa

SEQ ID NO: 3145681 - RNA, 22 nt, Human
aguaauuuauuguuuuuccuug

SEQ ID NO: 3145682 - RNA, 13 nt, Human
aguaauuuauugu

SEQ ID NO: 3145683 - RNA, 16 nt, Human
aguaaaaccacagcag

SEQ ID NO: 3145684 - RNA, 17 nt, Human
aguaaaaccacagcagu

SEQ ID NO: 3145685 - RNA, 19 nt, Human
aguaaaaccacagcaguug

SEQ ID NO: 3145686 - RNA, 14 nt, Human
agguugcagugagc

SEQ ID NO: 3145687 - RNA, 16 nt, Human
aggugcuacaaaaaca

SEQ ID NO: 3145688 - RNA, 19 nt, Human
uguaagggaaacugccagc

SEQ ID NO: 3145689 - RNA, 13 nt, Human
uguaagggaaacu

SEQ ID NO: 3145690 - RNA, 18 nt, Human
uguaagggaaacugccag

SEQ ID NO: 3145691 - RNA, 14 nt, Human
agucaggaaagaga

SEQ ID NO: 3145692 - RNA, 13 nt, Human
agucucaggaaau

SEQ ID NO: 3145693 - RNA, 22 nt, Human
ugucucaguccaugaagaugua

SEQ ID NO: 3145694 - RNA, 15 nt, Human
aguauuuagaagcca

SEQ ID NO: 3145695 - RNA, 19 nt, Human
aguauuuagaagccaacua

SEQ ID NO: 3145696 - RNA, 20 nt, Human
uguccagccccguagacgug

SEQ ID NO: 3145697 - RNA, 18 nt, Human
auagauaggucagugcaa

SEQ ID NO: 3145698 - RNA, 13 nt, Human
auagaaguaaaaa

SEQ ID NO: 3145699 - RNA, 17 nt, Human
auagaauuaacacauga

SEQ ID NO: 3145700 - RNA, 22 nt, Human
auagaauaaaggcaguuuucua

SEQ ID NO: 3145701 - RNA, 20 nt, Human
auagaauaaaggcaguuuuc

SEQ ID NO: 3145702 - RNA, 19 nt, Human
auagaauaaaggcaguuuu

SEQ ID NO: 3145703 - RNA, 18 nt, Human
auagaauaaaggcaguuu

SEQ ID NO: 3145704 - RNA, 17 nt, Human
auagaauaaaggcaguu

SEQ ID NO: 3145705 - RNA, 12 nt, Human
auagaauaaagg

SEQ ID NO: 3145706 - RNA, 16 nt, Human
auacucauuaggaugg

SEQ ID NO: 3145707 - RNA, 15 nt, Human
uuauuauauuuacaa

SEQ ID NO: 3145708 - RNA, 19 nt, Human
uuauguuaaaacugggaca

SEQ ID NO: 3145709 - RNA, 14 nt, Human
uuauuauauuuaca

SEQ ID NO: 3145710 - RNA, 19 nt, Human
uuaugauuaaguaaugaua

SEQ ID NO: 3145711 - RNA, 21 nt, Human
uuaugaauuacauuuguauaa

SEQ ID NO: 3145712 - RNA, 17 nt, Human
uuaugaauuacauuugu

SEQ ID NO: 3145713 - RNA, 16 nt, Human
uuaugaauuacauuug

SEQ ID NO: 3145714 - RNA, 14 nt, Human
uuaugaauuacauu

SEQ ID NO: 3145715 - RNA, 22 nt, Human
auaccacaggaaccacaagacu

SEQ ID NO: 3145716 - RNA, 17 nt, Human
auacuauggaauuucuc

SEQ ID NO: 3145717 - RNA, 19 nt, Human
uuauauuugaaauauugac

SEQ ID NO: 3145718 - RNA, 15 nt, Human
uuauauuugaaauau

SEQ ID NO: 3145719 - RNA, 14 nt, Human
auaaucuuucacag

SEQ ID NO: 3145720 - RNA, 16 nt, Human
uuaggguuaugauuaa

SEQ ID NO: 3145721 - RNA, 14 nt, Human
uuaggguuaugauu

SEQ ID NO: 3145722 - RNA, 14 nt, Human
uuagggagagaaga

SEQ ID NO: 3145723 - RNA, 15 nt, Human
uuagggagagaagau

SEQ ID NO: 3145724 - RNA, 12 nt, Human
uuagggaggggu

SEQ ID NO: 3145725 - RNA, 17 nt, Human
uuacaaaucagaaguca

SEQ ID NO: 3145726 - RNA, 16 nt, Human
uuacaaaucagaaguc

SEQ ID NO: 3145727 - RNA, 22 nt, Human
uuacaaaucagaagucaucuug

SEQ ID NO: 3145728 - RNA, 18 nt, Human
uuaauuuuuccaacuacu

SEQ ID NO: 3145729 - RNA, 14 nt, Human
uuacaguucugugg

SEQ ID NO: 3145730 - RNA, 13 nt, Human
uuacaguucugug

SEQ ID NO: 3145731 - RNA, 22 nt, Human
uuacaguucugugguuucaugu

SEQ ID NO: 3145732 - RNA, 12 nt, Human
uuacaguucugu

SEQ ID NO: 3145733 - RNA, 11 nt, Human
uuacaguucug

SEQ ID NO: 3145734 - RNA, 13 nt, Human
uuacuggccuuuu

SEQ ID NO: 3145735 - RNA, 18 nt, Human
uuacuggccuuuuucauu

SEQ ID NO: 3145736 - RNA, 16 nt, Human
uuacuggccuuuuuca

SEQ ID NO: 3145737 - RNA, 22 nt, Human
aguuuuuugaaaaugggcucaa

SEQ ID NO: 3145738 - RNA, 16 nt, Human
aguuuuauaugcuucu

SEQ ID NO: 3145739 - RNA, 15 nt, Human
uuaauuuuuccaacu

SEQ ID NO: 3145740 - RNA, 13 nt, Human
uuaauuuuuccaa

SEQ ID NO: 3145741 - RNA, 23 nt, Human
uuaauuuugaagugcuguuuauu

SEQ ID NO: 3145742 - RNA, 20 nt, Human
uuaauuuugaagugcuguuu

SEQ ID NO: 3145743 - RNA, 19 nt, Human
uuaauuuugaagugcuguu

SEQ ID NO: 3145744 - RNA, 21 nt, Human
uuaaucuuaguguaugauuac

SEQ ID NO: 3145745 - RNA, 19 nt, Human
uuaaucuuaguguaugauu

SEQ ID NO: 3145746 - RNA, 16 nt, Human
uuaaaaaauggaacau

SEQ ID NO: 3145747 - RNA, 22 nt, Human
uuaaaaucauuucugcaucagc

SEQ ID NO: 3145748 - RNA, 14 nt, Human
uuaaaaucauuucu

SEQ ID NO: 3145749 - RNA, 20 nt, Human
aguuuaaauuguaauaggcg

SEQ ID NO: 3145750 - RNA, 17 nt, Human
aguuuaaauuguaauag

SEQ ID NO: 3145751 - RNA, 15 nt, Human
aguuuagcuggaaaa

SEQ ID NO: 3145752 - RNA, 19 nt, Human
uuaaaaaagaaacauuugg

SEQ ID NO: 3145753 - RNA, 17 nt, Human
ugagguacugagaguga

SEQ ID NO: 3145754 - RNA, 22 nt, Human
ugagguacugagagugaacaaa

SEQ ID NO: 3145755 - RNA, 14 nt, Human
ugagcuacaaaugc

SEQ ID NO: 3145756 - RNA, 13 nt, Human
ugagcuacaaaug

SEQ ID NO: 3145757 - RNA, 16 nt, Human
ugagcuacaaaugcau

SEQ ID NO: 3145758 - RNA, 15 nt, Human
ugaggacacugauau

SEQ ID NO: 3145759 - RNA, 14 nt, Human
agcagaacagugau

SEQ ID NO: 3145760 - RNA, 23 nt, Human
agcacuuggagccaaggguucag

SEQ ID NO: 3145761 - RNA, 20 nt, Human
ugagcgacagugagacucug

SEQ ID NO: 3145762 - RNA, 16 nt, Human
ugagcgacagugagac

SEQ ID NO: 3145763 - RNA, 14 nt, Human
ugagcgacagugag

SEQ ID NO: 3145764 - RNA, 13 nt, Human
ugagcgacaguga

SEQ ID NO: 3145765 - RNA, 16 nt, Human
agcaccaaucaugaau

SEQ ID NO: 3145766 - RNA, 12 nt, Human
agcacagcccuu

SEQ ID NO: 3145767 - RNA, 22 nt, Human
agcacagccucuuagaugcagu

SEQ ID NO: 3145768 - RNA, 14 nt, Human
agcaacgcaggccc

SEQ ID NO: 3145769 - RNA, 19 nt, Human
agaugaugaugaucuuuaa

SEQ ID NO: 3145770 - RNA, 14 nt, Human
agauccuggaaauc

SEQ ID NO: 3145771 - RNA, 22 nt, Human
agauggaaaauucauuuuuuaa

SEQ ID NO: 3145772 - RNA, 18 nt, Human
agauggaaaauucauuuu

SEQ ID NO: 3145773 - RNA, 22 nt, Human
agaugcuagaacucccuuucaa

SEQ ID NO: 3145774 - RNA, 23 nt, Human
agaugcuagaacucccuuucaac

SEQ ID NO: 3145775 - RNA, 24 nt, Human
ugacuucuaaguaaaaccacagca

SEQ ID NO: 3145776 - RNA, 15 nt, Human
ugacuguuuccauca

SEQ ID NO: 3145777 - RNA, 16 nt, Human
agauugugccccugca

SEQ ID NO: 3145778 - RNA, 16 nt, Human
agauuuaccacuugug

SEQ ID NO: 3145779 - RNA, 17 nt, Human
ugaagauguagaggaga

SEQ ID NO: 3145780 - RNA, 18 nt, Human
ugaagauguagaggagaa

SEQ ID NO: 3145781 - RNA, 22 nt, Human
ugaacuuguaaaggaauuuaaa

SEQ ID NO: 3145782 - RNA, 20 nt, Human
ugaagaagcaccaaucauga

SEQ ID NO: 3145783 - RNA, 14 nt, Human
ugaagaagauggua

SEQ ID NO: 3145784 - RNA, 22 nt, Human
agagugaacaaauuuacagaga

SEQ ID NO: 3145785 - RNA, 14 nt, Human
agagugaacaaauu

SEQ ID NO: 3145786 - RNA, 11 nt, Human
agacuguggcu

SEQ ID NO: 3145787 - RNA, 14 nt, Human
agacuguggcugcu

SEQ ID NO: 3145788 - RNA, 20 nt, Human
agacuguggcugcuagcacu

SEQ ID NO: 3145789 - RNA, 14 nt, Human
agacuggcacaguu

SEQ ID NO: 3145790 - RNA, 15 nt, Human
agacuggcacaguuu

SEQ ID NO: 3145791 - RNA, 21 nt, Human
agacuggauaguccgucucug

SEQ ID NO: 3145792 - RNA, 20 nt, Human
agagacacacugaagaagca

SEQ ID NO: 3145793 - RNA, 18 nt, Human
agagacacacugaagaag

SEQ ID NO: 3145794 - RNA, 15 nt, Human
agagaaugagagaca

SEQ ID NO: 3145795 - RNA, 17 nt, Human
agagacacacugaagaa

SEQ ID NO: 3145796 - RNA, 21 nt, Human
ucuuuaaagggauggcaagau

SEQ ID NO: 3145797 - RNA, 17 nt, Human
ucuuuaaaauacacacu

SEQ ID NO: 3145798 - RNA, 20 nt, Human
agacuggauaguccgucucu

SEQ ID NO: 3145799 - RNA, 17 nt, Human
agacauguggugggaca

SEQ ID NO: 3145800 - RNA, 17 nt, Human
agacccucaugcugcca

SEQ ID NO: 3145801 - RNA, 19 nt, Human
agacccucaugcugccaau

SEQ ID NO: 3145802 - RNA, 18 nt, Human
agacccucaugcugccaa

SEQ ID NO: 3145803 - RNA, 21 nt, Human
agacccucaugcugccaauau

SEQ ID NO: 3145804 - RNA, 20 nt, Human
agacccucaugcugccaaua

SEQ ID NO: 3145805 - RNA, 24 nt, Human
agacccucaugcugccaauauccu

SEQ ID NO: 3145806 - RNA, 16 nt, Human
agacuccaaagaaaug

SEQ ID NO: 3145807 - RNA, 19 nt, Human
agacuccaaagaaauguaa

SEQ ID NO: 3145808 - RNA, 21 nt, Human
agacuauucaaacagucucag

SEQ ID NO: 3145809 - RNA, 18 nt, Human
agacuauucaaacagucu

SEQ ID NO: 3145810 - RNA, 20 nt, Human
agacuauucaaacagucuca

SEQ ID NO: 3145811 - RNA, 12 nt, Human
agacuccaaaga

SEQ ID NO: 3145812 - RNA, 13 nt, Human
agacuccaaagaa

SEQ ID NO: 3145813 - RNA, 14 nt, Human
agacuccaaagaaa

SEQ ID NO: 3145814 - RNA, 16 nt, Human
agacuauucaaacagu

SEQ ID NO: 3145815 - RNA, 15 nt, Human
ucuucacaacagauu

SEQ ID NO: 3145816 - RNA, 18 nt, Human
ucuuaauuaaaagaauau

SEQ ID NO: 3145817 - RNA, 21 nt, Human
ucuuaauuaaaagaauauuuu

SEQ ID NO: 3145818 - RNA, 14 nt, Human
ucuuaauuaaaaga

SEQ ID NO: 3145819 - RNA, 14 nt, Human
ucugucagcugcaa

SEQ ID NO: 3145820 - RNA, 13 nt, Human
ucugucagcugca

SEQ ID NO: 3145821 - RNA, 18 nt, Human
ucuguuuuauaauuuugu

SEQ ID NO: 3145822 - RNA, 16 nt, Human
ucuggcccaccagggu

SEQ ID NO: 3145823 - RNA, 14 nt, Human
ucuggcccaccagg

SEQ ID NO: 3145824 - RNA, 12 nt, Human
ucugcuugccau

SEQ ID NO: 3145825 - RNA, 21 nt, Human
agaagaacugaaaucauacuu

SEQ ID NO: 3145826 - RNA, 17 nt, Human
ucugcuaccucacuggg

SEQ ID NO: 3145827 - RNA, 14 nt, Human
ucugcuaccucacu

SEQ ID NO: 3145828 - RNA, 11 nt, Human
ucugcuugcca

SEQ ID NO: 3145829 - RNA, 21 nt, Human
ucugagaaagacuauucaaac

SEQ ID NO: 3145830 - RNA, 22 nt, Human
ucugagaaagacuauucaaaca

SEQ ID NO: 3145831 - RNA, 23 nt, Human
ucugagaaagacuauucaaacag

SEQ ID NO: 3145832 - RNA, 19 nt, Human
agaaagacuauucaaacag

SEQ ID NO: 3145833 - RNA, 18 nt, Human
agaaagacuauucaaaca

SEQ ID NO: 3145834 - RNA, 20 nt, Human
agaaagacuauucaaacagu

SEQ ID NO: 3145835 - RNA, 23 nt, Human
agaaagacuauucaaacagucuc

SEQ ID NO: 3145836 - RNA, 14 nt, Human
ucugagaaagacua

SEQ ID NO: 3145837 - RNA, 15 nt, Human
ucugagaaagacuau

SEQ ID NO: 3145838 - RNA, 19 nt, Human
ucugagaaagacuauucaa

SEQ ID NO: 3145839 - RNA, 20 nt, Human
ucugagaaagacuauucaaa

SEQ ID NO: 3145840 - RNA, 21 nt, Human
ucugacuguuuccaucaaggg

SEQ ID NO: 3145841 - RNA, 14 nt, Human
agaacucccuuuca

SEQ ID NO: 3145842 - RNA, 13 nt, Human
agaaacuggaacu

SEQ ID NO: 3145843 - RNA, 14 nt, Human
agaaagaaaaucag

SEQ ID NO: 3145844 - RNA, 15 nt, Human
agaaacauuugguaa

SEQ ID NO: 3145845 - RNA, 19 nt, Human
agaaaacaaggaugaauua

SEQ ID NO: 3145846 - RNA, 16 nt, Human
agaaaacaaggaugaa

SEQ ID NO: 3145847 - RNA, 13 nt, Human
ucucuucuuuaaa

SEQ ID NO: 3145848 - RNA, 12 nt, Human
ucucuucuuuaa

SEQ ID NO: 3145849 - RNA, 17 nt, Human
ucucuggccuucggccu

SEQ ID NO: 3145850 - RNA, 16 nt, Human
ucucuggccuucggcc

SEQ ID NO: 3145851 - RNA, 13 nt, Human
ucucuggccuucg

SEQ ID NO: 3145852 - RNA, 15 nt, Human
ucuccucucucugua

SEQ ID NO: 3145853 - RNA, 15 nt, Human
ucucccagucauuua

SEQ ID NO: 3145854 - RNA, 22 nt, Human
acuuuuuauggcacuaguauuu

SEQ ID NO: 3145855 - RNA, 11 nt, Human
acuuuuucuga

SEQ ID NO: 3145856 - RNA, 12 nt, Human
acuuuuucugau

SEQ ID NO: 3145857 - RNA, 22 nt, Human
acuuuugugaauuaggcuguaa

SEQ ID NO: 3145858 - RNA, 23 nt, Human
acuuuuuuucuguaccaguuaau

SEQ ID NO: 3145859 - RNA, 21 nt, Human
acuuuuuuucuguaccaguua

SEQ ID NO: 3145860 - RNA, 20 nt, Human
acuuuuuuucuguaccaguu

SEQ ID NO: 3145861 - RNA, 23 nt, Human
uccaacuacuaauagaauaaagg

SEQ ID NO: 3145862 - RNA, 21 nt, Human
uccaacuacuaauagaauaaa

SEQ ID NO: 3145863 - RNA, 20 nt, Human
uccaacuacuaauagaauaa

SEQ ID NO: 3145864 - RNA, 23 nt, Human
accuuauaguuacuguguaauua

SEQ ID NO: 3145865 - RNA, 22 nt, Human
accuuauaguuacuguguaauu

SEQ ID NO: 3145866 - RNA, 20 nt, Human
accuuauaguuacuguguaa

SEQ ID NO: 3145867 - RNA, 19 nt, Human
accuuauaguuacugugua

SEQ ID NO: 3145868 - RNA, 18 nt, Human
accuuauaguuacugugu

SEQ ID NO: 3145869 - RNA, 14 nt, Human
accuuauaguuacu

SEQ ID NO: 3145870 - RNA, 12 nt, Human
accuuauaguua

SEQ ID NO: 3145871 - RNA, 20 nt, Human
uccagccugagcgacaguga

SEQ ID NO: 3145872 - RNA, 21 nt, Human
uccagccugagcgacagugag

SEQ ID NO: 3145873 - RNA, 22 nt, Human
ucaugaauuaguuuuauaugcu

SEQ ID NO: 3145874 - RNA, 21 nt, Human
ucaugaauuaguuuuauaugc

SEQ ID NO: 3145875 - RNA, 23 nt, Human
ucauguuaguuaccuuauaguua

SEQ ID NO: 3145876 - RNA, 19 nt, Human
ucauguuaguuaccuuaua

SEQ ID NO: 3145877 - RNA, 15 nt, Human
ucauguuaguuaccu

SEQ ID NO: 3145878 - RNA, 20 nt, Human
ucauugacuaucaaacugaa

SEQ ID NO: 3145879 - RNA, 21 nt, Human
ucauugacuaucaaacugaag

SEQ ID NO: 3145880 - RNA, 21 nt, Human
accucacugggguccuggggc

SEQ ID NO: 3145881 - RNA, 23 nt, Human
accucacugggguccuggggccu

SEQ ID NO: 3145882 - RNA, 21 nt, Human
accuaagauuacaaaucagaa

SEQ ID NO: 3145883 - RNA, 18 nt, Human
accguuggggauugggga

SEQ ID NO: 3145884 - RNA, 23 nt, Human
accacuuguguuuugcaagccag

SEQ ID NO: 3145885 - RNA, 19 nt, Human
accacuuguguuuugcaag

SEQ ID NO: 3145886 - RNA, 14 nt, Human
ucaccucauggaau

SEQ ID NO: 3145887 - RNA, 17 nt, Human
accaggagucccuggua

SEQ ID NO: 3145888 - RNA, 22 nt, Human
accaggagucccugguaauaag

SEQ ID NO: 3145889 - RNA, 11 nt, Human
accacagcagu

SEQ ID NO: 3145890 - RNA, 12 nt, Human
uauuucauuucu

SEQ ID NO: 3145891 - RNA, 18 nt, Human
accacuuguguuuugcaa

SEQ ID NO: 3145892 - RNA, 19 nt, Human
accacugcagaagacagua

SEQ ID NO: 3145893 - RNA, 14 nt, Human
accacugcagaaga

SEQ ID NO: 3145894 - RNA, 13 nt, Human
accacugcagaag

SEQ ID NO: 3145895 - RNA, 14 nt, Human
accagggacugagg

SEQ ID NO: 3145896 - RNA, 13 nt, Human
accaguuaauuuu

SEQ ID NO: 3145897 - RNA, 12 nt, Human
accaguuaauuu

SEQ ID NO: 3145898 - RNA, 16 nt, Human
accaguucucaugggu

SEQ ID NO: 3145899 - RNA, 16 nt, Human
accaguuaauuuuucc

SEQ ID NO: 3145900 - RNA, 14 nt, Human
accaguuaauuuuu

SEQ ID NO: 3145901 - RNA, 21 nt, Human
accaguucucauggguggcac

SEQ ID NO: 3145902 - RNA, 22 nt, Human
ucaccuggacuuaagcaucugg

SEQ ID NO: 3145903 - RNA, 20 nt, Human
acccaaauguucaucaauga

SEQ ID NO: 3145904 - RNA, 18 nt, Human
acccaaaaggcagaagca

SEQ ID NO: 3145905 - RNA, 21 nt, Human
acccaaauguucaucaaugaa

SEQ ID NO: 3145906 - RNA, 15 nt, Human
acccaaaaggcagaa

SEQ ID NO: 3145907 - RNA, 13 nt, Human
acccaaaaggcag

SEQ ID NO: 3145908 - RNA, 18 nt, Human
ucagaugcacaugagcug

SEQ ID NO: 3145909 - RNA, 19 nt, Human
accccauggagcugggcua

SEQ ID NO: 3145910 - RNA, 21 nt, Human
acuccaaagaaauguaaggga

SEQ ID NO: 3145911 - RNA, 14 nt, Human
uccucacuguaucc

SEQ ID NO: 3145912 - RNA, 20 nt, Human
uccucaaaacuucagacaua

SEQ ID NO: 3145913 - RNA, 15 nt, Human
uccucaaagaaagug

SEQ ID NO: 3145914 - RNA, 18 nt, Human
uccucaaagaaaguguau

SEQ ID NO: 3145915 - RNA, 16 nt, Human
uccucaaagaaagugu

SEQ ID NO: 3145916 - RNA, 19 nt, Human
uccucaaagaaaguguauu

SEQ ID NO: 3145917 - RNA, 13 nt, Human
uccccuugcccag

SEQ ID NO: 3145918 - RNA, 15 nt, Human
uccccuugcccaggg

SEQ ID NO: 3145919 - RNA, 16 nt, Human
uccccuugcccagggc

SEQ ID NO: 3145920 - RNA, 12 nt, Human
uccccuccucug

SEQ ID NO: 3145921 - RNA, 13 nt, Human
acuaaaaauacaa

SEQ ID NO: 3145922 - RNA, 20 nt, Human
acuaaagcaguggacaccag

SEQ ID NO: 3145923 - RNA, 22 nt, Human
acugccuucucaacuccaaacu

SEQ ID NO: 3145924 - RNA, 20 nt, Human
acugccuucucaacuccaaa

SEQ ID NO: 3145925 - RNA, 18 nt, Human
acuggccuuuuucauuua

SEQ ID NO: 3145926 - RNA, 21 nt, Human
acuggcacaguuuucugagaa

SEQ ID NO: 3145927 - RNA, 22 nt, Human
acuggcacaguuuucugagaaa

SEQ ID NO: 3145928 - RNA, 13 nt, Human
uccuucagccuga

SEQ ID NO: 3145929 - RNA, 22 nt, Human
acugaggggaggggagcauggg

SEQ ID NO: 3145930 - RNA, 17 nt, Human
acugaggggaggggagc

SEQ ID NO: 3145931 - RNA, 13 nt, Human
acugaggcagaca

SEQ ID NO: 3145932 - RNA, 15 nt, Human
acugaggcagacagc

SEQ ID NO: 3145933 - RNA, 19 nt, Human
acugaggcagacagcagcu

SEQ ID NO: 3145934 - RNA, 22 nt, Human
acugaggcagacagcagcucag

SEQ ID NO: 3145935 - RNA, 23 nt, Human
acugaggcagacagcagcucagg

SEQ ID NO: 3145936 - RNA, 14 nt, Human
uccugggcagcugc

SEQ ID NO: 3145937 - RNA, 15 nt, Human
uccugggcagcugcc

SEQ ID NO: 3145938 - RNA, 16 nt, Human
uccugggcagcugccu

SEQ ID NO: 3145939 - RNA, 17 nt, Human
uccugggcagcugccuc

SEQ ID NO: 3145940 - RNA, 18 nt, Human
uccugggcagcugccucc

SEQ ID NO: 3145941 - RNA, 19 nt, Human
uccugggcagcugccuccc

SEQ ID NO: 3145942 - RNA, 22 nt, Human
uccugggcagcugccuccccuc

SEQ ID NO: 3145943 - RNA, 23 nt, Human
uccugggcagcugccuccccucc

SEQ ID NO: 3145944 - RNA, 21 nt, Human
uccuggggccucggagccuca

SEQ ID NO: 3145945 - RNA, 22 nt, Human
uccuggggccucggagccucau

SEQ ID NO: 3145946 - RNA, 13 nt, Human
uccuggggccucg

SEQ ID NO: 3145947 - RNA, 22 nt, Human
uccugucugccagccagcagcc

SEQ ID NO: 3145948 - RNA, 16 nt, Human
aaggaaaaaauaacaa

SEQ ID NO: 3145949 - RNA, 19 nt, Human
guucugugguuucauguua

SEQ ID NO: 3145950 - RNA, 16 nt, Human
guucugugguuucaug

SEQ ID NO: 3145951 - RNA, 21 nt, Human
guucugugguuucauguuagu

SEQ ID NO: 3145952 - RNA, 19 nt, Human
guucucauggguggcacuc

SEQ ID NO: 3145953 - RNA, 15 nt, Human
guuuucugagaaaga

SEQ ID NO: 3145954 - RNA, 22 nt, Human
guuuuauaauuuugugaagcaa

SEQ ID NO: 3145955 - RNA, 15 nt, Human
guuuuauaauuuugu

SEQ ID NO: 3145956 - RNA, 11 nt, Human
guuuggccaga

SEQ ID NO: 3145957 - RNA, 23 nt, Human
guuuggccagaagucaaggcuua

SEQ ID NO: 3145958 - RNA, 18 nt, Human
guuuggccagaagucaag

SEQ ID NO: 3145959 - RNA, 12 nt, Human
guuuggccagaa

SEQ ID NO: 3145960 - RNA, 21 nt, Human
aagggugaugggaaagcauug

SEQ ID NO: 3145961 - RNA, 19 nt, Human
aagggugaugggaaagcau

SEQ ID NO: 3145962 - RNA, 15 nt, Human
aaguaaaaccacagc

SEQ ID NO: 3145963 - RNA, 16 nt, Human
aaguaaaaccacagca

SEQ ID NO: 3145964 - RNA, 14 nt, Human
aaguaaaaccacag

SEQ ID NO: 3145965 - RNA, 21 nt, Human
guuucuagcaugaagacagag

SEQ ID NO: 3145966 - RNA, 17 nt, Human
aaguaaaaccacagcag

SEQ ID NO: 3145967 - RNA, 18 nt, Human
aaguaaaaccacagcagu

SEQ ID NO: 3145968 - RNA, 21 nt, Human
aaguauguuagugcaaauugu

SEQ ID NO: 3145969 - RNA, 23 nt, Human
aaguauguuagugcaaauuguca

SEQ ID NO: 3145970 - RNA, 22 nt, Human
guuuucugagaaagacuauuca

SEQ ID NO: 3145971 - RNA, 16 nt, Human
guuuucugagaaagac

SEQ ID NO: 3145972 - RNA, 17 nt, Human
guuuucugagaaagacu

SEQ ID NO: 3145973 - RNA, 22 nt, Human
aagucaaggcuuagacccucau

SEQ ID NO: 3145974 - RNA, 13 nt, Human
aagucaaggcuua

SEQ ID NO: 3145975 - RNA, 23 nt, Human
guuuuuuuuuaaaaaagaaacau

SEQ ID NO: 3145976 - RNA, 23 nt, Human
aagucaucuugcuaccaguauuu

SEQ ID NO: 3145977 - RNA, 20 nt, Human
aagucaucuugcuaccagua

SEQ ID NO: 3145978 - RNA, 14 nt, Human
aagucaucuugcua

SEQ ID NO: 3145979 - RNA, 13 nt, Human
aagucaucuugcu

SEQ ID NO: 3145980 - RNA, 13 nt, Human
uaacaaugcugua

SEQ ID NO: 3145981 - RNA, 17 nt, Human
uaacaaugcuguauuuu

SEQ ID NO: 3145982 - RNA, 15 nt, Human
uaacaaugcuguauu

SEQ ID NO: 3145983 - RNA, 17 nt, Human
uaaaugauuucauucaa

SEQ ID NO: 3145984 - RNA, 15 nt, Human
uaaauguugacaugg

SEQ ID NO: 3145985 - RNA, 14 nt, Human
aauacacacucaaa

SEQ ID NO: 3145986 - RNA, 19 nt, Human
aauaauguuucaaacauau

SEQ ID NO: 3145987 - RNA, 15 nt, Human
aauaaauauaucuac

SEQ ID NO: 3145988 - RNA, 23 nt, Human
aauaaauauaucuaccccagacu

SEQ ID NO: 3145989 - RNA, 12 nt, Human
aauaaaugugcc

SEQ ID NO: 3145990 - RNA, 21 nt, Human
aauaaaugugccuucauuuuu

SEQ ID NO: 3145991 - RNA, 15 nt, Human
aauaacgauaaaaga

SEQ ID NO: 3145992 - RNA, 15 nt, Human
aauaacaauaaaaga

SEQ ID NO: 3145993 - RNA, 17 nt, Human
uaaagucagauggaaaa

SEQ ID NO: 3145994 - RNA, 13 nt, Human
uaaagucagaugg

SEQ ID NO: 3145995 - RNA, 15 nt, Human
uaaagucagauggaa

SEQ ID NO: 3145996 - RNA, 12 nt, Human
aauaaaaauaau

SEQ ID NO: 3145997 - RNA, 15 nt, Human
aauaaaggcaguuuu

SEQ ID NO: 3145998 - RNA, 18 nt, Human
aauaaaggcaguuuucua

SEQ ID NO: 3145999 - RNA, 16 nt, Human
aauaaaggcaguuuuc

SEQ ID NO: 3146000 - RNA, 19 nt, Human
aauaaaggcaguuuucuaa

SEQ ID NO: 3146001 - RNA, 22 nt, Human
aauaaaauccauacauuugugu

SEQ ID NO: 3146002 - RNA, 19 nt, Human
uaaaccaaggcuagaacca

SEQ ID NO: 3146003 - RNA, 12 nt, Human
uaaacucauuuc

SEQ ID NO: 3146004 - RNA, 17 nt, Human
uaaacucauuucuagca

SEQ ID NO: 3146005 - RNA, 13 nt, Human
uaaagaaagugua

SEQ ID NO: 3146006 - RNA, 11 nt, Human
uaaagaaagug

SEQ ID NO: 3146007 - RNA, 17 nt, Human
uaaagaaaguguauuug

SEQ ID NO: 3146008 - RNA, 16 nt, Human
uaaagaaaguguauuu

SEQ ID NO: 3146009 - RNA, 15 nt, Human
uaaagaaaguguauu

SEQ ID NO: 3146010 - RNA, 14 nt, Human
uaaagaaaguguau

SEQ ID NO: 3146011 - RNA, 23 nt, Human
uaaagaaaguguauuuggaaaua

SEQ ID NO: 3146012 - RNA, 20 nt, Human
uaaagaaaguguauuuggaa

SEQ ID NO: 3146013 - RNA, 24 nt, Human
uaaagaaaguguauuuggaaauaa

SEQ ID NO: 3146014 - RNA, 21 nt, Human
guccuuuugacacugcucuaa

SEQ ID NO: 3146015 - RNA, 12 nt, Human
aaccacagcagu

SEQ ID NO: 3146016 - RNA, 23 nt, Human
gucucaguccaugaagauguaga

SEQ ID NO: 3146017 - RNA, 16 nt, Human
aacauauauaacaaug

SEQ ID NO: 3146018 - RNA, 19 nt, Human
aacagauuauuaccuuaca

SEQ ID NO: 3146019 - RNA, 19 nt, Human
aacagucucaggaaaucaa

SEQ ID NO: 3146020 - RNA, 17 nt, Human
aacagucucaggaaauc

SEQ ID NO: 3146021 - RNA, 23 nt, Human
guccaugaagauguagaggagaa

SEQ ID NO: 3146022 - RNA, 20 nt, Human
aacuaucucauuuccaagca

SEQ ID NO: 3146023 - RNA, 13 nt, Human
aacuauauuguuu

SEQ ID NO: 3146024 - RNA, 14 nt, Human
gugagucaccacuu

SEQ ID NO: 3146025 - RNA, 20 nt, Human
aacugaaaucauacuucuua

SEQ ID NO: 3146026 - RNA, 13 nt, Human
aacugaaaucaua

SEQ ID NO: 3146027 - RNA, 11 nt, Human
aacuaacaugu

SEQ ID NO: 3146028 - RNA, 15 nt, Human
aacuaacauguccug

SEQ ID NO: 3146029 - RNA, 14 nt, Human
aacuaacauguccu

SEQ ID NO: 3146030 - RNA, 17 nt, Human
aacuacuuuauaacuaa

SEQ ID NO: 3146031 - RNA, 15 nt, Human
aacuacuuuauaacu

SEQ ID NO: 3146032 - RNA, 13 nt, Human
aacuacuuuauaa

SEQ ID NO: 3146033 - RNA, 13 nt, Human
gucuucacaacag

SEQ ID NO: 3146034 - RNA, 12 nt, Human
gucuucagccua

SEQ ID NO: 3146035 - RNA, 23 nt, Human
gucuucagccuagccgaccucag

SEQ ID NO: 3146036 - RNA, 13 nt, Human
gucuucagccuag

SEQ ID NO: 3146037 - RNA, 15 nt, Human
gucuucagccuagcc

SEQ ID NO: 3146038 - RNA, 15 nt, Human
guggcagaguuacag

SEQ ID NO: 3146039 - RNA, 13 nt, Human
aagaauauuuuaa

SEQ ID NO: 3146040 - RNA, 13 nt, Human
aagacccaaaagg

SEQ ID NO: 3146041 - RNA, 15 nt, Human
guggacaccaggagu

SEQ ID NO: 3146042 - RNA, 21 nt, Human
guggacaccaggagucccugg

SEQ ID NO: 3146043 - RNA, 22 nt, Human
guggacaccaggagucccuggu

SEQ ID NO: 3146044 - RNA, 22 nt, Human
aagaagcaccaaucaugaauua

SEQ ID NO: 3146045 - RNA, 13 nt, Human
aagaaaauaucac

SEQ ID NO: 3146046 - RNA, 18 nt, Human
aagaaaguguauuuggaa

SEQ ID NO: 3146047 - RNA, 15 nt, Human
aagaaaguguauuug

SEQ ID NO: 3146048 - RNA, 12 nt, Human
aagaaaguguau

SEQ ID NO: 3146049 - RNA, 18 nt, Human
gugcacgcacacugucug

SEQ ID NO: 3146050 - RNA, 14 nt, Human
guggguagacacac

SEQ ID NO: 3146051 - RNA, 18 nt, Human
aagagcuguucacagcca

SEQ ID NO: 3146052 - RNA, 13 nt, Human
aagacuauucaaa

SEQ ID NO: 3146053 - RNA, 14 nt, Human
aagacuauucaaac

SEQ ID NO: 3146054 - RNA, 14 nt, Human
aagacuccaaagaa

SEQ ID NO: 3146055 - RNA, 16 nt, Human
aagacuccaaagaaau

SEQ ID NO: 3146056 - RNA, 17 nt, Human
aagacuccaaagaaaug

SEQ ID NO: 3146057 - RNA, 17 nt, Human
aagacugcauuauauuu

SEQ ID NO: 3146058 - RNA, 14 nt, Human
guguguuauuuaaa

SEQ ID NO: 3146059 - RNA, 16 nt, Human
aagcaaguauuagaau

SEQ ID NO: 3146060 - RNA, 19 nt, Human
aagcaaaauuuuuucucua

SEQ ID NO: 3146061 - RNA, 19 nt, Human
aagauguagaggagaaacu

SEQ ID NO: 3146062 - RNA, 13 nt, Human
aagcaaaauguga

SEQ ID NO: 3146063 - RNA, 22 nt, Human
aagauguagaggagaaacugga

SEQ ID NO: 3146064 - RNA, 18 nt, Human
uauaacaaugcuguauuu

SEQ ID NO: 3146065 - RNA, 14 nt, Human
uauaauuuugugaa

SEQ ID NO: 3146066 - RNA, 12 nt, Human
uauaggaauuga

SEQ ID NO: 3146067 - RNA, 13 nt, Human
uauaggaauugac

SEQ ID NO: 3146068 - RNA, 14 nt, Human
uauaggaauugacc

SEQ ID NO: 3146069 - RNA, 21 nt, Human
uauaggugcuacaaaaacaca

SEQ ID NO: 3146070 - RNA, 20 nt, Human
uauaggugcuacaaaaacac

SEQ ID NO: 3146071 - RNA, 23 nt, Human
uauaggugcuacaaaaacacagc

SEQ ID NO: 3146072 - RNA, 16 nt, Human
uaguuuuauaugcuuc

SEQ ID NO: 3146073 - RNA, 15 nt, Human
uaguuuuauaugcuu

SEQ ID NO: 3146074 - RNA, 19 nt, Human
uaguuacuguguaauuagu

SEQ ID NO: 3146075 - RNA, 18 nt, Human
uaguuacuguguaauuag

SEQ ID NO: 3146076 - RNA, 17 nt, Human
uaguuacuguguaauua

SEQ ID NO: 3146077 - RNA, 22 nt, Human
uagugagcagucaggaaagaga

SEQ ID NO: 3146078 - RNA, 22 nt, Human
acacaucagcuugcccuguuaa

SEQ ID NO: 3146079 - RNA, 22 nt, Human
uauaaaauaauuuuuauauuug

SEQ ID NO: 3146080 - RNA, 21 nt, Human
uauaaaauaauuuuuauauuu

SEQ ID NO: 3146081 - RNA, 19 nt, Human
acaccaggagucccuggua

SEQ ID NO: 3146082 - RNA, 17 nt, Human
acaccaggagucccugg

SEQ ID NO: 3146083 - RNA, 17 nt, Human
uauggcuauaggugcua

SEQ ID NO: 3146084 - RNA, 16 nt, Human
uauggcuauaggugcu

SEQ ID NO: 3146085 - RNA, 17 nt, Human
acagcagcucaggcaca

SEQ ID NO: 3146086 - RNA, 15 nt, Human
acagcagcucaggca

SEQ ID NO: 3146087 - RNA, 16 nt, Human
acagcagcucaggcac

SEQ ID NO: 3146088 - RNA, 14 nt, Human
acagcagcucaggc

SEQ ID NO: 3146089 - RNA, 15 nt, Human
uauauuuacaaaugg

SEQ ID NO: 3146090 - RNA, 14 nt, Human
uauauuuacaaaug

SEQ ID NO: 3146091 - RNA, 12 nt, Human
uauuaaaacuca

SEQ ID NO: 3146092 - RNA, 23 nt, Human
uauucauagcagcuuauucacaa

SEQ ID NO: 3146093 - RNA, 15 nt, Human
uauuagaauaccaca

SEQ ID NO: 3146094 - RNA, 15 nt, Human
uauuaccccuuuucg

SEQ ID NO: 3146095 - RNA, 21 nt, Human
acaguauggcagcuuuccuca

SEQ ID NO: 3146096 - RNA, 13 nt, Human
acagucucaggaa

SEQ ID NO: 3146097 - RNA, 14 nt, Human
acagucucaggaaa

SEQ ID NO: 3146098 - RNA, 15 nt, Human
acagucucaggaaau

SEQ ID NO: 3146099 - RNA, 16 nt, Human
acagucucaggaaauc

SEQ ID NO: 3146100 - RNA, 17 nt, Human
acagucucaggaaauca

SEQ ID NO: 3146101 - RNA, 20 nt, Human
acagugaaagaaaauaacaa

SEQ ID NO: 3146102 - RNA, 21 nt, Human
acaguuaccucugccucagaa

SEQ ID NO: 3146103 - RNA, 18 nt, Human
acagugagacucugucuc

SEQ ID NO: 3146104 - RNA, 14 nt, Human
acagugagacucug

SEQ ID NO: 3146105 - RNA, 20 nt, Human
uauugguuuaaagaaagugu

SEQ ID NO: 3146106 - RNA, 23 nt, Human
acaguucggugagcuacaaaugc

SEQ ID NO: 3146107 - RNA, 22 nt, Human
acaguucggugagcuacaaaug

SEQ ID NO: 3146108 - RNA, 19 nt, Human
acaguucggugagcuacaa

SEQ ID NO: 3146109 - RNA, 22 nt, Human
acaguucugugguuucauguua

SEQ ID NO: 3146110 - RNA, 12 nt, Human
acaguucugugg

SEQ ID NO: 3146111 - RNA, 17 nt, Human
uauugucuagugaaacu

SEQ ID NO: 3146112 - RNA, 16 nt, Human
uauuuauuuuaauaau

SEQ ID NO: 3146113 - RNA, 14 nt, Human
uauuuauuuuaaua

SEQ ID NO: 3146114 - RNA, 18 nt, Human
uauuuauuuuaauaaugu

SEQ ID NO: 3146115 - RNA, 19 nt, Human
aauugacccacaagaaaug

SEQ ID NO: 3146116 - RNA, 16 nt, Human
aauugacccacaagaa

SEQ ID NO: 3146117 - RNA, 13 nt, Human
aauugacccacaa

SEQ ID NO: 3146118 - RNA, 21 nt, Human
aauucuugccaaauauaaaua

SEQ ID NO: 3146119 - RNA, 20 nt, Human
aauuucucccagucauuuaa

SEQ ID NO: 3146120 - RNA, 19 nt, Human
aauuucucccagucauuua

SEQ ID NO: 3146121 - RNA, 17 nt, Human
aauuuaccuaagauuac

SEQ ID NO: 3146122 - RNA, 16 nt, Human
aauuuaccuaagauua

SEQ ID NO: 3146123 - RNA, 14 nt, Human
aauuuaccuaagau

SEQ ID NO: 3146124 - RNA, 13 nt, Human
aauuuaccuaaga

SEQ ID NO: 3146125 - RNA, 21 nt, Human
aauuuaccuaagauuacaaau

SEQ ID NO: 3146126 - RNA, 18 nt, Human
aauuuaccuaagauuaca

SEQ ID NO: 3146127 - RNA, 19 nt, Human
uacuucaaauccuugaaga

SEQ ID NO: 3146128 - RNA, 14 nt, Human
uacuucaaauccuu

SEQ ID NO: 3146129 - RNA, 23 nt, Human
aauugugugaaagguacuucaaa

SEQ ID NO: 3146130 - RNA, 19 nt, Human
uagaugcaguucugaagaa

SEQ ID NO: 3146131 - RNA, 17 nt, Human
uagaugcaguucugaag

SEQ ID NO: 3146132 - RNA, 16 nt, Human
uagaugcaguucugaa

SEQ ID NO: 3146133 - RNA, 18 nt, Human
uagcaugucgucaaagcu

SEQ ID NO: 3146134 - RNA, 21 nt, Human
uagcaugucgucaaagcugaa

SEQ ID NO: 3146135 - RNA, 18 nt, Human
acaagcacuaaacaaaga

SEQ ID NO: 3146136 - RNA, 22 nt, Human
acaagaaaugaaagcagggacu

SEQ ID NO: 3146137 - RNA, 21 nt, Human
uacuucaaauccuugaagauu

SEQ ID NO: 3146138 - RNA, 18 nt, Human
uagaacucccuuucaaca

SEQ ID NO: 3146139 - RNA, 16 nt, Human
acaaaaacacagcaag

SEQ ID NO: 3146140 - RNA, 19 nt, Human
aauuuuuucucuaggaaau

SEQ ID NO: 3146141 - RNA, 20 nt, Human
aauuuuuccaacuacuaaua

SEQ ID NO: 3146142 - RNA, 14 nt, Human
aauuuuuccaacua

SEQ ID NO: 3146143 - RNA, 19 nt, Human
aauuuuuauauuugaaaua

SEQ ID NO: 3146144 - RNA, 18 nt, Human
aauguugacaugggacau

SEQ ID NO: 3146145 - RNA, 22 nt, Human
uaccccagacuagauguaguau

SEQ ID NO: 3146146 - RNA, 21 nt, Human
uaccccagacuagauguagua

SEQ ID NO: 3146147 - RNA, 20 nt, Human
uaccccauggagcugggcua

SEQ ID NO: 3146148 - RNA, 16 nt, Human
aaugguuuaaaugguc

SEQ ID NO: 3146149 - RNA, 21 nt, Human
uaauucacagugcucuuuucu

SEQ ID NO: 3146150 - RNA, 14 nt, Human
uaauucacagugcu

SEQ ID NO: 3146151 - RNA, 22 nt, Human
uaauucacagugcucuuuucuc

SEQ ID NO: 3146152 - RNA, 16 nt, Human
uacaaaaacacagcaa

SEQ ID NO: 3146153 - RNA, 17 nt, Human
uacaaaaacacagcaag

SEQ ID NO: 3146154 - RNA, 18 nt, Human
uacaaaaacacagcaagg

SEQ ID NO: 3146155 - RNA, 22 nt, Human
uaauuuaccuaagauuacaaau

SEQ ID NO: 3146156 - RNA, 21 nt, Human
uaauuuaccuaagauuacaaa

SEQ ID NO: 3146157 - RNA, 22 nt, Human
uaauagaauaaaggcaguuuuc

SEQ ID NO: 3146158 - RNA, 20 nt, Human
uaauagaauaaaggcaguuu

SEQ ID NO: 3146159 - RNA, 16 nt, Human
uaauagaauaaaggca

SEQ ID NO: 3146160 - RNA, 14 nt, Human
uaauagaauaaagg

SEQ ID NO: 3146161 - RNA, 15 nt, Human
aaugaaugaaugaau

SEQ ID NO: 3146162 - RNA, 20 nt, Human
aaugaauacuuuauaaagga

SEQ ID NO: 3146163 - RNA, 22 nt, Human
gcuaauucaaggaauuucuuaa

SEQ ID NO: 3146164 - RNA, 17 nt, Human
gcuaauucaaggaauuu

SEQ ID NO: 3146165 - RNA, 16 nt, Human
gcuagaacucccuuuc

SEQ ID NO: 3146166 - RNA, 15 nt, Human
gcuagaacucccuuu

SEQ ID NO: 3146167 - RNA, 14 nt, Human
gcuagaacucccuu

SEQ ID NO: 3146168 - RNA, 13 nt, Human
gcuagaacucccu

SEQ ID NO: 3146169 - RNA, 12 nt, Human
gcuagaacuccc

SEQ ID NO: 3146170 - RNA, 21 nt, Human
gcuccccucggagaagagcug

SEQ ID NO: 3146171 - RNA, 18 nt, Human
gcuccccucggagaagag

SEQ ID NO: 3146172 - RNA, 18 nt, Human
gcuccacuuggucuguga

SEQ ID NO: 3146173 - RNA, 15 nt, Human
gcuccacuuggucug

SEQ ID NO: 3146174 - RNA, 19 nt, Human
gcuccaccuugcagcucuc

SEQ ID NO: 3146175 - RNA, 12 nt, Human
gcucgguggacc

SEQ ID NO: 3146176 - RNA, 14 nt, Human
gcucgguggaccca

SEQ ID NO: 3146177 - RNA, 17 nt, Human
gcucgguggacccaggg

SEQ ID NO: 3146178 - RNA, 18 nt, Human
gcucgguggacccaggga

SEQ ID NO: 3146179 - RNA, 15 nt, Human
gcucuaacagcccuc

SEQ ID NO: 3146180 - RNA, 15 nt, Human
gccucuuagaugcag

SEQ ID NO: 3146181 - RNA, 21 nt, Human
gccuucggccuccauccugag

SEQ ID NO: 3146182 - RNA, 19 nt, Human
gccuucggccuccauccug

SEQ ID NO: 3146183 - RNA, 20 nt, Human
gccuucggccuccauccuga

SEQ ID NO: 3146184 - RNA, 19 nt, Human
gccuagccgaccucagccu

SEQ ID NO: 3146185 - RNA, 20 nt, Human
gccuagccgaccucagccuu

SEQ ID NO: 3146186 - RNA, 15 nt, Human
gccuagccgaccuca

SEQ ID NO: 3146187 - RNA, 16 nt, Human
gccuagccgaccucag

SEQ ID NO: 3146188 - RNA, 17 nt, Human
gccuagccgaccucagc

SEQ ID NO: 3146189 - RNA, 18 nt, Human
gccuagccgaccucagcc

SEQ ID NO: 3146190 - RNA, 19 nt, Human
gcucuggggugggcaguuu

SEQ ID NO: 3146191 - RNA, 21 nt, Human
gcucuggggugggcaguuuuu

SEQ ID NO: 3146192 - RNA, 13 nt, Human
ggagaaacuggaa

SEQ ID NO: 3146193 - RNA, 22 nt, Human
ggacucauuuuaaaaaauggaa

SEQ ID NO: 3146194 - RNA, 10 nt, Human
ggcaguuuuu

SEQ ID NO: 3146195 - RNA, 20 nt, Human
ggcagacagcagcucaggca

SEQ ID NO: 3146196 - RNA, 13 nt, Human
ggcagacagcagc

SEQ ID NO: 3146197 - RNA, 14 nt, Human
ggcagacagcagcu

SEQ ID NO: 3146198 - RNA, 15 nt, Human
ggcagacagcagcuc

SEQ ID NO: 3146199 - RNA, 16 nt, Human
ggcagacagcagcuca

SEQ ID NO: 3146200 - RNA, 17 nt, Human
ggcagacagcagcucag

SEQ ID NO: 3146201 - RNA, 18 nt, Human
ggcagacagcagcucagg

SEQ ID NO: 3146202 - RNA, 19 nt, Human
ggcagacagcagcucaggc

SEQ ID NO: 3146203 - RNA, 21 nt, Human
ggcacaguuuucugagaaaga

SEQ ID NO: 3146204 - RNA, 13 nt, Human
ggccuccauccug

SEQ ID NO: 3146205 - RNA, 15 nt, Human
ggccuccauccugag

SEQ ID NO: 3146206 - RNA, 14 nt, Human
ggccuccauccuga

SEQ ID NO: 3146207 - RNA, 13 nt, Human
ggcucagccuggu

SEQ ID NO: 3146208 - RNA, 20 nt, Human
ggcucagccuggugggccuc

SEQ ID NO: 3146209 - RNA, 14 nt, Human
ggcuccacuugguc

SEQ ID NO: 3146210 - RNA, 21 nt, Human
gggacagucaccucauggaau

SEQ ID NO: 3146211 - RNA, 20 nt, Human
gggacagucaccucauggaa

SEQ ID NO: 3146212 - RNA, 22 nt, Human
gggacagucaccucauggaauu

SEQ ID NO: 3146213 - RNA, 20 nt, Human
gggaacccaaguccaagcau

SEQ ID NO: 3146214 - RNA, 14 nt, Human
aaaaauaacaauga

SEQ ID NO: 3146215 - RNA, 24 nt, Human
aaaaauaaauauaucuaccccaga

SEQ ID NO: 3146216 - RNA, 18 nt, Human
aaaaauaaauauaucuac

SEQ ID NO: 3146217 - RNA, 22 nt, Human
gggagggguaaaauuccuuagc

SEQ ID NO: 3146218 - RNA, 14 nt, Human
aaaaccacagcagu

SEQ ID NO: 3146219 - RNA, 17 nt, Human
aaaaaugguuuaaaugg

SEQ ID NO: 3146220 - RNA, 15 nt, Human
aaaacuucagacaua

SEQ ID NO: 3146221 - RNA, 18 nt, Human
gguccuuuugacacugcu

SEQ ID NO: 3146222 - RNA, 16 nt, Human
gguccuuuugacacug

SEQ ID NO: 3146223 - RNA, 17 nt, Human
aaagcacugacuucuaa

SEQ ID NO: 3146224 - RNA, 21 nt, Human
aaagcacugacuucuaaguaa

SEQ ID NO: 3146225 - RNA, 14 nt, Human
aaagguacuucaaa

SEQ ID NO: 3146226 - RNA, 14 nt, Human
ggguggggcagugc

SEQ ID NO: 3146227 - RNA, 23 nt, Human
aaacuucagcgguuuauauaagc

SEQ ID NO: 3146228 - RNA, 19 nt, Human
aaacuucagacauagaauu

SEQ ID NO: 3146229 - RNA, 13 nt, Human
aaagacagugaaa

SEQ ID NO: 3146230 - RNA, 17 nt, Human
aaagacuauucaaacag

SEQ ID NO: 3146231 - RNA, 18 nt, Human
aaagacuauucaaacagu

SEQ ID NO: 3146232 - RNA, 19 nt, Human
aaagacuauucaaacaguc

SEQ ID NO: 3146233 - RNA, 21 nt, Human
aaagacuauucaaacagucuc

SEQ ID NO: 3146234 - RNA, 15 nt, Human
aaagacuccaaagaa

SEQ ID NO: 3146235 - RNA, 21 nt, Human
aaagacuccaaagaaauguaa

SEQ ID NO: 3146236 - RNA, 14 nt, Human
aaagacuccaaaga

SEQ ID NO: 3146237 - RNA, 15 nt, Human
aaagaggcagcuuga

SEQ ID NO: 3146238 - RNA, 15 nt, Human
aaagaggaaugaagu

SEQ ID NO: 3146239 - RNA, 19 nt, Human
ggguccuuuugacacugcu

SEQ ID NO: 3146240 - RNA, 22 nt, Human
ggguccuuuugacacugcucua

SEQ ID NO: 3146241 - RNA, 12 nt, Human
aaaccacagcag

SEQ ID NO: 3146242 - RNA, 15 nt, Human
aaacucguuaauuug

SEQ ID NO: 3146243 - RNA, 15 nt, Human
aaacagucucaggaa

SEQ ID NO: 3146244 - RNA, 14 nt, Human
aaacaguagugaua

SEQ ID NO: 3146245 - RNA, 19 nt, Human
ggggaauugaggacacuga

SEQ ID NO: 3146246 - RNA, 12 nt, Human
aaacacagcaag

SEQ ID NO: 3146247 - RNA, 14 nt, Human
aaacacagcaaggg

SEQ ID NO: 3146248 - RNA, 11 nt, Human
aaacacagcaa

SEQ ID NO: 3146249 - RNA, 20 nt, Human
guagacgugcacgcacacug

SEQ ID NO: 3146250 - RNA, 23 nt, Human
guagacgugcacgcacacugucu

SEQ ID NO: 3146251 - RNA, 23 nt, Human
guacuguguacagaauucugcua

SEQ ID NO: 3146252 - RNA, 22 nt, Human
guacuucaaauccuugaagauu

SEQ ID NO: 3146253 - RNA, 21 nt, Human
guacuucaaauccuugaagau

SEQ ID NO: 3146254 - RNA, 12 nt, Human
aaaucagaaguc

SEQ ID NO: 3146255 - RNA, 21 nt, Human
aaaucagaagucaucuugcua

SEQ ID NO: 3146256 - RNA, 18 nt, Human
aaaucagaagucaucuug

SEQ ID NO: 3146257 - RNA, 17 nt, Human
aaauauuauguuaaaac

SEQ ID NO: 3146258 - RNA, 12 nt, Human
aaaucauuucug

SEQ ID NO: 3146259 - RNA, 19 nt, Human
aaaucauuucugcaucagc

SEQ ID NO: 3146260 - RNA, 21 nt, Human
aaaucauuucugcaucagcug

SEQ ID NO: 3146261 - RNA, 22 nt, Human
aaaucauuucugcaucagcugc

SEQ ID NO: 3146262 - RNA, 23 nt, Human
aaaucauuucugcaucagcugcu

SEQ ID NO: 3146263 - RNA, 11 nt, Human
aaaucauuucu

SEQ ID NO: 3146264 - RNA, 23 nt, Human
guaccaguuaauuuuuccaacua

SEQ ID NO: 3146265 - RNA, 22 nt, Human
guaccaguuaauuuuuccaacu

SEQ ID NO: 3146266 - RNA, 20 nt, Human
guaccaguuaauuuuuccaa

SEQ ID NO: 3146267 - RNA, 16 nt, Human
guaccaguuaauuuuu

SEQ ID NO: 3146268 - RNA, 11 nt, Human
guaccaguuaa

SEQ ID NO: 3146269 - RNA, 10 nt, Human
guaccaguua

SEQ ID NO: 3146270 - RNA, 15 nt, Human
aaauccauacauuug

SEQ ID NO: 3146271 - RNA, 20 nt, Human
guaauaggcguaacuaauuu

SEQ ID NO: 3146272 - RNA, 23 nt, Human
aaauaauuuuuauauuugaaaua

SEQ ID NO: 3146273 - RNA, 22 nt, Human
aaauaauuuuuauauuugaaau

SEQ ID NO: 3146274 - RNA, 15 nt, Human
aaauacacacucaaa

SEQ ID NO: 3146275 - RNA, 21 nt, Human
aaauaauuuuuauauuugaaa

SEQ ID NO: 3146276 - RNA, 19 nt, Human
aaauacacacucaaaucaa

SEQ ID NO: 3146277 - RNA, 17 nt, Human
aaaguauguuagugcaa

SEQ ID NO: 3146278 - RNA, 23 nt, Human
aaaguucugcagauaaacaguag

SEQ ID NO: 3146279 - RNA, 18 nt, Human
aaaguauguuagugcaaa

SEQ ID NO: 3146280 - RNA, 20 nt, Human
aaagguauuuuaaucaccaa

SEQ ID NO: 3146281 - RNA, 16 nt, Human
aaaguuggugacagau

SEQ ID NO: 3146282 - RNA, 15 nt, Human
gacuauucaaacagu

SEQ ID NO: 3146283 - RNA, 16 nt, Human
gacuauucaaacaguc

SEQ ID NO: 3146284 - RNA, 20 nt, Human
gacagaaagcagaacaguga

SEQ ID NO: 3146285 - RNA, 21 nt, Human
gacagcccuucuuuccacaga

SEQ ID NO: 3146286 - RNA, 14 nt, Human
gacagaaagcagaa

SEQ ID NO: 3146287 - RNA, 15 nt, Human
gagcgacagugagac

SEQ ID NO: 3146288 - RNA, 13 nt, Human
gagcgacagugag

SEQ ID NO: 3146289 - RNA, 18 nt, Human
gccaacuaugauuauuaa

SEQ ID NO: 3146290 - RNA, 16 nt, Human
gcauuguaaaugugcu

SEQ ID NO: 3146291 - RNA, 22 nt, Human
gcaguugaaaagacuccaaaga

SEQ ID NO: 3146292 - RNA, 15 nt, Human
gcagcuuauucacaa

SEQ ID NO: 3146293 - RNA, 21 nt, Human
gaugcugucuucguacuggga

SEQ ID NO: 3146294 - RNA, 17 nt, Human
gcacucccaccugacac

SEQ ID NO: 3146295 - RNA, 22 nt, Human
gcacucccaccugacacaccag

SEQ ID NO: 3146296 - RNA, 18 nt, Human
gcacucccaccugacaca

SEQ ID NO: 3146297 - RNA, 18 nt, Human
gcaauagucaaauugugu

SEQ ID NO: 3146298 - RNA, 16 nt, Human
gcaauaaaauggguuu

SEQ ID NO: 3146299 - RNA, 22 nt, Human
cugugcugcccgucuucagccu

SEQ ID NO: 3146300 - RNA, 13 nt, Human
cuguuauaaucuu

SEQ ID NO: 3146301 - RNA, 19 nt, Human
cuguaacuacuuuauaacu

SEQ ID NO: 3146302 - RNA, 17 nt, Human
cuguaacuacuuuauaa

SEQ ID NO: 3146303 - RNA, 16 nt, Human
cuguaacuacuuuaua

SEQ ID NO: 3146304 - RNA, 17 nt, Human
cugucggagcccugucu

SEQ ID NO: 3146305 - RNA, 21 nt, Human
cugucauccucaaagaaagug

SEQ ID NO: 3146306 - RNA, 20 nt, Human
cugucauccucaaagaaagu

SEQ ID NO: 3146307 - RNA, 23 nt, Human
cugucauccucaaagaaagugua

SEQ ID NO: 3146308 - RNA, 22 nt, Human
cugucauccucaaagaaagugu

SEQ ID NO: 3146309 - RNA, 14 nt, Human
cuuagcuuagaccu

SEQ ID NO: 3146310 - RNA, 15 nt, Human
cuuagcuuagaccuc

SEQ ID NO: 3146311 - RNA, 16 nt, Human
cuuagcuuagaccuca

SEQ ID NO: 3146312 - RNA, 17 nt, Human
cuuagcuuagaccucag

SEQ ID NO: 3146313 - RNA, 18 nt, Human
cuuagcuuagaccucagc

SEQ ID NO: 3146314 - RNA, 19 nt, Human
cuuagcuuagaccucagcc

SEQ ID NO: 3146315 - RNA, 20 nt, Human
cuuagcuuagaccucagccu

SEQ ID NO: 3146316 - RNA, 23 nt, Human
cuuagcuuagaccucagccugug

SEQ ID NO: 3146317 - RNA, 21 nt, Human
cuuagcuuagaccucagccug

SEQ ID NO: 3146318 - RNA, 22 nt, Human
cuuagcuuagaccucagccugu

SEQ ID NO: 3146319 - RNA, 21 nt, Human
cuuaaaaaugguuuaaauggu

SEQ ID NO: 3146320 - RNA, 21 nt, Human
cugccuccccuccucugcuug

SEQ ID NO: 3146321 - RNA, 22 nt, Human
cugcuagcacuuggagccaagg

SEQ ID NO: 3146322 - RNA, 20 nt, Human
cugcuuauccguuagccgug

SEQ ID NO: 3146323 - RNA, 18 nt, Human
cuggauaguccgucucug

SEQ ID NO: 3146324 - RNA, 19 nt, Human
cuggauaguccgucucugc

SEQ ID NO: 3146325 - RNA, 20 nt, Human
cuucucacauuuauauuuuu

SEQ ID NO: 3146326 - RNA, 13 nt, Human
cuucucacauuua

SEQ ID NO: 3146327 - RNA, 21 nt, Human
cuucuaaguaaaaccacagca

SEQ ID NO: 3146328 - RNA, 13 nt, Human
cuucuaaguaaaa

SEQ ID NO: 3146329 - RNA, 17 nt, Human
cuucuaaguaaaaccac

SEQ ID NO: 3146330 - RNA, 13 nt, Human
cuugcuaccagua

SEQ ID NO: 3146331 - RNA, 18 nt, Human
cuugcuaccaguauuuag

SEQ ID NO: 3146332 - RNA, 17 nt, Human
cuugcuaccaguauuua

SEQ ID NO: 3146333 - RNA, 20 nt, Human
cuugcuaccaguauuuagaa

SEQ ID NO: 3146334 - RNA, 16 nt, Human
cuuggucugugagaug

SEQ ID NO: 3146335 - RNA, 19 nt, Human
cuuggucugugagaugcua

SEQ ID NO: 3146336 - RNA, 15 nt, Human
cuuggucuuauuuau

SEQ ID NO: 3146337 - RNA, 15 nt, Human
cuuggguaggcggga

SEQ ID NO: 3146338 - RNA, 16 nt, Human
gaaaagacuccaaaga

SEQ ID NO: 3146339 - RNA, 17 nt, Human
gaaaagacuccaaagaa

SEQ ID NO: 3146340 - RNA, 14 nt, Human
gaaaagacuccaaa

SEQ ID NO: 3146341 - RNA, 21 nt, Human
gaacaaguuguuucauugacu

SEQ ID NO: 3146342 - RNA, 19 nt, Human
gaacaaguuguuucauuga

SEQ ID NO: 3146343 - RNA, 18 nt, Human
gaaagaaaaucaggcugg

SEQ ID NO: 3146344 - RNA, 12 nt, Human
gaaagggauuuu

SEQ ID NO: 3146345 - RNA, 20 nt, Human
gaaagggauuuucagcccuc

SEQ ID NO: 3146346 - RNA, 17 nt, Human
gaacccgggaggcagag

SEQ ID NO: 3146347 - RNA, 16 nt, Human
gaacccaaguccaagc

SEQ ID NO: 3146348 - RNA, 17 nt, Human
gaacccaaguccaagca

SEQ ID NO: 3146349 - RNA, 13 nt, Human
cauagcucugggg

SEQ ID NO: 3146350 - RNA, 12 nt, Human
cauagcucuggg

SEQ ID NO: 3146351 - RNA, 20 nt, Human
cauagcucuggggugggcag

SEQ ID NO: 3146352 - RNA, 12 nt, Human
cauuaucucaaa

SEQ ID NO: 3146353 - RNA, 13 nt, Human
cauuaucucaaaa

SEQ ID NO: 3146354 - RNA, 22 nt, Human
caugcugccaauauccuaauaa

SEQ ID NO: 3146355 - RNA, 18 nt, Human
ccacagaagcuccaggua

SEQ ID NO: 3146356 - RNA, 18 nt, Human
ccaccagucugacuguuu

SEQ ID NO: 3146357 - RNA, 16 nt, Human
ccacagaagcuccagg

SEQ ID NO: 3146358 - RNA, 18 nt, Human
cagggaggacgcucucug

SEQ ID NO: 3146359 - RNA, 17 nt, Human
cagggaggacgcucucu

SEQ ID NO: 3146360 - RNA, 15 nt, Human
caggcgcuaauucaa

SEQ ID NO: 3146361 - RNA, 15 nt, Human
cagucucaggaaauc

SEQ ID NO: 3146362 - RNA, 20 nt, Human
cagcaguugaaaagacucca

SEQ ID NO: 3146363 - RNA, 21 nt, Human
cagcaguugaaaagacuccaa

SEQ ID NO: 3146364 - RNA, 17 nt, Human
cagcaguugaaaagacu

SEQ ID NO: 3146365 - RNA, 14 nt, Human
cagccagcaguuca

SEQ ID NO: 3146366 - RNA, 19 nt, Human
cagccagcagccagcucuc

SEQ ID NO: 3146367 - RNA, 21 nt, Human
cagccagcagccagcucucag

SEQ ID NO: 3146368 - RNA, 15 nt, Human
cagccagcagccagc

SEQ ID NO: 3146369 - RNA, 17 nt, Human
cagccagcagccagcuc

SEQ ID NO: 3146370 - RNA, 18 nt, Human
cagccagcagccagcucu

SEQ ID NO: 3146371 - RNA, 15 nt, Human
cagccagcaguucag

SEQ ID NO: 3146372 - RNA, 21 nt, Human
cagccagcaguucagagcugc

SEQ ID NO: 3146373 - RNA, 13 nt, Human
cagagcugcccuc

SEQ ID NO: 3146374 - RNA, 15 nt, Human
cagagcugcccucuc

SEQ ID NO: 3146375 - RNA, 22 nt, Human
caggaaaucaaauaugcaaagc

SEQ ID NO: 3146376 - RNA, 23 nt, Human
caggaaaucaaauaugcaaagca

SEQ ID NO: 3146377 - RNA, 20 nt, Human
caggaaagagaacuuccaga

SEQ ID NO: 3146378 - RNA, 17 nt, Human
cagcuccccucggagaa

SEQ ID NO: 3146379 - RNA, 18 nt, Human
cagcuccccucggagaag

SEQ ID NO: 3146380 - RNA, 16 nt, Human
cagcuccccucggaga

SEQ ID NO: 3146381 - RNA, 22 nt, Human
cagcugcaagguacucugguga

SEQ ID NO: 3146382 - RNA, 20 nt, Human
cagcugcaagguacucuggu

SEQ ID NO: 3146383 - RNA, 19 nt, Human
cagcugcaagguacucugg

SEQ ID NO: 3146384 - RNA, 20 nt, Human
cagcugccuccccuccucug

SEQ ID NO: 3146385 - RNA, 23 nt, Human
cagcugccuccccuccucugcuu

SEQ ID NO: 3146386 - RNA, 24 nt, Human
cagcugccuccccuccucugcuug

SEQ ID NO: 3146387 - RNA, 21 nt, Human
cagcugccuccccuccucugc

SEQ ID NO: 3146388 - RNA, 22 nt, Human
cagcugccuccccuccucugcu

SEQ ID NO: 3146389 - RNA, 19 nt, Human
cagcccuucuuuccacaga

SEQ ID NO: 3146390 - RNA, 15 nt, Human
cagcccuucuuucca

SEQ ID NO: 3146391 - RNA, 23 nt, Human
cagcccuuaugcgguuaauuuug

SEQ ID NO: 3146392 - RNA, 19 nt, Human
cagccugagcgacagugag

SEQ ID NO: 3146393 - RNA, 18 nt, Human
cagccugagcgacaguga

SEQ ID NO: 3146394 - RNA, 15 nt, Human
auuuuuauauuugaa

SEQ ID NO: 3146395 - RNA, 24 nt, Human
caaacccaguguuuuaggagcaug

SEQ ID NO: 3146396 - RNA, 16 nt, Human
caaacagucucaggaa

SEQ ID NO: 3146397 - RNA, 17 nt, Human
caaacagucucaggaaa

SEQ ID NO: 3146398 - RNA, 15 nt, Human
caaacagucucagga

SEQ ID NO: 3146399 - RNA, 21 nt, Human
caaaaggauaaugaauacuuu

SEQ ID NO: 3146400 - RNA, 21 nt, Human
auuuuauaucaauuuaaaaaa

SEQ ID NO: 3146401 - RNA, 22 nt, Human
auuuugaagugcuguuuauuaa

SEQ ID NO: 3146402 - RNA, 19 nt, Human
auuuugaagugcuguuuau

SEQ ID NO: 3146403 - RNA, 13 nt, Human
auuuugaagugcu

SEQ ID NO: 3146404 - RNA, 21 nt, Human
caaaucuuaacuugaaggagu

SEQ ID NO: 3146405 - RNA, 19 nt, Human
caagacccaaaaggcagaa

SEQ ID NO: 3146406 - RNA, 15 nt, Human
caacuacuaauagaa

SEQ ID NO: 3146407 - RNA, 13 nt, Human
caacuacuaauag

SEQ ID NO: 3146408 - RNA, 21 nt, Human
caacuacuaauagaauaaagg

SEQ ID NO: 3146409 - RNA, 20 nt, Human
auuucuaugaaauauuaugu

SEQ ID NO: 3146410 - RNA, 20 nt, Human
auuucauaccuaucaucuua

SEQ ID NO: 3146411 - RNA, 16 nt, Human
auuuaauaaaugugcc

SEQ ID NO: 3146412 - RNA, 16 nt, Human
auuguguguuauuuaa

SEQ ID NO: 3146413 - RNA, 18 nt, Human
auuguguguuauuuaaau

SEQ ID NO: 3146414 - RNA, 20 nt, Human
auuaugaauuacauuuguau

SEQ ID NO: 3146415 - RNA, 19 nt, Human
auuaugaauuacauuugua

SEQ ID NO: 3146416 - RNA, 23 nt, Human
auuaggcuguaacuacuuuauaa

SEQ ID NO: 3146417 - RNA, 22 nt, Human
auuaggcuguaacuacuuuaua

SEQ ID NO: 3146418 - RNA, 21 nt, Human
auuaggcuguaacuacuuuau

SEQ ID NO: 3146419 - RNA, 17 nt, Human
auuaggcuguaacuacu

SEQ ID NO: 3146420 - RNA, 15 nt, Human
auuaggcuguaacua

SEQ ID NO: 3146421 - RNA, 14 nt, Human
auuaggcuguaacu

SEQ ID NO: 3146422 - RNA, 24 nt, Human
auuccuuagcuuagaccucagccu

SEQ ID NO: 3146423 - RNA, 22 nt, Human
auuccuuagcuuagaccucagc

SEQ ID NO: 3146424 - RNA, 23 nt, Human
auuccuuagcuuagaccucagcc

SEQ ID NO: 3146425 - RNA, 20 nt, Human
auuccuuagcuuagaccuca

SEQ ID NO: 3146426 - RNA, 21 nt, Human
auuccuuagcuuagaccucag

SEQ ID NO: 3146427 - RNA, 15 nt, Human
cacuuaaaaaugguu

SEQ ID NO: 3146428 - RNA, 19 nt, Human
cacugggguccuggggccu

SEQ ID NO: 3146429 - RNA, 20 nt, Human
cacugggguccuggggccuc

SEQ ID NO: 3146430 - RNA, 15 nt, Human
cacuuaauguauguu

SEQ ID NO: 3146431 - RNA, 14 nt, Human
cacuuaauguaugu

SEQ ID NO: 3146432 - RNA, 12 nt, Human
cacuuaauguau

SEQ ID NO: 3146433 - RNA, 20 nt, Human
cagaaauaaaguuggugaca

SEQ ID NO: 3146434 - RNA, 17 nt, Human
cagaacagugauuacca

SEQ ID NO: 3146435 - RNA, 12 nt, Human
cagaacagugau

SEQ ID NO: 3146436 - RNA, 11 nt, Human
cagaacaguga

SEQ ID NO: 3146437 - RNA, 12 nt, Human
cagaacagccgc

SEQ ID NO: 3146438 - RNA, 17 nt, Human
cagaacagccgcuccug

SEQ ID NO: 3146439 - RNA, 20 nt, Human
cagaacagccgcuccugucu

SEQ ID NO: 3146440 - RNA, 12 nt, Human
cacuccagccug

SEQ ID NO: 3146441 - RNA, 13 nt, Human
cacuccagccuga

SEQ ID NO: 3146442 - RNA, 23 nt, Human
cacuccagccugagcgacaguga

SEQ ID NO: 3146443 - RNA, 23 nt, Human
caauaaaauccauacauuugugu

SEQ ID NO: 3146444 - RNA, 20 nt, Human
caauaaaauccauacauuug

SEQ ID NO: 3146445 - RNA, 16 nt, Human
caaguuguuucauuga

SEQ ID NO: 3146446 - RNA, 15 nt, Human
caauaaaauggguuu

SEQ ID NO: 3146447 - RNA, 13 nt, Human
ccucggagccuca

SEQ ID NO: 3146448 - RNA, 14 nt, Human
ccucggagccucau

SEQ ID NO: 3146449 - RNA, 16 nt, Human
ccucggagccucaucc

SEQ ID NO: 3146450 - RNA, 23 nt, Human
ccucggagccucauccgaggcag

SEQ ID NO: 3146451 - RNA, 17 nt, Human
ccugucucuacuaaaaa

SEQ ID NO: 3146452 - RNA, 20 nt, Human
ccuaauaaaaaggugaccau

SEQ ID NO: 3146453 - RNA, 16 nt, Human
ccuaauaaaaagguga

SEQ ID NO: 3146454 - RNA, 15 nt, Human
ccuaauaaaaaggug

SEQ ID NO: 3146455 - RNA, 14 nt, Human
ccuaauaaaaaggu

SEQ ID NO: 3146456 - RNA, 14 nt, Human
ccgucuucagccua

SEQ ID NO: 3146457 - RNA, 15 nt, Human
ccgucuucagccuag

SEQ ID NO: 3146458 - RNA, 16 nt, Human
ccucccuucucuucac

SEQ ID NO: 3146459 - RNA, 12 nt, Human
ccucggagaaga

SEQ ID NO: 3146460 - RNA, 14 nt, Human
ccucggagaagagc

SEQ ID NO: 3146461 - RNA, 13 nt, Human
cccaacuccagaa

SEQ ID NO: 3146462 - RNA, 13 nt, Human
ccaucccucccuc

SEQ ID NO: 3146463 - RNA, 14 nt, Human
ccaucccucccucc

SEQ ID NO: 3146464 - RNA, 15 nt, Human
ccaucccucccucca

SEQ ID NO: 3146465 - RNA, 20 nt, Human
cccauauuuguacaccaaua

SEQ ID NO: 3146466 - RNA, 24 nt, Human
cccagccagcaguucagagcugcc

SEQ ID NO: 3146467 - RNA, 17 nt, Human
cccagcacuaaagcagu

SEQ ID NO: 3146468 - RNA, 16 nt, Human
cccagcacuaaagcag

SEQ ID NO: 3146469 - RNA, 19 nt, Human
ccccauggagcugggcuaa

SEQ ID NO: 3146470 - RNA, 18 nt, Human
cccccuugccagacaugu

SEQ ID NO: 3146471 - RNA, 13 nt, Human
cccuccucugcuu

SEQ ID NO: 3146472 - RNA, 22 nt, Human
cccuccucugcuugccaucccu

SEQ ID NO: 3146473 - RNA, 13 nt, Human
ccccugcacucca

SEQ ID NO: 3146474 - RNA, 17 nt, Human
cuacuaauagaauaaag

SEQ ID NO: 3146475 - RNA, 18 nt, Human
cuacuaauagaauaaagg

SEQ ID NO: 3146476 - RNA, 23 nt, Human
cucagaaaacaaggaugaauuaa

SEQ ID NO: 3146477 - RNA, 19 nt, Human
cucagaaaacaaggaugaa

SEQ ID NO: 3146478 - RNA, 13 nt, Human
cucaccuggacuu

SEQ ID NO: 3146479 - RNA, 12 nt, Human
cucaccuggacu

SEQ ID NO: 3146480 - RNA, 13 nt, Human
cucaaaacugcac

SEQ ID NO: 3146481 - RNA, 13 nt, Human
cucaaagaaagug

SEQ ID NO: 3146482 - RNA, 17 nt, Human
cucaaagaaaguguauu

SEQ ID NO: 3146483 - RNA, 16 nt, Human
cucaaagaaaguguau

SEQ ID NO: 3146484 - RNA, 15 nt, Human
cuaaacuuuuuuucu

SEQ ID NO: 3146485 - RNA, 21 nt, Human
cuaaacuuuuuuucuguacca

SEQ ID NO: 3146486 - RNA, 18 nt, Human
cuaaacuuuuuuucugua

SEQ ID NO: 3146487 - RNA, 17 nt, Human
cuaaacuuuuuuucugu

SEQ ID NO: 3146488 - RNA, 23 nt, Human
cggagaagagcuguucacagcca

SEQ ID NO: 3146489 - RNA, 24 nt, Human
cggagaagagcuguucacagccag

SEQ ID NO: 3146490 - RNA, 15 nt, Human
cgguuuauauaagcu

SEQ ID NO: 3146491 - RNA, 17 nt, Human
cugaaagaggaaugaag

SEQ ID NO: 3146492 - RNA, 13 nt, Human
cugaaagaggaau

SEQ ID NO: 3146493 - RNA, 21 nt, Human
cugacacaugcugaacaucac

SEQ ID NO: 3146494 - RNA, 14 nt, Human
cugacacaccaggc

SEQ ID NO: 3146495 - RNA, 23 nt, Human
cugacacaccaggcgcuaauuca

SEQ ID NO: 3146496 - RNA, 19 nt, Human
cugacacaccaggcgcuaa

SEQ ID NO: 3146497 - RNA, 17 nt, Human
cugacacaccaggcgcu

SEQ ID NO: 3146498 - RNA, 21 nt, Human
cuccagugagacagcucugca

SEQ ID NO: 3146499 - RNA, 19 nt, Human
cucccagaggagccaccag

SEQ ID NO: 3146500 - RNA, 22 nt, Human
cucccagaggagccaccaguuc

SEQ ID NO: 3146501 - RNA, 21 nt, Human
cucccagaggagccaccaguu

SEQ ID NO: 3146502 - RNA, 23 nt, Human
cucccagaggagccaccaguucu

SEQ ID NO: 3146503 - RNA, 17 nt, Human
cucucuggccuucggcc

SEQ ID NO: 3146504 - RNA, 19 nt, Human
cucucuggccuucggccuc

SEQ ID NO: 3146505 - RNA, 14 nt, Human
cucgguggacccag

SEQ ID NO: 3146506 - RNA, 12 nt, Human
uuggauuuccua

SEQ ID NO: 3146507 - RNA, 21 nt, Human
uuggauuuccuaauacuguca

SEQ ID NO: 3146508 - RNA, 14 nt, Human
uuggauuuccuaau

SEQ ID NO: 3146509 - RNA, 22 nt, Human
uuggaagauggcauaaccuguc

SEQ ID NO: 3146510 - RNA, 16 nt, Human
uugcuaagcauuccaa

SEQ ID NO: 3146511 - RNA, 18 nt, Human
uugcuaagcauuccaacu

SEQ ID NO: 3146512 - RNA, 16 nt, Human
uuggcauagcucuggg

SEQ ID NO: 3146513 - RNA, 13 nt, Human
uuguaaaauggug

SEQ ID NO: 3146514 - RNA, 12 nt, Human
uuguaaaauggu

SEQ ID NO: 3146515 - RNA, 20 nt, Human
uugguaaggggaauugagga

SEQ ID NO: 3146516 - RNA, 15 nt, Human
uugguaacuuuugug

SEQ ID NO: 3146517 - RNA, 14 nt, Human
uugguaacuuuugu

SEQ ID NO: 3146518 - RNA, 12 nt, Human
uugguaacuuuu

SEQ ID NO: 3146519 - RNA, 16 nt, Human
uuguaccgcaauguga

SEQ ID NO: 3146520 - RNA, 20 nt, Human
uuguaaaauggugugaccac

SEQ ID NO: 3146521 - RNA, 15 nt, Human
uugucuagugaaacu

SEQ ID NO: 3146522 - RNA, 24 nt, Human
uucuaaguaaaaccacagcaguug

SEQ ID NO: 3146523 - RNA, 21 nt, Human
uucuaaguaaaaccacagcag

SEQ ID NO: 3146524 - RNA, 19 nt, Human
uucuuaggguuaugauuaa

SEQ ID NO: 3146525 - RNA, 18 nt, Human
uucuuuccacagaagcuc

SEQ ID NO: 3146526 - RNA, 21 nt, Human
uugaaaaucuuauaauuuaaa

SEQ ID NO: 3146527 - RNA, 13 nt, Human
uucuuucuagaaa

SEQ ID NO: 3146528 - RNA, 12 nt, Human
uucuuucuagaa

SEQ ID NO: 3146529 - RNA, 20 nt, Human
uugauaugccuuuucccaac

SEQ ID NO: 3146530 - RNA, 22 nt, Human
uugccaucccucccuccaccuc

SEQ ID NO: 3146531 - RNA, 23 nt, Human
uugccaucccucccuccaccucc

SEQ ID NO: 3146532 - RNA, 14 nt, Human
uugccaucccuccc

SEQ ID NO: 3146533 - RNA, 16 nt, Human
uugccaucccucccuc

SEQ ID NO: 3146534 - RNA, 17 nt, Human
uugccaucccucccucc

SEQ ID NO: 3146535 - RNA, 18 nt, Human
uugccaucccucccucca

SEQ ID NO: 3146536 - RNA, 22 nt, Human
uugccagacauguggugggaca

SEQ ID NO: 3146537 - RNA, 13 nt, Human
uugccaucccucc

SEQ ID NO: 3146538 - RNA, 14 nt, Human
uugcagagacagga

SEQ ID NO: 3146539 - RNA, 18 nt, Human
uugcagauucauuuuucu

SEQ ID NO: 3146540 - RNA, 19 nt, Human
uugcagagacaggaccuga

SEQ ID NO: 3146541 - RNA, 23 nt, Human
uugcagcucuccccuucucugua

SEQ ID NO: 3146542 - RNA, 20 nt, Human
uuucauuuaucuauaauuua

SEQ ID NO: 3146543 - RNA, 12 nt, Human
uuucucuaggaa

SEQ ID NO: 3146544 - RNA, 12 nt, Human
uuuccuaauacu

SEQ ID NO: 3146545 - RNA, 18 nt, Human
uuugguaaggggaauuga

SEQ ID NO: 3146546 - RNA, 16 nt, Human
uuugaagugcuguuua

SEQ ID NO: 3146547 - RNA, 15 nt, Human
uuugaagugcuguuu

SEQ ID NO: 3146548 - RNA, 20 nt, Human
uuugaagugcuguuuauuaa

SEQ ID NO: 3146549 - RNA, 14 nt, Human
uuucuuaacuucuu

SEQ ID NO: 3146550 - RNA, 13 nt, Human
uuucuuaacuucu

SEQ ID NO: 3146551 - RNA, 21 nt, Human
uuugaaauuguauuacaaauc

SEQ ID NO: 3146552 - RNA, 13 nt, Human
uuuacagagacag

SEQ ID NO: 3146553 - RNA, 19 nt, Human
uuuaauaauguuucaaaca

SEQ ID NO: 3146554 - RNA, 15 nt, Human
uuuaauaauguuuca

SEQ ID NO: 3146555 - RNA, 14 nt, Human
uuuaauaauguuuc

SEQ ID NO: 3146556 - RNA, 13 nt, Human
uuuaauaaaccau

SEQ ID NO: 3146557 - RNA, 14 nt, Human
uuuauaacuaacau

SEQ ID NO: 3146558 - RNA, 18 nt, Human
uuguuuaaaaucauuucu

SEQ ID NO: 3146559 - RNA, 17 nt, Human
uuguuuaaaaucauuuc

SEQ ID NO: 3146560 - RNA, 12 nt, Human
uuuaaaaugucu

SEQ ID NO: 3146561 - RNA, 19 nt, Human
uuuaaaauacacacucaaa

SEQ ID NO: 3146562 - RNA, 16 nt, Human
uuuaaaaucauuucug

SEQ ID NO: 3146563 - RNA, 14 nt, Human
uuuaaaagaaugau

SEQ ID NO: 3146564 - RNA, 17 nt, Human
uuuaaaagaaugauuau

SEQ ID NO: 3146565 - RNA, 16 nt, Human
uuaugcgguuaauuuu

SEQ ID NO: 3146566 - RNA, 19 nt, Human
uuaugcgguuaauuuugaa

SEQ ID NO: 3146567 - RNA, 21 nt, Human
uuauggcacuaguauuucuau

SEQ ID NO: 3146568 - RNA, 22 nt, Human
uuaucuauaauuuaccuaagau

SEQ ID NO: 3146569 - RNA, 17 nt, Human
uuaucuauaauuuaccu

SEQ ID NO: 3146570 - RNA, 15 nt, Human
uuaucuauaauuuac

SEQ ID NO: 3146571 - RNA, 14 nt, Human
uuaucuauaauuua

SEQ ID NO: 3146572 - RNA, 16 nt, Human
uuaucugucagcugca

SEQ ID NO: 3146573 - RNA, 17 nt, Human
uuauggcuauaggugcu

SEQ ID NO: 3146574 - RNA, 17 nt, Human
uuauuaaucuuagugua

SEQ ID NO: 3146575 - RNA, 18 nt, Human
uuauuacuguaagaaaau

SEQ ID NO: 3146576 - RNA, 17 nt, Human
uuauuacuguaagaaaa

SEQ ID NO: 3146577 - RNA, 16 nt, Human
uuauuacuguaagaaa

SEQ ID NO: 3146578 - RNA, 13 nt, Human
uucagagcugccc

SEQ ID NO: 3146579 - RNA, 16 nt, Human
uucagacauagaauua

SEQ ID NO: 3146580 - RNA, 20 nt, Human
uucagacauagaauuaacac

SEQ ID NO: 3146581 - RNA, 15 nt, Human
uuauugucuagugaa

SEQ ID NO: 3146582 - RNA, 16 nt, Human
uuauuuuaauaauguu

SEQ ID NO: 3146583 - RNA, 15 nt, Human
uuauuuuaauaaugu

SEQ ID NO: 3146584 - RNA, 17 nt, Human
uucccuugaugaagaag

SEQ ID NO: 3146585 - RNA, 22 nt, Human
uucggccuccauccugaggcuc

SEQ ID NO: 3146586 - RNA, 20 nt, Human
uuccuuggacucauuuuaaa

SEQ ID NO: 3146587 - RNA, 17 nt, Human
uuccuuggacucauuuu

SEQ ID NO: 3146588 - RNA, 15 nt, Human
uucaugcagcugugg

SEQ ID NO: 3146589 - RNA, 14 nt, Human
uucaugcagcugug

SEQ ID NO: 3146590 - RNA, 13 nt, Human
uucaugcagcugu

SEQ ID NO: 3146591 - RNA, 19 nt, Human
uuccagauccuggaaauca

SEQ ID NO: 3146592 - RNA, 19 nt, Human
uguuucaaacauauauaac

SEQ ID NO: 3146593 - RNA, 22 nt, Human
uguuucaaacauauauaacaau

SEQ ID NO: 3146594 - RNA, 21 nt, Human
uguuucaaacauauauaacaa

SEQ ID NO: 3146595 - RNA, 19 nt, Human
uuaaaauacacacucaaau

SEQ ID NO: 3146596 - RNA, 15 nt, Human
uuaaaagaugaaaau

SEQ ID NO: 3146597 - RNA, 18 nt, Human
uuaaaagaugaaaauauu

SEQ ID NO: 3146598 - RNA, 17 nt, Human
uuaaagaaaguguauuu

SEQ ID NO: 3146599 - RNA, 12 nt, Human
uuaaagaaagug

SEQ ID NO: 3146600 - RNA, 21 nt, Human
uuaaaagaauauuuuaacuuc

SEQ ID NO: 3146601 - RNA, 22 nt, Human
uuaaaagaauauuuuaacuucc

SEQ ID NO: 3146602 - RNA, 21 nt, Human
uuaacuucuugcuucuuucua

SEQ ID NO: 3146603 - RNA, 17 nt, Human
uuaacuucuugcuucuu

SEQ ID NO: 3146604 - RNA, 14 nt, Human
uuaacuucuugcuu

SEQ ID NO: 3146605 - RNA, 14 nt, Human
uuaacgauguccaa

SEQ ID NO: 3146606 - RNA, 18 nt, Human
uuaauguauguuaccaaa

SEQ ID NO: 3146607 - RNA, 17 nt, Human
uuaauguauguuaccaa

SEQ ID NO: 3146608 - RNA, 15 nt, Human
uuaauguauguuacc

SEQ ID NO: 3146609 - RNA, 13 nt, Human
uuaauguauguua

SEQ ID NO: 3146610 - RNA, 20 nt, Human
uuagacccucaugcugccaa

SEQ ID NO: 3146611 - RNA, 19 nt, Human
uuagacccucaugcugcca

SEQ ID NO: 3146612 - RNA, 11 nt, Human
uuagaccucag

SEQ ID NO: 3146613 - RNA, 12 nt, Human
uuagaccucagc

SEQ ID NO: 3146614 - RNA, 13 nt, Human
uuagaccucagcc

SEQ ID NO: 3146615 - RNA, 16 nt, Human
uuagaccucagccugu

SEQ ID NO: 3146616 - RNA, 14 nt, Human
uuagaccucagccu

SEQ ID NO: 3146617 - RNA, 15 nt, Human
uuagaccucagccug

SEQ ID NO: 3146618 - RNA, 20 nt, Human
uuacuguguaauuagugcca

SEQ ID NO: 3146619 - RNA, 16 nt, Human
uuacuguguaauuagu

SEQ ID NO: 3146620 - RNA, 13 nt, Human
uuacuguguaauu

SEQ ID NO: 3146621 - RNA, 17 nt, Human
uuacuaguuucccuugc

SEQ ID NO: 3146622 - RNA, 21 nt, Human
uuagaugcaguucugaagaag

SEQ ID NO: 3146623 - RNA, 20 nt, Human
uuagaugcaguucugaagaa

SEQ ID NO: 3146624 - RNA, 13 nt, Human
uuagcuggaaaag

SEQ ID NO: 3146625 - RNA, 12 nt, Human
uuagcuggaaaa

SEQ ID NO: 3146626 - RNA, 16 nt, Human
uuagcuuagaccucag

SEQ ID NO: 3146627 - RNA, 17 nt, Human
uuagcuuagaccucagc

SEQ ID NO: 3146628 - RNA, 18 nt, Human
uuagcuuagaccucagcc

SEQ ID NO: 3146629 - RNA, 21 nt, Human
uuagcuuagaccucagccugu

SEQ ID NO: 3146630 - RNA, 22 nt, Human
uuaguuaccuuauaguuacugu

SEQ ID NO: 3146631 - RNA, 21 nt, Human
uuaguuaccuuauaguuacug

SEQ ID NO: 3146632 - RNA, 13 nt, Human
uuaguuaccuuau

SEQ ID NO: 3146633 - RNA, 20 nt, Human
uuaguuaccuuauaguuacu

SEQ ID NO: 3146634 - RNA, 19 nt, Human
uuaguuaccuuauaguuac

SEQ ID NO: 3146635 - RNA, 18 nt, Human
uuaguuaccuuauaguua

SEQ ID NO: 3146636 - RNA, 16 nt, Human
uuaguuaccuuauagu

SEQ ID NO: 3146637 - RNA, 20 nt, Human
uuaggcuguaacuacuuuau

SEQ ID NO: 3146638 - RNA, 17 nt, Human
uuaggcuguaacuacuu

SEQ ID NO: 3146639 - RNA, 14 nt, Human
uuaggcuguaacua

SEQ ID NO: 3146640 - RNA, 18 nt, Human
uuaggauguugaaaaagu

SEQ ID NO: 3146641 - RNA, 15 nt, Human
uaugauuacuggccu

SEQ ID NO: 3146642 - RNA, 21 nt, Human
uaugauuaaguaaugauaacu

SEQ ID NO: 3146643 - RNA, 21 nt, Human
uaugauuauuaacgaugucca

SEQ ID NO: 3146644 - RNA, 12 nt, Human
uaugauuauuaa

SEQ ID NO: 3146645 - RNA, 22 nt, Human
uaugauuacuggccuuuuucau

SEQ ID NO: 3146646 - RNA, 16 nt, Human
uaugauucccagccag

SEQ ID NO: 3146647 - RNA, 15 nt, Human
uaugcaaagcacuga

SEQ ID NO: 3146648 - RNA, 13 nt, Human
uaugcaaagcacu

SEQ ID NO: 3146649 - RNA, 14 nt, Human
uaugcaaagcacug

SEQ ID NO: 3146650 - RNA, 12 nt, Human
uaugcaaagcac

SEQ ID NO: 3146651 - RNA, 16 nt, Human
uaugcuucuguuuuau

SEQ ID NO: 3146652 - RNA, 15 nt, Human
uaugcuucuguuuua

SEQ ID NO: 3146653 - RNA, 22 nt, Human
uaucuaccccagacuagaugua

SEQ ID NO: 3146654 - RNA, 14 nt, Human
uauccuucagccug

SEQ ID NO: 3146655 - RNA, 15 nt, Human
uauccuucagccuga

SEQ ID NO: 3146656 - RNA, 23 nt, Human
uaugaauuacauuuguauaaaau

SEQ ID NO: 3146657 - RNA, 17 nt, Human
uaugaauuacauuugua

SEQ ID NO: 3146658 - RNA, 15 nt, Human
uaucugucagcugca

SEQ ID NO: 3146659 - RNA, 16 nt, Human
uaggucagugcaaaua

SEQ ID NO: 3146660 - RNA, 16 nt, Human
uaggccaugggacagg

SEQ ID NO: 3146661 - RNA, 18 nt, Human
uaggccaugggacaggga

SEQ ID NO: 3146662 - RNA, 12 nt, Human
uaggaauugacc

SEQ ID NO: 3146663 - RNA, 16 nt, Human
uaguauuucuaugaaa

SEQ ID NO: 3146664 - RNA, 19 nt, Human
uaguauuucuaugaaauau

SEQ ID NO: 3146665 - RNA, 18 nt, Human
uaguauuucuaugaaaua

SEQ ID NO: 3146666 - RNA, 18 nt, Human
uaguauuuuuuguauaau

SEQ ID NO: 3146667 - RNA, 13 nt, Human
uaguaucaaaaga

SEQ ID NO: 3146668 - RNA, 15 nt, Human
uagugcaaauuguca

SEQ ID NO: 3146669 - RNA, 14 nt, Human
uagugcaaauuguc

SEQ ID NO: 3146670 - RNA, 13 nt, Human
uagucaaauugug

SEQ ID NO: 3146671 - RNA, 19 nt, Human
uaguauuuuuuguauaauu

SEQ ID NO: 3146672 - RNA, 22 nt, Human
uagugccacuuaauguauguua

SEQ ID NO: 3146673 - RNA, 13 nt, Human
uauaugcuucugu

SEQ ID NO: 3146674 - RNA, 22 nt, Human
uauaguuacuguguaauuagug

SEQ ID NO: 3146675 - RNA, 20 nt, Human
uauaguuacuguguaauuag

SEQ ID NO: 3146676 - RNA, 18 nt, Human
uauaguuacuguguaauu

SEQ ID NO: 3146677 - RNA, 16 nt, Human
uauaguuacuguguaa

SEQ ID NO: 3146678 - RNA, 15 nt, Human
uauaguuacugugua

SEQ ID NO: 3146679 - RNA, 13 nt, Human
uauaguuacugug

SEQ ID NO: 3146680 - RNA, 18 nt, Human
uauaauuggauuuccuaa

SEQ ID NO: 3146681 - RNA, 17 nt, Human
uauaauuggauuuccua

SEQ ID NO: 3146682 - RNA, 20 nt, Human
uauaauuggauuuccuaaua

SEQ ID NO: 3146683 - RNA, 19 nt, Human
uauaauuggauuuccuaau

SEQ ID NO: 3146684 - RNA, 22 nt, Human
uauaauuggauuuccuaauacu

SEQ ID NO: 3146685 - RNA, 22 nt, Human
ucacaagacccaaaaggcagaa

SEQ ID NO: 3146686 - RNA, 18 nt, Human
ucacaagacccaaaaggc

SEQ ID NO: 3146687 - RNA, 20 nt, Human
ucacacacaggcaacugagg

SEQ ID NO: 3146688 - RNA, 21 nt, Human
ucacacacaggcaacugaggc

SEQ ID NO: 3146689 - RNA, 12 nt, Human
ucacauuuaaau

SEQ ID NO: 3146690 - RNA, 23 nt, Human
ucaaggaauuucuuaacuucuug

SEQ ID NO: 3146691 - RNA, 21 nt, Human
ucaaggaauuucuuaacuucu

SEQ ID NO: 3146692 - RNA, 19 nt, Human
ucaaggaauuucuuaacuu

SEQ ID NO: 3146693 - RNA, 16 nt, Human
ucaaggaauuucuuaa

SEQ ID NO: 3146694 - RNA, 22 nt, Human
ucaacuccaaacugacucuuaa

SEQ ID NO: 3146695 - RNA, 19 nt, Human
ucaacuccaaacugacucu

SEQ ID NO: 3146696 - RNA, 16 nt, Human
ucaaauaugcaaagca

SEQ ID NO: 3146697 - RNA, 17 nt, Human
ucaaauaugcaaagcac

SEQ ID NO: 3146698 - RNA, 18 nt, Human
ucaaauaugcaaagcacu

SEQ ID NO: 3146699 - RNA, 19 nt, Human
ucaaauaugcaaagcacug

SEQ ID NO: 3146700 - RNA, 15 nt, Human
ucaaauccuugaaga

SEQ ID NO: 3146701 - RNA, 16 nt, Human
ucaaauccuugaagau

SEQ ID NO: 3146702 - RNA, 22 nt, Human
ucaaacagucucaggaaaucaa

SEQ ID NO: 3146703 - RNA, 17 nt, Human
ucaaacauauauaacaa

SEQ ID NO: 3146704 - RNA, 15 nt, Human
uauuucuaugaaaua

SEQ ID NO: 3146705 - RNA, 14 nt, Human
uauuucuaugaaau

SEQ ID NO: 3146706 - RNA, 14 nt, Human
uauuuauuacugua

SEQ ID NO: 3146707 - RNA, 13 nt, Human
uauuucuaugaaa

SEQ ID NO: 3146708 - RNA, 13 nt, Human
uauuuauuacugu

SEQ ID NO: 3146709 - RNA, 20 nt, Human
uauuguuuaaaaucauuucu

SEQ ID NO: 3146710 - RNA, 22 nt, Human
uauuuaaauauuaaauauguua

SEQ ID NO: 3146711 - RNA, 19 nt, Human
uauuguguguuauuuaaau

SEQ ID NO: 3146712 - RNA, 17 nt, Human
uauuguguguuauuuaa

SEQ ID NO: 3146713 - RNA, 16 nt, Human
uauuguuuaaaaucau

SEQ ID NO: 3146714 - RNA, 17 nt, Human
uauuguuuaaaaucauu

SEQ ID NO: 3146715 - RNA, 15 nt, Human
uauuguuuaaaauca

SEQ ID NO: 3146716 - RNA, 17 nt, Human
uauuauauuuacaaaug

SEQ ID NO: 3146717 - RNA, 14 nt, Human
uauuaucugucagc

SEQ ID NO: 3146718 - RNA, 13 nt, Human
uauuaucugucag

SEQ ID NO: 3146719 - RNA, 16 nt, Human
uauuauguuaaaacug

SEQ ID NO: 3146720 - RNA, 15 nt, Human
uauuauuguguguua

SEQ ID NO: 3146721 - RNA, 15 nt, Human
uauuaacgaugucca

SEQ ID NO: 3146722 - RNA, 17 nt, Human
uauguucuaagaaguga

SEQ ID NO: 3146723 - RNA, 19 nt, Human
uauguuagugcaaauuguc

SEQ ID NO: 3146724 - RNA, 12 nt, Human
uauguuaaaacu

SEQ ID NO: 3146725 - RNA, 19 nt, Human
uauggaggcuuugcauaga

SEQ ID NO: 3146726 - RNA, 15 nt, Human
ucuccagcugacuaa

SEQ ID NO: 3146727 - RNA, 14 nt, Human
ucuccagcugacua

SEQ ID NO: 3146728 - RNA, 12 nt, Human
ucuccagcugac

SEQ ID NO: 3146729 - RNA, 23 nt, Human
ucucaguccaugaagauguagag

SEQ ID NO: 3146730 - RNA, 18 nt, Human
ucuaugaaauauuauguu

SEQ ID NO: 3146731 - RNA, 14 nt, Human
ucggagaagagcug

SEQ ID NO: 3146732 - RNA, 16 nt, Human
ucggagaagagcuguu

SEQ ID NO: 3146733 - RNA, 12 nt, Human
ucggagaagagc

SEQ ID NO: 3146734 - RNA, 21 nt, Human
uccuuagcuuagaccucagcc

SEQ ID NO: 3146735 - RNA, 22 nt, Human
uccuuagcuuagaccucagccu

SEQ ID NO: 3146736 - RNA, 17 nt, Human
uccugucugccagccag

SEQ ID NO: 3146737 - RNA, 21 nt, Human
uccugucugccagccagcagc

SEQ ID NO: 3146738 - RNA, 18 nt, Human
uccuuagcuuagaccuca

SEQ ID NO: 3146739 - RNA, 19 nt, Human
uccuuagcuuagaccucag

SEQ ID NO: 3146740 - RNA, 20 nt, Human
uccuuagcuuagaccucagc

SEQ ID NO: 3146741 - RNA, 12 nt, Human
uccugucugcca

SEQ ID NO: 3146742 - RNA, 13 nt, Human
uccugucugccag

SEQ ID NO: 3146743 - RNA, 14 nt, Human
uccugucugccagc

SEQ ID NO: 3146744 - RNA, 16 nt, Human
uccugucugccagcca

SEQ ID NO: 3146745 - RNA, 22 nt, Human
uccugucggagcccugucuccu

SEQ ID NO: 3146746 - RNA, 20 nt, Human
uccugaggcuccacuugguc

SEQ ID NO: 3146747 - RNA, 19 nt, Human
uccugaggcuccacuuggu

SEQ ID NO: 3146748 - RNA, 17 nt, Human
uccugaggcuccacuug

SEQ ID NO: 3146749 - RNA, 17 nt, Human
uccugccccugagccca

SEQ ID NO: 3146750 - RNA, 18 nt, Human
uccugccccugagcccau

SEQ ID NO: 3146751 - RNA, 14 nt, Human
uccucuguccaggg

SEQ ID NO: 3146752 - RNA, 16 nt, Human
uccucuguccagggcc

SEQ ID NO: 3146753 - RNA, 23 nt, Human
uccucuguccagggcccugagcu

SEQ ID NO: 3146754 - RNA, 14 nt, Human
uccuagugaaagag

SEQ ID NO: 3146755 - RNA, 23 nt, Human
uccuagugaaagaggcagcuuga

SEQ ID NO: 3146756 - RNA, 22 nt, Human
uccucauuuuuauaaugucccu

SEQ ID NO: 3146757 - RNA, 20 nt, Human
ucccuucacaaacccagugu

SEQ ID NO: 3146758 - RNA, 14 nt, Human
uccgaggcaggguc

SEQ ID NO: 3146759 - RNA, 21 nt, Human
ucauuuaucuauaauuuaccu

SEQ ID NO: 3146760 - RNA, 18 nt, Human
ucauuuaucuauaauuua

SEQ ID NO: 3146761 - RNA, 16 nt, Human
ucauuuaucuauaauu

SEQ ID NO: 3146762 - RNA, 12 nt, Human
ucauuuaucuau

SEQ ID NO: 3146763 - RNA, 14 nt, Human
uccaaagaaaugua

SEQ ID NO: 3146764 - RNA, 17 nt, Human
uccaaagaaauguaagg

SEQ ID NO: 3146765 - RNA, 16 nt, Human
ucauuaggauggcuag

SEQ ID NO: 3146766 - RNA, 22 nt, Human
ucaucuugcuaccaguauuuag

SEQ ID NO: 3146767 - RNA, 21 nt, Human
ucaucuugcuaccaguauuua

SEQ ID NO: 3146768 - RNA, 18 nt, Human
ucaucuugcuaccaguau

SEQ ID NO: 3146769 - RNA, 17 nt, Human
ucaucuugcuaccagua

SEQ ID NO: 3146770 - RNA, 11 nt, Human
ucaucuugcua

SEQ ID NO: 3146771 - RNA, 11 nt, Human
ucauagcagcu

SEQ ID NO: 3146772 - RNA, 12 nt, Human
ucauagcagcuu

SEQ ID NO: 3146773 - RNA, 17 nt, Human
ucaucaaugaaugaaug

SEQ ID NO: 3146774 - RNA, 17 nt, Human
uccacuuggucugugag

SEQ ID NO: 3146775 - RNA, 21 nt, Human
uccacuuggucugugagaugc

SEQ ID NO: 3146776 - RNA, 23 nt, Human
uccacuuggucugugagaugcua

SEQ ID NO: 3146777 - RNA, 21 nt, Human
uccagcugacuaaacuuuuuu

SEQ ID NO: 3146778 - RNA, 14 nt, Human
uccagcugacuaaa

SEQ ID NO: 3146779 - RNA, 12 nt, Human
uccauacauuug

SEQ ID NO: 3146780 - RNA, 19 nt, Human
uccagguagagggugugua

SEQ ID NO: 3146781 - RNA, 15 nt, Human
uccauacauuugugu

SEQ ID NO: 3146782 - RNA, 23 nt, Human
ucccaccugacacaccaggcgcu

SEQ ID NO: 3146783 - RNA, 19 nt, Human
ucccaccugacacaccagg

SEQ ID NO: 3146784 - RNA, 13 nt, Human
ucccaccugacac

SEQ ID NO: 3146785 - RNA, 14 nt, Human
ugagcucgguggac

SEQ ID NO: 3146786 - RNA, 20 nt, Human
ugagcucgguggacccaggg

SEQ ID NO: 3146787 - RNA, 21 nt, Human
ugagcucgguggacccaggga

SEQ ID NO: 3146788 - RNA, 13 nt, Human
ugagccccaaaag

SEQ ID NO: 3146789 - RNA, 16 nt, Human
ugagagugaacaaauu

SEQ ID NO: 3146790 - RNA, 20 nt, Human
ugaggcuccacuuggucugu

SEQ ID NO: 3146791 - RNA, 18 nt, Human
ugaggcuccacuuggucu

SEQ ID NO: 3146792 - RNA, 16 nt, Human
ugauaacuggaaacuu

SEQ ID NO: 3146793 - RNA, 16 nt, Human
ugauuaccagggacug

SEQ ID NO: 3146794 - RNA, 19 nt, Human
ugauuaugaauuacauuug

SEQ ID NO: 3146795 - RNA, 17 nt, Human
ugauuaugaauuacauu

SEQ ID NO: 3146796 - RNA, 13 nt, Human
ugauuauauguca

SEQ ID NO: 3146797 - RNA, 21 nt, Human
ugauuacuggccuuuuucauu

SEQ ID NO: 3146798 - RNA, 20 nt, Human
ugauuacuggccuuuuucau

SEQ ID NO: 3146799 - RNA, 23 nt, Human
ugauuacuggccuuuuucauuua

SEQ ID NO: 3146800 - RNA, 22 nt, Human
ugauuaugaauuacauuuguau

SEQ ID NO: 3146801 - RNA, 21 nt, Human
ugauuaugaauuacauuugua

SEQ ID NO: 3146802 - RNA, 20 nt, Human
ugauuauuaacgauguccaa

SEQ ID NO: 3146803 - RNA, 24 nt, Human
ugaucagcuuauugucuagugaaa

SEQ ID NO: 3146804 - RNA, 17 nt, Human
ugaucagcuuauugucu

SEQ ID NO: 3146805 - RNA, 14 nt, Human
ugaucuuuaaaaua

SEQ ID NO: 3146806 - RNA, 15 nt, Human
ugauggugguauguu

SEQ ID NO: 3146807 - RNA, 17 nt, Human
ugaucuuuaaaauacac

SEQ ID NO: 3146808 - RNA, 23 nt, Human
ugaugcuacaggauuugaaauug

SEQ ID NO: 3146809 - RNA, 20 nt, Human
ugaugcuacaggauuugaaa

SEQ ID NO: 3146810 - RNA, 20 nt, Human
ugacaagcucacagaccuuu

SEQ ID NO: 3146811 - RNA, 15 nt, Human
ugacaagcucacaga

SEQ ID NO: 3146812 - RNA, 12 nt, Human
ugacaagcucac

SEQ ID NO: 3146813 - RNA, 17 nt, Human
ugacaugggacauuugc

SEQ ID NO: 3146814 - RNA, 16 nt, Human
ugacaugggacauuug

SEQ ID NO: 3146815 - RNA, 16 nt, Human
ugacaugucccuacac

SEQ ID NO: 3146816 - RNA, 18 nt, Human
ugacaugggacauuugcu

SEQ ID NO: 3146817 - RNA, 20 nt, Human
ugaccacugcagaagacagu

SEQ ID NO: 3146818 - RNA, 18 nt, Human
ugaccacugcagaagaca

SEQ ID NO: 3146819 - RNA, 11 nt, Human
ugaaguccaag

SEQ ID NO: 3146820 - RNA, 22 nt, Human
ugaagugcuguuuauuaaucuu

SEQ ID NO: 3146821 - RNA, 18 nt, Human
ugaagugcuguuuauuaa

SEQ ID NO: 3146822 - RNA, 20 nt, Human
ugaaugaauggcuaagcaaa

SEQ ID NO: 3146823 - RNA, 18 nt, Human
ugaauuacauuuguauaa

SEQ ID NO: 3146824 - RNA, 16 nt, Human
ugaauuacauuuguau

SEQ ID NO: 3146825 - RNA, 15 nt, Human
ugaauuacauuugua

SEQ ID NO: 3146826 - RNA, 14 nt, Human
ugaauuacauuugu

SEQ ID NO: 3146827 - RNA, 22 nt, Human
ugaauuaggcuguaacuacuuu

SEQ ID NO: 3146828 - RNA, 21 nt, Human
ugaauuaggcuguaacuacuu

SEQ ID NO: 3146829 - RNA, 20 nt, Human
ugaauuaggcuguaacuacu

SEQ ID NO: 3146830 - RNA, 17 nt, Human
ugaauuaggcuguaacu

SEQ ID NO: 3146831 - RNA, 15 nt, Human
ugaaagguacuucaa

SEQ ID NO: 3146832 - RNA, 16 nt, Human
ugaaagguacuucaaa

SEQ ID NO: 3146833 - RNA, 23 nt, Human
ugaaagcagggacuugaacccau

SEQ ID NO: 3146834 - RNA, 18 nt, Human
ugaaagaggcagcuugaa

SEQ ID NO: 3146835 - RNA, 22 nt, Human
ugaaacaacaaauaggaauugu

SEQ ID NO: 3146836 - RNA, 19 nt, Human
ugaacaaguuguuucauug

SEQ ID NO: 3146837 - RNA, 20 nt, Human
ugaacaaguuguuucauuga

SEQ ID NO: 3146838 - RNA, 22 nt, Human
ugaacaaguuguuucauugacu

SEQ ID NO: 3146839 - RNA, 16 nt, Human
ugaaauauugacuuuu

SEQ ID NO: 3146840 - RNA, 18 nt, Human
ugaaauauuauguuaaaa

SEQ ID NO: 3146841 - RNA, 19 nt, Human
ugaaauggacuuuuguaca

SEQ ID NO: 3146842 - RNA, 13 nt, Human
ucuugcuaccagu

SEQ ID NO: 3146843 - RNA, 20 nt, Human
ucuugcuaccaguauuuaga

SEQ ID NO: 3146844 - RNA, 14 nt, Human
ucuugcuaccagua

SEQ ID NO: 3146845 - RNA, 11 nt, Human
ucuugcuucuu

SEQ ID NO: 3146846 - RNA, 17 nt, Human
ucuuucacauuuaaaua

SEQ ID NO: 3146847 - RNA, 17 nt, Human
ucuugcuucuuucuaga

SEQ ID NO: 3146848 - RNA, 16 nt, Human
ucuugcuucuuucuag

SEQ ID NO: 3146849 - RNA, 18 nt, Human
ucuugcuucuuucuagaa

SEQ ID NO: 3146850 - RNA, 12 nt, Human
ucuuugccaagu

SEQ ID NO: 3146851 - RNA, 19 nt, Human
ucuuuccacagaagcucca

SEQ ID NO: 3146852 - RNA, 17 nt, Human
ugggcagcugccucccc

SEQ ID NO: 3146853 - RNA, 12 nt, Human
ugggcagcugcc

SEQ ID NO: 3146854 - RNA, 13 nt, Human
ugggcagcugccu

SEQ ID NO: 3146855 - RNA, 14 nt, Human
ugggcagcugccuc

SEQ ID NO: 3146856 - RNA, 15 nt, Human
ugggcagcugccucc

SEQ ID NO: 3146857 - RNA, 13 nt, Human
ugguauguuuuca

SEQ ID NO: 3146858 - RNA, 16 nt, Human
uggucccagccagcag

SEQ ID NO: 3146859 - RNA, 17 nt, Human
uggucacaggaaguaga

SEQ ID NO: 3146860 - RNA, 22 nt, Human
uggucacaggaaguagaggagg

SEQ ID NO: 3146861 - RNA, 16 nt, Human
uggugauuuagcagga

SEQ ID NO: 3146862 - RNA, 20 nt, Human
uggcagaguuacaguucugu

SEQ ID NO: 3146863 - RNA, 19 nt, Human
uggcagaguuacaguucug

SEQ ID NO: 3146864 - RNA, 17 nt, Human
uggcagaguuacaguuc

SEQ ID NO: 3146865 - RNA, 12 nt, Human
uggcagaguuac

SEQ ID NO: 3146866 - RNA, 15 nt, Human
uggcacuaguauuuc

SEQ ID NO: 3146867 - RNA, 20 nt, Human
uggcaauagucaaauugugu

SEQ ID NO: 3146868 - RNA, 23 nt, Human
ugcuguuuauuaaucuuagugua

SEQ ID NO: 3146869 - RNA, 17 nt, Human
ugcuguuuauuaaucuu

SEQ ID NO: 3146870 - RNA, 14 nt, Human
ugcuguuuauuaau

SEQ ID NO: 3146871 - RNA, 21 nt, Human
ugccuauuaucugucagcugc

SEQ ID NO: 3146872 - RNA, 12 nt, Human
ugcaguucugaa

SEQ ID NO: 3146873 - RNA, 22 nt, Human
ugcaucaauuuuucuuauuuca

SEQ ID NO: 3146874 - RNA, 13 nt, Human
ugcaucagcugcu

SEQ ID NO: 3146875 - RNA, 16 nt, Human
ugccacuaaauugaca

SEQ ID NO: 3146876 - RNA, 16 nt, Human
ugcucuaacagcccuc

SEQ ID NO: 3146877 - RNA, 15 nt, Human
ugcucuaacagcccu

SEQ ID NO: 3146878 - RNA, 17 nt, Human
ugcuagaacucccuuuc

SEQ ID NO: 3146879 - RNA, 15 nt, Human
ugcuagaacucccuu

SEQ ID NO: 3146880 - RNA, 14 nt, Human
ugcuagaacucccu

SEQ ID NO: 3146881 - RNA, 13 nt, Human
ugcuagaacuccc

SEQ ID NO: 3146882 - RNA, 21 nt, Human
ugcugccaauauccuaauaaa

SEQ ID NO: 3146883 - RNA, 15 nt, Human
ugcugccaauauccu

SEQ ID NO: 3146884 - RNA, 19 nt, Human
ugcugccaauauccuaaua

SEQ ID NO: 3146885 - RNA, 18 nt, Human
ugcugccaauauccuaau

SEQ ID NO: 3146886 - RNA, 17 nt, Human
ugcugccaauauccuaa

SEQ ID NO: 3146887 - RNA, 16 nt, Human
ugcugccaauauccua

SEQ ID NO: 3146888 - RNA, 20 nt, Human
ugcugggggggauuguaaaa

SEQ ID NO: 3146889 - RNA, 18 nt, Human
gugcaaauugucacagga

SEQ ID NO: 3146890 - RNA, 16 nt, Human
gugagcagucaggaaa

SEQ ID NO: 3146891 - RNA, 14 nt, Human
gugagcuacaaaug

SEQ ID NO: 3146892 - RNA, 22 nt, Human
gugaauuaggcuguaacuacuu

SEQ ID NO: 3146893 - RNA, 21 nt, Human
gugaauuaggcuguaacuacu

SEQ ID NO: 3146894 - RNA, 18 nt, Human
gugaauuaggcuguaacu

SEQ ID NO: 3146895 - RNA, 14 nt, Human
gucugccagccagc

SEQ ID NO: 3146896 - RNA, 15 nt, Human
gucugccagccagca

SEQ ID NO: 3146897 - RNA, 20 nt, Human
gugaaacucguuaauuugua

SEQ ID NO: 3146898 - RNA, 19 nt, Human
gugaaagaaaauaacaaua

SEQ ID NO: 3146899 - RNA, 21 nt, Human
gugcugcccgucuucagccua

SEQ ID NO: 3146900 - RNA, 18 nt, Human
gugcugcccgucuucagc

SEQ ID NO: 3146901 - RNA, 19 nt, Human
gugcugcccgucuucagcc

SEQ ID NO: 3146902 - RNA, 19 nt, Human
gugcuguuuauuaaucuua

SEQ ID NO: 3146903 - RNA, 15 nt, Human
gugcuguuuauuaau

SEQ ID NO: 3146904 - RNA, 24 nt, Human
gugcuuggcccaggaguuuggcca

SEQ ID NO: 3146905 - RNA, 19 nt, Human
gugcuuggcccaggaguuu

SEQ ID NO: 3146906 - RNA, 17 nt, Human
gugcuuggcccaggagu

SEQ ID NO: 3146907 - RNA, 16 nt, Human
gugcuuggcccaggag

SEQ ID NO: 3146908 - RNA, 15 nt, Human
gugcuuggcccagga

SEQ ID NO: 3146909 - RNA, 14 nt, Human
gugcuuggcccagg

SEQ ID NO: 3146910 - RNA, 13 nt, Human
gugcuuggcccag

SEQ ID NO: 3146911 - RNA, 20 nt, Human
gugcucuuuucuccucacug

SEQ ID NO: 3146912 - RNA, 16 nt, Human
gugcucuuuucuccuc

SEQ ID NO: 3146913 - RNA, 14 nt, Human
gugcucuuuucucc

SEQ ID NO: 3146914 - RNA, 22 nt, Human
gucauccucaaagaaaguguau

SEQ ID NO: 3146915 - RNA, 19 nt, Human
gucauccucaaagaaagug

SEQ ID NO: 3146916 - RNA, 22 nt, Human
gucaucuugcuaccaguauuua

SEQ ID NO: 3146917 - RNA, 18 nt, Human
gucaucuugcuaccagua

SEQ ID NO: 3146918 - RNA, 15 nt, Human
gucaucuugcuacca

SEQ ID NO: 3146919 - RNA, 14 nt, Human
gucaucuugcuacc

SEQ ID NO: 3146920 - RNA, 12 nt, Human
gucaucuugcua

SEQ ID NO: 3146921 - RNA, 20 nt, Human
gucccagccagcaguucaga

SEQ ID NO: 3146922 - RNA, 14 nt, Human
guccagggcccuga

SEQ ID NO: 3146923 - RNA, 15 nt, Human
guccagggcccugag

SEQ ID NO: 3146924 - RNA, 16 nt, Human
guccagggcccugagc

SEQ ID NO: 3146925 - RNA, 21 nt, Human
guauuuggaaauaaagucaga

SEQ ID NO: 3146926 - RNA, 20 nt, Human
guauuuggaaauaaagucag

SEQ ID NO: 3146927 - RNA, 19 nt, Human
guauuuggaaauaaaguca

SEQ ID NO: 3146928 - RNA, 22 nt, Human
guauuucuaugaaauauuaugu

SEQ ID NO: 3146929 - RNA, 17 nt, Human
guauuucuaugaaauau

SEQ ID NO: 3146930 - RNA, 13 nt, Human
gucaaggcuuaga

SEQ ID NO: 3146931 - RNA, 17 nt, Human
guauuuuaaaagaauga

SEQ ID NO: 3146932 - RNA, 16 nt, Human
guauuuuaaaagaaug

SEQ ID NO: 3146933 - RNA, 14 nt, Human
gucaccucauggaa

SEQ ID NO: 3146934 - RNA, 15 nt, Human
gucaauaaaauccau

SEQ ID NO: 3146935 - RNA, 21 nt, Human
gucaauaaaauccauacauuu

SEQ ID NO: 3146936 - RNA, 15 nt, Human
gucccugguaauaag

SEQ ID NO: 3146937 - RNA, 22 nt, Human
guccuggggccucggagccuca

SEQ ID NO: 3146938 - RNA, 14 nt, Human
guccuggggccucg

SEQ ID NO: 3146939 - RNA, 18 nt, Human
guccugucggagcccugu

SEQ ID NO: 3146940 - RNA, 20 nt, Human
guccugucggagcccugucu

SEQ ID NO: 3146941 - RNA, 21 nt, Human
guccugucggagcccugucuc

SEQ ID NO: 3146942 - RNA, 17 nt, Human
gucuacacuaagagaga

SEQ ID NO: 3146943 - RNA, 23 nt, Human
gucuacacuaagagagaaugaga

SEQ ID NO: 3146944 - RNA, 17 nt, Human
ggggcagaacagccgcu

SEQ ID NO: 3146945 - RNA, 23 nt, Human
ggguaccuugaacacugggggag

SEQ ID NO: 3146946 - RNA, 22 nt, Human
ggugccccccuugccagacaug

SEQ ID NO: 3146947 - RNA, 19 nt, Human
ggugcuacaaaaacacagc

SEQ ID NO: 3146948 - RNA, 22 nt, Human
gguacuucaaauccuugaagau

SEQ ID NO: 3146949 - RNA, 12 nt, Human
gguaccuugaac

SEQ ID NO: 3146950 - RNA, 18 nt, Human
gguaccuugaacacuggg

SEQ ID NO: 3146951 - RNA, 21 nt, Human
ggguagccacuggacugacga

SEQ ID NO: 3146952 - RNA, 22 nt, Human
gguagacacacaugaaguccaa

SEQ ID NO: 3146953 - RNA, 15 nt, Human
gguagacacacauga

SEQ ID NO: 3146954 - RNA, 20 nt, Human
guaauuagugccacuuaaug

SEQ ID NO: 3146955 - RNA, 21 nt, Human
guaauuagugccacuuaaugu

SEQ ID NO: 3146956 - RNA, 15 nt, Human
guaauuggaaaggca

SEQ ID NO: 3146957 - RNA, 19 nt, Human
guaaugauaacuggaaacu

SEQ ID NO: 3146958 - RNA, 20 nt, Human
guacagaauucugcuaccuc

SEQ ID NO: 3146959 - RNA, 23 nt, Human
guacacugccuucucaacuccaa

SEQ ID NO: 3146960 - RNA, 15 nt, Human
guagaggagaaacug

SEQ ID NO: 3146961 - RNA, 23 nt, Human
guacuuuauuuucuauaauuuaa

SEQ ID NO: 3146962 - RNA, 15 nt, Human
guacuucaugcuguc

SEQ ID NO: 3146963 - RNA, 15 nt, Human
guaccgcaaugugac

SEQ ID NO: 3146964 - RNA, 18 nt, Human
guaccuugaacacugggg

SEQ ID NO: 3146965 - RNA, 23 nt, Human
guaccuugaacacugggggaggg

SEQ ID NO: 3146966 - RNA, 14 nt, Human
guaccuugaacacu

SEQ ID NO: 3146967 - RNA, 18 nt, Human
gguuuaaagaaaguguau

SEQ ID NO: 3146968 - RNA, 16 nt, Human
gguucagagacucagg

SEQ ID NO: 3146969 - RNA, 14 nt, Human
guaaaaccacagca

SEQ ID NO: 3146970 - RNA, 15 nt, Human
guaaaaccacagcag

SEQ ID NO: 3146971 - RNA, 16 nt, Human
guaaaaccacagcagu

SEQ ID NO: 3146972 - RNA, 18 nt, Human
guaaaaccacagcaguug

SEQ ID NO: 3146973 - RNA, 23 nt, Human
guaaaaccacagcaguugaaaag

SEQ ID NO: 3146974 - RNA, 14 nt, Human
guaaauaggaauug

SEQ ID NO: 3146975 - RNA, 18 nt, Human
guaagggaaacugccagc

SEQ ID NO: 3146976 - RNA, 17 nt, Human
guaagggaaacugccag

SEQ ID NO: 3146977 - RNA, 14 nt, Human
guaacuuuugugaa

SEQ ID NO: 3146978 - RNA, 20 nt, Human
ggaagugacgguuuaauggg

SEQ ID NO: 3146979 - RNA, 23 nt, Human
ggaauuucucccagucauuuaau

SEQ ID NO: 3146980 - RNA, 22 nt, Human
ggaauuucuuaacuucuugcuu

SEQ ID NO: 3146981 - RNA, 18 nt, Human
ggaauuucuuaacuucuu

SEQ ID NO: 3146982 - RNA, 22 nt, Human
ggaauuggagcucgugggacag

SEQ ID NO: 3146983 - RNA, 16 nt, Human
ggaauuggagcucgug

SEQ ID NO: 3146984 - RNA, 14 nt, Human
ggacgcucucuggc

SEQ ID NO: 3146985 - RNA, 13 nt, Human
ggacgcucucugg

SEQ ID NO: 3146986 - RNA, 19 nt, Human
ggagaaucacuugaacccg

SEQ ID NO: 3146987 - RNA, 15 nt, Human
ggagaaucacuugaa

SEQ ID NO: 3146988 - RNA, 14 nt, Human
ggaaaauucauuuu

SEQ ID NO: 3146989 - RNA, 23 nt, Human
ggaaagggauuuucagcccucag

SEQ ID NO: 3146990 - RNA, 17 nt, Human
ggaaaucaaauaugcaa

SEQ ID NO: 3146991 - RNA, 16 nt, Human
ggaaaucaaauaugca

SEQ ID NO: 3146992 - RNA, 19 nt, Human
gcuuagaccucagccugug

SEQ ID NO: 3146993 - RNA, 23 nt, Human
gcuuagaccucagccugugcugc

SEQ ID NO: 3146994 - RNA, 18 nt, Human
gcuuagaccucagccugu

SEQ ID NO: 3146995 - RNA, 21 nt, Human
gcugccaauauccuaauaaaa

SEQ ID NO: 3146996 - RNA, 20 nt, Human
gcugccaauauccuaauaaa

SEQ ID NO: 3146997 - RNA, 20 nt, Human
gcugucuacacuaagagaga

SEQ ID NO: 3146998 - RNA, 23 nt, Human
gcugccaauauccuaauaaaaag

SEQ ID NO: 3146999 - RNA, 19 nt, Human
ggccucggagccucauccg

SEQ ID NO: 3147000 - RNA, 22 nt, Human
ggccucggagccucauccgagg

SEQ ID NO: 3147001 - RNA, 13 nt, Human
ggccucggagccu

SEQ ID NO: 3147002 - RNA, 15 nt, Human
ggccucggagccuca

SEQ ID NO: 3147003 - RNA, 14 nt, Human
ggcccugagcucgg

SEQ ID NO: 3147004 - RNA, 19 nt, Human
ggcccugagcucgguggac

SEQ ID NO: 3147005 - RNA, 21 nt, Human
ggcccugagcucgguggaccc

SEQ ID NO: 3147006 - RNA, 12 nt, Human
ggauuggggaag

SEQ ID NO: 3147007 - RNA, 15 nt, Human
ggauuguaaaauggu

SEQ ID NO: 3147008 - RNA, 18 nt, Human
ggauuggggaagacugug

SEQ ID NO: 3147009 - RNA, 19 nt, Human
ggauuggggaagacugugg

SEQ ID NO: 3147010 - RNA, 14 nt, Human
ggcauggcugggaa

SEQ ID NO: 3147011 - RNA, 11 nt, Human
gcucagccugg

SEQ ID NO: 3147012 - RNA, 14 nt, Human
gcucagccuggugg

SEQ ID NO: 3147013 - RNA, 15 nt, Human
gcucagccugguggg

SEQ ID NO: 3147014 - RNA, 17 nt, Human
gcucagccuggugggcc

SEQ ID NO: 3147015 - RNA, 18 nt, Human
gcucagccuggugggccu

SEQ ID NO: 3147016 - RNA, 19 nt, Human
gcucagccuggugggccuc

SEQ ID NO: 3147017 - RNA, 20 nt, Human
gcucagccuggugggccucc

SEQ ID NO: 3147018 - RNA, 17 nt, Human
gcuaagcaaaaugugau

SEQ ID NO: 3147019 - RNA, 14 nt, Human
gcuaagcauuccaa

SEQ ID NO: 3147020 - RNA, 15 nt, Human
gcugccaauauccua

SEQ ID NO: 3147021 - RNA, 14 nt, Human
gcugccaauauccu

SEQ ID NO: 3147022 - RNA, 19 nt, Human
gcugccaauauccuaauaa

SEQ ID NO: 3147023 - RNA, 18 nt, Human
gcugccaauauccuaaua

SEQ ID NO: 3147024 - RNA, 17 nt, Human
gcugccaauauccuaau

SEQ ID NO: 3147025 - RNA, 16 nt, Human
gcugccaauauccuaa

SEQ ID NO: 3147026 - RNA, 11 nt, Human
gcucucuggcc

SEQ ID NO: 3147027 - RNA, 13 nt, Human
gcucucuggccuu

SEQ ID NO: 3147028 - RNA, 12 nt, Human
gcucucuggccu

SEQ ID NO: 3147029 - RNA, 20 nt, Human
gcucucuggccuucggccuc

SEQ ID NO: 3147030 - RNA, 19 nt, Human
gcucucuggccuucggccu

SEQ ID NO: 3147031 - RNA, 15 nt, Human
gcucucuggccuucg

SEQ ID NO: 3147032 - RNA, 14 nt, Human
gcucucuggccuuc

SEQ ID NO: 3147033 - RNA, 22 nt, Human
gcccucuccugggcagcugccu

SEQ ID NO: 3147034 - RNA, 23 nt, Human
gcccucuccugggcagcugccuc

SEQ ID NO: 3147035 - RNA, 12 nt, Human
gcccucuccugg

SEQ ID NO: 3147036 - RNA, 13 nt, Human
gcccucuccuggg

SEQ ID NO: 3147037 - RNA, 21 nt, Human
gcccucuccugggcagcugcc

SEQ ID NO: 3147038 - RNA, 14 nt, Human
gccucggagccuca

SEQ ID NO: 3147039 - RNA, 15 nt, Human
gccucggagccucau

SEQ ID NO: 3147040 - RNA, 17 nt, Human
gccucggagccucaucc

SEQ ID NO: 3147041 - RNA, 23 nt, Human
gccucggagccucauccgaggca

SEQ ID NO: 3147042 - RNA, 23 nt, Human
gccuccccuccucugcuugccau

SEQ ID NO: 3147043 - RNA, 18 nt, Human
gccucauccgaggcaggg

SEQ ID NO: 3147044 - RNA, 19 nt, Human
gccucauccgaggcagggu

SEQ ID NO: 3147045 - RNA, 16 nt, Human
gccucauccgaggcag

SEQ ID NO: 3147046 - RNA, 17 nt, Human
gccucauccgaggcagg

SEQ ID NO: 3147047 - RNA, 17 nt, Human
gccuaagugcagccccg

SEQ ID NO: 3147048 - RNA, 22 nt, Human
gccuauauuuuuuguuaaauga

SEQ ID NO: 3147049 - RNA, 23 nt, Human
gagccaaggguucagagacucag

SEQ ID NO: 3147050 - RNA, 12 nt, Human
gagccaccaguu

SEQ ID NO: 3147051 - RNA, 19 nt, Human
gagccaaggguucagagac

SEQ ID NO: 3147052 - RNA, 16 nt, Human
gagacaggaccugacu

SEQ ID NO: 3147053 - RNA, 20 nt, Human
gagacagcucugcauacuca

SEQ ID NO: 3147054 - RNA, 20 nt, Human
gagaaugagagacacacuga

SEQ ID NO: 3147055 - RNA, 19 nt, Human
gagagacacacugaagaag

SEQ ID NO: 3147056 - RNA, 22 nt, Human
gacuuaagcaucuggcucuaau

SEQ ID NO: 3147057 - RNA, 20 nt, Human
gacuuaagcaucuggcucua

SEQ ID NO: 3147058 - RNA, 17 nt, Human
gacuucuaaguaaaacc

SEQ ID NO: 3147059 - RNA, 18 nt, Human
gacuucuaaguaaaacca

SEQ ID NO: 3147060 - RNA, 16 nt, Human
gacuucuaaguaaaac

SEQ ID NO: 3147061 - RNA, 19 nt, Human
gacuucuaaguaaaaccac

SEQ ID NO: 3147062 - RNA, 23 nt, Human
gacuucuaaguaaaaccacagca

SEQ ID NO: 3147063 - RNA, 24 nt, Human
gacuucuaaguaaaaccacagcag

SEQ ID NO: 3147064 - RNA, 20 nt, Human
gacuucugucuucacaacag

SEQ ID NO: 3147065 - RNA, 23 nt, Human
gacuucugucuucacaacagauu

SEQ ID NO: 3147066 - RNA, 22 nt, Human
gagaaccuagggugauauuaac

SEQ ID NO: 3147067 - RNA, 21 nt, Human
gagaaccuagggugauauuaa

SEQ ID NO: 3147068 - RNA, 17 nt, Human
gagaaugagagacacac

SEQ ID NO: 3147069 - RNA, 23 nt, Human
gagaacuuccagauccuggaaau

SEQ ID NO: 3147070 - RNA, 22 nt, Human
gagaacuuccagauccuggaaa

SEQ ID NO: 3147071 - RNA, 16 nt, Human
gacugcauuauauuua

SEQ ID NO: 3147072 - RNA, 14 nt, Human
gacugcauuauauu

SEQ ID NO: 3147073 - RNA, 21 nt, Human
gacucauuuuaaaaaauggaa

SEQ ID NO: 3147074 - RNA, 11 nt, Human
gacuccaaaga

SEQ ID NO: 3147075 - RNA, 12 nt, Human
gacuccaaagaa

SEQ ID NO: 3147076 - RNA, 15 nt, Human
gacuccaaagaaaug

SEQ ID NO: 3147077 - RNA, 16 nt, Human
gacuccaaagaaaugu

SEQ ID NO: 3147078 - RNA, 18 nt, Human
gacuagauguaguauuuu

SEQ ID NO: 3147079 - RNA, 17 nt, Human
gacuagauguaguauuu

SEQ ID NO: 3147080 - RNA, 21 nt, Human
gaauugacccacaagaaauga

SEQ ID NO: 3147081 - RNA, 16 nt, Human
gaauugacccacaaga

SEQ ID NO: 3147082 - RNA, 16 nt, Human
gaauuggagcucgugg

SEQ ID NO: 3147083 - RNA, 16 nt, Human
gacaaggaaaaaauaa

SEQ ID NO: 3147084 - RNA, 21 nt, Human
gaauuucuuaacuucuugcuu

SEQ ID NO: 3147085 - RNA, 19 nt, Human
gaauuucuuaacuucuugc

SEQ ID NO: 3147086 - RNA, 14 nt, Human
gaauuucuuaacuu

SEQ ID NO: 3147087 - RNA, 13 nt, Human
gaauuucuuaacu

SEQ ID NO: 3147088 - RNA, 18 nt, Human
gaauuucuuaacuucuug

SEQ ID NO: 3147089 - RNA, 17 nt, Human
gaauuucuuaacuucuu

SEQ ID NO: 3147090 - RNA, 16 nt, Human
gaauuucuuaacuucu

SEQ ID NO: 3147091 - RNA, 15 nt, Human
gaauuucuuaacuuc

SEQ ID NO: 3147092 - RNA, 15 nt, Human
gacaagcucacagac

SEQ ID NO: 3147093 - RNA, 18 nt, Human
gaccacugcagaagacag

SEQ ID NO: 3147094 - RNA, 21 nt, Human
gaccacugcagaagacaguau

SEQ ID NO: 3147095 - RNA, 16 nt, Human
gacaugggacauuugc

SEQ ID NO: 3147096 - RNA, 15 nt, Human
gacccacaagaaaug

SEQ ID NO: 3147097 - RNA, 16 nt, Human
gacccaaaaggcagaa

SEQ ID NO: 3147098 - RNA, 20 nt, Human
gacccaaaaggcagaagcaa

SEQ ID NO: 3147099 - RNA, 20 nt, Human
gacauagaauuaacacauga

SEQ ID NO: 3147100 - RNA, 17 nt, Human
gacagggaggacgcucu

SEQ ID NO: 3147101 - RNA, 18 nt, Human
gacagggaggacgcucuc

SEQ ID NO: 3147102 - RNA, 13 nt, Human
gacagggacccac

SEQ ID NO: 3147103 - RNA, 19 nt, Human
gacagggacccacuucaca

SEQ ID NO: 3147104 - RNA, 19 nt, Human
gacaccaggagucccuggu

SEQ ID NO: 3147105 - RNA, 20 nt, Human
gacaccaggagucccuggua

SEQ ID NO: 3147106 - RNA, 16 nt, Human
gaguuacaguucugug

SEQ ID NO: 3147107 - RNA, 15 nt, Human
gaguuacaguucugu

SEQ ID NO: 3147108 - RNA, 14 nt, Human
gaguuacaguucug

SEQ ID NO: 3147109 - RNA, 13 nt, Human
gaguuacaguucu

SEQ ID NO: 3147110 - RNA, 23 nt, Human
gagugaacaaauuuacagagaca

SEQ ID NO: 3147111 - RNA, 14 nt, Human
gaguaauuuauugu

SEQ ID NO: 3147112 - RNA, 19 nt, Human
gaggcagacagcagcucag

SEQ ID NO: 3147113 - RNA, 20 nt, Human
gaggcagacagcagcucagg

SEQ ID NO: 3147114 - RNA, 21 nt, Human
gaggcagacagcagcucaggc

SEQ ID NO: 3147115 - RNA, 22 nt, Human
gaggcagacagcagcucaggca

SEQ ID NO: 3147116 - RNA, 12 nt, Human
gagcccugucuc

SEQ ID NO: 3147117 - RNA, 15 nt, Human
gaggguuagggaggg

SEQ ID NO: 3147118 - RNA, 15 nt, Human
gcacugacuucuaag

SEQ ID NO: 3147119 - RNA, 18 nt, Human
gcacugacuucuaaguaa

SEQ ID NO: 3147120 - RNA, 21 nt, Human
gcagacagcagcucaggcaca

SEQ ID NO: 3147121 - RNA, 13 nt, Human
gcagacagcagcu

SEQ ID NO: 3147122 - RNA, 14 nt, Human
gcagacagcagcuc

SEQ ID NO: 3147123 - RNA, 16 nt, Human
gcagacagcagcucag

SEQ ID NO: 3147124 - RNA, 17 nt, Human
gcagacagcagcucagg

SEQ ID NO: 3147125 - RNA, 18 nt, Human
gcagacagcagcucaggc

SEQ ID NO: 3147126 - RNA, 19 nt, Human
gcagacagcagcucaggca

SEQ ID NO: 3147127 - RNA, 20 nt, Human
gcagacagcagcucaggcac

SEQ ID NO: 3147128 - RNA, 12 nt, Human
gcacacuguagc

SEQ ID NO: 3147129 - RNA, 13 nt, Human
gcacacugucugc

SEQ ID NO: 3147130 - RNA, 20 nt, Human
gauuggggaagacuguggcu

SEQ ID NO: 3147131 - RNA, 13 nt, Human
gauuuccuaauac

SEQ ID NO: 3147132 - RNA, 16 nt, Human
gcaaauugucacagga

SEQ ID NO: 3147133 - RNA, 20 nt, Human
gaugcuagaacucccuuuca

SEQ ID NO: 3147134 - RNA, 18 nt, Human
gaugcuagaacucccuuu

SEQ ID NO: 3147135 - RNA, 19 nt, Human
gauguugaaaaaguucugc

SEQ ID NO: 3147136 - RNA, 23 nt, Human
cuugucaauaaaauccauacauu

SEQ ID NO: 3147137 - RNA, 19 nt, Human
cuugaguuuaaauuguaau

SEQ ID NO: 3147138 - RNA, 18 nt, Human
gaaaauauuuguaucaca

SEQ ID NO: 3147139 - RNA, 22 nt, Human
gaaaaucuacacuccagugaga

SEQ ID NO: 3147140 - RNA, 18 nt, Human
gaaaaucuuauaauuuaa

SEQ ID NO: 3147141 - RNA, 23 nt, Human
gaaacucguuaauuuguaguguu

SEQ ID NO: 3147142 - RNA, 14 nt, Human
gaaacccugucucu

SEQ ID NO: 3147143 - RNA, 16 nt, Human
gaaacacaacuauauu

SEQ ID NO: 3147144 - RNA, 11 nt, Human
gaaacauuugg

SEQ ID NO: 3147145 - RNA, 17 nt, Human
gaaagcagaacagugau

SEQ ID NO: 3147146 - RNA, 14 nt, Human
gaaagcagaacagu

SEQ ID NO: 3147147 - RNA, 22 nt, Human
gaaagcagaacagugauuacca

SEQ ID NO: 3147148 - RNA, 17 nt, Human
gaaagagaacuuccaga

SEQ ID NO: 3147149 - RNA, 20 nt, Human
gaaagaggcagcuugaaacu

SEQ ID NO: 3147150 - RNA, 21 nt, Human
gaaagaggaaugaaguacuca

SEQ ID NO: 3147151 - RNA, 18 nt, Human
gaaagagaaacaguuggu

SEQ ID NO: 3147152 - RNA, 14 nt, Human
gaaagcagggacuu

SEQ ID NO: 3147153 - RNA, 20 nt, Human
cuuagaugcaguucugaaga

SEQ ID NO: 3147154 - RNA, 22 nt, Human
cuuagaugcaguucugaagaag

SEQ ID NO: 3147155 - RNA, 15 nt, Human
cuuaguguaugauua

SEQ ID NO: 3147156 - RNA, 11 nt, Human
cuuaguguaug

SEQ ID NO: 3147157 - RNA, 22 nt, Human
cuucacacacaggcaacugagg

SEQ ID NO: 3147158 - RNA, 21 nt, Human
cuucacacacaggcaacugag

SEQ ID NO: 3147159 - RNA, 13 nt, Human
cuuauuuauuauu

SEQ ID NO: 3147160 - RNA, 14 nt, Human
cuuauuucauuucu

SEQ ID NO: 3147161 - RNA, 15 nt, Human
cuuauuucauuucuu

SEQ ID NO: 3147162 - RNA, 15 nt, Human
cuuauuuccucauuu

SEQ ID NO: 3147163 - RNA, 14 nt, Human
cuucucuccagcug

SEQ ID NO: 3147164 - RNA, 16 nt, Human
cuucucuccagcugac

SEQ ID NO: 3147165 - RNA, 15 nt, Human
cuucucuccagcuga

SEQ ID NO: 3147166 - RNA, 19 nt, Human
cuucucuccagcugacuaa

SEQ ID NO: 3147167 - RNA, 18 nt, Human
cuucucuccagcugacua

SEQ ID NO: 3147168 - RNA, 17 nt, Human
cuucucuccagcugacu

SEQ ID NO: 3147169 - RNA, 18 nt, Human
cuucugucuucacaacag

SEQ ID NO: 3147170 - RNA, 21 nt, Human
cuucugucuucacaacagauu

SEQ ID NO: 3147171 - RNA, 22 nt, Human
cuucugucuucacaacagauua

SEQ ID NO: 3147172 - RNA, 13 nt, Human
cuugaacacuggg

SEQ ID NO: 3147173 - RNA, 15 nt, Human
cuugaacacuggggg

SEQ ID NO: 3147174 - RNA, 16 nt, Human
cuugaacacuggggga

SEQ ID NO: 3147175 - RNA, 20 nt, Human
cuucuuggucuuauuuauua

SEQ ID NO: 3147176 - RNA, 16 nt, Human
cuucuuggucuuauuu

SEQ ID NO: 3147177 - RNA, 21 nt, Human
cuucuugcuucuuucuagaaa

SEQ ID NO: 3147178 - RNA, 20 nt, Human
cuucuugcuucuuucuagaa

SEQ ID NO: 3147179 - RNA, 20 nt, Human
cuguuaaaagaugaaaauau

SEQ ID NO: 3147180 - RNA, 21 nt, Human
cuguuaaaagaugaaaauauu

SEQ ID NO: 3147181 - RNA, 23 nt, Human
cuguuaaaagaugaaaauauuug

SEQ ID NO: 3147182 - RNA, 17 nt, Human
cugucucaccuggacuu

SEQ ID NO: 3147183 - RNA, 14 nt, Human
cugucucaccugga

SEQ ID NO: 3147184 - RNA, 12 nt, Human
cugucucaccug

SEQ ID NO: 3147185 - RNA, 17 nt, Human
cuguggcugcuagcacu

SEQ ID NO: 3147186 - RNA, 18 nt, Human
cuguggcagaguuacagu

SEQ ID NO: 3147187 - RNA, 17 nt, Human
cuguggcagaguuacag

SEQ ID NO: 3147188 - RNA, 23 nt, Human
cuguggcagaguuacaguucugu

SEQ ID NO: 3147189 - RNA, 22 nt, Human
cuguggcagaguuacaguucug

SEQ ID NO: 3147190 - RNA, 19 nt, Human
cuguggcagaguuacaguu

SEQ ID NO: 3147191 - RNA, 23 nt, Human
cuguauccagguucccucccaga

SEQ ID NO: 3147192 - RNA, 19 nt, Human
cuguauuuuaaaagaauga

SEQ ID NO: 3147193 - RNA, 20 nt, Human
cuguauuuuaaaagaaugau

SEQ ID NO: 3147194 - RNA, 22 nt, Human
cuguauuuuaaaagaaugauua

SEQ ID NO: 3147195 - RNA, 20 nt, Human
cugucuacacuaagagagaa

SEQ ID NO: 3147196 - RNA, 19 nt, Human
cuguccagggcccugagcu

SEQ ID NO: 3147197 - RNA, 20 nt, Human
cuguccagggcccugagcuc

SEQ ID NO: 3147198 - RNA, 22 nt, Human
cuguccagggcccugagcucgg

SEQ ID NO: 3147199 - RNA, 23 nt, Human
cuguccagggcccugagcucggu

SEQ ID NO: 3147200 - RNA, 18 nt, Human
cuguccagggcccugagc

SEQ ID NO: 3147201 - RNA, 23 nt, Human
cuguaaucacagcuacuugggag

SEQ ID NO: 3147202 - RNA, 22 nt, Human
cuguaauaaacucauuucuagc

SEQ ID NO: 3147203 - RNA, 22 nt, Human
cugggggggauuguaaaauggu

SEQ ID NO: 3147204 - RNA, 19 nt, Human
cugggguccuggggccucg

SEQ ID NO: 3147205 - RNA, 15 nt, Human
cugggguccuggggc

SEQ ID NO: 3147206 - RNA, 18 nt, Human
cugggguccuggggccuc

SEQ ID NO: 3147207 - RNA, 18 nt, Human
cugcugaaacaacaaaua

SEQ ID NO: 3147208 - RNA, 15 nt, Human
cugcccuagagcaca

SEQ ID NO: 3147209 - RNA, 19 nt, Human
cugcccuagagcacacugu

SEQ ID NO: 3147210 - RNA, 21 nt, Human
cugcccuagagcacacuguag

SEQ ID NO: 3147211 - RNA, 15 nt, Human
cugcccucuccuggg

SEQ ID NO: 3147212 - RNA, 16 nt, Human
cugcccucuccugggc

SEQ ID NO: 3147213 - RNA, 18 nt, Human
cugcccucuccugggcag

SEQ ID NO: 3147214 - RNA, 19 nt, Human
cugcccucuccugggcagc

SEQ ID NO: 3147215 - RNA, 20 nt, Human
cugcccucuccugggcagcu

SEQ ID NO: 3147216 - RNA, 21 nt, Human
cugcccucuccugggcagcug

SEQ ID NO: 3147217 - RNA, 13 nt, Human
cugccuccccucc

SEQ ID NO: 3147218 - RNA, 16 nt, Human
cuggagcucugcccau

SEQ ID NO: 3147219 - RNA, 13 nt, Human
cuggagcucugcc

SEQ ID NO: 3147220 - RNA, 12 nt, Human
cuggagcucugc

SEQ ID NO: 3147221 - RNA, 20 nt, Human
cuggcacaguuuucugagaa

SEQ ID NO: 3147222 - RNA, 21 nt, Human
cuggcacaguuuucugagaaa

SEQ ID NO: 3147223 - RNA, 22 nt, Human
cuggcacaguuuucugagaaag

SEQ ID NO: 3147224 - RNA, 23 nt, Human
cuggccuucggccuccauccuga

SEQ ID NO: 3147225 - RNA, 22 nt, Human
cuggccuucggccuccauccug

SEQ ID NO: 3147226 - RNA, 15 nt, Human
ccagggcccugagcu

SEQ ID NO: 3147227 - RNA, 18 nt, Human
ccagggcccugagcucgg

SEQ ID NO: 3147228 - RNA, 20 nt, Human
ccagguagaggguguguaag

SEQ ID NO: 3147229 - RNA, 12 nt, Human
ccaggugccagu

SEQ ID NO: 3147230 - RNA, 18 nt, Human
ccauccugaggcuccacu

SEQ ID NO: 3147231 - RNA, 20 nt, Human
ccauccugaggcuccacuug

SEQ ID NO: 3147232 - RNA, 16 nt, Human
ccauccugaggcucca

SEQ ID NO: 3147233 - RNA, 19 nt, Human
ccagccugagcgacaguga

SEQ ID NO: 3147234 - RNA, 15 nt, Human
ccacugguucuucuu

SEQ ID NO: 3147235 - RNA, 14 nt, Human
ccagacaucaacag

SEQ ID NO: 3147236 - RNA, 19 nt, Human
ccagacauguggugggaca

SEQ ID NO: 3147237 - RNA, 23 nt, Human
ccagacauguggugggacaggga

SEQ ID NO: 3147238 - RNA, 15 nt, Human
ccaccucccugcaau

SEQ ID NO: 3147239 - RNA, 14 nt, Human
ccaccucccugcaa

SEQ ID NO: 3147240 - RNA, 19 nt, Human
ccaccucccugcaauaaaa

SEQ ID NO: 3147241 - RNA, 21 nt, Human
ccaccucccugcaauaaaaug

SEQ ID NO: 3147242 - RNA, 18 nt, Human
ccccagacuagauguagu

SEQ ID NO: 3147243 - RNA, 15 nt, Human
ccccagacuagaugu

SEQ ID NO: 3147244 - RNA, 15 nt, Human
ccccucggagaagag

SEQ ID NO: 3147245 - RNA, 13 nt, Human
ccccuccucugcu

SEQ ID NO: 3147246 - RNA, 14 nt, Human
ccccuccucugcuu

SEQ ID NO: 3147247 - RNA, 17 nt, Human
ccccuccucugcuugcc

SEQ ID NO: 3147248 - RNA, 20 nt, Human
ccguuggggauuggggaaga

SEQ ID NO: 3147249 - RNA, 14 nt, Human
ccgcuccugucugc

SEQ ID NO: 3147250 - RNA, 15 nt, Human
ccgcuccugucugcc

SEQ ID NO: 3147251 - RNA, 17 nt, Human
ccgcuccugucugccag

SEQ ID NO: 3147252 - RNA, 20 nt, Human
cccucuccugggcagcugcc

SEQ ID NO: 3147253 - RNA, 15 nt, Human
cccucuccugggcag

SEQ ID NO: 3147254 - RNA, 21 nt, Human
cccucuccugggcagcugccu

SEQ ID NO: 3147255 - RNA, 22 nt, Human
cccucuccugggcagcugccuc

SEQ ID NO: 3147256 - RNA, 23 nt, Human
cccucuccugggcagcugccucc

SEQ ID NO: 3147257 - RNA, 16 nt, Human
cccuccccugcccuag

SEQ ID NO: 3147258 - RNA, 13 nt, Human
cccuugccagaca

SEQ ID NO: 3147259 - RNA, 12 nt, Human
cccuugcccagg

SEQ ID NO: 3147260 - RNA, 15 nt, Human
cccuugccagacaug

SEQ ID NO: 3147261 - RNA, 23 nt, Human
cccuugcccagggcucagccugg

SEQ ID NO: 3147262 - RNA, 21 nt, Human
cccuugcccagggcucagccu

SEQ ID NO: 3147263 - RNA, 22 nt, Human
cccuugcccagggcucagccug

SEQ ID NO: 3147264 - RNA, 14 nt, Human
cccuugcccagggc

SEQ ID NO: 3147265 - RNA, 15 nt, Human
cccuugcccagggcu

SEQ ID NO: 3147266 - RNA, 19 nt, Human
cccuugcccagggcucagc

SEQ ID NO: 3147267 - RNA, 20 nt, Human
cccuugcccagggcucagcc

SEQ ID NO: 3147268 - RNA, 19 nt, Human
cccuuaugcgguuaauuuu

SEQ ID NO: 3147269 - RNA, 16 nt, Human
ccuuguauuuaaauau

SEQ ID NO: 3147270 - RNA, 18 nt, Human
ccuucggccuccauccug

SEQ ID NO: 3147271 - RNA, 17 nt, Human
ccuucggccuccauccu

SEQ ID NO: 3147272 - RNA, 16 nt, Human
ccuucggccuccaucc

SEQ ID NO: 3147273 - RNA, 15 nt, Human
ccuuggacucauuuu

SEQ ID NO: 3147274 - RNA, 13 nt, Human
ccuuguauuuaaa

SEQ ID NO: 3147275 - RNA, 14 nt, Human
ccuuguauuuaaau

SEQ ID NO: 3147276 - RNA, 23 nt, Human
cgggaaggaggguuagggagggg

SEQ ID NO: 3147277 - RNA, 12 nt, Human
cgggaaggaggg

SEQ ID NO: 3147278 - RNA, 14 nt, Human
cgggaaggaggguu

SEQ ID NO: 3147279 - RNA, 14 nt, Human
cgaggcagggucag

SEQ ID NO: 3147280 - RNA, 22 nt, Human
cgaggcagggucaggagagggg

SEQ ID NO: 3147281 - RNA, 15 nt, Human
ccugagcucggugga

SEQ ID NO: 3147282 - RNA, 16 nt, Human
ccugagcucgguggac

SEQ ID NO: 3147283 - RNA, 18 nt, Human
ccugagcucgguggaccc

SEQ ID NO: 3147284 - RNA, 19 nt, Human
ccugagcucgguggaccca

SEQ ID NO: 3147285 - RNA, 20 nt, Human
ccugagcucgguggacccag

SEQ ID NO: 3147286 - RNA, 21 nt, Human
ccugagcucgguggacccagg

SEQ ID NO: 3147287 - RNA, 22 nt, Human
ccugagcucgguggacccaggg

SEQ ID NO: 3147288 - RNA, 14 nt, Human
ccugaggcuccacu

SEQ ID NO: 3147289 - RNA, 13 nt, Human
ccugaggcuccac

SEQ ID NO: 3147290 - RNA, 18 nt, Human
ccugcccuagagcacacu

SEQ ID NO: 3147291 - RNA, 19 nt, Human
ccugcccuagagcacacug

SEQ ID NO: 3147292 - RNA, 22 nt, Human
ccugcccuagagcacacuguag

SEQ ID NO: 3147293 - RNA, 24 nt, Human
ccugcccuagagcacacuguagca

SEQ ID NO: 3147294 - RNA, 17 nt, Human
ccugccccugagcccau

SEQ ID NO: 3147295 - RNA, 13 nt, Human
ccugggcagcugc

SEQ ID NO: 3147296 - RNA, 17 nt, Human
cucauuuccaagcaagu

SEQ ID NO: 3147297 - RNA, 12 nt, Human
cucauuuccaag

SEQ ID NO: 3147298 - RNA, 14 nt, Human
cucauuuccaagca

SEQ ID NO: 3147299 - RNA, 13 nt, Human
cucauuuccaagc

SEQ ID NO: 3147300 - RNA, 23 nt, Human
cucauuuuuauaaugucccuuca

SEQ ID NO: 3147301 - RNA, 14 nt, Human
cuccccucggagaa

SEQ ID NO: 3147302 - RNA, 20 nt, Human
cuccagcugacuaaacuuuu

SEQ ID NO: 3147303 - RNA, 22 nt, Human
cucaggaaaucaaauaugcaaa

SEQ ID NO: 3147304 - RNA, 18 nt, Human
cucagggccccagcacua

SEQ ID NO: 3147305 - RNA, 14 nt, Human
cucagggccccagc

SEQ ID NO: 3147306 - RNA, 16 nt, Human
cucagggccccagcac

SEQ ID NO: 3147307 - RNA, 12 nt, Human
cucagggcccca

SEQ ID NO: 3147308 - RNA, 13 nt, Human
cucagggccccag

SEQ ID NO: 3147309 - RNA, 21 nt, Human
cucagaugcacaugagcuggc

SEQ ID NO: 3147310 - RNA, 22 nt, Human
cucacugggguccuggggccuc

SEQ ID NO: 3147311 - RNA, 17 nt, Human
cucacugggguccuggg

SEQ ID NO: 3147312 - RNA, 20 nt, Human
cucacugggguccuggggcc

SEQ ID NO: 3147313 - RNA, 17 nt, Human
cuaccucacuggggucc

SEQ ID NO: 3147314 - RNA, 18 nt, Human
cuagaguuuagcuggaaa

SEQ ID NO: 3147315 - RNA, 19 nt, Human
cuagaguuuagcuggaaaa

SEQ ID NO: 3147316 - RNA, 20 nt, Human
cuaggaaauauuuauuuuaa

SEQ ID NO: 3147317 - RNA, 19 nt, Human
cuaggaaauauuuauuuua

SEQ ID NO: 3147318 - RNA, 15 nt, Human
cuaggaaauauuuau

SEQ ID NO: 3147319 - RNA, 14 nt, Human
cuaggaaauauuua

SEQ ID NO: 3147320 - RNA, 19 nt, Human
cuauuaucugucagcugca

SEQ ID NO: 3147321 - RNA, 14 nt, Human
cuaugauuauuaac

SEQ ID NO: 3147322 - RNA, 19 nt, Human
cuaugaaauauuauguuaa

SEQ ID NO: 3147323 - RNA, 18 nt, Human
cuaugaaauauuauguua

SEQ ID NO: 3147324 - RNA, 12 nt, Human
cuauaauuuaaa

SEQ ID NO: 3147325 - RNA, 23 nt, Human
cuaagauuacaaaucagaaguca

SEQ ID NO: 3147326 - RNA, 22 nt, Human
cuaagauuacaaaucagaaguc

SEQ ID NO: 3147327 - RNA, 21 nt, Human
cuaagauuacaaaucagaagu

SEQ ID NO: 3147328 - RNA, 19 nt, Human
cuaagauuacaaaucagaa

SEQ ID NO: 3147329 - RNA, 21 nt, Human
cuaagcuucacuguaaaauaa

SEQ ID NO: 3147330 - RNA, 21 nt, Human
cuaauagaauaaaggcaguuu

SEQ ID NO: 3147331 - RNA, 20 nt, Human
cuaauagaauaaaggcaguu

SEQ ID NO: 3147332 - RNA, 23 nt, Human
cuaauagaauaaaggcaguuuuc

SEQ ID NO: 3147333 - RNA, 14 nt, Human
cuaaguaaaaccac

SEQ ID NO: 3147334 - RNA, 18 nt, Human
cuaaguaaaaccacagca

SEQ ID NO: 3147335 - RNA, 19 nt, Human
cuaaguaaaaccacagcag

SEQ ID NO: 3147336 - RNA, 22 nt, Human
cuaauucacagugcucuuuucu

SEQ ID NO: 3147337 - RNA, 16 nt, Human
cuaauucacagugcuc

SEQ ID NO: 3147338 - RNA, 15 nt, Human
cuaauucacagugcu

SEQ ID NO: 3147339 - RNA, 14 nt, Human
cuacacuaagagag

SEQ ID NO: 3147340 - RNA, 23 nt, Human
cuacacgagauacagaauuuuau

SEQ ID NO: 3147341 - RNA, 22 nt, Human
cuacaccccuccccugcccuag

SEQ ID NO: 3147342 - RNA, 18 nt, Human
cuaauucaaggaauuucu

SEQ ID NO: 3147343 - RNA, 16 nt, Human
cuaauucaaggaauuu

SEQ ID NO: 3147344 - RNA, 20 nt, Human
cuaauucaaggaauuucuua

SEQ ID NO: 3147345 - RNA, 20 nt, Human
cgggaggcagagguugcagu

SEQ ID NO: 3147346 - RNA, 22 nt, Human
cuaacagcccuccucugcacuc

SEQ ID NO: 3147347 - RNA, 21 nt, Human
cuaacagcccuccucugcacu

SEQ ID NO: 3147348 - RNA, 12 nt, Human
cuaacagcccuc

SEQ ID NO: 3147349 - RNA, 19 nt, Human
cuaaauugacacuuaaaaa

SEQ ID NO: 3147350 - RNA, 15 nt, Human
cuaagagagaaugag

SEQ ID NO: 3147351 - RNA, 14 nt, Human
cuaagagagaauga

SEQ ID NO: 3147352 - RNA, 23 nt, Human
uugugaauuaggcuguaacuacu

SEQ ID NO: 3147353 - RNA, 19 nt, Human
uugugaauuaggcuguaac

SEQ ID NO: 3147354 - RNA, 18 nt, Human
uugugaauuaggcuguaa

SEQ ID NO: 3147355 - RNA, 20 nt, Human
uugucaauaaaauccauaca

SEQ ID NO: 3147356 - RNA, 16 nt, Human
uugucacuuuuucuga

SEQ ID NO: 3147357 - RNA, 14 nt, Human
uugucacuuuuucu

SEQ ID NO: 3147358 - RNA, 15 nt, Human
augagguacugagag

SEQ ID NO: 3147359 - RNA, 18 nt, Human
augagguacugagaguga

SEQ ID NO: 3147360 - RNA, 17 nt, Human
augagguacugagagug

SEQ ID NO: 3147361 - RNA, 13 nt, Human
augauuucauuca

SEQ ID NO: 3147362 - RNA, 18 nt, Human
uuuaaaaaaauuccaagu

SEQ ID NO: 3147363 - RNA, 12 nt, Human
augcaaagcacu

SEQ ID NO: 3147364 - RNA, 13 nt, Human
augcaaagcacug

SEQ ID NO: 3147365 - RNA, 14 nt, Human
augcaaagcacuga

SEQ ID NO: 3147366 - RNA, 21 nt, Human
uuuaaauauaugcuaagucuu

SEQ ID NO: 3147367 - RNA, 18 nt, Human
uuuaaauauaugcuaagu

SEQ ID NO: 3147368 - RNA, 19 nt, Human
uuuauaugcuucuguuuua

SEQ ID NO: 3147369 - RNA, 21 nt, Human
uuuauaugcuucuguuuuaua

SEQ ID NO: 3147370 - RNA, 17 nt, Human
uuuacuccguaacagau

SEQ ID NO: 3147371 - RNA, 15 nt, Human
uuuaccuaagauuac

SEQ ID NO: 3147372 - RNA, 14 nt, Human
augccuuuucccaa

SEQ ID NO: 3147373 - RNA, 22 nt, Human
augccuuuucccaacuccagaa

SEQ ID NO: 3147374 - RNA, 20 nt, Human
augccuuuucccaacuccag

SEQ ID NO: 3147375 - RNA, 18 nt, Human
augcuacaggauuugaaa

SEQ ID NO: 3147376 - RNA, 22 nt, Human
augcuguauuuuaaaagaauga

SEQ ID NO: 3147377 - RNA, 19 nt, Human
augcuguauuuuaaaagaa

SEQ ID NO: 3147378 - RNA, 23 nt, Human
augcuguauuuuaaaagaaugau

SEQ ID NO: 3147379 - RNA, 17 nt, Human
uuucaaacauauauaac

SEQ ID NO: 3147380 - RNA, 19 nt, Human
uuucaaacauauauaacaa

SEQ ID NO: 3147381 - RNA, 20 nt, Human
uuucacgccugaggcaauua

SEQ ID NO: 3147382 - RNA, 14 nt, Human
aucuuauaauuuaa

SEQ ID NO: 3147383 - RNA, 15 nt, Human
aucuuauaauuuaaa

SEQ ID NO: 3147384 - RNA, 15 nt, Human
uuggagaagaacuga

SEQ ID NO: 3147385 - RNA, 22 nt, Human
uuggagaagaacugaaaucaua

SEQ ID NO: 3147386 - RNA, 17 nt, Human
uuggagaagaacugaaa

SEQ ID NO: 3147387 - RNA, 12 nt, Human
aucuuuaaaaua

SEQ ID NO: 3147388 - RNA, 15 nt, Human
aucuuuaaaauacac

SEQ ID NO: 3147389 - RNA, 14 nt, Human
uuggguaggcggga

SEQ ID NO: 3147390 - RNA, 14 nt, Human
uuggcccaggaguu

SEQ ID NO: 3147391 - RNA, 13 nt, Human
uuggcccaggagu

SEQ ID NO: 3147392 - RNA, 22 nt, Human
uuggcccaggaguuuggccaga

SEQ ID NO: 3147393 - RNA, 21 nt, Human
uuggcccaggaguuuggccag

SEQ ID NO: 3147394 - RNA, 20 nt, Human
uuggcccaggaguuuggcca

SEQ ID NO: 3147395 - RNA, 15 nt, Human
uuggcccaggaguuu

SEQ ID NO: 3147396 - RNA, 18 nt, Human
augaacuuguaaaggaau

SEQ ID NO: 3147397 - RNA, 22 nt, Human
aucuaccccagacuagauguag

SEQ ID NO: 3147398 - RNA, 21 nt, Human
aucuaccccagacuagaugua

SEQ ID NO: 3147399 - RNA, 20 nt, Human
aucuaccccagacuagaugu

SEQ ID NO: 3147400 - RNA, 14 nt, Human
aucuaccccagacu

SEQ ID NO: 3147401 - RNA, 19 nt, Human
aucucaaaacugcacuguc

SEQ ID NO: 3147402 - RNA, 20 nt, Human
aucucaaaacugcacuguca

SEQ ID NO: 3147403 - RNA, 15 nt, Human
aucucaaaacugcac

SEQ ID NO: 3147404 - RNA, 12 nt, Human
uugacuuuuuau

SEQ ID NO: 3147405 - RNA, 13 nt, Human
uugacaugggaca

SEQ ID NO: 3147406 - RNA, 17 nt, Human
uugcccagggcucagcc

SEQ ID NO: 3147407 - RNA, 18 nt, Human
uugcccagggcucagccu

SEQ ID NO: 3147408 - RNA, 19 nt, Human
uugcccagggcucagccug

SEQ ID NO: 3147409 - RNA, 20 nt, Human
uugcccagggcucagccugg

SEQ ID NO: 3147410 - RNA, 18 nt, Human
uucucaacuccaaacuga

SEQ ID NO: 3147411 - RNA, 14 nt, Human
uucucaacuccaaa

SEQ ID NO: 3147412 - RNA, 20 nt, Human
aucauuucugcaucagcugc

SEQ ID NO: 3147413 - RNA, 21 nt, Human
uucuguaccaguuaauuuuuc

SEQ ID NO: 3147414 - RNA, 21 nt, Human
aucccucccuccaccucccug

SEQ ID NO: 3147415 - RNA, 23 nt, Human
aucccucccuccaccucccugca

SEQ ID NO: 3147416 - RNA, 11 nt, Human
aucccucccuc

SEQ ID NO: 3147417 - RNA, 13 nt, Human
aucccucccucca

SEQ ID NO: 3147418 - RNA, 14 nt, Human
uucuguaccaguua

SEQ ID NO: 3147419 - RNA, 13 nt, Human
uucuguaccaguu

SEQ ID NO: 3147420 - RNA, 12 nt, Human
uucuguaccagu

SEQ ID NO: 3147421 - RNA, 11 nt, Human
uucuguaccag

SEQ ID NO: 3147422 - RNA, 13 nt, Human
uucugaagaagau

SEQ ID NO: 3147423 - RNA, 12 nt, Human
uucugaagaaga

SEQ ID NO: 3147424 - RNA, 23 nt, Human
uucugcaucagcugcugaaacaa

SEQ ID NO: 3147425 - RNA, 16 nt, Human
uucugcaucagcugcu

SEQ ID NO: 3147426 - RNA, 19 nt, Human
auauuugaaauauugacuu

SEQ ID NO: 3147427 - RNA, 14 nt, Human
auauuugaaauauu

SEQ ID NO: 3147428 - RNA, 23 nt, Human
auauuugaaauauugacuuuuua

SEQ ID NO: 3147429 - RNA, 12 nt, Human
auauuuuaacuu

SEQ ID NO: 3147430 - RNA, 22 nt, Human
auauuuguaucacaaaucuuaa

SEQ ID NO: 3147431 - RNA, 13 nt, Human
auauuugaaauau

SEQ ID NO: 3147432 - RNA, 23 nt, Human
auauuaaauauguuagcaaagag

SEQ ID NO: 3147433 - RNA, 22 nt, Human
uucauguuaguuaccuuauagu

SEQ ID NO: 3147434 - RNA, 18 nt, Human
uucauguuaguuaccuua

SEQ ID NO: 3147435 - RNA, 16 nt, Human
uucauguuaguuaccu

SEQ ID NO: 3147436 - RNA, 13 nt, Human
uucauguuaguua

SEQ ID NO: 3147437 - RNA, 19 nt, Human
aucaauuuuucuuauuuca

SEQ ID NO: 3147438 - RNA, 17 nt, Human
uuauuguuuaaaaucau

SEQ ID NO: 3147439 - RNA, 12 nt, Human
uuauuuaaauga

SEQ ID NO: 3147440 - RNA, 18 nt, Human
auagcuacuaauuuuaaa

SEQ ID NO: 3147441 - RNA, 22 nt, Human
auagcucuggggugggcaguuu

SEQ ID NO: 3147442 - RNA, 19 nt, Human
auagcucuggggugggcag

SEQ ID NO: 3147443 - RNA, 13 nt, Human
auagcucuggggu

SEQ ID NO: 3147444 - RNA, 12 nt, Human
auagcucugggg

SEQ ID NO: 3147445 - RNA, 17 nt, Human
auagcuacuaauuuuaa

SEQ ID NO: 3147446 - RNA, 14 nt, Human
auagcuacuaauuu

SEQ ID NO: 3147447 - RNA, 15 nt, Human
uucacagugcucuuu

SEQ ID NO: 3147448 - RNA, 21 nt, Human
auaggaauugacccacaagaa

SEQ ID NO: 3147449 - RNA, 19 nt, Human
uucaaggaauuucuuaacu

SEQ ID NO: 3147450 - RNA, 17 nt, Human
uucaaggaauuucuuaa

SEQ ID NO: 3147451 - RNA, 16 nt, Human
uucaaggaauuucuua

SEQ ID NO: 3147452 - RNA, 15 nt, Human
uucaaacauauauaa

SEQ ID NO: 3147453 - RNA, 14 nt, Human
uucaaacauauaua

SEQ ID NO: 3147454 - RNA, 16 nt, Human
auaugcaaagcacuga

SEQ ID NO: 3147455 - RNA, 15 nt, Human
auaugcaaagcacug

SEQ ID NO: 3147456 - RNA, 23 nt, Human
auaugcaaagcacugacuucuaa

SEQ ID NO: 3147457 - RNA, 23 nt, Human
auaucuaccccagacuagaugua

SEQ ID NO: 3147458 - RNA, 21 nt, Human
auaucuaccccagacuagaug

SEQ ID NO: 3147459 - RNA, 23 nt, Human
uucagccuagccgaccucagccu

SEQ ID NO: 3147460 - RNA, 20 nt, Human
uucagccuagccgaccucag

SEQ ID NO: 3147461 - RNA, 21 nt, Human
uucagccuagccgaccucagc

SEQ ID NO: 3147462 - RNA, 22 nt, Human
uucagccuagccgaccucagcc

SEQ ID NO: 3147463 - RNA, 15 nt, Human
uucagcccucagaau

SEQ ID NO: 3147464 - RNA, 18 nt, Human
auauauaacaaugcugua

SEQ ID NO: 3147465 - RNA, 17 nt, Human
auauauaacaaugcugu

SEQ ID NO: 3147466 - RNA, 14 nt, Human
auauauaacaaugc

SEQ ID NO: 3147467 - RNA, 19 nt, Human
auauaagcuuguauuccuu

SEQ ID NO: 3147468 - RNA, 15 nt, Human
auauaacaaugcugu

SEQ ID NO: 3147469 - RNA, 12 nt, Human
auauaacaaugc

SEQ ID NO: 3147470 - RNA, 18 nt, Human
auagucaaauugugugaa

SEQ ID NO: 3147471 - RNA, 17 nt, Human
auagucaaauuguguga

SEQ ID NO: 3147472 - RNA, 23 nt, Human
augucgucaaagcugaaauggac

SEQ ID NO: 3147473 - RNA, 19 nt, Human
auguauauuuuauaucaau

SEQ ID NO: 3147474 - RNA, 16 nt, Human
auguccaacccgucug

SEQ ID NO: 3147475 - RNA, 15 nt, Human
uuugacacugcucua

SEQ ID NO: 3147476 - RNA, 20 nt, Human
uuugcuggagcucugcccau

SEQ ID NO: 3147477 - RNA, 20 nt, Human
augugcuaguaauuggaaag

SEQ ID NO: 3147478 - RNA, 21 nt, Human
augugcuaguaauuggaaagg

SEQ ID NO: 3147479 - RNA, 16 nt, Human
uuuucucuaggaaaua

SEQ ID NO: 3147480 - RNA, 20 nt, Human
uuuucaggcuagauguaugu

SEQ ID NO: 3147481 - RNA, 18 nt, Human
uuuuccaacuacuaauag

SEQ ID NO: 3147482 - RNA, 14 nt, Human
uuuuccaacuacua

SEQ ID NO: 3147483 - RNA, 22 nt, Human
uuuuauggcacuaguauuucua

SEQ ID NO: 3147484 - RNA, 17 nt, Human
auuccaagugauugaaa

SEQ ID NO: 3147485 - RNA, 20 nt, Human
auuauauggcuugaguuuaa

SEQ ID NO: 3147486 - RNA, 23 nt, Human
auuauuguguguuauuuaaauga

SEQ ID NO: 3147487 - RNA, 22 nt, Human
auucaaacagucucaggaaauc

SEQ ID NO: 3147488 - RNA, 18 nt, Human
auuagacacuuuggaaga

SEQ ID NO: 3147489 - RNA, 16 nt, Human
auuacuguaagaaaau

SEQ ID NO: 3147490 - RNA, 15 nt, Human
auuacuguaagaaaa

SEQ ID NO: 3147491 - RNA, 14 nt, Human
uuuugugaagcaaa

SEQ ID NO: 3147492 - RNA, 14 nt, Human
uuuugugaauuagg

SEQ ID NO: 3147493 - RNA, 15 nt, Human
uuuuguuuucauuau

SEQ ID NO: 3147494 - RNA, 21 nt, Human
uuuuguuggcauagcucuggg

SEQ ID NO: 3147495 - RNA, 13 nt, Human
uuuuguuggcaua

SEQ ID NO: 3147496 - RNA, 15 nt, Human
uuuuugaagcuguau

SEQ ID NO: 3147497 - RNA, 16 nt, Human
auuuaaauauuaaaua

SEQ ID NO: 3147498 - RNA, 22 nt, Human
auuuaccacuuguguuuugcaa

SEQ ID NO: 3147499 - RNA, 15 nt, Human
auuuaccacuugugu

SEQ ID NO: 3147500 - RNA, 16 nt, Human
auuguaguccuguaau

SEQ ID NO: 3147501 - RNA, 17 nt, Human
auuuaaaaaaaaaccug

SEQ ID NO: 3147502 - RNA, 20 nt, Human
auuuauuacuguaagaaaau

SEQ ID NO: 3147503 - RNA, 19 nt, Human
auuuauuacuguaagaaaa

SEQ ID NO: 3147504 - RNA, 21 nt, Human
auuuauuuuaauaauguuuca

SEQ ID NO: 3147505 - RNA, 21 nt, Human
auuuccuaauacugucauccu

SEQ ID NO: 3147506 - RNA, 17 nt, Human
auuuccuaauacuguca

SEQ ID NO: 3147507 - RNA, 17 nt, Human
auuucuuaacuucuugc

SEQ ID NO: 3147508 - RNA, 14 nt, Human
auuucuuaacuucu

SEQ ID NO: 3147509 - RNA, 19 nt, Human
auuucuuaacuucuugcuu

SEQ ID NO: 3147510 - RNA, 20 nt, Human
auuucuugagguaaaagcau

SEQ ID NO: 3147511 - RNA, 19 nt, Human
auuggggaagacuguggcu

SEQ ID NO: 3147512 - RNA, 17 nt, Human
auuggagcucgugggac

SEQ ID NO: 3147513 - RNA, 16 nt, Human
auuggagcucguggaa

SEQ ID NO: 3147514 - RNA, 17 nt, Human
auugaaggaugcugucu

SEQ ID NO: 3147515 - RNA, 24 nt, Human
auuccuagaaacugacacaugcug

SEQ ID NO: 3147516 - RNA, 22 nt, Human
auugaacaaguuguuucauuga

SEQ ID NO: 3147517 - RNA, 16 nt, Human
ugauuaaguaaugaua

SEQ ID NO: 3147518 - RNA, 15 nt, Human
ugauuaaguaaugau

SEQ ID NO: 3147519 - RNA, 17 nt, Human
ugaugaucuuuaaaaua

SEQ ID NO: 3147520 - RNA, 14 nt, Human
agccaccaguucuc

SEQ ID NO: 3147521 - RNA, 12 nt, Human
agccaccaguuc

SEQ ID NO: 3147522 - RNA, 20 nt, Human
agcaucacaugaacuuguaa

SEQ ID NO: 3147523 - RNA, 21 nt, Human
agcaucauuauuugcagagac

SEQ ID NO: 3147524 - RNA, 22 nt, Human
agcauuuagauguauagguuga

SEQ ID NO: 3147525 - RNA, 20 nt, Human
agcaggaagcugugagagca

SEQ ID NO: 3147526 - RNA, 16 nt, Human
agcaggcuacugucag

SEQ ID NO: 3147527 - RNA, 17 nt, Human
agcaggcuacugucagc

SEQ ID NO: 3147528 - RNA, 19 nt, Human
agcaggcuacugucagcuc

SEQ ID NO: 3147529 - RNA, 20 nt, Human
agcaggcuacugucagcucc

SEQ ID NO: 3147530 - RNA, 14 nt, Human
agcaggcuacuguc

SEQ ID NO: 3147531 - RNA, 19 nt, Human
agcagggcauggcugggaa

SEQ ID NO: 3147532 - RNA, 19 nt, Human
agcauaccaacacgagcag

SEQ ID NO: 3147533 - RNA, 22 nt, Human
agcauaccaacacgagcaggcu

SEQ ID NO: 3147534 - RNA, 13 nt, Human
agcauaccaacac

SEQ ID NO: 3147535 - RNA, 22 nt, Human
agcaguuugguuucuagcauga

SEQ ID NO: 3147536 - RNA, 23 nt, Human
agcaguuugguuucuagcaugaa

SEQ ID NO: 3147537 - RNA, 20 nt, Human
agcaguuugguuucuagcau

SEQ ID NO: 3147538 - RNA, 19 nt, Human
agcagucaggaaagagaac

SEQ ID NO: 3147539 - RNA, 18 nt, Human
agcagucaggaaagagaa

SEQ ID NO: 3147540 - RNA, 17 nt, Human
agcagucaggaaagaga

SEQ ID NO: 3147541 - RNA, 18 nt, Human
ugagugucuuaauuaaaa

SEQ ID NO: 3147542 - RNA, 13 nt, Human
ugcauacucauua

SEQ ID NO: 3147543 - RNA, 19 nt, Human
ugcauacucauuaggaugg

SEQ ID NO: 3147544 - RNA, 20 nt, Human
ugcauagauucccugagcag

SEQ ID NO: 3147545 - RNA, 19 nt, Human
agccugagcgacagugaga

SEQ ID NO: 3147546 - RNA, 23 nt, Human
ugccagccagcagccagcucuca

SEQ ID NO: 3147547 - RNA, 15 nt, Human
ugccagccagcagcc

SEQ ID NO: 3147548 - RNA, 16 nt, Human
ugccagccagcagcca

SEQ ID NO: 3147549 - RNA, 17 nt, Human
ugccagccagcagccag

SEQ ID NO: 3147550 - RNA, 22 nt, Human
ugccagccagcagccagcucuc

SEQ ID NO: 3147551 - RNA, 13 nt, Human
ugccauaauuacu

SEQ ID NO: 3147552 - RNA, 17 nt, Human
ugccaguuauggcuaua

SEQ ID NO: 3147553 - RNA, 17 nt, Human
ugcacuccagccugagc

SEQ ID NO: 3147554 - RNA, 22 nt, Human
ugcagaagacaguauggcagcu

SEQ ID NO: 3147555 - RNA, 15 nt, Human
ugcacuccagccuga

SEQ ID NO: 3147556 - RNA, 13 nt, Human
ugauuucauucaa

SEQ ID NO: 3147557 - RNA, 20 nt, Human
ugcaaagcacugacuucuaa

SEQ ID NO: 3147558 - RNA, 22 nt, Human
ugcaaagcacugacuucuaagu

SEQ ID NO: 3147559 - RNA, 18 nt, Human
ugcaaagcacugacuucu

SEQ ID NO: 3147560 - RNA, 21 nt, Human
ugcaagccagauuuuccugaa

SEQ ID NO: 3147561 - RNA, 15 nt, Human
ugcaagccagauuuu

SEQ ID NO: 3147562 - RNA, 16 nt, Human
ugcaagcacagcccuu

SEQ ID NO: 3147563 - RNA, 15 nt, Human
ugcaagcacagcccu

SEQ ID NO: 3147564 - RNA, 18 nt, Human
ugcaagguacucugguga

SEQ ID NO: 3147565 - RNA, 16 nt, Human
ugcaagguacucuggu

SEQ ID NO: 3147566 - RNA, 17 nt, Human
ugcaauaaaauggguuu

SEQ ID NO: 3147567 - RNA, 21 nt, Human
ugcaauaaaauggguuuuacu

SEQ ID NO: 3147568 - RNA, 20 nt, Human
ugcccuguuaaaagaugaaa

SEQ ID NO: 3147569 - RNA, 19 nt, Human
ugcccuguuaaaagaugaa

SEQ ID NO: 3147570 - RNA, 13 nt, Human
agcugcccucucc

SEQ ID NO: 3147571 - RNA, 14 nt, Human
agcugcccucuccu

SEQ ID NO: 3147572 - RNA, 15 nt, Human
agcugcccucuccug

SEQ ID NO: 3147573 - RNA, 23 nt, Human
agcugcaagguacucuggugagu

SEQ ID NO: 3147574 - RNA, 21 nt, Human
agcugcaagguacucugguga

SEQ ID NO: 3147575 - RNA, 22 nt, Human
agcucuggggugggcaguuuuu

SEQ ID NO: 3147576 - RNA, 21 nt, Human
agcucuggggugggcaguuuu

SEQ ID NO: 3147577 - RNA, 20 nt, Human
agcucuggggugggcaguuu

SEQ ID NO: 3147578 - RNA, 19 nt, Human
agcucuggggugggcaguu

SEQ ID NO: 3147579 - RNA, 14 nt, Human
agcucugggguggg

SEQ ID NO: 3147580 - RNA, 20 nt, Human
agcucgguggacccagggau

SEQ ID NO: 3147581 - RNA, 12 nt, Human
agcucgguggac

SEQ ID NO: 3147582 - RNA, 14 nt, Human
agcucgguggaccc

SEQ ID NO: 3147583 - RNA, 15 nt, Human
agcucgguggaccca

SEQ ID NO: 3147584 - RNA, 16 nt, Human
agcucgguggacccag

SEQ ID NO: 3147585 - RNA, 17 nt, Human
agcucgguggacccagg

SEQ ID NO: 3147586 - RNA, 18 nt, Human
agcucgguggacccaggg

SEQ ID NO: 3147587 - RNA, 19 nt, Human
agcucgguggacccaggga

SEQ ID NO: 3147588 - RNA, 22 nt, Human
agcuguggcagaguuacaguuc

SEQ ID NO: 3147589 - RNA, 21 nt, Human
agcuguggcagaguuacaguu

SEQ ID NO: 3147590 - RNA, 18 nt, Human
agcuguggcagaguuaca

SEQ ID NO: 3147591 - RNA, 21 nt, Human
aggaaaucaaauaugcaaagc

SEQ ID NO: 3147592 - RNA, 22 nt, Human
aggaaaucaaauaugcaaagca

SEQ ID NO: 3147593 - RNA, 20 nt, Human
aggaaaucaaauaugcaaag

SEQ ID NO: 3147594 - RNA, 19 nt, Human
aggaaaucaaauaugcaaa

SEQ ID NO: 3147595 - RNA, 17 nt, Human
ugccuuuucccaacucc

SEQ ID NO: 3147596 - RNA, 19 nt, Human
ugccuuuucccaacuccag

SEQ ID NO: 3147597 - RNA, 22 nt, Human
ugcuaccaguauuuagaagcca

SEQ ID NO: 3147598 - RNA, 18 nt, Human
ugcuaccaguauuuagaa

SEQ ID NO: 3147599 - RNA, 15 nt, Human
ugcuaccaguauuua

SEQ ID NO: 3147600 - RNA, 14 nt, Human
ugcuacaaaaacac

SEQ ID NO: 3147601 - RNA, 20 nt, Human
agcuugcccuggugccucac

SEQ ID NO: 3147602 - RNA, 16 nt, Human
agcuugcccuguuaaa

SEQ ID NO: 3147603 - RNA, 18 nt, Human
agcuugcccuguuaaaag

SEQ ID NO: 3147604 - RNA, 19 nt, Human
agcuugcccuguuaaaaga

SEQ ID NO: 3147605 - RNA, 20 nt, Human
aggacgcucucuggccuucg

SEQ ID NO: 3147606 - RNA, 19 nt, Human
aggacgcucucuggccuuc

SEQ ID NO: 3147607 - RNA, 17 nt, Human
aggacgcucucuggccu

SEQ ID NO: 3147608 - RNA, 16 nt, Human
aggacgcucucuggcc

SEQ ID NO: 3147609 - RNA, 14 nt, Human
aggacgcucucugg

SEQ ID NO: 3147610 - RNA, 13 nt, Human
aggacgcucucug

SEQ ID NO: 3147611 - RNA, 17 nt, Human
aggagaaacuggaacuc

SEQ ID NO: 3147612 - RNA, 19 nt, Human
aggagaaacuggaacucuc

SEQ ID NO: 3147613 - RNA, 18 nt, Human
aggagaaacuggaacucu

SEQ ID NO: 3147614 - RNA, 14 nt, Human
uggaaauaaaguca

SEQ ID NO: 3147615 - RNA, 12 nt, Human
uggaaauaaagu

SEQ ID NO: 3147616 - RNA, 16 nt, Human
uggaaauaaagucaga

SEQ ID NO: 3147617 - RNA, 14 nt, Human
uggaguugaaaauc

SEQ ID NO: 3147618 - RNA, 15 nt, Human
aggcccccaggugcc

SEQ ID NO: 3147619 - RNA, 14 nt, Human
uggagcucguggaa

SEQ ID NO: 3147620 - RNA, 21 nt, Human
uggagcucguggaacaguuac

SEQ ID NO: 3147621 - RNA, 17 nt, Human
uggagcucguggaacag

SEQ ID NO: 3147622 - RNA, 17 nt, Human
uggagccaaggguucag

SEQ ID NO: 3147623 - RNA, 19 nt, Human
uggacuuaagcaucuggcu

SEQ ID NO: 3147624 - RNA, 14 nt, Human
aggcaguuuucuaa

SEQ ID NO: 3147625 - RNA, 13 nt, Human
aggcaguuuucua

SEQ ID NO: 3147626 - RNA, 20 nt, Human
aggcauuuaggccaugggac

SEQ ID NO: 3147627 - RNA, 12 nt, Human
aggcaguuuucu

SEQ ID NO: 3147628 - RNA, 17 nt, Human
aggcagggucaggagag

SEQ ID NO: 3147629 - RNA, 19 nt, Human
aggcagggucaggagaggg

SEQ ID NO: 3147630 - RNA, 14 nt, Human
aggcagggucagga

SEQ ID NO: 3147631 - RNA, 20 nt, Human
aggcagggucaggagagggg

SEQ ID NO: 3147632 - RNA, 23 nt, Human
aggcagggucaggagaggggcag

SEQ ID NO: 3147633 - RNA, 15 nt, Human
aggcagcuugaaacu

SEQ ID NO: 3147634 - RNA, 20 nt, Human
aggcagcucuaaaugucaau

SEQ ID NO: 3147635 - RNA, 12 nt, Human
aggcacacuucu

SEQ ID NO: 3147636 - RNA, 15 nt, Human
aggcacacuucuucu

SEQ ID NO: 3147637 - RNA, 16 nt, Human
aggcacacuucuucuu

SEQ ID NO: 3147638 - RNA, 20 nt, Human
aggcacacuucuucuugguc

SEQ ID NO: 3147639 - RNA, 20 nt, Human
uguaguauuuuuuguauaau

SEQ ID NO: 3147640 - RNA, 19 nt, Human
uguaguauuuuuuguauaa

SEQ ID NO: 3147641 - RNA, 18 nt, Human
uguaguauuuuuuguaua

SEQ ID NO: 3147642 - RNA, 20 nt, Human
aguaaaaccacagcaguuga

SEQ ID NO: 3147643 - RNA, 13 nt, Human
aguaaaauccaca

SEQ ID NO: 3147644 - RNA, 20 nt, Human
aguaaugauaacuggaaacu

SEQ ID NO: 3147645 - RNA, 18 nt, Human
aguaaugauaacuggaaa

SEQ ID NO: 3147646 - RNA, 17 nt, Human
aguaaugauaacuggaa

SEQ ID NO: 3147647 - RNA, 13 nt, Human
aguaaugauaacu

SEQ ID NO: 3147648 - RNA, 15 nt, Human
uguaucacaaaucuu

SEQ ID NO: 3147649 - RNA, 18 nt, Human
uguaucacaaaucuuaac

SEQ ID NO: 3147650 - RNA, 15 nt, Human
uguaguguuggagaa

SEQ ID NO: 3147651 - RNA, 14 nt, Human
uguaguguuggaga

SEQ ID NO: 3147652 - RNA, 22 nt, Human
uguauuacaaauccaaugaaau

SEQ ID NO: 3147653 - RNA, 13 nt, Human
uguauuacaaauc

SEQ ID NO: 3147654 - RNA, 23 nt, Human
ugucaaaaaugucuuggguaggc

SEQ ID NO: 3147655 - RNA, 18 nt, Human
aguauuagaauaccacag

SEQ ID NO: 3147656 - RNA, 15 nt, Human
agucaccucauggaa

SEQ ID NO: 3147657 - RNA, 14 nt, Human
agucaccucaugga

SEQ ID NO: 3147658 - RNA, 17 nt, Human
agucaccucauggaauu

SEQ ID NO: 3147659 - RNA, 18 nt, Human
aguauuucuaugaaauau

SEQ ID NO: 3147660 - RNA, 16 nt, Human
aguauuucuaugaaau

SEQ ID NO: 3147661 - RNA, 17 nt, Human
aguauuucuaugaaaua

SEQ ID NO: 3147662 - RNA, 16 nt, Human
uguaaaggaauuuaaa

SEQ ID NO: 3147663 - RNA, 14 nt, Human
agggcucagccugg

SEQ ID NO: 3147664 - RNA, 15 nt, Human
agggcucagccuggu

SEQ ID NO: 3147665 - RNA, 16 nt, Human
ugggguccuggggccu

SEQ ID NO: 3147666 - RNA, 23 nt, Human
ugggugccccccuugccagacau

SEQ ID NO: 3147667 - RNA, 24 nt, Human
ugguaacuuuugugaauuaggcug

SEQ ID NO: 3147668 - RNA, 16 nt, Human
ugguaacuuuugugaa

SEQ ID NO: 3147669 - RNA, 14 nt, Human
ugguaacuuuugug

SEQ ID NO: 3147670 - RNA, 18 nt, Human
aggggagcaugggaagug

SEQ ID NO: 3147671 - RNA, 22 nt, Human
agggaggacgcucucuggccuu

SEQ ID NO: 3147672 - RNA, 21 nt, Human
agggaggacgcucucuggccu

SEQ ID NO: 3147673 - RNA, 23 nt, Human
agggaggacgcucucuggccuuc

SEQ ID NO: 3147674 - RNA, 13 nt, Human
agggaaauuucag

SEQ ID NO: 3147675 - RNA, 16 nt, Human
agggcccugagcucgg

SEQ ID NO: 3147676 - RNA, 13 nt, Human
agggcucagccug

SEQ ID NO: 3147677 - RNA, 12 nt, Human
agggcucagccu

SEQ ID NO: 3147678 - RNA, 21 nt, Human
aguucugcagauaaacaguag

SEQ ID NO: 3147679 - RNA, 16 nt, Human
aguucugcagauaaac

SEQ ID NO: 3147680 - RNA, 14 nt, Human
uguuuugcaagcca

SEQ ID NO: 3147681 - RNA, 16 nt, Human
aguucugaagaagaug

SEQ ID NO: 3147682 - RNA, 19 nt, Human
uguuuucauuaucucaaaa

SEQ ID NO: 3147683 - RNA, 17 nt, Human
uguuuauuaaucuuagu

SEQ ID NO: 3147684 - RNA, 15 nt, Human
uguuuauuaaucuua

SEQ ID NO: 3147685 - RNA, 14 nt, Human
uguuuauuaaucuu

SEQ ID NO: 3147686 - RNA, 16 nt, Human
aguuuagcuggaaaag

SEQ ID NO: 3147687 - RNA, 13 nt, Human
aguuggugacaga

SEQ ID NO: 3147688 - RNA, 16 nt, Human
aguugcagauucauuu

SEQ ID NO: 3147689 - RNA, 15 nt, Human
uuacuguaagaaaau

SEQ ID NO: 3147690 - RNA, 20 nt, Human
uuacuggccuuuuucauuua

SEQ ID NO: 3147691 - RNA, 12 nt, Human
uuaccugggaaa

SEQ ID NO: 3147692 - RNA, 14 nt, Human
uuaccuuacagaag

SEQ ID NO: 3147693 - RNA, 21 nt, Human
auaaauauaucuaccccagac

SEQ ID NO: 3147694 - RNA, 13 nt, Human
auaaauauaucua

SEQ ID NO: 3147695 - RNA, 18 nt, Human
auaaaguuggugacagau

SEQ ID NO: 3147696 - RNA, 17 nt, Human
auaaaguuggugacaga

SEQ ID NO: 3147697 - RNA, 16 nt, Human
auaaaguuggugacag

SEQ ID NO: 3147698 - RNA, 15 nt, Human
auaacuaacaugucc

SEQ ID NO: 3147699 - RNA, 22 nt, Human
uuaagaagacugcauuauauuu

SEQ ID NO: 3147700 - RNA, 20 nt, Human
uuaagaagacugcauuauau

SEQ ID NO: 3147701 - RNA, 18 nt, Human
uuaaguaaugauaacugg

SEQ ID NO: 3147702 - RNA, 19 nt, Human
auaaaauccauacauuugu

SEQ ID NO: 3147703 - RNA, 18 nt, Human
auaaaauccauacauuug

SEQ ID NO: 3147704 - RNA, 21 nt, Human
auaaaauaauuuuuauauuug

SEQ ID NO: 3147705 - RNA, 16 nt, Human
auaaaauaauuuuuau

SEQ ID NO: 3147706 - RNA, 15 nt, Human
auaaaauaauuuuua

SEQ ID NO: 3147707 - RNA, 16 nt, Human
agucucaggaaaucaa

SEQ ID NO: 3147708 - RNA, 22 nt, Human
agucucaggaaaucaaauaugc

SEQ ID NO: 3147709 - RNA, 19 nt, Human
ugugagaugcuagaacucc

SEQ ID NO: 3147710 - RNA, 15 nt, Human
ugugagaugcuagaa

SEQ ID NO: 3147711 - RNA, 14 nt, Human
agucucucuucucu

SEQ ID NO: 3147712 - RNA, 16 nt, Human
agucucucuucucucc

SEQ ID NO: 3147713 - RNA, 15 nt, Human
agucucucuucucuc

SEQ ID NO: 3147714 - RNA, 18 nt, Human
agucucucuucucuccag

SEQ ID NO: 3147715 - RNA, 20 nt, Human
agugaaacucguuaauuugu

SEQ ID NO: 3147716 - RNA, 18 nt, Human
agucuuucacauuuaaau

SEQ ID NO: 3147717 - RNA, 16 nt, Human
ugucacuuuuucugau

SEQ ID NO: 3147718 - RNA, 21 nt, Human
uguggcagaguuacaguucug

SEQ ID NO: 3147719 - RNA, 16 nt, Human
agugaacaaauuuaca

SEQ ID NO: 3147720 - RNA, 15 nt, Human
agugaaagaaaauaa

SEQ ID NO: 3147721 - RNA, 13 nt, Human
uguguaaguagau

SEQ ID NO: 3147722 - RNA, 20 nt, Human
uguggucacaggaaguagag

SEQ ID NO: 3147723 - RNA, 21 nt, Human
agugcuguuuauuaaucuuag

SEQ ID NO: 3147724 - RNA, 20 nt, Human
agugcuguuuauuaaucuua

SEQ ID NO: 3147725 - RNA, 22 nt, Human
agugcuguuuauuaaucuuagu

SEQ ID NO: 3147726 - RNA, 20 nt, Human
aguggacaccaggagucccu

SEQ ID NO: 3147727 - RNA, 22 nt, Human
aguggacaccaggagucccugg

SEQ ID NO: 3147728 - RNA, 15 nt, Human
uguuauaaucuuuca

SEQ ID NO: 3147729 - RNA, 12 nt, Human
uguuauaaucuu

SEQ ID NO: 3147730 - RNA, 14 nt, Human
uguuccuagugaaa

SEQ ID NO: 3147731 - RNA, 13 nt, Human
ucaaaacugcacu

SEQ ID NO: 3147732 - RNA, 18 nt, Human
ucaaaagaaagaaaauca

SEQ ID NO: 3147733 - RNA, 23 nt, Human
ucaaaauaccaugccauuuaaag

SEQ ID NO: 3147734 - RNA, 21 nt, Human
ucaaaauaugccccauucaac

SEQ ID NO: 3147735 - RNA, 21 nt, Human
ucaaaauaccaugccauuuaa

SEQ ID NO: 3147736 - RNA, 14 nt, Human
ucaaagcugaaaug

SEQ ID NO: 3147737 - RNA, 19 nt, Human
acaugauccugcaauucca

SEQ ID NO: 3147738 - RNA, 14 nt, Human
acaugcugaacauc

SEQ ID NO: 3147739 - RNA, 21 nt, Human
acaugcugaacaucacagcuu

SEQ ID NO: 3147740 - RNA, 23 nt, Human
acauguccugccuauuaucuguc

SEQ ID NO: 3147741 - RNA, 15 nt, Human
acaugucccuacacc

SEQ ID NO: 3147742 - RNA, 22 nt, Human
ucaagaugaugaugaucuuuaa

SEQ ID NO: 3147743 - RNA, 14 nt, Human
ucaaggcuuagacc

SEQ ID NO: 3147744 - RNA, 19 nt, Human
acauauauaacaaugcugu

SEQ ID NO: 3147745 - RNA, 18 nt, Human
acauagaauuaacacaug

SEQ ID NO: 3147746 - RNA, 14 nt, Human
acauagaauuaaca

SEQ ID NO: 3147747 - RNA, 13 nt, Human
acaucaacagaua

SEQ ID NO: 3147748 - RNA, 14 nt, Human
acaguugguaacuu

SEQ ID NO: 3147749 - RNA, 16 nt, Human
acaguugguaacuuuu

SEQ ID NO: 3147750 - RNA, 15 nt, Human
acaguugguaacuuu

SEQ ID NO: 3147751 - RNA, 24 nt, Human
acaguugguaacuuuugugaauua

SEQ ID NO: 3147752 - RNA, 13 nt, Human
uauuucauuucuu

SEQ ID NO: 3147753 - RNA, 18 nt, Human
acaguuuucugagaaaga

SEQ ID NO: 3147754 - RNA, 19 nt, Human
acaguuuucugagaaagac

SEQ ID NO: 3147755 - RNA, 20 nt, Human
acaguuuucugagaaagacu

SEQ ID NO: 3147756 - RNA, 21 nt, Human
acaguuuucugagaaagacua

SEQ ID NO: 3147757 - RNA, 16 nt, Human
acaguuuucugagaaa

SEQ ID NO: 3147758 - RNA, 17 nt, Human
acaguuuucugagaaag

SEQ ID NO: 3147759 - RNA, 15 nt, Human
acaguuuucugagaa

SEQ ID NO: 3147760 - RNA, 23 nt, Human
accauuucuugagguaaaagcau

SEQ ID NO: 3147761 - RNA, 22 nt, Human
ucagaagucaucuugcuaccag

SEQ ID NO: 3147762 - RNA, 18 nt, Human
ucagaagucaucuugcua

SEQ ID NO: 3147763 - RNA, 15 nt, Human
ucagaagucaucuug

SEQ ID NO: 3147764 - RNA, 18 nt, Human
ucagccuagccgaccuca

SEQ ID NO: 3147765 - RNA, 19 nt, Human
ucagccuagccgaccucag

SEQ ID NO: 3147766 - RNA, 20 nt, Human
ucagccuagccgaccucagc

SEQ ID NO: 3147767 - RNA, 21 nt, Human
ucagccuagccgaccucagcc

SEQ ID NO: 3147768 - RNA, 12 nt, Human
ucagagcugccc

SEQ ID NO: 3147769 - RNA, 21 nt, Human
ucagccaacgaguaauuuauu

SEQ ID NO: 3147770 - RNA, 20 nt, Human
ucaggaaaucaaauaugcaa

SEQ ID NO: 3147771 - RNA, 21 nt, Human
ucaggaaaucaaauaugcaaa

SEQ ID NO: 3147772 - RNA, 19 nt, Human
ucaggaaagagaacuucca

SEQ ID NO: 3147773 - RNA, 13 nt, Human
ucaggaaagagaa

SEQ ID NO: 3147774 - RNA, 15 nt, Human
ucaauucuugccaaa

SEQ ID NO: 3147775 - RNA, 20 nt, Human
ucaauuuuucuuauuucauu

SEQ ID NO: 3147776 - RNA, 23 nt, Human
ucaauuuuucuuauuucauuucu

SEQ ID NO: 3147777 - RNA, 15 nt, Human
accaaucaugaauua

SEQ ID NO: 3147778 - RNA, 13 nt, Human
accaaucaugaau

SEQ ID NO: 3147779 - RNA, 17 nt, Human
accagaaaagcccaagu

SEQ ID NO: 3147780 - RNA, 15 nt, Human
accacuucagggcuu

SEQ ID NO: 3147781 - RNA, 14 nt, Human
acgagaaaacaaua

SEQ ID NO: 3147782 - RNA, 19 nt, Human
acgagcaggcuacugucag

SEQ ID NO: 3147783 - RNA, 20 nt, Human
acgagcaggcuacugucagc

SEQ ID NO: 3147784 - RNA, 23 nt, Human
uccaacccgucuggcccaccagg

SEQ ID NO: 3147785 - RNA, 22 nt, Human
uccaacccgucuggcccaccag

SEQ ID NO: 3147786 - RNA, 21 nt, Human
uccaacuaucucauuuccaag

SEQ ID NO: 3147787 - RNA, 16 nt, Human
accuagggugauauua

SEQ ID NO: 3147788 - RNA, 21 nt, Human
accuagggugauauuaaccag

SEQ ID NO: 3147789 - RNA, 22 nt, Human
ucaggaaaucaaauaugcaaag

SEQ ID NO: 3147790 - RNA, 23 nt, Human
ucaggaaaucaaauaugcaaagc

SEQ ID NO: 3147791 - RNA, 16 nt, Human
ucaugaauuaguuuua

SEQ ID NO: 3147792 - RNA, 22 nt, Human
ucauccucaaagaaaguguauu

SEQ ID NO: 3147793 - RNA, 21 nt, Human
ucauccucaaagaaaguguau

SEQ ID NO: 3147794 - RNA, 18 nt, Human
ucauccucaaagaaagug

SEQ ID NO: 3147795 - RNA, 17 nt, Human
ucauccucaaagaaagu

SEQ ID NO: 3147796 - RNA, 23 nt, Human
ucauccucaaagaaaguguauug

SEQ ID NO: 3147797 - RNA, 12 nt, Human
accucccugcaa

SEQ ID NO: 3147798 - RNA, 13 nt, Human
accucccugcaau

SEQ ID NO: 3147799 - RNA, 14 nt, Human
ucauccucaaagaa

SEQ ID NO: 3147800 - RNA, 14 nt, Human
ucauccgaggcagg

SEQ ID NO: 3147801 - RNA, 15 nt, Human
ucauccgaggcaggg

SEQ ID NO: 3147802 - RNA, 20 nt, Human
accugacuauugaaguugca

SEQ ID NO: 3147803 - RNA, 14 nt, Human
acuccaaagaaaug

SEQ ID NO: 3147804 - RNA, 15 nt, Human
acuccaaagaaaugu

SEQ ID NO: 3147805 - RNA, 18 nt, Human
acuccaaagaaauguaag

SEQ ID NO: 3147806 - RNA, 18 nt, Human
acuccagaaagugacaag

SEQ ID NO: 3147807 - RNA, 21 nt, Human
ucccugguaauaaguacugug

SEQ ID NO: 3147808 - RNA, 21 nt, Human
ucccuccaccucccugcaaua

SEQ ID NO: 3147809 - RNA, 23 nt, Human
ucccuccaccucccugcaauaaa

SEQ ID NO: 3147810 - RNA, 13 nt, Human
ucccucccuccac

SEQ ID NO: 3147811 - RNA, 14 nt, Human
ucccucccuccacc

SEQ ID NO: 3147812 - RNA, 15 nt, Human
ucccucccuccaccu

SEQ ID NO: 3147813 - RNA, 16 nt, Human
ucccucccuccaccuc

SEQ ID NO: 3147814 - RNA, 11 nt, Human
ucccugagcag

SEQ ID NO: 3147815 - RNA, 17 nt, Human
uccccucggagaagagc

SEQ ID NO: 3147816 - RNA, 16 nt, Human
uccccucggagaagag

SEQ ID NO: 3147817 - RNA, 20 nt, Human
uccccuugcccagggcucag

SEQ ID NO: 3147818 - RNA, 22 nt, Human
uccccuugcccagggcucagcc

SEQ ID NO: 3147819 - RNA, 24 nt, Human
uccccuugcccagggcucagccug

SEQ ID NO: 3147820 - RNA, 17 nt, Human
uccccuugcccagggcu

SEQ ID NO: 3147821 - RNA, 14 nt, Human
ucccagucauuuaa

SEQ ID NO: 3147822 - RNA, 22 nt, Human
ucccagucauuuaauaaaugug

SEQ ID NO: 3147823 - RNA, 17 nt, Human
ucccagccagcaguuca

SEQ ID NO: 3147824 - RNA, 18 nt, Human
ucccagccagcaguucag

SEQ ID NO: 3147825 - RNA, 17 nt, Human
acuaacauguccugccu

SEQ ID NO: 3147826 - RNA, 21 nt, Human
uccaugaagauguagaggaga

SEQ ID NO: 3147827 - RNA, 13 nt, Human
uccaugaagaugu

SEQ ID NO: 3147828 - RNA, 21 nt, Human
uccauccugaggcuccacuug

SEQ ID NO: 3147829 - RNA, 20 nt, Human
uccauccugaggcuccacuu

SEQ ID NO: 3147830 - RNA, 19 nt, Human
uccauccugaggcuccacu

SEQ ID NO: 3147831 - RNA, 12 nt, Human
ucugaagaagau

SEQ ID NO: 3147832 - RNA, 23 nt, Human
agaaacuuaagguuaccuuuguu

SEQ ID NO: 3147833 - RNA, 19 nt, Human
agaaacaguugguaacuuu

SEQ ID NO: 3147834 - RNA, 18 nt, Human
agaaacaguugguaacuu

SEQ ID NO: 3147835 - RNA, 17 nt, Human
agaaacaguugguaacu

SEQ ID NO: 3147836 - RNA, 22 nt, Human
ucucuggccuucggccuccauc

SEQ ID NO: 3147837 - RNA, 21 nt, Human
ucucuggccuucggccuccau

SEQ ID NO: 3147838 - RNA, 12 nt, Human
ucucuggccuuc

SEQ ID NO: 3147839 - RNA, 16 nt, Human
acuuguguuuugcaag

SEQ ID NO: 3147840 - RNA, 16 nt, Human
acuugucaauaaaauc

SEQ ID NO: 3147841 - RNA, 20 nt, Human
acuugaacccgggaggcaga

SEQ ID NO: 3147842 - RNA, 19 nt, Human
acuugaacccgggaggcag

SEQ ID NO: 3147843 - RNA, 21 nt, Human
acuugaacccauauuuguaca

SEQ ID NO: 3147844 - RNA, 21 nt, Human
acuucuaaguaaaaccacagc

SEQ ID NO: 3147845 - RNA, 23 nt, Human
acuucuaaguaaaaccacagcag

SEQ ID NO: 3147846 - RNA, 24 nt, Human
ucucaccuggacuuaagcaucugg

SEQ ID NO: 3147847 - RNA, 13 nt, Human
ucucaccuggacu

SEQ ID NO: 3147848 - RNA, 15 nt, Human
uccuuguauuuaaau

SEQ ID NO: 3147849 - RNA, 18 nt, Human
ucgcuccaccuugcagcu

SEQ ID NO: 3147850 - RNA, 14 nt, Human
acugcauuauauuu

SEQ ID NO: 3147851 - RNA, 15 nt, Human
acugcauuauauuua

SEQ ID NO: 3147852 - RNA, 18 nt, Human
acugcucuaacagcccuc

SEQ ID NO: 3147853 - RNA, 19 nt, Human
acugccuucucaacuccaa

SEQ ID NO: 3147854 - RNA, 13 nt, Human
acugccuucucaa

SEQ ID NO: 3147855 - RNA, 13 nt, Human
acuggcacaguuu

SEQ ID NO: 3147856 - RNA, 19 nt, Human
acuggcacaguuuucugag

SEQ ID NO: 3147857 - RNA, 20 nt, Human
acuggcacaguuuucugaga

SEQ ID NO: 3147858 - RNA, 22 nt, Human
ucggguuuuauuguuuaaaauc

SEQ ID NO: 3147859 - RNA, 13 nt, Human
acuguguaauuag

SEQ ID NO: 3147860 - RNA, 18 nt, Human
acuguggguagacacaca

SEQ ID NO: 3147861 - RNA, 13 nt, Human
acuguggguagac

SEQ ID NO: 3147862 - RNA, 21 nt, Human
acugucagcuccccucggaga

SEQ ID NO: 3147863 - RNA, 18 nt, Human
acugggacaggggagaac

SEQ ID NO: 3147864 - RNA, 17 nt, Human
acuuaagcaucuggcuc

SEQ ID NO: 3147865 - RNA, 21 nt, Human
acuuaagcaucuggcucuaau

SEQ ID NO: 3147866 - RNA, 20 nt, Human
acuuaagcaucuggcucuaa

SEQ ID NO: 3147867 - RNA, 16 nt, Human
ucuacauacuauggaa

SEQ ID NO: 3147868 - RNA, 23 nt, Human
ucuaaguaaaaccacagcaguug

SEQ ID NO: 3147869 - RNA, 21 nt, Human
ucuaaguaaaaccacagcagu

SEQ ID NO: 3147870 - RNA, 22 nt, Human
ucuaaguaaaaccacagcaguu

SEQ ID NO: 3147871 - RNA, 20 nt, Human
ucuaaguaaaaccacagcag

SEQ ID NO: 3147872 - RNA, 20 nt, Human
ucuaaagccauuguaguccu

SEQ ID NO: 3147873 - RNA, 17 nt, Human
ucuaccaaaaaucucaa

SEQ ID NO: 3147874 - RNA, 15 nt, Human
agagguugcagugag

SEQ ID NO: 3147875 - RNA, 23 nt, Human
ugaacuagaguuuagcuggaaaa

SEQ ID NO: 3147876 - RNA, 18 nt, Human
ugaacaaauuuacagaga

SEQ ID NO: 3147877 - RNA, 20 nt, Human
ugaacaaauuuacagagaca

SEQ ID NO: 3147878 - RNA, 19 nt, Human
ugaacaaauuuacagagac

SEQ ID NO: 3147879 - RNA, 22 nt, Human
agagcugcccucuccugggcag

SEQ ID NO: 3147880 - RNA, 21 nt, Human
agagcuguucacagccagacu

SEQ ID NO: 3147881 - RNA, 19 nt, Human
agagcuguucacagccaga

SEQ ID NO: 3147882 - RNA, 15 nt, Human
ugaaauuguauuaca

SEQ ID NO: 3147883 - RNA, 13 nt, Human
agagcugcccucu

SEQ ID NO: 3147884 - RNA, 14 nt, Human
agagcugcccucuc

SEQ ID NO: 3147885 - RNA, 23 nt, Human
ugaaauaagccagacaucaacag

SEQ ID NO: 3147886 - RNA, 20 nt, Human
ugaaauaagccagacaucaa

SEQ ID NO: 3147887 - RNA, 18 nt, Human
ugaaauaagccagacauc

SEQ ID NO: 3147888 - RNA, 17 nt, Human
ugaaauaagccagacau

SEQ ID NO: 3147889 - RNA, 14 nt, Human
ugaaauaagccaga

SEQ ID NO: 3147890 - RNA, 14 nt, Human
agagcacacuguag

SEQ ID NO: 3147891 - RNA, 17 nt, Human
agaugcaguucugaaga

SEQ ID NO: 3147892 - RNA, 14 nt, Human
agaugcuagaacuc

SEQ ID NO: 3147893 - RNA, 19 nt, Human
agaugcaguucugaagaag

SEQ ID NO: 3147894 - RNA, 18 nt, Human
agaugcaguucugaagaa

SEQ ID NO: 3147895 - RNA, 17 nt, Human
ugacccacaagaaauga

SEQ ID NO: 3147896 - RNA, 22 nt, Human
ugacacaccaggcgcuaauuca

SEQ ID NO: 3147897 - RNA, 16 nt, Human
ugacacaccaggcgcu

SEQ ID NO: 3147898 - RNA, 23 nt, Human
ugacacaccaggcgcuaauucaa

SEQ ID NO: 3147899 - RNA, 17 nt, Human
agaguuuagcuggaaaa

SEQ ID NO: 3147900 - RNA, 16 nt, Human
agaguuuagcuggaaa

SEQ ID NO: 3147901 - RNA, 23 nt, Human
agaauuaacacaugauccugcaa

SEQ ID NO: 3147902 - RNA, 17 nt, Human
ucuggggugggcaguuu

SEQ ID NO: 3147903 - RNA, 13 nt, Human
ucuguccagggcc

SEQ ID NO: 3147904 - RNA, 17 nt, Human
ucuguccagggcccuga

SEQ ID NO: 3147905 - RNA, 19 nt, Human
ucuguccagggcccugagc

SEQ ID NO: 3147906 - RNA, 20 nt, Human
ucuguccagggcccugagcu

SEQ ID NO: 3147907 - RNA, 15 nt, Human
agacacacaugaagu

SEQ ID NO: 3147908 - RNA, 13 nt, Human
agaauucugcuac

SEQ ID NO: 3147909 - RNA, 20 nt, Human
agaauucugcuaccucacug

SEQ ID NO: 3147910 - RNA, 22 nt, Human
agaauucugcuaccucacuggg

SEQ ID NO: 3147911 - RNA, 17 nt, Human
agacacacugaagaagc

SEQ ID NO: 3147912 - RNA, 16 nt, Human
agacacacugaagaag

SEQ ID NO: 3147913 - RNA, 13 nt, Human
agacacuuuggaa

SEQ ID NO: 3147914 - RNA, 23 nt, Human
ucuuagaugcaguucugaagaag

SEQ ID NO: 3147915 - RNA, 22 nt, Human
ucuuagaugcaguucugaagaa

SEQ ID NO: 3147916 - RNA, 15 nt, Human
ucuuauuucauuucu

SEQ ID NO: 3147917 - RNA, 13 nt, Human
ucuuauuuauuau

SEQ ID NO: 3147918 - RNA, 16 nt, Human
ucuuauuucauuucuu

SEQ ID NO: 3147919 - RNA, 11 nt, Human
agaccucagcc

SEQ ID NO: 3147920 - RNA, 12 nt, Human
agaccucagccu

SEQ ID NO: 3147921 - RNA, 13 nt, Human
agaccucagccug

SEQ ID NO: 3147922 - RNA, 14 nt, Human
agaccucagccugu

SEQ ID NO: 3147923 - RNA, 15 nt, Human
agaccucagccugug

SEQ ID NO: 3147924 - RNA, 16 nt, Human
agaccucagccugugc

SEQ ID NO: 3147925 - RNA, 17 nt, Human
agaccucagccugugcu

SEQ ID NO: 3147926 - RNA, 19 nt, Human
agaccucagccugugcugc

SEQ ID NO: 3147927 - RNA, 20 nt, Human
agaccucagccugugcugcc

SEQ ID NO: 3147928 - RNA, 23 nt, Human
agacuauucaaacagucucagga

SEQ ID NO: 3147929 - RNA, 15 nt, Human
agagacagaaagcag

SEQ ID NO: 3147930 - RNA, 24 nt, Human
agagacagaaagcagaacagugau

SEQ ID NO: 3147931 - RNA, 24 nt, Human
guccaagcauaccaacacgagcag

SEQ ID NO: 3147932 - RNA, 21 nt, Human
guccaagcauuuagauguaua

SEQ ID NO: 3147933 - RNA, 15 nt, Human
aacaaggaugaauua

SEQ ID NO: 3147934 - RNA, 21 nt, Human
aacaagccuccuuuuaaagua

SEQ ID NO: 3147935 - RNA, 18 nt, Human
aacauuugguaaggggaa

SEQ ID NO: 3147936 - RNA, 22 nt, Human
aacaguagugauaguuguaccg

SEQ ID NO: 3147937 - RNA, 22 nt, Human
aacaguugguaacuuuugugaa

SEQ ID NO: 3147938 - RNA, 21 nt, Human
aacaguugguaacuuuuguga

SEQ ID NO: 3147939 - RNA, 17 nt, Human
aacaguugguaacuuuu

SEQ ID NO: 3147940 - RNA, 13 nt, Human
aacccaaauguuc

SEQ ID NO: 3147941 - RNA, 18 nt, Human
aacccaaauguucaucaa

SEQ ID NO: 3147942 - RNA, 20 nt, Human
aacccauauuuguacaccaa

SEQ ID NO: 3147943 - RNA, 20 nt, Human
aaccuagggugauauuaacc

SEQ ID NO: 3147944 - RNA, 17 nt, Human
aaccuagggugauauua

SEQ ID NO: 3147945 - RNA, 18 nt, Human
aacucguuaauuuguagu

SEQ ID NO: 3147946 - RNA, 14 nt, Human
aacucccuuucaac

SEQ ID NO: 3147947 - RNA, 13 nt, Human
aacucccuuucaa

SEQ ID NO: 3147948 - RNA, 15 nt, Human
gugaacacaucagcu

SEQ ID NO: 3147949 - RNA, 14 nt, Human
aacuccagaaagug

SEQ ID NO: 3147950 - RNA, 21 nt, Human
aacuccagaaagugacaagcu

SEQ ID NO: 3147951 - RNA, 19 nt, Human
gucuuaauuaaaagaauau

SEQ ID NO: 3147952 - RNA, 21 nt, Human
gucuuaauuaaaagaauauuu

SEQ ID NO: 3147953 - RNA, 22 nt, Human
gucuuaauuaaaagaauauuuu

SEQ ID NO: 3147954 - RNA, 14 nt, Human
guaugauucccagc

SEQ ID NO: 3147955 - RNA, 21 nt, Human
guaugauuacuggccuuuuuc

SEQ ID NO: 3147956 - RNA, 22 nt, Human
aaauguaagggaaacugccagc

SEQ ID NO: 3147957 - RNA, 16 nt, Human
aaauguaagggaaacu

SEQ ID NO: 3147958 - RNA, 17 nt, Human
aaauucccguuuuguca

SEQ ID NO: 3147959 - RNA, 19 nt, Human
aaauucauuuuuuaaauuc

SEQ ID NO: 3147960 - RNA, 13 nt, Human
aaauucauuuuuu

SEQ ID NO: 3147961 - RNA, 18 nt, Human
aaauuucagcagcugcag

SEQ ID NO: 3147962 - RNA, 17 nt, Human
aaauuucagcagcugca

SEQ ID NO: 3147963 - RNA, 18 nt, Human
aaauccauacauuugugu

SEQ ID NO: 3147964 - RNA, 14 nt, Human
aaauccuugaagau

SEQ ID NO: 3147965 - RNA, 19 nt, Human
aaaucuacacuccagugag

SEQ ID NO: 3147966 - RNA, 14 nt, Human
aaaugcauuucuaa

SEQ ID NO: 3147967 - RNA, 18 nt, Human
aaauggcuuccuggcaau

SEQ ID NO: 3147968 - RNA, 19 nt, Human
aaauggcuuccuggcaaua

SEQ ID NO: 3147969 - RNA, 12 nt, Human
aaaugagugugu

SEQ ID NO: 3147970 - RNA, 18 nt, Human
aaaugaguguguuuguca

SEQ ID NO: 3147971 - RNA, 22 nt, Human
aaaugaaagcagggacuugaac

SEQ ID NO: 3147972 - RNA, 21 nt, Human
aaaugaaagcagggacuugaa

SEQ ID NO: 3147973 - RNA, 21 nt, Human
gugugaccacugcagaagaca

SEQ ID NO: 3147974 - RNA, 14 nt, Human
gugguuucauguua

SEQ ID NO: 3147975 - RNA, 18 nt, Human
guggugggacagggaccc

SEQ ID NO: 3147976 - RNA, 21 nt, Human
gugggacagucaccucaugga

SEQ ID NO: 3147977 - RNA, 18 nt, Human
aagacuguggcugcuagc

SEQ ID NO: 3147978 - RNA, 19 nt, Human
aagagcuguucacagccag

SEQ ID NO: 3147979 - RNA, 12 nt, Human
aagacuguggcu

SEQ ID NO: 3147980 - RNA, 15 nt, Human
aagacuguggcugcu

SEQ ID NO: 3147981 - RNA, 22 nt, Human
guggacccagggaugacauguc

SEQ ID NO: 3147982 - RNA, 22 nt, Human
guggcacucagucucucuucuc

SEQ ID NO: 3147983 - RNA, 16 nt, Human
aagaaugauuaugaau

SEQ ID NO: 3147984 - RNA, 18 nt, Human
aagaaugauuaugaauua

SEQ ID NO: 3147985 - RNA, 22 nt, Human
aagaagugaaaaucuacacucc

SEQ ID NO: 3147986 - RNA, 16 nt, Human
aagaagugaaaaucua

SEQ ID NO: 3147987 - RNA, 18 nt, Human
guuguaccgcaaugugac

SEQ ID NO: 3147988 - RNA, 21 nt, Human
guuuauuaaucuuaguguaug

SEQ ID NO: 3147989 - RNA, 20 nt, Human
guuuauuaaucuuaguguau

SEQ ID NO: 3147990 - RNA, 18 nt, Human
guuuauuaaucuuagugu

SEQ ID NO: 3147991 - RNA, 14 nt, Human
guuuauuaaucuua

SEQ ID NO: 3147992 - RNA, 10 nt, Human
guuuaaaauc

SEQ ID NO: 3147993 - RNA, 16 nt, Human
guuuaaaaucauuucu

SEQ ID NO: 3147994 - RNA, 13 nt, Human
guuuaaagaaagu

SEQ ID NO: 3147995 - RNA, 23 nt, Human
guuuucugagaaagacuauucaa

SEQ ID NO: 3147996 - RNA, 21 nt, Human
guuucaaacauauauaacaau

SEQ ID NO: 3147997 - RNA, 11 nt, Human
guuagggaggg

SEQ ID NO: 3147998 - RNA, 13 nt, Human
guuagggaggggu

SEQ ID NO: 3147999 - RNA, 17 nt, Human
guuaguuaccuuauagu

SEQ ID NO: 3148000 - RNA, 23 nt, Human
guuaguuaccuuauaguuacugu

SEQ ID NO: 3148001 - RNA, 22 nt, Human
guuaguuaccuuauaguuacug

SEQ ID NO: 3148002 - RNA, 13 nt, Human
guuauuuaaauga

SEQ ID NO: 3148003 - RNA, 11 nt, Human
guuauuuaaau

SEQ ID NO: 3148004 - RNA, 15 nt, Human
guuauuuaaaugagu

SEQ ID NO: 3148005 - RNA, 18 nt, Human
guugacaugggacauuug

SEQ ID NO: 3148006 - RNA, 14 nt, Human
guugacaugggaca

SEQ ID NO: 3148007 - RNA, 13 nt, Human
guugacaugggac

SEQ ID NO: 3148008 - RNA, 23 nt, Human
aagcuuguauuccuuuuucucuc

SEQ ID NO: 3148009 - RNA, 18 nt, Human
aagcuuauuaaaacucau

SEQ ID NO: 3148010 - RNA, 13 nt, Human
guucccucccaga

SEQ ID NO: 3148011 - RNA, 16 nt, Human
acaccccuccccugcc

SEQ ID NO: 3148012 - RNA, 23 nt, Human
acaccccuccccugcccuagagc

SEQ ID NO: 3148013 - RNA, 17 nt, Human
acacuaagagagaauga

SEQ ID NO: 3148014 - RNA, 18 nt, Human
acacuaagagagaaugag

SEQ ID NO: 3148015 - RNA, 14 nt, Human
acacuaagagagaa

SEQ ID NO: 3148016 - RNA, 14 nt, Human
uauaacuaacaugu

SEQ ID NO: 3148017 - RNA, 18 nt, Human
acacaugcugaacaucac

SEQ ID NO: 3148018 - RNA, 23 nt, Human
uauaaaauaauuuuuauauuuga

SEQ ID NO: 3148019 - RNA, 16 nt, Human
uaguguuggagaagaa

SEQ ID NO: 3148020 - RNA, 12 nt, Human
uaguguuggaga

SEQ ID NO: 3148021 - RNA, 14 nt, Human
acacacugaagaag

SEQ ID NO: 3148022 - RNA, 20 nt, Human
acacaggcaacugaggcaga

SEQ ID NO: 3148023 - RNA, 16 nt, Human
acacaggcaacugagg

SEQ ID NO: 3148024 - RNA, 19 nt, Human
acacaggcaacugaggcag

SEQ ID NO: 3148025 - RNA, 15 nt, Human
acacaggcaacugag

SEQ ID NO: 3148026 - RNA, 17 nt, Human
acacaacuauauuguuu

SEQ ID NO: 3148027 - RNA, 14 nt, Human
acacaacuauauug

SEQ ID NO: 3148028 - RNA, 17 nt, Human
acaaugcuguauuuuaa

SEQ ID NO: 3148029 - RNA, 14 nt, Human
acaaugcuguauuu

SEQ ID NO: 3148030 - RNA, 20 nt, Human
uagcuuagaccucagccugu

SEQ ID NO: 3148031 - RNA, 23 nt, Human
uagcuuagaccucagccugugcu

SEQ ID NO: 3148032 - RNA, 16 nt, Human
uagcuuagaccucagc

SEQ ID NO: 3148033 - RNA, 17 nt, Human
uagcuuagaccucagcc

SEQ ID NO: 3148034 - RNA, 18 nt, Human
uagcuuagaccucagccu

SEQ ID NO: 3148035 - RNA, 19 nt, Human
uagcuuagaccucagccug

SEQ ID NO: 3148036 - RNA, 17 nt, Human
acacacaggcaacugag

SEQ ID NO: 3148037 - RNA, 20 nt, Human
acacacucaaaucaagaaac

SEQ ID NO: 3148038 - RNA, 13 nt, Human
acacacugaagaa

SEQ ID NO: 3148039 - RNA, 14 nt, Human
acacaccaggcgcu

SEQ ID NO: 3148040 - RNA, 17 nt, Human
acacaccaggcgcuaau

SEQ ID NO: 3148041 - RNA, 19 nt, Human
acagcccuucuuuccacag

SEQ ID NO: 3148042 - RNA, 21 nt, Human
acagcccuucuuuccacagaa

SEQ ID NO: 3148043 - RNA, 20 nt, Human
acagcccuucuuuccacaga

SEQ ID NO: 3148044 - RNA, 22 nt, Human
uauccuaauaaaaaggugacca

SEQ ID NO: 3148045 - RNA, 19 nt, Human
uauauuuauuacuguaaga

SEQ ID NO: 3148046 - RNA, 15 nt, Human
uauauuuauuacugu

SEQ ID NO: 3148047 - RNA, 17 nt, Human
uaucucaaaacugcacu

SEQ ID NO: 3148048 - RNA, 12 nt, Human
uauauuuacaaa

SEQ ID NO: 3148049 - RNA, 15 nt, Human
acacuuaaaaauggu

SEQ ID NO: 3148050 - RNA, 13 nt, Human
acacuuaaaaaug

SEQ ID NO: 3148051 - RNA, 14 nt, Human
acacuccagugaga

SEQ ID NO: 3148052 - RNA, 14 nt, Human
acacugaagaagca

SEQ ID NO: 3148053 - RNA, 12 nt, Human
acacugaagaag

SEQ ID NO: 3148054 - RNA, 20 nt, Human
uagaugcaguucugaagaag

SEQ ID NO: 3148055 - RNA, 21 nt, Human
uagaugcaguucugaagaaga

SEQ ID NO: 3148056 - RNA, 17 nt, Human
uagauaggccaugggca

SEQ ID NO: 3148057 - RNA, 22 nt, Human
uagauaggucagugcaaauacu

SEQ ID NO: 3148058 - RNA, 21 nt, Human
aauuuuucuuauuucauuucu

SEQ ID NO: 3148059 - RNA, 22 nt, Human
aauuuuuucucuaggaaauauu

SEQ ID NO: 3148060 - RNA, 15 nt, Human
uagcuuagaccucag

SEQ ID NO: 3148061 - RNA, 16 nt, Human
uagcuacuaauuuuaa

SEQ ID NO: 3148062 - RNA, 17 nt, Human
acaaauuuacagagaca

SEQ ID NO: 3148063 - RNA, 22 nt, Human
acaagcucacagaccuuugaac

SEQ ID NO: 3148064 - RNA, 12 nt, Human
aauuucuuaacu

SEQ ID NO: 3148065 - RNA, 16 nt, Human
aauuucuuaacuucuu

SEQ ID NO: 3148066 - RNA, 15 nt, Human
aauuucuuaacuucu

SEQ ID NO: 3148067 - RNA, 20 nt, Human
aauuucuuaacuucuugcuu

SEQ ID NO: 3148068 - RNA, 18 nt, Human
aauuuacagagacagaaa

SEQ ID NO: 3148069 - RNA, 17 nt, Human
aauuuacagagacagaa

SEQ ID NO: 3148070 - RNA, 19 nt, Human
uacuucuuaggguuaugau

SEQ ID NO: 3148071 - RNA, 16 nt, Human
uacuucaugcugucua

SEQ ID NO: 3148072 - RNA, 18 nt, Human
aauugaggacacugauau

SEQ ID NO: 3148073 - RNA, 23 nt, Human
uacugggaaagggauuuucagcc

SEQ ID NO: 3148074 - RNA, 17 nt, Human
uacugagagugaacaaa

SEQ ID NO: 3148075 - RNA, 14 nt, Human
uacuaaaaauacaa

SEQ ID NO: 3148076 - RNA, 18 nt, Human
uacuaaaaauacaaaaaa

SEQ ID NO: 3148077 - RNA, 20 nt, Human
uaauucaaggaauuucuuaa

SEQ ID NO: 3148078 - RNA, 18 nt, Human
uaauucaaggaauuucuu

SEQ ID NO: 3148079 - RNA, 22 nt, Human
uaauucaaggaauuucuuaacu

SEQ ID NO: 3148080 - RNA, 15 nt, Human
uacaaaaacacagca

SEQ ID NO: 3148081 - RNA, 13 nt, Human
uacaaaaacacag

SEQ ID NO: 3148082 - RNA, 14 nt, Human
uacaaaaacacagc

SEQ ID NO: 3148083 - RNA, 20 nt, Human
uaauuuauuguuuuuccuug

SEQ ID NO: 3148084 - RNA, 19 nt, Human
uacacuaagagagaaugag

SEQ ID NO: 3148085 - RNA, 18 nt, Human
uacacuaagagagaauga

SEQ ID NO: 3148086 - RNA, 19 nt, Human
aauggacuuuuguacauag

SEQ ID NO: 3148087 - RNA, 11 nt, Human
aaugugauaug

SEQ ID NO: 3148088 - RNA, 21 nt, Human
aaugagagacacacugaagaa

SEQ ID NO: 3148089 - RNA, 23 nt, Human
aaucuuaguguaugauuacuggc

SEQ ID NO: 3148090 - RNA, 14 nt, Human
aaucuuauaauuua

SEQ ID NO: 3148091 - RNA, 13 nt, Human
aauccuugaagau

SEQ ID NO: 3148092 - RNA, 14 nt, Human
uaaguacuguguac

SEQ ID NO: 3148093 - RNA, 17 nt, Human
aaucaugaauuaguuuu

SEQ ID NO: 3148094 - RNA, 19 nt, Human
aaucaugaauuaguuuuau

SEQ ID NO: 3148095 - RNA, 23 nt, Human
aaucaugaauuaguuuuauaugc

SEQ ID NO: 3148096 - RNA, 15 nt, Human
aaucaucaagucuuu

SEQ ID NO: 3148097 - RNA, 19 nt, Human
aauauccuaauaaaaaggu

SEQ ID NO: 3148098 - RNA, 15 nt, Human
aauauccuaauaaaa

SEQ ID NO: 3148099 - RNA, 18 nt, Human
uaaccugucucaccugga

SEQ ID NO: 3148100 - RNA, 12 nt, Human
aauaucacuugu

SEQ ID NO: 3148101 - RNA, 15 nt, Human
aauaucacuugucaa

SEQ ID NO: 3148102 - RNA, 14 nt, Human
aauauccuaauaaa

SEQ ID NO: 3148103 - RNA, 13 nt, Human
aauauccuaauaa

SEQ ID NO: 3148104 - RNA, 12 nt, Human
aauauccuaaua

SEQ ID NO: 3148105 - RNA, 18 nt, Human
aauaggcguaacuaauuu

SEQ ID NO: 3148106 - RNA, 16 nt, Human
aauaggaauugguuuc

SEQ ID NO: 3148107 - RNA, 24 nt, Human
aaucagaagucaucuugcuaccag

SEQ ID NO: 3148108 - RNA, 20 nt, Human
aaucagaagucaucuugcua

SEQ ID NO: 3148109 - RNA, 15 nt, Human
aauauuucagauaau

SEQ ID NO: 3148110 - RNA, 14 nt, Human
aauauuucagauaa

SEQ ID NO: 3148111 - RNA, 24 nt, Human
aauaugcaaagcacugacuucuaa

SEQ ID NO: 3148112 - RNA, 15 nt, Human
aauaugcaaagcacu

SEQ ID NO: 3148113 - RNA, 17 nt, Human
aauaugcaaagcacuga

SEQ ID NO: 3148114 - RNA, 16 nt, Human
uaacuaacauguccug

SEQ ID NO: 3148115 - RNA, 13 nt, Human
uaacuacuuuaua

SEQ ID NO: 3148116 - RNA, 19 nt, Human
aauaucuuuuuuuuaauaa

SEQ ID NO: 3148117 - RNA, 21 nt, Human
aauauccuaauaaaaagguga

SEQ ID NO: 3148118 - RNA, 20 nt, Human
aauaauuuuuauauuugaaa

SEQ ID NO: 3148119 - RNA, 16 nt, Human
aauaauuuuuauauuu

SEQ ID NO: 3148120 - RNA, 19 nt, Human
aauaauuuuuauauuugaa

SEQ ID NO: 3148121 - RNA, 17 nt, Human
aauaauuuuuauauuug

SEQ ID NO: 3148122 - RNA, 21 nt, Human
aauaacaaugaaaguugauaa

SEQ ID NO: 3148123 - RNA, 17 nt, Human
aauaaagucagauggaa

SEQ ID NO: 3148124 - RNA, 16 nt, Human
aauaaaaaggugacca

SEQ ID NO: 3148125 - RNA, 13 nt, Human
aauaaaaagguga

SEQ ID NO: 3148126 - RNA, 12 nt, Human
aauaaaaaggug

SEQ ID NO: 3148127 - RNA, 21 nt, Human
cacuccagugagacagcucug

SEQ ID NO: 3148128 - RNA, 16 nt, Human
cacuccagugagacag

SEQ ID NO: 3148129 - RNA, 23 nt, Human
cacugaagaagcaccaaucauga

SEQ ID NO: 3148130 - RNA, 11 nt, Human
cacugaagaag

SEQ ID NO: 3148131 - RNA, 13 nt, Human
cacaucagcuugc

SEQ ID NO: 3148132 - RNA, 23 nt, Human
cacaucagcuugcccuguuaaaa

SEQ ID NO: 3148133 - RNA, 17 nt, Human
caccaggagucccuggu

SEQ ID NO: 3148134 - RNA, 12 nt, Human
caacuccagaaa

SEQ ID NO: 3148135 - RNA, 19 nt, Human
caacuaucucauuuccaag

SEQ ID NO: 3148136 - RNA, 19 nt, Human
caacuauauuguuugcuaa

SEQ ID NO: 3148137 - RNA, 14 nt, Human
caagcaaguauuag

SEQ ID NO: 3148138 - RNA, 14 nt, Human
caagcacagcccuu

SEQ ID NO: 3148139 - RNA, 17 nt, Human
caaguucaugcagcugu

SEQ ID NO: 3148140 - RNA, 17 nt, Human
caaucagccuaguugau

SEQ ID NO: 3148141 - RNA, 21 nt, Human
caauauuucagauaaucacaa

SEQ ID NO: 3148142 - RNA, 19 nt, Human
auuuuuauauuugaaauau

SEQ ID NO: 3148143 - RNA, 16 nt, Human
auuuuuauauuugaaa

SEQ ID NO: 3148144 - RNA, 21 nt, Human
caaaagguauuuuaaucacca

SEQ ID NO: 3148145 - RNA, 17 nt, Human
caaacauauauaacaau

SEQ ID NO: 3148146 - RNA, 15 nt, Human
auuugcagagacagg

SEQ ID NO: 3148147 - RNA, 19 nt, Human
auuugcagagacaggaccu

SEQ ID NO: 3148148 - RNA, 22 nt, Human
auuugcagagacaggaccugac

SEQ ID NO: 3148149 - RNA, 19 nt, Human
auuuucuauaauuuaaaua

SEQ ID NO: 3148150 - RNA, 18 nt, Human
auuuucuauaauuuaaau

SEQ ID NO: 3148151 - RNA, 17 nt, Human
auuuucuauaauuuaaa

SEQ ID NO: 3148152 - RNA, 16 nt, Human
auuucagcagcugcag

SEQ ID NO: 3148153 - RNA, 15 nt, Human
auuuaucuauaauuu

SEQ ID NO: 3148154 - RNA, 11 nt, Human
auuuaucuaua

SEQ ID NO: 3148155 - RNA, 10 nt, Human
auuuaucuau

SEQ ID NO: 3148156 - RNA, 22 nt, Human
auucaaggaauuucuuaacuuc

SEQ ID NO: 3148157 - RNA, 20 nt, Human
auucaaggaauuucuuaacu

SEQ ID NO: 3148158 - RNA, 22 nt, Human
auugaggacacugauauggguc

SEQ ID NO: 3148159 - RNA, 18 nt, Human
caucuggcucuaauucac

SEQ ID NO: 3148160 - RNA, 14 nt, Human
caucuggcucuaau

SEQ ID NO: 3148161 - RNA, 19 nt, Human
cauccugaggcuccacuug

SEQ ID NO: 3148162 - RNA, 18 nt, Human
cauccugaggcuccacuu

SEQ ID NO: 3148163 - RNA, 19 nt, Human
cauagcagcuuauucacaa

SEQ ID NO: 3148164 - RNA, 19 nt, Human
caguuauggcuauaggugc

SEQ ID NO: 3148165 - RNA, 20 nt, Human
caguuauggcuauaggugcu

SEQ ID NO: 3148166 - RNA, 13 nt, Human
caguuauggcuau

SEQ ID NO: 3148167 - RNA, 21 nt, Human
caguuauuauauuuacaaaug

SEQ ID NO: 3148168 - RNA, 17 nt, Human
caguuauuauauuuaca

SEQ ID NO: 3148169 - RNA, 22 nt, Human
cagugauuaccagggacugagg

SEQ ID NO: 3148170 - RNA, 22 nt, Human
cagucucucuucucuccagcug

SEQ ID NO: 3148171 - RNA, 13 nt, Human
cagugggugcccc

SEQ ID NO: 3148172 - RNA, 17 nt, Human
cagucucucuucucucc

SEQ ID NO: 3148173 - RNA, 14 nt, Human
cagucucucuucuc

SEQ ID NO: 3148174 - RNA, 22 nt, Human
caguuauuauauuuacaaaugg

SEQ ID NO: 3148175 - RNA, 15 nt, Human
caguucagagcugcc

SEQ ID NO: 3148176 - RNA, 16 nt, Human
caguucagagcugccc

SEQ ID NO: 3148177 - RNA, 17 nt, Human
caguucagagcugcccu

SEQ ID NO: 3148178 - RNA, 23 nt, Human
caguucagagcugcccucuccug

SEQ ID NO: 3148179 - RNA, 24 nt, Human
caguucagagcugcccucuccugg

SEQ ID NO: 3148180 - RNA, 18 nt, Human
caguucagagcugcccuc

SEQ ID NO: 3148181 - RNA, 19 nt, Human
caguucagagcugcccucu

SEQ ID NO: 3148182 - RNA, 21 nt, Human
caguucagagcugcccucucc

SEQ ID NO: 3148183 - RNA, 22 nt, Human
caguucagagcugcccucuccu

SEQ ID NO: 3148184 - RNA, 19 nt, Human
cauuauauuuauuacugua

SEQ ID NO: 3148185 - RNA, 16 nt, Human
cauuuguauaaaauaa

SEQ ID NO: 3148186 - RNA, 14 nt, Human
cauuuguauaaaau

SEQ ID NO: 3148187 - RNA, 16 nt, Human
cauuuaucuauaauuu

SEQ ID NO: 3148188 - RNA, 14 nt, Human
cauuuaucuauaau

SEQ ID NO: 3148189 - RNA, 22 nt, Human
cauuuaucuauaauuuaccuaa

SEQ ID NO: 3148190 - RNA, 21 nt, Human
cauuuaucuauaauuuaccua

SEQ ID NO: 3148191 - RNA, 14 nt, Human
ccaaaaggcagaag

SEQ ID NO: 3148192 - RNA, 21 nt, Human
ccaacuccagaaagugacaag

SEQ ID NO: 3148193 - RNA, 14 nt, Human
cagccagacuggca

SEQ ID NO: 3148194 - RNA, 14 nt, Human
cagcacuaaagcag

SEQ ID NO: 3148195 - RNA, 17 nt, Human
cagcacuaaagcagugg

SEQ ID NO: 3148196 - RNA, 19 nt, Human
cagcacuaaagcaguggac

SEQ ID NO: 3148197 - RNA, 20 nt, Human
cagcacuaaagcaguggaca

SEQ ID NO: 3148198 - RNA, 15 nt, Human
cagccagacuggcac

SEQ ID NO: 3148199 - RNA, 18 nt, Human
cagccagacuggcacagu

SEQ ID NO: 3148200 - RNA, 22 nt, Human
cagccagcaguucagagcugcc

SEQ ID NO: 3148201 - RNA, 23 nt, Human
cagccagcaguucagagcugccc

SEQ ID NO: 3148202 - RNA, 18 nt, Human
cagagcugcccucuccug

SEQ ID NO: 3148203 - RNA, 19 nt, Human
cagagcugcccucuccugg

SEQ ID NO: 3148204 - RNA, 20 nt, Human
cagagcugcccucuccuggg

SEQ ID NO: 3148205 - RNA, 21 nt, Human
cagagcugcccucuccugggc

SEQ ID NO: 3148206 - RNA, 17 nt, Human
cagagcugcccucuccu

SEQ ID NO: 3148207 - RNA, 13 nt, Human
cagacagcagcuc

SEQ ID NO: 3148208 - RNA, 15 nt, Human
cagacagcagcucag

SEQ ID NO: 3148209 - RNA, 16 nt, Human
cagacagcagcucagg

SEQ ID NO: 3148210 - RNA, 19 nt, Human
cagacagcagcucaggcac

SEQ ID NO: 3148211 - RNA, 17 nt, Human
cagacagcagcucaggc

SEQ ID NO: 3148212 - RNA, 18 nt, Human
cagacagcagcucaggca

SEQ ID NO: 3148213 - RNA, 17 nt, Human
cagacuggcacaguuuu

SEQ ID NO: 3148214 - RNA, 18 nt, Human
cagacuggcacaguuuuc

SEQ ID NO: 3148215 - RNA, 22 nt, Human
cagacuggcacaguuuucugag

SEQ ID NO: 3148216 - RNA, 23 nt, Human
cagacuggcacaguuuucugaga

SEQ ID NO: 3148217 - RNA, 19 nt, Human
cagacuggauaguccgucu

SEQ ID NO: 3148218 - RNA, 11 nt, Human
caggcuacugu

SEQ ID NO: 3148219 - RNA, 22 nt, Human
cagggcuuuacuccguaacaga

SEQ ID NO: 3148220 - RNA, 14 nt, Human
cagggcucagccug

SEQ ID NO: 3148221 - RNA, 12 nt, Human
cagggcucagcc

SEQ ID NO: 3148222 - RNA, 13 nt, Human
cagggcucagccu

SEQ ID NO: 3148223 - RNA, 16 nt, Human
caggaaagagaacuuc

SEQ ID NO: 3148224 - RNA, 14 nt, Human
cagcuuauugucua

SEQ ID NO: 3148225 - RNA, 20 nt, Human
cagcuguaugauucccagcc

SEQ ID NO: 3148226 - RNA, 20 nt, Human
cagcuuauugucuagugaaa

SEQ ID NO: 3148227 - RNA, 17 nt, Human
cagcuuauucacaagac

SEQ ID NO: 3148228 - RNA, 19 nt, Human
cagcuguaugauucccagc

SEQ ID NO: 3148229 - RNA, 18 nt, Human
cagcugccuccccuccuc

SEQ ID NO: 3148230 - RNA, 19 nt, Human
cagcugccuccccuccucu

SEQ ID NO: 3148231 - RNA, 14 nt, Human
cagcugccuccccu

SEQ ID NO: 3148232 - RNA, 15 nt, Human
cagcugccuccccuc

SEQ ID NO: 3148233 - RNA, 16 nt, Human
cagcugccuccccucc

SEQ ID NO: 3148234 - RNA, 17 nt, Human
cagcugccuccccuccu

SEQ ID NO: 3148235 - RNA, 10 nt, Human
cagcugccuc

SEQ ID NO: 3148236 - RNA, 11 nt, Human
cagcugccucc

SEQ ID NO: 3148237 - RNA, 9 nt, Human
cagcugccu

SEQ ID NO: 3148238 - RNA, 22 nt, Human
ccagacuagauguaguauuuuu

SEQ ID NO: 3148239 - RNA, 18 nt, Human
ccagacuagauguaguau

SEQ ID NO: 3148240 - RNA, 19 nt, Human
ccacuuggucugugagaug

SEQ ID NO: 3148241 - RNA, 17 nt, Human
ccacuuggucugugaga

SEQ ID NO: 3148242 - RNA, 16 nt, Human
ccacuuggucugugag

SEQ ID NO: 3148243 - RNA, 15 nt, Human
ccacuuggucuguga

SEQ ID NO: 3148244 - RNA, 22 nt, Human
ccacuuggucugugagaugcua

SEQ ID NO: 3148245 - RNA, 20 nt, Human
ccacuuggucugugagaugc

SEQ ID NO: 3148246 - RNA, 12 nt, Human
ccacuuggucug

SEQ ID NO: 3148247 - RNA, 15 nt, Human
ccaggggccaugaau

SEQ ID NO: 3148248 - RNA, 18 nt, Human
ccaggaguuuggccagaa

SEQ ID NO: 3148249 - RNA, 17 nt, Human
ccaggaguuuggccaga

SEQ ID NO: 3148250 - RNA, 16 nt, Human
ccaggaguuuggccag

SEQ ID NO: 3148251 - RNA, 15 nt, Human
ccaggaguuuggcca

SEQ ID NO: 3148252 - RNA, 14 nt, Human
ccaggaguuuggcc

SEQ ID NO: 3148253 - RNA, 21 nt, Human
ccagcagccagcucucagcca

SEQ ID NO: 3148254 - RNA, 15 nt, Human
ccccauuguggucac

SEQ ID NO: 3148255 - RNA, 22 nt, Human
ccauuguggucacaggaaguag

SEQ ID NO: 3148256 - RNA, 13 nt, Human
ccauuuaaagcuu

SEQ ID NO: 3148257 - RNA, 18 nt, Human
ccaugggcacugugggua

SEQ ID NO: 3148258 - RNA, 21 nt, Human
ccucuccugggcagcugccuc

SEQ ID NO: 3148259 - RNA, 22 nt, Human
ccucuccugggcagcugccucc

SEQ ID NO: 3148260 - RNA, 17 nt, Human
ccucuccugggcagcug

SEQ ID NO: 3148261 - RNA, 18 nt, Human
ccucuccugggcagcugc

SEQ ID NO: 3148262 - RNA, 19 nt, Human
ccucuccugggcagcugcc

SEQ ID NO: 3148263 - RNA, 20 nt, Human
ccucuccugggcagcugccu

SEQ ID NO: 3148264 - RNA, 14 nt, Human
ccucuccugggcag

SEQ ID NO: 3148265 - RNA, 15 nt, Human
ccucuccugggcagc

SEQ ID NO: 3148266 - RNA, 16 nt, Human
ccucuccugggcagcu

SEQ ID NO: 3148267 - RNA, 15 nt, Human
ccucaugcugccaau

SEQ ID NO: 3148268 - RNA, 13 nt, Human
ccucaugcugcca

SEQ ID NO: 3148269 - RNA, 16 nt, Human
ccucaugcugccaaua

SEQ ID NO: 3148270 - RNA, 21 nt, Human
ccucccagaggagccaccagu

SEQ ID NO: 3148271 - RNA, 20 nt, Human
ccucccagaggagccaccag

SEQ ID NO: 3148272 - RNA, 18 nt, Human
ccuagccgaccucagccu

SEQ ID NO: 3148273 - RNA, 19 nt, Human
ccuagccgaccucagccuu

SEQ ID NO: 3148274 - RNA, 20 nt, Human
ccuagccgaccucagccuuc

SEQ ID NO: 3148275 - RNA, 14 nt, Human
ccuagccgaccuca

SEQ ID NO: 3148276 - RNA, 15 nt, Human
ccuagccgaccucag

SEQ ID NO: 3148277 - RNA, 16 nt, Human
ccuagccgaccucagc

SEQ ID NO: 3148278 - RNA, 17 nt, Human
ccuagccgaccucagcc

SEQ ID NO: 3148279 - RNA, 20 nt, Human
ccuaacgaaguauccuucag

SEQ ID NO: 3148280 - RNA, 15 nt, Human
ccuaacgaaguaucc

SEQ ID NO: 3148281 - RNA, 22 nt, Human
cccugagcucgguggacccagg

SEQ ID NO: 3148282 - RNA, 14 nt, Human
cccugagcaggauu

SEQ ID NO: 3148283 - RNA, 12 nt, Human
cccugagcucgg

SEQ ID NO: 3148284 - RNA, 13 nt, Human
cccucggagaaga

SEQ ID NO: 3148285 - RNA, 16 nt, Human
cucaguccaugaagau

SEQ ID NO: 3148286 - RNA, 18 nt, Human
cucaguagucagacugga

SEQ ID NO: 3148287 - RNA, 18 nt, Human
cuaucucauuuccaagca

SEQ ID NO: 3148288 - RNA, 23 nt, Human
cuaugucauuugcuggagcucug

SEQ ID NO: 3148289 - RNA, 18 nt, Human
cuauguucuaagaaguga

SEQ ID NO: 3148290 - RNA, 12 nt, Human
cuccucugcacu

SEQ ID NO: 3148291 - RNA, 13 nt, Human
cuccucugcacuc

SEQ ID NO: 3148292 - RNA, 13 nt, Human
cuccugucugcca

SEQ ID NO: 3148293 - RNA, 14 nt, Human
cuccugucugccag

SEQ ID NO: 3148294 - RNA, 15 nt, Human
cuccugucugccagc

SEQ ID NO: 3148295 - RNA, 22 nt, Human
cuccucugcuugccaucccucc

SEQ ID NO: 3148296 - RNA, 17 nt, Human
cuccucuguccagggcc

SEQ ID NO: 3148297 - RNA, 18 nt, Human
cuccucuguccagggccc

SEQ ID NO: 3148298 - RNA, 14 nt, Human
cuccucuguccagg

SEQ ID NO: 3148299 - RNA, 15 nt, Human
cuccucuguccaggg

SEQ ID NO: 3148300 - RNA, 16 nt, Human
cuccucuguccagggc

SEQ ID NO: 3148301 - RNA, 23 nt, Human
cucauggguggcacucagucucu

SEQ ID NO: 3148302 - RNA, 19 nt, Human
cucauggguggcacucagu

SEQ ID NO: 3148303 - RNA, 15 nt, Human
cucauggguggcacu

SEQ ID NO: 3148304 - RNA, 14 nt, Human
cucauggguggcac

SEQ ID NO: 3148305 - RNA, 15 nt, Human
cucccagaggagcca

SEQ ID NO: 3148306 - RNA, 22 nt, Human
cucccuccaccucccugcaaua

SEQ ID NO: 3148307 - RNA, 20 nt, Human
cucccuccaccucccugcaa

SEQ ID NO: 3148308 - RNA, 21 nt, Human
cucccuccaccucccugcaau

SEQ ID NO: 3148309 - RNA, 19 nt, Human
cucccuccaccucccugca

SEQ ID NO: 3148310 - RNA, 22 nt, Human
cucuguccagggcccugagcuc

SEQ ID NO: 3148311 - RNA, 15 nt, Human
cucuccccaugaugu

SEQ ID NO: 3148312 - RNA, 16 nt, Human
cucuccccaugauguu

SEQ ID NO: 3148313 - RNA, 19 nt, Human
cucuauguucuaagaagug

SEQ ID NO: 3148314 - RNA, 13 nt, Human
cucucuggccuuc

SEQ ID NO: 3148315 - RNA, 16 nt, Human
cucucuggccuucggc

SEQ ID NO: 3148316 - RNA, 14 nt, Human
cucucuggccuucg

SEQ ID NO: 3148317 - RNA, 16 nt, Human
cucucuucucuccagc

SEQ ID NO: 3148318 - RNA, 22 nt, Human
cucucuggccuucggccuccau

SEQ ID NO: 3148319 - RNA, 16 nt, Human
cucucuguaauaaacu

SEQ ID NO: 3148320 - RNA, 21 nt, Human
cucucuguaauaaacucauuu

SEQ ID NO: 3148321 - RNA, 18 nt, Human
cucgguggacccagggau

SEQ ID NO: 3148322 - RNA, 18 nt, Human
cuaaagcaguggacacca

SEQ ID NO: 3148323 - RNA, 11 nt, Human
cuaaagcagug

SEQ ID NO: 3148324 - RNA, 20 nt, Human
cuaacgaaguauccuucagc

SEQ ID NO: 3148325 - RNA, 19 nt, Human
cuaauaaaaaggugaccau

SEQ ID NO: 3148326 - RNA, 15 nt, Human
cuaauaaaaagguga

SEQ ID NO: 3148327 - RNA, 20 nt, Human
cuacaaaaacacagcaaggg

SEQ ID NO: 3148328 - RNA, 12 nt, Human
ccuuuucccaac

SEQ ID NO: 3148329 - RNA, 17 nt, Human
ccuuagcuuagaccuca

SEQ ID NO: 3148330 - RNA, 18 nt, Human
ccuuagcuuagaccucag

SEQ ID NO: 3148331 - RNA, 21 nt, Human
ccuuauaguuacuguguaauu

SEQ ID NO: 3148332 - RNA, 14 nt, Human
ccuuauaguuacug

SEQ ID NO: 3148333 - RNA, 23 nt, Human
ccuuagcuuagaccucagccugu

SEQ ID NO: 3148334 - RNA, 19 nt, Human
ccuuagcuuagaccucagc

SEQ ID NO: 3148335 - RNA, 20 nt, Human
ccuuagcuuagaccucagcc

SEQ ID NO: 3148336 - RNA, 21 nt, Human
ccuuagcuuagaccucagccu

SEQ ID NO: 3148337 - RNA, 22 nt, Human
ccuuagcuuagaccucagccug

SEQ ID NO: 3148338 - RNA, 22 nt, Human
ccuuccccuugcccagggcuca

SEQ ID NO: 3148339 - RNA, 18 nt, Human
ccuuccccuugcccaggg

SEQ ID NO: 3148340 - RNA, 20 nt, Human
ccuuccccuugcccagggcu

SEQ ID NO: 3148341 - RNA, 17 nt, Human
ccuucucuucacaguca

SEQ ID NO: 3148342 - RNA, 13 nt, Human
ccuugccagacau

SEQ ID NO: 3148343 - RNA, 21 nt, Human
gcuaguaauuggaaaggcagc

SEQ ID NO: 3148344 - RNA, 16 nt, Human
gcuaguaucaaaagaa

SEQ ID NO: 3148345 - RNA, 15 nt, Human
gcuccccucggagaa

SEQ ID NO: 3148346 - RNA, 19 nt, Human
gcucuaauucacagugcuc

SEQ ID NO: 3148347 - RNA, 18 nt, Human
gcucuaauucacagugcu

SEQ ID NO: 3148348 - RNA, 16 nt, Human
gcucuaauucacagug

SEQ ID NO: 3148349 - RNA, 15 nt, Human
gcucuaauucacagu

SEQ ID NO: 3148350 - RNA, 21 nt, Human
gcuucuuucuagaaagagaaa

SEQ ID NO: 3148351 - RNA, 15 nt, Human
gcuucuuucuagaaa

SEQ ID NO: 3148352 - RNA, 12 nt, Human
gcuucuuucuag

SEQ ID NO: 3148353 - RNA, 21 nt, Human
gcuguaacuacuuuauaacua

SEQ ID NO: 3148354 - RNA, 17 nt, Human
gcuggagcucugcccau

SEQ ID NO: 3148355 - RNA, 14 nt, Human
gcuggagcucugcc

SEQ ID NO: 3148356 - RNA, 14 nt, Human
gcugccuccccucc

SEQ ID NO: 3148357 - RNA, 16 nt, Human
gcugccuccccuccuc

SEQ ID NO: 3148358 - RNA, 17 nt, Human
gcugccuccccuccucu

SEQ ID NO: 3148359 - RNA, 20 nt, Human
gcugccuccccuccucugcu

SEQ ID NO: 3148360 - RNA, 21 nt, Human
gcugccuccccuccucugcuu

SEQ ID NO: 3148361 - RNA, 22 nt, Human
gcugccuccccuccucugcuug

SEQ ID NO: 3148362 - RNA, 16 nt, Human
gccauaugaaaaggcu

SEQ ID NO: 3148363 - RNA, 14 nt, Human
gccagccagcagcc

SEQ ID NO: 3148364 - RNA, 12 nt, Human
gccagccagcag

SEQ ID NO: 3148365 - RNA, 13 nt, Human
gccagccagcagc

SEQ ID NO: 3148366 - RNA, 21 nt, Human
gccagcaguucagagcugccc

SEQ ID NO: 3148367 - RNA, 22 nt, Human
gccagcaguucagagcugcccu

SEQ ID NO: 3148368 - RNA, 23 nt, Human
gccagcaguucagagcugcccuc

SEQ ID NO: 3148369 - RNA, 16 nt, Human
gccagcagccagcucu

SEQ ID NO: 3148370 - RNA, 17 nt, Human
gccagcagccagcucuc

SEQ ID NO: 3148371 - RNA, 18 nt, Human
gccagcagccagcucuca

SEQ ID NO: 3148372 - RNA, 19 nt, Human
gccagcagccagcucucag

SEQ ID NO: 3148373 - RNA, 20 nt, Human
gccagcagccagcucucagc

SEQ ID NO: 3148374 - RNA, 21 nt, Human
gccagcagccagcucucagcc

SEQ ID NO: 3148375 - RNA, 22 nt, Human
gccagcagccagcucucagcca

SEQ ID NO: 3148376 - RNA, 23 nt, Human
gccagcagccagcucucagccaa

SEQ ID NO: 3148377 - RNA, 12 nt, Human
gccagcagccag

SEQ ID NO: 3148378 - RNA, 13 nt, Human
gccagcagccagc

SEQ ID NO: 3148379 - RNA, 15 nt, Human
gccagcagccagcuc

SEQ ID NO: 3148380 - RNA, 22 nt, Human
gccagacaucaacagauaaaua

SEQ ID NO: 3148381 - RNA, 14 nt, Human
gccagacauguggu

SEQ ID NO: 3148382 - RNA, 23 nt, Human
gccagaagucaaggcuuagaccc

SEQ ID NO: 3148383 - RNA, 22 nt, Human
gccagaagucaaggcuuagacc

SEQ ID NO: 3148384 - RNA, 20 nt, Human
gccagaagucaaggcuuaga

SEQ ID NO: 3148385 - RNA, 16 nt, Human
gccagaagucaaggcu

SEQ ID NO: 3148386 - RNA, 19 nt, Human
gccagauuuuccugaaaac

SEQ ID NO: 3148387 - RNA, 12 nt, Human
gccagaaauaaa

SEQ ID NO: 3148388 - RNA, 16 nt, Human
gccacuuaauguaugu

SEQ ID NO: 3148389 - RNA, 13 nt, Human
gccacuuaaugua

SEQ ID NO: 3148390 - RNA, 19 nt, Human
gccacuuaauguauguuac

SEQ ID NO: 3148391 - RNA, 18 nt, Human
gccacuuaauguauguua

SEQ ID NO: 3148392 - RNA, 19 nt, Human
gccaccaguucucaugggu

SEQ ID NO: 3148393 - RNA, 13 nt, Human
gccaccaguucuc

SEQ ID NO: 3148394 - RNA, 11 nt, Human
gccaccaguuc

SEQ ID NO: 3148395 - RNA, 13 nt, Human
gcacuuggagcca

SEQ ID NO: 3148396 - RNA, 16 nt, Human
gcacuuggagccaagg

SEQ ID NO: 3148397 - RNA, 22 nt, Human
gcacuuggagccaaggguucag

SEQ ID NO: 3148398 - RNA, 16 nt, Human
gcccccaggugccagu

SEQ ID NO: 3148399 - RNA, 19 nt, Human
gcccuagagcacacuguag

SEQ ID NO: 3148400 - RNA, 13 nt, Human
gcccuagagcaca

SEQ ID NO: 3148401 - RNA, 17 nt, Human
gcccuagagcacacugu

SEQ ID NO: 3148402 - RNA, 23 nt, Human
gccgcuccugucugccagccagc

SEQ ID NO: 3148403 - RNA, 22 nt, Human
gccgcuccugucugccagccag

SEQ ID NO: 3148404 - RNA, 14 nt, Human
gcccuguuaaaaga

SEQ ID NO: 3148405 - RNA, 17 nt, Human
gcccuguuaaaagauga

SEQ ID NO: 3148406 - RNA, 13 nt, Human
gcccuguuaaaag

SEQ ID NO: 3148407 - RNA, 23 nt, Human
ggcccaggaguuuggccagaagu

SEQ ID NO: 3148408 - RNA, 22 nt, Human
ggcccaggaguuuggccagaag

SEQ ID NO: 3148409 - RNA, 21 nt, Human
ggcccaggaguuuggccagaa

SEQ ID NO: 3148410 - RNA, 16 nt, Human
ggccuccauccugagg

SEQ ID NO: 3148411 - RNA, 14 nt, Human
ggcagaacagccgc

SEQ ID NO: 3148412 - RNA, 18 nt, Human
ggcagaacagccgcuccu

SEQ ID NO: 3148413 - RNA, 20 nt, Human
ggcagaacagccgcuccugu

SEQ ID NO: 3148414 - RNA, 23 nt, Human
ggaugguucccuugaugaagaag

SEQ ID NO: 3148415 - RNA, 22 nt, Human
ggaugguucccuugaugaagaa

SEQ ID NO: 3148416 - RNA, 22 nt, Human
ggauguugaaaaaguucugcag

SEQ ID NO: 3148417 - RNA, 15 nt, Human
ggaugacaugucccu

SEQ ID NO: 3148418 - RNA, 16 nt, Human
ggaugacaugucccua

SEQ ID NO: 3148419 - RNA, 20 nt, Human
ggaugacaugucccuacacc

SEQ ID NO: 3148420 - RNA, 12 nt, Human
ggauuuucagcc

SEQ ID NO: 3148421 - RNA, 23 nt, Human
ggacuuaagcaucuggcucuaau

SEQ ID NO: 3148422 - RNA, 19 nt, Human
ggaggcugagaugggagaa

SEQ ID NO: 3148423 - RNA, 15 nt, Human
ggaggcugagauggg

SEQ ID NO: 3148424 - RNA, 21 nt, Human
gggauuuucagcccucagaau

SEQ ID NO: 3148425 - RNA, 20 nt, Human
gggcagcugccuccccuccu

SEQ ID NO: 3148426 - RNA, 23 nt, Human
gggcagcugccuccccuccucug

SEQ ID NO: 3148427 - RNA, 12 nt, Human
gggcagcugccu

SEQ ID NO: 3148428 - RNA, 13 nt, Human
gggcagcugccuc

SEQ ID NO: 3148429 - RNA, 14 nt, Human
gggcagcugccucc

SEQ ID NO: 3148430 - RNA, 19 nt, Human
gggcagcugccuccccucc

SEQ ID NO: 3148431 - RNA, 23 nt, Human
aaaauaauuuuuauauuugaaau

SEQ ID NO: 3148432 - RNA, 21 nt, Human
aaaauaauuuuuauauuugaa

SEQ ID NO: 3148433 - RNA, 20 nt, Human
aaaauaauuuuuauauuuga

SEQ ID NO: 3148434 - RNA, 14 nt, Human
aaaauaaauauauc

SEQ ID NO: 3148435 - RNA, 17 nt, Human
aaaauaaauauaucuac

SEQ ID NO: 3148436 - RNA, 21 nt, Human
aaaacuuuaugcuaagugaaa

SEQ ID NO: 3148437 - RNA, 22 nt, Human
aaaagcuccauuuuuagugaaa

SEQ ID NO: 3148438 - RNA, 20 nt, Human
gggaggcagagguugcagug

SEQ ID NO: 3148439 - RNA, 11 nt, Human
gggaggcagag

SEQ ID NO: 3148440 - RNA, 22 nt, Human
aaaaaugucuuggguaggcggg

SEQ ID NO: 3148441 - RNA, 19 nt, Human
aaaauuuuuucucuaggaa

SEQ ID NO: 3148442 - RNA, 17 nt, Human
aaacaaggaugaauuaa

SEQ ID NO: 3148443 - RNA, 21 nt, Human
aaacauauauaacaaugcugu

SEQ ID NO: 3148444 - RNA, 19 nt, Human
aaacauauauaacaaugcu

SEQ ID NO: 3148445 - RNA, 16 nt, Human
aaacauauauaacaau

SEQ ID NO: 3148446 - RNA, 13 nt, Human
aaacauauauaac

SEQ ID NO: 3148447 - RNA, 14 nt, Human
aaacacaacuauau

SEQ ID NO: 3148448 - RNA, 22 nt, Human
aaacaguugguaacuuuuguga

SEQ ID NO: 3148449 - RNA, 19 nt, Human
aaacaguugguaacuuuug

SEQ ID NO: 3148450 - RNA, 18 nt, Human
aaacaguugguaacuuuu

SEQ ID NO: 3148451 - RNA, 16 nt, Human
aaacaguugguaacuu

SEQ ID NO: 3148452 - RNA, 12 nt, Human
ggguaggcggga

SEQ ID NO: 3148453 - RNA, 16 nt, Human
ggguaggcgggaagga

SEQ ID NO: 3148454 - RNA, 14 nt, Human
gggucaggagaggg

SEQ ID NO: 3148455 - RNA, 16 nt, Human
aaaccacagcaguuga

SEQ ID NO: 3148456 - RNA, 15 nt, Human
aaaccacagcaguug

SEQ ID NO: 3148457 - RNA, 16 nt, Human
aaacucauuucuagca

SEQ ID NO: 3148458 - RNA, 20 nt, Human
ggugauuuagcaggaagcug

SEQ ID NO: 3148459 - RNA, 15 nt, Human
ggugccaguuauggc

SEQ ID NO: 3148460 - RNA, 14 nt, Human
ggucugugagaugc

SEQ ID NO: 3148461 - RNA, 13 nt, Human
aaaggaauuuaaa

SEQ ID NO: 3148462 - RNA, 13 nt, Human
aaagcuuauuaaa

SEQ ID NO: 3148463 - RNA, 16 nt, Human
aaagaaugauuaugaa

SEQ ID NO: 3148464 - RNA, 19 nt, Human
aaacuuuuuuucuguacca

SEQ ID NO: 3148465 - RNA, 15 nt, Human
aaacuuuuuuucugu

SEQ ID NO: 3148466 - RNA, 20 nt, Human
aaagaggcagcuugaaacug

SEQ ID NO: 3148467 - RNA, 22 nt, Human
aaagagaaacaguugguaacuu

SEQ ID NO: 3148468 - RNA, 19 nt, Human
aaagagaaacaguugguaa

SEQ ID NO: 3148469 - RNA, 18 nt, Human
aaagagaacuuccagauc

SEQ ID NO: 3148470 - RNA, 13 nt, Human
aaagacuccaaag

SEQ ID NO: 3148471 - RNA, 23 nt, Human
aaagacuauucaaacagucucag

SEQ ID NO: 3148472 - RNA, 22 nt, Human
aaagacuauucaaacagucuca

SEQ ID NO: 3148473 - RNA, 23 nt, Human
gaggcuccacuuggucugugaga

SEQ ID NO: 3148474 - RNA, 18 nt, Human
gaggcuccacuuggucug

SEQ ID NO: 3148475 - RNA, 19 nt, Human
gaggcuccacuuggucugu

SEQ ID NO: 3148476 - RNA, 13 nt, Human
gaggcagggucag

SEQ ID NO: 3148477 - RNA, 15 nt, Human
gaggacgcucucugg

SEQ ID NO: 3148478 - RNA, 20 nt, Human
gcacaguuuucugagaaaga

SEQ ID NO: 3148479 - RNA, 22 nt, Human
gcacaguuuucugagaaagacu

SEQ ID NO: 3148480 - RNA, 23 nt, Human
gcacaguuuucugagaaagacua

SEQ ID NO: 3148481 - RNA, 22 nt, Human
gcaauagucaaauugugugaaa

SEQ ID NO: 3148482 - RNA, 20 nt, Human
gcaaguauuagaauaccaca

SEQ ID NO: 3148483 - RNA, 16 nt, Human
gaugaucuuuaaaaua

SEQ ID NO: 3148484 - RNA, 22 nt, Human
gaugguucccuugaugaagaag

SEQ ID NO: 3148485 - RNA, 18 nt, Human
gauguagaggagaaacug

SEQ ID NO: 3148486 - RNA, 17 nt, Human
gauguagaggagaaacu

SEQ ID NO: 3148487 - RNA, 13 nt, Human
gauguaguauuuu

SEQ ID NO: 3148488 - RNA, 15 nt, Human
gauuuaccacuugug

SEQ ID NO: 3148489 - RNA, 16 nt, Human
gauuuaccacuugugu

SEQ ID NO: 3148490 - RNA, 13 nt, Human
gaacugaaaucau

SEQ ID NO: 3148491 - RNA, 14 nt, Human
gaacugaaaucaua

SEQ ID NO: 3148492 - RNA, 19 nt, Human
gaacccgggaggcagaggu

SEQ ID NO: 3148493 - RNA, 23 nt, Human
gaagcaacccaaauguucaucaa

SEQ ID NO: 3148494 - RNA, 14 nt, Human
gaagcaaaauuuuu

SEQ ID NO: 3148495 - RNA, 12 nt, Human
gacuguggcugc

SEQ ID NO: 3148496 - RNA, 14 nt, Human
gacuguggcugcua

SEQ ID NO: 3148497 - RNA, 15 nt, Human
gacuguggcugcuag

SEQ ID NO: 3148498 - RNA, 18 nt, Human
gacucuuaagaagacugc

SEQ ID NO: 3148499 - RNA, 14 nt, Human
gacucuuaagaaga

SEQ ID NO: 3148500 - RNA, 21 nt, Human
gacucuuaagaagacugcauu

SEQ ID NO: 3148501 - RNA, 17 nt, Human
gacgcucucuggccuuc

SEQ ID NO: 3148502 - RNA, 16 nt, Human
gacgcucucuggccuu

SEQ ID NO: 3148503 - RNA, 15 nt, Human
gacgcucucuggccu

SEQ ID NO: 3148504 - RNA, 15 nt, Human
gaccugacuauugaa

SEQ ID NO: 3148505 - RNA, 14 nt, Human
gacagugaaagaaa

SEQ ID NO: 3148506 - RNA, 21 nt, Human
gacagugagacucugucucag

SEQ ID NO: 3148507 - RNA, 16 nt, Human
gacauuugcucaugga

SEQ ID NO: 3148508 - RNA, 16 nt, Human
gacacacugaagaagc

SEQ ID NO: 3148509 - RNA, 15 nt, Human
gacacacugaagaag

SEQ ID NO: 3148510 - RNA, 14 nt, Human
gacacacugaagaa

SEQ ID NO: 3148511 - RNA, 21 nt, Human
gacagaaagcagaacagugau

SEQ ID NO: 3148512 - RNA, 18 nt, Human
cuggacuuaagcaucugg

SEQ ID NO: 3148513 - RNA, 23 nt, Human
cuggacuuaagcaucuggcucua

SEQ ID NO: 3148514 - RNA, 22 nt, Human
cuggacuuaagcaucuggcucu

SEQ ID NO: 3148515 - RNA, 19 nt, Human
cuggcucuaauucacagug

SEQ ID NO: 3148516 - RNA, 15 nt, Human
cuggcucuaauucac

SEQ ID NO: 3148517 - RNA, 22 nt, Human
cuggcucuaauucacagugcuc

SEQ ID NO: 3148518 - RNA, 20 nt, Human
cuggcucuaauucacagugc

SEQ ID NO: 3148519 - RNA, 23 nt, Human
cuggcucuaauucacagugcucu

SEQ ID NO: 3148520 - RNA, 14 nt, Human
cugggcagcugccu

SEQ ID NO: 3148521 - RNA, 15 nt, Human
cugggcagcugccuc

SEQ ID NO: 3148522 - RNA, 13 nt, Human
cugggcagcugcc

SEQ ID NO: 3148523 - RNA, 20 nt, Human
cuggggccucggagccucau

SEQ ID NO: 3148524 - RNA, 23 nt, Human
cuggggccucggagccucauccg

SEQ ID NO: 3148525 - RNA, 21 nt, Human
cuggugccucaccccuugcca

SEQ ID NO: 3148526 - RNA, 12 nt, Human
cuggugccucac

SEQ ID NO: 3148527 - RNA, 17 nt, Human
cugcaagcacagcccuu

SEQ ID NO: 3148528 - RNA, 14 nt, Human
cugcaagcacagcc

SEQ ID NO: 3148529 - RNA, 19 nt, Human
cugcaagguacucugguga

SEQ ID NO: 3148530 - RNA, 18 nt, Human
cugcaagguacucuggug

SEQ ID NO: 3148531 - RNA, 17 nt, Human
cugcaagguacucuggu

SEQ ID NO: 3148532 - RNA, 16 nt, Human
cugcaagguacucugg

SEQ ID NO: 3148533 - RNA, 16 nt, Human
cugcacuccagccuga

SEQ ID NO: 3148534 - RNA, 20 nt, Human
cugcacuccagccugagcga

SEQ ID NO: 3148535 - RNA, 17 nt, Human
cugcacuccagccugag

SEQ ID NO: 3148536 - RNA, 20 nt, Human
cugugcugcccgucuucagc

SEQ ID NO: 3148537 - RNA, 21 nt, Human
cuguguacagaauucugcuac

SEQ ID NO: 3148538 - RNA, 18 nt, Human
cuguguaauuagugccac

SEQ ID NO: 3148539 - RNA, 23 nt, Human
cuucaugcugucuacacuaagag

SEQ ID NO: 3148540 - RNA, 11 nt, Human
cuucagacaua

SEQ ID NO: 3148541 - RNA, 21 nt, Human
cuuugagugucuuaauuaaaa

SEQ ID NO: 3148542 - RNA, 20 nt, Human
cuuuaaagggauggcaagau

SEQ ID NO: 3148543 - RNA, 13 nt, Human
cuuggcccaggag

SEQ ID NO: 3148544 - RNA, 20 nt, Human
cuucuguuuuauaauuuugu

SEQ ID NO: 3148545 - RNA, 15 nt, Human
cuucuguuuuauaau

SEQ ID NO: 3148546 - RNA, 21 nt, Human
aacagccgcuccugucugcca

SEQ ID NO: 3148547 - RNA, 20 nt, Human
aacagccgcuccugucugcc

SEQ ID NO: 3148548 - RNA, 19 nt, Human
aacagcccuccucugcacu

SEQ ID NO: 3148549 - RNA, 17 nt, Human
aacagcccuccucugca

SEQ ID NO: 3148550 - RNA, 18 nt, Human
aaaucucaauauuucaga

SEQ ID NO: 3148551 - RNA, 21 nt, Human
aaauauuuauuuuaauaaugu

SEQ ID NO: 3148552 - RNA, 22 nt, Human
aaauguugacaugggacauuug

SEQ ID NO: 3148553 - RNA, 13 nt, Human
aaauguucaucaa

SEQ ID NO: 3148554 - RNA, 23 nt, Human
aaauguugacaugggacauuugc

SEQ ID NO: 3148555 - RNA, 17 nt, Human
aaaagaaagaaaaucag

SEQ ID NO: 3148556 - RNA, 12 nt, Human
aaaagaauauuu

SEQ ID NO: 3148557 - RNA, 11 nt, Human
aaaagaaugau

SEQ ID NO: 3148558 - RNA, 13 nt, Human
aaaagacuccaaa

SEQ ID NO: 3148559 - RNA, 13 nt, Human
aaaagaauauuuu

SEQ ID NO: 3148560 - RNA, 20 nt, Human
aaaagacaaggaaaaaauaa

SEQ ID NO: 3148561 - RNA, 11 nt, Human
aaaaucauuuc

SEQ ID NO: 3148562 - RNA, 12 nt, Human
aaaaucauuucu

SEQ ID NO: 3148563 - RNA, 10 nt, Human
aaaaucauuu

SEQ ID NO: 3148564 - RNA, 19 nt, Human
aaacccuugccaugugcua

SEQ ID NO: 3148565 - RNA, 15 nt, Human
aaacugcacugucaa

SEQ ID NO: 3148566 - RNA, 23 nt, Human
aaacuuuuuuucuguaccaguua

SEQ ID NO: 3148567 - RNA, 22 nt, Human
aaacuuuuuuucuguaccaguu

SEQ ID NO: 3148568 - RNA, 21 nt, Human
aaaaucauuucugcaucagcu

SEQ ID NO: 3148569 - RNA, 15 nt, Human
aaagcauuguaaaug

SEQ ID NO: 3148570 - RNA, 17 nt, Human
aaagcauuguaaaugug

SEQ ID NO: 3148571 - RNA, 16 nt, Human
aauauguuagcaaaga

SEQ ID NO: 3148572 - RNA, 16 nt, Human
aaucucaauauuucag

SEQ ID NO: 3148573 - RNA, 15 nt, Human
aaggcaguuuucuaa

SEQ ID NO: 3148574 - RNA, 21 nt, Human
aagccuuggggcugaugcagu

SEQ ID NO: 3148575 - RNA, 22 nt, Human
aagacagagccccacccucaga

SEQ ID NO: 3148576 - RNA, 20 nt, Human
aagagaaacaguugguaacu

SEQ ID NO: 3148577 - RNA, 15 nt, Human
aagaagacugcauua

SEQ ID NO: 3148578 - RNA, 20 nt, Human
aagaagacugcauuauauuu

SEQ ID NO: 3148579 - RNA, 21 nt, Human
aagacaaggaaaaaauaacaa

SEQ ID NO: 3148580 - RNA, 20 nt, Human
aacgcaggcccccaggugcc

SEQ ID NO: 3148581 - RNA, 13 nt, Human
aagaacugaaauc

SEQ ID NO: 3148582 - RNA, 12 nt, Human
aagaacugaaau

SEQ ID NO: 3148583 - RNA, 11 nt, Human
aagaacugaaa

SEQ ID NO: 3148584 - RNA, 15 nt, Human
aagaacugaaaucau

SEQ ID NO: 3148585 - RNA, 16 nt, Human
acccucaugcugccaa

SEQ ID NO: 3148586 - RNA, 14 nt, Human
acccucaugcugcc

SEQ ID NO: 3148587 - RNA, 22 nt, Human
acccucaugcugccaauauccu

SEQ ID NO: 3148588 - RNA, 20 nt, Human
acccucagaugcacaugagc

SEQ ID NO: 3148589 - RNA, 21 nt, Human
acccugucucuacuaaaaaua

SEQ ID NO: 3148590 - RNA, 11 nt, Human
accucagccug

SEQ ID NO: 3148591 - RNA, 12 nt, Human
accucagccugu

SEQ ID NO: 3148592 - RNA, 16 nt, Human
accucagccugugcug

SEQ ID NO: 3148593 - RNA, 17 nt, Human
accucagccugugcugc

SEQ ID NO: 3148594 - RNA, 18 nt, Human
accucagccugugcugcc

SEQ ID NO: 3148595 - RNA, 19 nt, Human
accucagccugugcugccc

SEQ ID NO: 3148596 - RNA, 20 nt, Human
accucagccuuccccuugcc

SEQ ID NO: 3148597 - RNA, 20 nt, Human
accucugccucagaaaacaa

SEQ ID NO: 3148598 - RNA, 23 nt, Human
accuugcugcaagcacagcccuu

SEQ ID NO: 3148599 - RNA, 22 nt, Human
accuugcugcaagcacagcccu

SEQ ID NO: 3148600 - RNA, 14 nt, Human
acgcacacugucug

SEQ ID NO: 3148601 - RNA, 17 nt, Human
acuguaaaauaauaacu

SEQ ID NO: 3148602 - RNA, 20 nt, Human
acuucuugcuucuuucuaga

SEQ ID NO: 3148603 - RNA, 11 nt, Human
acuucuugcuu

SEQ ID NO: 3148604 - RNA, 19 nt, Human
acuucuugcuucuuucuag

SEQ ID NO: 3148605 - RNA, 18 nt, Human
acuucuugcuucuuucua

SEQ ID NO: 3148606 - RNA, 21 nt, Human
acuucagacauagaauuaaca

SEQ ID NO: 3148607 - RNA, 21 nt, Human
acuuaaaaaugguuuaaaugg

SEQ ID NO: 3148608 - RNA, 22 nt, Human
acuuaaaaaugguuuaaauggu

SEQ ID NO: 3148609 - RNA, 18 nt, Human
acuucaaauccuugaaga

SEQ ID NO: 3148610 - RNA, 12 nt, Human
acuucagacaua

SEQ ID NO: 3148611 - RNA, 17 nt, Human
acuucaaauccuugaag

SEQ ID NO: 3148612 - RNA, 19 nt, Human
acugauaugggucuugaua

SEQ ID NO: 3148613 - RNA, 13 nt, Human
acugacacaugcu

SEQ ID NO: 3148614 - RNA, 16 nt, Human
acucccaccugacaca

SEQ ID NO: 3148615 - RNA, 14 nt, Human
acucccaccugaca

SEQ ID NO: 3148616 - RNA, 14 nt, Human
acucccuuucaaca

SEQ ID NO: 3148617 - RNA, 19 nt, Human
acuccguaacagauuuugu

SEQ ID NO: 3148618 - RNA, 19 nt, Human
acucguuaauuuguagugu

SEQ ID NO: 3148619 - RNA, 14 nt, Human
acucguuaauuugu

SEQ ID NO: 3148620 - RNA, 15 nt, Human
acaccaauauucaua

SEQ ID NO: 3148621 - RNA, 19 nt, Human
aauucugcuaccucacugg

SEQ ID NO: 3148622 - RNA, 15 nt, Human
aauucugcuaccuca

SEQ ID NO: 3148623 - RNA, 16 nt, Human
aauucugcuaccucac

SEQ ID NO: 3148624 - RNA, 15 nt, Human
aauuggagcucgugg

SEQ ID NO: 3148625 - RNA, 15 nt, Human
aauuggauuuccuaa

SEQ ID NO: 3148626 - RNA, 11 nt, Human
aauuggauuuc

SEQ ID NO: 3148627 - RNA, 17 nt, Human
aauuggauuuccuaaua

SEQ ID NO: 3148628 - RNA, 13 nt, Human
aauuccuuagcuu

SEQ ID NO: 3148629 - RNA, 23 nt, Human
aauuccuuagcuuagaccucagc

SEQ ID NO: 3148630 - RNA, 11 nt, Human
aauuguaauag

SEQ ID NO: 3148631 - RNA, 22 nt, Human
aauuucauaccuaucaucuuaa

SEQ ID NO: 3148632 - RNA, 15 nt, Human
acauguggugggaca

SEQ ID NO: 3148633 - RNA, 23 nt, Human
acauguggugggacagggaccca

SEQ ID NO: 3148634 - RNA, 19 nt, Human
acauuuguauaaaauaauu

SEQ ID NO: 3148635 - RNA, 16 nt, Human
acauuuguauaaaaua

SEQ ID NO: 3148636 - RNA, 14 nt, Human
acauuuguauaaaa

SEQ ID NO: 3148637 - RNA, 15 nt, Human
acauuugcucaugga

SEQ ID NO: 3148638 - RNA, 22 nt, Human
acaggaugguucccuugaugaa

SEQ ID NO: 3148639 - RNA, 24 nt, Human
acaggaugguucccuugaugaaga

SEQ ID NO: 3148640 - RNA, 19 nt, Human
acagugauuaccagggacu

SEQ ID NO: 3148641 - RNA, 21 nt, Human
acagugcucuuuucuccucac

SEQ ID NO: 3148642 - RNA, 17 nt, Human
acagugcucuuuucucc

SEQ ID NO: 3148643 - RNA, 16 nt, Human
acagugcucuuuucuc

SEQ ID NO: 3148644 - RNA, 15 nt, Human
acagugcucuuuucu

SEQ ID NO: 3148645 - RNA, 16 nt, Human
agagaaacaguuggua

SEQ ID NO: 3148646 - RNA, 13 nt, Human
agagaaacaguug

SEQ ID NO: 3148647 - RNA, 14 nt, Human
agacuagauguagu

SEQ ID NO: 3148648 - RNA, 13 nt, Human
agacuagauguag

SEQ ID NO: 3148649 - RNA, 12 nt, Human
agacuagaugua

SEQ ID NO: 3148650 - RNA, 23 nt, Human
agacuagauguaguauuuuuugu

SEQ ID NO: 3148651 - RNA, 19 nt, Human
agacuagauguaguauuuu

SEQ ID NO: 3148652 - RNA, 16 nt, Human
agacuagauguaguau

SEQ ID NO: 3148653 - RNA, 19 nt, Human
agacaaggaaaaaauaaca

SEQ ID NO: 3148654 - RNA, 21 nt, Human
agaagacugcauuauauuuau

SEQ ID NO: 3148655 - RNA, 18 nt, Human
agaagacugcauuauauu

SEQ ID NO: 3148656 - RNA, 13 nt, Human
agaagagcuguuc

SEQ ID NO: 3148657 - RNA, 20 nt, Human
agaagagcuguucacagcca

SEQ ID NO: 3148658 - RNA, 13 nt, Human
agaagauagcagg

SEQ ID NO: 3148659 - RNA, 19 nt, Human
agaagucaaggcuuagacc

SEQ ID NO: 3148660 - RNA, 18 nt, Human
agaagucaaggcuuagac

SEQ ID NO: 3148661 - RNA, 17 nt, Human
agaagucaaggcuuaga

SEQ ID NO: 3148662 - RNA, 16 nt, Human
agaagucaaggcuuag

SEQ ID NO: 3148663 - RNA, 22 nt, Human
agaacagugauuaccagggacu

SEQ ID NO: 3148664 - RNA, 18 nt, Human
agaacagccgcuccuguc

SEQ ID NO: 3148665 - RNA, 19 nt, Human
agaacagccgcuccugucu

SEQ ID NO: 3148666 - RNA, 20 nt, Human
agaacagccgcuccugucug

SEQ ID NO: 3148667 - RNA, 22 nt, Human
agaacagccgcuccugucugcc

SEQ ID NO: 3148668 - RNA, 23 nt, Human
agaacagccgcuccugucugcca

SEQ ID NO: 3148669 - RNA, 13 nt, Human
agcaucuggcucu

SEQ ID NO: 3148670 - RNA, 18 nt, Human
agcaucuggcucuaauuc

SEQ ID NO: 3148671 - RNA, 16 nt, Human
agcaucuggcucuaau

SEQ ID NO: 3148672 - RNA, 17 nt, Human
agccaacuaugauuauu

SEQ ID NO: 3148673 - RNA, 20 nt, Human
agccaacuaugauuauuaac

SEQ ID NO: 3148674 - RNA, 22 nt, Human
agccaaggguucagagacucag

SEQ ID NO: 3148675 - RNA, 18 nt, Human
agccaaggguucagagac

SEQ ID NO: 3148676 - RNA, 14 nt, Human
agccagcaguucag

SEQ ID NO: 3148677 - RNA, 12 nt, Human
agcaguggacac

SEQ ID NO: 3148678 - RNA, 15 nt, Human
agcaguggacaccag

SEQ ID NO: 3148679 - RNA, 19 nt, Human
agcaguggacaccaggagu

SEQ ID NO: 3148680 - RNA, 19 nt, Human
agcacugacuucuaaguaa

SEQ ID NO: 3148681 - RNA, 17 nt, Human
agcacugacuucuaagu

SEQ ID NO: 3148682 - RNA, 12 nt, Human
agcagcucaggc

SEQ ID NO: 3148683 - RNA, 13 nt, Human
agcagcucaggca

SEQ ID NO: 3148684 - RNA, 14 nt, Human
agcagcucaggcac

SEQ ID NO: 3148685 - RNA, 20 nt, Human
agauagauaggucagugcaa

SEQ ID NO: 3148686 - RNA, 17 nt, Human
aggcuagauguauguac

SEQ ID NO: 3148687 - RNA, 17 nt, Human
agggacaggauaagagg

SEQ ID NO: 3148688 - RNA, 12 nt, Human
aggcuuagaccc

SEQ ID NO: 3148689 - RNA, 21 nt, Human
aggcuuagacccucaugcugc

SEQ ID NO: 3148690 - RNA, 14 nt, Human
aggcuuagacccuc

SEQ ID NO: 3148691 - RNA, 22 nt, Human
aggcuuagacccucaugcugcc

SEQ ID NO: 3148692 - RNA, 20 nt, Human
agggauuagggagagaagau

SEQ ID NO: 3148693 - RNA, 23 nt, Human
aggccaugggcacuguggguaga

SEQ ID NO: 3148694 - RNA, 20 nt, Human
aggcagagguugcagugagc

SEQ ID NO: 3148695 - RNA, 18 nt, Human
aggaggguuagggagggg

SEQ ID NO: 3148696 - RNA, 14 nt, Human
agcuguaugauucc

SEQ ID NO: 3148697 - RNA, 14 nt, Human
agcugcugaaacaa

SEQ ID NO: 3148698 - RNA, 15 nt, Human
agcugcugaaacaac

SEQ ID NO: 3148699 - RNA, 16 nt, Human
agcugcugaaacaaca

SEQ ID NO: 3148700 - RNA, 23 nt, Human
agcugacuaaacuuuuuuucugu

SEQ ID NO: 3148701 - RNA, 18 nt, Human
aggaaaaaauaacaauga

SEQ ID NO: 3148702 - RNA, 18 nt, Human
agcuguaugauucccagc

SEQ ID NO: 3148703 - RNA, 17 nt, Human
agcuguaugauucccag

SEQ ID NO: 3148704 - RNA, 15 nt, Human
agcgacagugagacu

SEQ ID NO: 3148705 - RNA, 13 nt, Human
agcgacagugaga

SEQ ID NO: 3148706 - RNA, 12 nt, Human
agcuacaaaugc

SEQ ID NO: 3148707 - RNA, 13 nt, Human
agcuacaaaugca

SEQ ID NO: 3148708 - RNA, 13 nt, Human
agucauuuaauaa

SEQ ID NO: 3148709 - RNA, 19 nt, Human
agugaugucacuagggcag

SEQ ID NO: 3148710 - RNA, 13 nt, Human
agugauuaccagg

SEQ ID NO: 3148711 - RNA, 13 nt, Human
aguacucauacau

SEQ ID NO: 3148712 - RNA, 20 nt, Human
auacacacucaaaucaagaa

SEQ ID NO: 3148713 - RNA, 16 nt, Human
auaaguacuguguaca

SEQ ID NO: 3148714 - RNA, 13 nt, Human
auaaguacugugu

SEQ ID NO: 3148715 - RNA, 15 nt, Human
auaaaagacagugaa

SEQ ID NO: 3148716 - RNA, 16 nt, Human
auaaaagacagugaaa

SEQ ID NO: 3148717 - RNA, 15 nt, Human
aguuaauuuuuccaa

SEQ ID NO: 3148718 - RNA, 23 nt, Human
aguuaauuuuuccaacuacuaau

SEQ ID NO: 3148719 - RNA, 17 nt, Human
aguuaauuuuuccaacu

SEQ ID NO: 3148720 - RNA, 23 nt, Human
auggcuuccuggcaauagucaaa

SEQ ID NO: 3148721 - RNA, 14 nt, Human
augggaaagcauug

SEQ ID NO: 3148722 - RNA, 20 nt, Human
augggaaagcauuguaaaug

SEQ ID NO: 3148723 - RNA, 20 nt, Human
augggacauuugcucaugga

SEQ ID NO: 3148724 - RNA, 15 nt, Human
augggacagggagga

SEQ ID NO: 3148725 - RNA, 21 nt, Human
augcuucuguuuuauaauuuu

SEQ ID NO: 3148726 - RNA, 21 nt, Human
aucaugaauuaguuuuauaug

SEQ ID NO: 3148727 - RNA, 12 nt, Human
auccuugaagau

SEQ ID NO: 3148728 - RNA, 17 nt, Human
aucaaacugaagccaga

SEQ ID NO: 3148729 - RNA, 15 nt, Human
aucaaacugaagcca

SEQ ID NO: 3148730 - RNA, 16 nt, Human
aucaaacugaagccag

SEQ ID NO: 3148731 - RNA, 14 nt, Human
aucaaacugaagcc

SEQ ID NO: 3148732 - RNA, 14 nt, Human
aucaaaagaaagaa

SEQ ID NO: 3148733 - RNA, 16 nt, Human
caaagaguuaauauau

SEQ ID NO: 3148734 - RNA, 14 nt, Human
caaagaaauguaag

SEQ ID NO: 3148735 - RNA, 16 nt, Human
caaagaaaguguauug

SEQ ID NO: 3148736 - RNA, 14 nt, Human
caaagaaaguguau

SEQ ID NO: 3148737 - RNA, 16 nt, Human
auuuuaauaauguuuc

SEQ ID NO: 3148738 - RNA, 19 nt, Human
auuuuaauaauguuucaaa

SEQ ID NO: 3148739 - RNA, 18 nt, Human
auuuuaauaauguuucaa

SEQ ID NO: 3148740 - RNA, 13 nt, Human
caagaaaugaaag

SEQ ID NO: 3148741 - RNA, 19 nt, Human
caagacugcacaucaaaau

SEQ ID NO: 3148742 - RNA, 16 nt, Human
caagcauaccaacacg

SEQ ID NO: 3148743 - RNA, 21 nt, Human
caagcauaccaacacgagcag

SEQ ID NO: 3148744 - RNA, 19 nt, Human
caagcauuuagauguauag

SEQ ID NO: 3148745 - RNA, 16 nt, Human
caagcauuuagaugua

SEQ ID NO: 3148746 - RNA, 19 nt, Human
caaggguucagagacucag

SEQ ID NO: 3148747 - RNA, 20 nt, Human
caaggguucagagacucagg

SEQ ID NO: 3148748 - RNA, 16 nt, Human
caagguacucugguga

SEQ ID NO: 3148749 - RNA, 14 nt, Human
caagguacucuggu

SEQ ID NO: 3148750 - RNA, 23 nt, Human
caaauuuacagagacagaaagca

SEQ ID NO: 3148751 - RNA, 17 nt, Human
caaauuuacagagacag

SEQ ID NO: 3148752 - RNA, 16 nt, Human
caaauuuacagagaca

SEQ ID NO: 3148753 - RNA, 23 nt, Human
caacugggguggguggggcagug

SEQ ID NO: 3148754 - RNA, 23 nt, Human
cacaagaaaugaaagcagggacu

SEQ ID NO: 3148755 - RNA, 13 nt, Human
cacaagaaaugaa

SEQ ID NO: 3148756 - RNA, 21 nt, Human
cacaagaaaugaaagcaggga

SEQ ID NO: 3148757 - RNA, 15 nt, Human
cacaagaaaugaaag

SEQ ID NO: 3148758 - RNA, 18 nt, Human
cacaccaggcgcuaauuc

SEQ ID NO: 3148759 - RNA, 20 nt, Human
caauauccuaauaaaaaggu

SEQ ID NO: 3148760 - RNA, 19 nt, Human
caauauccuaauaaaaagg

SEQ ID NO: 3148761 - RNA, 18 nt, Human
caauauccuaauaaaaag

SEQ ID NO: 3148762 - RNA, 16 nt, Human
caauauccuaauaaaa

SEQ ID NO: 3148763 - RNA, 15 nt, Human
caauauccuaauaaa

SEQ ID NO: 3148764 - RNA, 14 nt, Human
caauauccuaauaa

SEQ ID NO: 3148765 - RNA, 13 nt, Human
caauauccuaaua

SEQ ID NO: 3148766 - RNA, 12 nt, Human
caauauccuaau

SEQ ID NO: 3148767 - RNA, 20 nt, Human
caccaguucucauggguggc

SEQ ID NO: 3148768 - RNA, 11 nt, Human
caccaguucuc

SEQ ID NO: 3148769 - RNA, 22 nt, Human
caccaggguccuuuugacacug

SEQ ID NO: 3148770 - RNA, 13 nt, Human
cacaggcaacuga

SEQ ID NO: 3148771 - RNA, 14 nt, Human
cacaggcaacugag

SEQ ID NO: 3148772 - RNA, 17 nt, Human
cacaggcaacugaggca

SEQ ID NO: 3148773 - RNA, 18 nt, Human
cacaggcaacugaggcag

SEQ ID NO: 3148774 - RNA, 19 nt, Human
cacaggcaacugaggcaga

SEQ ID NO: 3148775 - RNA, 20 nt, Human
cacaguuuucugagaaagac

SEQ ID NO: 3148776 - RNA, 16 nt, Human
cacaugaaguccaagc

SEQ ID NO: 3148777 - RNA, 20 nt, Human
cacaugaaguccaagcauuu

SEQ ID NO: 3148778 - RNA, 17 nt, Human
cacaugaaguccaagca

SEQ ID NO: 3148779 - RNA, 21 nt, Human
cacaguuuucugagaaagacu

SEQ ID NO: 3148780 - RNA, 22 nt, Human
cacaguuuucugagaaagacua

SEQ ID NO: 3148781 - RNA, 17 nt, Human
ucacuuuuucugauaaa

SEQ ID NO: 3148782 - RNA, 16 nt, Human
ucacuuuuucugauaa

SEQ ID NO: 3148783 - RNA, 14 nt, Human
ucacuuuuucugau

SEQ ID NO: 3148784 - RNA, 13 nt, Human
ucacuuuuucuga

SEQ ID NO: 3148785 - RNA, 17 nt, Human
ucacuugucaauaaaau

SEQ ID NO: 3148786 - RNA, 19 nt, Human
ucagacauagaauuaacac

SEQ ID NO: 3148787 - RNA, 22 nt, Human
ucagacauagaauuaacacaug

SEQ ID NO: 3148788 - RNA, 23 nt, Human
ucagagcugcccucuccugggca

SEQ ID NO: 3148789 - RNA, 21 nt, Human
uauuucuaugaaauauuaugu

SEQ ID NO: 3148790 - RNA, 22 nt, Human
uauuucuaugaaauauuauguu

SEQ ID NO: 3148791 - RNA, 19 nt, Human
uauuuggaaauaaagucag

SEQ ID NO: 3148792 - RNA, 17 nt, Human
uauuuggaaauaaaguc

SEQ ID NO: 3148793 - RNA, 16 nt, Human
uauuuggaaauaaagu

SEQ ID NO: 3148794 - RNA, 14 nt, Human
ucaaagaaagugua

SEQ ID NO: 3148795 - RNA, 12 nt, Human
ucaaagaaagug

SEQ ID NO: 3148796 - RNA, 16 nt, Human
ucaaagaaaguguauu

SEQ ID NO: 3148797 - RNA, 15 nt, Human
ucaaagaaaguguau

SEQ ID NO: 3148798 - RNA, 16 nt, Human
ucaaacugaagccaga

SEQ ID NO: 3148799 - RNA, 23 nt, Human
ucacaggacagcccuucuuucca

SEQ ID NO: 3148800 - RNA, 19 nt, Human
ucacaggaaguagaggagg

SEQ ID NO: 3148801 - RNA, 14 nt, Human
ucacaggaaguaga

SEQ ID NO: 3148802 - RNA, 17 nt, Human
ucccucccuccaccucc

SEQ ID NO: 3148803 - RNA, 16 nt, Human
ucccaaauuucauacc

SEQ ID NO: 3148804 - RNA, 20 nt, Human
uccaugggccauaugaaaag

SEQ ID NO: 3148805 - RNA, 17 nt, Human
uccagauccuggaaauc

SEQ ID NO: 3148806 - RNA, 16 nt, Human
uccagauccuggaaau

SEQ ID NO: 3148807 - RNA, 14 nt, Human
uccagauccuggaa

SEQ ID NO: 3148808 - RNA, 13 nt, Human
uccacuuggucug

SEQ ID NO: 3148809 - RNA, 12 nt, Human
uccacuuggucu

SEQ ID NO: 3148810 - RNA, 23 nt, Human
uccaccucccugcaauaaaaugg

SEQ ID NO: 3148811 - RNA, 14 nt, Human
uccaccuacaugag

SEQ ID NO: 3148812 - RNA, 23 nt, Human
uccaagcauaccaacacgagcag

SEQ ID NO: 3148813 - RNA, 17 nt, Human
uccaagcauuuagaugu

SEQ ID NO: 3148814 - RNA, 23 nt, Human
uccaaacugacucuuaagaagac

SEQ ID NO: 3148815 - RNA, 12 nt, Human
uccaaagaaaug

SEQ ID NO: 3148816 - RNA, 16 nt, Human
ucauuucugcaucagc

SEQ ID NO: 3148817 - RNA, 22 nt, Human
ucauuucugcaucagcugcuga

SEQ ID NO: 3148818 - RNA, 14 nt, Human
ucauuucuuugagu

SEQ ID NO: 3148819 - RNA, 16 nt, Human
ucauuauuugcagaga

SEQ ID NO: 3148820 - RNA, 23 nt, Human
uccugguccccucagcucugccu

SEQ ID NO: 3148821 - RNA, 21 nt, Human
ucuacacuaagagagaaugag

SEQ ID NO: 3148822 - RNA, 17 nt, Human
ucuacacuccagugaga

SEQ ID NO: 3148823 - RNA, 17 nt, Human
ucuacacuaagagagaa

SEQ ID NO: 3148824 - RNA, 18 nt, Human
ucucuucacagucacauu

SEQ ID NO: 3148825 - RNA, 16 nt, Human
ucucuucucuccagcu

SEQ ID NO: 3148826 - RNA, 15 nt, Human
ucucuucucuccagc

SEQ ID NO: 3148827 - RNA, 14 nt, Human
ucucuucucuccag

SEQ ID NO: 3148828 - RNA, 12 nt, Human
ucucuucucucc

SEQ ID NO: 3148829 - RNA, 23 nt, Human
ucucuucucuccagcugacuaaa

SEQ ID NO: 3148830 - RNA, 14 nt, Human
ucuccugggcagcu

SEQ ID NO: 3148831 - RNA, 13 nt, Human
ucuccugggcagc

SEQ ID NO: 3148832 - RNA, 15 nt, Human
ucuccugggcagcug

SEQ ID NO: 3148833 - RNA, 16 nt, Human
ucuccugggcagcugc

SEQ ID NO: 3148834 - RNA, 17 nt, Human
ucuccugggcagcugcc

SEQ ID NO: 3148835 - RNA, 18 nt, Human
ucuccugggcagcugccu

SEQ ID NO: 3148836 - RNA, 21 nt, Human
ucucagugucaaugcagcccc

SEQ ID NO: 3148837 - RNA, 20 nt, Human
ucucaguaccccauggagcu

SEQ ID NO: 3148838 - RNA, 12 nt, Human
ucucucuucucu

SEQ ID NO: 3148839 - RNA, 13 nt, Human
ucucuaggaaaua

SEQ ID NO: 3148840 - RNA, 21 nt, Human
ucuccugggcagcugccuccc

SEQ ID NO: 3148841 - RNA, 19 nt, Human
ucuccugggcagcugccuc

SEQ ID NO: 3148842 - RNA, 20 nt, Human
ucuccugggcagcugccucc

SEQ ID NO: 3148843 - RNA, 15 nt, Human
ugaaaagacuccaaa

SEQ ID NO: 3148844 - RNA, 16 nt, Human
ugaaaagacuccaaag

SEQ ID NO: 3148845 - RNA, 17 nt, Human
ugaaaagacuccaaaga

SEQ ID NO: 3148846 - RNA, 19 nt, Human
ugaaaagacuccaaagaaa

SEQ ID NO: 3148847 - RNA, 19 nt, Human
ugaaaacuuuaugcuaagu

SEQ ID NO: 3148848 - RNA, 19 nt, Human
ugaaagcagggacuugaac

SEQ ID NO: 3148849 - RNA, 18 nt, Human
ugaaagcagggacuugaa

SEQ ID NO: 3148850 - RNA, 18 nt, Human
ugaaacccugucucuacu

SEQ ID NO: 3148851 - RNA, 22 nt, Human
ugaaaagacuccaaagaaaugu

SEQ ID NO: 3148852 - RNA, 22 nt, Human
ugaacacugggggaggggacau

SEQ ID NO: 3148853 - RNA, 14 nt, Human
ugaacacuggggga

SEQ ID NO: 3148854 - RNA, 16 nt, Human
ugaacacugggggagg

SEQ ID NO: 3148855 - RNA, 17 nt, Human
ugaacacugggggaggg

SEQ ID NO: 3148856 - RNA, 14 nt, Human
ugaacacaucagcu

SEQ ID NO: 3148857 - RNA, 22 nt, Human
ugaaguccaagcauuuagaugu

SEQ ID NO: 3148858 - RNA, 21 nt, Human
ugaaguccaagcauuuagaug

SEQ ID NO: 3148859 - RNA, 12 nt, Human
ucuguaccaguu

SEQ ID NO: 3148860 - RNA, 22 nt, Human
ucuguaccaguuaauuuuucca

SEQ ID NO: 3148861 - RNA, 13 nt, Human
ucuguaccaguua

SEQ ID NO: 3148862 - RNA, 22 nt, Human
ucuguuuuauaauuuugugaag

SEQ ID NO: 3148863 - RNA, 20 nt, Human
ucuguuuuauaauuuuguga

SEQ ID NO: 3148864 - RNA, 22 nt, Human
ucuggcucuaauucacagugcu

SEQ ID NO: 3148865 - RNA, 20 nt, Human
ucuggcucuaauucacagug

SEQ ID NO: 3148866 - RNA, 23 nt, Human
ucuggccuucggccuccauccug

SEQ ID NO: 3148867 - RNA, 19 nt, Human
ucuguaauaaacucauuuc

SEQ ID NO: 3148868 - RNA, 23 nt, Human
ucuguaauaaacucauuucuagc

SEQ ID NO: 3148869 - RNA, 24 nt, Human
ucuguaauaaacucauuucuagca

SEQ ID NO: 3148870 - RNA, 14 nt, Human
ucuuaguguaugau

SEQ ID NO: 3148871 - RNA, 16 nt, Human
uaggcgggaaggaggg

SEQ ID NO: 3148872 - RNA, 14 nt, Human
uagucaaauugugu

SEQ ID NO: 3148873 - RNA, 18 nt, Human
uagucaaauugugugaaa

SEQ ID NO: 3148874 - RNA, 21 nt, Human
uaguuguaccgcaaugugacu

SEQ ID NO: 3148875 - RNA, 19 nt, Human
uaguguaugauuacuggcc

SEQ ID NO: 3148876 - RNA, 15 nt, Human
uaguguaugauuacu

SEQ ID NO: 3148877 - RNA, 13 nt, Human
uauauuugaaaua

SEQ ID NO: 3148878 - RNA, 14 nt, Human
uauauuugaaauau

SEQ ID NO: 3148879 - RNA, 23 nt, Human
uauauuuauuacuguaagaaaau

SEQ ID NO: 3148880 - RNA, 20 nt, Human
uauauuuauuacuguaagaa

SEQ ID NO: 3148881 - RNA, 20 nt, Human
uaggaauugacccacaagaa

SEQ ID NO: 3148882 - RNA, 23 nt, Human
uaggaauugacccacaagaaaug

SEQ ID NO: 3148883 - RNA, 13 nt, Human
uaggccaugggac

SEQ ID NO: 3148884 - RNA, 22 nt, Human
uagcucuggggugggcaguuuu

SEQ ID NO: 3148885 - RNA, 11 nt, Human
uagcucugggg

SEQ ID NO: 3148886 - RNA, 23 nt, Human
uagcucuggggugggcaguuuuu

SEQ ID NO: 3148887 - RNA, 14 nt, Human
uagccgaccucagc

SEQ ID NO: 3148888 - RNA, 13 nt, Human
uagccgaccucag

SEQ ID NO: 3148889 - RNA, 20 nt, Human
uagauguauguacuucaugc

SEQ ID NO: 3148890 - RNA, 16 nt, Human
uagauguauguacuuc

SEQ ID NO: 3148891 - RNA, 17 nt, Human
uagauguaguauuuuuu

SEQ ID NO: 3148892 - RNA, 15 nt, Human
uagauguaguauuuu

SEQ ID NO: 3148893 - RNA, 20 nt, Human
uagcagggcauggcugggaa

SEQ ID NO: 3148894 - RNA, 23 nt, Human
uagacccucaugcugccaauauc

SEQ ID NO: 3148895 - RNA, 11 nt, Human
uagaccucagc

SEQ ID NO: 3148896 - RNA, 12 nt, Human
uagaccucagcc

SEQ ID NO: 3148897 - RNA, 13 nt, Human
uagaccucagccu

SEQ ID NO: 3148898 - RNA, 21 nt, Human
uagaccucagccugugcugcc

SEQ ID NO: 3148899 - RNA, 22 nt, Human
uagaccucagccugugcugccc

SEQ ID NO: 3148900 - RNA, 14 nt, Human
uagaccucagccug

SEQ ID NO: 3148901 - RNA, 15 nt, Human
uagaccucagccugu

SEQ ID NO: 3148902 - RNA, 16 nt, Human
uagaccucagccugug

SEQ ID NO: 3148903 - RNA, 20 nt, Human
uagaccucagccugugcugc

SEQ ID NO: 3148904 - RNA, 18 nt, Human
uagaguuuagcuggaaaa

SEQ ID NO: 3148905 - RNA, 17 nt, Human
uagaguuuagcuggaaa

SEQ ID NO: 3148906 - RNA, 22 nt, Human
uaauuuugaagugcuguuuauu

SEQ ID NO: 3148907 - RNA, 18 nt, Human
uaauuuugaagugcuguu

SEQ ID NO: 3148908 - RNA, 21 nt, Human
uacagaauucugcuaccucac

SEQ ID NO: 3148909 - RNA, 18 nt, Human
uacagaauucugcuaccu

SEQ ID NO: 3148910 - RNA, 14 nt, Human
uacaggauuugaaa

SEQ ID NO: 3148911 - RNA, 16 nt, Human
uacauuuguauaaaau

SEQ ID NO: 3148912 - RNA, 11 nt, Human
uacauuugugu

SEQ ID NO: 3148913 - RNA, 17 nt, Human
uacauuuguauaaaaua

SEQ ID NO: 3148914 - RNA, 22 nt, Human
uacaugagguacugagagugaa

SEQ ID NO: 3148915 - RNA, 21 nt, Human
uacaugagguacugagaguga

SEQ ID NO: 3148916 - RNA, 16 nt, Human
uaccaacacgagcagg

SEQ ID NO: 3148917 - RNA, 22 nt, Human
uaccaaaaaucucaauauuuca

SEQ ID NO: 3148918 - RNA, 20 nt, Human
uacaucccuuaccugggaaa

SEQ ID NO: 3148919 - RNA, 23 nt, Human
uaccacaggaaccacaagacugc

SEQ ID NO: 3148920 - RNA, 16 nt, Human
uagaaagagaaacagu

SEQ ID NO: 3148921 - RNA, 23 nt, Human
uacuuuauaacuaacauguccug

SEQ ID NO: 3148922 - RNA, 20 nt, Human
uacuuuauaacuaacauguc

SEQ ID NO: 3148923 - RNA, 19 nt, Human
uacuuuauaacuaacaugu

SEQ ID NO: 3148924 - RNA, 13 nt, Human
uacuguguaauua

SEQ ID NO: 3148925 - RNA, 23 nt, Human
uacuguguacagaauucugcuac

SEQ ID NO: 3148926 - RNA, 14 nt, Human
uacuguguaauuag

SEQ ID NO: 3148927 - RNA, 22 nt, Human
uacuguguacagaauucugcua

SEQ ID NO: 3148928 - RNA, 23 nt, Human
uacuaauagaauaaaggcaguuu

SEQ ID NO: 3148929 - RNA, 20 nt, Human
uacuaauagaauaaaggcag

SEQ ID NO: 3148930 - RNA, 18 nt, Human
uaccuugaacacuggggg

SEQ ID NO: 3148931 - RNA, 19 nt, Human
uacugagagugaacaaauu

SEQ ID NO: 3148932 - RNA, 23 nt, Human
uacugauguuccuagugaaagag

SEQ ID NO: 3148933 - RNA, 20 nt, Human
uaauuaaaagaauauuuuaa

SEQ ID NO: 3148934 - RNA, 15 nt, Human
uaauguuucaaacau

SEQ ID NO: 3148935 - RNA, 14 nt, Human
uaauguuucaaaca

SEQ ID NO: 3148936 - RNA, 23 nt, Human
uaauuuguaguguuggagaagaa

SEQ ID NO: 3148937 - RNA, 20 nt, Human
uaauuuguaguguuggagaa

SEQ ID NO: 3148938 - RNA, 22 nt, Human
uaauuggaaaggcagcucuaaa

SEQ ID NO: 3148939 - RNA, 16 nt, Human
uaauuggauuuccuaa

SEQ ID NO: 3148940 - RNA, 15 nt, Human
uaauuggauuuccua

SEQ ID NO: 3148941 - RNA, 23 nt, Human
uaauuggauuuccuaauacuguc

SEQ ID NO: 3148942 - RNA, 17 nt, Human
uaauuggauuuccuaau

SEQ ID NO: 3148943 - RNA, 23 nt, Human
uaaugauaacuggaaacuucagc

SEQ ID NO: 3148944 - RNA, 19 nt, Human
uaaugccacuaaauugaca

SEQ ID NO: 3148945 - RNA, 15 nt, Human
uaaucuuaguguaug

SEQ ID NO: 3148946 - RNA, 13 nt, Human
uaaucuuagugua

SEQ ID NO: 3148947 - RNA, 18 nt, Human
uaaucuuaguguaugauu

SEQ ID NO: 3148948 - RNA, 14 nt, Human
uaauaauguuucaa

SEQ ID NO: 3148949 - RNA, 15 nt, Human
uaauaauguuucaaa

SEQ ID NO: 3148950 - RNA, 23 nt, Human
uaaauugacacuuaaaaaugguu

SEQ ID NO: 3148951 - RNA, 19 nt, Human
uaacaaugcuguauuuuaa

SEQ ID NO: 3148952 - RNA, 20 nt, Human
uaacagcccuccucugcacu

SEQ ID NO: 3148953 - RNA, 18 nt, Human
uaacagcccuccucugca

SEQ ID NO: 3148954 - RNA, 17 nt, Human
uaacagcccuccucugc

SEQ ID NO: 3148955 - RNA, 11 nt, Human
uaacagcccuc

SEQ ID NO: 3148956 - RNA, 18 nt, Human
uaagcaucuggcucuaau

SEQ ID NO: 3148957 - RNA, 13 nt, Human
uaagccagacauc

SEQ ID NO: 3148958 - RNA, 18 nt, Human
uaagcauuccaacuaucu

SEQ ID NO: 3148959 - RNA, 16 nt, Human
uaagcauuccaacuau

SEQ ID NO: 3148960 - RNA, 20 nt, Human
uaagcauuccaacuaucuca

SEQ ID NO: 3148961 - RNA, 21 nt, Human
uaagccagacaucaacagaua

SEQ ID NO: 3148962 - RNA, 20 nt, Human
uaagccagacaucaacagau

SEQ ID NO: 3148963 - RNA, 23 nt, Human
uaagagggauuagggagagaaga

SEQ ID NO: 3148964 - RNA, 23 nt, Human
uaagagagaaugagagacacacu

SEQ ID NO: 3148965 - RNA, 13 nt, Human
guuuagaaagcuu

SEQ ID NO: 3148966 - RNA, 20 nt, Human
guuuaggauguugaaaaagu

SEQ ID NO: 3148967 - RNA, 11 nt, Human
guuucauugac

SEQ ID NO: 3148968 - RNA, 18 nt, Human
guuuucaggcuagaugua

SEQ ID NO: 3148969 - RNA, 16 nt, Human
guuuucauuaucucaa

SEQ ID NO: 3148970 - RNA, 16 nt, Human
uaaaaaagaaacauuu

SEQ ID NO: 3148971 - RNA, 19 nt, Human
uaaagcaguggacaccagg

SEQ ID NO: 3148972 - RNA, 16 nt, Human
uaaacuuuuuuucugu

SEQ ID NO: 3148973 - RNA, 13 nt, Human
uaaagcaguggac

SEQ ID NO: 3148974 - RNA, 18 nt, Human
uaaacuuuuuuucuguac

SEQ ID NO: 3148975 - RNA, 14 nt, Human
uaaaggaauuuaaa

SEQ ID NO: 3148976 - RNA, 17 nt, Human
uaaauaaaaauaauccu

SEQ ID NO: 3148977 - RNA, 21 nt, Human
uaaauauguuagcaaagaguu

SEQ ID NO: 3148978 - RNA, 18 nt, Human
uaaauauguuagcaaaga

SEQ ID NO: 3148979 - RNA, 20 nt, Human
uaaauauaucuaccccagac

SEQ ID NO: 3148980 - RNA, 18 nt, Human
uaaauauaucuaccccag

SEQ ID NO: 3148981 - RNA, 14 nt, Human
uaaauauaucuacc

SEQ ID NO: 3148982 - RNA, 18 nt, Human
uaaauauaugcuaagucu

SEQ ID NO: 3148983 - RNA, 18 nt, Human
uaaaauccauacauuugu

SEQ ID NO: 3148984 - RNA, 19 nt, Human
uaaaauccauacauuugug

SEQ ID NO: 3148985 - RNA, 14 nt, Human
uaaaagaugaaaau

SEQ ID NO: 3148986 - RNA, 18 nt, Human
uggggcagugcuuggccc

SEQ ID NO: 3148987 - RNA, 22 nt, Human
uggggcagugcuuggcccagga

SEQ ID NO: 3148988 - RNA, 20 nt, Human
uggggcagugcuuggcccag

SEQ ID NO: 3148989 - RNA, 23 nt, Human
uggggcagugcuuggcccaggag

SEQ ID NO: 3148990 - RNA, 16 nt, Human
uggguagacacacaug

SEQ ID NO: 3148991 - RNA, 17 nt, Human
uggguagacacacauga

SEQ ID NO: 3148992 - RNA, 16 nt, Human
ugggcaguuuuuugaa

SEQ ID NO: 3148993 - RNA, 15 nt, Human
ugggcaguuuuuuga

SEQ ID NO: 3148994 - RNA, 18 nt, Human
ugggccuccucuguccag

SEQ ID NO: 3148995 - RNA, 20 nt, Human
ugggccuccucuguccaggg

SEQ ID NO: 3148996 - RNA, 21 nt, Human
ugggacagucaccucauggaa

SEQ ID NO: 3148997 - RNA, 20 nt, Human
ugggacagucaccucaugga

SEQ ID NO: 3148998 - RNA, 18 nt, Human
ugggacagucaccucaug

SEQ ID NO: 3148999 - RNA, 20 nt, Human
ugggacauuugcucauggaa

SEQ ID NO: 3149000 - RNA, 19 nt, Human
ugggacauuugcucaugga

SEQ ID NO: 3149001 - RNA, 18 nt, Human
uggccuucggccuccauc

SEQ ID NO: 3149002 - RNA, 17 nt, Human
uggccuucggccuccau

SEQ ID NO: 3149003 - RNA, 14 nt, Human
uggccuucggccuc

SEQ ID NO: 3149004 - RNA, 22 nt, Human
uggccuuuuucauuuaucuaua

SEQ ID NO: 3149005 - RNA, 20 nt, Human
uggccuuuuucauuuaucua

SEQ ID NO: 3149006 - RNA, 19 nt, Human
uggccuuuuucauuuaucu

SEQ ID NO: 3149007 - RNA, 16 nt, Human
uggccuuuuucauuua

SEQ ID NO: 3149008 - RNA, 19 nt, Human
uggcucuaauucacagugc

SEQ ID NO: 3149009 - RNA, 14 nt, Human
uggaacucucgagc

SEQ ID NO: 3149010 - RNA, 22 nt, Human
uggaaaaguauguuagugcaaa

SEQ ID NO: 3149011 - RNA, 14 nt, Human
ugcuucuguuuuau

SEQ ID NO: 3149012 - RNA, 14 nt, Human
ugcuucuuucuaga

SEQ ID NO: 3149013 - RNA, 15 nt, Human
ugcuucuuucuagaa

SEQ ID NO: 3149014 - RNA, 17 nt, Human
uggccagaagucaaggc

SEQ ID NO: 3149015 - RNA, 21 nt, Human
ugccaucccucccuccaccuc

SEQ ID NO: 3149016 - RNA, 22 nt, Human
ugccaucccucccuccaccucc

SEQ ID NO: 3149017 - RNA, 15 nt, Human
ugccaucccucccuc

SEQ ID NO: 3149018 - RNA, 14 nt, Human
ugccaucccucccu

SEQ ID NO: 3149019 - RNA, 19 nt, Human
ugccaucccucccuccacc

SEQ ID NO: 3149020 - RNA, 20 nt, Human
ugccaucccucccuccaccu

SEQ ID NO: 3149021 - RNA, 19 nt, Human
ugcaucagcugcugaaaca

SEQ ID NO: 3149022 - RNA, 22 nt, Human
ugcaucagcugcugaaacaaca

SEQ ID NO: 3149023 - RNA, 20 nt, Human
ugcauuauauuuauuacugu

SEQ ID NO: 3149024 - RNA, 14 nt, Human
ugcauuauauuuau

SEQ ID NO: 3149025 - RNA, 15 nt, Human
ugcauuauauuuauu

SEQ ID NO: 3149026 - RNA, 16 nt, Human
ugcagauaaacaguag

SEQ ID NO: 3149027 - RNA, 13 nt, Human
ugaaguccaagca

SEQ ID NO: 3149028 - RNA, 15 nt, Human
ugcacaucaaaauau

SEQ ID NO: 3149029 - RNA, 17 nt, Human
ugcccagggcucagccu

SEQ ID NO: 3149030 - RNA, 18 nt, Human
ugcccagggcucagccug

SEQ ID NO: 3149031 - RNA, 11 nt, Human
ugcccagggcu

SEQ ID NO: 3149032 - RNA, 14 nt, Human
ugcccagggcucag

SEQ ID NO: 3149033 - RNA, 15 nt, Human
ugcccagggcucagc

SEQ ID NO: 3149034 - RNA, 16 nt, Human
ugcccagggcucagcc

SEQ ID NO: 3149035 - RNA, 18 nt, Human
ugccuccccuccucugcu

SEQ ID NO: 3149036 - RNA, 19 nt, Human
ugccuccccuccucugcuu

SEQ ID NO: 3149037 - RNA, 22 nt, Human
ugccuccccuccucugcuugcc

SEQ ID NO: 3149038 - RNA, 23 nt, Human
ugccuccccuccucugcuugcca

SEQ ID NO: 3149039 - RNA, 16 nt, Human
ugccuccccuccucug

SEQ ID NO: 3149040 - RNA, 21 nt, Human
ugcgguuaauuuugaagugcu

SEQ ID NO: 3149041 - RNA, 16 nt, Human
ugcgguuaauuuugaa

SEQ ID NO: 3149042 - RNA, 22 nt, Human
ugccuucucaacuccaaacuga

SEQ ID NO: 3149043 - RNA, 17 nt, Human
ugccuucucaacuccaa

SEQ ID NO: 3149044 - RNA, 23 nt, Human
ugcucuuuucuccucacuguauc

SEQ ID NO: 3149045 - RNA, 21 nt, Human
ugcucuuuucuccucacugua

SEQ ID NO: 3149046 - RNA, 15 nt, Human
ugcucuuuucuccuc

SEQ ID NO: 3149047 - RNA, 13 nt, Human
ugcucuuuucucc

SEQ ID NO: 3149048 - RNA, 18 nt, Human
ugcuagaacucccuuuca

SEQ ID NO: 3149049 - RNA, 19 nt, Human
ugcuagaacucccuuucaa

SEQ ID NO: 3149050 - RNA, 20 nt, Human
ugcuagcacuuggagccaag

SEQ ID NO: 3149051 - RNA, 21 nt, Human
ugcuagaacucccuuucaaca

SEQ ID NO: 3149052 - RNA, 20 nt, Human
ugcuagaacucccuuucaac

SEQ ID NO: 3149053 - RNA, 18 nt, Human
ugcuagcacuuggagcca

SEQ ID NO: 3149054 - RNA, 21 nt, Human
uguauuuggaaauaaagucag

SEQ ID NO: 3149055 - RNA, 13 nt, Human
uguauuuggaaau

SEQ ID NO: 3149056 - RNA, 12 nt, Human
uguauuuggaaa

SEQ ID NO: 3149057 - RNA, 21 nt, Human
uguauaauuggauuuccuaau

SEQ ID NO: 3149058 - RNA, 19 nt, Human
uguauaauuggauuuccua

SEQ ID NO: 3149059 - RNA, 18 nt, Human
uguauaauuggauuuccu

SEQ ID NO: 3149060 - RNA, 14 nt, Human
uguauaauuggauu

SEQ ID NO: 3149061 - RNA, 16 nt, Human
uguaugauucccagcc

SEQ ID NO: 3149062 - RNA, 18 nt, Human
uguaacuacuuuauaacu

SEQ ID NO: 3149063 - RNA, 17 nt, Human
uguaacuacuuuauaac

SEQ ID NO: 3149064 - RNA, 16 nt, Human
uguaacuacuuuauaa

SEQ ID NO: 3149065 - RNA, 15 nt, Human
uguaaucacagcuac

SEQ ID NO: 3149066 - RNA, 14 nt, Human
uguaaucacagcua

SEQ ID NO: 3149067 - RNA, 22 nt, Human
ugugaccacugcagaagacagu

SEQ ID NO: 3149068 - RNA, 21 nt, Human
ugucucaguccaugaagaugu

SEQ ID NO: 3149069 - RNA, 15 nt, Human
ugucugccagccagc

SEQ ID NO: 3149070 - RNA, 16 nt, Human
ugucugccagccagca

SEQ ID NO: 3149071 - RNA, 18 nt, Human
ugucugccagccagcagc

SEQ ID NO: 3149072 - RNA, 19 nt, Human
ugucugccagccagcagcc

SEQ ID NO: 3149073 - RNA, 14 nt, Human
uguggcugcuagca

SEQ ID NO: 3149074 - RNA, 14 nt, Human
ugugcguccugucg

SEQ ID NO: 3149075 - RNA, 20 nt, Human
uuacagagacagaaagcaga

SEQ ID NO: 3149076 - RNA, 15 nt, Human
uuacauuuguauaaa

SEQ ID NO: 3149077 - RNA, 14 nt, Human
uuacauuuguauaa

SEQ ID NO: 3149078 - RNA, 21 nt, Human
uuaccacuuguguuuugcaag

SEQ ID NO: 3149079 - RNA, 18 nt, Human
uuaauaauguuucaaaca

SEQ ID NO: 3149080 - RNA, 16 nt, Human
uuaauaauguuucaaa

SEQ ID NO: 3149081 - RNA, 22 nt, Human
uuaaugucaauucuugccaaau

SEQ ID NO: 3149082 - RNA, 20 nt, Human
uuaaagcuuauuaaaacuca

SEQ ID NO: 3149083 - RNA, 19 nt, Human
uuaaaagaaugauuaugaa

SEQ ID NO: 3149084 - RNA, 13 nt, Human
uuaaaagaaugau

SEQ ID NO: 3149085 - RNA, 20 nt, Human
uguuuuuccuuguauuuaaa

SEQ ID NO: 3149086 - RNA, 13 nt, Human
uguuuaaaaucau

SEQ ID NO: 3149087 - RNA, 20 nt, Human
uguuggagaagaacugaaau

SEQ ID NO: 3149088 - RNA, 21 nt, Human
uguuggagaagaacugaaauc

SEQ ID NO: 3149089 - RNA, 23 nt, Human
uguuaccaaaaauaaauauaucu

SEQ ID NO: 3149090 - RNA, 19 nt, Human
uguuaccaaaaauaaauau

SEQ ID NO: 3149091 - RNA, 14 nt, Human
uguuagugcaaauu

SEQ ID NO: 3149092 - RNA, 23 nt, Human
uguuaguuaccuuauaguuacug

SEQ ID NO: 3149093 - RNA, 20 nt, Human
uguuaguuaccuuauaguua

SEQ ID NO: 3149094 - RNA, 16 nt, Human
uguucacagccagacu

SEQ ID NO: 3149095 - RNA, 20 nt, Human
uuuagaaacacaacuauauu

SEQ ID NO: 3149096 - RNA, 22 nt, Human
uuuagaagccaacuaugauuau

SEQ ID NO: 3149097 - RNA, 14 nt, Human
uuuagaagccaacu

SEQ ID NO: 3149098 - RNA, 12 nt, Human
uuuagaaacaca

SEQ ID NO: 3149099 - RNA, 20 nt, Human
uuuaucuauaauuuaccuaa

SEQ ID NO: 3149100 - RNA, 19 nt, Human
uuuaucuauaauuuaccua

SEQ ID NO: 3149101 - RNA, 14 nt, Human
uuuaucuauaauuu

SEQ ID NO: 3149102 - RNA, 15 nt, Human
uuucugagaaagacu

SEQ ID NO: 3149103 - RNA, 22 nt, Human
uuucugagaaagacuauucaaa

SEQ ID NO: 3149104 - RNA, 22 nt, Human
uuucauugacuaucaaacugaa

SEQ ID NO: 3149105 - RNA, 15 nt, Human
uuucagauaaucaca

SEQ ID NO: 3149106 - RNA, 15 nt, Human
uuucagcagcugcag

SEQ ID NO: 3149107 - RNA, 21 nt, Human
uuugcauagauucccugagca

SEQ ID NO: 3149108 - RNA, 17 nt, Human
uuucuuaacuucuugcu

SEQ ID NO: 3149109 - RNA, 21 nt, Human
uuucuuaacuucuugcuucuu

SEQ ID NO: 3149110 - RNA, 18 nt, Human
uuucuuaacuucuugcuu

SEQ ID NO: 3149111 - RNA, 15 nt, Human
uuugucacuuuuucu

SEQ ID NO: 3149112 - RNA, 14 nt, Human
uuugucacuuuuuc

SEQ ID NO: 3149113 - RNA, 19 nt, Human
uuuguauaaaauaauuuuu

SEQ ID NO: 3149114 - RNA, 13 nt, Human
uuuguauaauugg

SEQ ID NO: 3149115 - RNA, 21 nt, Human
uuuguauaauuggauuuccua

SEQ ID NO: 3149116 - RNA, 21 nt, Human
uuuguauaaaauaauuuuuau

SEQ ID NO: 3149117 - RNA, 10 nt, Human
uuuuauauuu

SEQ ID NO: 3149118 - RNA, 20 nt, Human
uuuuauaugcuucuguuuua

SEQ ID NO: 3149119 - RNA, 15 nt, Human
uuuuauaugcuucug

SEQ ID NO: 3149120 - RNA, 20 nt, Human
uuuuauaucaauuuaaaaaa

SEQ ID NO: 3149121 - RNA, 19 nt, Human
uuuucggccccauguaucu

SEQ ID NO: 3149122 - RNA, 16 nt, Human
uuuuucuguaccaguu

SEQ ID NO: 3149123 - RNA, 14 nt, Human
uuuuucuguaccag

SEQ ID NO: 3149124 - RNA, 21 nt, Human
uucuaugaaauauuauguuaa

SEQ ID NO: 3149125 - RNA, 19 nt, Human
uucucuccagcugacuaaa

SEQ ID NO: 3149126 - RNA, 12 nt, Human
uucucuccagcu

SEQ ID NO: 3149127 - RNA, 19 nt, Human
uucggccuccauccugagg

SEQ ID NO: 3149128 - RNA, 18 nt, Human
uucggccuccauccugag

SEQ ID NO: 3149129 - RNA, 18 nt, Human
uucccuugaugaagaagu

SEQ ID NO: 3149130 - RNA, 12 nt, Human
uuccuagugaaa

SEQ ID NO: 3149131 - RNA, 15 nt, Human
uucagagacucaggg

SEQ ID NO: 3149132 - RNA, 20 nt, Human
uucagagacucagggcccca

SEQ ID NO: 3149133 - RNA, 21 nt, Human
uucagagcugcccucuccugg

SEQ ID NO: 3149134 - RNA, 21 nt, Human
uucagagacucagggccccag

SEQ ID NO: 3149135 - RNA, 22 nt, Human
uucagagcugcccucuccuggg

SEQ ID NO: 3149136 - RNA, 23 nt, Human
uucagagcugcccucuccugggc

SEQ ID NO: 3149137 - RNA, 19 nt, Human
uuccacuuauaggaauuga

SEQ ID NO: 3149138 - RNA, 17 nt, Human
uucauuuaucuauaauu

SEQ ID NO: 3149139 - RNA, 18 nt, Human
uucauuuaucuauaauuu

SEQ ID NO: 3149140 - RNA, 20 nt, Human
uugcugcaagcacagcccuu

SEQ ID NO: 3149141 - RNA, 21 nt, Human
uuggaaauaaagucagaugga

SEQ ID NO: 3149142 - RNA, 13 nt, Human
uuggaaauaaagu

SEQ ID NO: 3149143 - RNA, 12 nt, Human
uugggaggcuga

SEQ ID NO: 3149144 - RNA, 20 nt, Human
uuggccagaagucaaggcuu

SEQ ID NO: 3149145 - RNA, 11 nt, Human
uuguaaaugug

SEQ ID NO: 3149146 - RNA, 14 nt, Human
uuguaaaugugcuu

SEQ ID NO: 3149147 - RNA, 18 nt, Human
uuguaaaugugcuuuuaa

SEQ ID NO: 3149148 - RNA, 16 nt, Human
uuguaaaggaauuuaa

SEQ ID NO: 3149149 - RNA, 14 nt, Human
uuguauuacaaauc

SEQ ID NO: 3149150 - RNA, 19 nt, Human
uuguaucacaaaucuuaac

SEQ ID NO: 3149151 - RNA, 23 nt, Human
uugaaacugagaugugaacacau

SEQ ID NO: 3149152 - RNA, 16 nt, Human
uugaaaagacuccaaa

SEQ ID NO: 3149153 - RNA, 18 nt, Human
uugaaaagacuccaaaga

SEQ ID NO: 3149154 - RNA, 22 nt, Human
uugaaaagacuccaaagaaaug

SEQ ID NO: 3149155 - RNA, 23 nt, Human
uugaaaagacuccaaagaaaugu

SEQ ID NO: 3149156 - RNA, 15 nt, Human
uucugagaaagacua

SEQ ID NO: 3149157 - RNA, 14 nt, Human
uucugagcauuuaa

SEQ ID NO: 3149158 - RNA, 15 nt, Human
uucuuauuucauuuc

SEQ ID NO: 3149159 - RNA, 14 nt, Human
uugaggacacugau

SEQ ID NO: 3149160 - RNA, 15 nt, Human
uugaggacacugaua

SEQ ID NO: 3149161 - RNA, 17 nt, Human
uugacuaucaaacugaa

SEQ ID NO: 3149162 - RNA, 18 nt, Human
uugcauagauucccugag

SEQ ID NO: 3149163 - RNA, 12 nt, Human
uugaugaagaag

SEQ ID NO: 3149164 - RNA, 18 nt, Human
ccaucaaggguacacugc

SEQ ID NO: 3149165 - RNA, 14 nt, Human
ccauacauuugugu

SEQ ID NO: 3149166 - RNA, 16 nt, Human
ccaugauguuuagaaa

SEQ ID NO: 3149167 - RNA, 14 nt, Human
ccaugaagauguag

SEQ ID NO: 3149168 - RNA, 13 nt, Human
cccaaaaggcaga

SEQ ID NO: 3149169 - RNA, 18 nt, Human
cccaaaaggcagaagcaa

SEQ ID NO: 3149170 - RNA, 13 nt, Human
ccaggugccaguu

SEQ ID NO: 3149171 - RNA, 17 nt, Human
ccaggugccaguuaugg

SEQ ID NO: 3149172 - RNA, 11 nt, Human
ccagggcucag

SEQ ID NO: 3149173 - RNA, 16 nt, Human
ccagggcucagccugg

SEQ ID NO: 3149174 - RNA, 20 nt, Human
ccagggcucagccugguggg

SEQ ID NO: 3149175 - RNA, 12 nt, Human
ccagggcucagc

SEQ ID NO: 3149176 - RNA, 13 nt, Human
ccagggcucagcc

SEQ ID NO: 3149177 - RNA, 14 nt, Human
ccagggcucagccu

SEQ ID NO: 3149178 - RNA, 15 nt, Human
ccagggcucagccug

SEQ ID NO: 3149179 - RNA, 19 nt, Human
cccaaguucaugcagcugu

SEQ ID NO: 3149180 - RNA, 13 nt, Human
cccaggugccagu

SEQ ID NO: 3149181 - RNA, 16 nt, Human
cccaggaguuuggcca

SEQ ID NO: 3149182 - RNA, 15 nt, Human
cccaggaguuuggcc

SEQ ID NO: 3149183 - RNA, 20 nt, Human
cccaggaguuuggccagaag

SEQ ID NO: 3149184 - RNA, 19 nt, Human
cccaggaguuuggccagaa

SEQ ID NO: 3149185 - RNA, 18 nt, Human
cccaggaguuuggccaga

SEQ ID NO: 3149186 - RNA, 17 nt, Human
cccaggaguuuggccag

SEQ ID NO: 3149187 - RNA, 18 nt, Human
ccagaagucaaggcuuag

SEQ ID NO: 3149188 - RNA, 20 nt, Human
ccacuuaauguauguuacca

SEQ ID NO: 3149189 - RNA, 17 nt, Human
ccacuuaauguauguua

SEQ ID NO: 3149190 - RNA, 15 nt, Human
ccacuuaauguaugu

SEQ ID NO: 3149191 - RNA, 18 nt, Human
ccacugcagaagacagua

SEQ ID NO: 3149192 - RNA, 13 nt, Human
ccacugcagaaga

SEQ ID NO: 3149193 - RNA, 21 nt, Human
ccagaaauaaaguuggugaca

SEQ ID NO: 3149194 - RNA, 23 nt, Human
ccagaaauaaaguuggugacaga

SEQ ID NO: 3149195 - RNA, 20 nt, Human
ccacaggaaccacaagacug

SEQ ID NO: 3149196 - RNA, 16 nt, Human
ccaauauucauagcag

SEQ ID NO: 3149197 - RNA, 19 nt, Human
ccaauauccuaauaaaaag

SEQ ID NO: 3149198 - RNA, 18 nt, Human
ccaauauccuaauaaaaa

SEQ ID NO: 3149199 - RNA, 17 nt, Human
ccaauauccuaauaaaa

SEQ ID NO: 3149200 - RNA, 16 nt, Human
ccaauauccuaauaaa

SEQ ID NO: 3149201 - RNA, 15 nt, Human
ccaauauccuaauaa

SEQ ID NO: 3149202 - RNA, 14 nt, Human
ccaauauccuaaua

SEQ ID NO: 3149203 - RNA, 13 nt, Human
ccaauauccuaau

SEQ ID NO: 3149204 - RNA, 12 nt, Human
ccaauauccuaa

SEQ ID NO: 3149205 - RNA, 17 nt, Human
ccaagcauuuagaugua

SEQ ID NO: 3149206 - RNA, 22 nt, Human
ccaagcauaccaacacgagcag

SEQ ID NO: 3149207 - RNA, 20 nt, Human
ccaaggguucagagacucag

SEQ ID NO: 3149208 - RNA, 23 nt, Human
ccaaggguucagagacucagggc

SEQ ID NO: 3149209 - RNA, 14 nt, Human
ccaagcaaguauua

SEQ ID NO: 3149210 - RNA, 23 nt, Human
ccaaauuucauaccuaucaucuu

SEQ ID NO: 3149211 - RNA, 22 nt, Human
ccaaacugacucuuaagaagac

SEQ ID NO: 3149212 - RNA, 22 nt, Human
ccaacccgucuggcccaccagg

SEQ ID NO: 3149213 - RNA, 18 nt, Human
cauuugcucauggaauug

SEQ ID NO: 3149214 - RNA, 13 nt, Human
cauuugcucaugg

SEQ ID NO: 3149215 - RNA, 17 nt, Human
cauuuaggccaugggac

SEQ ID NO: 3149216 - RNA, 15 nt, Human
cccuugaugaagaag

SEQ ID NO: 3149217 - RNA, 16 nt, Human
cccuugaugaagaagu

SEQ ID NO: 3149218 - RNA, 15 nt, Human
ccuagagcacacugu

SEQ ID NO: 3149219 - RNA, 19 nt, Human
ccguuuugucacuuuuucu

SEQ ID NO: 3149220 - RNA, 14 nt, Human
ccguuuugucacuu

SEQ ID NO: 3149221 - RNA, 22 nt, Human
ccgggaggcagagguugcagug

SEQ ID NO: 3149222 - RNA, 11 nt, Human
ccucuccuggg

SEQ ID NO: 3149223 - RNA, 12 nt, Human
ccucuccugggc

SEQ ID NO: 3149224 - RNA, 13 nt, Human
ccucuccugggca

SEQ ID NO: 3149225 - RNA, 21 nt, Human
ccucugcuugccaucccuccc

SEQ ID NO: 3149226 - RNA, 17 nt, Human
ccucugcuugccauccc

SEQ ID NO: 3149227 - RNA, 20 nt, Human
ccucugcuugccaucccucc

SEQ ID NO: 3149228 - RNA, 16 nt, Human
ccucugcacucccacc

SEQ ID NO: 3149229 - RNA, 21 nt, Human
ccuccucugcacucccaccug

SEQ ID NO: 3149230 - RNA, 11 nt, Human
ccuccucugcu

SEQ ID NO: 3149231 - RNA, 12 nt, Human
ccucccugcaau

SEQ ID NO: 3149232 - RNA, 16 nt, Human
ccucccugcaauaaaa

SEQ ID NO: 3149233 - RNA, 17 nt, Human
ccuccccuccucugcuu

SEQ ID NO: 3149234 - RNA, 18 nt, Human
ccuccccuccucugcuug

SEQ ID NO: 3149235 - RNA, 15 nt, Human
ccuccccuccucugc

SEQ ID NO: 3149236 - RNA, 14 nt, Human
ccuccccuccucug

SEQ ID NO: 3149237 - RNA, 20 nt, Human
ccucagaaaacaaggaugaa

SEQ ID NO: 3149238 - RNA, 20 nt, Human
ccugaggcuccacuuggucu

SEQ ID NO: 3149239 - RNA, 18 nt, Human
ccugaggcuccacuuggu

SEQ ID NO: 3149240 - RNA, 17 nt, Human
ccugaggcuccacuugg

SEQ ID NO: 3149241 - RNA, 23 nt, Human
ccugaaagaggaaugaaguacuc

SEQ ID NO: 3149242 - RNA, 13 nt, Human
ccugaaagaggaa

SEQ ID NO: 3149243 - RNA, 18 nt, Human
ccugaaagaggaaugaag

SEQ ID NO: 3149244 - RNA, 23 nt, Human
ccucuuagaugcaguucugaaga

SEQ ID NO: 3149245 - RNA, 14 nt, Human
ccucuguccagggc

SEQ ID NO: 3149246 - RNA, 15 nt, Human
ccucuguccagggcc

SEQ ID NO: 3149247 - RNA, 18 nt, Human
ccucuguccagggcccug

SEQ ID NO: 3149248 - RNA, 20 nt, Human
ccucuguccagggcccugag

SEQ ID NO: 3149249 - RNA, 21 nt, Human
ccucuguccagggcccugagc

SEQ ID NO: 3149250 - RNA, 23 nt, Human
ccucuguccagggcccugagcuc

SEQ ID NO: 3149251 - RNA, 11 nt, Human
cgcaaugugac

SEQ ID NO: 3149252 - RNA, 17 nt, Human
cggccuccauccugagg

SEQ ID NO: 3149253 - RNA, 16 nt, Human
cggccuccauccugag

SEQ ID NO: 3149254 - RNA, 14 nt, Human
cggccuccauccug

SEQ ID NO: 3149255 - RNA, 21 nt, Human
cgcuccugucugccagccagc

SEQ ID NO: 3149256 - RNA, 17 nt, Human
cgcuccugucugccagc

SEQ ID NO: 3149257 - RNA, 20 nt, Human
cgcuccugucugccagccag

SEQ ID NO: 3149258 - RNA, 16 nt, Human
cgcuccugucugccag

SEQ ID NO: 3149259 - RNA, 14 nt, Human
cgcuccugucugcc

SEQ ID NO: 3149260 - RNA, 17 nt, Human
cgucuggcccaccaggg

SEQ ID NO: 3149261 - RNA, 11 nt, Human
cguuuugucac

SEQ ID NO: 3149262 - RNA, 24 nt, Human
ccuggacuuaagcaucuggcucua

SEQ ID NO: 3149263 - RNA, 20 nt, Human
ccuggacuuaagcaucuggc

SEQ ID NO: 3149264 - RNA, 14 nt, Human
ccugggcagcugcc

SEQ ID NO: 3149265 - RNA, 15 nt, Human
ccugggcagcugccu

SEQ ID NO: 3149266 - RNA, 16 nt, Human
ccugggcagcugccuc

SEQ ID NO: 3149267 - RNA, 17 nt, Human
ccugggcagcugccucc

SEQ ID NO: 3149268 - RNA, 18 nt, Human
ccugggcagcugccuccc

SEQ ID NO: 3149269 - RNA, 22 nt, Human
ccugugcugcccgucuucagcc

SEQ ID NO: 3149270 - RNA, 20 nt, Human
ccugggcagcugccuccccu

SEQ ID NO: 3149271 - RNA, 21 nt, Human
ccugugcugcccgucuucagc

SEQ ID NO: 3149272 - RNA, 23 nt, Human
ccugugcugcccgucuucagccu

SEQ ID NO: 3149273 - RNA, 12 nt, Human
ccuucagccuga

SEQ ID NO: 3149274 - RNA, 15 nt, Human
cugccagcaacgcag

SEQ ID NO: 3149275 - RNA, 12 nt, Human
cugccagccagc

SEQ ID NO: 3149276 - RNA, 13 nt, Human
cugccagccagca

SEQ ID NO: 3149277 - RNA, 14 nt, Human
cugccagccagcag

SEQ ID NO: 3149278 - RNA, 15 nt, Human
cugccagccagcagc

SEQ ID NO: 3149279 - RNA, 16 nt, Human
cugccagccagcagcc

SEQ ID NO: 3149280 - RNA, 18 nt, Human
cugccagccagcagccag

SEQ ID NO: 3149281 - RNA, 19 nt, Human
cugccagccagcagccagc

SEQ ID NO: 3149282 - RNA, 20 nt, Human
cugccagccagcagccagcu

SEQ ID NO: 3149283 - RNA, 23 nt, Human
cugccagccagcagccagcucuc

SEQ ID NO: 3149284 - RNA, 15 nt, Human
cugccuaagugcagc

SEQ ID NO: 3149285 - RNA, 18 nt, Human
cugauaaaagauggccau

SEQ ID NO: 3149286 - RNA, 13 nt, Human
cugauguuccuag

SEQ ID NO: 3149287 - RNA, 18 nt, Human
cugauguuccuagugaaa

SEQ ID NO: 3149288 - RNA, 20 nt, Human
cugauguuccuagugaaaga

SEQ ID NO: 3149289 - RNA, 21 nt, Human
cugauguuccuagugaaagag

SEQ ID NO: 3149290 - RNA, 13 nt, Human
cugcagaagacag

SEQ ID NO: 3149291 - RNA, 23 nt, Human
cugcagaagacaguauggcagcu

SEQ ID NO: 3149292 - RNA, 18 nt, Human
cuggcacaguuuucugag

SEQ ID NO: 3149293 - RNA, 19 nt, Human
cuggcacaguuuucugaga

SEQ ID NO: 3149294 - RNA, 16 nt, Human
cuggccaacgggguga

SEQ ID NO: 3149295 - RNA, 14 nt, Human
cuggcccaccaggg

SEQ ID NO: 3149296 - RNA, 13 nt, Human
cuggcccaccagg

SEQ ID NO: 3149297 - RNA, 13 nt, Human
cugcugaaacaac

SEQ ID NO: 3149298 - RNA, 23 nt, Human
cuggaauaauccuaaacauauga

SEQ ID NO: 3149299 - RNA, 12 nt, Human
cuggugggccuc

SEQ ID NO: 3149300 - RNA, 17 nt, Human
cuggugggccuccucug

SEQ ID NO: 3149301 - RNA, 21 nt, Human
cuggucccagccagcaguuca

SEQ ID NO: 3149302 - RNA, 18 nt, Human
cuggggugggcaguuuuu

SEQ ID NO: 3149303 - RNA, 16 nt, Human
cuggggugggcaguuu

SEQ ID NO: 3149304 - RNA, 22 nt, Human
cugggaacccaaguccaagcau

SEQ ID NO: 3149305 - RNA, 17 nt, Human
cucccagucauuuaaua

SEQ ID NO: 3149306 - RNA, 20 nt, Human
cuccauccugaggcuccacu

SEQ ID NO: 3149307 - RNA, 21 nt, Human
cuccauccugaggcuccacuu

SEQ ID NO: 3149308 - RNA, 23 nt, Human
cuccauccugaggcuccacuugg

SEQ ID NO: 3149309 - RNA, 14 nt, Human
cuccaccucccugc

SEQ ID NO: 3149310 - RNA, 15 nt, Human
cuccaccucccugca

SEQ ID NO: 3149311 - RNA, 16 nt, Human
cuccaccucccugcaa

SEQ ID NO: 3149312 - RNA, 17 nt, Human
cuccaccucccugcaau

SEQ ID NO: 3149313 - RNA, 18 nt, Human
cucauuaggauggcuagu

SEQ ID NO: 3149314 - RNA, 17 nt, Human
cucauuaggauggcuag

SEQ ID NO: 3149315 - RNA, 13 nt, Human
cucggagaagagc

SEQ ID NO: 3149316 - RNA, 20 nt, Human
cucggagaagagcuguucac

SEQ ID NO: 3149317 - RNA, 12 nt, Human
cucggagaagag

SEQ ID NO: 3149318 - RNA, 14 nt, Human
cucuaacagcccuc

SEQ ID NO: 3149319 - RNA, 16 nt, Human
cucccuucucuucaca

SEQ ID NO: 3149320 - RNA, 12 nt, Human
cucccuuucaac

SEQ ID NO: 3149321 - RNA, 13 nt, Human
cucccuuucaaca

SEQ ID NO: 3149322 - RNA, 19 nt, Human
cuccucacuguauccaggu

SEQ ID NO: 3149323 - RNA, 16 nt, Human
cuccucacuguaucca

SEQ ID NO: 3149324 - RNA, 14 nt, Human
cuccucacuguauc

SEQ ID NO: 3149325 - RNA, 15 nt, Human
cucuucucuccagcu

SEQ ID NO: 3149326 - RNA, 14 nt, Human
cucuucucuccagc

SEQ ID NO: 3149327 - RNA, 13 nt, Human
cucuucucuccag

SEQ ID NO: 3149328 - RNA, 22 nt, Human
cucuucucuccagcugacuaaa

SEQ ID NO: 3149329 - RNA, 19 nt, Human
cucuucucuccagcugacu

SEQ ID NO: 3149330 - RNA, 16 nt, Human
cucuaauucacagugc

SEQ ID NO: 3149331 - RNA, 15 nt, Human
cucuaauucacagug

SEQ ID NO: 3149332 - RNA, 18 nt, Human
cucuccagcugacuaaac

SEQ ID NO: 3149333 - RNA, 21 nt, Human
cucuccugggcagcugccucc

SEQ ID NO: 3149334 - RNA, 20 nt, Human
cucuccugggcagcugccuc

SEQ ID NO: 3149335 - RNA, 23 nt, Human
cucugcauacucauuaggauggc

SEQ ID NO: 3149336 - RNA, 19 nt, Human
cuuccuuggacucauuuua

SEQ ID NO: 3149337 - RNA, 20 nt, Human
cuucgaaagcaucauuauuu

SEQ ID NO: 3149338 - RNA, 18 nt, Human
cuucggccuccauccuga

SEQ ID NO: 3149339 - RNA, 17 nt, Human
cuucggccuccauccug

SEQ ID NO: 3149340 - RNA, 19 nt, Human
cuuccccuugcccagggcu

SEQ ID NO: 3149341 - RNA, 23 nt, Human
cuuccccuugcccagggcucagc

SEQ ID NO: 3149342 - RNA, 16 nt, Human
cuuccccuugcccagg

SEQ ID NO: 3149343 - RNA, 19 nt, Human
cuuccagauccuggaaauc

SEQ ID NO: 3149344 - RNA, 16 nt, Human
cuucagcgguuuauau

SEQ ID NO: 3149345 - RNA, 23 nt, Human
cuucagccuagccgaccucagcc

SEQ ID NO: 3149346 - RNA, 18 nt, Human
cuucagcgguuuauauaa

SEQ ID NO: 3149347 - RNA, 13 nt, Human
cuucagccuagcc

SEQ ID NO: 3149348 - RNA, 20 nt, Human
cuucagccuagccgaccuca

SEQ ID NO: 3149349 - RNA, 21 nt, Human
cuucagccuagccgaccucag

SEQ ID NO: 3149350 - RNA, 22 nt, Human
cuucagccuagccgaccucagc

SEQ ID NO: 3149351 - RNA, 23 nt, Human
cuuaagcaucuggcucuaauuca

SEQ ID NO: 3149352 - RNA, 18 nt, Human
cuuaagcaucuggcucua

SEQ ID NO: 3149353 - RNA, 17 nt, Human
cuuaagcaucuggcucu

SEQ ID NO: 3149354 - RNA, 15 nt, Human
cuuaagcaucuggcu

SEQ ID NO: 3149355 - RNA, 22 nt, Human
cuuaacuucuugcuucuuucua

SEQ ID NO: 3149356 - RNA, 21 nt, Human
cuuaacuucuugcuucuuucu

SEQ ID NO: 3149357 - RNA, 18 nt, Human
cuuaacuucuugcuucuu

SEQ ID NO: 3149358 - RNA, 15 nt, Human
cuuaacuucuugcuu

SEQ ID NO: 3149359 - RNA, 14 nt, Human
cuuaacuucuugcu

SEQ ID NO: 3149360 - RNA, 18 nt, Human
cuuaaugccacuaaauug

SEQ ID NO: 3149361 - RNA, 19 nt, Human
cuguuuuauaauuuuguga

SEQ ID NO: 3149362 - RNA, 18 nt, Human
cuguuuauuaaucuuagu

SEQ ID NO: 3149363 - RNA, 16 nt, Human
cuguuuauuaaucuua

SEQ ID NO: 3149364 - RNA, 14 nt, Human
cuguuuauuaaucu

SEQ ID NO: 3149365 - RNA, 21 nt, Human
cuuaggguuaugauuaaguaa

SEQ ID NO: 3149366 - RNA, 13 nt, Human
cuuauaauuuaaa

SEQ ID NO: 3149367 - RNA, 19 nt, Human
cuuauaggaauugacccac

SEQ ID NO: 3149368 - RNA, 14 nt, Human
cuuauaauuuaaaa

SEQ ID NO: 3149369 - RNA, 14 nt, Human
cuuauaguuacugu

SEQ ID NO: 3149370 - RNA, 21 nt, Human
cuuauaguuacuguguaauua

SEQ ID NO: 3149371 - RNA, 19 nt, Human
cuuauaguuacuguguaau

SEQ ID NO: 3149372 - RNA, 18 nt, Human
cuuauaguuacuguguaa

SEQ ID NO: 3149373 - RNA, 16 nt, Human
cuuauaguuacugugu

SEQ ID NO: 3149374 - RNA, 15 nt, Human
cuuauaguuacugug

SEQ ID NO: 3149375 - RNA, 19 nt, Human
cuuacuaguuucccuugca

SEQ ID NO: 3149376 - RNA, 21 nt, Human
cuuaauguauguuaccaaaaa

SEQ ID NO: 3149377 - RNA, 14 nt, Human
cuuaauguauguua

SEQ ID NO: 3149378 - RNA, 17 nt, Human
cuuaauguauguuacca

SEQ ID NO: 3149379 - RNA, 19 nt, Human
cuuagaugcaguucugaag

SEQ ID NO: 3149380 - RNA, 14 nt, Human
cuuagacccucaug

SEQ ID NO: 3149381 - RNA, 14 nt, Human
gaaaaguauguuag

SEQ ID NO: 3149382 - RNA, 20 nt, Human
gaaaaguauguuagugcaaa

SEQ ID NO: 3149383 - RNA, 19 nt, Human
cuuuccucaaaacuucaga

SEQ ID NO: 3149384 - RNA, 21 nt, Human
cuugcugcaagcacagcccuu

SEQ ID NO: 3149385 - RNA, 20 nt, Human
cuugcugcaagcacagcccu

SEQ ID NO: 3149386 - RNA, 19 nt, Human
cuugcuucuuucuagaaag

SEQ ID NO: 3149387 - RNA, 18 nt, Human
cuugcuucuuucuagaaa

SEQ ID NO: 3149388 - RNA, 15 nt, Human
cuugcuucuuucuag

SEQ ID NO: 3149389 - RNA, 14 nt, Human
cuugcuucuuucua

SEQ ID NO: 3149390 - RNA, 20 nt, Human
cuugcuugauuguauggugg

SEQ ID NO: 3149391 - RNA, 22 nt, Human
cuugcccuguuaaaagaugaaa

SEQ ID NO: 3149392 - RNA, 14 nt, Human
cuugccaucccucc

SEQ ID NO: 3149393 - RNA, 14 nt, Human
cuugcccuguuaaa

SEQ ID NO: 3149394 - RNA, 18 nt, Human
cuugcccuggugccucac

SEQ ID NO: 3149395 - RNA, 20 nt, Human
cuugcccagggcucagccug

SEQ ID NO: 3149396 - RNA, 21 nt, Human
cuugcccagggcucagccugg

SEQ ID NO: 3149397 - RNA, 23 nt, Human
cuugcccagggcucagccuggug

SEQ ID NO: 3149398 - RNA, 15 nt, Human
cuugccaucccuccc

SEQ ID NO: 3149399 - RNA, 16 nt, Human
cuugccaucccucccu

SEQ ID NO: 3149400 - RNA, 17 nt, Human
cuugccaucccucccuc

SEQ ID NO: 3149401 - RNA, 13 nt, Human
cuugcccagggcu

SEQ ID NO: 3149402 - RNA, 14 nt, Human
cuugcccagggcuc

SEQ ID NO: 3149403 - RNA, 15 nt, Human
cuugcccagggcuca

SEQ ID NO: 3149404 - RNA, 16 nt, Human
cuugcccagggcucag

SEQ ID NO: 3149405 - RNA, 18 nt, Human
cuugcccagggcucagcc

SEQ ID NO: 3149406 - RNA, 19 nt, Human
cuugcccagggcucagccu

SEQ ID NO: 3149407 - RNA, 23 nt, Human
cuugcaucaauuuuucuuauuuc

SEQ ID NO: 3149408 - RNA, 16 nt, Human
cuuggggcugaugcag

SEQ ID NO: 3149409 - RNA, 18 nt, Human
cuuggggcugaugcaguu

SEQ ID NO: 3149410 - RNA, 17 nt, Human
cuuguacuuuauuuucu

SEQ ID NO: 3149411 - RNA, 16 nt, Human
cuuggacucauuuuaa

SEQ ID NO: 3149412 - RNA, 22 nt, Human
gaaguccaagcauuuagaugua

SEQ ID NO: 3149413 - RNA, 12 nt, Human
gaaguccaagca

SEQ ID NO: 3149414 - RNA, 16 nt, Human
gaaguauccuucagcc

SEQ ID NO: 3149415 - RNA, 18 nt, Human
gaagucaucuugcuacca

SEQ ID NO: 3149416 - RNA, 15 nt, Human
gaagucaucuugcua

SEQ ID NO: 3149417 - RNA, 14 nt, Human
gaaguauccuucag

SEQ ID NO: 3149418 - RNA, 16 nt, Human
gaauauuuuaacuucc

SEQ ID NO: 3149419 - RNA, 19 nt, Human
gaauucugcuaccucacug

SEQ ID NO: 3149420 - RNA, 18 nt, Human
gaauucugcuaccucacu

SEQ ID NO: 3149421 - RNA, 13 nt, Human
gaagacuguggcu

SEQ ID NO: 3149422 - RNA, 17 nt, Human
gaagacugcauuauauu

SEQ ID NO: 3149423 - RNA, 11 nt, Human
gaagacugugg

SEQ ID NO: 3149424 - RNA, 12 nt, Human
gaagacuguggc

SEQ ID NO: 3149425 - RNA, 19 nt, Human
gaagacugcauuauauuua

SEQ ID NO: 3149426 - RNA, 12 nt, Human
gaagaacugaaa

SEQ ID NO: 3149427 - RNA, 18 nt, Human
gaagauguagaggagaaa

SEQ ID NO: 3149428 - RNA, 17 nt, Human
gaagauguagaggagaa

SEQ ID NO: 3149429 - RNA, 16 nt, Human
gaaauuguauuacaaa

SEQ ID NO: 3149430 - RNA, 20 nt, Human
gaacagugauuaccagggac

SEQ ID NO: 3149431 - RNA, 16 nt, Human
gaacagugauuaccag

SEQ ID NO: 3149432 - RNA, 18 nt, Human
gaacagccgcuccugucu

SEQ ID NO: 3149433 - RNA, 15 nt, Human
gaacauaaaauacaa

SEQ ID NO: 3149434 - RNA, 14 nt, Human
gaacaucacagcuu

SEQ ID NO: 3149435 - RNA, 24 nt, Human
gacugcauuauauuuauuacugua

SEQ ID NO: 3149436 - RNA, 16 nt, Human
gacugaggggagggga

SEQ ID NO: 3149437 - RNA, 22 nt, Human
gacuggauaguccgucucugcu

SEQ ID NO: 3149438 - RNA, 18 nt, Human
gacuggcacaguuuucug

SEQ ID NO: 3149439 - RNA, 22 nt, Human
gacuggcacaguuuucugagaa

SEQ ID NO: 3149440 - RNA, 14 nt, Human
gacuggcacaguuu

SEQ ID NO: 3149441 - RNA, 17 nt, Human
gacuggauaguccgucu

SEQ ID NO: 3149442 - RNA, 16 nt, Human
gacuggauaguccguc

SEQ ID NO: 3149443 - RNA, 22 nt, Human
gacuaaacuuuuuuucuguacc

SEQ ID NO: 3149444 - RNA, 20 nt, Human
gacuaaacuuuuuuucugua

SEQ ID NO: 3149445 - RNA, 19 nt, Human
gacuaaacuuuuuuucugu

SEQ ID NO: 3149446 - RNA, 18 nt, Human
gacuaaacuuuuuuucug

SEQ ID NO: 3149447 - RNA, 14 nt, Human
gacaucaacagaua

SEQ ID NO: 3149448 - RNA, 23 nt, Human
gacaggaugguucccuugaugaa

SEQ ID NO: 3149449 - RNA, 15 nt, Human
gacagcagcucaggc

SEQ ID NO: 3149450 - RNA, 16 nt, Human
gacagcagcucaggca

SEQ ID NO: 3149451 - RNA, 18 nt, Human
gacagcagcucaggcaca

SEQ ID NO: 3149452 - RNA, 20 nt, Human
gacagcagcucaggcacacu

SEQ ID NO: 3149453 - RNA, 13 nt, Human
gacagcagcucag

SEQ ID NO: 3149454 - RNA, 14 nt, Human
gacagcagcucagg

SEQ ID NO: 3149455 - RNA, 21 nt, Human
gacagagccccacccucagau

SEQ ID NO: 3149456 - RNA, 19 nt, Human
gacagagccccacccucag

SEQ ID NO: 3149457 - RNA, 23 nt, Human
gacccacuucacacacaggcaac

SEQ ID NO: 3149458 - RNA, 19 nt, Human
gacccaaaaggcagaagca

SEQ ID NO: 3149459 - RNA, 18 nt, Human
gacccaaaaggcagaagc

SEQ ID NO: 3149460 - RNA, 16 nt, Human
gaccacugcagaagac

SEQ ID NO: 3149461 - RNA, 17 nt, Human
gaguguguuugucaccg

SEQ ID NO: 3149462 - RNA, 22 nt, Human
gauaaauggcuuccuggcaaua

SEQ ID NO: 3149463 - RNA, 13 nt, Human
gauaaacaguagu

SEQ ID NO: 3149464 - RNA, 16 nt, Human
gauaaaagauggccau

SEQ ID NO: 3149465 - RNA, 13 nt, Human
gauaaaagauggc

SEQ ID NO: 3149466 - RNA, 23 nt, Human
gaucagcuuauugucuagugaaa

SEQ ID NO: 3149467 - RNA, 13 nt, Human
gauccuggaaauc

SEQ ID NO: 3149468 - RNA, 14 nt, Human
gauccuggaaauca

SEQ ID NO: 3149469 - RNA, 22 nt, Human
gcaacugaggcagacagcagcu

SEQ ID NO: 3149470 - RNA, 19 nt, Human
gcaacugaggcagacagca

SEQ ID NO: 3149471 - RNA, 21 nt, Human
gcaacugaggcagacagcagc

SEQ ID NO: 3149472 - RNA, 13 nt, Human
gcaacugaggcag

SEQ ID NO: 3149473 - RNA, 14 nt, Human
gcaacugaggcaga

SEQ ID NO: 3149474 - RNA, 15 nt, Human
gcaacugaggcagac

SEQ ID NO: 3149475 - RNA, 15 nt, Human
gcaagcacagcccuu

SEQ ID NO: 3149476 - RNA, 12 nt, Human
gcaagauguggg

SEQ ID NO: 3149477 - RNA, 16 nt, Human
gcaagaugugggcagu

SEQ ID NO: 3149478 - RNA, 16 nt, Human
gaugcuagaacucccu

SEQ ID NO: 3149479 - RNA, 22 nt, Human
gauuaaguaaugauaacuggaa

SEQ ID NO: 3149480 - RNA, 14 nt, Human
gauuaaguaaugau

SEQ ID NO: 3149481 - RNA, 17 nt, Human
gauuacaaaucagaagu

SEQ ID NO: 3149482 - RNA, 16 nt, Human
gauuacaaaucagaag

SEQ ID NO: 3149483 - RNA, 23 nt, Human
gauuacaaaucagaagucaucuu

SEQ ID NO: 3149484 - RNA, 21 nt, Human
gauuacaaaucagaagucauc

SEQ ID NO: 3149485 - RNA, 20 nt, Human
gauuacaaaucagaagucau

SEQ ID NO: 3149486 - RNA, 19 nt, Human
gauuacaaaucagaaguca

SEQ ID NO: 3149487 - RNA, 20 nt, Human
gcacagccucuuagaugcag

SEQ ID NO: 3149488 - RNA, 18 nt, Human
gcacagccucuuagaugc

SEQ ID NO: 3149489 - RNA, 14 nt, Human
gcagaagacaguau

SEQ ID NO: 3149490 - RNA, 15 nt, Human
gcacugucaagauga

SEQ ID NO: 3149491 - RNA, 21 nt, Human
gcagaguuacaguucuguggu

SEQ ID NO: 3149492 - RNA, 17 nt, Human
gcagagacaggaccuga

SEQ ID NO: 3149493 - RNA, 17 nt, Human
gcagaguuacaguucug

SEQ ID NO: 3149494 - RNA, 20 nt, Human
gcagaguuacaguucugugg

SEQ ID NO: 3149495 - RNA, 18 nt, Human
gcagaguuacaguucugu

SEQ ID NO: 3149496 - RNA, 13 nt, Human
gcaguucugaaga

SEQ ID NO: 3149497 - RNA, 18 nt, Human
gcauagauucccugagca

SEQ ID NO: 3149498 - RNA, 14 nt, Human
gcauagcucugggg

SEQ ID NO: 3149499 - RNA, 15 nt, Human
gcauagcucuggggu

SEQ ID NO: 3149500 - RNA, 16 nt, Human
gcagugcuuggcccag

SEQ ID NO: 3149501 - RNA, 15 nt, Human
gcaggcuacugucag

SEQ ID NO: 3149502 - RNA, 15 nt, Human
gccgaccucagccuu

SEQ ID NO: 3149503 - RNA, 17 nt, Human
gccgaccucagccuucc

SEQ ID NO: 3149504 - RNA, 12 nt, Human
gccgaccucagc

SEQ ID NO: 3149505 - RNA, 13 nt, Human
gccgaccucagcc

SEQ ID NO: 3149506 - RNA, 14 nt, Human
gccgaccucagccu

SEQ ID NO: 3149507 - RNA, 19 nt, Human
gcccuucuuuccacagaag

SEQ ID NO: 3149508 - RNA, 11 nt, Human
gccuccccucc

SEQ ID NO: 3149509 - RNA, 12 nt, Human
gccuccccuccu

SEQ ID NO: 3149510 - RNA, 13 nt, Human
gccuccccuccuc

SEQ ID NO: 3149511 - RNA, 14 nt, Human
gccuccccuccucu

SEQ ID NO: 3149512 - RNA, 22 nt, Human
gcgacagugagacucugucuca

SEQ ID NO: 3149513 - RNA, 18 nt, Human
gccuucggccuccauccu

SEQ ID NO: 3149514 - RNA, 18 nt, Human
gccuguaaucacagcuac

SEQ ID NO: 3149515 - RNA, 15 nt, Human
gccuggugggccucc

SEQ ID NO: 3149516 - RNA, 19 nt, Human
gcguccugucggagcccug

SEQ ID NO: 3149517 - RNA, 15 nt, Human
gcuaccaguauuuag

SEQ ID NO: 3149518 - RNA, 14 nt, Human
gcuaccaguauuua

SEQ ID NO: 3149519 - RNA, 13 nt, Human
gcuaccaguauuu

SEQ ID NO: 3149520 - RNA, 22 nt, Human
gcuaccaguauuuagaagccaa

SEQ ID NO: 3149521 - RNA, 21 nt, Human
gcuaccaguauuuagaagcca

SEQ ID NO: 3149522 - RNA, 19 nt, Human
gcuaccaguauuuagaagc

SEQ ID NO: 3149523 - RNA, 18 nt, Human
gcuaccaguauuuagaag

SEQ ID NO: 3149524 - RNA, 22 nt, Human
gcguccugucggagcccugucu

SEQ ID NO: 3149525 - RNA, 17 nt, Human
gccccgugggguuccuc

SEQ ID NO: 3149526 - RNA, 19 nt, Human
gccccugcacuccagccug

SEQ ID NO: 3149527 - RNA, 18 nt, Human
gcccucuccugggcagcu

SEQ ID NO: 3149528 - RNA, 19 nt, Human
gcccucuccugggcagcug

SEQ ID NO: 3149529 - RNA, 14 nt, Human
gcccucuccugggc

SEQ ID NO: 3149530 - RNA, 15 nt, Human
gcccucuccugggca

SEQ ID NO: 3149531 - RNA, 16 nt, Human
gcccucuccugggcag

SEQ ID NO: 3149532 - RNA, 16 nt, Human
gcccuccucugcacuc

SEQ ID NO: 3149533 - RNA, 12 nt, Human
gcccagggcuca

SEQ ID NO: 3149534 - RNA, 13 nt, Human
gcccagggcucag

SEQ ID NO: 3149535 - RNA, 14 nt, Human
gcccagggcucagc

SEQ ID NO: 3149536 - RNA, 15 nt, Human
gcccagggcucagcc

SEQ ID NO: 3149537 - RNA, 16 nt, Human
gcccagggcucagccu

SEQ ID NO: 3149538 - RNA, 17 nt, Human
gcccagggcucagccug

SEQ ID NO: 3149539 - RNA, 11 nt, Human
gccaucccucc

SEQ ID NO: 3149540 - RNA, 13 nt, Human
gccaucccucccu

SEQ ID NO: 3149541 - RNA, 14 nt, Human
gccaucccucccuc

SEQ ID NO: 3149542 - RNA, 22 nt, Human
gccauuuaaagcuuauuaaaac

SEQ ID NO: 3149543 - RNA, 19 nt, Human
gccaugggacagggaggac

SEQ ID NO: 3149544 - RNA, 14 nt, Human
gccaugggacaggg

SEQ ID NO: 3149545 - RNA, 15 nt, Human
gccaucccucccucc

SEQ ID NO: 3149546 - RNA, 16 nt, Human
gcccacagcuguauga

SEQ ID NO: 3149547 - RNA, 22 nt, Human
gccacguucuuacuaguuuccc

SEQ ID NO: 3149548 - RNA, 13 nt, Human
gccagcucucagc

SEQ ID NO: 3149549 - RNA, 14 nt, Human
gccagcucucagcc

SEQ ID NO: 3149550 - RNA, 15 nt, Human
gccagcucucagcca

SEQ ID NO: 3149551 - RNA, 23 nt, Human
gcuguucacagccagacuggcac

SEQ ID NO: 3149552 - RNA, 15 nt, Human
gcuguucacagccag

SEQ ID NO: 3149553 - RNA, 16 nt, Human
gcuguucacagccaga

SEQ ID NO: 3149554 - RNA, 16 nt, Human
gcuugccaucccuccc

SEQ ID NO: 3149555 - RNA, 19 nt, Human
gcuugcccuggugccucac

SEQ ID NO: 3149556 - RNA, 17 nt, Human
gcuugcccuggugccuc

SEQ ID NO: 3149557 - RNA, 18 nt, Human
gcuugccaucccucccuc

SEQ ID NO: 3149558 - RNA, 21 nt, Human
gcuugccaucccucccuccac

SEQ ID NO: 3149559 - RNA, 19 nt, Human
gcuuuacuccguaacagau

SEQ ID NO: 3149560 - RNA, 23 nt, Human
gcuuggcccaggaguuuggccag

SEQ ID NO: 3149561 - RNA, 13 nt, Human
gcuuggcccagga

SEQ ID NO: 3149562 - RNA, 22 nt, Human
gcuuggcccaggaguuuggcca

SEQ ID NO: 3149563 - RNA, 16 nt, Human
gcuuggcccaggaguu

SEQ ID NO: 3149564 - RNA, 15 nt, Human
gcuuggcccaggagu

SEQ ID NO: 3149565 - RNA, 14 nt, Human
gcuuggcccaggag

SEQ ID NO: 3149566 - RNA, 20 nt, Human
ggaaaaaauaacaaugaaag

SEQ ID NO: 3149567 - RNA, 17 nt, Human
gcuuuuaaaaaaaaaua

SEQ ID NO: 3149568 - RNA, 18 nt, Human
ggaaauauuuauuuuaau

SEQ ID NO: 3149569 - RNA, 17 nt, Human
ggaaauauuuauuuuaa

SEQ ID NO: 3149570 - RNA, 15 nt, Human
ggaaauauuuauuuu

SEQ ID NO: 3149571 - RNA, 13 nt, Human
ggaaauauuuauu

SEQ ID NO: 3149572 - RNA, 12 nt, Human
ggaaauauuuau

SEQ ID NO: 3149573 - RNA, 17 nt, Human
gcuagcacuuggagcca

SEQ ID NO: 3149574 - RNA, 18 nt, Human
gcuagauguauguacuuc

SEQ ID NO: 3149575 - RNA, 16 nt, Human
gcuagauguauguacu

SEQ ID NO: 3149576 - RNA, 20 nt, Human
gcugcuagcacuuggagcca

SEQ ID NO: 3149577 - RNA, 23 nt, Human
gcugcuagcacuuggagccaagg

SEQ ID NO: 3149578 - RNA, 19 nt, Human
gcugcuagcacuuggagcc

SEQ ID NO: 3149579 - RNA, 22 nt, Human
gcuguauuuuaaaagaaugauu

SEQ ID NO: 3149580 - RNA, 13 nt, Human
ggcaacugaggca

SEQ ID NO: 3149581 - RNA, 14 nt, Human
ggcaacugaggcag

SEQ ID NO: 3149582 - RNA, 15 nt, Human
ggcaacugaggcaga

SEQ ID NO: 3149583 - RNA, 23 nt, Human
ggcaacugaggcagacagcagcu

SEQ ID NO: 3149584 - RNA, 19 nt, Human
ggcaacugaggcagacagc

SEQ ID NO: 3149585 - RNA, 20 nt, Human
ggcaacugaggcagacagca

SEQ ID NO: 3149586 - RNA, 16 nt, Human
ggcagcugccuccccu

SEQ ID NO: 3149587 - RNA, 22 nt, Human
ggcagcugccuccccuccucug

SEQ ID NO: 3149588 - RNA, 18 nt, Human
ggcagcugccuccccucc

SEQ ID NO: 3149589 - RNA, 21 nt, Human
ggcagcugccuccccuccucu

SEQ ID NO: 3149590 - RNA, 22 nt, Human
ggccaugggacagggaggacgc

SEQ ID NO: 3149591 - RNA, 20 nt, Human
ggaaggaggguuagggaggg

SEQ ID NO: 3149592 - RNA, 14 nt, Human
ggacccagggauga

SEQ ID NO: 3149593 - RNA, 23 nt, Human
ggagcccugucuccucucucugu

SEQ ID NO: 3149594 - RNA, 14 nt, Human
ggagaggggcagaa

SEQ ID NO: 3149595 - RNA, 19 nt, Human
ggaggacgcucucuggccu

SEQ ID NO: 3149596 - RNA, 21 nt, Human
ggaggacgcucucuggccuuc

SEQ ID NO: 3149597 - RNA, 20 nt, Human
ggaggacgcucucuggccuu

SEQ ID NO: 3149598 - RNA, 13 nt, Human
gguuagggagggg

SEQ ID NO: 3149599 - RNA, 15 nt, Human
gguuagggaggggua

SEQ ID NO: 3149600 - RNA, 21 nt, Human
ggugcuacaaaaacacagcaa

SEQ ID NO: 3149601 - RNA, 23 nt, Human
ggugcuacaaaaacacagcaagg

SEQ ID NO: 3149602 - RNA, 22 nt, Human
ggguaaaauuccuuagcuuaga

SEQ ID NO: 3149603 - RNA, 23 nt, Human
ggggcagugcuuggcccaggagu

SEQ ID NO: 3149604 - RNA, 21 nt, Human
ggggcagugcuuggcccagga

SEQ ID NO: 3149605 - RNA, 13 nt, Human
ggggcagaacagc

SEQ ID NO: 3149606 - RNA, 21 nt, Human
gggugccccccuugccagaca

SEQ ID NO: 3149607 - RNA, 19 nt, Human
ggguucagagacucagggc

SEQ ID NO: 3149608 - RNA, 22 nt, Human
ggucaggagaggggcagaacag

SEQ ID NO: 3149609 - RNA, 22 nt, Human
gggcagugcuuggcccaggagu

SEQ ID NO: 3149610 - RNA, 20 nt, Human
gggcagugcuuggcccagga

SEQ ID NO: 3149611 - RNA, 19 nt, Human
gggcagugcuuggcccagg

SEQ ID NO: 3149612 - RNA, 18 nt, Human
gggcagugcuuggcccag

SEQ ID NO: 3149613 - RNA, 23 nt, Human
gggcagugcuuggcccaggaguu

SEQ ID NO: 3149614 - RNA, 13 nt, Human
gggcccugagcuc

SEQ ID NO: 3149615 - RNA, 22 nt, Human
gggcccugagcucgguggaccc

SEQ ID NO: 3149616 - RNA, 12 nt, Human
gggcccugagcu

SEQ ID NO: 3149617 - RNA, 22 nt, Human
gggcagaacagccgcuccuguc

SEQ ID NO: 3149618 - RNA, 14 nt, Human
gggaauugaggaca

SEQ ID NO: 3149619 - RNA, 22 nt, Human
ggcuugaguuuaaauuguaaua

SEQ ID NO: 3149620 - RNA, 16 nt, Human
ggcuuagacccucaug

SEQ ID NO: 3149621 - RNA, 18 nt, Human
caaggaaaaaauaacaau

SEQ ID NO: 3149622 - RNA, 21 nt, Human
caauauccuaauaaaaaggug

SEQ ID NO: 3149623 - RNA, 19 nt, Human
caauagucaaauuguguga

SEQ ID NO: 3149624 - RNA, 17 nt, Human
caauagucaaauugugu

SEQ ID NO: 3149625 - RNA, 23 nt, Human
caagggugaugggaaagcauugu

SEQ ID NO: 3149626 - RNA, 21 nt, Human
caagggugaugggaaagcauu

SEQ ID NO: 3149627 - RNA, 22 nt, Human
caaggcuuagacccucaugcug

SEQ ID NO: 3149628 - RNA, 19 nt, Human
caaggcuuagacccucaug

SEQ ID NO: 3149629 - RNA, 18 nt, Human
caaggcuuagacccucau

SEQ ID NO: 3149630 - RNA, 18 nt, Human
cacaagaaaugaaagcag

SEQ ID NO: 3149631 - RNA, 20 nt, Human
cacaagaaaugaaagcaggg

SEQ ID NO: 3149632 - RNA, 22 nt, Human
caauauccuaauaaaaagguga

SEQ ID NO: 3149633 - RNA, 22 nt, Human
caauuuuucuuauuucauuucu

SEQ ID NO: 3149634 - RNA, 23 nt, Human
cacagcccuuaugcgguuaauuu

SEQ ID NO: 3149635 - RNA, 17 nt, Human
cacagccagacuggcac

SEQ ID NO: 3149636 - RNA, 18 nt, Human
cacagccagacuggcaca

SEQ ID NO: 3149637 - RNA, 19 nt, Human
cacagcaguugaaaagacu

SEQ ID NO: 3149638 - RNA, 21 nt, Human
cacagcaguugaaaagacucc

SEQ ID NO: 3149639 - RNA, 13 nt, Human
cacacugaagaag

SEQ ID NO: 3149640 - RNA, 18 nt, Human
caaauguucaucaaugaa

SEQ ID NO: 3149641 - RNA, 14 nt, Human
caaauguucaucaa

SEQ ID NO: 3149642 - RNA, 13 nt, Human
caaauaugcaaag

SEQ ID NO: 3149643 - RNA, 12 nt, Human
caaauaugcaaa

SEQ ID NO: 3149644 - RNA, 19 nt, Human
caagaaaugaaagcaggga

SEQ ID NO: 3149645 - RNA, 17 nt, Human
caagaaaugaaagcagg

SEQ ID NO: 3149646 - RNA, 15 nt, Human
caagaaaugaaagca

SEQ ID NO: 3149647 - RNA, 14 nt, Human
caaaacugcacugu

SEQ ID NO: 3149648 - RNA, 17 nt, Human
caaaacugcacugucaa

SEQ ID NO: 3149649 - RNA, 18 nt, Human
caaaacugcacugucaag

SEQ ID NO: 3149650 - RNA, 16 nt, Human
caaacugacucuuaag

SEQ ID NO: 3149651 - RNA, 15 nt, Human
caaacugaagccaga

SEQ ID NO: 3149652 - RNA, 14 nt, Human
caaacugaagccag

SEQ ID NO: 3149653 - RNA, 21 nt, Human
caaacugacucuuaagaagac

SEQ ID NO: 3149654 - RNA, 17 nt, Human
caaacugacucuuaaga

SEQ ID NO: 3149655 - RNA, 18 nt, Human
cacagugcucuuuucucc

SEQ ID NO: 3149656 - RNA, 16 nt, Human
cacagugcucuuuucu

SEQ ID NO: 3149657 - RNA, 14 nt, Human
cucccugcaauaaa

SEQ ID NO: 3149658 - RNA, 16 nt, Human
cucccugcaauaaaau

SEQ ID NO: 3149659 - RNA, 17 nt, Human
cucagucucucuucucu

SEQ ID NO: 3149660 - RNA, 12 nt, Human
cucagucucucu

SEQ ID NO: 3149661 - RNA, 19 nt, Human
cucagucucucuucucucc

SEQ ID NO: 3149662 - RNA, 12 nt, Human
cucaugcugcca

SEQ ID NO: 3149663 - RNA, 22 nt, Human
cucaugcugccaauauccuaau

SEQ ID NO: 3149664 - RNA, 14 nt, Human
cucaugcugccaau

SEQ ID NO: 3149665 - RNA, 16 nt, Human
cucagccugugcugcc

SEQ ID NO: 3149666 - RNA, 18 nt, Human
cucagccugugcugcccg

SEQ ID NO: 3149667 - RNA, 22 nt, Human
cucagccuuccccuugcccagg

SEQ ID NO: 3149668 - RNA, 23 nt, Human
cucagccuuccccuugcccaggg

SEQ ID NO: 3149669 - RNA, 12 nt, Human
cucagccuggug

SEQ ID NO: 3149670 - RNA, 16 nt, Human
cucagccuggugggcc

SEQ ID NO: 3149671 - RNA, 18 nt, Human
cucagccuggugggccuc

SEQ ID NO: 3149672 - RNA, 19 nt, Human
cucagccuggugggccucc

SEQ ID NO: 3149673 - RNA, 20 nt, Human
cucagccuggugggccuccu

SEQ ID NO: 3149674 - RNA, 13 nt, Human
cucagccugugcu

SEQ ID NO: 3149675 - RNA, 14 nt, Human
cucagccugugcug

SEQ ID NO: 3149676 - RNA, 11 nt, Human
cucucagccaa

SEQ ID NO: 3149677 - RNA, 23 nt, Human
cucucagccaacgaguaauuuau

SEQ ID NO: 3149678 - RNA, 12 nt, Human
cucucuggccuu

SEQ ID NO: 3149679 - RNA, 11 nt, Human
cucucuggccu

SEQ ID NO: 3149680 - RNA, 15 nt, Human
cucuuagaugcaguu

SEQ ID NO: 3149681 - RNA, 23 nt, Human
cucugcacucccaccugacacac

SEQ ID NO: 3149682 - RNA, 20 nt, Human
cucugcacucccaccugaca

SEQ ID NO: 3149683 - RNA, 19 nt, Human
cucugcacucccaccugac

SEQ ID NO: 3149684 - RNA, 20 nt, Human
cucuuagaugcaguucugaa

SEQ ID NO: 3149685 - RNA, 14 nt, Human
cuaacuggacuggu

SEQ ID NO: 3149686 - RNA, 15 nt, Human
cuacaugagguacug

SEQ ID NO: 3149687 - RNA, 23 nt, Human
cuaagugaaauaagccagacauc

SEQ ID NO: 3149688 - RNA, 20 nt, Human
cuaagugaaauaagccagac

SEQ ID NO: 3149689 - RNA, 16 nt, Human
cuagcaugaagacaga

SEQ ID NO: 3149690 - RNA, 13 nt, Human
cuagaacucccuu

SEQ ID NO: 3149691 - RNA, 19 nt, Human
cuagaacucccuuucaaca

SEQ ID NO: 3149692 - RNA, 18 nt, Human
cuagaacucccuuucaac

SEQ ID NO: 3149693 - RNA, 17 nt, Human
cuagaacucccuuucaa

SEQ ID NO: 3149694 - RNA, 16 nt, Human
cuagaacucccuuuca

SEQ ID NO: 3149695 - RNA, 13 nt, Human
cuagccgaccuca

SEQ ID NO: 3149696 - RNA, 14 nt, Human
cuagccgaccucag

SEQ ID NO: 3149697 - RNA, 15 nt, Human
cuagccgaccucagc

SEQ ID NO: 3149698 - RNA, 16 nt, Human
cuagccgaccucagcc

SEQ ID NO: 3149699 - RNA, 17 nt, Human
cuagccgaccucagccu

SEQ ID NO: 3149700 - RNA, 18 nt, Human
cuagccgaccucagccuu

SEQ ID NO: 3149701 - RNA, 19 nt, Human
cuagccgaccucagccuuc

SEQ ID NO: 3149702 - RNA, 20 nt, Human
cuagccgaccucagccuucc

SEQ ID NO: 3149703 - RNA, 23 nt, Human
cuaguugaucagcuuauugucua

SEQ ID NO: 3149704 - RNA, 22 nt, Human
cggagccucauccgaggcaggg

SEQ ID NO: 3149705 - RNA, 20 nt, Human
cggagccucauccgaggcag

SEQ ID NO: 3149706 - RNA, 21 nt, Human
cggagccucauccgaggcagg

SEQ ID NO: 3149707 - RNA, 12 nt, Human
cgaccucagccu

SEQ ID NO: 3149708 - RNA, 13 nt, Human
cgaccucagccuu

SEQ ID NO: 3149709 - RNA, 14 nt, Human
cgaccucagccuuc

SEQ ID NO: 3149710 - RNA, 15 nt, Human
cgaccucagccuucc

SEQ ID NO: 3149711 - RNA, 13 nt, Human
ccuuuuucauuua

SEQ ID NO: 3149712 - RNA, 16 nt, Human
cgacagugagacucug

SEQ ID NO: 3149713 - RNA, 15 nt, Human
cgacagugagacucu

SEQ ID NO: 3149714 - RNA, 15 nt, Human
ccuugcccagggcuc

SEQ ID NO: 3149715 - RNA, 16 nt, Human
ccuugcccagggcuca

SEQ ID NO: 3149716 - RNA, 17 nt, Human
ccuugcccagggcucag

SEQ ID NO: 3149717 - RNA, 18 nt, Human
ccuugcccagggcucagc

SEQ ID NO: 3149718 - RNA, 13 nt, Human
ccuugcccagggc

SEQ ID NO: 3149719 - RNA, 23 nt, Human
cccauuguggucacaggaaguag

SEQ ID NO: 3149720 - RNA, 22 nt, Human
cccauuguggucacaggaagua

SEQ ID NO: 3149721 - RNA, 11 nt, Human
ccccagcacua

SEQ ID NO: 3149722 - RNA, 19 nt, Human
ccccagcacuaaagcagug

SEQ ID NO: 3149723 - RNA, 23 nt, Human
cccgggaggcagagguugcagug

SEQ ID NO: 3149724 - RNA, 23 nt, Human
ccccuugcccagggcucagccug

SEQ ID NO: 3149725 - RNA, 17 nt, Human
ccccuugcccagggcuc

SEQ ID NO: 3149726 - RNA, 20 nt, Human
ccccuugcccagggcucagc

SEQ ID NO: 3149727 - RNA, 21 nt, Human
ccccuugcccagggcucagcc

SEQ ID NO: 3149728 - RNA, 22 nt, Human
ccccuuuucggccccauguauc

SEQ ID NO: 3149729 - RNA, 17 nt, Human
cccagccagcaguucag

SEQ ID NO: 3149730 - RNA, 20 nt, Human
cccagccagcaguucagagc

SEQ ID NO: 3149731 - RNA, 16 nt, Human
cccagccagcaguuca

SEQ ID NO: 3149732 - RNA, 15 nt, Human
ccagauccuggaaau

SEQ ID NO: 3149733 - RNA, 15 nt, Human
ccagcagccagcucu

SEQ ID NO: 3149734 - RNA, 16 nt, Human
ccagcagccagcucuc

SEQ ID NO: 3149735 - RNA, 18 nt, Human
ccagcagccagcucucag

SEQ ID NO: 3149736 - RNA, 19 nt, Human
ccagcagccagcucucagc

SEQ ID NO: 3149737 - RNA, 20 nt, Human
ccagcagccagcucucagcc

SEQ ID NO: 3149738 - RNA, 21 nt, Human
ccaguuauggcuauaggugcu

SEQ ID NO: 3149739 - RNA, 13 nt, Human
ccucugcuugcca

SEQ ID NO: 3149740 - RNA, 13 nt, Human
cccuucucuguau

SEQ ID NO: 3149741 - RNA, 14 nt, Human
ccgaccucagccuu

SEQ ID NO: 3149742 - RNA, 15 nt, Human
ccgaccucagccuuc

SEQ ID NO: 3149743 - RNA, 12 nt, Human
ccgaccucagcc

SEQ ID NO: 3149744 - RNA, 13 nt, Human
ccgaccucagccu

SEQ ID NO: 3149745 - RNA, 24 nt, Human
ccguagacgugcacgcacacuguc

SEQ ID NO: 3149746 - RNA, 16 nt, Human
ccguagguuauuuuca

SEQ ID NO: 3149747 - RNA, 16 nt, Human
ccgucuggcccaccag

SEQ ID NO: 3149748 - RNA, 18 nt, Human
ccgucuggcccaccaggg

SEQ ID NO: 3149749 - RNA, 17 nt, Human
ccgucuggcccaccagg

SEQ ID NO: 3149750 - RNA, 15 nt, Human
ccucauguccacugg

SEQ ID NO: 3149751 - RNA, 20 nt, Human
ccucauguccacugguucuu

SEQ ID NO: 3149752 - RNA, 23 nt, Human
ccucccagaggagccaccaguuc

SEQ ID NO: 3149753 - RNA, 14 nt, Human
cacugggggagggg

SEQ ID NO: 3149754 - RNA, 15 nt, Human
cacugggggagggga

SEQ ID NO: 3149755 - RNA, 18 nt, Human
cacugggggaggggacau

SEQ ID NO: 3149756 - RNA, 21 nt, Human
cacugggggaggggacauuga

SEQ ID NO: 3149757 - RNA, 21 nt, Human
cacugcagaagacaguauggc

SEQ ID NO: 3149758 - RNA, 22 nt, Human
cacugguucuucuuggucucag

SEQ ID NO: 3149759 - RNA, 15 nt, Human
cacugggguccuggg

SEQ ID NO: 3149760 - RNA, 18 nt, Human
cacugggguccuggggcc

SEQ ID NO: 3149761 - RNA, 19 nt, Human
cacuuguguuuugcaagcc

SEQ ID NO: 3149762 - RNA, 16 nt, Human
cacuugucaauaaaau

SEQ ID NO: 3149763 - RNA, 22 nt, Human
cacuuguguuuugcaagccaga

SEQ ID NO: 3149764 - RNA, 17 nt, Human
cacuuguguuuugcaag

SEQ ID NO: 3149765 - RNA, 20 nt, Human
cacuagggcagggacaggau

SEQ ID NO: 3149766 - RNA, 21 nt, Human
cacuagggcagggacaggaua

SEQ ID NO: 3149767 - RNA, 15 nt, Human
caauucuugccaaau

SEQ ID NO: 3149768 - RNA, 15 nt, Human
caaugcuguauuuua

SEQ ID NO: 3149769 - RNA, 17 nt, Human
caaugcuguauuuuaaa

SEQ ID NO: 3149770 - RNA, 16 nt, Human
caaugcuguauuuuaa

SEQ ID NO: 3149771 - RNA, 18 nt, Human
cacaagacugcacaucaa

SEQ ID NO: 3149772 - RNA, 13 nt, Human
cacacaggcaacu

SEQ ID NO: 3149773 - RNA, 20 nt, Human
cacacaggcaacugaggcag

SEQ ID NO: 3149774 - RNA, 16 nt, Human
cacacaggcaacugag

SEQ ID NO: 3149775 - RNA, 19 nt, Human
cacacaggcaacugaggca

SEQ ID NO: 3149776 - RNA, 22 nt, Human
cacacaugaaguccaagcauuu

SEQ ID NO: 3149777 - RNA, 17 nt, Human
cacacaugaaguccaag

SEQ ID NO: 3149778 - RNA, 17 nt, Human
cacagccucuuagaugc

SEQ ID NO: 3149779 - RNA, 21 nt, Human
cacagccucuuagaugcaguu

SEQ ID NO: 3149780 - RNA, 14 nt, Human
caaguccaagcaua

SEQ ID NO: 3149781 - RNA, 23 nt, Human
auuguaauaggcguaacuaauuu

SEQ ID NO: 3149782 - RNA, 14 nt, Human
auuguaaaauggug

SEQ ID NO: 3149783 - RNA, 13 nt, Human
auuguaaaauggu

SEQ ID NO: 3149784 - RNA, 23 nt, Human
auuacaaaucagaagucaucuug

SEQ ID NO: 3149785 - RNA, 22 nt, Human
auuacaaaucagaagucaucuu

SEQ ID NO: 3149786 - RNA, 21 nt, Human
auuacaaaucagaagucaucu

SEQ ID NO: 3149787 - RNA, 19 nt, Human
auuacaaaucagaagucau

SEQ ID NO: 3149788 - RNA, 18 nt, Human
auuacaaaucagaaguca

SEQ ID NO: 3149789 - RNA, 16 nt, Human
auuacaaaucagaagu

SEQ ID NO: 3149790 - RNA, 14 nt, Human
auuacaaaucagaa

SEQ ID NO: 3149791 - RNA, 22 nt, Human
auuaugaauuacauuuguauaa

SEQ ID NO: 3149792 - RNA, 18 nt, Human
auuaugaauuacauuugu

SEQ ID NO: 3149793 - RNA, 19 nt, Human
auucacaagacccaaaagg

SEQ ID NO: 3149794 - RNA, 17 nt, Human
auuaugaauuacauuug

SEQ ID NO: 3149795 - RNA, 14 nt, Human
auuaugaauuacau

SEQ ID NO: 3149796 - RNA, 16 nt, Human
auuagggagagaagau

SEQ ID NO: 3149797 - RNA, 22 nt, Human
auucauagcagcuuauucacaa

SEQ ID NO: 3149798 - RNA, 19 nt, Human
auucauagcagcuuauuca

SEQ ID NO: 3149799 - RNA, 20 nt, Human
auucacagugcucuuuucuc

SEQ ID NO: 3149800 - RNA, 19 nt, Human
auucacagugcucuuuucu

SEQ ID NO: 3149801 - RNA, 21 nt, Human
auucacagugcucuuuucucc

SEQ ID NO: 3149802 - RNA, 17 nt, Human
auuuuauagcuacuaau

SEQ ID NO: 3149803 - RNA, 19 nt, Human
auuuuauagcuacuaauuu

SEQ ID NO: 3149804 - RNA, 15 nt, Human
auuuggaaauaaagu

SEQ ID NO: 3149805 - RNA, 22 nt, Human
auuuggaaauaaagucagaugg

SEQ ID NO: 3149806 - RNA, 17 nt, Human
auuuggaaauaaaguca

SEQ ID NO: 3149807 - RNA, 17 nt, Human
auuugcucauggaauug

SEQ ID NO: 3149808 - RNA, 14 nt, Human
auuugcucauggaa

SEQ ID NO: 3149809 - RNA, 13 nt, Human
caaacccaguguu

SEQ ID NO: 3149810 - RNA, 20 nt, Human
caaaaaaaaaaaaaaauuag

SEQ ID NO: 3149811 - RNA, 15 nt, Human
caaaaggcagaagca

SEQ ID NO: 3149812 - RNA, 15 nt, Human
caacacgagcaggcu

SEQ ID NO: 3149813 - RNA, 23 nt, Human
caacacgagcaggcuacugucag

SEQ ID NO: 3149814 - RNA, 20 nt, Human
caaagcacugacuucuaagu

SEQ ID NO: 3149815 - RNA, 22 nt, Human
caaagcacugacuucuaaguaa

SEQ ID NO: 3149816 - RNA, 19 nt, Human
cagccccgugggguuccuc

SEQ ID NO: 3149817 - RNA, 23 nt, Human
cagccugagcgacagugagacuc

SEQ ID NO: 3149818 - RNA, 22 nt, Human
cagccugagcgacagugagacu

SEQ ID NO: 3149819 - RNA, 21 nt, Human
cagcaguucagagcugcccuc

SEQ ID NO: 3149820 - RNA, 22 nt, Human
cagcaguucagagcugcccucu

SEQ ID NO: 3149821 - RNA, 18 nt, Human
cagcaguucagagcugcc

SEQ ID NO: 3149822 - RNA, 19 nt, Human
cagcaguucagagcugccc

SEQ ID NO: 3149823 - RNA, 20 nt, Human
cagcaguucagagcugcccu

SEQ ID NO: 3149824 - RNA, 20 nt, Human
cagccagacuggcacaguuu

SEQ ID NO: 3149825 - RNA, 22 nt, Human
cagcacagccucuuagaugcag

SEQ ID NO: 3149826 - RNA, 14 nt, Human
cagccagcagccag

SEQ ID NO: 3149827 - RNA, 12 nt, Human
cagccagcagcc

SEQ ID NO: 3149828 - RNA, 11 nt, Human
cagccagcagc

SEQ ID NO: 3149829 - RNA, 23 nt, Human
cagagcugcccucuccugggcag

SEQ ID NO: 3149830 - RNA, 17 nt, Human
caguauuuagaagccaa

SEQ ID NO: 3149831 - RNA, 16 nt, Human
caguauuuagaagcca

SEQ ID NO: 3149832 - RNA, 19 nt, Human
cagggaggacgcucucugg

SEQ ID NO: 3149833 - RNA, 22 nt, Human
cagggaggacgcucucuggccu

SEQ ID NO: 3149834 - RNA, 15 nt, Human
cagggcucagccugg

SEQ ID NO: 3149835 - RNA, 16 nt, Human
cagggcucagccuggu

SEQ ID NO: 3149836 - RNA, 19 nt, Human
cagggcucagccugguggg

SEQ ID NO: 3149837 - RNA, 16 nt, Human
cagcuuauucacaaga

SEQ ID NO: 3149838 - RNA, 17 nt, Human
cagcuguggcagaguua

SEQ ID NO: 3149839 - RNA, 23 nt, Human
cagcuguggcagaguuacaguuc

SEQ ID NO: 3149840 - RNA, 19 nt, Human
cagcuguggcagaguuaca

SEQ ID NO: 3149841 - RNA, 21 nt, Human
caggaaaucaaauaugcaaag

SEQ ID NO: 3149842 - RNA, 19 nt, Human
caggaaaucaaauaugcaa

SEQ ID NO: 3149843 - RNA, 24 nt, Human
caggacagcccuucuuuccacaga

SEQ ID NO: 3149844 - RNA, 23 nt, Human
caggacagcccuucuuuccacag

SEQ ID NO: 3149845 - RNA, 21 nt, Human
caugcugccaauauccuaaua

SEQ ID NO: 3149846 - RNA, 19 nt, Human
caugcugccaauauccuaa

SEQ ID NO: 3149847 - RNA, 17 nt, Human
caugcugccaauauccu

SEQ ID NO: 3149848 - RNA, 15 nt, Human
caugcugccaauauc

SEQ ID NO: 3149849 - RNA, 16 nt, Human
caugaauuaguuuuau

SEQ ID NO: 3149850 - RNA, 20 nt, Human
caucagcuugcccuguuaaa

SEQ ID NO: 3149851 - RNA, 17 nt, Human
caucagcugcugaaaca

SEQ ID NO: 3149852 - RNA, 18 nt, Human
caucagcugcugaaacaa

SEQ ID NO: 3149853 - RNA, 15 nt, Human
caucagcugcugaaa

SEQ ID NO: 3149854 - RNA, 13 nt, Human
caucagcugcuga

SEQ ID NO: 3149855 - RNA, 17 nt, Human
cauagauucccugagca

SEQ ID NO: 3149856 - RNA, 18 nt, Human
cauagauucccugagcag

SEQ ID NO: 3149857 - RNA, 20 nt, Human
cauagcagcuuauucacaag

SEQ ID NO: 3149858 - RNA, 18 nt, Human
ccaaauguucaucaauga

SEQ ID NO: 3149859 - RNA, 22 nt, Human
ccaacuacuaauagaauaaagg

SEQ ID NO: 3149860 - RNA, 14 nt, Human
ccaacuacuaauag

SEQ ID NO: 3149861 - RNA, 14 nt, Human
ccaacuaugauuau

SEQ ID NO: 3149862 - RNA, 15 nt, Human
cauuaggauggcuag

SEQ ID NO: 3149863 - RNA, 16 nt, Human
ccaaaaauaaauauau

SEQ ID NO: 3149864 - RNA, 18 nt, Human
gcuacaaaaacacagcaa

SEQ ID NO: 3149865 - RNA, 19 nt, Human
gcuacaaaaacacagcaag

SEQ ID NO: 3149866 - RNA, 17 nt, Human
gcuacaaaaacacagca

SEQ ID NO: 3149867 - RNA, 15 nt, Human
gcuacugucagcucc

SEQ ID NO: 3149868 - RNA, 17 nt, Human
gcuacuugggaggcuga

SEQ ID NO: 3149869 - RNA, 20 nt, Human
gccuccauccugaggcucca

SEQ ID NO: 3149870 - RNA, 16 nt, Human
gccuccauccugaggc

SEQ ID NO: 3149871 - RNA, 15 nt, Human
gccuccauccugagg

SEQ ID NO: 3149872 - RNA, 20 nt, Human
gccagcaguucagagcugcc

SEQ ID NO: 3149873 - RNA, 16 nt, Human
gccagccagcagccag

SEQ ID NO: 3149874 - RNA, 19 nt, Human
gccagccagcagccagcuc

SEQ ID NO: 3149875 - RNA, 13 nt, Human
gccagcaguucag

SEQ ID NO: 3149876 - RNA, 14 nt, Human
gccagcaguucaga

SEQ ID NO: 3149877 - RNA, 19 nt, Human
gccagcaguucagagcugc

SEQ ID NO: 3149878 - RNA, 22 nt, Human
gccaguuauggcuauaggugcu

SEQ ID NO: 3149879 - RNA, 15 nt, Human
gccccacccucagau

SEQ ID NO: 3149880 - RNA, 18 nt, Human
gccccacccucagaugca

SEQ ID NO: 3149881 - RNA, 21 nt, Human
gcccuagagcacacuguagca

SEQ ID NO: 3149882 - RNA, 17 nt, Human
gcccaggaguuuggcca

SEQ ID NO: 3149883 - RNA, 22 nt, Human
gccaugugcuaguaauuggaaa

SEQ ID NO: 3149884 - RNA, 13 nt, Human
gcccaggaguuug

SEQ ID NO: 3149885 - RNA, 16 nt, Human
gcccaggaguuuggcc

SEQ ID NO: 3149886 - RNA, 15 nt, Human
gcccaggaguuuggc

SEQ ID NO: 3149887 - RNA, 16 nt, Human
gcugaaacaacaaaua

SEQ ID NO: 3149888 - RNA, 12 nt, Human
gcugaacaucac

SEQ ID NO: 3149889 - RNA, 15 nt, Human
gcucugcccauccug

SEQ ID NO: 3149890 - RNA, 21 nt, Human
gcucugcccauccugccccug

SEQ ID NO: 3149891 - RNA, 20 nt, Human
gcuccacuuggucugugaga

SEQ ID NO: 3149892 - RNA, 19 nt, Human
gcuccacuuggucugugag

SEQ ID NO: 3149893 - RNA, 11 nt, Human
gcucucagcca

SEQ ID NO: 3149894 - RNA, 17 nt, Human
gcucucagccaacgagu

SEQ ID NO: 3149895 - RNA, 10 nt, Human
gcucucagcc

SEQ ID NO: 3149896 - RNA, 19 nt, Human
gcuuccuggcaauagucaa

SEQ ID NO: 3149897 - RNA, 13 nt, Human
gcuguauuuuaaa

SEQ ID NO: 3149898 - RNA, 12 nt, Human
gcuguauuuuaa

SEQ ID NO: 3149899 - RNA, 17 nt, Human
gcuuauuuccucauuuu

SEQ ID NO: 3149900 - RNA, 15 nt, Human
ggaaaauucauuuuu

SEQ ID NO: 3149901 - RNA, 13 nt, Human
ggaguuuggccag

SEQ ID NO: 3149902 - RNA, 15 nt, Human
ggaguuuggccagaa

SEQ ID NO: 3149903 - RNA, 14 nt, Human
ggaguuuggccaga

SEQ ID NO: 3149904 - RNA, 12 nt, Human
ggauggcaagau

SEQ ID NO: 3149905 - RNA, 15 nt, Human
ggagccaccaguucu

SEQ ID NO: 3149906 - RNA, 14 nt, Human
ggagccaccaguuc

SEQ ID NO: 3149907 - RNA, 23 nt, Human
ggagccaaggguucagagacuca

SEQ ID NO: 3149908 - RNA, 15 nt, Human
ggccuuuuucauuua

SEQ ID NO: 3149909 - RNA, 23 nt, Human
ggccuucggccuccauccugagg

SEQ ID NO: 3149910 - RNA, 22 nt, Human
ggccuucggccuccauccugag

SEQ ID NO: 3149911 - RNA, 10 nt, Human
ggcucagccu

SEQ ID NO: 3149912 - RNA, 12 nt, Human
ggcucagccugg

SEQ ID NO: 3149913 - RNA, 11 nt, Human
ggcucagccug

SEQ ID NO: 3149914 - RNA, 20 nt, Human
ggcccaggaguuuggccaga

SEQ ID NO: 3149915 - RNA, 19 nt, Human
ggcccaggaguuuggccag

SEQ ID NO: 3149916 - RNA, 18 nt, Human
ggcccaggaguuuggcca

SEQ ID NO: 3149917 - RNA, 13 nt, Human
ggcccaggaguuu

SEQ ID NO: 3149918 - RNA, 11 nt, Human
ggcccaggagu

SEQ ID NO: 3149919 - RNA, 15 nt, Human
ggcauagcucugggg

SEQ ID NO: 3149920 - RNA, 13 nt, Human
ggcauagcucugg

SEQ ID NO: 3149921 - RNA, 17 nt, Human
gggauuguaaaauggug

SEQ ID NO: 3149922 - RNA, 16 nt, Human
gggauuguaaaauggu

SEQ ID NO: 3149923 - RNA, 17 nt, Human
gggauugaaggaugcug

SEQ ID NO: 3149924 - RNA, 20 nt, Human
gggaaggaggguuagggagg

SEQ ID NO: 3149925 - RNA, 19 nt, Human
gggacauuugcucauggaa

SEQ ID NO: 3149926 - RNA, 21 nt, Human
gggacauuugcucauggaauu

SEQ ID NO: 3149927 - RNA, 20 nt, Human
gggacauuugcucauggaau

SEQ ID NO: 3149928 - RNA, 17 nt, Human
aaaagaugaaaauauuu

SEQ ID NO: 3149929 - RNA, 13 nt, Human
aaaacucauuuuu

SEQ ID NO: 3149930 - RNA, 13 nt, Human
aaaaccacagcag

SEQ ID NO: 3149931 - RNA, 12 nt, Human
aaaaccacagca

SEQ ID NO: 3149932 - RNA, 22 nt, Human
aaaaauggaacauaaaauacaa

SEQ ID NO: 3149933 - RNA, 15 nt, Human
aaaaugugauaugua

SEQ ID NO: 3149934 - RNA, 22 nt, Human
aaaauuuuuucucuaggaaaua

SEQ ID NO: 3149935 - RNA, 20 nt, Human
aaacaagcacuaaacaaaga

SEQ ID NO: 3149936 - RNA, 20 nt, Human
aaacagucucaggaaaucaa

SEQ ID NO: 3149937 - RNA, 15 nt, Human
gggcgugguggugag

SEQ ID NO: 3149938 - RNA, 21 nt, Human
gggccuccucuguccagggcc

SEQ ID NO: 3149939 - RNA, 19 nt, Human
aaaaguauguuagugcaaa

SEQ ID NO: 3149940 - RNA, 15 nt, Human
gggugggcaguuuuu

SEQ ID NO: 3149941 - RNA, 19 nt, Human
gguaauaaguacuguguac

SEQ ID NO: 3149942 - RNA, 14 nt, Human
aaagacuauucaaa

SEQ ID NO: 3149943 - RNA, 24 nt, Human
ggucugugagaugcuagaacuccc

SEQ ID NO: 3149944 - RNA, 14 nt, Human
gguccuggggccuc

SEQ ID NO: 3149945 - RNA, 12 nt, Human
gguccuggggcc

SEQ ID NO: 3149946 - RNA, 15 nt, Human
aaagacuauucaaac

SEQ ID NO: 3149947 - RNA, 17 nt, Human
aaagcagggacuugaac

SEQ ID NO: 3149948 - RNA, 18 nt, Human
gguggggcagugcuuggc

SEQ ID NO: 3149949 - RNA, 16 nt, Human
ggugugaccacugcag

SEQ ID NO: 3149950 - RNA, 12 nt, Human
gguuucuagcau

SEQ ID NO: 3149951 - RNA, 16 nt, Human
gguuuagaaagcuugc

SEQ ID NO: 3149952 - RNA, 15 nt, Human
aaauaauuuuuauau

SEQ ID NO: 3149953 - RNA, 20 nt, Human
aaauaauuuuuauauuugaa

SEQ ID NO: 3149954 - RNA, 18 nt, Human
aaauaauuuuuauauuug

SEQ ID NO: 3149955 - RNA, 10 nt, Human
aaaguguauu

SEQ ID NO: 3149956 - RNA, 15 nt, Human
aaaguguauuuggaa

SEQ ID NO: 3149957 - RNA, 14 nt, Human
aaaguguauuugga

SEQ ID NO: 3149958 - RNA, 22 nt, Human
aaaguguauuuggaaauaaagu

SEQ ID NO: 3149959 - RNA, 17 nt, Human
gagccccacccucagau

SEQ ID NO: 3149960 - RNA, 15 nt, Human
gagaaucacuugaac

SEQ ID NO: 3149961 - RNA, 14 nt, Human
gagaaucacuugaa

SEQ ID NO: 3149962 - RNA, 22 nt, Human
gacuauucaaacagucucagga

SEQ ID NO: 3149963 - RNA, 18 nt, Human
gacuaucaaacugaagcc

SEQ ID NO: 3149964 - RNA, 22 nt, Human
gacuaucaaacugaagccagaa

SEQ ID NO: 3149965 - RNA, 16 nt, Human
gacucuuaagaagacu

SEQ ID NO: 3149966 - RNA, 15 nt, Human
gacucuuaagaagac

SEQ ID NO: 3149967 - RNA, 17 nt, Human
gacucuuaagaagacug

SEQ ID NO: 3149968 - RNA, 20 nt, Human
gacaguauggcagcuuuccu

SEQ ID NO: 3149969 - RNA, 16 nt, Human
gacacuuaaaaauggu

SEQ ID NO: 3149970 - RNA, 11 nt, Human
gaauuaguuuu

SEQ ID NO: 3149971 - RNA, 12 nt, Human
gacacacaugaa

SEQ ID NO: 3149972 - RNA, 13 nt, Human
gacacacugaaga

SEQ ID NO: 3149973 - RNA, 15 nt, Human
gacacaccaggcgcu

SEQ ID NO: 3149974 - RNA, 18 nt, Human
gacacaccaggcgcuaau

SEQ ID NO: 3149975 - RNA, 20 nt, Human
gaaugaauggcuaagcaaaa

SEQ ID NO: 3149976 - RNA, 20 nt, Human
gaaugagagacacacugaag

SEQ ID NO: 3149977 - RNA, 23 nt, Human
gaaugagagacacacugaagaag

SEQ ID NO: 3149978 - RNA, 22 nt, Human
gaaugagagacacacugaagaa

SEQ ID NO: 3149979 - RNA, 20 nt, Human
gaagugcuguuuauuaaucu

SEQ ID NO: 3149980 - RNA, 18 nt, Human
gaagugcuguuuauuaau

SEQ ID NO: 3149981 - RNA, 16 nt, Human
gaguuuagcuggaaaa

SEQ ID NO: 3149982 - RNA, 16 nt, Human
gaguuuaaauuguaau

SEQ ID NO: 3149983 - RNA, 21 nt, Human
gagugcucaguagucagacug

SEQ ID NO: 3149984 - RNA, 13 nt, Human
gaguuuggccaga

SEQ ID NO: 3149985 - RNA, 12 nt, Human
gaguuuggccag

SEQ ID NO: 3149986 - RNA, 14 nt, Human
gaguuuggccagaa

SEQ ID NO: 3149987 - RNA, 20 nt, Human
gauauguaccuaacgaagua

SEQ ID NO: 3149988 - RNA, 17 nt, Human
gauuagggagagaagau

SEQ ID NO: 3149989 - RNA, 19 nt, Human
gauuauuaacgauguccaa

SEQ ID NO: 3149990 - RNA, 22 nt, Human
gauuacuggccuuuuucauuua

SEQ ID NO: 3149991 - RNA, 14 nt, Human
gauuaccagggacu

SEQ ID NO: 3149992 - RNA, 14 nt, Human
gaugugaacacauc

SEQ ID NO: 3149993 - RNA, 16 nt, Human
gaugugaacacaucag

SEQ ID NO: 3149994 - RNA, 14 nt, Human
gcacaguuuucuga

SEQ ID NO: 3149995 - RNA, 17 nt, Human
gcacaguuuucugagaa

SEQ ID NO: 3149996 - RNA, 18 nt, Human
gcacaguuuucugagaaa

SEQ ID NO: 3149997 - RNA, 21 nt, Human
gcacaugagcuggcgggauug

SEQ ID NO: 3149998 - RNA, 18 nt, Human
gcagaacagccgcuccug

SEQ ID NO: 3149999 - RNA, 21 nt, Human
gcagaacagccgcuccugucu

SEQ ID NO: 3150000 - RNA, 19 nt, Human
gcagggacuugaacccaua

SEQ ID NO: 3150001 - RNA, 11 nt, Human
gcagcugccuc

SEQ ID NO: 3150002 - RNA, 12 nt, Human
gcagcugccucc

SEQ ID NO: 3150003 - RNA, 13 nt, Human
gcagcugccuccc

SEQ ID NO: 3150004 - RNA, 15 nt, Human
gcagcugccuccccu

SEQ ID NO: 3150005 - RNA, 16 nt, Human
gcagcugccuccccuc

SEQ ID NO: 3150006 - RNA, 17 nt, Human
gcagcugccuccccucc

SEQ ID NO: 3150007 - RNA, 18 nt, Human
gcagcugccuccccuccu

SEQ ID NO: 3150008 - RNA, 22 nt, Human
gcagcugccuccccuccucugc

SEQ ID NO: 3150009 - RNA, 18 nt, Human
gcaguuuuuugaaaaugg

SEQ ID NO: 3150010 - RNA, 12 nt, Human
gcaguuuuuuga

SEQ ID NO: 3150011 - RNA, 14 nt, Human
gcauaaccugucuc

SEQ ID NO: 3150012 - RNA, 19 nt, Human
gcauaaccugucucaccug

SEQ ID NO: 3150013 - RNA, 22 nt, Human
cugccaauauccuaauaaaaag

SEQ ID NO: 3150014 - RNA, 20 nt, Human
cugccaauauccuaauaaaa

SEQ ID NO: 3150015 - RNA, 19 nt, Human
cugccaauauccuaauaaa

SEQ ID NO: 3150016 - RNA, 18 nt, Human
cugccaauauccuaauaa

SEQ ID NO: 3150017 - RNA, 17 nt, Human
cugccaauauccuaaua

SEQ ID NO: 3150018 - RNA, 16 nt, Human
cugccaauauccuaau

SEQ ID NO: 3150019 - RNA, 14 nt, Human
cugccaauauccua

SEQ ID NO: 3150020 - RNA, 13 nt, Human
cugccaauauccu

SEQ ID NO: 3150021 - RNA, 12 nt, Human
cugcuaccucac

SEQ ID NO: 3150022 - RNA, 15 nt, Human
cugcuaccucacugg

SEQ ID NO: 3150023 - RNA, 13 nt, Human
cugcuaccucacu

SEQ ID NO: 3150024 - RNA, 14 nt, Human
cugcuaccucacug

SEQ ID NO: 3150025 - RNA, 21 nt, Human
cuggaaaucaggguuaguauu

SEQ ID NO: 3150026 - RNA, 16 nt, Human
cugggcagcugccucc

SEQ ID NO: 3150027 - RNA, 19 nt, Human
cugggcagcugccuccccu

SEQ ID NO: 3150028 - RNA, 22 nt, Human
cugggcagcugccuccccuccu

SEQ ID NO: 3150029 - RNA, 20 nt, Human
cugggcagcugccuccccuc

SEQ ID NO: 3150030 - RNA, 21 nt, Human
cugggcagcugccuccccucc

SEQ ID NO: 3150031 - RNA, 19 nt, Human
cuggggccucggagccuca

SEQ ID NO: 3150032 - RNA, 24 nt, Human
cuggugagucaccacuucagggcu

SEQ ID NO: 3150033 - RNA, 10 nt, Human
cugggacagg

SEQ ID NO: 3150034 - RNA, 16 nt, Human
cugugagaugcuagaa

SEQ ID NO: 3150035 - RNA, 23 nt, Human
cugucagcuccccucggagaaga

SEQ ID NO: 3150036 - RNA, 21 nt, Human
cugucagcuccccucggagaa

SEQ ID NO: 3150037 - RNA, 17 nt, Human
cuuaugcgguuaauuuu

SEQ ID NO: 3150038 - RNA, 16 nt, Human
cuuaugcgguuaauuu

SEQ ID NO: 3150039 - RNA, 18 nt, Human
cuuaugcgguuaauuuug

SEQ ID NO: 3150040 - RNA, 15 nt, Human
cuucacuguaaaaua

SEQ ID NO: 3150041 - RNA, 13 nt, Human
cuugaugaagaag

SEQ ID NO: 3150042 - RNA, 12 nt, Human
cuugaugaagaa

SEQ ID NO: 3150043 - RNA, 22 nt, Human
cuucuaaguaaaaccacagcag

SEQ ID NO: 3150044 - RNA, 23 nt, Human
cuucuaaguaaaaccacagcagu

SEQ ID NO: 3150045 - RNA, 22 nt, Human
cuuucuagaaagagaaacaguu

SEQ ID NO: 3150046 - RNA, 13 nt, Human
gaaaauucauuuu

SEQ ID NO: 3150047 - RNA, 14 nt, Human
gaaaauucauuuuu

SEQ ID NO: 3150048 - RNA, 21 nt, Human
gaaaacuuuaugcuaagugaa

SEQ ID NO: 3150049 - RNA, 13 nt, Human
cuuuugugaauua

SEQ ID NO: 3150050 - RNA, 19 nt, Human
cuuuuuuucuguaccaguu

SEQ ID NO: 3150051 - RNA, 16 nt, Human
cuuuuuuucuguacca

SEQ ID NO: 3150052 - RNA, 14 nt, Human
cuuuuuuucuguac

SEQ ID NO: 3150053 - RNA, 17 nt, Human
gaaauauuuauuuuaau

SEQ ID NO: 3150054 - RNA, 19 nt, Human
gaaaucaaauaugcaaagc

SEQ ID NO: 3150055 - RNA, 20 nt, Human
gaaaucaaauaugcaaagca

SEQ ID NO: 3150056 - RNA, 18 nt, Human
gaaauauuuauuuuaaua

SEQ ID NO: 3150057 - RNA, 18 nt, Human
gaaaucaaauaugcaaag

SEQ ID NO: 3150058 - RNA, 17 nt, Human
gaaaucaaauaugcaaa

SEQ ID NO: 3150059 - RNA, 17 nt, Human
gaaagacuauucaaaca

SEQ ID NO: 3150060 - RNA, 14 nt, Human
gaaagacuauucaa

SEQ ID NO: 3150061 - RNA, 15 nt, Human
gaaagacuauucaaa

SEQ ID NO: 3150062 - RNA, 21 nt, Human
auugacccacaagaaaugaaa

SEQ ID NO: 3150063 - RNA, 20 nt, Human
auugacacuuaaaaaugguu

SEQ ID NO: 3150064 - RNA, 19 nt, Human
auuuaaagcuuauuaaaac

SEQ ID NO: 3150065 - RNA, 15 nt, Human
auuuaccuaagauua

SEQ ID NO: 3150066 - RNA, 14 nt, Human
auuuaccuaagauu

SEQ ID NO: 3150067 - RNA, 18 nt, Human
auuuaccuaagauuacaa

SEQ ID NO: 3150068 - RNA, 17 nt, Human
auuuaccuaagauuaca

SEQ ID NO: 3150069 - RNA, 16 nt, Human
auuuacaaaugggaaa

SEQ ID NO: 3150070 - RNA, 13 nt, Human
auugugccccugc

SEQ ID NO: 3150071 - RNA, 14 nt, Human
auuguauuacaaau

SEQ ID NO: 3150072 - RNA, 21 nt, Human
auuuguauaaaauaauuuuua

SEQ ID NO: 3150073 - RNA, 15 nt, Human
auuuguaucacaaau

SEQ ID NO: 3150074 - RNA, 14 nt, Human
auuuuaauaauguu

SEQ ID NO: 3150075 - RNA, 12 nt, Human
auuuuaauaaug

SEQ ID NO: 3150076 - RNA, 15 nt, Human
auuuuaauaauguuu

SEQ ID NO: 3150077 - RNA, 23 nt, Human
auuugguaaggggaauugaggac

SEQ ID NO: 3150078 - RNA, 18 nt, Human
auuuguaguguuggagaa

SEQ ID NO: 3150079 - RNA, 22 nt, Human
auuuauuacuguaagaaaauau

SEQ ID NO: 3150080 - RNA, 18 nt, Human
auguuucaaacauauaua

SEQ ID NO: 3150081 - RNA, 15 nt, Human
auuaaaagaauauuu

SEQ ID NO: 3150082 - RNA, 16 nt, Human
auuaaaagaauauuuu

SEQ ID NO: 3150083 - RNA, 15 nt, Human
auuaacgauguccaa

SEQ ID NO: 3150084 - RNA, 23 nt, Human
uuuuauggaggcuuugcauagau

SEQ ID NO: 3150085 - RNA, 19 nt, Human
uuuuauggcacuaguauuu

SEQ ID NO: 3150086 - RNA, 14 nt, Human
uuuuauaauuuugu

SEQ ID NO: 3150087 - RNA, 16 nt, Human
uuuucuauaauuuaaa

SEQ ID NO: 3150088 - RNA, 19 nt, Human
auguucaucaaugaaugaa

SEQ ID NO: 3150089 - RNA, 15 nt, Human
auguugacaugggac

SEQ ID NO: 3150090 - RNA, 23 nt, Human
auguuaguuaccuuauaguuacu

SEQ ID NO: 3150091 - RNA, 22 nt, Human
auguuaguuaccuuauaguuac

SEQ ID NO: 3150092 - RNA, 21 nt, Human
auguuaguuaccuuauaguua

SEQ ID NO: 3150093 - RNA, 20 nt, Human
auguuaguuaccuuauaguu

SEQ ID NO: 3150094 - RNA, 22 nt, Human
auguaguauuuuuuguauaauu

SEQ ID NO: 3150095 - RNA, 21 nt, Human
auguaguauuuuuuguauaau

SEQ ID NO: 3150096 - RNA, 12 nt, Human
auguaguauuuu

SEQ ID NO: 3150097 - RNA, 23 nt, Human
auguaguauuuuuuguauaauug

SEQ ID NO: 3150098 - RNA, 21 nt, Human
augucccuacaccccuccccu

SEQ ID NO: 3150099 - RNA, 12 nt, Human
uuugcucaugga

SEQ ID NO: 3150100 - RNA, 11 nt, Human
uuugcucaugg

SEQ ID NO: 3150101 - RNA, 19 nt, Human
uuugcuaagcauuccaacu

SEQ ID NO: 3150102 - RNA, 14 nt, Human
uuuggccagaaguc

SEQ ID NO: 3150103 - RNA, 12 nt, Human
uuuggccagaag

SEQ ID NO: 3150104 - RNA, 10 nt, Human
uuuggccaga

SEQ ID NO: 3150105 - RNA, 13 nt, Human
uuuuaaaaaagaa

SEQ ID NO: 3150106 - RNA, 14 nt, Human
uuuuaaaagaauga

SEQ ID NO: 3150107 - RNA, 20 nt, Human
auuccacuuauaggaauuga

SEQ ID NO: 3150108 - RNA, 14 nt, Human
auucaaacagucuc

SEQ ID NO: 3150109 - RNA, 15 nt, Human
auucaaacagucuca

SEQ ID NO: 3150110 - RNA, 22 nt, Human
auuacuggccuuuuucauuuau

SEQ ID NO: 3150111 - RNA, 21 nt, Human
auuacuggccuuuuucauuua

SEQ ID NO: 3150112 - RNA, 17 nt, Human
auuacuggccuuuuuca

SEQ ID NO: 3150113 - RNA, 16 nt, Human
auuauauuuacaaaug

SEQ ID NO: 3150114 - RNA, 18 nt, Human
auuaucucaaaacugcac

SEQ ID NO: 3150115 - RNA, 23 nt, Human
auuaucucaaaacugcacuguca

SEQ ID NO: 3150116 - RNA, 15 nt, Human
auuauauuuacaaau

SEQ ID NO: 3150117 - RNA, 15 nt, Human
auuaaguaaugauaa

SEQ ID NO: 3150118 - RNA, 13 nt, Human
auuaaguaaugau

SEQ ID NO: 3150119 - RNA, 22 nt, Human
auuaaucuuaguguaugauuac

SEQ ID NO: 3150120 - RNA, 21 nt, Human
auuaaucuuaguguaugauua

SEQ ID NO: 3150121 - RNA, 20 nt, Human
auuaaucuuaguguaugauu

SEQ ID NO: 3150122 - RNA, 19 nt, Human
auuaaucuuaguguaugau

SEQ ID NO: 3150123 - RNA, 17 nt, Human
auuaaucuuaguguaug

SEQ ID NO: 3150124 - RNA, 16 nt, Human
auuaaucuuaguguau

SEQ ID NO: 3150125 - RNA, 20 nt, Human
auuacauuuguauaaaauaa

SEQ ID NO: 3150126 - RNA, 15 nt, Human
auuacauuuguauaa

SEQ ID NO: 3150127 - RNA, 13 nt, Human
auuacauuuguau

SEQ ID NO: 3150128 - RNA, 13 nt, Human
uugcccuguuaaa

SEQ ID NO: 3150129 - RNA, 19 nt, Human
uugauggugguauguuuuc

SEQ ID NO: 3150130 - RNA, 18 nt, Human
uugauggugguauguuuu

SEQ ID NO: 3150131 - RNA, 21 nt, Human
aucucauuuccaagcaaguau

SEQ ID NO: 3150132 - RNA, 23 nt, Human
aucucauuuccaagcaaguauua

SEQ ID NO: 3150133 - RNA, 14 nt, Human
aucucauuuccaag

SEQ ID NO: 3150134 - RNA, 13 nt, Human
aucucaauauuuc

SEQ ID NO: 3150135 - RNA, 23 nt, Human
uugguuuaaagaaaguguauuug

SEQ ID NO: 3150136 - RNA, 17 nt, Human
uugguuuaaagaaagug

SEQ ID NO: 3150137 - RNA, 22 nt, Human
uugguuuaaagaaaguguauuu

SEQ ID NO: 3150138 - RNA, 18 nt, Human
uugguuuaaagaaagugu

SEQ ID NO: 3150139 - RNA, 15 nt, Human
uuguauaaaauaauu

SEQ ID NO: 3150140 - RNA, 16 nt, Human
uuguauaaaauaauuu

SEQ ID NO: 3150141 - RNA, 16 nt, Human
uuguaucacaaaucuu

SEQ ID NO: 3150142 - RNA, 17 nt, Human
uuguauaaaauaauuuu

SEQ ID NO: 3150143 - RNA, 19 nt, Human
augagagacacacugaaga

SEQ ID NO: 3150144 - RNA, 17 nt, Human
augagagacacacugaa

SEQ ID NO: 3150145 - RNA, 14 nt, Human
augagagacacacu

SEQ ID NO: 3150146 - RNA, 13 nt, Human
augagagacacac

SEQ ID NO: 3150147 - RNA, 13 nt, Human
augaaugaauggc

SEQ ID NO: 3150148 - RNA, 18 nt, Human
augaagauguagaggaga

SEQ ID NO: 3150149 - RNA, 17 nt, Human
augaaauauuauguuaa

SEQ ID NO: 3150150 - RNA, 13 nt, Human
augaaauauuaug

SEQ ID NO: 3150151 - RNA, 18 nt, Human
augaaauauuauguuaaa

SEQ ID NO: 3150152 - RNA, 15 nt, Human
augaaagcagggacu

SEQ ID NO: 3150153 - RNA, 13 nt, Human
aucuuuuucuaac

SEQ ID NO: 3150154 - RNA, 19 nt, Human
uuucauguuaguuaccuua

SEQ ID NO: 3150155 - RNA, 20 nt, Human
auggcuaguaucaaaagaaa

SEQ ID NO: 3150156 - RNA, 13 nt, Human
uuuauauaagcuu

SEQ ID NO: 3150157 - RNA, 22 nt, Human
uuuagcuggaaaaguauguuag

SEQ ID NO: 3150158 - RNA, 20 nt, Human
uuuagcuggaaaaguauguu

SEQ ID NO: 3150159 - RNA, 15 nt, Human
augcuagaacucccu

SEQ ID NO: 3150160 - RNA, 16 nt, Human
augcuagaacucccuu

SEQ ID NO: 3150161 - RNA, 22 nt, Human
augcugucuacacuaagagaga

SEQ ID NO: 3150162 - RNA, 23 nt, Human
uugugugaaagguacuucaaauc

SEQ ID NO: 3150163 - RNA, 15 nt, Human
uuguguguuauuuaa

SEQ ID NO: 3150164 - RNA, 16 nt, Human
uuguguguuauuuaaa

SEQ ID NO: 3150165 - RNA, 20 nt, Human
uuguguguuauuuaaaugag

SEQ ID NO: 3150166 - RNA, 21 nt, Human
uuguguguuauuuaaaugagu

SEQ ID NO: 3150167 - RNA, 16 nt, Human
uuguuggcauagcucu

SEQ ID NO: 3150168 - RNA, 21 nt, Human
augagagacacacugaagaag

SEQ ID NO: 3150169 - RNA, 20 nt, Human
augagagacacacugaagaa

SEQ ID NO: 3150170 - RNA, 15 nt, Human
augcaaagcacugac

SEQ ID NO: 3150171 - RNA, 12 nt, Human
augauucccagc

SEQ ID NO: 3150172 - RNA, 22 nt, Human
augauuaugaauuacauuugua

SEQ ID NO: 3150173 - RNA, 17 nt, Human
augcaguucugaagaag

SEQ ID NO: 3150174 - RNA, 15 nt, Human
augcaguucugaaga

SEQ ID NO: 3150175 - RNA, 17 nt, Human
augccacuaaauugaca

SEQ ID NO: 3150176 - RNA, 15 nt, Human
augccacuaaauuga

SEQ ID NO: 3150177 - RNA, 19 nt, Human
augcaguucugaagaagau

SEQ ID NO: 3150178 - RNA, 18 nt, Human
augcaguucugaagaaga

SEQ ID NO: 3150179 - RNA, 14 nt, Human
uuguuuucauuauc

SEQ ID NO: 3150180 - RNA, 14 nt, Human
uucuauaauuuaaa

SEQ ID NO: 3150181 - RNA, 13 nt, Human
uucuauaauuuaa

SEQ ID NO: 3150182 - RNA, 22 nt, Human
uucuagaaagagaaacaguugg

SEQ ID NO: 3150183 - RNA, 19 nt, Human
uucuagaaagagaaacagu

SEQ ID NO: 3150184 - RNA, 19 nt, Human
uucuaaguaaaaccacagc

SEQ ID NO: 3150185 - RNA, 20 nt, Human
uucuaaguaaaaccacagca

SEQ ID NO: 3150186 - RNA, 17 nt, Human
uucuaaguaaaaccaca

SEQ ID NO: 3150187 - RNA, 22 nt, Human
uuccuuagcuuagaccucagcc

SEQ ID NO: 3150188 - RNA, 23 nt, Human
uuccuuagcuuagaccucagccu

SEQ ID NO: 3150189 - RNA, 20 nt, Human
uuccuuagcuuagaccucag

SEQ ID NO: 3150190 - RNA, 21 nt, Human
uuccuuagcuuagaccucagc

SEQ ID NO: 3150191 - RNA, 20 nt, Human
aucaaauaugcaaagcacug

SEQ ID NO: 3150192 - RNA, 22 nt, Human
uuccccuugcccagggcucagc

SEQ ID NO: 3150193 - RNA, 23 nt, Human
uuccccuugcccagggcucagcc

SEQ ID NO: 3150194 - RNA, 22 nt, Human
auccuaauaaaaaggugaccau

SEQ ID NO: 3150195 - RNA, 18 nt, Human
auccuaauaaaaagguga

SEQ ID NO: 3150196 - RNA, 12 nt, Human
auccuaauaaaa

SEQ ID NO: 3150197 - RNA, 17 nt, Human
auccuaauaaaaaggug

SEQ ID NO: 3150198 - RNA, 16 nt, Human
auccuaauaaaaaggu

SEQ ID NO: 3150199 - RNA, 15 nt, Human
auccuaauaaaaagg

SEQ ID NO: 3150200 - RNA, 14 nt, Human
auccuaauaaaaag

SEQ ID NO: 3150201 - RNA, 13 nt, Human
uugaacacugggg

SEQ ID NO: 3150202 - RNA, 19 nt, Human
uugaaauauugacuuuuua

SEQ ID NO: 3150203 - RNA, 20 nt, Human
uugaacaaguuguuucauug

SEQ ID NO: 3150204 - RNA, 19 nt, Human
uucuugcuucuuucuagaa

SEQ ID NO: 3150205 - RNA, 17 nt, Human
uucuugcuucuuucuag

SEQ ID NO: 3150206 - RNA, 20 nt, Human
auaguuacuguguaauuagu

SEQ ID NO: 3150207 - RNA, 18 nt, Human
auaguuacuguguaauua

SEQ ID NO: 3150208 - RNA, 14 nt, Human
auaguuacugugua

SEQ ID NO: 3150209 - RNA, 13 nt, Human
auaguuacugugu

SEQ ID NO: 3150210 - RNA, 17 nt, Human
auaguuacuguguaauu

SEQ ID NO: 3150211 - RNA, 20 nt, Human
auaguuguaccgcaauguga

SEQ ID NO: 3150212 - RNA, 19 nt, Human
auauauaacaaugcuguau

SEQ ID NO: 3150213 - RNA, 17 nt, Human
auauaacaaugcuguau

SEQ ID NO: 3150214 - RNA, 24 nt, Human
auauaucuaccccagacuagaugu

SEQ ID NO: 3150215 - RNA, 18 nt, Human
uucaaacagucucaggaa

SEQ ID NO: 3150216 - RNA, 22 nt, Human
auaggaauugacccacaagaaa

SEQ ID NO: 3150217 - RNA, 17 nt, Human
auaggcguaacuaauuu

SEQ ID NO: 3150218 - RNA, 23 nt, Human
uucacaagacccaaaaggcagaa

SEQ ID NO: 3150219 - RNA, 22 nt, Human
uucacaagacccaaaaggcaga

SEQ ID NO: 3150220 - RNA, 21 nt, Human
uucacacacaggcaacugagg

SEQ ID NO: 3150221 - RNA, 12 nt, Human
uucccaaauuuc

SEQ ID NO: 3150222 - RNA, 18 nt, Human
uucccaacuccagaaagu

SEQ ID NO: 3150223 - RNA, 23 nt, Human
agcauaaauguugacaugggaca

SEQ ID NO: 3150224 - RNA, 22 nt, Human
ugaguaacugauuuguaacaag

SEQ ID NO: 3150225 - RNA, 12 nt, Human
ugauaugggucu

SEQ ID NO: 3150226 - RNA, 17 nt, Human
agcauuguaaaugugcu

SEQ ID NO: 3150227 - RNA, 18 nt, Human
agcauuguaaaugugcuu

SEQ ID NO: 3150228 - RNA, 20 nt, Human
agcaugucgucaaagcugaa

SEQ ID NO: 3150229 - RNA, 17 nt, Human
agcaugucgucaaagcu

SEQ ID NO: 3150230 - RNA, 14 nt, Human
agccagacuggcac

SEQ ID NO: 3150231 - RNA, 16 nt, Human
agccagcucucagcca

SEQ ID NO: 3150232 - RNA, 19 nt, Human
agccagaaauaaaguuggu

SEQ ID NO: 3150233 - RNA, 23 nt, Human
agccagaaauaaaguuggugaca

SEQ ID NO: 3150234 - RNA, 12 nt, Human
ugauuaaaccaa

SEQ ID NO: 3150235 - RNA, 14 nt, Human
ugauuaccagggac

SEQ ID NO: 3150236 - RNA, 14 nt, Human
ugaugaucuuuaaa

SEQ ID NO: 3150237 - RNA, 22 nt, Human
ugauguuuagaaacacaacuau

SEQ ID NO: 3150238 - RNA, 17 nt, Human
ugaugaagaaguugaua

SEQ ID NO: 3150239 - RNA, 12 nt, Human
ugaugaagaagu

SEQ ID NO: 3150240 - RNA, 22 nt, Human
agccugaaagaggaaugaagua

SEQ ID NO: 3150241 - RNA, 16 nt, Human
agccgaccucagccuu

SEQ ID NO: 3150242 - RNA, 14 nt, Human
agccgaccucagcc

SEQ ID NO: 3150243 - RNA, 15 nt, Human
agccgaccucagccu

SEQ ID NO: 3150244 - RNA, 12 nt, Human
agccgaccucag

SEQ ID NO: 3150245 - RNA, 13 nt, Human
agccgaccucagc

SEQ ID NO: 3150246 - RNA, 15 nt, Human
agccucauguccacu

SEQ ID NO: 3150247 - RNA, 19 nt, Human
agccucauccgaggcaggg

SEQ ID NO: 3150248 - RNA, 18 nt, Human
agccucauccgaggcagg

SEQ ID NO: 3150249 - RNA, 20 nt, Human
agccucauccgaggcagggu

SEQ ID NO: 3150250 - RNA, 20 nt, Human
agccucauguccacugguuc

SEQ ID NO: 3150251 - RNA, 21 nt, Human
agccuagccgaccucagccuu

SEQ ID NO: 3150252 - RNA, 17 nt, Human
agccuagccgaccucag

SEQ ID NO: 3150253 - RNA, 18 nt, Human
agccuagccgaccucagc

SEQ ID NO: 3150254 - RNA, 19 nt, Human
agccuagccgaccucagcc

SEQ ID NO: 3150255 - RNA, 20 nt, Human
agccuagccgaccucagccu

SEQ ID NO: 3150256 - RNA, 18 nt, Human
agcccauggcacucuaug

SEQ ID NO: 3150257 - RNA, 18 nt, Human
agccccgugggguuccuc

SEQ ID NO: 3150258 - RNA, 18 nt, Human
agcuacuugggaggcuga

SEQ ID NO: 3150259 - RNA, 17 nt, Human
agcuacuugggaggcug

SEQ ID NO: 3150260 - RNA, 12 nt, Human
ugccagacaugu

SEQ ID NO: 3150261 - RNA, 13 nt, Human
ugccagacaugug

SEQ ID NO: 3150262 - RNA, 11 nt, Human
agccugguggg

SEQ ID NO: 3150263 - RNA, 14 nt, Human
agccuggugggccu

SEQ ID NO: 3150264 - RNA, 16 nt, Human
agccuggugggccucc

SEQ ID NO: 3150265 - RNA, 18 nt, Human
agccuggugggccuccuc

SEQ ID NO: 3150266 - RNA, 21 nt, Human
agccuggugggccuccucugu

SEQ ID NO: 3150267 - RNA, 22 nt, Human
agccuggugggccuccucuguc

SEQ ID NO: 3150268 - RNA, 20 nt, Human
agccuuggggcugaugcagu

SEQ ID NO: 3150269 - RNA, 16 nt, Human
uggcauagcucugggg

SEQ ID NO: 3150270 - RNA, 15 nt, Human
uggcauagcucuggg

SEQ ID NO: 3150271 - RNA, 14 nt, Human
uggcauagcucugg

SEQ ID NO: 3150272 - RNA, 19 nt, Human
uggcacaguuuucugagaa

SEQ ID NO: 3150273 - RNA, 18 nt, Human
uggcacaguuuucugaga

SEQ ID NO: 3150274 - RNA, 13 nt, Human
uggaaaggcagcu

SEQ ID NO: 3150275 - RNA, 18 nt, Human
uggacaccaggagucccu

SEQ ID NO: 3150276 - RNA, 13 nt, Human
uggagaagaacug

SEQ ID NO: 3150277 - RNA, 13 nt, Human
ugcuguauuuuaa

SEQ ID NO: 3150278 - RNA, 22 nt, Human
ugcuguauuuuaaaagaaugau

SEQ ID NO: 3150279 - RNA, 21 nt, Human
ugcuguauuuuaaaagaauga

SEQ ID NO: 3150280 - RNA, 17 nt, Human
aggacacugauaugggu

SEQ ID NO: 3150281 - RNA, 23 nt, Human
aggaaaucaaauaugcaaagcac

SEQ ID NO: 3150282 - RNA, 12 nt, Human
aggaaauauuua

SEQ ID NO: 3150283 - RNA, 14 nt, Human
ugcucauggaauug

SEQ ID NO: 3150284 - RNA, 11 nt, Human
ugcucauggaa

SEQ ID NO: 3150285 - RNA, 16 nt, Human
agcuguucacagccag

SEQ ID NO: 3150286 - RNA, 19 nt, Human
agcuguucacagccagacu

SEQ ID NO: 3150287 - RNA, 14 nt, Human
agcuguucacagcc

SEQ ID NO: 3150288 - RNA, 16 nt, Human
agcugccuccccuccu

SEQ ID NO: 3150289 - RNA, 15 nt, Human
agcugccuccccucc

SEQ ID NO: 3150290 - RNA, 22 nt, Human
agcugcccucuccugggcagcu

SEQ ID NO: 3150291 - RNA, 21 nt, Human
agcugcccucuccugggcagc

SEQ ID NO: 3150292 - RNA, 15 nt, Human
ugcuacaaaaacaca

SEQ ID NO: 3150293 - RNA, 16 nt, Human
ugcuacaaaaacacag

SEQ ID NO: 3150294 - RNA, 17 nt, Human
ugcuacaaaaacacagc

SEQ ID NO: 3150295 - RNA, 18 nt, Human
ugcuacaaaaacacagca

SEQ ID NO: 3150296 - RNA, 19 nt, Human
ugcuacaaaaacacagcaa

SEQ ID NO: 3150297 - RNA, 20 nt, Human
ugcuacaaaaacacagcaag

SEQ ID NO: 3150298 - RNA, 17 nt, Human
agcuugaaacugagaug

SEQ ID NO: 3150299 - RNA, 14 nt, Human
agcuuagaccucag

SEQ ID NO: 3150300 - RNA, 15 nt, Human
agcuuagaccucagc

SEQ ID NO: 3150301 - RNA, 20 nt, Human
agcuuagaccucagccugug

SEQ ID NO: 3150302 - RNA, 16 nt, Human
agcuuagaccucagcc

SEQ ID NO: 3150303 - RNA, 17 nt, Human
agcuuagaccucagccu

SEQ ID NO: 3150304 - RNA, 18 nt, Human
agcuuagaccucagccug

SEQ ID NO: 3150305 - RNA, 19 nt, Human
agcuuagaccucagccugu

SEQ ID NO: 3150306 - RNA, 20 nt, Human
ugguaaggggaauugaggac

SEQ ID NO: 3150307 - RNA, 13 nt, Human
aggguuagggagg

SEQ ID NO: 3150308 - RNA, 15 nt, Human
aggguuagggagggg

SEQ ID NO: 3150309 - RNA, 16 nt, Human
aggguuagggaggggu

SEQ ID NO: 3150310 - RNA, 23 nt, Human
agguacuucaaauccuugaagau

SEQ ID NO: 3150311 - RNA, 14 nt, Human
uggggaagacugug

SEQ ID NO: 3150312 - RNA, 24 nt, Human
uggggaagacuguggcugcuagca

SEQ ID NO: 3150313 - RNA, 16 nt, Human
uggggaagacuguggc

SEQ ID NO: 3150314 - RNA, 17 nt, Human
uggggaagacuguggcu

SEQ ID NO: 3150315 - RNA, 17 nt, Human
agggcagggacaggaua

SEQ ID NO: 3150316 - RNA, 23 nt, Human
ugucauuugcuggagcucugccc

SEQ ID NO: 3150317 - RNA, 22 nt, Human
ugucagcugcaagguacucugg

SEQ ID NO: 3150318 - RNA, 23 nt, Human
ugucagcugcaagguacucuggu

SEQ ID NO: 3150319 - RNA, 15 nt, Human
aguauuucuaugaaa

SEQ ID NO: 3150320 - RNA, 13 nt, Human
aguauuucuauga

SEQ ID NO: 3150321 - RNA, 22 nt, Human
aguauuucuaugaaauauuaug

SEQ ID NO: 3150322 - RNA, 21 nt, Human
ugucaauaaaauccauacauu

SEQ ID NO: 3150323 - RNA, 20 nt, Human
ugucaaucagccuaguugau

SEQ ID NO: 3150324 - RNA, 13 nt, Human
aguagucagacug

SEQ ID NO: 3150325 - RNA, 15 nt, Human
agucaggaaagagaa

SEQ ID NO: 3150326 - RNA, 16 nt, Human
agucaggaaagagaac

SEQ ID NO: 3150327 - RNA, 23 nt, Human
agucagacuggauaguccgucuc

SEQ ID NO: 3150328 - RNA, 23 nt, Human
uguaccaguuaauuuuuccaacu

SEQ ID NO: 3150329 - RNA, 22 nt, Human
uguaccaguuaauuuuuccaac

SEQ ID NO: 3150330 - RNA, 21 nt, Human
uguaccaguuaauuuuuccaa

SEQ ID NO: 3150331 - RNA, 15 nt, Human
uguaccaguuaauuu

SEQ ID NO: 3150332 - RNA, 14 nt, Human
uguaccaguuaauu

SEQ ID NO: 3150333 - RNA, 12 nt, Human
uguaccaguuaa

SEQ ID NO: 3150334 - RNA, 11 nt, Human
uguaccaguua

SEQ ID NO: 3150335 - RNA, 16 nt, Human
uguagaggagaaacug

SEQ ID NO: 3150336 - RNA, 18 nt, Human
uguagaggagaaacugga

SEQ ID NO: 3150337 - RNA, 15 nt, Human
aguaaaaccacagca

SEQ ID NO: 3150338 - RNA, 19 nt, Human
aguagauaggccaugggca

SEQ ID NO: 3150339 - RNA, 23 nt, Human
aguaauuuauuguuuuuccuugu

SEQ ID NO: 3150340 - RNA, 23 nt, Human
uguaauuagugccacuuaaugua

SEQ ID NO: 3150341 - RNA, 21 nt, Human
uguaauuagugccacuuaaug

SEQ ID NO: 3150342 - RNA, 13 nt, Human
uguguuauuuaaa

SEQ ID NO: 3150343 - RNA, 14 nt, Human
uguguuauuuaaau

SEQ ID NO: 3150344 - RNA, 16 nt, Human
uguguuauuuaaauga

SEQ ID NO: 3150345 - RNA, 22 nt, Human
ugugguuucauguuaguuaccu

SEQ ID NO: 3150346 - RNA, 17 nt, Human
ugugguuucauguuagu

SEQ ID NO: 3150347 - RNA, 20 nt, Human
agugcuuggcccaggaguuu

SEQ ID NO: 3150348 - RNA, 21 nt, Human
agugccuguaaucacagcuac

SEQ ID NO: 3150349 - RNA, 19 nt, Human
agugcuuggcccaggaguu

SEQ ID NO: 3150350 - RNA, 18 nt, Human
agugcuuggcccaggagu

SEQ ID NO: 3150351 - RNA, 16 nt, Human
agugcuuggcccagga

SEQ ID NO: 3150352 - RNA, 15 nt, Human
agugcuuggcccagg

SEQ ID NO: 3150353 - RNA, 14 nt, Human
agugcuuggcccag

SEQ ID NO: 3150354 - RNA, 12 nt, Human
agugcuuggccc

SEQ ID NO: 3150355 - RNA, 20 nt, Human
uguggcagaguuacaguucu

SEQ ID NO: 3150356 - RNA, 19 nt, Human
uguggcagaguuacaguuc

SEQ ID NO: 3150357 - RNA, 15 nt, Human
uguggcagaguuaca

SEQ ID NO: 3150358 - RNA, 14 nt, Human
uguggcagaguuac

SEQ ID NO: 3150359 - RNA, 16 nt, Human
agugccacuuaaugua

SEQ ID NO: 3150360 - RNA, 14 nt, Human
agugccacuuaaug

SEQ ID NO: 3150361 - RNA, 21 nt, Human
agugcaaauugucacaggaca

SEQ ID NO: 3150362 - RNA, 18 nt, Human
agugcaaauugucacagg

SEQ ID NO: 3150363 - RNA, 14 nt, Human
agugcaaauuguca

SEQ ID NO: 3150364 - RNA, 19 nt, Human
aguucggugagcuacaaau

SEQ ID NO: 3150365 - RNA, 15 nt, Human
uguuauuuaaaugag

SEQ ID NO: 3150366 - RNA, 16 nt, Human
aguguuggagaagaac

SEQ ID NO: 3150367 - RNA, 14 nt, Human
aguguuggagaaga

SEQ ID NO: 3150368 - RNA, 18 nt, Human
aguguuggagaagaacug

SEQ ID NO: 3150369 - RNA, 17 nt, Human
aguguuggagaagaacu

SEQ ID NO: 3150370 - RNA, 11 nt, Human
aguuacugugu

SEQ ID NO: 3150371 - RNA, 19 nt, Human
aguuacuguguaauuagug

SEQ ID NO: 3150372 - RNA, 18 nt, Human
aguuacuguguaauuagu

SEQ ID NO: 3150373 - RNA, 16 nt, Human
aguuacuguguaauua

SEQ ID NO: 3150374 - RNA, 15 nt, Human
aguuacuguguaauu

SEQ ID NO: 3150375 - RNA, 14 nt, Human
aguuacuguguaau

SEQ ID NO: 3150376 - RNA, 23 nt, Human
auaauuuaccuaagauuacaaau

SEQ ID NO: 3150377 - RNA, 20 nt, Human
uuagcaaagaguuaauauau

SEQ ID NO: 3150378 - RNA, 13 nt, Human
uuagcaaagaguu

SEQ ID NO: 3150379 - RNA, 19 nt, Human
uuagcaaagaguuaauaua

SEQ ID NO: 3150380 - RNA, 16 nt, Human
auaauuuaccuaagau

SEQ ID NO: 3150381 - RNA, 13 nt, Human
auaauuuaccuaa

SEQ ID NO: 3150382 - RNA, 18 nt, Human
auaauccuaaacauauga

SEQ ID NO: 3150383 - RNA, 15 nt, Human
auaaauaguuuauga

SEQ ID NO: 3150384 - RNA, 13 nt, Human
auaaauaaaaaua

SEQ ID NO: 3150385 - RNA, 22 nt, Human
auaacgauaaaagacagugaaa

SEQ ID NO: 3150386 - RNA, 22 nt, Human
auaaccugucucaccuggacuu

SEQ ID NO: 3150387 - RNA, 18 nt, Human
uuaccuuauaguuacugu

SEQ ID NO: 3150388 - RNA, 19 nt, Human
uuagaaacacaacuauauu

SEQ ID NO: 3150389 - RNA, 15 nt, Human
aguugguaacuuuug

SEQ ID NO: 3150390 - RNA, 13 nt, Human
aguugguaacuuu

SEQ ID NO: 3150391 - RNA, 13 nt, Human
uguuucaaacaua

SEQ ID NO: 3150392 - RNA, 20 nt, Human
aguugguaacuuuugugaau

SEQ ID NO: 3150393 - RNA, 16 nt, Human
aguugguaacuuuugu

SEQ ID NO: 3150394 - RNA, 14 nt, Human
aguuuaaauuguaa

SEQ ID NO: 3150395 - RNA, 16 nt, Human
uuaaucuuaguguaug

SEQ ID NO: 3150396 - RNA, 14 nt, Human
uuaaucuuagugua

SEQ ID NO: 3150397 - RNA, 22 nt, Human
auaaaauaauuuuuauauuuga

SEQ ID NO: 3150398 - RNA, 12 nt, Human
auaaaauaauuu

SEQ ID NO: 3150399 - RNA, 19 nt, Human
aguuuucugagaaagacua

SEQ ID NO: 3150400 - RNA, 18 nt, Human
aguuuucugagaaagacu

SEQ ID NO: 3150401 - RNA, 23 nt, Human
aguuuucugagaaagacuauuca

SEQ ID NO: 3150402 - RNA, 14 nt, Human
uauuuuaaaagaau

SEQ ID NO: 3150403 - RNA, 18 nt, Human
uauuuuaaaagaaugauu

SEQ ID NO: 3150404 - RNA, 22 nt, Human
uauuuuaauaauguuucaaaca

SEQ ID NO: 3150405 - RNA, 19 nt, Human
uauuuuaauaauguuucaa

SEQ ID NO: 3150406 - RNA, 20 nt, Human
ucaaacagucucaggaaauc

SEQ ID NO: 3150407 - RNA, 21 nt, Human
ucaaacagucucaggaaauca

SEQ ID NO: 3150408 - RNA, 13 nt, Human
ucaaacagucuca

SEQ ID NO: 3150409 - RNA, 14 nt, Human
accaacacgagcag

SEQ ID NO: 3150410 - RNA, 19 nt, Human
accaacacgagcaggcuac

SEQ ID NO: 3150411 - RNA, 16 nt, Human
accacaagacugcaca

SEQ ID NO: 3150412 - RNA, 22 nt, Human
ucacagcuuauuuccucauuuu

SEQ ID NO: 3150413 - RNA, 17 nt, Human
ucacagccagacuggca

SEQ ID NO: 3150414 - RNA, 23 nt, Human
ucacagccagacuggcacaguuu

SEQ ID NO: 3150415 - RNA, 16 nt, Human
ucacagaccuuugaac

SEQ ID NO: 3150416 - RNA, 13 nt, Human
ucaauuuaaaaaa

SEQ ID NO: 3150417 - RNA, 12 nt, Human
ucaauuuaaaaa

SEQ ID NO: 3150418 - RNA, 23 nt, Human
ucaauauuucagauaaucacaau

SEQ ID NO: 3150419 - RNA, 13 nt, Human
ucaguagucagac

SEQ ID NO: 3150420 - RNA, 21 nt, Human
accaggguccuuuugacacug

SEQ ID NO: 3150421 - RNA, 16 nt, Human
acccaaauguucauca

SEQ ID NO: 3150422 - RNA, 17 nt, Human
ucagagcugcccucucc

SEQ ID NO: 3150423 - RNA, 15 nt, Human
ucagagcugcccucu

SEQ ID NO: 3150424 - RNA, 16 nt, Human
ucagagcugcccucuc

SEQ ID NO: 3150425 - RNA, 13 nt, Human
ucagagcugcccu

SEQ ID NO: 3150426 - RNA, 14 nt, Human
ucagagcugcccuc

SEQ ID NO: 3150427 - RNA, 14 nt, Human
ucagagacucaggg

SEQ ID NO: 3150428 - RNA, 17 nt, Human
ucagagacucagggccc

SEQ ID NO: 3150429 - RNA, 19 nt, Human
ucagagacucagggcccca

SEQ ID NO: 3150430 - RNA, 20 nt, Human
ucagagacucagggccccag

SEQ ID NO: 3150431 - RNA, 12 nt, Human
ucagcccucaga

SEQ ID NO: 3150432 - RNA, 20 nt, Human
ucagauggaaaauucauuuu

SEQ ID NO: 3150433 - RNA, 19 nt, Human
ucagauggaaaauucauuu

SEQ ID NO: 3150434 - RNA, 12 nt, Human
ucagauggaaaa

SEQ ID NO: 3150435 - RNA, 14 nt, Human
uccagugagacagc

SEQ ID NO: 3150436 - RNA, 22 nt, Human
uccaugaagauguagaggagaa

SEQ ID NO: 3150437 - RNA, 16 nt, Human
acgcucucuggccuuc

SEQ ID NO: 3150438 - RNA, 15 nt, Human
acgcucucuggccuu

SEQ ID NO: 3150439 - RNA, 14 nt, Human
acgcucucuggccu

SEQ ID NO: 3150440 - RNA, 17 nt, Human
acgcucucuggccuucg

SEQ ID NO: 3150441 - RNA, 16 nt, Human
acgaguaauuuauugu

SEQ ID NO: 3150442 - RNA, 22 nt, Human
accuggacuuaagcaucuggcu

SEQ ID NO: 3150443 - RNA, 16 nt, Human
ucauaauaaguugcau

SEQ ID NO: 3150444 - RNA, 17 nt, Human
accugagccccaaaagg

SEQ ID NO: 3150445 - RNA, 12 nt, Human
accugagcccca

SEQ ID NO: 3150446 - RNA, 21 nt, Human
accugacacaccaggcgcuaa

SEQ ID NO: 3150447 - RNA, 19 nt, Human
accugacacaccaggcgcu

SEQ ID NO: 3150448 - RNA, 16 nt, Human
uccucugcacucccac

SEQ ID NO: 3150449 - RNA, 12 nt, Human
uccucugcacuc

SEQ ID NO: 3150450 - RNA, 21 nt, Human
uccugaaaacccuugccaugu

SEQ ID NO: 3150451 - RNA, 17 nt, Human
uccucuccccaugaugu

SEQ ID NO: 3150452 - RNA, 14 nt, Human
acuccagaaaguga

SEQ ID NO: 3150453 - RNA, 14 nt, Human
ucccuccaccuccc

SEQ ID NO: 3150454 - RNA, 15 nt, Human
ucccuccaccucccu

SEQ ID NO: 3150455 - RNA, 17 nt, Human
ucccuccaccucccugc

SEQ ID NO: 3150456 - RNA, 19 nt, Human
ucccuccaccucccugcaa

SEQ ID NO: 3150457 - RNA, 22 nt, Human
ucccucccagaggagccaccag

SEQ ID NO: 3150458 - RNA, 23 nt, Human
ucccucccagaggagccaccagu

SEQ ID NO: 3150459 - RNA, 20 nt, Human
acucauuuuaaaaaauggaa

SEQ ID NO: 3150460 - RNA, 21 nt, Human
acuccaaacugacucuuaaga

SEQ ID NO: 3150461 - RNA, 15 nt, Human
acuaugauuauuaac

SEQ ID NO: 3150462 - RNA, 13 nt, Human
acuauucaaacag

SEQ ID NO: 3150463 - RNA, 14 nt, Human
acuauucaaacagu

SEQ ID NO: 3150464 - RNA, 16 nt, Human
acuauucaaacagucu

SEQ ID NO: 3150465 - RNA, 24 nt, Human
uccccuccucugcuugccaucccu

SEQ ID NO: 3150466 - RNA, 14 nt, Human
uccccuccucugcu

SEQ ID NO: 3150467 - RNA, 15 nt, Human
uccccuccucugcuu

SEQ ID NO: 3150468 - RNA, 18 nt, Human
uccccuccucugcuugcc

SEQ ID NO: 3150469 - RNA, 19 nt, Human
acuacuaauagaauaaagg

SEQ ID NO: 3150470 - RNA, 12 nt, Human
acuacuuuauaa

SEQ ID NO: 3150471 - RNA, 20 nt, Human
acuagaguuuagcuggaaaa

SEQ ID NO: 3150472 - RNA, 18 nt, Human
acugggguccuggggccu

SEQ ID NO: 3150473 - RNA, 20 nt, Human
acugggguccuggggccucg

SEQ ID NO: 3150474 - RNA, 13 nt, Human
acugggggagggg

SEQ ID NO: 3150475 - RNA, 22 nt, Human
acugaagaagcaccaaucauga

SEQ ID NO: 3150476 - RNA, 12 nt, Human
acugaagaagca

SEQ ID NO: 3150477 - RNA, 18 nt, Human
acugaagccagaaauaaa

SEQ ID NO: 3150478 - RNA, 22 nt, Human
acugucauccucaaagaaagug

SEQ ID NO: 3150479 - RNA, 21 nt, Human
acugucauccucaaagaaagu

SEQ ID NO: 3150480 - RNA, 22 nt, Human
acugucagcuccccucggagaa

SEQ ID NO: 3150481 - RNA, 23 nt, Human
acugucagcuccccucggagaag

SEQ ID NO: 3150482 - RNA, 19 nt, Human
acuguggcugcuagcacuu

SEQ ID NO: 3150483 - RNA, 12 nt, Human
acuguggcugcu

SEQ ID NO: 3150484 - RNA, 18 nt, Human
ucuaccccagacuagaug

SEQ ID NO: 3150485 - RNA, 16 nt, Human
ucuaccccagacuaga

SEQ ID NO: 3150486 - RNA, 23 nt, Human
ucuaccccagacuagauguagua

SEQ ID NO: 3150487 - RNA, 21 nt, Human
ucuaccccagacuagauguag

SEQ ID NO: 3150488 - RNA, 20 nt, Human
acuuccagauccuggaaauc

SEQ ID NO: 3150489 - RNA, 13 nt, Human
ucuauaauuuaaa

SEQ ID NO: 3150490 - RNA, 16 nt, Human
ucuauaauuuaccuaa

SEQ ID NO: 3150491 - RNA, 12 nt, Human
ucuauaauuuac

SEQ ID NO: 3150492 - RNA, 12 nt, Human
ucuagcaugaag

SEQ ID NO: 3150493 - RNA, 17 nt, Human
ucucaaaacugcacugu

SEQ ID NO: 3150494 - RNA, 18 nt, Human
acuucuaaguaaaaccac

SEQ ID NO: 3150495 - RNA, 19 nt, Human
acuucuaaguaaaaccaca

SEQ ID NO: 3150496 - RNA, 13 nt, Human
acuucuaaguaaa

SEQ ID NO: 3150497 - RNA, 14 nt, Human
acuuggagccaagg

SEQ ID NO: 3150498 - RNA, 19 nt, Human
acuuggagccaaggguuca

SEQ ID NO: 3150499 - RNA, 11 nt, Human
acuuggagcca

SEQ ID NO: 3150500 - RNA, 23 nt, Human
acuugaacccgggaggcagaggu

SEQ ID NO: 3150501 - RNA, 21 nt, Human
acuugaacccgggaggcagag

SEQ ID NO: 3150502 - RNA, 14 nt, Human
agaagcuccaggua

SEQ ID NO: 3150503 - RNA, 13 nt, Human
agaaguugauaug

SEQ ID NO: 3150504 - RNA, 21 nt, Human
agaauaaaggcaguuuucuaa

SEQ ID NO: 3150505 - RNA, 20 nt, Human
agaauaaaggcaguuuucua

SEQ ID NO: 3150506 - RNA, 18 nt, Human
agaauaaaggcaguuuuc

SEQ ID NO: 3150507 - RNA, 15 nt, Human
agaauaaaggcaguu

SEQ ID NO: 3150508 - RNA, 14 nt, Human
agaauaaaggcagu

SEQ ID NO: 3150509 - RNA, 13 nt, Human
agaauaaaggcag

SEQ ID NO: 3150510 - RNA, 20 nt, Human
ucugcccauccugccccuga

SEQ ID NO: 3150511 - RNA, 19 nt, Human
agaagcaccaaucaugaau

SEQ ID NO: 3150512 - RNA, 19 nt, Human
agaagcaacccaaauguuc

SEQ ID NO: 3150513 - RNA, 16 nt, Human
agaacucccuuucaac

SEQ ID NO: 3150514 - RNA, 15 nt, Human
agaacucccuuucaa

SEQ ID NO: 3150515 - RNA, 17 nt, Human
agaacucccuuucaaca

SEQ ID NO: 3150516 - RNA, 19 nt, Human
ucucuccagcugacuaaac

SEQ ID NO: 3150517 - RNA, 18 nt, Human
ucucuccagcugacuaaa

SEQ ID NO: 3150518 - RNA, 15 nt, Human
ucucuccagcugacu

SEQ ID NO: 3150519 - RNA, 16 nt, Human
agaaacacaacuauau

SEQ ID NO: 3150520 - RNA, 15 nt, Human
agaaacuggaacucu

SEQ ID NO: 3150521 - RNA, 22 nt, Human
agaaacaguugguaacuuuugu

SEQ ID NO: 3150522 - RNA, 21 nt, Human
agaaacaguugguaacuuuug

SEQ ID NO: 3150523 - RNA, 16 nt, Human
agaaagacuauucaaa

SEQ ID NO: 3150524 - RNA, 17 nt, Human
agaaagagaaacaguug

SEQ ID NO: 3150525 - RNA, 20 nt, Human
agaaagcagaacagugauua

SEQ ID NO: 3150526 - RNA, 18 nt, Human
agaaagcagaacagugau

SEQ ID NO: 3150527 - RNA, 17 nt, Human
agaaagcagaacaguga

SEQ ID NO: 3150528 - RNA, 16 nt, Human
ucuuggguaggcggga

SEQ ID NO: 3150529 - RNA, 12 nt, Human
agacucagggcc

SEQ ID NO: 3150530 - RNA, 16 nt, Human
agacucagggccccag

SEQ ID NO: 3150531 - RNA, 17 nt, Human
agacucagggccccagc

SEQ ID NO: 3150532 - RNA, 21 nt, Human
agacucagggccccagcacua

SEQ ID NO: 3150533 - RNA, 18 nt, Human
agacucagggccccagca

SEQ ID NO: 3150534 - RNA, 20 nt, Human
agacucagggccccagcacu

SEQ ID NO: 3150535 - RNA, 12 nt, Human
agacuauucaaa

SEQ ID NO: 3150536 - RNA, 14 nt, Human
agacuauucaaaca

SEQ ID NO: 3150537 - RNA, 15 nt, Human
agacuauucaaacag

SEQ ID NO: 3150538 - RNA, 21 nt, Human
agacauagaauuaacacauga

SEQ ID NO: 3150539 - RNA, 14 nt, Human
agacauagaauuaa

SEQ ID NO: 3150540 - RNA, 18 nt, Human
agacaucaacagauaaau

SEQ ID NO: 3150541 - RNA, 17 nt, Human
agacaucaacagauaaa

SEQ ID NO: 3150542 - RNA, 14 nt, Human
agaaucacuugaac

SEQ ID NO: 3150543 - RNA, 18 nt, Human
ucuucucuccagcugacu

SEQ ID NO: 3150544 - RNA, 14 nt, Human
ucuucucuccagcu

SEQ ID NO: 3150545 - RNA, 19 nt, Human
agagacucagggccccagc

SEQ ID NO: 3150546 - RNA, 20 nt, Human
agagacucagggccccagca

SEQ ID NO: 3150547 - RNA, 21 nt, Human
agagcaguuugguuucuagca

SEQ ID NO: 3150548 - RNA, 23 nt, Human
agagcaguuugguuucuagcaug

SEQ ID NO: 3150549 - RNA, 19 nt, Human
ugaaacucguuaauuugua

SEQ ID NO: 3150550 - RNA, 22 nt, Human
ugaaaaaguucugcagauaaac

SEQ ID NO: 3150551 - RNA, 20 nt, Human
ugaaaagcuccauuuuuagu

SEQ ID NO: 3150552 - RNA, 16 nt, Human
ucuuucugaugucaaa

SEQ ID NO: 3150553 - RNA, 15 nt, Human
ugaauacuuuauaaa

SEQ ID NO: 3150554 - RNA, 23 nt, Human
agcaacgcaggcccccaggugcc

SEQ ID NO: 3150555 - RNA, 15 nt, Human
agauucccugagcag

SEQ ID NO: 3150556 - RNA, 17 nt, Human
agauucauuuuucuuuc

SEQ ID NO: 3150557 - RNA, 12 nt, Human
agauucauuuuu

SEQ ID NO: 3150558 - RNA, 22 nt, Human
ugacuucuaaguaaaaccacag

SEQ ID NO: 3150559 - RNA, 23 nt, Human
ugacuucuaaguaaaaccacagc

SEQ ID NO: 3150560 - RNA, 15 nt, Human
ugacuucuaaguaaa

SEQ ID NO: 3150561 - RNA, 16 nt, Human
ugacacuuaaaaaugg

SEQ ID NO: 3150562 - RNA, 17 nt, Human
ugacacuuaaaaauggu

SEQ ID NO: 3150563 - RNA, 16 nt, Human
agaugcaguucugaag

SEQ ID NO: 3150564 - RNA, 14 nt, Human
aacaguugguaacu

SEQ ID NO: 3150565 - RNA, 23 nt, Human
aacccaaauguucaucaaugaau

SEQ ID NO: 3150566 - RNA, 18 nt, Human
aacccaaguccaagcaua

SEQ ID NO: 3150567 - RNA, 18 nt, Human
aaccugagccccaaaagg

SEQ ID NO: 3150568 - RNA, 20 nt, Human
aaccugagccccaaaaggua

SEQ ID NO: 3150569 - RNA, 15 nt, Human
gucuggcccaccagg

SEQ ID NO: 3150570 - RNA, 16 nt, Human
gucuuucacauuuaaa

SEQ ID NO: 3150571 - RNA, 12 nt, Human
aacucauuucua

SEQ ID NO: 3150572 - RNA, 21 nt, Human
aacuagaguuuagcuggaaaa

SEQ ID NO: 3150573 - RNA, 23 nt, Human
aacuaucucauuuccaagcaagu

SEQ ID NO: 3150574 - RNA, 16 nt, Human
aacuaugauuauuaac

SEQ ID NO: 3150575 - RNA, 18 nt, Human
aaccuugaaaacuuuaug

SEQ ID NO: 3150576 - RNA, 17 nt, Human
aacuacuaauagaauaa

SEQ ID NO: 3150577 - RNA, 21 nt, Human
gugagaugcuagaacucccuu

SEQ ID NO: 3150578 - RNA, 12 nt, Human
aacugaaaucau

SEQ ID NO: 3150579 - RNA, 19 nt, Human
aacugcacugucaagauga

SEQ ID NO: 3150580 - RNA, 19 nt, Human
aacuggacugguucaaaug

SEQ ID NO: 3150581 - RNA, 17 nt, Human
aacugggacaggggaga

SEQ ID NO: 3150582 - RNA, 21 nt, Human
aacuucagcgguuuauauaag

SEQ ID NO: 3150583 - RNA, 18 nt, Human
aacuuccagauccuggaa

SEQ ID NO: 3150584 - RNA, 17 nt, Human
gugaugggaaagcauug

SEQ ID NO: 3150585 - RNA, 18 nt, Human
aacuucuugcuucuuucu

SEQ ID NO: 3150586 - RNA, 12 nt, Human
aacuucuugcuu

SEQ ID NO: 3150587 - RNA, 18 nt, Human
gugccacuuaauguaugu

SEQ ID NO: 3150588 - RNA, 15 nt, Human
gugccacuuaaugua

SEQ ID NO: 3150589 - RNA, 20 nt, Human
aaauuuuuucucuaggaaau

SEQ ID NO: 3150590 - RNA, 15 nt, Human
aacaaugcuguauuu

SEQ ID NO: 3150591 - RNA, 14 nt, Human
aacaaugcuguauu

SEQ ID NO: 3150592 - RNA, 12 nt, Human
aacaauaaaaga

SEQ ID NO: 3150593 - RNA, 22 nt, Human
aacaaugcuguauuuuaaaaga

SEQ ID NO: 3150594 - RNA, 17 nt, Human
aacaaugcuguauuuua

SEQ ID NO: 3150595 - RNA, 16 nt, Human
aacacaacuauauugu

SEQ ID NO: 3150596 - RNA, 15 nt, Human
aacacaacuauauug

SEQ ID NO: 3150597 - RNA, 16 nt, Human
aacagauaaauaguuu

SEQ ID NO: 3150598 - RNA, 22 nt, Human
aacagugauuaccagggacuga

SEQ ID NO: 3150599 - RNA, 15 nt, Human
aacagugauuaccag

SEQ ID NO: 3150600 - RNA, 15 nt, Human
aacacagcaagggug

SEQ ID NO: 3150601 - RNA, 16 nt, Human
gucaaauugugugaaa

SEQ ID NO: 3150602 - RNA, 18 nt, Human
guauguacuucaugcugu

SEQ ID NO: 3150603 - RNA, 20 nt, Human
guauccagguucccucccag

SEQ ID NO: 3150604 - RNA, 16 nt, Human
guauauuuuauaucaa

SEQ ID NO: 3150605 - RNA, 21 nt, Human
guauaaaauaauuuuuauauu

SEQ ID NO: 3150606 - RNA, 15 nt, Human
guauaaaauaauuuu

SEQ ID NO: 3150607 - RNA, 15 nt, Human
aaauggguuuuacug

SEQ ID NO: 3150608 - RNA, 14 nt, Human
aaauggguuuuacu

SEQ ID NO: 3150609 - RNA, 17 nt, Human
guaguguuggagaagaa

SEQ ID NO: 3150610 - RNA, 20 nt, Human
guaguguuggagaagaacug

SEQ ID NO: 3150611 - RNA, 23 nt, Human
aagaggaaugaaguacucauaca

SEQ ID NO: 3150612 - RNA, 16 nt, Human
aagacugcacaucaaa

SEQ ID NO: 3150613 - RNA, 21 nt, Human
guguauuuggaaauaaaguca

SEQ ID NO: 3150614 - RNA, 13 nt, Human
aagauguagagga

SEQ ID NO: 3150615 - RNA, 19 nt, Human
guguauuuggaaauaaagu

SEQ ID NO: 3150616 - RNA, 13 nt, Human
aagaugaaaauau

SEQ ID NO: 3150617 - RNA, 14 nt, Human
aagaugaaaauauu

SEQ ID NO: 3150618 - RNA, 16 nt, Human
aagcauuuagauguau

SEQ ID NO: 3150619 - RNA, 13 nt, Human
aagcauuguaaau

SEQ ID NO: 3150620 - RNA, 19 nt, Human
aagcaucuggcucuaauuc

SEQ ID NO: 3150621 - RNA, 17 nt, Human
aagcaucuggcucuaau

SEQ ID NO: 3150622 - RNA, 13 nt, Human
aagcaucuggcuc

SEQ ID NO: 3150623 - RNA, 22 nt, Human
aagcaucauuauuugcagagac

SEQ ID NO: 3150624 - RNA, 17 nt, Human
aagcaguggacaccagg

SEQ ID NO: 3150625 - RNA, 14 nt, Human
aagcuccagguaga

SEQ ID NO: 3150626 - RNA, 13 nt, Human
aagcuccagguag

SEQ ID NO: 3150627 - RNA, 20 nt, Human
aagcucacagaccuuugaac

SEQ ID NO: 3150628 - RNA, 20 nt, Human
guuauuauauuuacaaaugg

SEQ ID NO: 3150629 - RNA, 13 nt, Human
aagguacuucaaa

SEQ ID NO: 3150630 - RNA, 14 nt, Human
aagguacuucaaau

SEQ ID NO: 3150631 - RNA, 13 nt, Human
aaggauaaugaau

SEQ ID NO: 3150632 - RNA, 18 nt, Human
aaggaggguuagggaggg

SEQ ID NO: 3150633 - RNA, 19 nt, Human
aaggaggguuagggagggg

SEQ ID NO: 3150634 - RNA, 20 nt, Human
uaaaagacagugaaagaaaa

SEQ ID NO: 3150635 - RNA, 16 nt, Human
uaaaagaauauuuuaa

SEQ ID NO: 3150636 - RNA, 23 nt, Human
uaaaagaauauuuuaacuuccuu

SEQ ID NO: 3150637 - RNA, 12 nt, Human
uaaaagaaugau

SEQ ID NO: 3150638 - RNA, 13 nt, Human
aaguauuagaaua

SEQ ID NO: 3150639 - RNA, 14 nt, Human
aaguaaugauaacu

SEQ ID NO: 3150640 - RNA, 19 nt, Human
guuuuuccuuguauuuaaa

SEQ ID NO: 3150641 - RNA, 16 nt, Human
aagucuuucacauuua

SEQ ID NO: 3150642 - RNA, 22 nt, Human
aagucuuauauauuguagauaa

SEQ ID NO: 3150643 - RNA, 14 nt, Human
aauuacauuuguau

SEQ ID NO: 3150644 - RNA, 13 nt, Human
aauuacauuugua

SEQ ID NO: 3150645 - RNA, 17 nt, Human
aauuagacacuuuggaa

SEQ ID NO: 3150646 - RNA, 16 nt, Human
aauuagacacuuugga

SEQ ID NO: 3150647 - RNA, 23 nt, Human
aauucaaggaauuucuuaacuuc

SEQ ID NO: 3150648 - RNA, 17 nt, Human
aauucaaggaauuucuu

SEQ ID NO: 3150649 - RNA, 16 nt, Human
aauucaaggaauuucu

SEQ ID NO: 3150650 - RNA, 19 nt, Human
uaccagggacugaggggag

SEQ ID NO: 3150651 - RNA, 20 nt, Human
uaccaguauuuagaagccaa

SEQ ID NO: 3150652 - RNA, 19 nt, Human
uaccaguauuuagaagcca

SEQ ID NO: 3150653 - RNA, 18 nt, Human
uaccaguauuuagaagcc

SEQ ID NO: 3150654 - RNA, 15 nt, Human
uaccaguauuuagaa

SEQ ID NO: 3150655 - RNA, 12 nt, Human
uaccaguauuua

SEQ ID NO: 3150656 - RNA, 16 nt, Human
uaccaugccauuuaaa

SEQ ID NO: 3150657 - RNA, 19 nt, Human
uaccaguuaauuuuuccaa

SEQ ID NO: 3150658 - RNA, 18 nt, Human
uaccaguuaauuuuucca

SEQ ID NO: 3150659 - RNA, 13 nt, Human
aauguucaucaau

SEQ ID NO: 3150660 - RNA, 20 nt, Human
aauguucaucaaugaaugaa

SEQ ID NO: 3150661 - RNA, 16 nt, Human
aauguucaucaaugaa

SEQ ID NO: 3150662 - RNA, 22 nt, Human
uaauuccguagguuauuuucag

SEQ ID NO: 3150663 - RNA, 18 nt, Human
uaauuuuuauauuugaaa

SEQ ID NO: 3150664 - RNA, 21 nt, Human
uaauuuuuauauuugaaauau

SEQ ID NO: 3150665 - RNA, 19 nt, Human
uaauuuuuauauuugaaau

SEQ ID NO: 3150666 - RNA, 16 nt, Human
aaugauuucauucaau

SEQ ID NO: 3150667 - RNA, 22 nt, Human
aaugagagacacacugaagaag

SEQ ID NO: 3150668 - RNA, 23 nt, Human
aaugauuaugaauuacauuugua

SEQ ID NO: 3150669 - RNA, 17 nt, Human
uacagagacagaaagca

SEQ ID NO: 3150670 - RNA, 13 nt, Human
uacagaauuuuau

SEQ ID NO: 3150671 - RNA, 20 nt, Human
aauguaagggaaacugccag

SEQ ID NO: 3150672 - RNA, 21 nt, Human
uacaaaaaaaaaaaaaaauua

SEQ ID NO: 3150673 - RNA, 17 nt, Human
uaauuuuuauauuugaa

SEQ ID NO: 3150674 - RNA, 13 nt, Human
uaauuuuuccaac

SEQ ID NO: 3150675 - RNA, 14 nt, Human
uaauuuuuccaacu

SEQ ID NO: 3150676 - RNA, 21 nt, Human
aaugcuguauuuuaaaagaau

SEQ ID NO: 3150677 - RNA, 20 nt, Human
aaugcuguauuuuaaaagaa

SEQ ID NO: 3150678 - RNA, 22 nt, Human
aaugcuguauuuuaaaagaaug

SEQ ID NO: 3150679 - RNA, 14 nt, Human
uaagcaaaauguga

SEQ ID NO: 3150680 - RNA, 15 nt, Human
uaagcaaaaugugau

SEQ ID NO: 3150681 - RNA, 19 nt, Human
uaagauuacaaaucagaag

SEQ ID NO: 3150682 - RNA, 22 nt, Human
uaagauuacaaaucagaaguca

SEQ ID NO: 3150683 - RNA, 16 nt, Human
aaucagccuaguugau

SEQ ID NO: 3150684 - RNA, 13 nt, Human
uaaguaaaaccac

SEQ ID NO: 3150685 - RNA, 15 nt, Human
uaaguaaaaccacag

SEQ ID NO: 3150686 - RNA, 18 nt, Human
uaagguuaccuuuguucc

SEQ ID NO: 3150687 - RNA, 20 nt, Human
uaaguaaugauaacuggaaa

SEQ ID NO: 3150688 - RNA, 16 nt, Human
uaaguaaaaccacagc

SEQ ID NO: 3150689 - RNA, 17 nt, Human
uaaguaaaaccacagca

SEQ ID NO: 3150690 - RNA, 18 nt, Human
uaaguaaaaccacagcag

SEQ ID NO: 3150691 - RNA, 18 nt, Human
uaaguuuuuuuuuaaaaa

SEQ ID NO: 3150692 - RNA, 12 nt, Human
uaauaaaaaggu

SEQ ID NO: 3150693 - RNA, 15 nt, Human
uaauaaaaaggugac

SEQ ID NO: 3150694 - RNA, 14 nt, Human
uaauaaaaagguga

SEQ ID NO: 3150695 - RNA, 20 nt, Human
aauccucaguuuuugugaaa

SEQ ID NO: 3150696 - RNA, 22 nt, Human
uaacauguccugccuauuaucu

SEQ ID NO: 3150697 - RNA, 19 nt, Human
aauagucaaauugugugaa

SEQ ID NO: 3150698 - RNA, 21 nt, Human
uaacuuccuuggacucauuuu

SEQ ID NO: 3150699 - RNA, 13 nt, Human
uaagaagugaaaa

SEQ ID NO: 3150700 - RNA, 23 nt, Human
aauaccacaggaaccacaagacu

SEQ ID NO: 3150701 - RNA, 18 nt, Human
aauaccaugccauuuaaa

SEQ ID NO: 3150702 - RNA, 23 nt, Human
aauacaucccuuaccugggaaag

SEQ ID NO: 3150703 - RNA, 16 nt, Human
uaaaugugcuuuuaaa

SEQ ID NO: 3150704 - RNA, 21 nt, Human
aaguguauuuggaaauaaagu

SEQ ID NO: 3150705 - RNA, 15 nt, Human
aaguguauuuggaaa

SEQ ID NO: 3150706 - RNA, 13 nt, Human
aaguguauuugga

SEQ ID NO: 3150707 - RNA, 19 nt, Human
uaucuauaauuuaccuaag

SEQ ID NO: 3150708 - RNA, 16 nt, Human
uaucuauaauuuaccu

SEQ ID NO: 3150709 - RNA, 14 nt, Human
uaucuauaauuuac

SEQ ID NO: 3150710 - RNA, 13 nt, Human
uaucuauaauuua

SEQ ID NO: 3150711 - RNA, 16 nt, Human
uaucaaacugaagcca

SEQ ID NO: 3150712 - RNA, 14 nt, Human
acagaccuuugaac

SEQ ID NO: 3150713 - RNA, 14 nt, Human
uaucacaaaucuua

SEQ ID NO: 3150714 - RNA, 16 nt, Human
uaucacaaaucuuaac

SEQ ID NO: 3150715 - RNA, 20 nt, Human
uaucacaaaucuuaacuuga

SEQ ID NO: 3150716 - RNA, 19 nt, Human
acagaaagcagaacaguga

SEQ ID NO: 3150717 - RNA, 22 nt, Human
acacuucuucuuggucuuauuu

SEQ ID NO: 3150718 - RNA, 19 nt, Human
uauaggaauugacccacaa

SEQ ID NO: 3150719 - RNA, 16 nt, Human
uauaggugcuacaaaa

SEQ ID NO: 3150720 - RNA, 21 nt, Human
uauaucuaccccagacuagau

SEQ ID NO: 3150721 - RNA, 20 nt, Human
uauaauuuaccuaagauuac

SEQ ID NO: 3150722 - RNA, 18 nt, Human
uauaauuuaccuaagauu

SEQ ID NO: 3150723 - RNA, 17 nt, Human
uauaauuuaccuaagau

SEQ ID NO: 3150724 - RNA, 16 nt, Human
uauaauuuaccuaaga

SEQ ID NO: 3150725 - RNA, 14 nt, Human
uauaauuuaccuaa

SEQ ID NO: 3150726 - RNA, 13 nt, Human
acacucaaaucaa

SEQ ID NO: 3150727 - RNA, 19 nt, Human
acacuaagagagaaugaga

SEQ ID NO: 3150728 - RNA, 17 nt, Human
acacucaaaucaagaaa

SEQ ID NO: 3150729 - RNA, 23 nt, Human
acagcccuuaugcgguuaauuuu

SEQ ID NO: 3150730 - RNA, 22 nt, Human
acagcccuuaugcgguuaauuu

SEQ ID NO: 3150731 - RNA, 18 nt, Human
acagcaagggugauggga

SEQ ID NO: 3150732 - RNA, 23 nt, Human
acagcuguaugauucccagccag

SEQ ID NO: 3150733 - RNA, 20 nt, Human
acagcuguaugauucccagc

SEQ ID NO: 3150734 - RNA, 19 nt, Human
acagcuguaugauucccag

SEQ ID NO: 3150735 - RNA, 14 nt, Human
acagcuguaugauu

SEQ ID NO: 3150736 - RNA, 13 nt, Human
uagacacacauga

SEQ ID NO: 3150737 - RNA, 15 nt, Human
uagacacuuuggaag

SEQ ID NO: 3150738 - RNA, 15 nt, Human
uagaacucccuuuca

SEQ ID NO: 3150739 - RNA, 17 nt, Human
uagaacucccuuucaac

SEQ ID NO: 3150740 - RNA, 16 nt, Human
uagaacucccuuucaa

SEQ ID NO: 3150741 - RNA, 15 nt, Human
uagaaacacaacuau

SEQ ID NO: 3150742 - RNA, 14 nt, Human
acaaaaacacagca

SEQ ID NO: 3150743 - RNA, 15 nt, Human
acaaaaacacagcaa

SEQ ID NO: 3150744 - RNA, 13 nt, Human
acaaaaacacagc

SEQ ID NO: 3150745 - RNA, 18 nt, Human
acaaaaggauaaugaaua

SEQ ID NO: 3150746 - RNA, 14 nt, Human
uagaggguguguaa

SEQ ID NO: 3150747 - RNA, 14 nt, Human
acaaaucagaaguc

SEQ ID NO: 3150748 - RNA, 23 nt, Human
acaaaucagaagucaucuugcua

SEQ ID NO: 3150749 - RNA, 16 nt, Human
acaaaucagaagucau

SEQ ID NO: 3150750 - RNA, 15 nt, Human
acaaaucagaaguca

SEQ ID NO: 3150751 - RNA, 13 nt, Human
uaggauguugaaa

SEQ ID NO: 3150752 - RNA, 20 nt, Human
acaaaucagaagucaucuug

SEQ ID NO: 3150753 - RNA, 13 nt, Human
acacaacuauauu

SEQ ID NO: 3150754 - RNA, 21 nt, Human
acacaggcaacugaggcagac

SEQ ID NO: 3150755 - RNA, 19 nt, Human
accaaggcugauuaaacca

SEQ ID NO: 3150756 - RNA, 20 nt, Human
accaaggcugauuaaaccaa

SEQ ID NO: 3150757 - RNA, 20 nt, Human
acaucccuuaccugggaaag

SEQ ID NO: 3150758 - RNA, 20 nt, Human
acagugauuaccagggacug

SEQ ID NO: 3150759 - RNA, 21 nt, Human
acagugauuaccagggacuga

SEQ ID NO: 3150760 - RNA, 14 nt, Human
acagugggugcccc

SEQ ID NO: 3150761 - RNA, 21 nt, Human
acagugggugccccccuugcc

SEQ ID NO: 3150762 - RNA, 16 nt, Human
acagaagcuccaggua

SEQ ID NO: 3150763 - RNA, 15 nt, Human
acacugggggagggg

SEQ ID NO: 3150764 - RNA, 16 nt, Human
acacugggggagggga

SEQ ID NO: 3150765 - RNA, 17 nt, Human
aauuuugugaagcaaaa

SEQ ID NO: 3150766 - RNA, 13 nt, Human
aauuuugugaagc

SEQ ID NO: 3150767 - RNA, 18 nt, Human
aauuuugugaagcaaaau

SEQ ID NO: 3150768 - RNA, 13 nt, Human
acaagaaaugaaa

SEQ ID NO: 3150769 - RNA, 16 nt, Human
acaagaaaugaaagca

SEQ ID NO: 3150770 - RNA, 15 nt, Human
acaagaaaugaaagc

SEQ ID NO: 3150771 - RNA, 21 nt, Human
acaaggaugaauuaaguuuuu

SEQ ID NO: 3150772 - RNA, 18 nt, Human
accucugccucagaaaac

SEQ ID NO: 3150773 - RNA, 17 nt, Human
accucugccucagaaaa

SEQ ID NO: 3150774 - RNA, 19 nt, Human
acggacgaaccuugaaaac

SEQ ID NO: 3150775 - RNA, 20 nt, Human
acuaauagaauaaaggcagu

SEQ ID NO: 3150776 - RNA, 18 nt, Human
acuauugaaguugcagau

SEQ ID NO: 3150777 - RNA, 18 nt, Human
acuaguauuucuaugaaa

SEQ ID NO: 3150778 - RNA, 17 nt, Human
acucugucucaguccau

SEQ ID NO: 3150779 - RNA, 15 nt, Human
acucugucucagucc

SEQ ID NO: 3150780 - RNA, 15 nt, Human
acucuuaagaagacu

SEQ ID NO: 3150781 - RNA, 14 nt, Human
acucuuaagaagac

SEQ ID NO: 3150782 - RNA, 19 nt, Human
acuucaaauccuugaagau

SEQ ID NO: 3150783 - RNA, 14 nt, Human
acuuaaaaaugguu

SEQ ID NO: 3150784 - RNA, 13 nt, Human
acuuaaaaauggu

SEQ ID NO: 3150785 - RNA, 19 nt, Human
acuucagcgguuuauauaa

SEQ ID NO: 3150786 - RNA, 18 nt, Human
acuucagcgguuuauaua

SEQ ID NO: 3150787 - RNA, 17 nt, Human
acuucagcgguuuauau

SEQ ID NO: 3150788 - RNA, 20 nt, Human
acuucaaauccuugaagauu

SEQ ID NO: 3150789 - RNA, 22 nt, Human
acuugggaggcugagaugggag

SEQ ID NO: 3150790 - RNA, 17 nt, Human
acuuuaugcuaagugaa

SEQ ID NO: 3150791 - RNA, 12 nt, Human
acuuuaugcuaa

SEQ ID NO: 3150792 - RNA, 15 nt, Human
aagagaacuuccaga

SEQ ID NO: 3150793 - RNA, 23 nt, Human
aagacagugaaagaaaauaacaa

SEQ ID NO: 3150794 - RNA, 15 nt, Human
aagcagggacuugaa

SEQ ID NO: 3150795 - RNA, 21 nt, Human
aagggauuuucagcccucaga

SEQ ID NO: 3150796 - RNA, 23 nt, Human
aagggauuuucagcccucagaau

SEQ ID NO: 3150797 - RNA, 14 nt, Human
aagggauggcaaga

SEQ ID NO: 3150798 - RNA, 17 nt, Human
aagggauggcaagaugu

SEQ ID NO: 3150799 - RNA, 15 nt, Human
aagggauuuucagcc

SEQ ID NO: 3150800 - RNA, 12 nt, Human
aaguagaggagg

SEQ ID NO: 3150801 - RNA, 19 nt, Human
aagccagauuuuccugaaa

SEQ ID NO: 3150802 - RNA, 14 nt, Human
aaggaauuucuuaa

SEQ ID NO: 3150803 - RNA, 20 nt, Human
aaggaauuucuuaacuucuu

SEQ ID NO: 3150804 - RNA, 19 nt, Human
aaggaauuucuuaacuucu

SEQ ID NO: 3150805 - RNA, 17 nt, Human
aaggaauuucuuaacuu

SEQ ID NO: 3150806 - RNA, 16 nt, Human
aaggaauuucuuaacu

SEQ ID NO: 3150807 - RNA, 23 nt, Human
aaggaauuucuuaacuucuugcu

SEQ ID NO: 3150808 - RNA, 17 nt, Human
aauccauacauuugugu

SEQ ID NO: 3150809 - RNA, 14 nt, Human
aauccauacauuug

SEQ ID NO: 3150810 - RNA, 16 nt, Human
aauccauacauuugug

SEQ ID NO: 3150811 - RNA, 15 nt, Human
aauccaaugaaauga

SEQ ID NO: 3150812 - RNA, 14 nt, Human
aaugauaacuggaa

SEQ ID NO: 3150813 - RNA, 16 nt, Human
aaugauaacuggaaac

SEQ ID NO: 3150814 - RNA, 15 nt, Human
aaugauaacuggaaa

SEQ ID NO: 3150815 - RNA, 15 nt, Human
aaucaaauaugcaaa

SEQ ID NO: 3150816 - RNA, 16 nt, Human
aaucaaauaugcaaag

SEQ ID NO: 3150817 - RNA, 22 nt, Human
aaucaaauaugcaaagcacuga

SEQ ID NO: 3150818 - RNA, 22 nt, Human
aaucauuucugcaucagcugcu

SEQ ID NO: 3150819 - RNA, 10 nt, Human
aauaaaccau

SEQ ID NO: 3150820 - RNA, 17 nt, Human
aaguucugcagauaaac

SEQ ID NO: 3150821 - RNA, 22 nt, Human
aaguugauaugccuuuucccaa

SEQ ID NO: 3150822 - RNA, 12 nt, Human
aauaauguuuca

SEQ ID NO: 3150823 - RNA, 14 nt, Human
aauaauguuucaaa

SEQ ID NO: 3150824 - RNA, 13 nt, Human
aacugaagccaga

SEQ ID NO: 3150825 - RNA, 23 nt, Human
aacugagaugugaacacaucagc

SEQ ID NO: 3150826 - RNA, 22 nt, Human
aaauugacacuuaaaaaugguu

SEQ ID NO: 3150827 - RNA, 20 nt, Human
aaauguucaucaaugaauga

SEQ ID NO: 3150828 - RNA, 17 nt, Human
aaauguucaucaaugaa

SEQ ID NO: 3150829 - RNA, 14 nt, Human
aaaucuuaacuuga

SEQ ID NO: 3150830 - RNA, 19 nt, Human
aaaauccauacauuugugu

SEQ ID NO: 3150831 - RNA, 13 nt, Human
aaaauucauuuuu

SEQ ID NO: 3150832 - RNA, 13 nt, Human
aaagaaacauuug

SEQ ID NO: 3150833 - RNA, 21 nt, Human
aaacccugucucuacuaaaaa

SEQ ID NO: 3150834 - RNA, 19 nt, Human
aaaggcagaagcaacccaa

SEQ ID NO: 3150835 - RNA, 16 nt, Human
aaaggcaguuuucuaa

SEQ ID NO: 3150836 - RNA, 14 nt, Human
aaaggcaguuuucu

SEQ ID NO: 3150837 - RNA, 13 nt, Human
aaaggcaguuuuc

SEQ ID NO: 3150838 - RNA, 19 nt, Human
aaagcauuguaaaugugcu

SEQ ID NO: 3150839 - RNA, 20 nt, Human
aaagcauuguaaaugugcuu

SEQ ID NO: 3150840 - RNA, 13 nt, Human
agaggaaugaagu

SEQ ID NO: 3150841 - RNA, 16 nt, Human
agacuggauaguccgu

SEQ ID NO: 3150842 - RNA, 18 nt, Human
agacucugucucagucca

SEQ ID NO: 3150843 - RNA, 12 nt, Human
agacagcagcuc

SEQ ID NO: 3150844 - RNA, 14 nt, Human
agacagcagcucag

SEQ ID NO: 3150845 - RNA, 16 nt, Human
agacagcagcucaggc

SEQ ID NO: 3150846 - RNA, 19 nt, Human
agacccaaaaggcagaagc

SEQ ID NO: 3150847 - RNA, 17 nt, Human
agacccaaaaggcagaa

SEQ ID NO: 3150848 - RNA, 22 nt, Human
agaagagcuguucacagccaga

SEQ ID NO: 3150849 - RNA, 21 nt, Human
agaagagcuguucacagccag

SEQ ID NO: 3150850 - RNA, 17 nt, Human
agaaugauuaugaauua

SEQ ID NO: 3150851 - RNA, 22 nt, Human
agaaugagagacacacugaaga

SEQ ID NO: 3150852 - RNA, 17 nt, Human
agaaugagagacacacu

SEQ ID NO: 3150853 - RNA, 22 nt, Human
agaagucaucuugcuaccagua

SEQ ID NO: 3150854 - RNA, 16 nt, Human
agaagucaucuugcua

SEQ ID NO: 3150855 - RNA, 15 nt, Human
agaagucaucuugcu

SEQ ID NO: 3150856 - RNA, 21 nt, Human
agaagugaaaaucuacacucc

SEQ ID NO: 3150857 - RNA, 14 nt, Human
agcacuuggagcca

SEQ ID NO: 3150858 - RNA, 17 nt, Human
agcacuuggagccaagg

SEQ ID NO: 3150859 - RNA, 16 nt, Human
agauguagaggagaaa

SEQ ID NO: 3150860 - RNA, 19 nt, Human
agauguagaggagaaacug

SEQ ID NO: 3150861 - RNA, 24 nt, Human
agcaaaauuuuuucucuaggaaau

SEQ ID NO: 3150862 - RNA, 23 nt, Human
agcaaaauuuuuucucuaggaaa

SEQ ID NO: 3150863 - RNA, 11 nt, Human
agccagcagcc

SEQ ID NO: 3150864 - RNA, 13 nt, Human
agccagcagccag

SEQ ID NO: 3150865 - RNA, 14 nt, Human
agccagcagccagc

SEQ ID NO: 3150866 - RNA, 16 nt, Human
agccagcagccagcuc

SEQ ID NO: 3150867 - RNA, 20 nt, Human
agccagcagccagcucucag

SEQ ID NO: 3150868 - RNA, 17 nt, Human
agcuccccucggagaag

SEQ ID NO: 3150869 - RNA, 19 nt, Human
agcuccccucggagaagag

SEQ ID NO: 3150870 - RNA, 20 nt, Human
agcuccccucggagaagagc

SEQ ID NO: 3150871 - RNA, 20 nt, Human
agcugcugaaacaacaaaua

SEQ ID NO: 3150872 - RNA, 17 nt, Human
agcgacagugagacucu

SEQ ID NO: 3150873 - RNA, 13 nt, Human
aggaaguagagga

SEQ ID NO: 3150874 - RNA, 20 nt, Human
agcuuauuuccucauuuuua

SEQ ID NO: 3150875 - RNA, 14 nt, Human
aggcgggaaggagg

SEQ ID NO: 3150876 - RNA, 15 nt, Human
aggcgggaaggaggg

SEQ ID NO: 3150877 - RNA, 15 nt, Human
agggacugaggggag

SEQ ID NO: 3150878 - RNA, 23 nt, Human
aggcuuagacccucaugcugcca

SEQ ID NO: 3150879 - RNA, 24 nt, Human
aggcuuagacccucaugcugccaa

SEQ ID NO: 3150880 - RNA, 21 nt, Human
aggccaugggcacugugggua

SEQ ID NO: 3150881 - RNA, 15 nt, Human
agggauuagggagag

SEQ ID NO: 3150882 - RNA, 17 nt, Human
agggauuuucagcccuc

SEQ ID NO: 3150883 - RNA, 22 nt, Human
agggauuuucagcccucagaau

SEQ ID NO: 3150884 - RNA, 22 nt, Human
aggguccuuuugacacugcucu

SEQ ID NO: 3150885 - RNA, 17 nt, Human
aggguccuuuugacacu

SEQ ID NO: 3150886 - RNA, 20 nt, Human
aguauuuuuuguauaauugg

SEQ ID NO: 3150887 - RNA, 19 nt, Human
aguauuuuuuguauaauug

SEQ ID NO: 3150888 - RNA, 13 nt, Human
aguauuuuuugua

SEQ ID NO: 3150889 - RNA, 22 nt, Human
aguauuuuuuguauaauuggau

SEQ ID NO: 3150890 - RNA, 16 nt, Human
aguacuguguacagaa

SEQ ID NO: 3150891 - RNA, 23 nt, Human
aguucagagcugcccucuccugg

SEQ ID NO: 3150892 - RNA, 21 nt, Human
aguucagagcugcccucuccu

SEQ ID NO: 3150893 - RNA, 22 nt, Human
aguucagagcugcccucuccug

SEQ ID NO: 3150894 - RNA, 20 nt, Human
aguucagagcugcccucucc

SEQ ID NO: 3150895 - RNA, 19 nt, Human
aguucagagcugcccucuc

SEQ ID NO: 3150896 - RNA, 19 nt, Human
aguugaaaagacuccaaag

SEQ ID NO: 3150897 - RNA, 20 nt, Human
aguugaaaagacuccaaaga

SEQ ID NO: 3150898 - RNA, 14 nt, Human
aguugaaaagacuc

SEQ ID NO: 3150899 - RNA, 18 nt, Human
aguugaaaagacuccaaa

SEQ ID NO: 3150900 - RNA, 17 nt, Human
agugcucuuuucuccuc

SEQ ID NO: 3150901 - RNA, 14 nt, Human
agugcucuuuucuc

SEQ ID NO: 3150902 - RNA, 19 nt, Human
agugucaaugcagccccca

SEQ ID NO: 3150903 - RNA, 13 nt, Human
auauuauguuaaa

SEQ ID NO: 3150904 - RNA, 14 nt, Human
auauuauguuaaaa

SEQ ID NO: 3150905 - RNA, 23 nt, Human
auauuucagauaaucacaauaca

SEQ ID NO: 3150906 - RNA, 15 nt, Human
auagcagcuuauuca

SEQ ID NO: 3150907 - RNA, 20 nt, Human
auaacaaugcuguauuuuaa

SEQ ID NO: 3150908 - RNA, 19 nt, Human
auaacaaugcuguauuuua

SEQ ID NO: 3150909 - RNA, 21 nt, Human
auaacaaugcuguauuuuaaa

SEQ ID NO: 3150910 - RNA, 17 nt, Human
auaacaaugcuguauuu

SEQ ID NO: 3150911 - RNA, 15 nt, Human
auaacaaugcuguau

SEQ ID NO: 3150912 - RNA, 14 nt, Human
auaacaaugaaagu

SEQ ID NO: 3150913 - RNA, 18 nt, Human
auaauguuucaaacauau

SEQ ID NO: 3150914 - RNA, 13 nt, Human
auaauguuucaaa

SEQ ID NO: 3150915 - RNA, 14 nt, Human
auaagccagacauc

SEQ ID NO: 3150916 - RNA, 22 nt, Human
auaagccagacaucaacagaua

SEQ ID NO: 3150917 - RNA, 21 nt, Human
auaagccagacaucaacagau

SEQ ID NO: 3150918 - RNA, 19 nt, Human
auccucaguuuuugugaaa

SEQ ID NO: 3150919 - RNA, 17 nt, Human
aucgcuccaccuugcag

SEQ ID NO: 3150920 - RNA, 21 nt, Human
aucgcuccaccuugcagcucu

SEQ ID NO: 3150921 - RNA, 17 nt, Human
aucaugaauuaguuuua

SEQ ID NO: 3150922 - RNA, 22 nt, Human
aucagcuugcccuguuaaaaga

SEQ ID NO: 3150923 - RNA, 13 nt, Human
aucagcuuauugu

SEQ ID NO: 3150924 - RNA, 14 nt, Human
aucaaauaugcaaa

SEQ ID NO: 3150925 - RNA, 13 nt, Human
aucuauaauuuac

SEQ ID NO: 3150926 - RNA, 11 nt, Human
aucuauaauuu

SEQ ID NO: 3150927 - RNA, 23 nt, Human
aucuauaauuuaccuaagauuac

SEQ ID NO: 3150928 - RNA, 16 nt, Human
aucuauaauuuaccua

SEQ ID NO: 3150929 - RNA, 21 nt, Human
augaaguacucauacauguua

SEQ ID NO: 3150930 - RNA, 13 nt, Human
augaaguacucau

SEQ ID NO: 3150931 - RNA, 23 nt, Human
augaaguccaagcauuuagaugu

SEQ ID NO: 3150932 - RNA, 20 nt, Human
augaaguccaagcauuuaga

SEQ ID NO: 3150933 - RNA, 18 nt, Human
augaugaucuuuaaaaua

SEQ ID NO: 3150934 - RNA, 21 nt, Human
augaugaucuuuaaaauacac

SEQ ID NO: 3150935 - RNA, 16 nt, Human
augaucuuuaaaauac

SEQ ID NO: 3150936 - RNA, 21 nt, Human
augucaaucagccuaguugau

SEQ ID NO: 3150937 - RNA, 16 nt, Human
augucaaucagccuag

SEQ ID NO: 3150938 - RNA, 15 nt, Human
augugaacacaucag

SEQ ID NO: 3150939 - RNA, 15 nt, Human
auguuccuagugaaa

SEQ ID NO: 3150940 - RNA, 16 nt, Human
auguuccuagugaaag

SEQ ID NO: 3150941 - RNA, 17 nt, Human
auguuccuagugaaaga

SEQ ID NO: 3150942 - RNA, 15 nt, Human
ugaaugaauggcuaa

SEQ ID NO: 3150943 - RNA, 17 nt, Human
ugaccacugcagaagac

SEQ ID NO: 3150944 - RNA, 16 nt, Human
ugaccacugcagaaga

SEQ ID NO: 3150945 - RNA, 13 nt, Human
ugaauuacauuug

SEQ ID NO: 3150946 - RNA, 14 nt, Human
ugaauuaaguuuuu

SEQ ID NO: 3150947 - RNA, 21 nt, Human
ugacuaaacuuuuuuucugua

SEQ ID NO: 3150948 - RNA, 19 nt, Human
ugacuaaacuuuuuuucug

SEQ ID NO: 3150949 - RNA, 18 nt, Human
ugacuaaacuuuuuuucu

SEQ ID NO: 3150950 - RNA, 12 nt, Human
ugacuaaacuuu

SEQ ID NO: 3150951 - RNA, 13 nt, Human
ugacucuuaagaa

SEQ ID NO: 3150952 - RNA, 15 nt, Human
ugacucuuaagaaga

SEQ ID NO: 3150953 - RNA, 14 nt, Human
ugacucuuaagaag

SEQ ID NO: 3150954 - RNA, 16 nt, Human
ugacucuuaagaagac

SEQ ID NO: 3150955 - RNA, 20 nt, Human
ugagaaagacuauucaaaca

SEQ ID NO: 3150956 - RNA, 20 nt, Human
ugagcaggauuuuaaucuuu

SEQ ID NO: 3150957 - RNA, 15 nt, Human
ugagcaggauuuuaa

SEQ ID NO: 3150958 - RNA, 24 nt, Human
ugaggcagacagcagcucaggcac

SEQ ID NO: 3150959 - RNA, 12 nt, Human
ugaggcagacag

SEQ ID NO: 3150960 - RNA, 13 nt, Human
ugaggcagacagc

SEQ ID NO: 3150961 - RNA, 14 nt, Human
ugaggcagacagca

SEQ ID NO: 3150962 - RNA, 15 nt, Human
ugaggcagacagcag

SEQ ID NO: 3150963 - RNA, 16 nt, Human
ugaggcagacagcagc

SEQ ID NO: 3150964 - RNA, 17 nt, Human
ugaggcagacagcagcu

SEQ ID NO: 3150965 - RNA, 20 nt, Human
ugaggcagacagcagcucag

SEQ ID NO: 3150966 - RNA, 23 nt, Human
ugaggcagacagcagcucaggca

SEQ ID NO: 3150967 - RNA, 17 nt, Human
ucuuuccacagaagcuc

SEQ ID NO: 3150968 - RNA, 22 nt, Human
ucuuaggguuaugauuaaguaa

SEQ ID NO: 3150969 - RNA, 14 nt, Human
ucuuauaauuuaaa

SEQ ID NO: 3150970 - RNA, 13 nt, Human
ucuuauaauuuaa

SEQ ID NO: 3150971 - RNA, 19 nt, Human
ucuugccaaauauaaauaa

SEQ ID NO: 3150972 - RNA, 16 nt, Human
ucuucuuggucucagu

SEQ ID NO: 3150973 - RNA, 21 nt, Human
ucugcacucccaccugacaca

SEQ ID NO: 3150974 - RNA, 18 nt, Human
ucugcacucccaccugac

SEQ ID NO: 3150975 - RNA, 14 nt, Human
ucugucucagucca

SEQ ID NO: 3150976 - RNA, 13 nt, Human
uccagggcccuga

SEQ ID NO: 3150977 - RNA, 20 nt, Human
uccaagcauuuagauguaua

SEQ ID NO: 3150978 - RNA, 20 nt, Human
uccagggcccugagcucggu

SEQ ID NO: 3150979 - RNA, 16 nt, Human
uccagggcccugagcu

SEQ ID NO: 3150980 - RNA, 17 nt, Human
uccagggcccugagcuc

SEQ ID NO: 3150981 - RNA, 19 nt, Human
ucauggaauuggagcucgu

SEQ ID NO: 3150982 - RNA, 21 nt, Human
ucauggaauuggagcucgugg

SEQ ID NO: 3150983 - RNA, 20 nt, Human
ucagucucucuucucuccag

SEQ ID NO: 3150984 - RNA, 18 nt, Human
ucaguccaugaagaugua

SEQ ID NO: 3150985 - RNA, 22 nt, Human
ucagcuccccucggagaagagc

SEQ ID NO: 3150986 - RNA, 21 nt, Human
ucagcuccccucggagaagag

SEQ ID NO: 3150987 - RNA, 20 nt, Human
ucaggagaggggcagaacag

SEQ ID NO: 3150988 - RNA, 15 nt, Human
ucaggagaggggcag

SEQ ID NO: 3150989 - RNA, 17 nt, Human
ucaggagaggggcagaa

SEQ ID NO: 3150990 - RNA, 18 nt, Human
ucaggagaggggcagaac

SEQ ID NO: 3150991 - RNA, 16 nt, Human
ucagcugcugaaacaa

SEQ ID NO: 3150992 - RNA, 22 nt, Human
ucagccuagccgaccucagccu

SEQ ID NO: 3150993 - RNA, 23 nt, Human
ucagccuagccgaccucagccuu

SEQ ID NO: 3150994 - RNA, 23 nt, Human
uccuuagcuuagaccucagccug

SEQ ID NO: 3150995 - RNA, 15 nt, Human
uccuugcaucaauuu

SEQ ID NO: 3150996 - RNA, 17 nt, Human
uccuugcaucaauuuuu

SEQ ID NO: 3150997 - RNA, 18 nt, Human
uccuuuugacacugcucu

SEQ ID NO: 3150998 - RNA, 16 nt, Human
uccuuuugacacugcu

SEQ ID NO: 3150999 - RNA, 14 nt, Human
uccuuuugacacug

SEQ ID NO: 3151000 - RNA, 13 nt, Human
uccuuuugacacu

SEQ ID NO: 3151001 - RNA, 22 nt, Human
uccuuuugacacugcucuaaca

SEQ ID NO: 3151002 - RNA, 20 nt, Human
uccuuuugacacugcucuaa

SEQ ID NO: 3151003 - RNA, 16 nt, Human
ucggccuccauccuga

SEQ ID NO: 3151004 - RNA, 15 nt, Human
ucggccuccauccug

SEQ ID NO: 3151005 - RNA, 14 nt, Human
ucggagcccugucu

SEQ ID NO: 3151006 - RNA, 15 nt, Human
ucggagcccugucuc

SEQ ID NO: 3151007 - RNA, 22 nt, Human
ucggagccucauccgaggcagg

SEQ ID NO: 3151008 - RNA, 23 nt, Human
ucggagccucauccgaggcaggg

SEQ ID NO: 3151009 - RNA, 12 nt, Human
ucuacuaaaaau

SEQ ID NO: 3151010 - RNA, 15 nt, Human
ucuacuaaaaauaca

SEQ ID NO: 3151011 - RNA, 19 nt, Human
ucuacuaaaaauacaaaaa

SEQ ID NO: 3151012 - RNA, 12 nt, Human
uccgaggcaggg

SEQ ID NO: 3151013 - RNA, 13 nt, Human
uccgaggcagggu

SEQ ID NO: 3151014 - RNA, 14 nt, Human
uccucugcuugcca

SEQ ID NO: 3151015 - RNA, 15 nt, Human
uccucugcuugccau

SEQ ID NO: 3151016 - RNA, 16 nt, Human
uccucugcuugccauc

SEQ ID NO: 3151017 - RNA, 17 nt, Human
uccucugcuugccaucc

SEQ ID NO: 3151018 - RNA, 21 nt, Human
uccugaggcuccacuuggucu

SEQ ID NO: 3151019 - RNA, 13 nt, Human
uccucuguccagg

SEQ ID NO: 3151020 - RNA, 16 nt, Human
uccugaggcuccacuu

SEQ ID NO: 3151021 - RNA, 15 nt, Human
uccugaggcuccacu

SEQ ID NO: 3151022 - RNA, 22 nt, Human
uggaauaauccuaaacauauga

SEQ ID NO: 3151023 - RNA, 20 nt, Human
uggaacauaaaauacaaugu

SEQ ID NO: 3151024 - RNA, 21 nt, Human
uggaacauaaaauacaauguu

SEQ ID NO: 3151025 - RNA, 23 nt, Human
uggaaacuucagcgguuuauaua

SEQ ID NO: 3151026 - RNA, 15 nt, Human
uggaaaauucauuuu

SEQ ID NO: 3151027 - RNA, 21 nt, Human
uggauuuccuaauacugucau

SEQ ID NO: 3151028 - RNA, 15 nt, Human
uggauuuccuaauac

SEQ ID NO: 3151029 - RNA, 11 nt, Human
uggagggaagc

SEQ ID NO: 3151030 - RNA, 12 nt, Human
uggcccaggagu

SEQ ID NO: 3151031 - RNA, 22 nt, Human
uggcccaggaguuuggccagaa

SEQ ID NO: 3151032 - RNA, 21 nt, Human
uggcccaggaguuuggccaga

SEQ ID NO: 3151033 - RNA, 20 nt, Human
uggcccaggaguuuggccag

SEQ ID NO: 3151034 - RNA, 13 nt, Human
uggcccaggaguu

SEQ ID NO: 3151035 - RNA, 19 nt, Human
uggcccaggaguuuggcca

SEQ ID NO: 3151036 - RNA, 14 nt, Human
uggcccaggaguuu

SEQ ID NO: 3151037 - RNA, 21 nt, Human
ugguauguuuucaggcuagau

SEQ ID NO: 3151038 - RNA, 14 nt, Human
ugggaguacaaaag

SEQ ID NO: 3151039 - RNA, 16 nt, Human
uggcuuccuggcaaua

SEQ ID NO: 3151040 - RNA, 20 nt, Human
ugccacuaaauugacacuua

SEQ ID NO: 3151041 - RNA, 22 nt, Human
ugccaaauauaaauaaaaauaa

SEQ ID NO: 3151042 - RNA, 19 nt, Human
ugccaaauauaaauaaaaa

SEQ ID NO: 3151043 - RNA, 18 nt, Human
ugccaaauauaaauaaaa

SEQ ID NO: 3151044 - RNA, 17 nt, Human
ugccaaauauaaauaaa

SEQ ID NO: 3151045 - RNA, 23 nt, Human
ugcccagggcucagccugguggg

SEQ ID NO: 3151046 - RNA, 11 nt, Human
ugccaucccuc

SEQ ID NO: 3151047 - RNA, 12 nt, Human
ugccaucccucc

SEQ ID NO: 3151048 - RNA, 19 nt, Human
ugcccagggcucagccugg

SEQ ID NO: 3151049 - RNA, 20 nt, Human
ugcccagggcucagccuggu

SEQ ID NO: 3151050 - RNA, 21 nt, Human
ugcccagggcucagccuggug

SEQ ID NO: 3151051 - RNA, 19 nt, Human
ugcacgcacacugucugcc

SEQ ID NO: 3151052 - RNA, 17 nt, Human
ugcacgcacacugucug

SEQ ID NO: 3151053 - RNA, 19 nt, Human
ugcagugagccgagauugu

SEQ ID NO: 3151054 - RNA, 14 nt, Human
ugcaguucugaaga

SEQ ID NO: 3151055 - RNA, 18 nt, Human
ugcaguucugaagaagau

SEQ ID NO: 3151056 - RNA, 17 nt, Human
ugcaguucugaagaaga

SEQ ID NO: 3151057 - RNA, 16 nt, Human
ugcaguucugaagaag

SEQ ID NO: 3151058 - RNA, 15 nt, Human
ugcaguucugaagaa

SEQ ID NO: 3151059 - RNA, 22 nt, Human
ugcaguucugaagaagauggua

SEQ ID NO: 3151060 - RNA, 19 nt, Human
ugcaguucugaagaagaug

SEQ ID NO: 3151061 - RNA, 18 nt, Human
ugccuguaaucacagcua

SEQ ID NO: 3151062 - RNA, 15 nt, Human
ugccuucucaacucc

SEQ ID NO: 3151063 - RNA, 19 nt, Human
ugcuaagcauuccaacuau

SEQ ID NO: 3151064 - RNA, 15 nt, Human
ugcuaagcauuccaa

SEQ ID NO: 3151065 - RNA, 16 nt, Human
ugcucaguagucagac

SEQ ID NO: 3151066 - RNA, 17 nt, Human
ugcugaaacaacaaaua

SEQ ID NO: 3151067 - RNA, 19 nt, Human
ugcugcaagcacagcccuu

SEQ ID NO: 3151068 - RNA, 17 nt, Human
uguagauaauacaguuc

SEQ ID NO: 3151069 - RNA, 22 nt, Human
uguaguguuggagaagaacuga

SEQ ID NO: 3151070 - RNA, 16 nt, Human
uguaccgcaaugugac

SEQ ID NO: 3151071 - RNA, 15 nt, Human
uguaccgcaauguga

SEQ ID NO: 3151072 - RNA, 20 nt, Human
uguaauaaacucauuucuag

SEQ ID NO: 3151073 - RNA, 13 nt, Human
uguccagggcccu

SEQ ID NO: 3151074 - RNA, 17 nt, Human
uguccagggcccugagc

SEQ ID NO: 3151075 - RNA, 19 nt, Human
uguccagggcccugagcuc

SEQ ID NO: 3151076 - RNA, 13 nt, Human
uguauuuaaauau

SEQ ID NO: 3151077 - RNA, 22 nt, Human
uguaugauuacuggccuuuuuc

SEQ ID NO: 3151078 - RNA, 15 nt, Human
uguaugauucccagc

SEQ ID NO: 3151079 - RNA, 13 nt, Human
uguaugauuacug

SEQ ID NO: 3151080 - RNA, 12 nt, Human
uguaugauuacu

SEQ ID NO: 3151081 - RNA, 24 nt, Human
ugugaauuaggcuguaacuacuuu

SEQ ID NO: 3151082 - RNA, 23 nt, Human
ugugaauuaggcuguaacuacuu

SEQ ID NO: 3151083 - RNA, 22 nt, Human
ugugaauuaggcuguaacuacu

SEQ ID NO: 3151084 - RNA, 19 nt, Human
ugugaauuaggcuguaacu

SEQ ID NO: 3151085 - RNA, 19 nt, Human
ugugcuaguaauuggaaag

SEQ ID NO: 3151086 - RNA, 23 nt, Human
uguguacagaauucugcuaccuc

SEQ ID NO: 3151087 - RNA, 21 nt, Human
uguguacagaauucugcuacc

SEQ ID NO: 3151088 - RNA, 21 nt, Human
uguguaauuagugccacuuaa

SEQ ID NO: 3151089 - RNA, 20 nt, Human
uguugacaugggacauuugc

SEQ ID NO: 3151090 - RNA, 17 nt, Human
uguuuaaaaucauuucu

SEQ ID NO: 3151091 - RNA, 18 nt, Human
uguuuaaaaucauuucug

SEQ ID NO: 3151092 - RNA, 17 nt, Human
uguuggcauagcucugg

SEQ ID NO: 3151093 - RNA, 14 nt, Human
uguuuaaaaucauu

SEQ ID NO: 3151094 - RNA, 19 nt, Human
uguuggagaagaacugaaa

SEQ ID NO: 3151095 - RNA, 17 nt, Human
uguuggagaagaacuga

SEQ ID NO: 3151096 - RNA, 16 nt, Human
uguuggagaagaacug

SEQ ID NO: 3151097 - RNA, 14 nt, Human
uguuggagaagaac

SEQ ID NO: 3151098 - RNA, 19 nt, Human
uguguuuugcaagccagau

SEQ ID NO: 3151099 - RNA, 13 nt, Human
uguguuuugcaag

SEQ ID NO: 3151100 - RNA, 19 nt, Human
ugugugcguccugucggag

SEQ ID NO: 3151101 - RNA, 20 nt, Human
ugugugaaagguacuucaaa

SEQ ID NO: 3151102 - RNA, 22 nt, Human
ugugugaaagguacuucaaauc

SEQ ID NO: 3151103 - RNA, 21 nt, Human
ugugugaaagguacuucaaau

SEQ ID NO: 3151104 - RNA, 21 nt, Human
uguuaaaagaugaaaauauuu

SEQ ID NO: 3151105 - RNA, 22 nt, Human
uuaagcaucuggcucuaauuca

SEQ ID NO: 3151106 - RNA, 20 nt, Human
uuacauuuguauaaaauaau

SEQ ID NO: 3151107 - RNA, 21 nt, Human
uuaaauauguuagcaaagagu

SEQ ID NO: 3151108 - RNA, 18 nt, Human
uuaaaauacacacucaaa

SEQ ID NO: 3151109 - RNA, 22 nt, Human
uuaaaaaaaaaccugagcccca

SEQ ID NO: 3151110 - RNA, 13 nt, Human
uaagugaaauaag

SEQ ID NO: 3151111 - RNA, 22 nt, Human
uaauguuucaaacauauauaac

SEQ ID NO: 3151112 - RNA, 22 nt, Human
uaaugauaacuggaaacuucag

SEQ ID NO: 3151113 - RNA, 17 nt, Human
uaaugauaacuggaaac

SEQ ID NO: 3151114 - RNA, 16 nt, Human
uaaugauaacuggaaa

SEQ ID NO: 3151115 - RNA, 20 nt, Human
uaaauugacacuuaaaaaug

SEQ ID NO: 3151116 - RNA, 18 nt, Human
uaaauucccguuuuguca

SEQ ID NO: 3151117 - RNA, 19 nt, Human
uaaauucccguuuugucac

SEQ ID NO: 3151118 - RNA, 16 nt, Human
uaaaugugccuucauu

SEQ ID NO: 3151119 - RNA, 20 nt, Human
uaaauggcuuccuggcaaua

SEQ ID NO: 3151120 - RNA, 21 nt, Human
uaagaaaauaucacuugucaa

SEQ ID NO: 3151121 - RNA, 13 nt, Human
uaagagagaauga

SEQ ID NO: 3151122 - RNA, 14 nt, Human
uaagagagaaugag

SEQ ID NO: 3151123 - RNA, 12 nt, Human
uaacuuuuguga

SEQ ID NO: 3151124 - RNA, 15 nt, Human
uaacuggaaacuuca

SEQ ID NO: 3151125 - RNA, 22 nt, Human
uaacuuuugugaauuaggcugu

SEQ ID NO: 3151126 - RNA, 16 nt, Human
uaacuuuugugaauua

SEQ ID NO: 3151127 - RNA, 17 nt, Human
uaaccaggggccaugaa

SEQ ID NO: 3151128 - RNA, 17 nt, Human
guuuagaaagcuugccc

SEQ ID NO: 3151129 - RNA, 21 nt, Human
guuuagcuggaaaaguauguu

SEQ ID NO: 3151130 - RNA, 20 nt, Human
guuuagcuggaaaaguaugu

SEQ ID NO: 3151131 - RNA, 20 nt, Human
guuuauauaagcuuguauuc

SEQ ID NO: 3151132 - RNA, 21 nt, Human
guuucauguuaguuaccuuau

SEQ ID NO: 3151133 - RNA, 17 nt, Human
guuucauguuaguuacc

SEQ ID NO: 3151134 - RNA, 17 nt, Human
uaaaggcaguuuucuaa

SEQ ID NO: 3151135 - RNA, 14 nt, Human
uaaaggcaguuuuc

SEQ ID NO: 3151136 - RNA, 14 nt, Human
uaaaguguuugaaa

SEQ ID NO: 3151137 - RNA, 20 nt, Human
uaaacuuuuuuucuguacca

SEQ ID NO: 3151138 - RNA, 19 nt, Human
uaaaaaugguuuaaauggu

SEQ ID NO: 3151139 - RNA, 18 nt, Human
uaaaaaugguuuaaaugg

SEQ ID NO: 3151140 - RNA, 15 nt, Human
uaaaaaugguuuaaa

SEQ ID NO: 3151141 - RNA, 22 nt, Human
uaaaacaagcacuaaacaaaga

SEQ ID NO: 3151142 - RNA, 10 nt, Human
uaaaaucauu

SEQ ID NO: 3151143 - RNA, 13 nt, Human
uaaaaucauuucu

SEQ ID NO: 3151144 - RNA, 18 nt, Human
uaaaaucauuucugcauc

SEQ ID NO: 3151145 - RNA, 22 nt, Human
uaaaaucauuucugcaucagcu

SEQ ID NO: 3151146 - RNA, 17 nt, Human
uaaaauccauacauuug

SEQ ID NO: 3151147 - RNA, 15 nt, Human
uaaaauccauacauu

SEQ ID NO: 3151148 - RNA, 20 nt, Human
uauauuugaaauauugacuu

SEQ ID NO: 3151149 - RNA, 16 nt, Human
uauaugcuucuguuuu

SEQ ID NO: 3151150 - RNA, 14 nt, Human
uauaugcuucuguu

SEQ ID NO: 3151151 - RNA, 19 nt, Human
uauauuuuuuguuaaauga

SEQ ID NO: 3151152 - RNA, 21 nt, Human
uauauuuuuuguuaaaugauu

SEQ ID NO: 3151153 - RNA, 13 nt, Human
uaucaaacugaag

SEQ ID NO: 3151154 - RNA, 14 nt, Human
uaucaaaagaaaga

SEQ ID NO: 3151155 - RNA, 19 nt, Human
uauauaacaaugcuguauu

SEQ ID NO: 3151156 - RNA, 17 nt, Human
uauauaacaaugcugua

SEQ ID NO: 3151157 - RNA, 13 nt, Human
uauauaacaaugc

SEQ ID NO: 3151158 - RNA, 17 nt, Human
uaguauuguccaggucu

SEQ ID NO: 3151159 - RNA, 19 nt, Human
uaggcuguaacuacuuuau

SEQ ID NO: 3151160 - RNA, 21 nt, Human
uaggcuguaacuacuuuauaa

SEQ ID NO: 3151161 - RNA, 20 nt, Human
uaggugcuacaaaaacacag

SEQ ID NO: 3151162 - RNA, 22 nt, Human
uaggugcuacaaaaacacagca

SEQ ID NO: 3151163 - RNA, 23 nt, Human
uaggugcuacaaaaacacagcaa

SEQ ID NO: 3151164 - RNA, 18 nt, Human
uaggugcuacaaaaacac

SEQ ID NO: 3151165 - RNA, 18 nt, Human
uagaauuaacacaugauc

SEQ ID NO: 3151166 - RNA, 16 nt, Human
uagaauuaacacauga

SEQ ID NO: 3151167 - RNA, 15 nt, Human
uagaauuaacacaug

SEQ ID NO: 3151168 - RNA, 23 nt, Human
uagaauaccacaggaaccacaag

SEQ ID NO: 3151169 - RNA, 22 nt, Human
uagaauaaaggcaguuuucuaa

SEQ ID NO: 3151170 - RNA, 21 nt, Human
uagaauaaaggcaguuuucua

SEQ ID NO: 3151171 - RNA, 19 nt, Human
uagaauaaaggcaguuuuc

SEQ ID NO: 3151172 - RNA, 19 nt, Human
uagacccucaugcugccaa

SEQ ID NO: 3151173 - RNA, 18 nt, Human
uagacccucaugcugcca

SEQ ID NO: 3151174 - RNA, 17 nt, Human
uagacccucaugcugcc

SEQ ID NO: 3151175 - RNA, 14 nt, Human
uagauaggccaugg

SEQ ID NO: 3151176 - RNA, 16 nt, Human
uagcaugaagacagag

SEQ ID NO: 3151177 - RNA, 15 nt, Human
uagccgaccucagcc

SEQ ID NO: 3151178 - RNA, 16 nt, Human
uagccgaccucagccu

SEQ ID NO: 3151179 - RNA, 17 nt, Human
uagccgaccucagccuu

SEQ ID NO: 3151180 - RNA, 19 nt, Human
uacaaaucagaagucaucu

SEQ ID NO: 3151181 - RNA, 17 nt, Human
uacaaaucagaagucau

SEQ ID NO: 3151182 - RNA, 16 nt, Human
uacaaaucagaaguca

SEQ ID NO: 3151183 - RNA, 21 nt, Human
uacaaaucagaagucaucuug

SEQ ID NO: 3151184 - RNA, 20 nt, Human
uacaaaucagaagucaucuu

SEQ ID NO: 3151185 - RNA, 22 nt, Human
uacaaaucagaagucaucuugc

SEQ ID NO: 3151186 - RNA, 16 nt, Human
uaauuuuuauauuuga

SEQ ID NO: 3151187 - RNA, 12 nt, Human
uaauuuuuauau

SEQ ID NO: 3151188 - RNA, 18 nt, Human
uaauuuugugaagcaaaa

SEQ ID NO: 3151189 - RNA, 13 nt, Human
uaauuuugugaag

SEQ ID NO: 3151190 - RNA, 22 nt, Human
uaauuagugccacuuaauguau

SEQ ID NO: 3151191 - RNA, 21 nt, Human
uaauuagugccacuuaaugua

SEQ ID NO: 3151192 - RNA, 19 nt, Human
uaauuagugccacuuaaug

SEQ ID NO: 3151193 - RNA, 14 nt, Human
uaauuagugccacu

SEQ ID NO: 3151194 - RNA, 17 nt, Human
uacacacucaaaucaag

SEQ ID NO: 3151195 - RNA, 16 nt, Human
uacacacucaaaucaa

SEQ ID NO: 3151196 - RNA, 14 nt, Human
uacacuccagugag

SEQ ID NO: 3151197 - RNA, 23 nt, Human
uacaguucggugagcuacaaaug

SEQ ID NO: 3151198 - RNA, 15 nt, Human
uacaguucugugguu

SEQ ID NO: 3151199 - RNA, 14 nt, Human
uacaguucuguggu

SEQ ID NO: 3151200 - RNA, 21 nt, Human
uacaguucugugguuucaugu

SEQ ID NO: 3151201 - RNA, 23 nt, Human
uaccuuuguucccaaauuucaua

SEQ ID NO: 3151202 - RNA, 18 nt, Human
uaccuuauaguuacugug

SEQ ID NO: 3151203 - RNA, 17 nt, Human
uaccuuauaguuacugu

SEQ ID NO: 3151204 - RNA, 16 nt, Human
uaccuuauaguuacug

SEQ ID NO: 3151205 - RNA, 15 nt, Human
uaccaaaaauaaaua

SEQ ID NO: 3151206 - RNA, 22 nt, Human
uaccuaacgaaguauccuucag

SEQ ID NO: 3151207 - RNA, 22 nt, Human
uaccuaagauuacaaaucagaa

SEQ ID NO: 3151208 - RNA, 20 nt, Human
uaccuaagauuacaaaucag

SEQ ID NO: 3151209 - RNA, 17 nt, Human
uaccuaagauuacaaau

SEQ ID NO: 3151210 - RNA, 16 nt, Human
uaccuaucaucuuaag

SEQ ID NO: 3151211 - RNA, 15 nt, Human
uaccucacugggguc

SEQ ID NO: 3151212 - RNA, 23 nt, Human
uacugucagcuccccucggagaa

SEQ ID NO: 3151213 - RNA, 23 nt, Human
uacugucauccucaaagaaagug

SEQ ID NO: 3151214 - RNA, 18 nt, Human
guguacagaauucugcua

SEQ ID NO: 3151215 - RNA, 21 nt, Human
guguaaguagauaggccaugg

SEQ ID NO: 3151216 - RNA, 23 nt, Human
guggggcagugcuuggcccagga

SEQ ID NO: 3151217 - RNA, 14 nt, Human
guggggcagugcuu

SEQ ID NO: 3151218 - RNA, 15 nt, Human
guggguggggcagug

SEQ ID NO: 3151219 - RNA, 15 nt, Human
gugggccuccucugu

SEQ ID NO: 3151220 - RNA, 20 nt, Human
gugggccuccucuguccagg

SEQ ID NO: 3151221 - RNA, 23 nt, Human
gugggccuccucuguccagggcc

SEQ ID NO: 3151222 - RNA, 15 nt, Human
gugcuacaaaaacac

SEQ ID NO: 3151223 - RNA, 20 nt, Human
gugcuacaaaaacacagcaa

SEQ ID NO: 3151224 - RNA, 17 nt, Human
guggcugcuagcacuug

SEQ ID NO: 3151225 - RNA, 19 nt, Human
guggcugcuagcacuugga

SEQ ID NO: 3151226 - RNA, 14 nt, Human
gugugcguccuguc

SEQ ID NO: 3151227 - RNA, 16 nt, Human
gugugcguccugucgg

SEQ ID NO: 3151228 - RNA, 20 nt, Human
guuaaaagaugaaaauauuu

SEQ ID NO: 3151229 - RNA, 14 nt, Human
guuaaaagaugaaa

SEQ ID NO: 3151230 - RNA, 16 nt, Human
guuaaaagaugaaaau

SEQ ID NO: 3151231 - RNA, 17 nt, Human
guguuauuuaaaugagu

SEQ ID NO: 3151232 - RNA, 15 nt, Human
guucugaagaagaug

SEQ ID NO: 3151233 - RNA, 14 nt, Human
guucugaagaagau

SEQ ID NO: 3151234 - RNA, 13 nt, Human
guucugaagaaga

SEQ ID NO: 3151235 - RNA, 12 nt, Human
guucugaagaag

SEQ ID NO: 3151236 - RNA, 17 nt, Human
guugaaaagacuccaaa

SEQ ID NO: 3151237 - RNA, 22 nt, Human
guugaaaagacuccaaagaaau

SEQ ID NO: 3151238 - RNA, 23 nt, Human
guugaaaagacuccaaagaaaug

SEQ ID NO: 3151239 - RNA, 20 nt, Human
guugauggugguauguuuuc

SEQ ID NO: 3151240 - RNA, 21 nt, Human
guugauggugguauguuuuca

SEQ ID NO: 3151241 - RNA, 18 nt, Human
guuggcauagcucugggg

SEQ ID NO: 3151242 - RNA, 15 nt, Human
guuggcauagcucug

SEQ ID NO: 3151243 - RNA, 19 nt, Human
guuggcauagcucuggggu

SEQ ID NO: 3151244 - RNA, 16 nt, Human
guucaugcagcugugg

SEQ ID NO: 3151245 - RNA, 15 nt, Human
guucaugcagcugug

SEQ ID NO: 3151246 - RNA, 16 nt, Human
guucaucaaugaauga

SEQ ID NO: 3151247 - RNA, 13 nt, Human
guucagagcugcc

SEQ ID NO: 3151248 - RNA, 14 nt, Human
guucagagcugccc

SEQ ID NO: 3151249 - RNA, 16 nt, Human
guucagagacucaggg

SEQ ID NO: 3151250 - RNA, 17 nt, Human
guucagagacucagggc

SEQ ID NO: 3151251 - RNA, 23 nt, Human
guucagagcugcccucuccuggg

SEQ ID NO: 3151252 - RNA, 22 nt, Human
guucagagacucagggccccag

SEQ ID NO: 3151253 - RNA, 20 nt, Human
guucagagcugcccucuccu

SEQ ID NO: 3151254 - RNA, 22 nt, Human
guucagagcugcccucuccugg

SEQ ID NO: 3151255 - RNA, 15 nt, Human
guucagagcugcccu

SEQ ID NO: 3151256 - RNA, 16 nt, Human
guucagagcugcccuc

SEQ ID NO: 3151257 - RNA, 17 nt, Human
guucagagcugcccucu

SEQ ID NO: 3151258 - RNA, 19 nt, Human
guucagagcugcccucucc

SEQ ID NO: 3151259 - RNA, 23 nt, Human
guuaccucugccucagaaaacaa

SEQ ID NO: 3151260 - RNA, 15 nt, Human
guuacaguucugugg

SEQ ID NO: 3151261 - RNA, 14 nt, Human
guuacaguucugug

SEQ ID NO: 3151262 - RNA, 13 nt, Human
guuacaguucugu

SEQ ID NO: 3151263 - RNA, 22 nt, Human
guuaccuuauaguuacugugua

SEQ ID NO: 3151264 - RNA, 20 nt, Human
guuaccuuauaguuacugug

SEQ ID NO: 3151265 - RNA, 18 nt, Human
guuaccuuauaguuacug

SEQ ID NO: 3151266 - RNA, 15 nt, Human
guuaccuuauaguua

SEQ ID NO: 3151267 - RNA, 23 nt, Human
gucggguuuuauuguuuaaaauc

SEQ ID NO: 3151268 - RNA, 12 nt, Human
gucggagcccug

SEQ ID NO: 3151269 - RNA, 16 nt, Human
gucggagcccugucuc

SEQ ID NO: 3151270 - RNA, 18 nt, Human
gucgucaaagcugaaaug

SEQ ID NO: 3151271 - RNA, 19 nt, Human
gucucaccuggacuuaagc

SEQ ID NO: 3151272 - RNA, 13 nt, Human
gucugacuguuuc

SEQ ID NO: 3151273 - RNA, 14 nt, Human
gucucucuucucuc

SEQ ID NO: 3151274 - RNA, 23 nt, Human
gucucucuucucuccagcugacu

SEQ ID NO: 3151275 - RNA, 20 nt, Human
gucucucuucucuccagcug

SEQ ID NO: 3151276 - RNA, 19 nt, Human
gucucucuucucuccagcu

SEQ ID NO: 3151277 - RNA, 15 nt, Human
gucucucuucucucc

SEQ ID NO: 3151278 - RNA, 16 nt, Human
gucugccagccagcag

SEQ ID NO: 3151279 - RNA, 17 nt, Human
gucugccagccagcagc

SEQ ID NO: 3151280 - RNA, 18 nt, Human
gucugccagccagcagcc

SEQ ID NO: 3151281 - RNA, 23 nt, Human
gucugugagaugcuagaacuccc

SEQ ID NO: 3151282 - RNA, 22 nt, Human
gucugugagaugcuagaacucc

SEQ ID NO: 3151283 - RNA, 21 nt, Human
gucugugagaugcuagaacuc

SEQ ID NO: 3151284 - RNA, 17 nt, Human
gucugugagaugcuaga

SEQ ID NO: 3151285 - RNA, 16 nt, Human
gucugugagaugcuag

SEQ ID NO: 3151286 - RNA, 15 nt, Human
gucugugagaugcua

SEQ ID NO: 3151287 - RNA, 16 nt, Human
gugacaagcucacaga

SEQ ID NO: 3151288 - RNA, 21 nt, Human
gugaacaaauuuacagagaca

SEQ ID NO: 3151289 - RNA, 13 nt, Human
gugaacacaucag

SEQ ID NO: 3151290 - RNA, 13 nt, Human
gugccccccuugc

SEQ ID NO: 3151291 - RNA, 20 nt, Human
gugccccccuugccagacau

SEQ ID NO: 3151292 - RNA, 13 nt, Human
gugcguccugucg

SEQ ID NO: 3151293 - RNA, 23 nt, Human
guaguauuuuuuguauaauugga

SEQ ID NO: 3151294 - RNA, 20 nt, Human
guaguauuuuuuguauaauu

SEQ ID NO: 3151295 - RNA, 19 nt, Human
guaguauuuuuuguauaau

SEQ ID NO: 3151296 - RNA, 15 nt, Human
guaguauuuuuugua

SEQ ID NO: 3151297 - RNA, 15 nt, Human
guaguguuggagaag

SEQ ID NO: 3151298 - RNA, 14 nt, Human
guaguguuggagaa

SEQ ID NO: 3151299 - RNA, 19 nt, Human
guauaauuggauuuccuaa

SEQ ID NO: 3151300 - RNA, 18 nt, Human
guauaauuggauuuccua

SEQ ID NO: 3151301 - RNA, 20 nt, Human
guauaauuggauuuccuaau

SEQ ID NO: 3151302 - RNA, 18 nt, Human
gcuauaggugcuacaaaa

SEQ ID NO: 3151303 - RNA, 15 nt, Human
guagcauuacagugg

SEQ ID NO: 3151304 - RNA, 17 nt, Human
guauguuagugcaaauu

SEQ ID NO: 3151305 - RNA, 21 nt, Human
gucagcuccccucggagaaga

SEQ ID NO: 3151306 - RNA, 22 nt, Human
gucagcuccccucggagaagag

SEQ ID NO: 3151307 - RNA, 23 nt, Human
gucagcuccccucggagaagagc

SEQ ID NO: 3151308 - RNA, 17 nt, Human
guccagggcccugagcu

SEQ ID NO: 3151309 - RNA, 20 nt, Human
guccagggcccugagcucgg

SEQ ID NO: 3151310 - RNA, 16 nt, Human
gucccuacaccccucc

SEQ ID NO: 3151311 - RNA, 21 nt, Human
gucccuacaccccuccccugc

SEQ ID NO: 3151312 - RNA, 20 nt, Human
guauuuuaaaagaaugauua

SEQ ID NO: 3151313 - RNA, 13 nt, Human
guauuuuaaucac

SEQ ID NO: 3151314 - RNA, 18 nt, Human
guauuuuaaaagaaugau

SEQ ID NO: 3151315 - RNA, 15 nt, Human
gucaaugcagccccc

SEQ ID NO: 3151316 - RNA, 22 nt, Human
gucaauaaaauccauacauuug

SEQ ID NO: 3151317 - RNA, 23 nt, Human
gucaauaaaauccauacauuugu

SEQ ID NO: 3151318 - RNA, 18 nt, Human
gucaaggcuuagacccuc

SEQ ID NO: 3151319 - RNA, 16 nt, Human
gucaaggcuuagaccc

SEQ ID NO: 3151320 - RNA, 14 nt, Human
gucaaggcuuagac

SEQ ID NO: 3151321 - RNA, 20 nt, Human
gucaaggcuuagacccucau

SEQ ID NO: 3151322 - RNA, 19 nt, Human
gucagcuccccucggagaa

SEQ ID NO: 3151323 - RNA, 14 nt, Human
uuuguauaaaauaa

SEQ ID NO: 3151324 - RNA, 13 nt, Human
uuuguauaaaaua

SEQ ID NO: 3151325 - RNA, 13 nt, Human
uuugguuucuagc

SEQ ID NO: 3151326 - RNA, 21 nt, Human
uuuuaaaagaaugauuaugaa

SEQ ID NO: 3151327 - RNA, 15 nt, Human
uuuuaaaagaaugau

SEQ ID NO: 3151328 - RNA, 20 nt, Human
uuuuaaauucccguuuuguc

SEQ ID NO: 3151329 - RNA, 20 nt, Human
uuuuaauaauguuucaaaca

SEQ ID NO: 3151330 - RNA, 18 nt, Human
uuugaaucaucaagucuu

SEQ ID NO: 3151331 - RNA, 17 nt, Human
uuucuuauuucauuucu

SEQ ID NO: 3151332 - RNA, 13 nt, Human
uuucuagaaagag

SEQ ID NO: 3151333 - RNA, 13 nt, Human
uuucugagaaaga

SEQ ID NO: 3151334 - RNA, 21 nt, Human
uuaccaaaaauaaauauaucu

SEQ ID NO: 3151335 - RNA, 22 nt, Human
uuuccucaaaacuucagacaua

SEQ ID NO: 3151336 - RNA, 18 nt, Human
uuuccucauuuuuauaau

SEQ ID NO: 3151337 - RNA, 18 nt, Human
uuuuggucuggagggaag

SEQ ID NO: 3151338 - RNA, 14 nt, Human
uuuuccugaaaacc

SEQ ID NO: 3151339 - RNA, 13 nt, Human
uuuuccugaaaac

SEQ ID NO: 3151340 - RNA, 24 nt, Human
uuuuguauaauuggauuuccuaau

SEQ ID NO: 3151341 - RNA, 23 nt, Human
uuuuguauaauuggauuuccuaa

SEQ ID NO: 3151342 - RNA, 16 nt, Human
uuuuguauaauuggau

SEQ ID NO: 3151343 - RNA, 14 nt, Human
uuuuguauaauugg

SEQ ID NO: 3151344 - RNA, 18 nt, Human
uuuugucacuuuuucuga

SEQ ID NO: 3151345 - RNA, 18 nt, Human
uuuuuaaaaaagaaacau

SEQ ID NO: 3151346 - RNA, 17 nt, Human
uuuuuccuuguauuuaa

SEQ ID NO: 3151347 - RNA, 19 nt, Human
uuuuucucuaggaaauauu

SEQ ID NO: 3151348 - RNA, 17 nt, Human
uuuuucugauaaaagau

SEQ ID NO: 3151349 - RNA, 13 nt, Human
uuuuucugauaaa

SEQ ID NO: 3151350 - RNA, 20 nt, Human
cuaccaguauuuagaagcca

SEQ ID NO: 3151351 - RNA, 19 nt, Human
cuaccaguauuuagaagcc

SEQ ID NO: 3151352 - RNA, 13 nt, Human
cuaccaguauuua

SEQ ID NO: 3151353 - RNA, 17 nt, Human
cuacacuccagugagac

SEQ ID NO: 3151354 - RNA, 16 nt, Human
cuacacuccagugaga

SEQ ID NO: 3151355 - RNA, 14 nt, Human
cuaagcaaaaugug

SEQ ID NO: 3151356 - RNA, 17 nt, Human
cuaacauguccugccua

SEQ ID NO: 3151357 - RNA, 18 nt, Human
cuaagcaaaaugugauau

SEQ ID NO: 3151358 - RNA, 15 nt, Human
cuaagcaaaauguga

SEQ ID NO: 3151359 - RNA, 19 nt, Human
cuacuugggaggcugagau

SEQ ID NO: 3151360 - RNA, 18 nt, Human
cuacuuuauaacuaacau

SEQ ID NO: 3151361 - RNA, 14 nt, Human
cuacuuuauaacua

SEQ ID NO: 3151362 - RNA, 19 nt, Human
cuacuuuauaacuaacaug

SEQ ID NO: 3151363 - RNA, 18 nt, Human
cuacuugggaggcugaga

SEQ ID NO: 3151364 - RNA, 15 nt, Human
cuacuugggaggcug

SEQ ID NO: 3151365 - RNA, 22 nt, Human
cuagauguaguauuuuuuguau

SEQ ID NO: 3151366 - RNA, 20 nt, Human
cuagauguaguauuuuuugu

SEQ ID NO: 3151367 - RNA, 23 nt, Human
cuagauguaguauuuuuuguaua

SEQ ID NO: 3151368 - RNA, 16 nt, Human
cuagauguaguauuuu

SEQ ID NO: 3151369 - RNA, 20 nt, Human
cuauauuuuuuguuaaauga

SEQ ID NO: 3151370 - RNA, 19 nt, Human
cuauauuguuugcuaagca

SEQ ID NO: 3151371 - RNA, 18 nt, Human
cuauauuguuugcuaagc

SEQ ID NO: 3151372 - RNA, 13 nt, Human
cuaugaaauauua

SEQ ID NO: 3151373 - RNA, 16 nt, Human
cuaucaaacugaagcc

SEQ ID NO: 3151374 - RNA, 20 nt, Human
cuaucaaacugaagccagaa

SEQ ID NO: 3151375 - RNA, 21 nt, Human
cuaucaaacugaagccagaaa

SEQ ID NO: 3151376 - RNA, 22 nt, Human
cuauauuuuuuguuaaaugauu

SEQ ID NO: 3151377 - RNA, 13 nt, Human
cuaucaaacugaa

SEQ ID NO: 3151378 - RNA, 22 nt, Human
cuaggaaauauuuauuuuaaua

SEQ ID NO: 3151379 - RNA, 16 nt, Human
cuagcacuuggagcca

SEQ ID NO: 3151380 - RNA, 23 nt, Human
cuaguaucaaaagaaagaaaauc

SEQ ID NO: 3151381 - RNA, 17 nt, Human
cuaguaucaaaagaaag

SEQ ID NO: 3151382 - RNA, 15 nt, Human
cuaguaucaaaagaa

SEQ ID NO: 3151383 - RNA, 20 nt, Human
cuaguauuucuaugaaauau

SEQ ID NO: 3151384 - RNA, 19 nt, Human
cuaguauuucuaugaaaua

SEQ ID NO: 3151385 - RNA, 22 nt, Human
cuaguauuucuaugaaauauua

SEQ ID NO: 3151386 - RNA, 17 nt, Human
cucaccccuugccauaa

SEQ ID NO: 3151387 - RNA, 23 nt, Human
cuaaauugacacuuaaaaauggu

SEQ ID NO: 3151388 - RNA, 15 nt, Human
cgucuucagccuagc

SEQ ID NO: 3151389 - RNA, 13 nt, Human
cgucuucagccua

SEQ ID NO: 3151390 - RNA, 14 nt, Human
cgucuucagccuag

SEQ ID NO: 3151391 - RNA, 18 nt, Human
cgugcacgcacacugucu

SEQ ID NO: 3151392 - RNA, 21 nt, Human
cggguuuuauuguuuaaaauc

SEQ ID NO: 3151393 - RNA, 22 nt, Human
cggucggguuuuauuguuuaaa

SEQ ID NO: 3151394 - RNA, 17 nt, Human
cggugagcuacaaaugc

SEQ ID NO: 3151395 - RNA, 12 nt, Human
cggccuccaucc

SEQ ID NO: 3151396 - RNA, 18 nt, Human
cgcucucuggccuucggc

SEQ ID NO: 3151397 - RNA, 23 nt, Human
cgcuaauucaaggaauuucuuaa

SEQ ID NO: 3151398 - RNA, 15 nt, Human
cgcucucuggccuuc

SEQ ID NO: 3151399 - RNA, 14 nt, Human
cgcucucuggccuu

SEQ ID NO: 3151400 - RNA, 22 nt, Human
cucuucuuuaaagggauggcaa

SEQ ID NO: 3151401 - RNA, 14 nt, Human
cugaagaagauggu

SEQ ID NO: 3151402 - RNA, 23 nt, Human
cugaagaagcaccaaucaugaau

SEQ ID NO: 3151403 - RNA, 12 nt, Human
cucuggccuucg

SEQ ID NO: 3151404 - RNA, 12 nt, Human
cucugcuugcca

SEQ ID NO: 3151405 - RNA, 14 nt, Human
cucugcuugccauc

SEQ ID NO: 3151406 - RNA, 17 nt, Human
cucugcuugccaucccu

SEQ ID NO: 3151407 - RNA, 20 nt, Human
cucugcuugccaucccuccc

SEQ ID NO: 3151408 - RNA, 17 nt, Human
cugacucuuaagaagac

SEQ ID NO: 3151409 - RNA, 13 nt, Human
cugacuucuaagu

SEQ ID NO: 3151410 - RNA, 15 nt, Human
cugacuucuaaguaa

SEQ ID NO: 3151411 - RNA, 16 nt, Human
cugacuucuaaguaaa

SEQ ID NO: 3151412 - RNA, 22 nt, Human
cugagaaagacuauucaaacag

SEQ ID NO: 3151413 - RNA, 23 nt, Human
cugagaaagacuauucaaacagu

SEQ ID NO: 3151414 - RNA, 13 nt, Human
cugaggcagacag

SEQ ID NO: 3151415 - RNA, 22 nt, Human
cugagcucgguggacccaggga

SEQ ID NO: 3151416 - RNA, 18 nt, Human
cugaggcagacagcagcu

SEQ ID NO: 3151417 - RNA, 22 nt, Human
cugaggcagacagcagcucagg

SEQ ID NO: 3151418 - RNA, 14 nt, Human
cugaggcagacagc

SEQ ID NO: 3151419 - RNA, 15 nt, Human
cugaggcagacagca

SEQ ID NO: 3151420 - RNA, 16 nt, Human
cugaggcagacagcag

SEQ ID NO: 3151421 - RNA, 17 nt, Human
cugaggcagacagcagc

SEQ ID NO: 3151422 - RNA, 20 nt, Human
cugagcgacagugagacucu

SEQ ID NO: 3151423 - RNA, 16 nt, Human
cugagcgacagugaga

SEQ ID NO: 3151424 - RNA, 17 nt, Human
cugagcucgguggaccc

SEQ ID NO: 3151425 - RNA, 18 nt, Human
cugagcucgguggaccca

SEQ ID NO: 3151426 - RNA, 20 nt, Human
cugagcucgguggacccagg

SEQ ID NO: 3151427 - RNA, 12 nt, Human
cucuccugggca

SEQ ID NO: 3151428 - RNA, 15 nt, Human
cucuccugggcagcu

SEQ ID NO: 3151429 - RNA, 16 nt, Human
cucuccugggcagcug

SEQ ID NO: 3151430 - RNA, 18 nt, Human
cucuccugggcagcugcc

SEQ ID NO: 3151431 - RNA, 19 nt, Human
cucuccugggcagcugccu

SEQ ID NO: 3151432 - RNA, 16 nt, Human
cucuccagcugacuaa

SEQ ID NO: 3151433 - RNA, 15 nt, Human
cucuccagcugacua

SEQ ID NO: 3151434 - RNA, 14 nt, Human
cucuccagcugacu

SEQ ID NO: 3151435 - RNA, 17 nt, Human
cucuaggaaauauuuau

SEQ ID NO: 3151436 - RNA, 15 nt, Human
cucuaggaaauauuu

SEQ ID NO: 3151437 - RNA, 12 nt, Human
cucggagccuca

SEQ ID NO: 3151438 - RNA, 13 nt, Human
cucggagccucau

SEQ ID NO: 3151439 - RNA, 16 nt, Human
cucggagccucauccg

SEQ ID NO: 3151440 - RNA, 22 nt, Human
cucggagccucauccgaggcag

SEQ ID NO: 3151441 - RNA, 23 nt, Human
cucggagccucauccgaggcagg

SEQ ID NO: 3151442 - RNA, 17 nt, Human
cucuaauucacagugcu

SEQ ID NO: 3151443 - RNA, 20 nt, Human
cucuaauucacagugcucuu

SEQ ID NO: 3151444 - RNA, 16 nt, Human
cuccauccugaggcuc

SEQ ID NO: 3151445 - RNA, 14 nt, Human
cuccauccugaggc

SEQ ID NO: 3151446 - RNA, 18 nt, Human
cuccauccugaggcucca

SEQ ID NO: 3151447 - RNA, 17 nt, Human
cucccuccaccucccug

SEQ ID NO: 3151448 - RNA, 15 nt, Human
cucccuccaccuccc

SEQ ID NO: 3151449 - RNA, 16 nt, Human
cuccugucugccagcc

SEQ ID NO: 3151450 - RNA, 17 nt, Human
cuccugucugccagcca

SEQ ID NO: 3151451 - RNA, 19 nt, Human
cuccugucugccagccagc

SEQ ID NO: 3151452 - RNA, 22 nt, Human
cuccugucugccagccagcagc

SEQ ID NO: 3151453 - RNA, 23 nt, Human
cuccugucugccagccagcagcc

SEQ ID NO: 3151454 - RNA, 15 nt, Human
cuguaugauucccag

SEQ ID NO: 3151455 - RNA, 16 nt, Human
cuguauuuuaaaagaa

SEQ ID NO: 3151456 - RNA, 13 nt, Human
cuguauuuuaaaa

SEQ ID NO: 3151457 - RNA, 18 nt, Human
cugucucuacuaaaaaua

SEQ ID NO: 3151458 - RNA, 17 nt, Human
cugucuccucucucugu

SEQ ID NO: 3151459 - RNA, 20 nt, Human
cugucuccucucucuguaau

SEQ ID NO: 3151460 - RNA, 18 nt, Human
cuguaccaguuaauuuuu

SEQ ID NO: 3151461 - RNA, 17 nt, Human
cuguaccaguuaauuuu

SEQ ID NO: 3151462 - RNA, 16 nt, Human
cuguaccaguuaauuu

SEQ ID NO: 3151463 - RNA, 12 nt, Human
cuguaccaguua

SEQ ID NO: 3151464 - RNA, 15 nt, Human
cuggccuucggccuc

SEQ ID NO: 3151465 - RNA, 21 nt, Human
cuggccuucggccuccauccu

SEQ ID NO: 3151466 - RNA, 18 nt, Human
cuggccuucggccuccau

SEQ ID NO: 3151467 - RNA, 17 nt, Human
cuggccuucggccucca

SEQ ID NO: 3151468 - RNA, 16 nt, Human
cuggccuucggccucc

SEQ ID NO: 3151469 - RNA, 21 nt, Human
cuggccuuuuucauuuaucua

SEQ ID NO: 3151470 - RNA, 20 nt, Human
cuggccuuuuucauuuaucu

SEQ ID NO: 3151471 - RNA, 19 nt, Human
cuggccuuuuucauuuauc

SEQ ID NO: 3151472 - RNA, 17 nt, Human
cuggccuuuuucauuua

SEQ ID NO: 3151473 - RNA, 20 nt, Human
cugggaaagggauuuucagc

SEQ ID NO: 3151474 - RNA, 21 nt, Human
cugcccgucuucagccuagcc

SEQ ID NO: 3151475 - RNA, 15 nt, Human
cugcccgucuucagc

SEQ ID NO: 3151476 - RNA, 16 nt, Human
cugcccgucuucagcc

SEQ ID NO: 3151477 - RNA, 17 nt, Human
cugcccgucuucagccu

SEQ ID NO: 3151478 - RNA, 18 nt, Human
cugcccgucuucagccua

SEQ ID NO: 3151479 - RNA, 22 nt, Human
cugcacucccaccugacacacc

SEQ ID NO: 3151480 - RNA, 12 nt, Human
cugcacugucaa

SEQ ID NO: 3151481 - RNA, 19 nt, Human
cugcacucccaccugacac

SEQ ID NO: 3151482 - RNA, 18 nt, Human
cugcacucccaccugaca

SEQ ID NO: 3151483 - RNA, 16 nt, Human
cugcacucccaccuga

SEQ ID NO: 3151484 - RNA, 18 nt, Human
cugcuugccaucccuccc

SEQ ID NO: 3151485 - RNA, 19 nt, Human
cugcuugccaucccucccu

SEQ ID NO: 3151486 - RNA, 20 nt, Human
cugcuugccaucccucccuc

SEQ ID NO: 3151487 - RNA, 22 nt, Human
cugcuugccaucccucccucca

SEQ ID NO: 3151488 - RNA, 16 nt, Human
cugcuugccaucccuc

SEQ ID NO: 3151489 - RNA, 15 nt, Human
cugcuugccaucccu

SEQ ID NO: 3151490 - RNA, 12 nt, Human
cugcccucuccu

SEQ ID NO: 3151491 - RNA, 13 nt, Human
cugcccucuccug

SEQ ID NO: 3151492 - RNA, 14 nt, Human
cugcccucuccugg

SEQ ID NO: 3151493 - RNA, 17 nt, Human
cugcucuaacagcccuc

SEQ ID NO: 3151494 - RNA, 12 nt, Human
cugcucuaacag

SEQ ID NO: 3151495 - RNA, 23 nt, Human
gaagagcuguucacagccagacu

SEQ ID NO: 3151496 - RNA, 15 nt, Human
gaagagcuguucaca

SEQ ID NO: 3151497 - RNA, 20 nt, Human
gaagagcuguucacagccag

SEQ ID NO: 3151498 - RNA, 13 nt, Human
gaagagcuguuca

SEQ ID NO: 3151499 - RNA, 15 nt, Human
gaaccacaagacugc

SEQ ID NO: 3151500 - RNA, 14 nt, Human
gaaccacaagacug

SEQ ID NO: 3151501 - RNA, 16 nt, Human
gaacucccuuucaaca

SEQ ID NO: 3151502 - RNA, 15 nt, Human
gaacucccuuucaac

SEQ ID NO: 3151503 - RNA, 22 nt, Human
gaacuuguaaaggaauuuaaaa

SEQ ID NO: 3151504 - RNA, 14 nt, Human
gaaggaugcugucu

SEQ ID NO: 3151505 - RNA, 19 nt, Human
gaaggaggguuagggaggg

SEQ ID NO: 3151506 - RNA, 23 nt, Human
gaaguccaagcauuuagauguau

SEQ ID NO: 3151507 - RNA, 18 nt, Human
gaagucaaggcuuagacc

SEQ ID NO: 3151508 - RNA, 24 nt, Human
gaacaguuaccucugccucagaaa

SEQ ID NO: 3151509 - RNA, 22 nt, Human
gaaauguaagggaaacugccag

SEQ ID NO: 3151510 - RNA, 13 nt, Human
gaaauauuuauuu

SEQ ID NO: 3151511 - RNA, 16 nt, Human
gaaauauuuauuuuaa

SEQ ID NO: 3151512 - RNA, 15 nt, Human
gaaauauuuauuuua

SEQ ID NO: 3151513 - RNA, 13 nt, Human
gaaacugccagca

SEQ ID NO: 3151514 - RNA, 15 nt, Human
gaaacugccagcaac

SEQ ID NO: 3151515 - RNA, 16 nt, Human
gaaacugacacaugcu

SEQ ID NO: 3151516 - RNA, 13 nt, Human
gaaagcagaacag

SEQ ID NO: 3151517 - RNA, 22 nt, Human
gaaagacuauucaaacagucuc

SEQ ID NO: 3151518 - RNA, 23 nt, Human
gaaagacuauucaaacagucuca

SEQ ID NO: 3151519 - RNA, 19 nt, Human
gaaagacuauucaaacagu

SEQ ID NO: 3151520 - RNA, 21 nt, Human
gaaagcuugcccuggugccuc

SEQ ID NO: 3151521 - RNA, 23 nt, Human
gaaaguguauuuggaaauaaagu

SEQ ID NO: 3151522 - RNA, 15 nt, Human
gaaaguguauuugga

SEQ ID NO: 3151523 - RNA, 11 nt, Human
gaaaguguauu

SEQ ID NO: 3151524 - RNA, 21 nt, Human
cuuuauuuucuauaauuuaaa

SEQ ID NO: 3151525 - RNA, 12 nt, Human
cuuuuucauuua

SEQ ID NO: 3151526 - RNA, 15 nt, Human
cuuuuucauuuaucu

SEQ ID NO: 3151527 - RNA, 13 nt, Human
cuuuuucauuuau

SEQ ID NO: 3151528 - RNA, 23 nt, Human
cuuuuucauuuaucuauaauuua

SEQ ID NO: 3151529 - RNA, 12 nt, Human
cuuguauuuaaa

SEQ ID NO: 3151530 - RNA, 18 nt, Human
cuuguauuuaaauauuaa

SEQ ID NO: 3151531 - RNA, 20 nt, Human
cuuguauuuaaauauuaaau

SEQ ID NO: 3151532 - RNA, 17 nt, Human
cuugccaaauauaaaua

SEQ ID NO: 3151533 - RNA, 14 nt, Human
cuugaacccgggag

SEQ ID NO: 3151534 - RNA, 19 nt, Human
cuugaacccgggaggcaga

SEQ ID NO: 3151535 - RNA, 20 nt, Human
cuugaacccgggaggcagag

SEQ ID NO: 3151536 - RNA, 13 nt, Human
cuucuuuccacag

SEQ ID NO: 3151537 - RNA, 19 nt, Human
cuucuuuccacagaagcuc

SEQ ID NO: 3151538 - RNA, 16 nt, Human
cuucuuucuagaaaga

SEQ ID NO: 3151539 - RNA, 21 nt, Human
cuugcaugguuuagaaagcuu

SEQ ID NO: 3151540 - RNA, 22 nt, Human
cuugcagcucuccccuucucug

SEQ ID NO: 3151541 - RNA, 16 nt, Human
cuugagugcucaguag

SEQ ID NO: 3151542 - RNA, 18 nt, Human
gacuccaaagaaauguaa

SEQ ID NO: 3151543 - RNA, 14 nt, Human
gacucagggcccca

SEQ ID NO: 3151544 - RNA, 15 nt, Human
gacucagggccccag

SEQ ID NO: 3151545 - RNA, 17 nt, Human
gacucagggccccagca

SEQ ID NO: 3151546 - RNA, 18 nt, Human
gacucagggccccagcac

SEQ ID NO: 3151547 - RNA, 20 nt, Human
gacucagggccccagcacua

SEQ ID NO: 3151548 - RNA, 10 nt, Human
gaccucagcc

SEQ ID NO: 3151549 - RNA, 11 nt, Human
gaccucagccu

SEQ ID NO: 3151550 - RNA, 12 nt, Human
gaccucagccug

SEQ ID NO: 3151551 - RNA, 13 nt, Human
gaccucagccugu

SEQ ID NO: 3151552 - RNA, 14 nt, Human
gaccucagccugug

SEQ ID NO: 3151553 - RNA, 16 nt, Human
gaccucagccugugcu

SEQ ID NO: 3151554 - RNA, 19 nt, Human
gaccucagccugugcugcc

SEQ ID NO: 3151555 - RNA, 13 nt, Human
gaccucagccuuc

SEQ ID NO: 3151556 - RNA, 14 nt, Human
gaccucagccuucc

SEQ ID NO: 3151557 - RNA, 20 nt, Human
gaccucagccuuccccuugc

SEQ ID NO: 3151558 - RNA, 23 nt, Human
gaccugauuucugagcauuuaau

SEQ ID NO: 3151559 - RNA, 22 nt, Human
gacccacaagaaaugaaagcag

SEQ ID NO: 3151560 - RNA, 22 nt, Human
gacaugggacauuugcucaugg

SEQ ID NO: 3151561 - RNA, 17 nt, Human
gacaugggacauuugcu

SEQ ID NO: 3151562 - RNA, 15 nt, Human
gacaggaccugacua

SEQ ID NO: 3151563 - RNA, 13 nt, Human
gacaggaccugac

SEQ ID NO: 3151564 - RNA, 15 nt, Human
gagagugaacaaauu

SEQ ID NO: 3151565 - RNA, 19 nt, Human
gagagugaacaaauuuaca

SEQ ID NO: 3151566 - RNA, 17 nt, Human
gagauacagaauuuuau

SEQ ID NO: 3151567 - RNA, 13 nt, Human
gagacagcucugc

SEQ ID NO: 3151568 - RNA, 18 nt, Human
gagacagcucugcauacu

SEQ ID NO: 3151569 - RNA, 15 nt, Human
gagacagcucugcau

SEQ ID NO: 3151570 - RNA, 21 nt, Human
gagaaugagagacacacugaa

SEQ ID NO: 3151571 - RNA, 15 nt, Human
gagaagagcuguuca

SEQ ID NO: 3151572 - RNA, 22 nt, Human
gagaagagcuguucacagccag

SEQ ID NO: 3151573 - RNA, 13 nt, Human
gagaagagcuguu

SEQ ID NO: 3151574 - RNA, 14 nt, Human
gagaagaacugaaa

SEQ ID NO: 3151575 - RNA, 13 nt, Human
gagaagaacugaa

SEQ ID NO: 3151576 - RNA, 16 nt, Human
gagaagaacugaaauc

SEQ ID NO: 3151577 - RNA, 18 nt, Human
gagacacacugaagaagc

SEQ ID NO: 3151578 - RNA, 13 nt, Human
gagaaagacuauu

SEQ ID NO: 3151579 - RNA, 15 nt, Human
gagaaagacuauuca

SEQ ID NO: 3151580 - RNA, 17 nt, Human
gagaaagacuauucaaa

SEQ ID NO: 3151581 - RNA, 18 nt, Human
gagaaagacuauucaaac

SEQ ID NO: 3151582 - RNA, 19 nt, Human
gagaaacaguugguaacuu

SEQ ID NO: 3151583 - RNA, 18 nt, Human
gagaaacaguugguaacu

SEQ ID NO: 3151584 - RNA, 17 nt, Human
gagaaacaguugguaac

SEQ ID NO: 3151585 - RNA, 22 nt, Human
gagaaacaguugguaacuuuug

SEQ ID NO: 3151586 - RNA, 21 nt, Human
gagaaacaguugguaacuuuu

SEQ ID NO: 3151587 - RNA, 17 nt, Human
gagccucauccgaggca

SEQ ID NO: 3151588 - RNA, 18 nt, Human
gagccucauccgaggcag

SEQ ID NO: 3151589 - RNA, 19 nt, Human
gagccucauccgaggcagg

SEQ ID NO: 3151590 - RNA, 20 nt, Human
gagccucauccgaggcaggg

SEQ ID NO: 3151591 - RNA, 16 nt, Human
gagcucgugggacagu

SEQ ID NO: 3151592 - RNA, 15 nt, Human
gagcucgguggaccc

SEQ ID NO: 3151593 - RNA, 17 nt, Human
gagcugcccucuccugg

SEQ ID NO: 3151594 - RNA, 18 nt, Human
gagcugcccucuccuggg

SEQ ID NO: 3151595 - RNA, 19 nt, Human
gagcugcccucuccugggc

SEQ ID NO: 3151596 - RNA, 21 nt, Human
gagcugcccucuccugggcag

SEQ ID NO: 3151597 - RNA, 23 nt, Human
gagcugcccucuccugggcagcu

SEQ ID NO: 3151598 - RNA, 17 nt, Human
gauaggucagugcaaau

SEQ ID NO: 3151599 - RNA, 23 nt, Human
gauagauaggucagugcaaauac

SEQ ID NO: 3151600 - RNA, 22 nt, Human
gauaaauaguuuaugauuccac

SEQ ID NO: 3151601 - RNA, 14 nt, Human
gaugaaaauauuug

SEQ ID NO: 3151602 - RNA, 21 nt, Human
gauggcuaguaucaaaagaaa

SEQ ID NO: 3151603 - RNA, 15 nt, Human
gauuuuccugaaaac

SEQ ID NO: 3151604 - RNA, 11 nt, Human
gauuuucagcc

SEQ ID NO: 3151605 - RNA, 15 nt, Human
gauuuucagcccuca

SEQ ID NO: 3151606 - RNA, 19 nt, Human
gauuuucagcccucagaau

SEQ ID NO: 3151607 - RNA, 23 nt, Human
gcaaagcacugacuucuaaguaa

SEQ ID NO: 3151608 - RNA, 14 nt, Human
gcaagggugauggg

SEQ ID NO: 3151609 - RNA, 10 nt, Human
gcaagccaga

SEQ ID NO: 3151610 - RNA, 17 nt, Human
gcaagguacucugguga

SEQ ID NO: 3151611 - RNA, 15 nt, Human
gcaagguacucuggu

SEQ ID NO: 3151612 - RNA, 13 nt, Human
gcauuauauuuau

SEQ ID NO: 3151613 - RNA, 20 nt, Human
gcagugcuuggcccaggagu

SEQ ID NO: 3151614 - RNA, 19 nt, Human
gcagugcuuggcccaggag

SEQ ID NO: 3151615 - RNA, 18 nt, Human
gcagugcuuggcccagga

SEQ ID NO: 3151616 - RNA, 17 nt, Human
gcagugcuuggcccagg

SEQ ID NO: 3151617 - RNA, 15 nt, Human
gcaguggacaccagg

SEQ ID NO: 3151618 - RNA, 17 nt, Human
gcauagguuuaauaauu

SEQ ID NO: 3151619 - RNA, 16 nt, Human
gcaguucagagcugcc

SEQ ID NO: 3151620 - RNA, 15 nt, Human
gcaguucugaagaag

SEQ ID NO: 3151621 - RNA, 17 nt, Human
gcaguucagagcugccc

SEQ ID NO: 3151622 - RNA, 18 nt, Human
gcaguucagagcugcccu

SEQ ID NO: 3151623 - RNA, 17 nt, Human
gcaguucugaagaagau

SEQ ID NO: 3151624 - RNA, 14 nt, Human
gcaguucugaagaa

SEQ ID NO: 3151625 - RNA, 13 nt, Human
gcauagaaguaaa

SEQ ID NO: 3151626 - RNA, 20 nt, Human
gcagccccgugggguuccuc

SEQ ID NO: 3151627 - RNA, 20 nt, Human
gcagauucauuuuucuuucu

SEQ ID NO: 3151628 - RNA, 19 nt, Human
gcagauucauuuuucuuuc

SEQ ID NO: 3151629 - RNA, 18 nt, Human
gcagauaaacaguaguga

SEQ ID NO: 3151630 - RNA, 14 nt, Human
gccuuuuucauuua

SEQ ID NO: 3151631 - RNA, 19 nt, Human
gccuuuuucauuuaucuau

SEQ ID NO: 3151632 - RNA, 18 nt, Human
gccuuuuucauuuaucua

SEQ ID NO: 3151633 - RNA, 17 nt, Human
gccuuuuucauuuaucu

SEQ ID NO: 3151634 - RNA, 15 nt, Human
gccuuuuucauuuau

SEQ ID NO: 3151635 - RNA, 22 nt, Human
gccuuuuucauuuaucuauaau

SEQ ID NO: 3151636 - RNA, 13 nt, Human
gccuggugggccu

SEQ ID NO: 3151637 - RNA, 22 nt, Human
gcgcuaauucaaggaauuucuu

SEQ ID NO: 3151638 - RNA, 12 nt, Human
gcgacagugaga

SEQ ID NO: 3151639 - RNA, 13 nt, Human
gcuauaggugcua

SEQ ID NO: 3151640 - RNA, 18 nt, Human
gcuagaacucccuuucaa

SEQ ID NO: 3151641 - RNA, 19 nt, Human
gcuagaacucccuuucaac

SEQ ID NO: 3151642 - RNA, 14 nt, Human
gcuaccucacuggg

SEQ ID NO: 3151643 - RNA, 20 nt, Human
gccuccccuccucugcuugc

SEQ ID NO: 3151644 - RNA, 22 nt, Human
gccuccccuccucugcuugcca

SEQ ID NO: 3151645 - RNA, 17 nt, Human
gccuccccuccucugcu

SEQ ID NO: 3151646 - RNA, 19 nt, Human
gccuccccuccucugcuug

SEQ ID NO: 3151647 - RNA, 16 nt, Human
gccuccccuccucugc

SEQ ID NO: 3151648 - RNA, 20 nt, Human
gccgggcgugguggugagug

SEQ ID NO: 3151649 - RNA, 11 nt, Human
gccgaccucag

SEQ ID NO: 3151650 - RNA, 23 nt, Human
gccguggugauuuagcaggaagc

SEQ ID NO: 3151651 - RNA, 22 nt, Human
gccgugugugugcguccugucg

SEQ ID NO: 3151652 - RNA, 21 nt, Human
gccuauuaucugucagcugca

SEQ ID NO: 3151653 - RNA, 16 nt, Human
gccaucccucccucca

SEQ ID NO: 3151654 - RNA, 23 nt, Human
gccaucccucccuccaccucccu

SEQ ID NO: 3151655 - RNA, 18 nt, Human
gccaucccucccuccacc

SEQ ID NO: 3151656 - RNA, 19 nt, Human
gccaugggcacugugggua

SEQ ID NO: 3151657 - RNA, 22 nt, Human
gcccugagcucgguggacccag

SEQ ID NO: 3151658 - RNA, 13 nt, Human
gcccugagcucgg

SEQ ID NO: 3151659 - RNA, 15 nt, Human
gcccugagcucggug

SEQ ID NO: 3151660 - RNA, 16 nt, Human
gcccugagcucggugg

SEQ ID NO: 3151661 - RNA, 12 nt, Human
gccccagcacua

SEQ ID NO: 3151662 - RNA, 17 nt, Human
gccccagcacuaaagca

SEQ ID NO: 3151663 - RNA, 19 nt, Human
gccccagcacuaaagcagu

SEQ ID NO: 3151664 - RNA, 23 nt, Human
gccccagcacuaaagcaguggac

SEQ ID NO: 3151665 - RNA, 18 nt, Human
gcccagggcucagccugg

SEQ ID NO: 3151666 - RNA, 20 nt, Human
cauccucaaagaaaguguau

SEQ ID NO: 3151667 - RNA, 14 nt, Human
cauccucaaagaaa

SEQ ID NO: 3151668 - RNA, 22 nt, Human
cauccucaaagaaaguguauug

SEQ ID NO: 3151669 - RNA, 14 nt, Human
caucuagugagcag

SEQ ID NO: 3151670 - RNA, 22 nt, Human
caucuagugagcagucaggaaa

SEQ ID NO: 3151671 - RNA, 18 nt, Human
caucuugcuaccaguauu

SEQ ID NO: 3151672 - RNA, 17 nt, Human
caucuugcuaccaguau

SEQ ID NO: 3151673 - RNA, 16 nt, Human
caucuugcuaccagua

SEQ ID NO: 3151674 - RNA, 14 nt, Human
caucuugcuaccag

SEQ ID NO: 3151675 - RNA, 22 nt, Human
caucuugcuaccaguauuuaga

SEQ ID NO: 3151676 - RNA, 20 nt, Human
caucuugcuaccaguauuua

SEQ ID NO: 3151677 - RNA, 23 nt, Human
caucuugcuaccaguauuuagaa

SEQ ID NO: 3151678 - RNA, 12 nt, Human
caucuugcuacc

SEQ ID NO: 3151679 - RNA, 14 nt, Human
caucccucccucca

SEQ ID NO: 3151680 - RNA, 12 nt, Human
caucccucccuc

SEQ ID NO: 3151681 - RNA, 13 nt, Human
caucccucccucc

SEQ ID NO: 3151682 - RNA, 20 nt, Human
cauauauaacaaugcuguau

SEQ ID NO: 3151683 - RNA, 22 nt, Human
caucaagucuuucacauuuaaa

SEQ ID NO: 3151684 - RNA, 18 nt, Human
caucaaugaaugaaugaa

SEQ ID NO: 3151685 - RNA, 20 nt, Human
cagugcuuggcccaggaguu

SEQ ID NO: 3151686 - RNA, 19 nt, Human
cagugcuuggcccaggagu

SEQ ID NO: 3151687 - RNA, 18 nt, Human
cagugcuuggcccaggag

SEQ ID NO: 3151688 - RNA, 17 nt, Human
cagugcuuggcccagga

SEQ ID NO: 3151689 - RNA, 12 nt, Human
cagugcuuggcc

SEQ ID NO: 3151690 - RNA, 13 nt, Human
caguggacaccag

SEQ ID NO: 3151691 - RNA, 22 nt, Human
caguggacaccaggagucccug

SEQ ID NO: 3151692 - RNA, 16 nt, Human
cagugcuuggcccagg

SEQ ID NO: 3151693 - RNA, 15 nt, Human
cagugcuuggcccag

SEQ ID NO: 3151694 - RNA, 14 nt, Human
cagugcuuggccca

SEQ ID NO: 3151695 - RNA, 13 nt, Human
cagugcuuggccc

SEQ ID NO: 3151696 - RNA, 14 nt, Human
cagugucaaugcag

SEQ ID NO: 3151697 - RNA, 20 nt, Human
caguguuuuaggagcaugag

SEQ ID NO: 3151698 - RNA, 16 nt, Human
caguguuuuaggagca

SEQ ID NO: 3151699 - RNA, 12 nt, Human
caguuaauuuuu

SEQ ID NO: 3151700 - RNA, 19 nt, Human
caguuaauuuuuccaacua

SEQ ID NO: 3151701 - RNA, 16 nt, Human
caguuaauuuuuccaa

SEQ ID NO: 3151702 - RNA, 14 nt, Human
caguuaauuuuucc

SEQ ID NO: 3151703 - RNA, 13 nt, Human
caguuaauuuuuc

SEQ ID NO: 3151704 - RNA, 21 nt, Human
caguuaccucugccucagaaa

SEQ ID NO: 3151705 - RNA, 22 nt, Human
caguucggugagcuacaaaugc

SEQ ID NO: 3151706 - RNA, 12 nt, Human
caguucugaaga

SEQ ID NO: 3151707 - RNA, 14 nt, Human
caguucugaagaag

SEQ ID NO: 3151708 - RNA, 13 nt, Human
caguucugaagaa

SEQ ID NO: 3151709 - RNA, 16 nt, Human
caguucugaagaagau

SEQ ID NO: 3151710 - RNA, 15 nt, Human
caguucugaagaaga

SEQ ID NO: 3151711 - RNA, 22 nt, Human
caguucugaagaagaugguacc

SEQ ID NO: 3151712 - RNA, 20 nt, Human
caguucucauggguggcacu

SEQ ID NO: 3151713 - RNA, 20 nt, Human
caguucugugguuucauguu

SEQ ID NO: 3151714 - RNA, 17 nt, Human
cauaccaacacgagcag

SEQ ID NO: 3151715 - RNA, 12 nt, Human
cauaaccugucu

SEQ ID NO: 3151716 - RNA, 23 nt, Human
cauaaccugucucaccuggacuu

SEQ ID NO: 3151717 - RNA, 23 nt, Human
caguugaaaagacuccaaagaaa

SEQ ID NO: 3151718 - RNA, 21 nt, Human
caguugaaaagacuccaaaga

SEQ ID NO: 3151719 - RNA, 22 nt, Human
caguugaaaagacuccaaagaa

SEQ ID NO: 3151720 - RNA, 14 nt, Human
caguugaaaagacu

SEQ ID NO: 3151721 - RNA, 18 nt, Human
caguugaaaagacuccaa

SEQ ID NO: 3151722 - RNA, 19 nt, Human
caguuuucugagaaagacu

SEQ ID NO: 3151723 - RNA, 20 nt, Human
caguuuucugagaaagacua

SEQ ID NO: 3151724 - RNA, 14 nt, Human
caguuuucugagaa

SEQ ID NO: 3151725 - RNA, 15 nt, Human
caguuuucugagaaa

SEQ ID NO: 3151726 - RNA, 16 nt, Human
caguugguaacuuuug

SEQ ID NO: 3151727 - RNA, 14 nt, Human
caguugguaacuuu

SEQ ID NO: 3151728 - RNA, 17 nt, Human
caguugguaacuuuugu

SEQ ID NO: 3151729 - RNA, 17 nt, Human
caugggacagggaggac

SEQ ID NO: 3151730 - RNA, 23 nt, Human
caugcugucuacacuaagagaga

SEQ ID NO: 3151731 - RNA, 12 nt, Human
caugugguggga

SEQ ID NO: 3151732 - RNA, 21 nt, Human
cauguggugggacagggaccc

SEQ ID NO: 3151733 - RNA, 19 nt, Human
cauugacuaucaaacugaa

SEQ ID NO: 3151734 - RNA, 22 nt, Human
cauugacuaucaaacugaagcc

SEQ ID NO: 3151735 - RNA, 18 nt, Human
cauugacuaucaaacuga

SEQ ID NO: 3151736 - RNA, 19 nt, Human
cauuuaaagcuuauuaaaa

SEQ ID NO: 3151737 - RNA, 12 nt, Human
cauuuccaagca

SEQ ID NO: 3151738 - RNA, 23 nt, Human
cauuucugcaucagcugcugaaa

SEQ ID NO: 3151739 - RNA, 14 nt, Human
cauuugcucaugga

SEQ ID NO: 3151740 - RNA, 15 nt, Human
cauuugcucauggaa

SEQ ID NO: 3151741 - RNA, 16 nt, Human
cauuugcucauggaau

SEQ ID NO: 3151742 - RNA, 17 nt, Human
ccaaagaaauguaaggg

SEQ ID NO: 3151743 - RNA, 22 nt, Human
ccacaagaaaugaaagcaggga

SEQ ID NO: 3151744 - RNA, 16 nt, Human
ccacaagaaaugaaag

SEQ ID NO: 3151745 - RNA, 19 nt, Human
ccaaggcugauuaaaccaa

SEQ ID NO: 3151746 - RNA, 20 nt, Human
ccaauauucauagcagcuua

SEQ ID NO: 3151747 - RNA, 18 nt, Human
ccaaggcuagaaccaccu

SEQ ID NO: 3151748 - RNA, 14 nt, Human
ccaacacgagcagg

SEQ ID NO: 3151749 - RNA, 21 nt, Human
ccaacacgagcaggcuacugu

SEQ ID NO: 3151750 - RNA, 15 nt, Human
ccauccugaggcucc

SEQ ID NO: 3151751 - RNA, 13 nt, Human
ccagcucucagcc

SEQ ID NO: 3151752 - RNA, 14 nt, Human
ccagcucucagcca

SEQ ID NO: 3151753 - RNA, 15 nt, Human
ccagcucucagccaa

SEQ ID NO: 3151754 - RNA, 12 nt, Human
ccagcucucagc

SEQ ID NO: 3151755 - RNA, 23 nt, Human
ccagcugacuaaacuuuuuuucu

SEQ ID NO: 3151756 - RNA, 17 nt, Human
ccagcugacuaaacuuu

SEQ ID NO: 3151757 - RNA, 14 nt, Human
ccagcugacuaaac

SEQ ID NO: 3151758 - RNA, 20 nt, Human
cccagaggagccaccaguuc

SEQ ID NO: 3151759 - RNA, 23 nt, Human
cccagacuagauguaguauuuuu

SEQ ID NO: 3151760 - RNA, 20 nt, Human
cccagacuagauguaguauu

SEQ ID NO: 3151761 - RNA, 23 nt, Human
ccauggcacucuauguucuaaga

SEQ ID NO: 3151762 - RNA, 16 nt, Human
cccaguguuuuaggag

SEQ ID NO: 3151763 - RNA, 17 nt, Human
cccaguguuuuaggagc

SEQ ID NO: 3151764 - RNA, 14 nt, Human
cccucaugcugcca

SEQ ID NO: 3151765 - RNA, 17 nt, Human
cccucaugcugccaaua

SEQ ID NO: 3151766 - RNA, 20 nt, Human
cccucccuccaccucccugc

SEQ ID NO: 3151767 - RNA, 13 nt, Human
cccucccuccacc

SEQ ID NO: 3151768 - RNA, 12 nt, Human
cccucccuccac

SEQ ID NO: 3151769 - RNA, 13 nt, Human
cccgucuucagcc

SEQ ID NO: 3151770 - RNA, 14 nt, Human
cccgucuucagccu

SEQ ID NO: 3151771 - RNA, 15 nt, Human
cccgucuucagccua

SEQ ID NO: 3151772 - RNA, 16 nt, Human
cccgucuucagccuag

SEQ ID NO: 3151773 - RNA, 17 nt, Human
cccgucuucagccuagc

SEQ ID NO: 3151774 - RNA, 12 nt, Human
cccgucuucagc

SEQ ID NO: 3151775 - RNA, 18 nt, Human
cccgucuucagccuagcc

SEQ ID NO: 3151776 - RNA, 13 nt, Human
cccguuuugucac

SEQ ID NO: 3151777 - RNA, 14 nt, Human
ccccaggugccagu

SEQ ID NO: 3151778 - RNA, 14 nt, Human
cccugcaauaaaau

SEQ ID NO: 3151779 - RNA, 15 nt, Human
cccugcaauaaaaug

SEQ ID NO: 3151780 - RNA, 13 nt, Human
ccuccauccugag

SEQ ID NO: 3151781 - RNA, 12 nt, Human
ccuccauccuga

SEQ ID NO: 3151782 - RNA, 14 nt, Human
ccuccccugcccua

SEQ ID NO: 3151783 - RNA, 12 nt, Human
ccuccccuccuc

SEQ ID NO: 3151784 - RNA, 13 nt, Human
ccuccccuccucu

SEQ ID NO: 3151785 - RNA, 20 nt, Human
ccucagaugcacaugagcug

SEQ ID NO: 3151786 - RNA, 19 nt, Human
ccucacugggguccugggg

SEQ ID NO: 3151787 - RNA, 20 nt, Human
ccucacugggguccuggggc

SEQ ID NO: 3151788 - RNA, 23 nt, Human
ccucacugggguccuggggccuc

SEQ ID NO: 3151789 - RNA, 20 nt, Human
ccucacuguauccagguucc

SEQ ID NO: 3151790 - RNA, 17 nt, Human
ccuauuaucugucagcu

SEQ ID NO: 3151791 - RNA, 17 nt, Human
cccuucuuuccacagaa

SEQ ID NO: 3151792 - RNA, 13 nt, Human
ccuaaacauauga

SEQ ID NO: 3151793 - RNA, 14 nt, Human
cagaagucaaggcu

SEQ ID NO: 3151794 - RNA, 19 nt, Respiratory syncytial virus
aaauccuacaaaaaaaugc

SEQ ID NO: 3151795 - RNA, 12 nt, Respiratory syncytial virus
aauuugaaaaua

SEQ ID NO: 3151796 - RNA, 15 nt, Respiratory syncytial virus
caccuguaagcacuu

SEQ ID NO: 3151797 - RNA, 20 nt, Respiratory syncytial virus
aaugucuuagaaaaagacga

SEQ ID NO: 3151798 - RNA, 15 nt, Respiratory syncytial virus
gauaaauauaaaagu

SEQ ID NO: 3151799 - RNA, 18 nt, Respiratory syncytial virus
uuaaaaauucccauagcu

SEQ ID NO: 3151800 - RNA, 17 nt, Respiratory syncytial virus
uggcacuuuuccuaugc

SEQ ID NO: 3151801 - RNA, 19 nt, Respiratory syncytial virus
caagauuaaauccaacaau

SEQ ID NO: 3151802 - RNA, 15 nt, Respiratory syncytial virus
gaaaacuugaugaaa

SEQ ID NO: 3151803 - RNA, 13 nt, Respiratory syncytial virus
accacaaaaccaa

SEQ ID NO: 3151804 - RNA, 16 nt, Respiratory syncytial virus
cuugauaaaucaugaa

SEQ ID NO: 3151805 - RNA, 20 nt, Respiratory syncytial virus
uacacacuaacacuguauuc

SEQ ID NO: 3151806 - RNA, 17 nt, Respiratory syncytial virus
gcugaacaacucaaaga

SEQ ID NO: 3151807 - RNA, 16 nt, Respiratory syncytial virus
gaccaacaaacaaacc

SEQ ID NO: 3151808 - RNA, 16 nt, Respiratory syncytial virus
cauccaugccagcaga

SEQ ID NO: 3151809 - RNA, 17 nt, Respiratory syncytial virus
agagaugggcagcaauu

SEQ ID NO: 3151810 - RNA, 15 nt, Respiratory syncytial virus
caaugaucuaucacu

SEQ ID NO: 3151811 - RNA, 16 nt, Respiratory syncytial virus
ccuaagauccaucagu

SEQ ID NO: 3151812 - RNA, 23 nt, Respiratory syncytial virus
guuugaacacauuaaauaaaagc

SEQ ID NO: 3151813 - RNA, 18 nt, Respiratory syncytial virus
ucaaccaauggaaaauac

SEQ ID NO: 3151814 - RNA, 23 nt, Respiratory syncytial virus
aucaaaaaacugagggacaauga

SEQ ID NO: 3151815 - RNA, 18 nt, Respiratory syncytial virus
ucagagaaauugaacaac

SEQ ID NO: 3151816 - RNA, 15 nt, Respiratory syncytial virus
augccaucacaaaug

SEQ ID NO: 3151817 - RNA, 17 nt, Respiratory syncytial virus
acacucaacaaagauca

SEQ ID NO: 3151818 - RNA, 18 nt, Respiratory syncytial virus
guaccuaccaccaagccc

SEQ ID NO: 3151819 - RNA, 19 nt, Respiratory syncytial virus
augguugguuuaagagaag

SEQ ID NO: 3151820 - RNA, 21 nt, Respiratory syncytial virus
acccauccaaccaaacaucua

SEQ ID NO: 3151821 - RNA, 18 nt, Respiratory syncytial virus
ugcauguuauuacaagua

SEQ ID NO: 3151822 - RNA, 16 nt, Respiratory syncytial virus
auggacacaacacaca

SEQ ID NO: 3151823 - RNA, 20 nt, Respiratory syncytial virus
ccaguggcauugcuguaucu

SEQ ID NO: 3151824 - RNA, 19 nt, Respiratory syncytial virus
auacauagcauucaccaau

SEQ ID NO: 3151825 - RNA, 23 nt, Respiratory syncytial virus
aaacuaagugauucaacaaugac

SEQ ID NO: 3151826 - RNA, 15 nt, Respiratory syncytial virus
acucucaucuauaaa

SEQ ID NO: 3151827 - RNA, 21 nt, Respiratory syncytial virus
gaaagauggggcaaauacaaa

SEQ ID NO: 3151828 - RNA, 21 nt, Respiratory syncytial virus
ugaaacuacaucacaaaccac

SEQ ID NO: 3151829 - RNA, 14 nt, Respiratory syncytial virus
aguacucaaauaag

SEQ ID NO: 3151830 - RNA, 17 nt, Respiratory syncytial virus
aacaacugaaauucaaa

SEQ ID NO: 3151831 - RNA, 16 nt, Respiratory syncytial virus
uaaaaauacucagaga

SEQ ID NO: 3151832 - RNA, 17 nt, Respiratory syncytial virus
gccucagaucaucccaa

SEQ ID NO: 3151833 - RNA, 16 nt, Respiratory syncytial virus
caagcccaccacaaaa

SEQ ID NO: 3151834 - RNA, 16 nt, Respiratory syncytial virus
aagcacuaaauacaaa

SEQ ID NO: 3151835 - RNA, 15 nt, Respiratory syncytial virus
aagcacacagcuaca

SEQ ID NO: 3151836 - RNA, 15 nt, Respiratory syncytial virus
caaauuggaagcaca

SEQ ID NO: 3151837 - RNA, 15 nt, Respiratory syncytial virus
caaauggagccugaa

SEQ ID NO: 3151838 - RNA, 22 nt, Respiratory syncytial virus
aacacacuauauuucaaucaaa

SEQ ID NO: 3151839 - RNA, 20 nt, Respiratory syncytial virus
aacuagcuaaugucaacaua

SEQ ID NO: 3151840 - RNA, 18 nt, Respiratory syncytial virus
guugaaugauacacucaa

SEQ ID NO: 3151841 - RNA, 23 nt, Respiratory syncytial virus
auucacccaagauaagaguguac

SEQ ID NO: 3151842 - RNA, 12 nt, Respiratory syncytial virus
ccucaaaccaca

SEQ ID NO: 3151843 - RNA, 18 nt, Respiratory syncytial virus
accaaaauaaccauauau

SEQ ID NO: 3151844 - RNA, 14 nt, Respiratory syncytial virus
aaguguuugaaaaa

SEQ ID NO: 3151845 - RNA, 23 nt, Respiratory syncytial virus
aaaacuaagugauucaacaauga

SEQ ID NO: 3151846 - RNA, 16 nt, Respiratory syncytial virus
cucaauccaugaauuu

SEQ ID NO: 3151847 - RNA, 18 nt, Respiratory syncytial virus
auaguuagacagcaaagu

SEQ ID NO: 3151848 - RNA, 14 nt, Respiratory syncytial virus
guucaacuaaucaa

SEQ ID NO: 3151849 - RNA, 15 nt, Respiratory syncytial virus
gacaugauagaaaaa

SEQ ID NO: 3151850 - RNA, 19 nt, Respiratory syncytial virus
uuugauaacaaugaagaag

SEQ ID NO: 3151851 - RNA, 16 nt, Respiratory syncytial virus
aucauaacacacagau

SEQ ID NO: 3151852 - RNA, 15 nt, Respiratory syncytial virus
auaaccauauauacu

SEQ ID NO: 3151853 - RNA, 23 nt, Respiratory syncytial virus
cauuuguaagugaacaacccuca

SEQ ID NO: 3151854 - RNA, 22 nt, Respiratory syncytial virus
caaugagggguucuacauaaua

SEQ ID NO: 3151855 - RNA, 14 nt, Respiratory syncytial virus
aagaaaauggugug

SEQ ID NO: 3151856 - RNA, 15 nt, Respiratory syncytial virus
aucuuauauuaaaaa

SEQ ID NO: 3151857 - RNA, 22 nt, Respiratory syncytial virus
auuaaauucuccaaaaaacuaa

SEQ ID NO: 3151858 - RNA, 14 nt, Respiratory syncytial virus
gcaccuaaucaugu

SEQ ID NO: 3151859 - RNA, 21 nt, Respiratory syncytial virus
aauuuguuugacaaugaugaa

SEQ ID NO: 3151860 - RNA, 17 nt, Respiratory syncytial virus
agaaacacaucaauaag

SEQ ID NO: 3151861 - RNA, 23 nt, Respiratory syncytial virus
ugccagcagacguauugaagaaa

SEQ ID NO: 3151862 - RNA, 20 nt, Respiratory syncytial virus
auccaauuucacaacaaugc

SEQ ID NO: 3151863 - RNA, 15 nt, Respiratory syncytial virus
uuauuaaucacagaa

SEQ ID NO: 3151864 - RNA, 15 nt, Respiratory syncytial virus
caaauacaaaaaugg

SEQ ID NO: 3151865 - RNA, 14 nt, Respiratory syncytial virus
uggauuuucuuaaa

SEQ ID NO: 3151866 - RNA, 17 nt, Respiratory syncytial virus
caaccauggacacaaca

SEQ ID NO: 3151867 - RNA, 21 nt, Respiratory syncytial virus
gaaucgaguauuuugugacac

SEQ ID NO: 3151868 - RNA, 21 nt, Respiratory syncytial virus
acaaaauuuguuugacaauga

SEQ ID NO: 3151869 - RNA, 21 nt, Respiratory syncytial virus
cuggaaagaaaaccaccacca

SEQ ID NO: 3151870 - RNA, 20 nt, Respiratory syncytial virus
aaaugaucagacaaacgaua

SEQ ID NO: 3151871 - RNA, 15 nt, Respiratory syncytial virus
gucaagucaacccug

SEQ ID NO: 3151872 - RNA, 11 nt, Respiratory syncytial virus
uggagccugaa

SEQ ID NO: 3151873 - RNA, 20 nt, Respiratory syncytial virus
caauguaacauuaagcaaga

SEQ ID NO: 3151874 - RNA, 19 nt, Respiratory syncytial virus
aaacccaucuggagccuca

SEQ ID NO: 3151875 - RNA, 12 nt, Respiratory syncytial virus
ccaaaacaaaca

SEQ ID NO: 3151876 - RNA, 22 nt, Respiratory syncytial virus
aaucaaugucacuaacaccauu

SEQ ID NO: 3151877 - RNA, 16 nt, Respiratory syncytial virus
cagaagauaaaaaugg

SEQ ID NO: 3151878 - RNA, 21 nt, Respiratory syncytial virus
aagucauaauaccaacauacc

SEQ ID NO: 3151879 - RNA, 13 nt, Respiratory syncytial virus
aaauaauauugca

SEQ ID NO: 3151880 - RNA, 20 nt, Respiratory syncytial virus
aucacaauaucugucaacau

SEQ ID NO: 3151881 - RNA, 17 nt, Respiratory syncytial virus
guucaaauggagccuga

SEQ ID NO: 3151882 - RNA, 17 nt, Respiratory syncytial virus
caaaaacacaacaacaa

SEQ ID NO: 3151883 - RNA, 14 nt, Respiratory syncytial virus
ugaacuaauccuaa

SEQ ID NO: 3151884 - RNA, 22 nt, Respiratory syncytial virus
acuauguauaaucaaaagaaca

SEQ ID NO: 3151885 - RNA, 16 nt, Respiratory syncytial virus
aauauacaaguaugau

SEQ ID NO: 3151886 - RNA, 14 nt, Respiratory syncytial virus
ucaugauaaacuca

SEQ ID NO: 3151887 - RNA, 15 nt, Respiratory syncytial virus
aguauugauacuccu

SEQ ID NO: 3151888 - RNA, 16 nt, Respiratory syncytial virus
aauccaauuucacaac

SEQ ID NO: 3151889 - RNA, 15 nt, Respiratory syncytial virus
acccaucuggagccu

SEQ ID NO: 3151890 - RNA, 12 nt, Respiratory syncytial virus
aaaacuauacaa

SEQ ID NO: 3151891 - RNA, 22 nt, Respiratory syncytial virus
ucaagaucuauaugaugcugca

SEQ ID NO: 3151892 - RNA, 17 nt, Respiratory syncytial virus
auuuguaagugaacaac

SEQ ID NO: 3151893 - RNA, 19 nt, Respiratory syncytial virus
auccaucuguuaaaaagau

SEQ ID NO: 3151894 - RNA, 14 nt, Respiratory syncytial virus
aaaugauggaauua

SEQ ID NO: 3151895 - RNA, 18 nt, Respiratory syncytial virus
auaaagggcaaauucaca

SEQ ID NO: 3151896 - RNA, 16 nt, Respiratory syncytial virus
uuaaucacagaagaug

SEQ ID NO: 3151897 - RNA, 22 nt, Respiratory syncytial virus
guuuaugaauuauacacucaac

SEQ ID NO: 3151898 - RNA, 12 nt, Respiratory syncytial virus
ccauaacaaaac

SEQ ID NO: 3151899 - RNA, 12 nt, Respiratory syncytial virus
ccaacacaugac

SEQ ID NO: 3151900 - RNA, 21 nt, Respiratory syncytial virus
aaauccagaacacacaaguca

SEQ ID NO: 3151901 - RNA, 17 nt, Respiratory syncytial virus
cacugcucaccaacaau

SEQ ID NO: 3151902 - RNA, 17 nt, Respiratory syncytial virus
cuagcaaaucaauguca

SEQ ID NO: 3151903 - RNA, 15 nt, Respiratory syncytial virus
cuaaucaaacaaaac

SEQ ID NO: 3151904 - RNA, 13 nt, Respiratory syncytial virus
caacagaagacca

SEQ ID NO: 3151905 - RNA, 20 nt, Respiratory syncytial virus
aauacauuuaacuaaugcau

SEQ ID NO: 3151906 - RNA, 16 nt, Respiratory syncytial virus
aaccacugaauucaaa

SEQ ID NO: 3151907 - RNA, 13 nt, Respiratory syncytial virus
aaacauacgugaa

SEQ ID NO: 3151908 - RNA, 15 nt, Respiratory syncytial virus
uaaucacagaagaug

SEQ ID NO: 3151909 - RNA, 17 nt, Respiratory syncytial virus
auaucauguaaaagcaa

SEQ ID NO: 3151910 - RNA, 24 nt, Respiratory syncytial virus
gaaaacacucaacccaacacauga

SEQ ID NO: 3151911 - RNA, 12 nt, Respiratory syncytial virus
aaccagcaaagu

SEQ ID NO: 3151912 - RNA, 22 nt, Respiratory syncytial virus
caaaagaacacacuauauuuca

SEQ ID NO: 3151913 - RNA, 22 nt, Respiratory syncytial virus
acacuaacacuguauucaauua

SEQ ID NO: 3151914 - RNA, 20 nt, Respiratory syncytial virus
aaaaaugcuaaaagaaaugg

SEQ ID NO: 3151915 - RNA, 23 nt, Respiratory syncytial virus
aucauauucauagccucggcaaa

SEQ ID NO: 3151916 - RNA, 23 nt, Respiratory syncytial virus
auauggaaacauacgugaacaaa

SEQ ID NO: 3151917 - RNA, 21 nt, Respiratory syncytial virus
cauacaagaugcaacaagcca

SEQ ID NO: 3151918 - RNA, 13 nt, Respiratory syncytial virus
gccaaaacaaacc

SEQ ID NO: 3151919 - RNA, 13 nt, Respiratory syncytial virus
cauaauauacaag

SEQ ID NO: 3151920 - RNA, 16 nt, Respiratory syncytial virus
agcccacaaaaaaacc

SEQ ID NO: 3151921 - RNA, 20 nt, Respiratory syncytial virus
cagaauacaggcaugacucu

SEQ ID NO: 3151922 - RNA, 22 nt, Respiratory syncytial virus
caacauaccuaagauccaucag

SEQ ID NO: 3151923 - RNA, 23 nt, Respiratory syncytial virus
cacuuauaauugcagccaucaua

SEQ ID NO: 3151924 - RNA, 15 nt, Respiratory syncytial virus
aacacucaauccuaa

SEQ ID NO: 3151925 - RNA, 14 nt, Respiratory syncytial virus
ucaugcauaaccac

SEQ ID NO: 3151926 - RNA, 15 nt, Respiratory syncytial virus
ugaauuugaaaauau

SEQ ID NO: 3151927 - RNA, 22 nt, Respiratory syncytial virus
ucaaaacuauacaaagaaacca

SEQ ID NO: 3151928 - RNA, 16 nt, Respiratory syncytial virus
auaacuauagaauuaa

SEQ ID NO: 3151929 - RNA, 23 nt, Respiratory syncytial virus
aaccacugaauucaaaaaugcca

SEQ ID NO: 3151930 - RNA, 14 nt, Respiratory syncytial virus
acuguauucaauua

SEQ ID NO: 3151931 - RNA, 13 nt, Respiratory syncytial virus
acaauauauauau

SEQ ID NO: 3151932 - RNA, 18 nt, Respiratory syncytial virus
auaugcuaugucuagauu

SEQ ID NO: 3151933 - RNA, 15 nt, Respiratory syncytial virus
agccugaaaauuaua

SEQ ID NO: 3151934 - RNA, 15 nt, Respiratory syncytial virus
caacagucaagacca

SEQ ID NO: 3151935 - RNA, 17 nt, Respiratory syncytial virus
uuaauuuauacacaaaa

SEQ ID NO: 3151936 - RNA, 13 nt, Respiratory syncytial virus
ugcuagcacaaau

SEQ ID NO: 3151937 - RNA, 20 nt, Respiratory syncytial virus
caucuauaaaccaucucacu

SEQ ID NO: 3151938 - RNA, 18 nt, Respiratory syncytial virus
uuagauaaauauaaaagu

SEQ ID NO: 3151939 - RNA, 22 nt, Respiratory syncytial virus
aaaucaaccagaaucaaaauca

SEQ ID NO: 3151940 - RNA, 15 nt, Respiratory syncytial virus
uugauagacaaucau

SEQ ID NO: 3151941 - RNA, 14 nt, Respiratory syncytial virus
caaaacuauacaaa

SEQ ID NO: 3151942 - RNA, 18 nt, Respiratory syncytial virus
ucauagacaacccaucua

SEQ ID NO: 3151943 - RNA, 15 nt, Respiratory syncytial virus
aaauuaauacauuua

SEQ ID NO: 3151944 - RNA, 15 nt, Respiratory syncytial virus
aauccacaacaguca

SEQ ID NO: 3151945 - RNA, 19 nt, Respiratory syncytial virus
acaauugugaaauuaaauu

SEQ ID NO: 3151946 - RNA, 15 nt, Respiratory syncytial virus
guuagauuacaaaau

SEQ ID NO: 3151947 - RNA, 19 nt, Respiratory syncytial virus
uauccauucuggcaaugau

SEQ ID NO: 3151948 - RNA, 21 nt, Respiratory syncytial virus
guaccuaccaccaagcccaca

SEQ ID NO: 3151949 - RNA, 22 nt, Respiratory syncytial virus
caggaaaaacaauaaacaaacu

SEQ ID NO: 3151950 - RNA, 18 nt, Respiratory syncytial virus
gaacaacucaaagaaaau

SEQ ID NO: 3151951 - RNA, 15 nt, Respiratory syncytial virus
gaacaacucaaagaa

SEQ ID NO: 3151952 - RNA, 16 nt, Respiratory syncytial virus
uucauugaguaugaua

SEQ ID NO: 3151953 - RNA, 17 nt, Respiratory syncytial virus
gauggcaauccaagccc

SEQ ID NO: 3151954 - RNA, 22 nt, Respiratory syncytial virus
uaauaauguccuaaaaaaugaa

SEQ ID NO: 3151955 - RNA, 16 nt, Respiratory syncytial virus
gacaaacgauaauaua

SEQ ID NO: 3151956 - RNA, 22 nt, Respiratory syncytial virus
acugaugauauauacacaauau

SEQ ID NO: 3151957 - RNA, 18 nt, Respiratory syncytial virus
aagucaaguugaaugaua

SEQ ID NO: 3151958 - RNA, 21 nt, Respiratory syncytial virus
aacuaagugauucaacaauga

SEQ ID NO: 3151959 - RNA, 22 nt, Respiratory syncytial virus
aagcacacucccauaauauaca

SEQ ID NO: 3151960 - RNA, 16 nt, Respiratory syncytial virus
uuugcccuaauaauaa

SEQ ID NO: 3151961 - RNA, 23 nt, Respiratory syncytial virus
aauauccacauggggcaaauaau

SEQ ID NO: 3151962 - RNA, 22 nt, Respiratory syncytial virus
aaauucccauagcuacacacua

SEQ ID NO: 3151963 - RNA, 19 nt, Respiratory syncytial virus
agcuauucauaugaagaaa

SEQ ID NO: 3151964 - RNA, 14 nt, Respiratory syncytial virus
caagacacuagaaa

SEQ ID NO: 3151965 - RNA, 16 nt, Respiratory syncytial virus
augugaauuugaaaau

SEQ ID NO: 3151966 - RNA, 19 nt, Respiratory syncytial virus
ucuaugacccauuaguguu

SEQ ID NO: 3151967 - RNA, 16 nt, Respiratory syncytial virus
cagccaauccaaaacu

SEQ ID NO: 3151968 - RNA, 16 nt, Respiratory syncytial virus
uagcuaaugucaacau

SEQ ID NO: 3151969 - RNA, 22 nt, Respiratory syncytial virus
accucuuuacaaaaccacauca

SEQ ID NO: 3151970 - RNA, 15 nt, Respiratory syncytial virus
gauuccuaguuuaua

SEQ ID NO: 3151971 - RNA, 16 nt, Respiratory syncytial virus
aguucaaauggagccu

SEQ ID NO: 3151972 - RNA, 16 nt, Respiratory syncytial virus
cucaacaauaccaaaa

SEQ ID NO: 3151973 - RNA, 13 nt, Respiratory syncytial virus
agugaacaacccu

SEQ ID NO: 3151974 - RNA, 19 nt, Respiratory syncytial virus
acacuguauucaauuauag

SEQ ID NO: 3151975 - RNA, 22 nt, Respiratory syncytial virus
aacaucagagaaauugaacaac

SEQ ID NO: 3151976 - RNA, 23 nt, Respiratory syncytial virus
ccagagacaucauaacacacaga

SEQ ID NO: 3151977 - RNA, 18 nt, Respiratory syncytial virus
auuaaacaacauauuaac

SEQ ID NO: 3151978 - RNA, 20 nt, Respiratory syncytial virus
uuaagucuauggauaaaagc

SEQ ID NO: 3151979 - RNA, 20 nt, Respiratory syncytial virus
ucuaacaugccuaaaaucaa

SEQ ID NO: 3151980 - RNA, 20 nt, Respiratory syncytial virus
cuagaggcuaucaaacauca

SEQ ID NO: 3151981 - RNA, 22 nt, Respiratory syncytial virus
aagaacacaaccccaacauacc

SEQ ID NO: 3151982 - RNA, 15 nt, Respiratory syncytial virus
aaauaaagaucugaa

SEQ ID NO: 3151983 - RNA, 18 nt, Respiratory syncytial virus
ucauuguucaucagaucu

SEQ ID NO: 3151984 - RNA, 13 nt, Respiratory syncytial virus
ucugucaacucaa

SEQ ID NO: 3151985 - RNA, 20 nt, Respiratory syncytial virus
aagaugcaaacaacagagcu

SEQ ID NO: 3151986 - RNA, 19 nt, Respiratory syncytial virus
acacaugauaacaacaaua

SEQ ID NO: 3151987 - RNA, 16 nt, Respiratory syncytial virus
ugacaauugugaaauu

SEQ ID NO: 3151988 - RNA, 17 nt, Respiratory syncytial virus
ugauaacaaugaagaag

SEQ ID NO: 3151989 - RNA, 19 nt, Respiratory syncytial virus
acauugagauagaaucuag

SEQ ID NO: 3151990 - RNA, 16 nt, Respiratory syncytial virus
aacauacgugaacaaa

SEQ ID NO: 3151991 - RNA, 20 nt, Respiratory syncytial virus
gauggggcaaauacaaaaau

SEQ ID NO: 3151992 - RNA, 21 nt, Respiratory syncytial virus
aagucaacccugcaauccaca

SEQ ID NO: 3151993 - RNA, 14 nt, Respiratory syncytial virus
cucggcaaaccaca

SEQ ID NO: 3151994 - RNA, 16 nt, Respiratory syncytial virus
accauuaguuaauaua

SEQ ID NO: 3151995 - RNA, 17 nt, Respiratory syncytial virus
agccaugaccaaaucaa

SEQ ID NO: 3151996 - RNA, 15 nt, Respiratory syncytial virus
uggcuaaggcaguga

SEQ ID NO: 3151997 - RNA, 15 nt, Respiratory syncytial virus
aacaucaaaaaaagu

SEQ ID NO: 3151998 - RNA, 20 nt, Respiratory syncytial virus
guuaccaaucuguacaucaa

SEQ ID NO: 3151999 - RNA, 22 nt, Respiratory syncytial virus
acuagcaaaucaaugucacuaa

SEQ ID NO: 3152000 - RNA, 22 nt, Respiratory syncytial virus
acaaagacugaugaucacagac

SEQ ID NO: 3152001 - RNA, 23 nt, Respiratory syncytial virus
aagugcucuacuauccacaaaca

SEQ ID NO: 3152002 - RNA, 15 nt, Respiratory syncytial virus
auacauaaagccaca

SEQ ID NO: 3152003 - RNA, 16 nt, Respiratory syncytial virus
cuugaugaaagacagg

SEQ ID NO: 3152004 - RNA, 23 nt, Respiratory syncytial virus
aaagcccuauaacaucaaauuca

SEQ ID NO: 3152005 - RNA, 13 nt, Respiratory syncytial virus
cuaauaauaauau

SEQ ID NO: 3152006 - RNA, 16 nt, Respiratory syncytial virus
auuacauaauguaaau

SEQ ID NO: 3152007 - RNA, 14 nt, Respiratory syncytial virus
acaaugaucuauca

SEQ ID NO: 3152008 - RNA, 20 nt, Respiratory syncytial virus
uuaccagggaauuuaguguu

SEQ ID NO: 3152009 - RNA, 17 nt, Respiratory syncytial virus
uuucaaaacuauacaaa

SEQ ID NO: 3152010 - RNA, 22 nt, Respiratory syncytial virus
aaacuaagugauucaacaauga

SEQ ID NO: 3152011 - RNA, 23 nt, Respiratory syncytial virus
acaaucugaaauaacaacuucau

SEQ ID NO: 3152012 - RNA, 16 nt, Respiratory syncytial virus
ucaacacacaacacca

SEQ ID NO: 3152013 - RNA, 21 nt, Respiratory syncytial virus
gagaaaacuugaugaaagaca

SEQ ID NO: 3152014 - RNA, 22 nt, Respiratory syncytial virus
aggcuccacauacacagcugcu

SEQ ID NO: 3152015 - RNA, 22 nt, Respiratory syncytial virus
cagacaugagaccauugucacu

SEQ ID NO: 3152016 - RNA, 22 nt, Respiratory syncytial virus
uuugaacacauuaaauaaaagc

SEQ ID NO: 3152017 - RNA, 21 nt, Respiratory syncytial virus
aaauggcucuuagcaaaguca

SEQ ID NO: 3152018 - RNA, 21 nt, Respiratory syncytial virus
ccaacaaaugagacagaugau

SEQ ID NO: 3152019 - RNA, 21 nt, Respiratory syncytial virus
aucaaugucacuaacaccauu

SEQ ID NO: 3152020 - RNA, 15 nt, Respiratory syncytial virus
ccaacacaacaaacc

SEQ ID NO: 3152021 - RNA, 12 nt, Respiratory syncytial virus
agaucaacuucu

SEQ ID NO: 3152022 - RNA, 17 nt, Respiratory syncytial virus
aaaacuaagugauucaa

SEQ ID NO: 3152023 - RNA, 12 nt, Respiratory syncytial virus
agcacaaaucac

SEQ ID NO: 3152024 - RNA, 20 nt, Respiratory syncytial virus
caacccugcaauccacaaca

SEQ ID NO: 3152025 - RNA, 18 nt, Respiratory syncytial virus
ucaacaucucaccaugca

SEQ ID NO: 3152026 - RNA, 23 nt, Respiratory syncytial virus
caguguauuagacuugacagcag

SEQ ID NO: 3152027 - RNA, 21 nt, Respiratory syncytial virus
uggagaagaugcaaacaacag

SEQ ID NO: 3152028 - RNA, 15 nt, Respiratory syncytial virus
acgauuugcaaucaa

SEQ ID NO: 3152029 - RNA, 23 nt, Respiratory syncytial virus
uggaaacauacgugaacaaacuu

SEQ ID NO: 3152030 - RNA, 15 nt, Respiratory syncytial virus
ucaagcuuaacaacu

SEQ ID NO: 3152031 - RNA, 15 nt, Respiratory syncytial virus
cacacuauauuucaa

SEQ ID NO: 3152032 - RNA, 16 nt, Respiratory syncytial virus
acaagagucacacaau

SEQ ID NO: 3152033 - RNA, 17 nt, Respiratory syncytial virus
cuguacaucaacacaca

SEQ ID NO: 3152034 - RNA, 13 nt, Respiratory syncytial virus
caaugacaccaca

SEQ ID NO: 3152035 - RNA, 18 nt, Respiratory syncytial virus
ccaauauuuaucaaucau

SEQ ID NO: 3152036 - RNA, 22 nt, Respiratory syncytial virus
uaugccaauauuuaucaaucau

SEQ ID NO: 3152037 - RNA, 14 nt, Respiratory syncytial virus
aagaccaacaaaca

SEQ ID NO: 3152038 - RNA, 17 nt, Respiratory syncytial virus
gucauaauaccaacaua

SEQ ID NO: 3152039 - RNA, 23 nt, Respiratory syncytial virus
ugaaugauacacucaacaaagau

SEQ ID NO: 3152040 - RNA, 13 nt, Respiratory syncytial virus
aauucaaaaaugc

SEQ ID NO: 3152041 - RNA, 19 nt, Respiratory syncytial virus
aauaucugucaacauagac

SEQ ID NO: 3152042 - RNA, 15 nt, Respiratory syncytial virus
augcaauucaaaauu

SEQ ID NO: 3152043 - RNA, 22 nt, Respiratory syncytial virus
auguauagcggcauuaguaaua

SEQ ID NO: 3152044 - RNA, 13 nt, Respiratory syncytial virus
ucaaaccacaaaa

SEQ ID NO: 3152045 - RNA, 19 nt, Respiratory syncytial virus
ugcucuacuauccacaaac

SEQ ID NO: 3152046 - RNA, 18 nt, Respiratory syncytial virus
uacacaugauaacaacaa

SEQ ID NO: 3152047 - RNA, 20 nt, Respiratory syncytial virus
cauggaaaaguuugcuccug

SEQ ID NO: 3152048 - RNA, 14 nt, Respiratory syncytial virus
aacgccaaaacaaa

SEQ ID NO: 3152049 - RNA, 18 nt, Respiratory syncytial virus
agauggggcaaauacaaa

SEQ ID NO: 3152050 - RNA, 11 nt, Respiratory syncytial virus
ucaauacauag

SEQ ID NO: 3152051 - RNA, 14 nt, Respiratory syncytial virus
auaugcugaacaac

SEQ ID NO: 3152052 - RNA, 20 nt, Respiratory syncytial virus
cauguuauuaaucacagaag

SEQ ID NO: 3152053 - RNA, 14 nt, Respiratory syncytial virus
aaaccacaaaguca

SEQ ID NO: 3152054 - RNA, 21 nt, Respiratory syncytial virus
agcacuaaauacaaaaaauau

SEQ ID NO: 3152055 - RNA, 21 nt, Respiratory syncytial virus
gaauuagauaaauauaaaagu

SEQ ID NO: 3152056 - RNA, 16 nt, Respiratory syncytial virus
uauuaagacuaacaau

SEQ ID NO: 3152057 - RNA, 17 nt, Respiratory syncytial virus
auggaauuaacacacug

SEQ ID NO: 3152058 - RNA, 17 nt, Respiratory syncytial virus
auacuauaguuacaaaa

SEQ ID NO: 3152059 - RNA, 15 nt, Respiratory syncytial virus
auaacuauagaauua

SEQ ID NO: 3152060 - RNA, 23 nt, Respiratory syncytial virus
aaauaucaacuagcaaaucaaug

SEQ ID NO: 3152061 - RNA, 16 nt, Respiratory syncytial virus
ccauagcuacacacua

SEQ ID NO: 3152062 - RNA, 19 nt, Respiratory syncytial virus
uguagaguuacuauguaua

SEQ ID NO: 3152063 - RNA, 18 nt, Respiratory syncytial virus
cuaaaauuaucauuuuga

SEQ ID NO: 3152064 - RNA, 22 nt, Respiratory syncytial virus
gaagaaaaccauaaaaaccaca

SEQ ID NO: 3152065 - RNA, 20 nt, Respiratory syncytial virus
agagaugggcagcaauucau

SEQ ID NO: 3152066 - RNA, 13 nt, Respiratory syncytial virus
aauacaaaaaugg

SEQ ID NO: 3152067 - RNA, 22 nt, Respiratory syncytial virus
accauauauugaacaacccaaa

SEQ ID NO: 3152068 - RNA, 15 nt, Respiratory syncytial virus
cuauaugaugcugca

SEQ ID NO: 3152069 - RNA, 19 nt, Respiratory syncytial virus
ccaacagaagaccaacaaa

SEQ ID NO: 3152070 - RNA, 19 nt, Respiratory syncytial virus
aaaauuuguuugacaauga

SEQ ID NO: 3152071 - RNA, 16 nt, Respiratory syncytial virus
guauuacugaugauau

SEQ ID NO: 3152072 - RNA, 17 nt, Respiratory syncytial virus
acauguccaaaaacaag

SEQ ID NO: 3152073 - RNA, 14 nt, Respiratory syncytial virus
accuguaagcacuu

SEQ ID NO: 3152074 - RNA, 16 nt, Respiratory syncytial virus
cacuaaauacaaaaaa

SEQ ID NO: 3152075 - RNA, 17 nt, Respiratory syncytial virus
guuaaaucuuaaaucua

SEQ ID NO: 3152076 - RNA, 17 nt, Respiratory syncytial virus
uggauguaacaacacau

SEQ ID NO: 3152077 - RNA, 24 nt, Respiratory syncytial virus
uuauauuaaaaauucccauagcua

SEQ ID NO: 3152078 - RNA, 18 nt, Respiratory syncytial virus
ucaaugucacuaacacca

SEQ ID NO: 3152079 - RNA, 11 nt, Respiratory syncytial virus
ggagccucaga

SEQ ID NO: 3152080 - RNA, 17 nt, Respiratory syncytial virus
acccucaccucuuuaca

SEQ ID NO: 3152081 - RNA, 12 nt, Respiratory syncytial virus
uguccaacaaug

SEQ ID NO: 3152082 - RNA, 18 nt, Respiratory syncytial virus
ggaaaauaaguguaaugg

SEQ ID NO: 3152083 - RNA, 18 nt, Respiratory syncytial virus
ucugaaacuacaucacaa

SEQ ID NO: 3152084 - RNA, 23 nt, Respiratory syncytial virus
uaccacaggaaauccagaacaca

SEQ ID NO: 3152085 - RNA, 23 nt, Respiratory syncytial virus
uaaaaauucccauagcuacacac

SEQ ID NO: 3152086 - RNA, 19 nt, Respiratory syncytial virus
uaaguuaauaaaaauaucc

SEQ ID NO: 3152087 - RNA, 15 nt, Respiratory syncytial virus
aaauuuaaauccaaa

SEQ ID NO: 3152088 - RNA, 21 nt, Respiratory syncytial virus
ucaacuaugaaaugaaacuau

SEQ ID NO: 3152089 - RNA, 15 nt, Respiratory syncytial virus
uuuguuugacaauga

SEQ ID NO: 3152090 - RNA, 19 nt, Respiratory syncytial virus
cauagcuacacacuaacac

SEQ ID NO: 3152091 - RNA, 15 nt, Respiratory syncytial virus
ugaaugauacacuca

SEQ ID NO: 3152092 - RNA, 13 nt, Respiratory syncytial virus
aaacaacauauua

SEQ ID NO: 3152093 - RNA, 15 nt, Respiratory syncytial virus
aaggcuccacauaca

SEQ ID NO: 3152094 - RNA, 14 nt, Respiratory syncytial virus
accauucaaugaaa

SEQ ID NO: 3152095 - RNA, 16 nt, Respiratory syncytial virus
uauuaacucaaacaau

SEQ ID NO: 3152096 - RNA, 20 nt, Respiratory syncytial virus
auggccuaauagaugacaau

SEQ ID NO: 3152097 - RNA, 16 nt, Respiratory syncytial virus
auaagaauuugauaag

SEQ ID NO: 3152098 - RNA, 20 nt, Respiratory syncytial virus
uagcuacacacuaacacugu

SEQ ID NO: 3152099 - RNA, 18 nt, Respiratory syncytial virus
auugcaauacugaacaaa

SEQ ID NO: 3152100 - RNA, 13 nt, Respiratory syncytial virus
uucaaauacauaa

SEQ ID NO: 3152101 - RNA, 17 nt, Respiratory syncytial virus
ggaacccuccacucaac

SEQ ID NO: 3152102 - RNA, 20 nt, Respiratory syncytial virus
augauacacucaacaaagau

SEQ ID NO: 3152103 - RNA, 19 nt, Respiratory syncytial virus
uggggcaaauaaaacauca

SEQ ID NO: 3152104 - RNA, 13 nt, Respiratory syncytial virus
uauaguaacauca

SEQ ID NO: 3152105 - RNA, 17 nt, Respiratory syncytial virus
uacauaaagccacaaag

SEQ ID NO: 3152106 - RNA, 12 nt, Respiratory syncytial virus
aaaugaaauuug

SEQ ID NO: 3152107 - RNA, 13 nt, Respiratory syncytial virus
uucaaugaaaucc

SEQ ID NO: 3152108 - RNA, 19 nt, Respiratory syncytial virus
cuggaaagaaaaccaccac

SEQ ID NO: 3152109 - RNA, 23 nt, Respiratory syncytial virus
uauaacaaccacugaauucaaaa

SEQ ID NO: 3152110 - RNA, 15 nt, Respiratory syncytial virus
aaauuuucuacaaca

SEQ ID NO: 3152111 - RNA, 19 nt, Respiratory syncytial virus
ugaacucaacagugaugac

SEQ ID NO: 3152112 - RNA, 18 nt, Respiratory syncytial virus
aucaaaagaacacacuau

SEQ ID NO: 3152113 - RNA, 17 nt, Respiratory syncytial virus
caaggaaucaagaucua

SEQ ID NO: 3152114 - RNA, 20 nt, Respiratory syncytial virus
uacacaugauaacaacaaua

SEQ ID NO: 3152115 - RNA, 20 nt, Respiratory syncytial virus
aagucacacuaacaacugca

SEQ ID NO: 3152116 - RNA, 13 nt, Respiratory syncytial virus
caagcccacaaaa

SEQ ID NO: 3152117 - RNA, 13 nt, Respiratory syncytial virus
gcaaauaaaacau

SEQ ID NO: 3152118 - RNA, 15 nt, Respiratory syncytial virus
ugcuagcacaaaugc

SEQ ID NO: 3152119 - RNA, 15 nt, Respiratory syncytial virus
cagaaucaaaaucaa

SEQ ID NO: 3152120 - RNA, 20 nt, Respiratory syncytial virus
aucugaacacacuugaaaau

SEQ ID NO: 3152121 - RNA, 15 nt, Respiratory syncytial virus
gaaguaaccaaagaa

SEQ ID NO: 3152122 - RNA, 17 nt, Respiratory syncytial virus
gcaagcuggcauaugau

SEQ ID NO: 3152123 - RNA, 17 nt, Respiratory syncytial virus
gauaggauugaugaaaa

SEQ ID NO: 3152124 - RNA, 18 nt, Respiratory syncytial virus
cauaugcugaacaacuca

SEQ ID NO: 3152125 - RNA, 17 nt, Respiratory syncytial virus
gcuacacacuaacacug

SEQ ID NO: 3152126 - RNA, 11 nt, Respiratory syncytial virus
cggagcacagg

SEQ ID NO: 3152127 - RNA, 18 nt, Respiratory syncytial virus
uguuaacauugucaagcu

SEQ ID NO: 3152128 - RNA, 22 nt, Respiratory syncytial virus
ucaagaccaaaaacacaacaac

SEQ ID NO: 3152129 - RNA, 22 nt, Respiratory syncytial virus
gaaauccaacuaaucacaauau

SEQ ID NO: 3152130 - RNA, 15 nt, Respiratory syncytial virus
uaguauuaggcaaug

SEQ ID NO: 3152131 - RNA, 21 nt, Respiratory syncytial virus
aaauuaauacauuuaacuaau

SEQ ID NO: 3152132 - RNA, 19 nt, Respiratory syncytial virus
agauauuaagacuaacaau

SEQ ID NO: 3152133 - RNA, 20 nt, Respiratory syncytial virus
uggcuaaggcagugauacau

SEQ ID NO: 3152134 - RNA, 19 nt, Respiratory syncytial virus
uauuauguuacaacaaauu

SEQ ID NO: 3152135 - RNA, 10 nt, Respiratory syncytial virus
uacaacccag

SEQ ID NO: 3152136 - RNA, 22 nt, Respiratory syncytial virus
ccagaagcacaccagucacacu

SEQ ID NO: 3152137 - RNA, 15 nt, Respiratory syncytial virus
auguggcauguuauu

SEQ ID NO: 3152138 - RNA, 23 nt, Respiratory syncytial virus
caccaaucugauggcacaaaaca

SEQ ID NO: 3152139 - RNA, 15 nt, Respiratory syncytial virus
auuaccgcaauccuu

SEQ ID NO: 3152140 - RNA, 15 nt, Respiratory syncytial virus
aaucagccaauccaa

SEQ ID NO: 3152141 - RNA, 20 nt, Respiratory syncytial virus
auacucaccgaaucaaccau

SEQ ID NO: 3152142 - RNA, 16 nt, Respiratory syncytial virus
cauagcuacacacuaa

SEQ ID NO: 3152143 - RNA, 14 nt, Respiratory syncytial virus
gaauuugaaaauau

SEQ ID NO: 3152144 - RNA, 20 nt, Respiratory syncytial virus
acaucauugcuuuaugugaa

SEQ ID NO: 3152145 - RNA, 11 nt, Respiratory syncytial virus
uauaacuaaac

SEQ ID NO: 3152146 - RNA, 15 nt, Respiratory syncytial virus
ccaauccaaaacuag

SEQ ID NO: 3152147 - RNA, 15 nt, Respiratory syncytial virus
acaacacacaaugac

SEQ ID NO: 3152148 - RNA, 20 nt, Respiratory syncytial virus
ugaaauaaaaauagaagaac

SEQ ID NO: 3152149 - RNA, 24 nt, Respiratory syncytial virus
gcuaaucauaaucuccaucaugau

SEQ ID NO: 3152150 - RNA, 13 nt, Respiratory syncytial virus
aacaacccaaaag

SEQ ID NO: 3152151 - RNA, 14 nt, Respiratory syncytial virus
acacucaacaaaga

SEQ ID NO: 3152152 - RNA, 16 nt, Respiratory syncytial virus
uuguuugacaaugaug

SEQ ID NO: 3152153 - RNA, 17 nt, Respiratory syncytial virus
cuaaagaucccaagaaa

SEQ ID NO: 3152154 - RNA, 14 nt, Respiratory syncytial virus
acucacccauccaa

SEQ ID NO: 3152155 - RNA, 13 nt, Respiratory syncytial virus
augggacaaaaug

SEQ ID NO: 3152156 - RNA, 18 nt, Respiratory syncytial virus
aagaucugaacacacuug

SEQ ID NO: 3152157 - RNA, 15 nt, Respiratory syncytial virus
agucucuauguaaaa

SEQ ID NO: 3152158 - RNA, 13 nt, Respiratory syncytial virus
aaacccaucugga

SEQ ID NO: 3152159 - RNA, 24 nt, Respiratory syncytial virus
cacaaucugaaauaacaacuucau

SEQ ID NO: 3152160 - RNA, 16 nt, Respiratory syncytial virus
acaucaaaaaaaguca

SEQ ID NO: 3152161 - RNA, 14 nt, Respiratory syncytial virus
aucagcuucuccaa

SEQ ID NO: 3152162 - RNA, 11 nt, Respiratory syncytial virus
uuuaauaacuu

SEQ ID NO: 3152163 - RNA, 24 nt, Respiratory syncytial virus
uaccaagagcucgagucaauacau

SEQ ID NO: 3152164 - RNA, 12 nt, Respiratory syncytial virus
uuagaaaaagac

SEQ ID NO: 3152165 - RNA, 15 nt, Respiratory syncytial virus
ucaagaacacaaccc

SEQ ID NO: 3152166 - RNA, 16 nt, Respiratory syncytial virus
acacgccaggcaaaau

SEQ ID NO: 3152167 - RNA, 22 nt, Respiratory syncytial virus
gaaaaccaccaccaagcccaca

SEQ ID NO: 3152168 - RNA, 14 nt, Respiratory syncytial virus
cugaauacaacaca

SEQ ID NO: 3152169 - RNA, 15 nt, Respiratory syncytial virus
acaacccaucuauca

SEQ ID NO: 3152170 - RNA, 15 nt, Respiratory syncytial virus
agaucugaacacacu

SEQ ID NO: 3152171 - RNA, 21 nt, Respiratory syncytial virus
accauggacacaacacacaau

SEQ ID NO: 3152172 - RNA, 18 nt, Respiratory syncytial virus
uuccauggagaagaugca

SEQ ID NO: 3152173 - RNA, 21 nt, Respiratory syncytial virus
agccucggcaaaccacaaagu

SEQ ID NO: 3152174 - RNA, 16 nt, Respiratory syncytial virus
auuaagacuaacaaua

SEQ ID NO: 3152175 - RNA, 11 nt, Respiratory syncytial virus
cugaacaaacu

SEQ ID NO: 3152176 - RNA, 13 nt, Respiratory syncytial virus
uucaccaucauaa

SEQ ID NO: 3152177 - RNA, 20 nt, Respiratory syncytial virus
aaaauaccaauguaacauua

SEQ ID NO: 3152178 - RNA, 15 nt, Respiratory syncytial virus
agaauucucaagcaa

SEQ ID NO: 3152179 - RNA, 18 nt, Respiratory syncytial virus
cauccaaccaaacaucua

SEQ ID NO: 3152180 - RNA, 21 nt, Respiratory syncytial virus
aggggaagugaacaaaaucaa

SEQ ID NO: 3152181 - RNA, 20 nt, Respiratory syncytial virus
ugaucuaggaggaauaaauu

SEQ ID NO: 3152182 - RNA, 20 nt, Respiratory syncytial virus
acauacuagugaaacaaaua

SEQ ID NO: 3152183 - RNA, 24 nt, Respiratory syncytial virus
agaugcuaaucauaaauucacugg

SEQ ID NO: 3152184 - RNA, 13 nt, Respiratory syncytial virus
cugacaaauuaau

SEQ ID NO: 3152185 - RNA, 14 nt, Respiratory syncytial virus
uacacucaacaaag

SEQ ID NO: 3152186 - RNA, 18 nt, Respiratory syncytial virus
uuaacucaaacaauucaa

SEQ ID NO: 3152187 - RNA, 16 nt, Respiratory syncytial virus
aucaaacaaaacccau

SEQ ID NO: 3152188 - RNA, 21 nt, Respiratory syncytial virus
aaagaucugaacacacuugaa

SEQ ID NO: 3152189 - RNA, 18 nt, Respiratory syncytial virus
cacuugaaaauauaacaa

SEQ ID NO: 3152190 - RNA, 15 nt, Respiratory syncytial virus
uaaugggaaagaaau

SEQ ID NO: 3152191 - RNA, 11 nt, Respiratory syncytial virus
ugccaucacaa

SEQ ID NO: 3152192 - RNA, 20 nt, Respiratory syncytial virus
ccaaucugauggcacaaaac

SEQ ID NO: 3152193 - RNA, 11 nt, Respiratory syncytial virus
aguuaauuaaa

SEQ ID NO: 3152194 - RNA, 13 nt, Respiratory syncytial virus
agcagaagaacua

SEQ ID NO: 3152195 - RNA, 18 nt, Respiratory syncytial virus
acaucaaauucaaccauu

SEQ ID NO: 3152196 - RNA, 14 nt, Respiratory syncytial virus
gcaaugauaaucuc

SEQ ID NO: 3152197 - RNA, 18 nt, Respiratory syncytial virus
caauccaugaauuucaac

SEQ ID NO: 3152198 - RNA, 16 nt, Respiratory syncytial virus
accaaacaaaaaaccu

SEQ ID NO: 3152199 - RNA, 15 nt, Respiratory syncytial virus
ugcaagcagaaaugg

SEQ ID NO: 3152200 - RNA, 19 nt, Respiratory syncytial virus
agcucgagucaauacauag

SEQ ID NO: 3152201 - RNA, 22 nt, Respiratory syncytial virus
gauggcaaaagacacaucagau

SEQ ID NO: 3152202 - RNA, 15 nt, Respiratory syncytial virus
auaugcccaaaaauu

SEQ ID NO: 3152203 - RNA, 18 nt, Respiratory syncytial virus
cuuauauguuaacaaaua

SEQ ID NO: 3152204 - RNA, 15 nt, Respiratory syncytial virus
caccaccaagacacu

SEQ ID NO: 3152205 - RNA, 19 nt, Respiratory syncytial virus
agagacaucauaacacaca

SEQ ID NO: 3152206 - RNA, 14 nt, Respiratory syncytial virus
aaucauaaucucca

SEQ ID NO: 3152207 - RNA, 20 nt, Respiratory syncytial virus
auugauaaaacaagaauuag

SEQ ID NO: 3152208 - RNA, 17 nt, Respiratory syncytial virus
acaaugaccaauuauau

SEQ ID NO: 3152209 - RNA, 16 nt, Respiratory syncytial virus
cuagcaaaucaauguc

SEQ ID NO: 3152210 - RNA, 22 nt, Respiratory syncytial virus
ugauacauacaaucaaauugaa

SEQ ID NO: 3152211 - RNA, 21 nt, Respiratory syncytial virus
uggaaauucugcuaaugugua

SEQ ID NO: 3152212 - RNA, 21 nt, Respiratory syncytial virus
aggaaucaagaucuauaugau

SEQ ID NO: 3152213 - RNA, 16 nt, Respiratory syncytial virus
gucuauggauaaaagc

SEQ ID NO: 3152214 - RNA, 20 nt, Respiratory syncytial virus
uagcuauucauaugaagaaa

SEQ ID NO: 3152215 - RNA, 15 nt, Respiratory syncytial virus
auguguucaaugcaa

SEQ ID NO: 3152216 - RNA, 13 nt, Respiratory syncytial virus
ucagaucauccca

SEQ ID NO: 3152217 - RNA, 16 nt, Respiratory syncytial virus
auaaucccuuuucaaa

SEQ ID NO: 3152218 - RNA, 19 nt, Respiratory syncytial virus
gguucuacauaauaaaaga

SEQ ID NO: 3152219 - RNA, 19 nt, Respiratory syncytial virus
uacaaaaccacaucaacau

SEQ ID NO: 3152220 - RNA, 15 nt, Respiratory syncytial virus
aauacaaaaaauaua

SEQ ID NO: 3152221 - RNA, 14 nt, Respiratory syncytial virus
aucaaacuauuaac

SEQ ID NO: 3152222 - RNA, 19 nt, Respiratory syncytial virus
caaagucacacuaacaacu

SEQ ID NO: 3152223 - RNA, 18 nt, Respiratory syncytial virus
ucaucuauaaaccaucuc

SEQ ID NO: 3152224 - RNA, 11 nt, Respiratory syncytial virus
gaauguaaugc

SEQ ID NO: 3152225 - RNA, 23 nt, Respiratory syncytial virus
uagcuacacacuaacacuguauu

SEQ ID NO: 3152226 - RNA, 15 nt, Respiratory syncytial virus
auacacucaacaaua

SEQ ID NO: 3152227 - RNA, 21 nt, Respiratory syncytial virus
agauuaggaagagaagacacc

SEQ ID NO: 3152228 - RNA, 15 nt, Respiratory syncytial virus
ucuuuacaaaaccac

SEQ ID NO: 3152229 - RNA, 13 nt, Respiratory syncytial virus
aagugaacaaaau

SEQ ID NO: 3152230 - RNA, 15 nt, Respiratory syncytial virus
auuauguaucaaaua

SEQ ID NO: 3152231 - RNA, 23 nt, Respiratory syncytial virus
accauauauacucaccgaaucaa

SEQ ID NO: 3152232 - RNA, 11 nt, Respiratory syncytial virus
ccaaacaaaaa

SEQ ID NO: 3152233 - RNA, 22 nt, Respiratory syncytial virus
aucaugauggguucuuagaaug

SEQ ID NO: 3152234 - RNA, 20 nt, Respiratory syncytial virus
uggcauuguauuugugcaug

SEQ ID NO: 3152235 - RNA, 15 nt, Respiratory syncytial virus
uggaaagaaaaccac

SEQ ID NO: 3152236 - RNA, 17 nt, Respiratory syncytial virus
auauuugcccuaauaau

SEQ ID NO: 3152237 - RNA, 19 nt, Respiratory syncytial virus
caagucauuguucaucaga

SEQ ID NO: 3152238 - RNA, 22 nt, Respiratory syncytial virus
uuuucaaaacuauacaaagaaa

SEQ ID NO: 3152239 - RNA, 16 nt, Respiratory syncytial virus
acaucaucaaacuauu

SEQ ID NO: 3152240 - RNA, 21 nt, Respiratory syncytial virus
cuuaaagcagucaaaaaucac

SEQ ID NO: 3152241 - RNA, 21 nt, Respiratory syncytial virus
acaaguaugaucucaauccau

SEQ ID NO: 3152242 - RNA, 22 nt, Respiratory syncytial virus
cagagacaucauaacacacaga

SEQ ID NO: 3152243 - RNA, 21 nt, Respiratory syncytial virus
ucagugaguugauucauacaa

SEQ ID NO: 3152244 - RNA, 23 nt, Respiratory syncytial virus
uuaaccuuuuucuucuacaucag

SEQ ID NO: 3152245 - RNA, 15 nt, Respiratory syncytial virus
aacagagcuaccaaa

SEQ ID NO: 3152246 - RNA, 14 nt, Respiratory syncytial virus
cucuacaaaacaaa

SEQ ID NO: 3152247 - RNA, 16 nt, Respiratory syncytial virus
caauccucaaaacaaa

SEQ ID NO: 3152248 - RNA, 15 nt, Respiratory syncytial virus
cagaaacacaucaau

SEQ ID NO: 3152249 - RNA, 15 nt, Respiratory syncytial virus
gaagcacuaaauaca

SEQ ID NO: 3152250 - RNA, 23 nt, Respiratory syncytial virus
ucaacacaagagucacacaaucu

SEQ ID NO: 3152251 - RNA, 12 nt, Respiratory syncytial virus
cuauacaaagaa

SEQ ID NO: 3152252 - RNA, 20 nt, Respiratory syncytial virus
gaugaaguagcauuguuaaa

SEQ ID NO: 3152253 - RNA, 11 nt, Respiratory syncytial virus
aauugaacaac

SEQ ID NO: 3152254 - RNA, 17 nt, Respiratory syncytial virus
cuaaucauaaauucacu

SEQ ID NO: 3152255 - RNA, 16 nt, Respiratory syncytial virus
auccgaugaauuauua

SEQ ID NO: 3152256 - RNA, 19 nt, Respiratory syncytial virus
aucaugauugcaauacuga

SEQ ID NO: 3152257 - RNA, 12 nt, Respiratory syncytial virus
uacuugauaaau

SEQ ID NO: 3152258 - RNA, 21 nt, Respiratory syncytial virus
uucaacacaagagucacacaa

SEQ ID NO: 3152259 - RNA, 22 nt, Respiratory syncytial virus
ugaaauccaauuucacaacaau

SEQ ID NO: 3152260 - RNA, 10 nt, Respiratory syncytial virus
aucagugagu

SEQ ID NO: 3152261 - RNA, 20 nt, Respiratory syncytial virus
uuaccaagugaaguaaaucu

SEQ ID NO: 3152262 - RNA, 15 nt, Respiratory syncytial virus
aauugauaaaacaag

SEQ ID NO: 3152263 - RNA, 16 nt, Respiratory syncytial virus
caacaggaaaaacaau

SEQ ID NO: 3152264 - RNA, 16 nt, Respiratory syncytial virus
ggagauaguauugaua

SEQ ID NO: 3152265 - RNA, 11 nt, Respiratory syncytial virus
caaaccaccac

SEQ ID NO: 3152266 - RNA, 17 nt, Respiratory syncytial virus
gcuauucauaugaagaa

SEQ ID NO: 3152267 - RNA, 22 nt, Respiratory syncytial virus
cacaaagacugaugaucacaga

SEQ ID NO: 3152268 - RNA, 23 nt, Respiratory syncytial virus
cugugauagaguuccaacaaaag

SEQ ID NO: 3152269 - RNA, 16 nt, Respiratory syncytial virus
ucaaaccucaaaccac

SEQ ID NO: 3152270 - RNA, 16 nt, Respiratory syncytial virus
cacacaaucugaaaua

SEQ ID NO: 3152271 - RNA, 20 nt, Respiratory syncytial virus
ucauagccucggcaaaccac

SEQ ID NO: 3152272 - RNA, 18 nt, Respiratory syncytial virus
accucuuuacaaaaccac

SEQ ID NO: 3152273 - RNA, 12 nt, Respiratory syncytial virus
aaucaaaacaac

SEQ ID NO: 3152274 - RNA, 19 nt, Respiratory syncytial virus
aacaucagcuuaauccaaa

SEQ ID NO: 3152275 - RNA, 23 nt, Respiratory syncytial virus
auugcuuuaugugaauuugaaaa

SEQ ID NO: 3152276 - RNA, 16 nt, Respiratory syncytial virus
uauaauaauaucacua

SEQ ID NO: 3152277 - RNA, 22 nt, Respiratory syncytial virus
ucaacaccaccaaaacaaacau

SEQ ID NO: 3152278 - RNA, 13 nt, Respiratory syncytial virus
caaauaaucauug

SEQ ID NO: 3152279 - RNA, 15 nt, Respiratory syncytial virus
acaucauggaaaagu

SEQ ID NO: 3152280 - RNA, 14 nt, Respiratory syncytial virus
cagauguaagcagc

SEQ ID NO: 3152281 - RNA, 19 nt, Respiratory syncytial virus
cacaaaucacauuauccau

SEQ ID NO: 3152282 - RNA, 15 nt, Respiratory syncytial virus
caaucagccaaucca

SEQ ID NO: 3152283 - RNA, 18 nt, Respiratory syncytial virus
auaucaacuagcaaauca

SEQ ID NO: 3152284 - RNA, 12 nt, Respiratory syncytial virus
ugcaaaaaucau

SEQ ID NO: 3152285 - RNA, 16 nt, Respiratory syncytial virus
gccaucacaaaugcaa

SEQ ID NO: 3152286 - RNA, 14 nt, Respiratory syncytial virus
ucaacacacaacac

SEQ ID NO: 3152287 - RNA, 19 nt, Respiratory syncytial virus
gaacacauuaaauaaaagc

SEQ ID NO: 3152288 - RNA, 16 nt, Respiratory syncytial virus
aacacacuugaaaaua

SEQ ID NO: 3152289 - RNA, 18 nt, Respiratory syncytial virus
auagaguuccaacaaaag

SEQ ID NO: 3152290 - RNA, 17 nt, Respiratory syncytial virus
ucaacuguuagugauau

SEQ ID NO: 3152291 - RNA, 16 nt, Respiratory syncytial virus
agguauguuauaugcu

SEQ ID NO: 3152292 - RNA, 17 nt, Respiratory syncytial virus
agauggcaaaagacaca

SEQ ID NO: 3152293 - RNA, 17 nt, Respiratory syncytial virus
auacgccaaucagccaa

SEQ ID NO: 3152294 - RNA, 16 nt, Respiratory syncytial virus
aucugaaauaacaacu

SEQ ID NO: 3152295 - RNA, 19 nt, Respiratory syncytial virus
aaacaaucagcauguguug

SEQ ID NO: 3152296 - RNA, 14 nt, Respiratory syncytial virus
cuuagaaugcauug

SEQ ID NO: 3152297 - RNA, 14 nt, Respiratory syncytial virus
acagcaaaguuacu

SEQ ID NO: 3152298 - RNA, 23 nt, Respiratory syncytial virus
caaagaucaacuucugucaucca

SEQ ID NO: 3152299 - RNA, 20 nt, Respiratory syncytial virus
uagaaacauuugauaacaau

SEQ ID NO: 3152300 - RNA, 18 nt, Respiratory syncytial virus
cucaccaugcaagccauc

SEQ ID NO: 3152301 - RNA, 12 nt, Respiratory syncytial virus
acacuaauacac

SEQ ID NO: 3152302 - RNA, 20 nt, Respiratory syncytial virus
auacaacacaaaauauggca

SEQ ID NO: 3152303 - RNA, 16 nt, Respiratory syncytial virus
agcuuaauccaaaaga

SEQ ID NO: 3152304 - RNA, 15 nt, Respiratory syncytial virus
caccaccaaaacaaa

SEQ ID NO: 3152305 - RNA, 19 nt, Respiratory syncytial virus
caaucugucugaaacuaca

SEQ ID NO: 3152306 - RNA, 18 nt, Respiratory syncytial virus
auaaaaaucuuauauuaa

SEQ ID NO: 3152307 - RNA, 11 nt, Respiratory syncytial virus
caaugaugaag

SEQ ID NO: 3152308 - RNA, 15 nt, Respiratory syncytial virus
guuggggcaaaugca

SEQ ID NO: 3152309 - RNA, 13 nt, Respiratory syncytial virus
uagugaauuauua

SEQ ID NO: 3152310 - RNA, 19 nt, Respiratory syncytial virus
uuaaucacagaagaugcua

SEQ ID NO: 3152311 - RNA, 21 nt, Respiratory syncytial virus
agaagacccuacgccaaguga

SEQ ID NO: 3152312 - RNA, 13 nt, Respiratory syncytial virus
ugaagaaaaccau

SEQ ID NO: 3152313 - RNA, 15 nt, Respiratory syncytial virus
gaauuacugugacaa

SEQ ID NO: 3152314 - RNA, 19 nt, Respiratory syncytial virus
auaguucaaauggagccug

SEQ ID NO: 3152315 - RNA, 20 nt, Respiratory syncytial virus
auggacacaacacacaauga

SEQ ID NO: 3152316 - RNA, 18 nt, Respiratory syncytial virus
caaaauggaucccauuau

SEQ ID NO: 3152317 - RNA, 23 nt, Respiratory syncytial virus
agucaacacgccaggcaaaauca

SEQ ID NO: 3152318 - RNA, 12 nt, Respiratory syncytial virus
auauugaacaac

SEQ ID NO: 3152319 - RNA, 22 nt, Respiratory syncytial virus
uaaucauaaucuccaucaugau

SEQ ID NO: 3152320 - RNA, 20 nt, Respiratory syncytial virus
gagagacauaagaugaaaga

SEQ ID NO: 3152321 - RNA, 22 nt, Respiratory syncytial virus
aagugaaauacuaggaaugcuu

SEQ ID NO: 3152322 - RNA, 22 nt, Respiratory syncytial virus
acuucaugcauaaccacacucc

SEQ ID NO: 3152323 - RNA, 17 nt, Respiratory syncytial virus
ucucaaaccucaaacca

SEQ ID NO: 3152324 - RNA, 20 nt, Respiratory syncytial virus
ccucuuuacaaaaccacauc

SEQ ID NO: 3152325 - RNA, 16 nt, Respiratory syncytial virus
cacuguauucaauuau

SEQ ID NO: 3152326 - RNA, 17 nt, Respiratory syncytial virus
caaauauggaaacauac

SEQ ID NO: 3152327 - RNA, 17 nt, Respiratory syncytial virus
ucaaaccacaaaaccaa

SEQ ID NO: 3152328 - RNA, 22 nt, Respiratory syncytial virus
uuaaauucuccaaaaaacuaag

SEQ ID NO: 3152329 - RNA, 20 nt, Respiratory syncytial virus
cuaagugauucaacaaugac

SEQ ID NO: 3152330 - RNA, 17 nt, Respiratory syncytial virus
cauacuaauaacaagua

SEQ ID NO: 3152331 - RNA, 23 nt, Respiratory syncytial virus
cugaaauaacaacuucaugcaua

SEQ ID NO: 3152332 - RNA, 15 nt, Respiratory syncytial virus
caagcccacaaaaaa

SEQ ID NO: 3152333 - RNA, 18 nt, Respiratory syncytial virus
cuagcaaaucaaugucac

SEQ ID NO: 3152334 - RNA, 16 nt, Respiratory syncytial virus
acagcagaagaacuag

SEQ ID NO: 3152335 - RNA, 23 nt, Respiratory syncytial virus
guugccaauccucaaaacaaaug

SEQ ID NO: 3152336 - RNA, 14 nt, Respiratory syncytial virus
caucaucaaacuau

SEQ ID NO: 3152337 - RNA, 16 nt, Respiratory syncytial virus
aaaguuagauuacaaa

SEQ ID NO: 3152338 - RNA, 18 nt, Respiratory syncytial virus
ccuggaaagaaaaccacc

SEQ ID NO: 3152339 - RNA, 17 nt, Respiratory syncytial virus
aacuugaugaaagacag

SEQ ID NO: 3152340 - RNA, 17 nt, Respiratory syncytial virus
ugaacaacccucaccuc

SEQ ID NO: 3152341 - RNA, 14 nt, Respiratory syncytial virus
uuugcuaaucauaa

SEQ ID NO: 3152342 - RNA, 20 nt, Respiratory syncytial virus
cacuagcugaaacauguaaa

SEQ ID NO: 3152343 - RNA, 15 nt, Respiratory syncytial virus
cacaauauauauauu

SEQ ID NO: 3152344 - RNA, 18 nt, Respiratory syncytial virus
aaugucuuagaaaaagac

SEQ ID NO: 3152345 - RNA, 15 nt, Respiratory syncytial virus
uauauuucaaucaaa

SEQ ID NO: 3152346 - RNA, 21 nt, Respiratory syncytial virus
aaagaaaugggagagguagcu

SEQ ID NO: 3152347 - RNA, 13 nt, Respiratory syncytial virus
auagaaguaacca

SEQ ID NO: 3152348 - RNA, 18 nt, Respiratory syncytial virus
uugauugaugcaauucaa

SEQ ID NO: 3152349 - RNA, 20 nt, Respiratory syncytial virus
aaagucauaauaccaacaua

SEQ ID NO: 3152350 - RNA, 19 nt, Respiratory syncytial virus
ugcauuggcuaaggcagug

SEQ ID NO: 3152351 - RNA, 17 nt, Respiratory syncytial virus
gcauuaagccuacaaag

SEQ ID NO: 3152352 - RNA, 16 nt, Respiratory syncytial virus
ccauggacacaacaca

SEQ ID NO: 3152353 - RNA, 21 nt, Respiratory syncytial virus
cuguauucaauuauaguuauu

SEQ ID NO: 3152354 - RNA, 22 nt, Respiratory syncytial virus
agagcucgagucaauacauagc

SEQ ID NO: 3152355 - RNA, 14 nt, Respiratory syncytial virus
caccaugcaagcca

SEQ ID NO: 3152356 - RNA, 23 nt, Respiratory syncytial virus
aacuucaugcauaaccacacucc

SEQ ID NO: 3152357 - RNA, 17 nt, Respiratory syncytial virus
agcaaaucaaugucacu

SEQ ID NO: 3152358 - RNA, 14 nt, Respiratory syncytial virus
aaaaagaucucaaa

SEQ ID NO: 3152359 - RNA, 19 nt, Respiratory syncytial virus
aaaaucagaacugaagcau

SEQ ID NO: 3152360 - RNA, 13 nt, Respiratory syncytial virus
accaccaccaagc

SEQ ID NO: 3152361 - RNA, 19 nt, Respiratory syncytial virus
uaacguuggggcaaaugca

SEQ ID NO: 3152362 - RNA, 13 nt, Respiratory syncytial virus
gcaaaccacaaag

SEQ ID NO: 3152363 - RNA, 19 nt, Respiratory syncytial virus
cauuauaaacccaacaaau

SEQ ID NO: 3152364 - RNA, 20 nt, Respiratory syncytial virus
cauccaacggagcacaggag

SEQ ID NO: 3152365 - RNA, 14 nt, Respiratory syncytial virus
auagcuacacacua

SEQ ID NO: 3152366 - RNA, 20 nt, Respiratory syncytial virus
agugucuuaaccagcaaagu

SEQ ID NO: 3152367 - RNA, 21 nt, Respiratory syncytial virus
ugaaauaacaacuucaugcau

SEQ ID NO: 3152368 - RNA, 15 nt, Respiratory syncytial virus
uauugcacaaagugg

SEQ ID NO: 3152369 - RNA, 19 nt, Respiratory syncytial virus
uacauuuaacuaaugcauu

SEQ ID NO: 3152370 - RNA, 13 nt, Respiratory syncytial virus
ccaaaacaaacca

SEQ ID NO: 3152371 - RNA, 17 nt, Respiratory syncytial virus
auacauccauaacaaua

SEQ ID NO: 3152372 - RNA, 16 nt, Respiratory syncytial virus
cuaauggccuaauaga

SEQ ID NO: 3152373 - RNA, 13 nt, Respiratory syncytial virus
caaagaugauaua

SEQ ID NO: 3152374 - RNA, 14 nt, Respiratory syncytial virus
cuaucauuggauuu

SEQ ID NO: 3152375 - RNA, 19 nt, Respiratory syncytial virus
cucucaauccaacaucaga

SEQ ID NO: 3152376 - RNA, 23 nt, Respiratory syncytial virus
aaaaaguuaauguccaacaaugu

SEQ ID NO: 3152377 - RNA, 13 nt, Respiratory syncytial virus
ccauccaaccaaa

SEQ ID NO: 3152378 - RNA, 13 nt, Respiratory syncytial virus
gguacugugacaa

SEQ ID NO: 3152379 - RNA, 22 nt, Respiratory syncytial virus
aguugccaauccucaaaacaaa

SEQ ID NO: 3152380 - RNA, 20 nt, Respiratory syncytial virus
ugaugugcagaaacacauca

SEQ ID NO: 3152381 - RNA, 19 nt, Respiratory syncytial virus
accuaucacaaccuccauc

SEQ ID NO: 3152382 - RNA, 17 nt, Respiratory syncytial virus
acuauuaacucaaacaa

SEQ ID NO: 3152383 - RNA, 12 nt, Respiratory syncytial virus
uucacaacaaug

SEQ ID NO: 3152384 - RNA, 12 nt, Respiratory syncytial virus
caaaaacagaug

SEQ ID NO: 3152385 - RNA, 23 nt, Respiratory syncytial virus
aguuguuaccuauugugaacaag

SEQ ID NO: 3152386 - RNA, 17 nt, Respiratory syncytial virus
gaaauucaaaucaacau

SEQ ID NO: 3152387 - RNA, 18 nt, Respiratory syncytial virus
ucuacuauccacaaacaa

SEQ ID NO: 3152388 - RNA, 14 nt, Respiratory syncytial virus
caccacaaaacaac

SEQ ID NO: 3152389 - RNA, 22 nt, Respiratory syncytial virus
accuggaaagaaaaccaccacc

SEQ ID NO: 3152390 - RNA, 14 nt, Respiratory syncytial virus
uauuaaaaauuccc

SEQ ID NO: 3152391 - RNA, 16 nt, Respiratory syncytial virus
uagcuacacacuaaca

SEQ ID NO: 3152392 - RNA, 13 nt, Respiratory syncytial virus
cacuaauacacau

SEQ ID NO: 3152393 - RNA, 13 nt, Respiratory syncytial virus
ugcagcaacaauc

SEQ ID NO: 3152394 - RNA, 14 nt, Respiratory syncytial virus
uauauauuaguguc

SEQ ID NO: 3152395 - RNA, 20 nt, Respiratory syncytial virus
accacacuccauaguucaaa

SEQ ID NO: 3152396 - RNA, 16 nt, Respiratory syncytial virus
agauggcaaaagacac

SEQ ID NO: 3152397 - RNA, 14 nt, Respiratory syncytial virus
aagugaacaaaauc

SEQ ID NO: 3152398 - RNA, 21 nt, Respiratory syncytial virus
uccacaagagcauaaccauca

SEQ ID NO: 3152399 - RNA, 23 nt, Respiratory syncytial virus
caaaacuuuauguuaaacagaau

SEQ ID NO: 3152400 - RNA, 13 nt, Respiratory syncytial virus
agccaucauccau

SEQ ID NO: 3152401 - RNA, 22 nt, Respiratory syncytial virus
guauuacugaugauauauacac

SEQ ID NO: 3152402 - RNA, 22 nt, Respiratory syncytial virus
agacuugauugaugcaauucaa

SEQ ID NO: 3152403 - RNA, 21 nt, Respiratory syncytial virus
caaccauggacacaacacaca

SEQ ID NO: 3152404 - RNA, 18 nt, Respiratory syncytial virus
aauuuguuugacaaugau

SEQ ID NO: 3152405 - RNA, 15 nt, Respiratory syncytial virus
ucccauagcuacaca

SEQ ID NO: 3152406 - RNA, 13 nt, Respiratory syncytial virus
agguuuaugaaua

SEQ ID NO: 3152407 - RNA, 21 nt, Respiratory syncytial virus
ucugaacuucaucgaaacucu

SEQ ID NO: 3152408 - RNA, 19 nt, Respiratory syncytial virus
ugcuaaucauaaauucacu

SEQ ID NO: 3152409 - RNA, 18 nt, Respiratory syncytial virus
ucagaucuaguacucaaa

SEQ ID NO: 3152410 - RNA, 12 nt, Respiratory syncytial virus
gucuuagaaaaa

SEQ ID NO: 3152411 - RNA, 18 nt, Respiratory syncytial virus
uuccuagaaucaauaaag

SEQ ID NO: 3152412 - RNA, 13 nt, Respiratory syncytial virus
uaaagaucucacu

SEQ ID NO: 3152413 - RNA, 22 nt, Respiratory syncytial virus
uaaugcuuaccacaucaucaaa

SEQ ID NO: 3152414 - RNA, 17 nt, Respiratory syncytial virus
gcuuaacaacugaaauu

SEQ ID NO: 3152415 - RNA, 12 nt, Respiratory syncytial virus
uguauucaauua

SEQ ID NO: 3152416 - RNA, 17 nt, Respiratory syncytial virus
ccucguuagaacagauu

SEQ ID NO: 3152417 - RNA, 21 nt, Respiratory syncytial virus
agaaacauuugauaacaauga

SEQ ID NO: 3152418 - RNA, 16 nt, Respiratory syncytial virus
acaucaacaucucacc

SEQ ID NO: 3152419 - RNA, 12 nt, Respiratory syncytial virus
aaccaaacaucu

SEQ ID NO: 3152420 - RNA, 21 nt, Respiratory syncytial virus
aaaucguggaaucauaaagac

SEQ ID NO: 3152421 - RNA, 17 nt, Respiratory syncytial virus
aaugggaaagaaaugaa

SEQ ID NO: 3152422 - RNA, 20 nt, Respiratory syncytial virus
auuaaggagagacauaagau

SEQ ID NO: 3152423 - RNA, 17 nt, Respiratory syncytial virus
cacaacaacaaccaaaa

SEQ ID NO: 3152424 - RNA, 20 nt, Respiratory syncytial virus
cauuaauagaacacauaaau

SEQ ID NO: 3152425 - RNA, 19 nt, Respiratory syncytial virus
auuuuagucauaauuauuu

SEQ ID NO: 3152426 - RNA, 14 nt, Respiratory syncytial virus
uauguuauaugcua

SEQ ID NO: 3152427 - RNA, 17 nt, Respiratory syncytial virus
cucccuugguuagagau

SEQ ID NO: 3152428 - RNA, 16 nt, Respiratory syncytial virus
ugaugcaauucaaaau

SEQ ID NO: 3152429 - RNA, 20 nt, Respiratory syncytial virus
agaauaccaaacaaaaaacc

SEQ ID NO: 3152430 - RNA, 23 nt, Respiratory syncytial virus
acaucagugaguugauucauaca

SEQ ID NO: 3152431 - RNA, 22 nt, Respiratory syncytial virus
ucugaaacuacaucacaaacca

SEQ ID NO: 3152432 - RNA, 22 nt, Respiratory syncytial virus
agauauuaaugggaaagaaaug

SEQ ID NO: 3152433 - RNA, 15 nt, Respiratory syncytial virus
cgggauaucauguaa

SEQ ID NO: 3152434 - RNA, 17 nt, Respiratory syncytial virus
cuggaaagaaaaccacc

SEQ ID NO: 3152435 - RNA, 24 nt, Respiratory syncytial virus
acauuccuggucaacuaugaaaug

SEQ ID NO: 3152436 - RNA, 22 nt, Respiratory syncytial virus
uauaacaucaaauucaaccauu

SEQ ID NO: 3152437 - RNA, 14 nt, Respiratory syncytial virus
agaucuauaugaug

SEQ ID NO: 3152438 - RNA, 16 nt, Respiratory syncytial virus
cauaguucaaauggag

SEQ ID NO: 3152439 - RNA, 23 nt, Respiratory syncytial virus
acaagagucacacaaucugaaau

SEQ ID NO: 3152440 - RNA, 14 nt, Respiratory syncytial virus
aacaaauauccaca

SEQ ID NO: 3152441 - RNA, 16 nt, Respiratory syncytial virus
aacaccaccaaaacaa

SEQ ID NO: 3152442 - RNA, 17 nt, Respiratory syncytial virus
augaccaauuauaugaa

SEQ ID NO: 3152443 - RNA, 14 nt, Respiratory syncytial virus
accaaacaucuaua

SEQ ID NO: 3152444 - RNA, 15 nt, Respiratory syncytial virus
acaucaauaaguuau

SEQ ID NO: 3152445 - RNA, 20 nt, Respiratory syncytial virus
caaagaaagcccuauaacau

SEQ ID NO: 3152446 - RNA, 19 nt, Respiratory syncytial virus
acucaggaaugaggaaagu

SEQ ID NO: 3152447 - RNA, 23 nt, Respiratory syncytial virus
aaaagugcucuacuauccacaaa

SEQ ID NO: 3152448 - RNA, 13 nt, Respiratory syncytial virus
aacucaaagaaaa

SEQ ID NO: 3152449 - RNA, 14 nt, Respiratory syncytial virus
auuguuuaugaaug

SEQ ID NO: 3152450 - RNA, 16 nt, Respiratory syncytial virus
guccuuggaugaaaga

SEQ ID NO: 3152451 - RNA, 20 nt, Respiratory syncytial virus
agucaacccugcaauccaca

SEQ ID NO: 3152452 - RNA, 19 nt, Respiratory syncytial virus
acaacucaaagaaaauggu

SEQ ID NO: 3152453 - RNA, 17 nt, Respiratory syncytial virus
uaucauuaaucaaugau

SEQ ID NO: 3152454 - RNA, 14 nt, Respiratory syncytial virus
cacagaagaugcua

SEQ ID NO: 3152455 - RNA, 14 nt, Respiratory syncytial virus
ucaauccaacauca

SEQ ID NO: 3152456 - RNA, 13 nt, Respiratory syncytial virus
gagcuaccaaauu

SEQ ID NO: 3152457 - RNA, 18 nt, Respiratory syncytial virus
gacacucucaaucaucua

SEQ ID NO: 3152458 - RNA, 21 nt, Respiratory syncytial virus
caauaaagggcaaauucacau

SEQ ID NO: 3152459 - RNA, 16 nt, Respiratory syncytial virus
ugauagaaaaaaucag

SEQ ID NO: 3152460 - RNA, 18 nt, Respiratory syncytial virus
ugcauuuaguaacuaaau

SEQ ID NO: 3152461 - RNA, 15 nt, Respiratory syncytial virus
acauugacauauuca

SEQ ID NO: 3152462 - RNA, 22 nt, Respiratory syncytial virus
cacaaugacaccacaccacaaa

SEQ ID NO: 3152463 - RNA, 13 nt, Respiratory syncytial virus
acucuugaagaaa

SEQ ID NO: 3152464 - RNA, 13 nt, Respiratory syncytial virus
ucaugaauguaua

SEQ ID NO: 3152465 - RNA, 11 nt, Respiratory syncytial virus
agucaaaacau

SEQ ID NO: 3152466 - RNA, 18 nt, Respiratory syncytial virus
ggggcaaaugcaaacaug

SEQ ID NO: 3152467 - RNA, 14 nt, Respiratory syncytial virus
acaacaauaaucuc

SEQ ID NO: 3152468 - RNA, 23 nt, Respiratory syncytial virus
acaggccacauuuacauuccugg

SEQ ID NO: 3152469 - RNA, 14 nt, Respiratory syncytial virus
ucuauaaaccaucu

SEQ ID NO: 3152470 - RNA, 23 nt, Respiratory syncytial virus
ugacaacaaaggagcauucaaau

SEQ ID NO: 3152471 - RNA, 20 nt, Respiratory syncytial virus
auuauuaucauuaaucaaug

SEQ ID NO: 3152472 - RNA, 13 nt, Respiratory syncytial virus
gcauaaugggaga

SEQ ID NO: 3152473 - RNA, 21 nt, Respiratory syncytial virus
gaugacaauugugaaauuaaa

SEQ ID NO: 3152474 - RNA, 20 nt, Respiratory syncytial virus
ugauacacucaacaaagauc

SEQ ID NO: 3152475 - RNA, 15 nt, Respiratory syncytial virus
guucaaauggagccu

SEQ ID NO: 3152476 - RNA, 18 nt, Respiratory syncytial virus
cacacuccauaguucaaa

SEQ ID NO: 3152477 - RNA, 16 nt, Respiratory syncytial virus
cgaggucauugcuuga

SEQ ID NO: 3152478 - RNA, 23 nt, Respiratory syncytial virus
cagagcuaccaaauuccuagaau

SEQ ID NO: 3152479 - RNA, 19 nt, Respiratory syncytial virus
cucucaucuauaaaccauc

SEQ ID NO: 3152480 - RNA, 13 nt, Respiratory syncytial virus
acaaagaaaccau

SEQ ID NO: 3152481 - RNA, 17 nt, Respiratory syncytial virus
auucaaaucaacauuga

SEQ ID NO: 3152482 - RNA, 17 nt, Respiratory syncytial virus
aaagaucucacuaugaa

SEQ ID NO: 3152483 - RNA, 21 nt, Respiratory syncytial virus
auauuaaugggaaagaaauga

SEQ ID NO: 3152484 - RNA, 20 nt, Respiratory syncytial virus
uguuauuacaaguagugaua

SEQ ID NO: 3152485 - RNA, 20 nt, Respiratory syncytial virus
aucuuaaagcagucaaaaau

SEQ ID NO: 3152486 - RNA, 16 nt, Respiratory syncytial virus
ccauccaaccaaacau

SEQ ID NO: 3152487 - RNA, 12 nt, Respiratory syncytial virus
ucaacaccacca

SEQ ID NO: 3152488 - RNA, 10 nt, Respiratory syncytial virus
gccacccgga

SEQ ID NO: 3152489 - RNA, 16 nt, Respiratory syncytial virus
uaugaaaacacucaac

SEQ ID NO: 3152490 - RNA, 20 nt, Respiratory syncytial virus
auaaugauacuaccugacaa

SEQ ID NO: 3152491 - RNA, 22 nt, Respiratory syncytial virus
uuacaaaaccacaucaacaucu

SEQ ID NO: 3152492 - RNA, 22 nt, Respiratory syncytial virus
cauaucaucgugcuuauacaag

SEQ ID NO: 3152493 - RNA, 22 nt, Respiratory syncytial virus
aaauacaccauccaacggagca

SEQ ID NO: 3152494 - RNA, 21 nt, Respiratory syncytial virus
acagaagauaaaaauggggca

SEQ ID NO: 3152495 - RNA, 14 nt, Respiratory syncytial virus
aaucuuauauuaaa

SEQ ID NO: 3152496 - RNA, 13 nt, Respiratory syncytial virus
ucucaauccauga

SEQ ID NO: 3152497 - RNA, 16 nt, Respiratory syncytial virus
acucaaauaaguuaau

SEQ ID NO: 3152498 - RNA, 13 nt, Respiratory syncytial virus
ucauaugaagaaa

SEQ ID NO: 3152499 - RNA, 20 nt, Respiratory syncytial virus
acuugauugaugcaauucaa

SEQ ID NO: 3152500 - RNA, 15 nt, Respiratory syncytial virus
caaucauccaugcca

SEQ ID NO: 3152501 - RNA, 23 nt, Respiratory syncytial virus
uaaggaacucaaaagaauuacug

SEQ ID NO: 3152502 - RNA, 16 nt, Respiratory syncytial virus
ucuaaagaaacuaaau

SEQ ID NO: 3152503 - RNA, 18 nt, Respiratory syncytial virus
gcauuaguaauaaccaaa

SEQ ID NO: 3152504 - RNA, 14 nt, Respiratory syncytial virus
cuugcugcagucac

SEQ ID NO: 3152505 - RNA, 13 nt, Respiratory syncytial virus
uauaacaaccacu

SEQ ID NO: 3152506 - RNA, 19 nt, Respiratory syncytial virus
uggcauuguauuugugcau

SEQ ID NO: 3152507 - RNA, 21 nt, Respiratory syncytial virus
ucacccagaauccccagcuug

SEQ ID NO: 3152508 - RNA, 15 nt, Respiratory syncytial virus
caaugucacuaacac

SEQ ID NO: 3152509 - RNA, 13 nt, Respiratory syncytial virus
auuucacaacaau

SEQ ID NO: 3152510 - RNA, 23 nt, Respiratory syncytial virus
ucaaagucuaugcuauauugaau

SEQ ID NO: 3152511 - RNA, 12 nt, Respiratory syncytial virus
gugaaacaaaua

SEQ ID NO: 3152512 - RNA, 21 nt, Respiratory syncytial virus
uaucaacuagcaaaucaaugu

SEQ ID NO: 3152513 - RNA, 22 nt, Respiratory syncytial virus
auguaacaacacaucgucaaga

SEQ ID NO: 3152514 - RNA, 12 nt, Respiratory syncytial virus
cagcaagcccac

SEQ ID NO: 3152515 - RNA, 21 nt, Respiratory syncytial virus
acaaugccaguguuacaaaau

SEQ ID NO: 3152516 - RNA, 20 nt, Respiratory syncytial virus
uauuuguaaaaaaugagaac

SEQ ID NO: 3152517 - RNA, 19 nt, Respiratory syncytial virus
agguauuacugaugauaua

SEQ ID NO: 3152518 - RNA, 14 nt, Respiratory syncytial virus
ugauaaaucaugaa

SEQ ID NO: 3152519 - RNA, 13 nt, Respiratory syncytial virus
aguaaccaaagaa

SEQ ID NO: 3152520 - RNA, 14 nt, Respiratory syncytial virus
aguugccaauccuc

SEQ ID NO: 3152521 - RNA, 23 nt, Respiratory syncytial virus
aacaauaccaaaaauaccaaugu

SEQ ID NO: 3152522 - RNA, 22 nt, Respiratory syncytial virus
augcuuaccacaucaucaaacu

SEQ ID NO: 3152523 - RNA, 13 nt, Respiratory syncytial virus
caaauacaaaaau

SEQ ID NO: 3152524 - RNA, 14 nt, Respiratory syncytial virus
augcuaaaagaaau

SEQ ID NO: 3152525 - RNA, 12 nt, Respiratory syncytial virus
aaauaagcaaga

SEQ ID NO: 3152526 - RNA, 12 nt, Respiratory syncytial virus
agacuaacaaua

SEQ ID NO: 3152527 - RNA, 19 nt, Respiratory syncytial virus
agagaagacaugauagaaa

SEQ ID NO: 3152528 - RNA, 22 nt, Respiratory syncytial virus
uaaauucacuggguuaauaggu

SEQ ID NO: 3152529 - RNA, 23 nt, Respiratory syncytial virus
uguuggaucugcaaucgccagug

SEQ ID NO: 3152530 - RNA, 19 nt, Respiratory syncytial virus
aucagugucagaaauaaag

SEQ ID NO: 3152531 - RNA, 14 nt, Respiratory syncytial virus
auuuuaucaaacaa

SEQ ID NO: 3152532 - RNA, 21 nt, Respiratory syncytial virus
aaauauggaaacauacgugaa

SEQ ID NO: 3152533 - RNA, 22 nt, Respiratory syncytial virus
aacauacuagugaaacaaauau

SEQ ID NO: 3152534 - RNA, 16 nt, Respiratory syncytial virus
acaucagugaguugau

SEQ ID NO: 3152535 - RNA, 17 nt, Respiratory syncytial virus
caacaaugaccaauuau

SEQ ID NO: 3152536 - RNA, 12 nt, Respiratory syncytial virus
aaagauggggca

SEQ ID NO: 3152537 - RNA, 13 nt, Respiratory syncytial virus
auacauuuaacua

SEQ ID NO: 3152538 - RNA, 15 nt, Respiratory syncytial virus
auucaaaucaacauu

SEQ ID NO: 3152539 - RNA, 14 nt, Respiratory syncytial virus
gccuauaacaaaug

SEQ ID NO: 3152540 - RNA, 15 nt, Respiratory syncytial virus
uacauuuaacuaaug

SEQ ID NO: 3152541 - RNA, 15 nt, Respiratory syncytial virus
ucaaucaugaugggu

SEQ ID NO: 3152542 - RNA, 19 nt, Respiratory syncytial virus
aaaucuauagcacaaauca

SEQ ID NO: 3152543 - RNA, 14 nt, Respiratory syncytial virus
aucaagaucuauau

SEQ ID NO: 3152544 - RNA, 19 nt, Respiratory syncytial virus
aaaucuuauauuaaaaauu

SEQ ID NO: 3152545 - RNA, 16 nt, Respiratory syncytial virus
uucacaucaccuaaag

SEQ ID NO: 3152546 - RNA, 18 nt, Respiratory syncytial virus
aucaacuagcaaaucaau

SEQ ID NO: 3152547 - RNA, 13 nt, Respiratory syncytial virus
aacaccaacagaa

SEQ ID NO: 3152548 - RNA, 17 nt, Respiratory syncytial virus
auaaacccaacaaauga

SEQ ID NO: 3152549 - RNA, 19 nt, Respiratory syncytial virus
auaacaauagaauucucaa

SEQ ID NO: 3152550 - RNA, 14 nt, Respiratory syncytial virus
ccaggcaaaaucaa

SEQ ID NO: 3152551 - RNA, 21 nt, Respiratory syncytial virus
gaucucaaaccucaaaccaca

SEQ ID NO: 3152552 - RNA, 19 nt, Respiratory syncytial virus
auaacaugcuauacugaca

SEQ ID NO: 3152553 - RNA, 14 nt, Respiratory syncytial virus
cucaaacaauucaa

SEQ ID NO: 3152554 - RNA, 17 nt, Respiratory syncytial virus
ucccauagcuacacacu

SEQ ID NO: 3152555 - RNA, 13 nt, Respiratory syncytial virus
accaagacacuag

SEQ ID NO: 3152556 - RNA, 14 nt, Respiratory syncytial virus
gaauacaacacaaa

SEQ ID NO: 3152557 - RNA, 20 nt, Respiratory syncytial virus
augcuaaucauaaauucacu

SEQ ID NO: 3152558 - RNA, 15 nt, Respiratory syncytial virus
aacuaagugauucaa

SEQ ID NO: 3152559 - RNA, 18 nt, Respiratory syncytial virus
accaacgcaccaccaaga

SEQ ID NO: 3152560 - RNA, 19 nt, Respiratory syncytial virus
augauacacucaacaaaga

SEQ ID NO: 3152561 - RNA, 16 nt, Respiratory syncytial virus
gaauuaacacacugcu

SEQ ID NO: 3152562 - RNA, 17 nt, Respiratory syncytial virus
ccaucacaaaugcaaaa

SEQ ID NO: 3152563 - RNA, 15 nt, Respiratory syncytial virus
caacacacaaugaca

SEQ ID NO: 3152564 - RNA, 18 nt, Respiratory syncytial virus
acacaacacacaaugaca

SEQ ID NO: 3152565 - RNA, 16 nt, Respiratory syncytial virus
caccauuaguuaauau

SEQ ID NO: 3152566 - RNA, 19 nt, Respiratory syncytial virus
cagugauacauacaaucaa

SEQ ID NO: 3152567 - RNA, 16 nt, Respiratory syncytial virus
ccaucuggagccucag

SEQ ID NO: 3152568 - RNA, 14 nt, Respiratory syncytial virus
caauauuuaucaau

SEQ ID NO: 3152569 - RNA, 16 nt, Respiratory syncytial virus
uaaccauauauacuca

SEQ ID NO: 3152570 - RNA, 21 nt, Respiratory syncytial virus
uuucaaucaaaacaaccaaaa

SEQ ID NO: 3152571 - RNA, 13 nt, Respiratory syncytial virus
caggcaaaaucaa

SEQ ID NO: 3152572 - RNA, 15 nt, Respiratory syncytial virus
aauuaaauucuccaa

SEQ ID NO: 3152573 - RNA, 16 nt, Respiratory syncytial virus
aaguugaaugauacac

SEQ ID NO: 3152574 - RNA, 15 nt, Respiratory syncytial virus
augaucacagacaug

SEQ ID NO: 3152575 - RNA, 13 nt, Respiratory syncytial virus
aaacuauugcaca

SEQ ID NO: 3152576 - RNA, 16 nt, Respiratory syncytial virus
gcacuaaauacaaaaa

SEQ ID NO: 3152577 - RNA, 22 nt, Respiratory syncytial virus
gcauguuauuacaaguagugau

SEQ ID NO: 3152578 - RNA, 16 nt, Respiratory syncytial virus
cuuauauuaaaaauuc

SEQ ID NO: 3152579 - RNA, 20 nt, Respiratory syncytial virus
uacuaggaaugcuucacaca

SEQ ID NO: 3152580 - RNA, 15 nt, Respiratory syncytial virus
cuauauuucaaucaa

SEQ ID NO: 3152581 - RNA, 16 nt, Respiratory syncytial virus
gagaagacaugauaga

SEQ ID NO: 3152582 - RNA, 18 nt, Respiratory syncytial virus
uaucauuggauuuucuua

SEQ ID NO: 3152583 - RNA, 21 nt, Respiratory syncytial virus
aaaucaguuaaaaauauuaug

SEQ ID NO: 3152584 - RNA, 16 nt, Respiratory syncytial virus
cauaaaaauacucaga

SEQ ID NO: 3152585 - RNA, 16 nt, Respiratory syncytial virus
caaaauuaaacaacau

SEQ ID NO: 3152586 - RNA, 21 nt, Respiratory syncytial virus
uaauaguaugcucaacaacau

SEQ ID NO: 3152587 - RNA, 18 nt, Respiratory syncytial virus
caagucauuguucaucag

SEQ ID NO: 3152588 - RNA, 18 nt, Respiratory syncytial virus
auaguucaaauggagccu

SEQ ID NO: 3152589 - RNA, 11 nt, Respiratory syncytial virus
acaucagugag

SEQ ID NO: 3152590 - RNA, 19 nt, Respiratory syncytial virus
aguaguuaauuaaaaauaa

SEQ ID NO: 3152591 - RNA, 17 nt, Respiratory syncytial virus
gucugaaacuacaucac

SEQ ID NO: 3152592 - RNA, 20 nt, Respiratory syncytial virus
aauugcagccaucauauuca

SEQ ID NO: 3152593 - RNA, 19 nt, Respiratory syncytial virus
acacaagagucacacaauc

SEQ ID NO: 3152594 - RNA, 13 nt, Respiratory syncytial virus
uguuacaacaaau

SEQ ID NO: 3152595 - RNA, 20 nt, Respiratory syncytial virus
aaaaucacucuacaaaacaa

SEQ ID NO: 3152596 - RNA, 16 nt, Respiratory syncytial virus
uaugaucucaauccau

SEQ ID NO: 3152597 - RNA, 17 nt, Respiratory syncytial virus
ccucaaaacaaaugcaa

SEQ ID NO: 3152598 - RNA, 22 nt, Respiratory syncytial virus
cuccauaguucaaauggagccu

SEQ ID NO: 3152599 - RNA, 20 nt, Respiratory syncytial virus
cucaccgaaucaaccauuca

SEQ ID NO: 3152600 - RNA, 16 nt, Respiratory syncytial virus
acacuguauucaauua

SEQ ID NO: 3152601 - RNA, 15 nt, Respiratory syncytial virus
uuuuaauaacuuuua

SEQ ID NO: 3152602 - RNA, 16 nt, Respiratory syncytial virus
uaagugauucaacaau

SEQ ID NO: 3152603 - RNA, 21 nt, Respiratory syncytial virus
agucacacaaucugaaauaac

SEQ ID NO: 3152604 - RNA, 13 nt, Respiratory syncytial virus
uagcuacacacua

SEQ ID NO: 3152605 - RNA, 19 nt, Respiratory syncytial virus
aagauggggcaaauacaaa

SEQ ID NO: 3152606 - RNA, 23 nt, Respiratory syncytial virus
acuaacaccauuaguuaauauaa

SEQ ID NO: 3152607 - RNA, 20 nt, Respiratory syncytial virus
augcauaaccacacuccaua

SEQ ID NO: 3152608 - RNA, 12 nt, Respiratory syncytial virus
guaaaagcaaau

SEQ ID NO: 3152609 - RNA, 14 nt, Respiratory syncytial virus
accaaaauaaccau

SEQ ID NO: 3152610 - RNA, 15 nt, Respiratory syncytial virus
aacaggaaaaacaau

SEQ ID NO: 3152611 - RNA, 21 nt, Respiratory syncytial virus
auacuugauaaaucaugaaug

SEQ ID NO: 3152612 - RNA, 14 nt, Respiratory syncytial virus
cuacaucacaaacc

SEQ ID NO: 3152613 - RNA, 13 nt, Respiratory syncytial virus
gacaauugugaaa

SEQ ID NO: 3152614 - RNA, 14 nt, Respiratory syncytial virus
ugaaaucaaggcau

SEQ ID NO: 3152615 - RNA, 17 nt, Respiratory syncytial virus
cuuucuaccuacauucu

SEQ ID NO: 3152616 - RNA, 19 nt, Respiratory syncytial virus
aucaucgugcuuauacaag

SEQ ID NO: 3152617 - RNA, 17 nt, Respiratory syncytial virus
uaugaaucaauuaucug

SEQ ID NO: 3152618 - RNA, 14 nt, Respiratory syncytial virus
ccaacgcaccacca

SEQ ID NO: 3152619 - RNA, 14 nt, Respiratory syncytial virus
acaaagcacacucc

SEQ ID NO: 3152620 - RNA, 15 nt, Respiratory syncytial virus
aacucaaacaauuca

SEQ ID NO: 3152621 - RNA, 13 nt, Respiratory syncytial virus
acaucucaccaug

SEQ ID NO: 3152622 - RNA, 19 nt, Respiratory syncytial virus
ugaacacacuugaaaauau

SEQ ID NO: 3152623 - RNA, 23 nt, Respiratory syncytial virus
aguugaaugauacacucaacaaa

SEQ ID NO: 3152624 - RNA, 22 nt, Respiratory syncytial virus
caucauuauugucuuugacuca

SEQ ID NO: 3152625 - RNA, 21 nt, Respiratory syncytial virus
uaaauaucaacuagcaaauca

SEQ ID NO: 3152626 - RNA, 15 nt, Respiratory syncytial virus
aauagguauguuaua

SEQ ID NO: 3152627 - RNA, 18 nt, Respiratory syncytial virus
cuagugaaacaaauaucc

SEQ ID NO: 3152628 - RNA, 21 nt, Respiratory syncytial virus
ucaugauugcaauacugaaca

SEQ ID NO: 3152629 - RNA, 14 nt, Respiratory syncytial virus
gccuacaaagcaca

SEQ ID NO: 3152630 - RNA, 12 nt, Respiratory syncytial virus
aaaucaacauug

SEQ ID NO: 3152631 - RNA, 18 nt, Respiratory syncytial virus
caucaacacacaacacca

SEQ ID NO: 3152632 - RNA, 18 nt, Respiratory syncytial virus
aucucaccaugcaagcca

SEQ ID NO: 3152633 - RNA, 18 nt, Respiratory syncytial virus
acaaugaagaagaaucua

SEQ ID NO: 3152634 - RNA, 15 nt, Respiratory syncytial virus
agcacuaaauacaaa

SEQ ID NO: 3152635 - RNA, 17 nt, Respiratory syncytial virus
cacaaaaaaaccaacca

SEQ ID NO: 3152636 - RNA, 23 nt, Respiratory syncytial virus
auuaaaaauaaucauaacaauga

SEQ ID NO: 3152637 - RNA, 15 nt, Respiratory syncytial virus
acacaacacacaaug

SEQ ID NO: 3152638 - RNA, 17 nt, Respiratory syncytial virus
aauaucaacuagcaaau

SEQ ID NO: 3152639 - RNA, 19 nt, Respiratory syncytial virus
gauaaaaguuagauuacaa

SEQ ID NO: 3152640 - RNA, 15 nt, Respiratory syncytial virus
uccaugccagcagau

SEQ ID NO: 3152641 - RNA, 15 nt, Respiratory syncytial virus
uagcuacacacuaac

SEQ ID NO: 3152642 - RNA, 14 nt, Respiratory syncytial virus
gcaaauaacaaugg

SEQ ID NO: 3152643 - RNA, 14 nt, Respiratory syncytial virus
uacacucaacaaua

SEQ ID NO: 3152644 - RNA, 13 nt, Respiratory syncytial virus
aagugauguuacg

SEQ ID NO: 3152645 - RNA, 23 nt, Respiratory syncytial virus
acaugcagugcagucagcaaagg

SEQ ID NO: 3152646 - RNA, 16 nt, Respiratory syncytial virus
gagguagcuccagaau

SEQ ID NO: 3152647 - RNA, 14 nt, Respiratory syncytial virus
ugacaccacaccac

SEQ ID NO: 3152648 - RNA, 23 nt, Respiratory syncytial virus
accuagaaggggaagugaacaaa

SEQ ID NO: 3152649 - RNA, 17 nt, Respiratory syncytial virus
ucaauccaacaucagag

SEQ ID NO: 3152650 - RNA, 16 nt, Respiratory syncytial virus
aguuacaaaaaaagau

SEQ ID NO: 3152651 - RNA, 18 nt, Respiratory syncytial virus
uacuagugaaacaaauau

SEQ ID NO: 3152652 - RNA, 12 nt, Respiratory syncytial virus
cuaaacaaucag

SEQ ID NO: 3152653 - RNA, 18 nt, Respiratory syncytial virus
aaccaucaauaacccaaa

SEQ ID NO: 3152654 - RNA, 21 nt, Respiratory syncytial virus
cuucaccaucauaaucaccaa

SEQ ID NO: 3152655 - RNA, 18 nt, Respiratory syncytial virus
augccaauauuuaucaau

SEQ ID NO: 3152656 - RNA, 15 nt, Respiratory syncytial virus
gauggcacaaaacag

SEQ ID NO: 3152657 - RNA, 13 nt, Respiratory syncytial virus
caaauaacaaugg

SEQ ID NO: 3152658 - RNA, 17 nt, Respiratory syncytial virus
aacauaccuaagaucca

SEQ ID NO: 3152659 - RNA, 18 nt, Respiratory syncytial virus
cagugauacauacaauca

SEQ ID NO: 3152660 - RNA, 12 nt, Respiratory syncytial virus
aaacaaaaagau

SEQ ID NO: 3152661 - RNA, 18 nt, Respiratory syncytial virus
ucacacaaucugaaauaa

SEQ ID NO: 3152662 - RNA, 15 nt, Respiratory syncytial virus
aagaugcaacaagcc

SEQ ID NO: 3152663 - RNA, 21 nt, Respiratory syncytial virus
auuugugcauguuauuacaag

SEQ ID NO: 3152664 - RNA, 11 nt, Respiratory syncytial virus
aacaaugccag

SEQ ID NO: 3152665 - RNA, 18 nt, Respiratory syncytial virus
uuaucaaagaaaaccucu

SEQ ID NO: 3152666 - RNA, 15 nt, Respiratory syncytial virus
aguuugcuccugaau

SEQ ID NO: 3152667 - RNA, 17 nt, Respiratory syncytial virus
aaguaguuaauuaaaaa

SEQ ID NO: 3152668 - RNA, 16 nt, Respiratory syncytial virus
cugaacucaacaguga

SEQ ID NO: 3152669 - RNA, 22 nt, Respiratory syncytial virus
uauaauaaauaucaacuagcaa

SEQ ID NO: 3152670 - RNA, 16 nt, Respiratory syncytial virus
uauuaauggaaauucu

SEQ ID NO: 3152671 - RNA, 15 nt, Respiratory syncytial virus
aucuguuaaaaagau

SEQ ID NO: 3152672 - RNA, 13 nt, Respiratory syncytial virus
ucacuaacaccau

SEQ ID NO: 3152673 - RNA, 17 nt, Respiratory syncytial virus
caaugacagacuagaag

SEQ ID NO: 3152674 - RNA, 13 nt, Respiratory syncytial virus
cagucagcaaagg

SEQ ID NO: 3152675 - RNA, 23 nt, Respiratory syncytial virus
accaacauaccuaagauccauca

SEQ ID NO: 3152676 - RNA, 15 nt, Respiratory syncytial virus
ccaucacaaaugcaa

SEQ ID NO: 3152677 - RNA, 13 nt, Respiratory syncytial virus
ugcuaaucauaaa

SEQ ID NO: 3152678 - RNA, 18 nt, Respiratory syncytial virus
cauaguucaaauggagcc

SEQ ID NO: 3152679 - RNA, 16 nt, Respiratory syncytial virus
aaauuccauacuaaua

SEQ ID NO: 3152680 - RNA, 14 nt, Respiratory syncytial virus
caaauaaaacauca

SEQ ID NO: 3152681 - RNA, 18 nt, Respiratory syncytial virus
uagcaaaucaaugucacu

SEQ ID NO: 3152682 - RNA, 16 nt, Respiratory syncytial virus
agacguauugaagaaa

SEQ ID NO: 3152683 - RNA, 15 nt, Respiratory syncytial virus
cacaugacaucauug

SEQ ID NO: 3152684 - RNA, 14 nt, Respiratory syncytial virus
cauuugauaacaau

SEQ ID NO: 3152685 - RNA, 18 nt, Respiratory syncytial virus
uuuauauguauauuaacu

SEQ ID NO: 3152686 - RNA, 23 nt, Respiratory syncytial virus
gucaagcuuaacaacugaaauuc

SEQ ID NO: 3152687 - RNA, 19 nt, Respiratory syncytial virus
cugaugauauauacacaau

SEQ ID NO: 3152688 - RNA, 17 nt, Respiratory syncytial virus
ugucauccagcaaauac

SEQ ID NO: 3152689 - RNA, 20 nt, Respiratory syncytial virus
gaaagauggggcaaauacaa

SEQ ID NO: 3152690 - RNA, 17 nt, Respiratory syncytial virus
acaaaugcaaaaaucau

SEQ ID NO: 3152691 - RNA, 19 nt, Respiratory syncytial virus
aacacgccaggcaaaauca

SEQ ID NO: 3152692 - RNA, 16 nt, Respiratory syncytial virus
gugcauguuauuacaa

SEQ ID NO: 3152693 - RNA, 17 nt, Respiratory syncytial virus
ugaaaauauaacaacca

SEQ ID NO: 3152694 - RNA, 18 nt, Respiratory syncytial virus
auaaacccaacaaaugag

SEQ ID NO: 3152695 - RNA, 15 nt, Respiratory syncytial virus
cuauggcaagacuca

SEQ ID NO: 3152696 - RNA, 14 nt, Respiratory syncytial virus
auucauacaaacuu

SEQ ID NO: 3152697 - RNA, 23 nt, Respiratory syncytial virus
caguuaaagaucucacuaugaaa

SEQ ID NO: 3152698 - RNA, 19 nt, Respiratory syncytial virus
auacugacaaauuaauaca

SEQ ID NO: 3152699 - RNA, 22 nt, Respiratory syncytial virus
aauacaaaaaauauacugaaua

SEQ ID NO: 3152700 - RNA, 13 nt, Respiratory syncytial virus
uuacaaaaccaca

SEQ ID NO: 3152701 - RNA, 18 nt, Respiratory syncytial virus
gaacacacuugaaaauau

SEQ ID NO: 3152702 - RNA, 20 nt, Respiratory syncytial virus
caaguaugaucucaauccau

SEQ ID NO: 3152703 - RNA, 12 nt, Respiratory syncytial virus
aaagaaaaagac

SEQ ID NO: 3152704 - RNA, 18 nt, Respiratory syncytial virus
auauuaaugggaaagaaa

SEQ ID NO: 3152705 - RNA, 21 nt, Respiratory syncytial virus
cauaaugggagaauacagagg

SEQ ID NO: 3152706 - RNA, 18 nt, Respiratory syncytial virus
ccaucaagacaaccaaaa

SEQ ID NO: 3152707 - RNA, 12 nt, Respiratory syncytial virus
auauaaaacaau

SEQ ID NO: 3152708 - RNA, 19 nt, Respiratory syncytial virus
ucaacaaagaucaacuucu

SEQ ID NO: 3152709 - RNA, 17 nt, Respiratory syncytial virus
agcuauucauaugaaga

SEQ ID NO: 3152710 - RNA, 20 nt, Respiratory syncytial virus
aaucauuggaggaaauccaa

SEQ ID NO: 3152711 - RNA, 17 nt, Respiratory syncytial virus
guuaaaaauaacaugcu

SEQ ID NO: 3152712 - RNA, 17 nt, Respiratory syncytial virus
agacaucauaacacaca

SEQ ID NO: 3152713 - RNA, 17 nt, Respiratory syncytial virus
ucacacaaucugaaaua

SEQ ID NO: 3152714 - RNA, 17 nt, Respiratory syncytial virus
ggaaauucugcuaaugu

SEQ ID NO: 3152715 - RNA, 15 nt, Respiratory syncytial virus
caaauaaaacaucau

SEQ ID NO: 3152716 - RNA, 14 nt, Respiratory syncytial virus
aaauggagccugaa

SEQ ID NO: 3152717 - RNA, 17 nt, Respiratory syncytial virus
caaaacccaucuggagc

SEQ ID NO: 3152718 - RNA, 15 nt, Respiratory syncytial virus
acauguccaaaaaca

SEQ ID NO: 3152719 - RNA, 13 nt, Respiratory syncytial virus
ugauaacaacaau

SEQ ID NO: 3152720 - RNA, 20 nt, Respiratory syncytial virus
uccugcaccuagaaggggaa

SEQ ID NO: 3152721 - RNA, 21 nt, Respiratory syncytial virus
ucuuaaaucuauagcacaaau

SEQ ID NO: 3152722 - RNA, 13 nt, Respiratory syncytial virus
cacaaucugaaau

SEQ ID NO: 3152723 - RNA, 22 nt, Respiratory syncytial virus
aauauuguuaucauuaauugcc

SEQ ID NO: 3152724 - RNA, 22 nt, Respiratory syncytial virus
aauauacugaauacaacacaaa

SEQ ID NO: 3152725 - RNA, 17 nt, Respiratory syncytial virus
caaugaucuaucacuug

SEQ ID NO: 3152726 - RNA, 16 nt, Respiratory syncytial virus
caaagucacacuaaca

SEQ ID NO: 3152727 - RNA, 14 nt, Respiratory syncytial virus
aaagaaaugggaga

SEQ ID NO: 3152728 - RNA, 16 nt, Respiratory syncytial virus
agugaaauacuaggaa

SEQ ID NO: 3152729 - RNA, 16 nt, Respiratory syncytial virus
uuauuaauggaaauuc

SEQ ID NO: 3152730 - RNA, 16 nt, Respiratory syncytial virus
cagauuuauauacuug

SEQ ID NO: 3152731 - RNA, 14 nt, Respiratory syncytial virus
caaccaacacaaag

SEQ ID NO: 3152732 - RNA, 12 nt, Respiratory syncytial virus
caaaaaaaccaa

SEQ ID NO: 3152733 - RNA, 12 nt, Respiratory syncytial virus
cacaaucugaaa

SEQ ID NO: 3152734 - RNA, 18 nt, Respiratory syncytial virus
uugccaauccucaaaaca

SEQ ID NO: 3152735 - RNA, 21 nt, Respiratory syncytial virus
agcagauuuacuuauaaaaga

SEQ ID NO: 3152736 - RNA, 15 nt, Respiratory syncytial virus
acagcuucuaugaag

SEQ ID NO: 3152737 - RNA, 20 nt, Respiratory syncytial virus
uguaccuugcagcauaugca

SEQ ID NO: 3152738 - RNA, 18 nt, Respiratory syncytial virus
aagugucucucaauccaa

SEQ ID NO: 3152739 - RNA, 14 nt, Respiratory syncytial virus
uagauuccuaguuu

SEQ ID NO: 3152740 - RNA, 14 nt, Respiratory syncytial virus
uaacaacugaaauu

SEQ ID NO: 3152741 - RNA, 20 nt, Respiratory syncytial virus
caugaauuucaacacaagag

SEQ ID NO: 3152742 - RNA, 17 nt, Respiratory syncytial virus
uagaaguaaccaaagaa

SEQ ID NO: 3152743 - RNA, 18 nt, Respiratory syncytial virus
auacuccuaauuaugaug

SEQ ID NO: 3152744 - RNA, 22 nt, Respiratory syncytial virus
aucaagaucuauaugaugcugc

SEQ ID NO: 3152745 - RNA, 13 nt, Respiratory syncytial virus
uugucaagcuuaa

SEQ ID NO: 3152746 - RNA, 16 nt, Respiratory syncytial virus
ugccaucacaaaugca

SEQ ID NO: 3152747 - RNA, 19 nt, Respiratory syncytial virus
uagaggcuaucaaacauca

SEQ ID NO: 3152748 - RNA, 16 nt, Respiratory syncytial virus
gccucggcaaaccaca

SEQ ID NO: 3152749 - RNA, 14 nt, Respiratory syncytial virus
cacauggggcaaau

SEQ ID NO: 3152750 - RNA, 21 nt, Respiratory syncytial virus
uccacaaacaaggcuguaguc

SEQ ID NO: 3152751 - RNA, 21 nt, Respiratory syncytial virus
caugagaccauugucacuuga

SEQ ID NO: 3152752 - RNA, 20 nt, Respiratory syncytial virus
cgaugacccugcaucacuua

SEQ ID NO: 3152753 - RNA, 23 nt, Respiratory syncytial virus
ucuuaaaucuauagcacaaauca

SEQ ID NO: 3152754 - RNA, 14 nt, Respiratory syncytial virus
ucaauccuaaugcu

SEQ ID NO: 3152755 - RNA, 14 nt, Respiratory syncytial virus
aaaagaauaccaaa

SEQ ID NO: 3152756 - RNA, 18 nt, Respiratory syncytial virus
guucuacauaauaaaaga

SEQ ID NO: 3152757 - RNA, 12 nt, Respiratory syncytial virus
ucaaaacaacac

SEQ ID NO: 3152758 - RNA, 21 nt, Respiratory syncytial virus
uucaacuuuguaccuugcagc

SEQ ID NO: 3152759 - RNA, 12 nt, Respiratory syncytial virus
aaaagucauaau

SEQ ID NO: 3152760 - RNA, 16 nt, Respiratory syncytial virus
ugcaauacugaacaaa

SEQ ID NO: 3152761 - RNA, 19 nt, Respiratory syncytial virus
aucagaucuaguacucaaa

SEQ ID NO: 3152762 - RNA, 20 nt, Respiratory syncytial virus
uaacaacugcaaucauacaa

SEQ ID NO: 3152763 - RNA, 17 nt, Respiratory syncytial virus
caaagaaaccauagaaa

SEQ ID NO: 3152764 - RNA, 21 nt, Respiratory syncytial virus
uauuaaugggaaagaaaugaa

SEQ ID NO: 3152765 - RNA, 23 nt, Respiratory syncytial virus
uggcaaugauaaucucaacuuca

SEQ ID NO: 3152766 - RNA, 17 nt, Respiratory syncytial virus
gcaagcccaccacaaaa

SEQ ID NO: 3152767 - RNA, 22 nt, Respiratory syncytial virus
aaaauugauaaaacaagaauua

SEQ ID NO: 3152768 - RNA, 22 nt, Respiratory syncytial virus
aaaugagacagaugauacugua

SEQ ID NO: 3152769 - RNA, 22 nt, Respiratory syncytial virus
gacccugcaucacuuacaauau

SEQ ID NO: 3152770 - RNA, 19 nt, Respiratory syncytial virus
agauauagaaguaaccaaa

SEQ ID NO: 3152771 - RNA, 11 nt, Respiratory syncytial virus
ucagugaguug

SEQ ID NO: 3152772 - RNA, 14 nt, Respiratory syncytial virus
aucaacuagcaaau

SEQ ID NO: 3152773 - RNA, 13 nt, Respiratory syncytial virus
aaaccaaccauca

SEQ ID NO: 3152774 - RNA, 13 nt, Respiratory syncytial virus
ugcagaaacacau

SEQ ID NO: 3152775 - RNA, 13 nt, Respiratory syncytial virus
cucuuagcaaagu

SEQ ID NO: 3152776 - RNA, 19 nt, Respiratory syncytial virus
ugaaagauggggcaaauac

SEQ ID NO: 3152777 - RNA, 14 nt, Respiratory syncytial virus
uaguauaaauucca

SEQ ID NO: 3152778 - RNA, 23 nt, Respiratory syncytial virus
uauaauaaauaucaacuagcaaa

SEQ ID NO: 3152779 - RNA, 22 nt, Respiratory syncytial virus
uccauaguucaaauggagccug

SEQ ID NO: 3152780 - RNA, 16 nt, Respiratory syncytial virus
ccaucagugucagaaa

SEQ ID NO: 3152781 - RNA, 18 nt, Respiratory syncytial virus
caugcauaaccacacucc

SEQ ID NO: 3152782 - RNA, 13 nt, Respiratory syncytial virus
uggacacaacaca

SEQ ID NO: 3152783 - RNA, 16 nt, Respiratory syncytial virus
aagacaaccaaaaaag

SEQ ID NO: 3152784 - RNA, 18 nt, Respiratory syncytial virus
uggagaagaugcaaacaa

SEQ ID NO: 3152785 - RNA, 20 nt, Respiratory syncytial virus
uagcauuuauucguaaaucc

SEQ ID NO: 3152786 - RNA, 19 nt, Respiratory syncytial virus
augcauaaccacacuccau

SEQ ID NO: 3152787 - RNA, 23 nt, Respiratory syncytial virus
uggcauuguauuugugcauguua

SEQ ID NO: 3152788 - RNA, 21 nt, Respiratory syncytial virus
auacucaccgaaucaaccauu

SEQ ID NO: 3152789 - RNA, 17 nt, Respiratory syncytial virus
ccuuguaguauaaauuc

SEQ ID NO: 3152790 - RNA, 19 nt, Respiratory syncytial virus
auccaauuucacaacaaug

SEQ ID NO: 3152791 - RNA, 14 nt, Respiratory syncytial virus
auuuacuuauaaaa

SEQ ID NO: 3152792 - RNA, 18 nt, Respiratory syncytial virus
augaaauuugaaguguua

SEQ ID NO: 3152793 - RNA, 22 nt, Respiratory syncytial virus
uugcaaaaagccaugaccaaau

SEQ ID NO: 3152794 - RNA, 14 nt, Respiratory syncytial virus
uguuauuacaagua

SEQ ID NO: 3152795 - RNA, 12 nt, Respiratory syncytial virus
aauaaccaaauu

SEQ ID NO: 3152796 - RNA, 19 nt, Respiratory syncytial virus
agcuucaacaacaccaagu

SEQ ID NO: 3152797 - RNA, 23 nt, Respiratory syncytial virus
caauccuaaugcuuaccacauca

SEQ ID NO: 3152798 - RNA, 16 nt, Respiratory syncytial virus
aaguaccacuuaaauu

SEQ ID NO: 3152799 - RNA, 19 nt, Respiratory syncytial virus
uauagaaguaaccaaagaa

SEQ ID NO: 3152800 - RNA, 15 nt, Respiratory syncytial virus
auaaaaauauccaca

SEQ ID NO: 3152801 - RNA, 17 nt, Respiratory syncytial virus
uucuacauaauaaaaga

SEQ ID NO: 3152802 - RNA, 18 nt, Respiratory syncytial virus
aaaaugcuaaaagaaaug

SEQ ID NO: 3152803 - RNA, 15 nt, Respiratory syncytial virus
auugaagaaaaccau

SEQ ID NO: 3152804 - RNA, 23 nt, Respiratory syncytial virus
guuaauagguauguuauaugcua

SEQ ID NO: 3152805 - RNA, 20 nt, Respiratory syncytial virus
ugcauuuguaagugaacaac

SEQ ID NO: 3152806 - RNA, 22 nt, Respiratory syncytial virus
auagcuacacacuaacacugua

SEQ ID NO: 3152807 - RNA, 15 nt, Respiratory syncytial virus
auaccaaacaaaaaa

SEQ ID NO: 3152808 - RNA, 19 nt, Respiratory syncytial virus
agcugcuguucaauacaau

SEQ ID NO: 3152809 - RNA, 14 nt, Respiratory syncytial virus
ggcaaauaaaucaa

SEQ ID NO: 3152810 - RNA, 16 nt, Respiratory syncytial virus
gccaguguuacaaaau

SEQ ID NO: 3152811 - RNA, 18 nt, Respiratory syncytial virus
auaugggaaaugauggaa

SEQ ID NO: 3152812 - RNA, 13 nt, Respiratory syncytial virus
aaaaauucccaua

SEQ ID NO: 3152813 - RNA, 21 nt, Respiratory syncytial virus
aaucaauaaagggcaaauuca

SEQ ID NO: 3152814 - RNA, 15 nt, Respiratory syncytial virus
ggcuaaggcagugau

SEQ ID NO: 3152815 - RNA, 11 nt, Respiratory syncytial virus
aaucaaaacaa

SEQ ID NO: 3152816 - RNA, 12 nt, Respiratory syncytial virus
agauaaaaaugg

SEQ ID NO: 3152817 - RNA, 20 nt, Respiratory syncytial virus
ggaugauaauauuauguaua

SEQ ID NO: 3152818 - RNA, 15 nt, Respiratory syncytial virus
caacugaaauucaaa

SEQ ID NO: 3152819 - RNA, 22 nt, Respiratory syncytial virus
aaaaguuaauguccaacaaugu

SEQ ID NO: 3152820 - RNA, 18 nt, Respiratory syncytial virus
ucaaauggaguuaguguc

SEQ ID NO: 3152821 - RNA, 18 nt, Respiratory syncytial virus
ccacaaaaaaaccaacca

SEQ ID NO: 3152822 - RNA, 18 nt, Respiratory syncytial virus
aucgucaagauauuaaug

SEQ ID NO: 3152823 - RNA, 17 nt, Respiratory syncytial virus
cauagcuacacacuaac

SEQ ID NO: 3152824 - RNA, 13 nt, Respiratory syncytial virus
gccaguguuacaa

SEQ ID NO: 3152825 - RNA, 21 nt, Respiratory syncytial virus
caaaauuuucuacaacaucua

SEQ ID NO: 3152826 - RNA, 14 nt, Respiratory syncytial virus
aauuucaacacaag

SEQ ID NO: 3152827 - RNA, 17 nt, Respiratory syncytial virus
gacuucaaaaacagaug

SEQ ID NO: 3152828 - RNA, 16 nt, Respiratory syncytial virus
auggagccugaaaauu

SEQ ID NO: 3152829 - RNA, 15 nt, Respiratory syncytial virus
augauaacaacaaua

SEQ ID NO: 3152830 - RNA, 21 nt, Respiratory syncytial virus
ucaaacuauuaacucaaacaa

SEQ ID NO: 3152831 - RNA, 15 nt, Respiratory syncytial virus
uagucauaauuauuu

SEQ ID NO: 3152832 - RNA, 19 nt, Respiratory syncytial virus
agaucuaguacucaaauaa

SEQ ID NO: 3152833 - RNA, 19 nt, Respiratory syncytial virus
uucuuacaaugguuucaua

SEQ ID NO: 3152834 - RNA, 13 nt, Respiratory syncytial virus
auaugcccaaaaa

SEQ ID NO: 3152835 - RNA, 12 nt, Respiratory syncytial virus
uaaccacacucc

SEQ ID NO: 3152836 - RNA, 20 nt, Respiratory syncytial virus
gauaaaaauggggcaaauaa

SEQ ID NO: 3152837 - RNA, 18 nt, Respiratory syncytial virus
uacuagcuucaacaacac

SEQ ID NO: 3152838 - RNA, 17 nt, Respiratory syncytial virus
uaaaaauucccauagcu

SEQ ID NO: 3152839 - RNA, 20 nt, Respiratory syncytial virus
uguagucagcuuaucaaaug

SEQ ID NO: 3152840 - RNA, 20 nt, Respiratory syncytial virus
auuuauuuugaaucaauaug

SEQ ID NO: 3152841 - RNA, 20 nt, Respiratory syncytial virus
cugcucauagacaacccauc

SEQ ID NO: 3152842 - RNA, 21 nt, Respiratory syncytial virus
ucaauaaagggcaaauucaca

SEQ ID NO: 3152843 - RNA, 11 nt, Respiratory syncytial virus
ucuaacaugcc

SEQ ID NO: 3152844 - RNA, 16 nt, Respiratory syncytial virus
uacuagcuucaacaac

SEQ ID NO: 3152845 - RNA, 17 nt, Respiratory syncytial virus
caagcagaaauggaaca

SEQ ID NO: 3152846 - RNA, 17 nt, Respiratory syncytial virus
gaaguagcauuguuaaa

SEQ ID NO: 3152847 - RNA, 18 nt, Respiratory syncytial virus
acaagcccaauuaucaaa

SEQ ID NO: 3152848 - RNA, 22 nt, Respiratory syncytial virus
cagccaauccaaaacuagccac

SEQ ID NO: 3152849 - RNA, 16 nt, Respiratory syncytial virus
guaaccuugcauuugu

SEQ ID NO: 3152850 - RNA, 23 nt, Respiratory syncytial virus
cauagcuacacacuaacacugua

SEQ ID NO: 3152851 - RNA, 13 nt, Respiratory syncytial virus
uaaauuccauacu

SEQ ID NO: 3152852 - RNA, 23 nt, Respiratory syncytial virus
caagaaaaaagauaguaucauau

SEQ ID NO: 3152853 - RNA, 16 nt, Respiratory syncytial virus
cuacaaagcacacucc

SEQ ID NO: 3152854 - RNA, 23 nt, Respiratory syncytial virus
ugccaauccucaaaacaaaugca

SEQ ID NO: 3152855 - RNA, 13 nt, Respiratory syncytial virus
gacacuagaaaag

SEQ ID NO: 3152856 - RNA, 14 nt, Respiratory syncytial virus
cauaguucaaaugg

SEQ ID NO: 3152857 - RNA, 19 nt, Respiratory syncytial virus
aaccaucaagacaaccaaa

SEQ ID NO: 3152858 - RNA, 19 nt, Respiratory syncytial virus
ucauaaucaccaacccucu

SEQ ID NO: 3152859 - RNA, 19 nt, Respiratory syncytial virus
aacaccaagugucaaguca

SEQ ID NO: 3152860 - RNA, 17 nt, Respiratory syncytial virus
gugcagaaacacaucaa

SEQ ID NO: 3152861 - RNA, 14 nt, Respiratory syncytial virus
caaaauauggcacu

SEQ ID NO: 3152862 - RNA, 19 nt, Respiratory syncytial virus
uaaauccgaugaauuauua

SEQ ID NO: 3152863 - RNA, 15 nt, Respiratory syncytial virus
acccauggaagauua

SEQ ID NO: 3152864 - RNA, 23 nt, Respiratory syncytial virus
uuggcuaaggcagugauacauac

SEQ ID NO: 3152865 - RNA, 15 nt, Respiratory syncytial virus
ggagccugaaaauua

SEQ ID NO: 3152866 - RNA, 18 nt, Respiratory syncytial virus
caucuauaaaccaucuca

SEQ ID NO: 3152867 - RNA, 17 nt, Respiratory syncytial virus
aucagugucagaaauaa

SEQ ID NO: 3152868 - RNA, 20 nt, Respiratory syncytial virus
cagagacaucauaacacaca

SEQ ID NO: 3152869 - RNA, 21 nt, Respiratory syncytial virus
acaucgucaagauauuaaugg

SEQ ID NO: 3152870 - RNA, 22 nt, Respiratory syncytial virus
cauccaacggagcacaggagau

SEQ ID NO: 3152871 - RNA, 12 nt, Respiratory syncytial virus
agugaauuauua

SEQ ID NO: 3152872 - RNA, 14 nt, Respiratory syncytial virus
aaagccaaccauca

SEQ ID NO: 3152873 - RNA, 13 nt, Respiratory syncytial virus
gucaacuaugaaa

SEQ ID NO: 3152874 - RNA, 17 nt, Respiratory syncytial virus
agacauaagaugaaaga

SEQ ID NO: 3152875 - RNA, 18 nt, Respiratory syncytial virus
caugcaagccaucaucca

SEQ ID NO: 3152876 - RNA, 15 nt, Respiratory syncytial virus
uugaucuaggaggaa

SEQ ID NO: 3152877 - RNA, 14 nt, Respiratory syncytial virus
uaguagacaaaauc

SEQ ID NO: 3152878 - RNA, 13 nt, Respiratory syncytial virus
cagaucaagaaca

SEQ ID NO: 3152879 - RNA, 16 nt, Respiratory syncytial virus
gaagcacuaaauacaa

SEQ ID NO: 3152880 - RNA, 13 nt, Respiratory syncytial virus
caaucaaaacaac

SEQ ID NO: 3152881 - RNA, 17 nt, Respiratory syncytial virus
ucaagauauuaauggga

SEQ ID NO: 3152882 - RNA, 15 nt, Respiratory syncytial virus
aauuuucuacaacau

SEQ ID NO: 3152883 - RNA, 20 nt, Respiratory syncytial virus
auaaauuuaaauccaaaucu

SEQ ID NO: 3152884 - RNA, 16 nt, Respiratory syncytial virus
uacugaauacaacaca

SEQ ID NO: 3152885 - RNA, 20 nt, Respiratory syncytial virus
caacuagcaaaucaauguca

SEQ ID NO: 3152886 - RNA, 13 nt, Respiratory syncytial virus
caaccaaacaucu

SEQ ID NO: 3152887 - RNA, 17 nt, Respiratory syncytial virus
auuaaugggaaagaaau

SEQ ID NO: 3152888 - RNA, 12 nt, Respiratory syncytial virus
caaagaaaaugg

SEQ ID NO: 3152889 - RNA, 14 nt, Respiratory syncytial virus
cacacuaagcaagg

SEQ ID NO: 3152890 - RNA, 17 nt, Respiratory syncytial virus
uccaacacaacaaacca

SEQ ID NO: 3152891 - RNA, 14 nt, Respiratory syncytial virus
aaguuacauauuca

SEQ ID NO: 3152892 - RNA, 19 nt, Respiratory syncytial virus
aguaaguuucaaagaagac

SEQ ID NO: 3152893 - RNA, 19 nt, Respiratory syncytial virus
uacaagaugcaacaagcca

SEQ ID NO: 3152894 - RNA, 14 nt, Respiratory syncytial virus
gcuuaacaacugaa

SEQ ID NO: 3152895 - RNA, 21 nt, Respiratory syncytial virus
uggguuaauagguauguuaua

SEQ ID NO: 3152896 - RNA, 19 nt, Respiratory syncytial virus
acagucaagaccaaaaaca

SEQ ID NO: 3152897 - RNA, 19 nt, Respiratory syncytial virus
auucaaaaaugccaucaca

SEQ ID NO: 3152898 - RNA, 14 nt, Respiratory syncytial virus
agaguuccaacaaa

SEQ ID NO: 3152899 - RNA, 19 nt, Respiratory syncytial virus
caagaccaaaaacacaaca

SEQ ID NO: 3152900 - RNA, 11 nt, Respiratory syncytial virus
uggagccucag

SEQ ID NO: 3152901 - RNA, 17 nt, Respiratory syncytial virus
caaaaagauacaaucaa

SEQ ID NO: 3152902 - RNA, 15 nt, Respiratory syncytial virus
ucuuagcaaagucaa

SEQ ID NO: 3152903 - RNA, 18 nt, Respiratory syncytial virus
aaaguuagauuacaaaau

SEQ ID NO: 3152904 - RNA, 19 nt, Respiratory syncytial virus
agcuacacacuaacacugu

SEQ ID NO: 3152905 - RNA, 21 nt, Respiratory syncytial virus
ucaagaccaaaaacacaacaa

SEQ ID NO: 3152906 - RNA, 15 nt, Respiratory syncytial virus
aacguuggggcaaau

SEQ ID NO: 3152907 - RNA, 21 nt, Respiratory syncytial virus
agcaagcccaccacaaaacaa

SEQ ID NO: 3152908 - RNA, 14 nt, Respiratory syncytial virus
agaacacacuauau

SEQ ID NO: 3152909 - RNA, 13 nt, Respiratory syncytial virus
cugaacaacucaa

SEQ ID NO: 3152910 - RNA, 20 nt, Respiratory syncytial virus
aucaaugucacuaacaccau

SEQ ID NO: 3152911 - RNA, 20 nt, Respiratory syncytial virus
aauggagccugaaaauuaua

SEQ ID NO: 3152912 - RNA, 16 nt, Respiratory syncytial virus
cacuuaaauuuaacuc

SEQ ID NO: 3152913 - RNA, 15 nt, Respiratory syncytial virus
ucaaugucacuaaca

SEQ ID NO: 3152914 - RNA, 20 nt, Respiratory syncytial virus
guuacuauguauaaucaaaa

SEQ ID NO: 3152915 - RNA, 16 nt, Respiratory syncytial virus
acaaacgauaauauaa

SEQ ID NO: 3152916 - RNA, 21 nt, Respiratory syncytial virus
cacaaaauuaaacaacauauu

SEQ ID NO: 3152917 - RNA, 18 nt, Respiratory syncytial virus
ccacagaaaagccaacca

SEQ ID NO: 3152918 - RNA, 20 nt, Respiratory syncytial virus
caugagaccauugucacuug

SEQ ID NO: 3152919 - RNA, 12 nt, Respiratory syncytial virus
acaaacaaacca

SEQ ID NO: 3152920 - RNA, 20 nt, Respiratory syncytial virus
gagucacacaaucugaaaua

SEQ ID NO: 3152921 - RNA, 11 nt, Respiratory syncytial virus
gcaagcccacc

SEQ ID NO: 3152922 - RNA, 22 nt, Respiratory syncytial virus
uggaaaauacauccauaacaau

SEQ ID NO: 3152923 - RNA, 21 nt, Respiratory syncytial virus
agauacuauaguuacaaaaaa

SEQ ID NO: 3152924 - RNA, 14 nt, Respiratory syncytial virus
aguguuacaaaaug

SEQ ID NO: 3152925 - RNA, 16 nt, Respiratory syncytial virus
cuacacacuaacacug

SEQ ID NO: 3152926 - RNA, 18 nt, Respiratory syncytial virus
aaguuagauuacaaaauu

SEQ ID NO: 3152927 - RNA, 19 nt, Respiratory syncytial virus
caauagaauucucaagcaa

SEQ ID NO: 3152928 - RNA, 15 nt, Respiratory syncytial virus
acaaagugggaagca

SEQ ID NO: 3152929 - RNA, 22 nt, Respiratory syncytial virus
cauggagaagaugcaaacaaca

SEQ ID NO: 3152930 - RNA, 20 nt, Respiratory syncytial virus
cauggagaagaugcaaacaa

SEQ ID NO: 3152931 - RNA, 14 nt, Respiratory syncytial virus
auuauuacauaaug

SEQ ID NO: 3152932 - RNA, 14 nt, Respiratory syncytial virus
gaaagauggggcaa

SEQ ID NO: 3152933 - RNA, 11 nt, Respiratory syncytial virus
aaaaaaaaugg

SEQ ID NO: 3152934 - RNA, 20 nt, Respiratory syncytial virus
gauaucauguaaaagcaaau

SEQ ID NO: 3152935 - RNA, 18 nt, Respiratory syncytial virus
ggagcuuaccuagaaaaa

SEQ ID NO: 3152936 - RNA, 14 nt, Respiratory syncytial virus
aucaaagaaaaccu

SEQ ID NO: 3152937 - RNA, 19 nt, Respiratory syncytial virus
cacuaacacuguauucaau

SEQ ID NO: 3152938 - RNA, 13 nt, Respiratory syncytial virus
aaaaucaaccaau

SEQ ID NO: 3152939 - RNA, 15 nt, Respiratory syncytial virus
ccaacaaaugagaca

SEQ ID NO: 3152940 - RNA, 13 nt, Respiratory syncytial virus
uauggauaaaagc

SEQ ID NO: 3152941 - RNA, 18 nt, Respiratory syncytial virus
gaacacaaccccaacaua

SEQ ID NO: 3152942 - RNA, 18 nt, Respiratory syncytial virus
ccaauuaucaaagaaaac

SEQ ID NO: 3152943 - RNA, 21 nt, Respiratory syncytial virus
uaaaaaaaauggggcaaauaa

SEQ ID NO: 3152944 - RNA, 15 nt, Respiratory syncytial virus
caaauucacaucacc

SEQ ID NO: 3152945 - RNA, 21 nt, Respiratory syncytial virus
gaaacuacaucacaaaccacc

SEQ ID NO: 3152946 - RNA, 12 nt, Respiratory syncytial virus
auacaaagaaac

SEQ ID NO: 3152947 - RNA, 15 nt, Respiratory syncytial virus
auccauucuggcaau

SEQ ID NO: 3152948 - RNA, 23 nt, Respiratory syncytial virus
cuagaggcuaucaaacaucagcu

SEQ ID NO: 3152949 - RNA, 19 nt, Respiratory syncytial virus
auacacucaacaaagauca

SEQ ID NO: 3152950 - RNA, 19 nt, Respiratory syncytial virus
aucgaaacucucaucuaua

SEQ ID NO: 3152951 - RNA, 23 nt, Respiratory syncytial virus
ccugaaaauuauaguaauuuaaa

SEQ ID NO: 3152952 - RNA, 22 nt, Respiratory syncytial virus
agcccuauaacaucaaauucaa

SEQ ID NO: 3152953 - RNA, 17 nt, Respiratory syncytial virus
agucaaguugaaugaua

SEQ ID NO: 3152954 - RNA, 16 nt, Respiratory syncytial virus
cuaccaccaagcccac

SEQ ID NO: 3152955 - RNA, 15 nt, Respiratory syncytial virus
acagcagaagaacua

SEQ ID NO: 3152956 - RNA, 23 nt, Respiratory syncytial virus
ugaagaauuuuaucaaacaacau

SEQ ID NO: 3152957 - RNA, 22 nt, Respiratory syncytial virus
ucagugaguugauucauacaaa

SEQ ID NO: 3152958 - RNA, 22 nt, Respiratory syncytial virus
cucaacagugaugacaucaaaa

SEQ ID NO: 3152959 - RNA, 14 nt, Respiratory syncytial virus
agugaguugauuca

SEQ ID NO: 3152960 - RNA, 14 nt, Respiratory syncytial virus
aaauucccauagcu

SEQ ID NO: 3152961 - RNA, 23 nt, Respiratory syncytial virus
acaaaugaucagaaaaaguuaau

SEQ ID NO: 3152962 - RNA, 15 nt, Respiratory syncytial virus
caagcagaaauggaa

SEQ ID NO: 3152963 - RNA, 14 nt, Respiratory syncytial virus
ucauguucuuacaa

SEQ ID NO: 3152964 - RNA, 22 nt, Respiratory syncytial virus
agccaauccaaaacuagccacc

SEQ ID NO: 3152965 - RNA, 13 nt, Respiratory syncytial virus
cuauaaaccaucu

SEQ ID NO: 3152966 - RNA, 17 nt, Respiratory syncytial virus
gaagagaagacaccaua

SEQ ID NO: 3152967 - RNA, 16 nt, Respiratory syncytial virus
uauauuaaaaauuccc

SEQ ID NO: 3152968 - RNA, 18 nt, Respiratory syncytial virus
gaguuacuauguauaauc

SEQ ID NO: 3152969 - RNA, 16 nt, Respiratory syncytial virus
caugcagugcagucag

SEQ ID NO: 3152970 - RNA, 17 nt, Respiratory syncytial virus
aucccaagaaaaaagau

SEQ ID NO: 3152971 - RNA, 10 nt, Respiratory syncytial virus
uccaacaaug

SEQ ID NO: 3152972 - RNA, 11 nt, Respiratory syncytial virus
ggcaaaugcaa

SEQ ID NO: 3152973 - RNA, 15 nt, Respiratory syncytial virus
aaauauggaaacaua

SEQ ID NO: 3152974 - RNA, 14 nt, Respiratory syncytial virus
cuuaaagcagucaa

SEQ ID NO: 3152975 - RNA, 20 nt, Respiratory syncytial virus
cuaaucaaacaaaacccauc

SEQ ID NO: 3152976 - RNA, 21 nt, Respiratory syncytial virus
auugcaauacugaacaaacuc

SEQ ID NO: 3152977 - RNA, 17 nt, Respiratory syncytial virus
cauuaaucaaugauaug

SEQ ID NO: 3152978 - RNA, 22 nt, Respiratory syncytial virus
acuaacaacugcaaucauacaa

SEQ ID NO: 3152979 - RNA, 20 nt, Respiratory syncytial virus
acgccaaucagccaauccaa

SEQ ID NO: 3152980 - RNA, 19 nt, Respiratory syncytial virus
ugaaaauauaguaacauca

SEQ ID NO: 3152981 - RNA, 19 nt, Respiratory syncytial virus
auguuauuacaaguaguga

SEQ ID NO: 3152982 - RNA, 20 nt, Respiratory syncytial virus
gugucucucaauccaacauc

SEQ ID NO: 3152983 - RNA, 21 nt, Respiratory syncytial virus
agaacuagcuaaugucaacau

SEQ ID NO: 3152984 - RNA, 20 nt, Respiratory syncytial virus
caucaacaucucaccaugca

SEQ ID NO: 3152985 - RNA, 21 nt, Respiratory syncytial virus
caacuaaucaaacaaaaccca

SEQ ID NO: 3152986 - RNA, 12 nt, Respiratory syncytial virus
agacaaacgaua

SEQ ID NO: 3152987 - RNA, 22 nt, Respiratory syncytial virus
aaucaagaucuauaugaugcug

SEQ ID NO: 3152988 - RNA, 13 nt, Respiratory syncytial virus
cauaucugcucau

SEQ ID NO: 3152989 - RNA, 22 nt, Respiratory syncytial virus
ccuagaaggggaagugaacaaa

SEQ ID NO: 3152990 - RNA, 19 nt, Respiratory syncytial virus
caaccaaaauaaccauaua

SEQ ID NO: 3152991 - RNA, 21 nt, Respiratory syncytial virus
gaaaauacauccauaacaaua

SEQ ID NO: 3152992 - RNA, 17 nt, Respiratory syncytial virus
auagaugacaauuguga

SEQ ID NO: 3152993 - RNA, 21 nt, Respiratory syncytial virus
augauugcaauacugaacaaa

SEQ ID NO: 3152994 - RNA, 20 nt, Respiratory syncytial virus
ucaccucuuuacaaaaccac

SEQ ID NO: 3152995 - RNA, 16 nt, Respiratory syncytial virus
acaccaccaaaacaaa

SEQ ID NO: 3152996 - RNA, 13 nt, Respiratory syncytial virus
uuccauacuaaua

SEQ ID NO: 3152997 - RNA, 14 nt, Respiratory syncytial virus
cagaggaugguacu

SEQ ID NO: 3152998 - RNA, 18 nt, Respiratory syncytial virus
aacaugccuaaaaucaaa

SEQ ID NO: 3152999 - RNA, 22 nt, Respiratory syncytial virus
caacuucaugcauaaccacacu

SEQ ID NO: 3153000 - RNA, 22 nt, Respiratory syncytial virus
auaaggaacucaaaagaauuac

SEQ ID NO: 3153001 - RNA, 20 nt, Respiratory syncytial virus
caccucuuuacaaaaccaca

SEQ ID NO: 3153002 - RNA, 22 nt, Respiratory syncytial virus
uaguucaaauggagccugaaaa

SEQ ID NO: 3153003 - RNA, 22 nt, Respiratory syncytial virus
acaaaaccuuugagcuaccaag

SEQ ID NO: 3153004 - RNA, 15 nt, Respiratory syncytial virus
aucaaauucaaccau

SEQ ID NO: 3153005 - RNA, 22 nt, Respiratory syncytial virus
caaagacugaugaucacagaca

SEQ ID NO: 3153006 - RNA, 13 nt, Respiratory syncytial virus
aguucaaauggag

SEQ ID NO: 3153007 - RNA, 19 nt, Respiratory syncytial virus
accaugcaagccaucaucc

SEQ ID NO: 3153008 - RNA, 18 nt, Respiratory syncytial virus
aucugucaacauagacaa

SEQ ID NO: 3153009 - RNA, 21 nt, Respiratory syncytial virus
aaguguuagaccucaaaaacu

SEQ ID NO: 3153010 - RNA, 19 nt, Respiratory syncytial virus
uucaugcauaaccacacuc

SEQ ID NO: 3153011 - RNA, 18 nt, Respiratory syncytial virus
caaaugcaaaaaucaucc

SEQ ID NO: 3153012 - RNA, 16 nt, Respiratory syncytial virus
gucaacuaugaaauga

SEQ ID NO: 3153013 - RNA, 16 nt, Respiratory syncytial virus
ugaaauaacaacuuca

SEQ ID NO: 3153014 - RNA, 15 nt, Respiratory syncytial virus
cggcaaccaacaauc

SEQ ID NO: 3153015 - RNA, 17 nt, Respiratory syncytial virus
uaaauaucaacuagcaa

SEQ ID NO: 3153016 - RNA, 15 nt, Respiratory syncytial virus
gcaccuaaucauguu

SEQ ID NO: 3153017 - RNA, 12 nt, Respiratory syncytial virus
augauauauaca

SEQ ID NO: 3153018 - RNA, 20 nt, Respiratory syncytial virus
cuacacacuaacacuguauu

SEQ ID NO: 3153019 - RNA, 10 nt, Respiratory syncytial virus
uucaacaaug

SEQ ID NO: 3153020 - RNA, 22 nt, Respiratory syncytial virus
cagacguauugaagaaaaccau

SEQ ID NO: 3153021 - RNA, 22 nt, Respiratory syncytial virus
acaagauuaaauccaacaaugg

SEQ ID NO: 3153022 - RNA, 20 nt, Respiratory syncytial virus
aaugucaacauacuagugaa

SEQ ID NO: 3153023 - RNA, 23 nt, Respiratory syncytial virus
aauagcaccuaaucauguucuua

SEQ ID NO: 3153024 - RNA, 18 nt, Respiratory syncytial virus
auauacuugauaaaucau

SEQ ID NO: 3153025 - RNA, 16 nt, Respiratory syncytial virus
ucaccaacccucugug

SEQ ID NO: 3153026 - RNA, 18 nt, Respiratory syncytial virus
uacuguuagucaucacag

SEQ ID NO: 3153027 - RNA, 23 nt, Respiratory syncytial virus
aaugaaacuauugcacaaagugg

SEQ ID NO: 3153028 - RNA, 11 nt, Respiratory syncytial virus
uccuacaaaaa

SEQ ID NO: 3153029 - RNA, 20 nt, Respiratory syncytial virus
caacgccaaaacaaaccacc

SEQ ID NO: 3153030 - RNA, 13 nt, Respiratory syncytial virus
aaagcaaauggag

SEQ ID NO: 3153031 - RNA, 18 nt, Respiratory syncytial virus
ucacuaugaaaacacuca

SEQ ID NO: 3153032 - RNA, 17 nt, Respiratory syncytial virus
aaaaagucauaauacca

SEQ ID NO: 3153033 - RNA, 14 nt, Respiratory syncytial virus
accuagaaaaagaa

SEQ ID NO: 3153034 - RNA, 15 nt, Respiratory syncytial virus
cuaacacuguauuca

SEQ ID NO: 3153035 - RNA, 19 nt, Respiratory syncytial virus
uaauauuguagugaaaucc

SEQ ID NO: 3153036 - RNA, 16 nt, Respiratory syncytial virus
ccaccaagcccacaaa

SEQ ID NO: 3153037 - RNA, 19 nt, Respiratory syncytial virus
gaccucguuagaacagauu

SEQ ID NO: 3153038 - RNA, 12 nt, Respiratory syncytial virus
caccaagcccac

SEQ ID NO: 3153039 - RNA, 19 nt, Respiratory syncytial virus
uggucaacuaugaaaugaa

SEQ ID NO: 3153040 - RNA, 18 nt, Respiratory syncytial virus
ugaaaauauaacaaccac

SEQ ID NO: 3153041 - RNA, 17 nt, Respiratory syncytial virus
uaaaugcugguaaaucc

SEQ ID NO: 3153042 - RNA, 19 nt, Respiratory syncytial virus
caaccaucaagacaaccaa

SEQ ID NO: 3153043 - RNA, 12 nt, Respiratory syncytial virus
caacaccaccaa

SEQ ID NO: 3153044 - RNA, 21 nt, Respiratory syncytial virus
gauagaaucuagaaaauccua

SEQ ID NO: 3153045 - RNA, 21 nt, Respiratory syncytial virus
cuggucaacuaugaaaugaaa

SEQ ID NO: 3153046 - RNA, 22 nt, Respiratory syncytial virus
augauacuguagggaacaagcc

SEQ ID NO: 3153047 - RNA, 21 nt, Respiratory syncytial virus
caaaauuuguuugacaaugau

SEQ ID NO: 3153048 - RNA, 18 nt, Respiratory syncytial virus
agcccaccacaaaacaac

SEQ ID NO: 3153049 - RNA, 14 nt, Respiratory syncytial virus
ucuucacuucacca

SEQ ID NO: 3153050 - RNA, 14 nt, Respiratory syncytial virus
gcacuaaauacaaa

SEQ ID NO: 3153051 - RNA, 22 nt, Respiratory syncytial virus
uuaacaacugaaauucaaauca

SEQ ID NO: 3153052 - RNA, 22 nt, Respiratory syncytial virus
uaauccaaaagauaaugaugua

SEQ ID NO: 3153053 - RNA, 21 nt, Respiratory syncytial virus
ugauacauacaaucaaauuga

SEQ ID NO: 3153054 - RNA, 16 nt, Respiratory syncytial virus
gcaaauacaccaucca

SEQ ID NO: 3153055 - RNA, 13 nt, Respiratory syncytial virus
agaaucaauaaag

SEQ ID NO: 3153056 - RNA, 21 nt, Respiratory syncytial virus
cacaaucuucuaccagaggug

SEQ ID NO: 3153057 - RNA, 23 nt, Respiratory syncytial virus
caagucauuguucaucagaucua

SEQ ID NO: 3153058 - RNA, 15 nt, Respiratory syncytial virus
caacccugcaaucca

SEQ ID NO: 3153059 - RNA, 22 nt, Respiratory syncytial virus
agcacacucccauaauauacaa

SEQ ID NO: 3153060 - RNA, 22 nt, Respiratory syncytial virus
agucaaaacaucacugaagaau

SEQ ID NO: 3153061 - RNA, 22 nt, Respiratory syncytial virus
uaaauaucaacuagcaaaucaa

SEQ ID NO: 3153062 - RNA, 17 nt, Respiratory syncytial virus
ugaauacaacacaaaau

SEQ ID NO: 3153063 - RNA, 20 nt, Respiratory syncytial virus
ucaaaacaucacugaagaau

SEQ ID NO: 3153064 - RNA, 13 nt, Respiratory syncytial virus
uaauuaugaugug

SEQ ID NO: 3153065 - RNA, 13 nt, Respiratory syncytial virus
acccaacaaauga

SEQ ID NO: 3153066 - RNA, 15 nt, Respiratory syncytial virus
auuaagacuaacaau

SEQ ID NO: 3153067 - RNA, 18 nt, Respiratory syncytial virus
caaauggagccugaaaau

SEQ ID NO: 3153068 - RNA, 23 nt, Respiratory syncytial virus
ucaaaacaacacucuugaagaaa

SEQ ID NO: 3153069 - RNA, 15 nt, Respiratory syncytial virus
uauuaaucacagaag

SEQ ID NO: 3153070 - RNA, 18 nt, Respiratory syncytial virus
uagcuacacacuaacacu

SEQ ID NO: 3153071 - RNA, 19 nt, Respiratory syncytial virus
aauggggcaaauaaaacau

SEQ ID NO: 3153072 - RNA, 12 nt, Respiratory syncytial virus
ggggcaaauaaa

SEQ ID NO: 3153073 - RNA, 12 nt, Respiratory syncytial virus
guauuacugaug

SEQ ID NO: 3153074 - RNA, 21 nt, Respiratory syncytial virus
aguugccaauccucaaaacaa

SEQ ID NO: 3153075 - RNA, 22 nt, Respiratory syncytial virus
agugucauaacacucaauccua

SEQ ID NO: 3153076 - RNA, 21 nt, Respiratory syncytial virus
cuaagauauuaagacuaacaa

SEQ ID NO: 3153077 - RNA, 13 nt, Respiratory syncytial virus
ugaaauaacaacu

SEQ ID NO: 3153078 - RNA, 15 nt, Respiratory syncytial virus
cagaucaagaacaca

SEQ ID NO: 3153079 - RNA, 18 nt, Respiratory syncytial virus
aauguccuaaaaaaugaa

SEQ ID NO: 3153080 - RNA, 16 nt, Respiratory syncytial virus
gcaaaucaaugucacu

SEQ ID NO: 3153081 - RNA, 23 nt, Respiratory syncytial virus
guagaguuacuauguauaaucaa

SEQ ID NO: 3153082 - RNA, 21 nt, Respiratory syncytial virus
aaaaccuggaaagaaaaccac

SEQ ID NO: 3153083 - RNA, 12 nt, Respiratory syncytial virus
uacgugaacaaa

SEQ ID NO: 3153084 - RNA, 16 nt, Respiratory syncytial virus
agaucaucccaaguca

SEQ ID NO: 3153085 - RNA, 16 nt, Respiratory syncytial virus
accuauugugaacaag

SEQ ID NO: 3153086 - RNA, 23 nt, Respiratory syncytial virus
caccaccaagcccacaaaaaaac

SEQ ID NO: 3153087 - RNA, 15 nt, Respiratory syncytial virus
uauuaacucaaacaa

SEQ ID NO: 3153088 - RNA, 18 nt, Respiratory syncytial virus
agagaugcgggauaucau

SEQ ID NO: 3153089 - RNA, 14 nt, Respiratory syncytial virus
caacaauccaaccu

SEQ ID NO: 3153090 - RNA, 17 nt, Respiratory syncytial virus
gaucuaguacucaaaua

SEQ ID NO: 3153091 - RNA, 22 nt, Respiratory syncytial virus
ggacugcuccuauacugcaagg

SEQ ID NO: 3153092 - RNA, 14 nt, Respiratory syncytial virus
aauaaccaaauuag

SEQ ID NO: 3153093 - RNA, 11 nt, Respiratory syncytial virus
aaccaaacauc

SEQ ID NO: 3153094 - RNA, 21 nt, Respiratory syncytial virus
caaggaccaacgcaccaccaa

SEQ ID NO: 3153095 - RNA, 19 nt, Respiratory syncytial virus
uuaaaaucugaacuucauc

SEQ ID NO: 3153096 - RNA, 16 nt, Respiratory syncytial virus
gaaagaaaugaaauuu

SEQ ID NO: 3153097 - RNA, 23 nt, Respiratory syncytial virus
uaucaacuagcaaaucaauguca

SEQ ID NO: 3153098 - RNA, 15 nt, Respiratory syncytial virus
auaacaaugaacuaa

SEQ ID NO: 3153099 - RNA, 21 nt, Respiratory syncytial virus
auuaagccuacaaagcacacu

SEQ ID NO: 3153100 - RNA, 14 nt, Respiratory syncytial virus
aucauauauugaaa

SEQ ID NO: 3153101 - RNA, 18 nt, Respiratory syncytial virus
caucucacuuacauuauu

SEQ ID NO: 3153102 - RNA, 18 nt, Respiratory syncytial virus
ugaaauucaaaucaacau

SEQ ID NO: 3153103 - RNA, 15 nt, Respiratory syncytial virus
aguaaccuugcauuu

SEQ ID NO: 3153104 - RNA, 15 nt, Respiratory syncytial virus
ugccaucacaaaugc

SEQ ID NO: 3153105 - RNA, 16 nt, Respiratory syncytial virus
agcagacguauugaag

SEQ ID NO: 3153106 - RNA, 17 nt, Respiratory syncytial virus
auuaaauccaacaaugg

SEQ ID NO: 3153107 - RNA, 17 nt, Respiratory syncytial virus
acucaagaagugcagug

SEQ ID NO: 3153108 - RNA, 16 nt, Respiratory syncytial virus
auuuacuuaaaaagau

SEQ ID NO: 3153109 - RNA, 23 nt, Respiratory syncytial virus
aaauacauaaagccacaaaguca

SEQ ID NO: 3153110 - RNA, 22 nt, Respiratory syncytial virus
aaggcauguagucuaacaugcc

SEQ ID NO: 3153111 - RNA, 16 nt, Respiratory syncytial virus
uauucauaugaagaaa

SEQ ID NO: 3153112 - RNA, 18 nt, Respiratory syncytial virus
auauuucaaucaaaacaa

SEQ ID NO: 3153113 - RNA, 13 nt, Respiratory syncytial virus
augauacacucaa

SEQ ID NO: 3153114 - RNA, 20 nt, Respiratory syncytial virus
auacauuauauuauguaaau

SEQ ID NO: 3153115 - RNA, 17 nt, Respiratory syncytial virus
aaccacacuccauaguu

SEQ ID NO: 3153116 - RNA, 15 nt, Respiratory syncytial virus
uaacaccauuaguua

SEQ ID NO: 3153117 - RNA, 13 nt, Respiratory syncytial virus
gcaaauacaaaaa

SEQ ID NO: 3153118 - RNA, 22 nt, Respiratory syncytial virus
accaagcccacaaaaaaaccaa

SEQ ID NO: 3153119 - RNA, 23 nt, Respiratory syncytial virus
aauuuuuuaauaacuuuuaguga

SEQ ID NO: 3153120 - RNA, 13 nt, Respiratory syncytial virus
acacuaacacugu

SEQ ID NO: 3153121 - RNA, 20 nt, Respiratory syncytial virus
caacaaagaucaacuucugu

SEQ ID NO: 3153122 - RNA, 16 nt, Respiratory syncytial virus
uucccauagcuacaca

SEQ ID NO: 3153123 - RNA, 16 nt, Respiratory syncytial virus
gauaacaaugaagaag

SEQ ID NO: 3153124 - RNA, 18 nt, Respiratory syncytial virus
agaaaacuugaugaaaga

SEQ ID NO: 3153125 - RNA, 16 nt, Respiratory syncytial virus
augauagugacaauga

SEQ ID NO: 3153126 - RNA, 20 nt, Respiratory syncytial virus
cucaaaccacaaaaccaaag

SEQ ID NO: 3153127 - RNA, 15 nt, Respiratory syncytial virus
acucuacaaaacaaa

SEQ ID NO: 3153128 - RNA, 19 nt, Respiratory syncytial virus
augccaguguuacaaaaug

SEQ ID NO: 3153129 - RNA, 18 nt, Respiratory syncytial virus
uacauaaagccacaaagu

SEQ ID NO: 3153130 - RNA, 21 nt, Respiratory syncytial virus
agaaaauggugugauuaacua

SEQ ID NO: 3153131 - RNA, 22 nt, Respiratory syncytial virus
aaucaacucuggggcaaauaac

SEQ ID NO: 3153132 - RNA, 12 nt, Respiratory syncytial virus
aaagaacaacag

SEQ ID NO: 3153133 - RNA, 23 nt, Respiratory syncytial virus
aguguaguauuaggcaaugcugc

SEQ ID NO: 3153134 - RNA, 12 nt, Respiratory syncytial virus
acaaucugaaau

SEQ ID NO: 3153135 - RNA, 17 nt, Respiratory syncytial virus
ugggcagcaauucauug

SEQ ID NO: 3153136 - RNA, 22 nt, Respiratory syncytial virus
guucaucagaucuaguacucaa

SEQ ID NO: 3153137 - RNA, 16 nt, Respiratory syncytial virus
augugcagaaacacau

SEQ ID NO: 3153138 - RNA, 16 nt, Respiratory syncytial virus
gccaaaacaaaccacc

SEQ ID NO: 3153139 - RNA, 21 nt, Respiratory syncytial virus
aggaaauccaacuaaucacaa

SEQ ID NO: 3153140 - RNA, 23 nt, Respiratory syncytial virus
gcaaauucacaucaccuaaagau

SEQ ID NO: 3153141 - RNA, 16 nt, Respiratory syncytial virus
uacauagcauucacca

SEQ ID NO: 3153142 - RNA, 16 nt, Respiratory syncytial virus
caaauucacaucaccu

SEQ ID NO: 3153143 - RNA, 15 nt, Respiratory syncytial virus
ugucacuaacaccau

SEQ ID NO: 3153144 - RNA, 19 nt, Respiratory syncytial virus
auaaauaucaacuagcaaa

SEQ ID NO: 3153145 - RNA, 16 nt, Respiratory syncytial virus
aaugagacagaugaua

SEQ ID NO: 3153146 - RNA, 20 nt, Respiratory syncytial virus
augucuagauuaggaagaga

SEQ ID NO: 3153147 - RNA, 19 nt, Respiratory syncytial virus
agacuauaauaauaucacu

SEQ ID NO: 3153148 - RNA, 14 nt, Respiratory syncytial virus
caaugucacuaaca

SEQ ID NO: 3153149 - RNA, 16 nt, Respiratory syncytial virus
auuuauacacaaaauu

SEQ ID NO: 3153150 - RNA, 16 nt, Respiratory syncytial virus
ugaugaucacagacau

SEQ ID NO: 3153151 - RNA, 22 nt, Respiratory syncytial virus
gaacaagcccaauuaucaaaga

SEQ ID NO: 3153152 - RNA, 13 nt, Respiratory syncytial virus
cauaaaaaccaca

SEQ ID NO: 3153153 - RNA, 16 nt, Respiratory syncytial virus
uggauguaacaacaca

SEQ ID NO: 3153154 - RNA, 22 nt, Respiratory syncytial virus
uuuuaauaacuuuuagugaacu

SEQ ID NO: 3153155 - RNA, 15 nt, Respiratory syncytial virus
aaaacccaucuggag

SEQ ID NO: 3153156 - RNA, 14 nt, Respiratory syncytial virus
accuaccaccaagc

SEQ ID NO: 3153157 - RNA, 22 nt, Respiratory syncytial virus
aauuaaaaauaaucauaacaau

SEQ ID NO: 3153158 - RNA, 18 nt, Respiratory syncytial virus
uggaaauucugcuaaugu

SEQ ID NO: 3153159 - RNA, 19 nt, Respiratory syncytial virus
gcacaaagugggaagcacu

SEQ ID NO: 3153160 - RNA, 15 nt, Respiratory syncytial virus
ucaacuguuagugau

SEQ ID NO: 3153161 - RNA, 13 nt, Respiratory syncytial virus
aagucauuguuca

SEQ ID NO: 3153162 - RNA, 17 nt, Respiratory syncytial virus
gucauuguucaucagau

SEQ ID NO: 3153163 - RNA, 17 nt, Respiratory syncytial virus
caauauuuaucaaucau

SEQ ID NO: 3153164 - RNA, 13 nt, Respiratory syncytial virus
acuugaugaaaga

SEQ ID NO: 3153165 - RNA, 12 nt, Respiratory syncytial virus
ggcaaugcugcu

SEQ ID NO: 3153166 - RNA, 17 nt, Respiratory syncytial virus
aaaaccauaaaaaccac

SEQ ID NO: 3153167 - RNA, 20 nt, Respiratory syncytial virus
cuaaucauaaucuccaucau

SEQ ID NO: 3153168 - RNA, 17 nt, Respiratory syncytial virus
uaucucaagucaaugag

SEQ ID NO: 3153169 - RNA, 14 nt, Respiratory syncytial virus
cgauaauauaacag

SEQ ID NO: 3153170 - RNA, 16 nt, Respiratory syncytial virus
accuagaaaaagaaag

SEQ ID NO: 3153171 - RNA, 13 nt, Respiratory syncytial virus
aagucaaguugaa

SEQ ID NO: 3153172 - RNA, 13 nt, Respiratory syncytial virus
aucucaccaugca

SEQ ID NO: 3153173 - RNA, 19 nt, Respiratory syncytial virus
ccaaaaauuggguggagaa

SEQ ID NO: 3153174 - RNA, 17 nt, Respiratory syncytial virus
cuugauugaugcaauuc

SEQ ID NO: 3153175 - RNA, 20 nt, Respiratory syncytial virus
cuauugugaacaagcaaagc

SEQ ID NO: 3153176 - RNA, 21 nt, Respiratory syncytial virus
acaacaucuagguauuacuga

SEQ ID NO: 3153177 - RNA, 19 nt, Respiratory syncytial virus
aaaauggcucuuagcaaag

SEQ ID NO: 3153178 - RNA, 13 nt, Respiratory syncytial virus
ucauaucugcuca

SEQ ID NO: 3153179 - RNA, 16 nt, Respiratory syncytial virus
aaguaaccaaagaaag

SEQ ID NO: 3153180 - RNA, 15 nt, Respiratory syncytial virus
cacaaaccaccacca

SEQ ID NO: 3153181 - RNA, 18 nt, Respiratory syncytial virus
gauauuaaugggaaagaa

SEQ ID NO: 3153182 - RNA, 13 nt, Respiratory syncytial virus
uaauauaacagca

SEQ ID NO: 3153183 - RNA, 16 nt, Respiratory syncytial virus
guggcauugcuguauc

SEQ ID NO: 3153184 - RNA, 20 nt, Respiratory syncytial virus
aaucuagcuauucauaugaa

SEQ ID NO: 3153185 - RNA, 14 nt, Respiratory syncytial virus
agccacaaagucaa

SEQ ID NO: 3153186 - RNA, 22 nt, Respiratory syncytial virus
ugauaaguaccacuuaaauuua

SEQ ID NO: 3153187 - RNA, 15 nt, Respiratory syncytial virus
acccauccaaccaaa

SEQ ID NO: 3153188 - RNA, 13 nt, Respiratory syncytial virus
aaaugcaaacaug

SEQ ID NO: 3153189 - RNA, 23 nt, Respiratory syncytial virus
guugaaugauacacucaacaaag

SEQ ID NO: 3153190 - RNA, 18 nt, Respiratory syncytial virus
aauacaaugucuuagaaa

SEQ ID NO: 3153191 - RNA, 17 nt, Respiratory syncytial virus
agcugaaacauguaaag

SEQ ID NO: 3153192 - RNA, 16 nt, Respiratory syncytial virus
guaauuuaaaauuaag

SEQ ID NO: 3153193 - RNA, 13 nt, Respiratory syncytial virus
aaaaguuagauua

SEQ ID NO: 3153194 - RNA, 14 nt, Respiratory syncytial virus
uauaguaauuuaaa

SEQ ID NO: 3153195 - RNA, 18 nt, Respiratory syncytial virus
caaugucacuaacaccau

SEQ ID NO: 3153196 - RNA, 21 nt, Respiratory syncytial virus
gagcuaccaaauuccuagaau

SEQ ID NO: 3153197 - RNA, 14 nt, Respiratory syncytial virus
aaaucagaacugaa

SEQ ID NO: 3153198 - RNA, 20 nt, Respiratory syncytial virus
acacucccauaauauacaag

SEQ ID NO: 3153199 - RNA, 22 nt, Respiratory syncytial virus
agccacccggaaaaaauagaua

SEQ ID NO: 3153200 - RNA, 14 nt, Respiratory syncytial virus
uagaggcuaucaaa

SEQ ID NO: 3153201 - RNA, 16 nt, Respiratory syncytial virus
cugaaacuacaucaca

SEQ ID NO: 3153202 - RNA, 23 nt, Respiratory syncytial virus
acucaggaaugaggaaagugaaa

SEQ ID NO: 3153203 - RNA, 18 nt, Respiratory syncytial virus
acuacaguuaaagaucuc

SEQ ID NO: 3153204 - RNA, 20 nt, Respiratory syncytial virus
ucagagaaauugaacaaccu

SEQ ID NO: 3153205 - RNA, 13 nt, Respiratory syncytial virus
caaauggagccug

SEQ ID NO: 3153206 - RNA, 15 nt, Respiratory syncytial virus
ugaugcaauucaaaa

SEQ ID NO: 3153207 - RNA, 19 nt, Respiratory syncytial virus
gaagauaaaaauggggcaa

SEQ ID NO: 3153208 - RNA, 22 nt, Respiratory syncytial virus
caacgccaaaacaaaccaccaa

SEQ ID NO: 3153209 - RNA, 22 nt, Respiratory syncytial virus
agccuacaaagcacacucccau

SEQ ID NO: 3153210 - RNA, 18 nt, Respiratory syncytial virus
cuaguaaguuucaaagaa

SEQ ID NO: 3153211 - RNA, 20 nt, Respiratory syncytial virus
aacaaugccaguguuacaaa

SEQ ID NO: 3153212 - RNA, 11 nt, Respiratory syncytial virus
gugaacaaacu

SEQ ID NO: 3153213 - RNA, 13 nt, Respiratory syncytial virus
uauuucaaucaaa

SEQ ID NO: 3153214 - RNA, 19 nt, Respiratory syncytial virus
gaaaaccaccaccaagccc

SEQ ID NO: 3153215 - RNA, 19 nt, Respiratory syncytial virus
agaucccaagaaaaaagau

SEQ ID NO: 3153216 - RNA, 18 nt, Respiratory syncytial virus
ucauguaaaagcaaaugg

SEQ ID NO: 3153217 - RNA, 12 nt, Respiratory syncytial virus
ucacccauccaa

SEQ ID NO: 3153218 - RNA, 13 nt, Respiratory syncytial virus
ccaacccucugug

SEQ ID NO: 3153219 - RNA, 17 nt, Respiratory syncytial virus
gacuugauugaugcaau

SEQ ID NO: 3153220 - RNA, 17 nt, Respiratory syncytial virus
caaauaaaucaauucag

SEQ ID NO: 3153221 - RNA, 18 nt, Respiratory syncytial virus
gcuauucauaugaagaaa

SEQ ID NO: 3153222 - RNA, 19 nt, Respiratory syncytial virus
guauucaauuauaguuauu

SEQ ID NO: 3153223 - RNA, 19 nt, Respiratory syncytial virus
cuguagggaacaagcccaa

SEQ ID NO: 3153224 - RNA, 16 nt, Respiratory syncytial virus
gcacaaaucacauuau

SEQ ID NO: 3153225 - RNA, 20 nt, Respiratory syncytial virus
acccuccacucaaccuccuc

SEQ ID NO: 3153226 - RNA, 14 nt, Respiratory syncytial virus
uauuucaaucaaaa

SEQ ID NO: 3153227 - RNA, 12 nt, Respiratory syncytial virus
acuugaugaaag

SEQ ID NO: 3153228 - RNA, 17 nt, Respiratory syncytial virus
gugcuagcacaaaugcc

SEQ ID NO: 3153229 - RNA, 14 nt, Respiratory syncytial virus
agcauaucaaacau

SEQ ID NO: 3153230 - RNA, 13 nt, Respiratory syncytial virus
acuuauaauugca

SEQ ID NO: 3153231 - RNA, 17 nt, Respiratory syncytial virus
auaaucucaacuucacu

SEQ ID NO: 3153232 - RNA, 21 nt, Respiratory syncytial virus
uauaacaucaaauucaaccau

SEQ ID NO: 3153233 - RNA, 17 nt, Respiratory syncytial virus
cacacaacaccaacaga

SEQ ID NO: 3153234 - RNA, 16 nt, Respiratory syncytial virus
acauguccaaaaacaa

SEQ ID NO: 3153235 - RNA, 17 nt, Respiratory syncytial virus
aaggggaagugaacaaa

SEQ ID NO: 3153236 - RNA, 17 nt, Respiratory syncytial virus
aauguccuaaaaaauga

SEQ ID NO: 3153237 - RNA, 15 nt, Respiratory syncytial virus
auaucaacuagcaaa

SEQ ID NO: 3153238 - RNA, 16 nt, Respiratory syncytial virus
caucuggagccucaga

SEQ ID NO: 3153239 - RNA, 22 nt, Respiratory syncytial virus
agcauaugcugaacaacucaaa

SEQ ID NO: 3153240 - RNA, 14 nt, Respiratory syncytial virus
gacaucaaaaaacu

SEQ ID NO: 3153241 - RNA, 21 nt, Respiratory syncytial virus
gaugauauauacacaauauau

SEQ ID NO: 3153242 - RNA, 16 nt, Respiratory syncytial virus
caaaaauaaugauacu

SEQ ID NO: 3153243 - RNA, 23 nt, Respiratory syncytial virus
agcuggcauaugauguaaccaca

SEQ ID NO: 3153244 - RNA, 16 nt, Respiratory syncytial virus
cugucauccagcaaau

SEQ ID NO: 3153245 - RNA, 13 nt, Respiratory syncytial virus
aaauaaagaucug

SEQ ID NO: 3153246 - RNA, 14 nt, Respiratory syncytial virus
ccaaccaaacaucu

SEQ ID NO: 3153247 - RNA, 14 nt, Respiratory syncytial virus
uaacaaugaagaag

SEQ ID NO: 3153248 - RNA, 15 nt, Respiratory syncytial virus
cugaaauaacaacuu

SEQ ID NO: 3153249 - RNA, 18 nt, Respiratory syncytial virus
caaccauggacacaacac

SEQ ID NO: 3153250 - RNA, 13 nt, Respiratory syncytial virus
ucaaaacaaccaa

SEQ ID NO: 3153251 - RNA, 14 nt, Respiratory syncytial virus
agcaacaauccaac

SEQ ID NO: 3153252 - RNA, 13 nt, Respiratory syncytial virus
ucaaggaaaauaa

SEQ ID NO: 3153253 - RNA, 15 nt, Respiratory syncytial virus
uggauguaacaacac

SEQ ID NO: 3153254 - RNA, 16 nt, Respiratory syncytial virus
cugcucaccaacaaua

SEQ ID NO: 3153255 - RNA, 21 nt, Respiratory syncytial virus
aaucauuggaggaaauccaac

SEQ ID NO: 3153256 - RNA, 22 nt, Respiratory syncytial virus
caaaggaaguaccuaccaccaa

SEQ ID NO: 3153257 - RNA, 17 nt, Respiratory syncytial virus
agaggcuaucaaacauc

SEQ ID NO: 3153258 - RNA, 16 nt, Respiratory syncytial virus
uaaauuccauacuaau

SEQ ID NO: 3153259 - RNA, 22 nt, Respiratory syncytial virus
ucaugcuauggcaaaacuaaau

SEQ ID NO: 3153260 - RNA, 18 nt, Respiratory syncytial virus
caacacaagagucacaca

SEQ ID NO: 3153261 - RNA, 15 nt, Respiratory syncytial virus
aauccaauuucacaa

SEQ ID NO: 3153262 - RNA, 17 nt, Respiratory syncytial virus
caccggcaaccaacaau

SEQ ID NO: 3153263 - RNA, 15 nt, Respiratory syncytial virus
gacauaagaugaaag

SEQ ID NO: 3153264 - RNA, 23 nt, Respiratory syncytial virus
auucauaugaagaaauaaaugau

SEQ ID NO: 3153265 - RNA, 18 nt, Respiratory syncytial virus
accacaucaacaucucac

SEQ ID NO: 3153266 - RNA, 13 nt, Respiratory syncytial virus
aacagcaagauua

SEQ ID NO: 3153267 - RNA, 22 nt, Respiratory syncytial virus
agcacuuauauguuaacaaaua

SEQ ID NO: 3153268 - RNA, 24 nt, Respiratory syncytial virus
uauaugaugcugcaaaagcauaug

SEQ ID NO: 3153269 - RNA, 17 nt, Respiratory syncytial virus
aauuuacuuaaaaagau

SEQ ID NO: 3153270 - RNA, 22 nt, Respiratory syncytial virus
cacuaacacuguauucaauuau

SEQ ID NO: 3153271 - RNA, 22 nt, Respiratory syncytial virus
agauaguaucauaucugucaac

SEQ ID NO: 3153272 - RNA, 23 nt, Respiratory syncytial virus
caaaaaaaugcuaaaagaaaugg

SEQ ID NO: 3153273 - RNA, 20 nt, Respiratory syncytial virus
gauauagaaguaaccaaaga

SEQ ID NO: 3153274 - RNA, 17 nt, Respiratory syncytial virus
cauauauugaaagcaac

SEQ ID NO: 3153275 - RNA, 22 nt, Respiratory syncytial virus
gacugaugaucacagacaugag

SEQ ID NO: 3153276 - RNA, 19 nt, Respiratory syncytial virus
cugaaauaacaacuucaug

SEQ ID NO: 3153277 - RNA, 19 nt, Respiratory syncytial virus
acucuugaagaaauuaaug

SEQ ID NO: 3153278 - RNA, 15 nt, Respiratory syncytial virus
gauaacaaugaagaa

SEQ ID NO: 3153279 - RNA, 15 nt, Respiratory syncytial virus
cacuguauucaauua

SEQ ID NO: 3153280 - RNA, 14 nt, Respiratory syncytial virus
uauaguuauuuaaa

SEQ ID NO: 3153281 - RNA, 18 nt, Respiratory syncytial virus
caugaauuucaacacaag

SEQ ID NO: 3153282 - RNA, 18 nt, Respiratory syncytial virus
aaaaauggggcaaauaaa

SEQ ID NO: 3153283 - RNA, 19 nt, Respiratory syncytial virus
uaaaacaauugaauaccag

SEQ ID NO: 3153284 - RNA, 13 nt, Respiratory syncytial virus
cuucacuucacca

SEQ ID NO: 3153285 - RNA, 23 nt, Respiratory syncytial virus
uagaguuacuauguauaaucaaa

SEQ ID NO: 3153286 - RNA, 18 nt, Respiratory syncytial virus
aaguuaauguccaacaau

SEQ ID NO: 3153287 - RNA, 19 nt, Respiratory syncytial virus
acaauauauauauuagugu

SEQ ID NO: 3153288 - RNA, 13 nt, Respiratory syncytial virus
cuucaccaucaua

SEQ ID NO: 3153289 - RNA, 16 nt, Respiratory syncytial virus
caaaagaacacacuau

SEQ ID NO: 3153290 - RNA, 13 nt, Respiratory syncytial virus
auccuacaaaaaa

SEQ ID NO: 3153291 - RNA, 21 nt, Respiratory syncytial virus
acaaguuaaaucuuaaaucua

SEQ ID NO: 3153292 - RNA, 14 nt, Respiratory syncytial virus
cuaauacacaugau

SEQ ID NO: 3153293 - RNA, 16 nt, Respiratory syncytial virus
acacaucgucaagaua

SEQ ID NO: 3153294 - RNA, 14 nt, Respiratory syncytial virus
uagcaaaucaaugu

SEQ ID NO: 3153295 - RNA, 15 nt, Respiratory syncytial virus
aauacaaaaauggcu

SEQ ID NO: 3153296 - RNA, 19 nt, Respiratory syncytial virus
ugccaauauuuaucaauca

SEQ ID NO: 3153297 - RNA, 17 nt, Respiratory syncytial virus
ucuggagccucagauca

SEQ ID NO: 3153298 - RNA, 20 nt, Respiratory syncytial virus
cauaaaaauacucagagaug

SEQ ID NO: 3153299 - RNA, 13 nt, Respiratory syncytial virus
auuaucaaagaaa

SEQ ID NO: 3153300 - RNA, 14 nt, Respiratory syncytial virus
auuaucaaagaaaa

SEQ ID NO: 3153301 - RNA, 16 nt, Respiratory syncytial virus
uaaucaaaagaacaca

SEQ ID NO: 3153302 - RNA, 18 nt, Respiratory syncytial virus
ucacauuauccauucugg

SEQ ID NO: 3153303 - RNA, 15 nt, Respiratory syncytial virus
cgauaguuauuuaaa

SEQ ID NO: 3153304 - RNA, 19 nt, Respiratory syncytial virus
auauaguaacaucaaaaaa

SEQ ID NO: 3153305 - RNA, 19 nt, Respiratory syncytial virus
cauuaccaagugaaguaaa

SEQ ID NO: 3153306 - RNA, 20 nt, Respiratory syncytial virus
cacccugugaaaucaaggca

SEQ ID NO: 3153307 - RNA, 22 nt, Reston Ebola virus (REBOV)
auuuacuugaaugcugaccacu

SEQ ID NO: 3153308 - RNA, 20 nt, Reston Ebola virus (REBOV)
uaacaauggcuaagauuuca

SEQ ID NO: 3153309 - RNA, 16 nt, Reston Ebola virus (REBOV)
ugagucccaccaggaa

SEQ ID NO: 3153310 - RNA, 18 nt, Reston Ebola virus (REBOV)
ucuauaagugauucuuaa

SEQ ID NO: 3153311 - RNA, 14 nt, Reston Ebola virus (REBOV)
cacaacagaacuga

SEQ ID NO: 3153312 - RNA, 19 nt, Reston Ebola virus (REBOV)
aguuaagaucaaaugcaaa

SEQ ID NO: 3153313 - RNA, 17 nt, Reston Ebola virus (REBOV)
auccccgaugacccagg

SEQ ID NO: 3153314 - RNA, 16 nt, Reston Ebola virus (REBOV)
ugcauaaucagaaugg

SEQ ID NO: 3153315 - RNA, 20 nt, Reston Ebola virus (REBOV)
ucucaggguuacucuaagga

SEQ ID NO: 3153316 - RNA, 20 nt, Reston Ebola virus (REBOV)
aaguaagguagcugauucac

SEQ ID NO: 3153317 - RNA, 21 nt, Reston Ebola virus (REBOV)
uuauucugcuaguaauuccga

SEQ ID NO: 3153318 - RNA, 18 nt, Reston Ebola virus (REBOV)
ugaggaagauuaagaaaa

SEQ ID NO: 3153319 - RNA, 14 nt, Reston Ebola virus (REBOV)
uccgauccaaggcu

SEQ ID NO: 3153320 - RNA, 15 nt, Reston Ebola virus (REBOV)
cuuuauuuuaauaac

SEQ ID NO: 3153321 - RNA, 15 nt, Reston Ebola virus (REBOV)
auuaauuaugcauuu

SEQ ID NO: 3153322 - RNA, 19 nt, Reston Ebola virus (REBOV)
guaauaugagugauaaugu

SEQ ID NO: 3153323 - RNA, 13 nt, Reston Ebola virus (REBOV)
uugccccaagucc

SEQ ID NO: 3153324 - RNA, 16 nt, Reston Ebola virus (REBOV)
agcaaucagaaauugg

SEQ ID NO: 3153325 - RNA, 16 nt, Reston Ebola virus (REBOV)
uagacugaaaaugcua

SEQ ID NO: 3153326 - RNA, 16 nt, Reston Ebola virus (REBOV)
agugauucuuaaucua

SEQ ID NO: 3153327 - RNA, 16 nt, Reston Ebola virus (REBOV)
aagcgagguugauaac

SEQ ID NO: 3153328 - RNA, 24 nt, Reston Ebola virus (REBOV)
uguggauugacccauucugcuuaa

SEQ ID NO: 3153329 - RNA, 15 nt, Reston Ebola virus (REBOV)
gcagcaaaccaggaa

SEQ ID NO: 3153330 - RNA, 16 nt, Reston Ebola virus (REBOV)
cuucaguuaaguaaca

SEQ ID NO: 3153331 - RNA, 16 nt, Reston Ebola virus (REBOV)
ugaagacuccccccca

SEQ ID NO: 3153332 - RNA, 21 nt, Reston Ebola virus (REBOV)
auagacuaaaaaucugauugu

SEQ ID NO: 3153333 - RNA, 12 nt, Reston Ebola virus (REBOV)
uaugaauugugc

SEQ ID NO: 3153334 - RNA, 15 nt, Reston Ebola virus (REBOV)
cuuaaaauaaguaca

SEQ ID NO: 3153335 - RNA, 20 nt, Reston Ebola virus (REBOV)
uccaaggcucgaacaacucc

SEQ ID NO: 3153336 - RNA, 24 nt, Reston Ebola virus (REBOV)
aggaaccagcccaggaagcgcagc

SEQ ID NO: 3153337 - RNA, 20 nt, Reston Ebola virus (REBOV)
aaaauauuacugaugaaauu

SEQ ID NO: 3153338 - RNA, 20 nt, Reston Ebola virus (REBOV)
uuugaucaaguaaucaugau

SEQ ID NO: 3153339 - RNA, 21 nt, Reston Ebola virus (REBOV)
uguaacuuuauuuuaauaaca

SEQ ID NO: 3153340 - RNA, 13 nt, Reston Ebola virus (REBOV)
cuaguaauuuuaa

SEQ ID NO: 3153341 - RNA, 12 nt, Reston Ebola virus (REBOV)
augacccaggac

SEQ ID NO: 3153342 - RNA, 18 nt, Reston Ebola virus (REBOV)
ugaacagccgaacaacac

SEQ ID NO: 3153343 - RNA, 14 nt, Reston Ebola virus (REBOV)
cuuuaaauaaugau

SEQ ID NO: 3153344 - RNA, 22 nt, Reston Ebola virus (REBOV)
aaauauaacaagugaugaagau

SEQ ID NO: 3153345 - RNA, 17 nt, Reston Ebola virus (REBOV)
acccaaugacaaccacc

SEQ ID NO: 3153346 - RNA, 20 nt, Reston Ebola virus (REBOV)
uuccauuuaguaauaaugau

SEQ ID NO: 3153347 - RNA, 15 nt, Reston Ebola virus (REBOV)
accaagugaacagcc

SEQ ID NO: 3153348 - RNA, 14 nt, Reston Ebola virus (REBOV)
ucuucaguuaagua

SEQ ID NO: 3153349 - RNA, 15 nt, Reston Ebola virus (REBOV)
aaauguaacccagau

SEQ ID NO: 3153350 - RNA, 22 nt, Reston Ebola virus (REBOV)
acaacuccgcccagagcccaca

SEQ ID NO: 3153351 - RNA, 14 nt, Reston Ebola virus (REBOV)
uuaaauucuccuaa

SEQ ID NO: 3153352 - RNA, 14 nt, Reston Ebola virus (REBOV)
agagacggccaaca

SEQ ID NO: 3153353 - RNA, 23 nt, Reston Ebola virus (REBOV)
auaauuguuuaguaauaugagug

SEQ ID NO: 3153354 - RNA, 17 nt, Reston Ebola virus (REBOV)
auggcuaagauuucaau

SEQ ID NO: 3153355 - RNA, 14 nt, Reston Ebola virus (REBOV)
ucgggauagaacaa

SEQ ID NO: 3153356 - RNA, 20 nt, Reston Ebola virus (REBOV)
acgccagcacccacaacauc

SEQ ID NO: 3153357 - RNA, 12 nt, Reston Ebola virus (REBOV)
uucuucuucaac

SEQ ID NO: 3153358 - RNA, 10 nt, Reston Ebola virus (REBOV)
aaaccaggaa

SEQ ID NO: 3153359 - RNA, 13 nt, Reston Ebola virus (REBOV)
acagcagcaaacc

SEQ ID NO: 3153360 - RNA, 23 nt, Reston Ebola virus (REBOV)
uugacaauccccuaccagaccac

SEQ ID NO: 3153361 - RNA, 21 nt, Reston Ebola virus (REBOV)
gauauuucucuuaauaaugau

SEQ ID NO: 3153362 - RNA, 14 nt, Reston Ebola virus (REBOV)
agugauaauguaaa

SEQ ID NO: 3153363 - RNA, 21 nt, Reston Ebola virus (REBOV)
uaacauagacugaaaaugcua

SEQ ID NO: 3153364 - RNA, 21 nt, Reston Ebola virus (REBOV)
agguggucuuuuugaaaugga

SEQ ID NO: 3153365 - RNA, 19 nt, Reston Ebola virus (REBOV)
caagaccacgccagcaccc

SEQ ID NO: 3153366 - RNA, 22 nt, Reston Ebola virus (REBOV)
acaauguaccaagugaacagcc

SEQ ID NO: 3153367 - RNA, 14 nt, Reston Ebola virus (REBOV)
ccaucggcaagcaa

SEQ ID NO: 3153368 - RNA, 18 nt, Reston Ebola virus (REBOV)
cugaaaaugcuaagaaga

SEQ ID NO: 3153369 - RNA, 13 nt, Reston Ebola virus (REBOV)
aaaugauaaugau

SEQ ID NO: 3153370 - RNA, 21 nt, Reston Ebola virus (REBOV)
auccuaguauuuauuagaaug

SEQ ID NO: 3153371 - RNA, 15 nt, Reston Ebola virus (REBOV)
cccaggcucuucaau

SEQ ID NO: 3153372 - RNA, 17 nt, Reston Ebola virus (REBOV)
aauagcaaaguuaaauu

SEQ ID NO: 3153373 - RNA, 14 nt, Reston Ebola virus (REBOV)
uuaaucuaauuuuc

SEQ ID NO: 3153374 - RNA, 21 nt, Reston Ebola virus (REBOV)
uagcucuuugaauuggaagau

SEQ ID NO: 3153375 - RNA, 22 nt, Reston Ebola virus (REBOV)
aauuuaauuaaacuucaaagug

SEQ ID NO: 3153376 - RNA, 12 nt, Reston Ebola virus (REBOV)
ugcgagauuucc

SEQ ID NO: 3153377 - RNA, 17 nt, Reston Ebola virus (REBOV)
uaugauauuucucuuaa

SEQ ID NO: 3153378 - RNA, 21 nt, Reston Ebola virus (REBOV)
augauuaauauauuaagaaaa

SEQ ID NO: 3153379 - RNA, 22 nt, Reston Ebola virus (REBOV)
ccacgccagcacccacaacauc

SEQ ID NO: 3153380 - RNA, 21 nt, Reston Ebola virus (REBOV)
gauccaaggcucgaacaacuc

SEQ ID NO: 3153381 - RNA, 15 nt, Reston Ebola virus (REBOV)
gaguuuuuuaaucua

SEQ ID NO: 3153382 - RNA, 15 nt, Reston Ebola virus (REBOV)
uucgagcuauuauuc

SEQ ID NO: 3153383 - RNA, 22 nt, Reston Ebola virus (REBOV)
gauuguauagaauuauaaaaga

SEQ ID NO: 3153384 - RNA, 16 nt, Reston Ebola virus (REBOV)
gauuggaguaaaagua

SEQ ID NO: 3153385 - RNA, 15 nt, Reston Ebola virus (REBOV)
acaugacuugaaugu

SEQ ID NO: 3153386 - RNA, 17 nt, Reston Ebola virus (REBOV)
uucggaccugcagcaga

SEQ ID NO: 3153387 - RNA, 23 nt, Reston Ebola virus (REBOV)
gauucacugagucccaccaggaa

SEQ ID NO: 3153388 - RNA, 12 nt, Reston Ebola virus (REBOV)
uauccaaauguu

SEQ ID NO: 3153389 - RNA, 16 nt, Reston Ebola virus (REBOV)
agaucauuccaaacuu

SEQ ID NO: 3153390 - RNA, 22 nt, Reston Ebola virus (REBOV)
aguccaaccaugacaagcgagg

SEQ ID NO: 3153391 - RNA, 18 nt, Reston Ebola virus (REBOV)
auuuagaguguaugaauu

SEQ ID NO: 3153392 - RNA, 20 nt, Reston Ebola virus (REBOV)
accaggaaccagcccaggaa

SEQ ID NO: 3153393 - RNA, 12 nt, Reston Ebola virus (REBOV)
caaaaauaaugu

SEQ ID NO: 3153394 - RNA, 14 nt, Reston Ebola virus (REBOV)
caaguaaucaugau

SEQ ID NO: 3153395 - RNA, 12 nt, Reston Ebola virus (REBOV)
caagcaauauuc

SEQ ID NO: 3153396 - RNA, 20 nt, Reston Ebola virus (REBOV)
ucgagcuauuauucugcuag

SEQ ID NO: 3153397 - RNA, 14 nt, Reston Ebola virus (REBOV)
accaggaaccagcc

SEQ ID NO: 3153398 - RNA, 16 nt, Reston Ebola virus (REBOV)
uacucuaaggagaaau

SEQ ID NO: 3153399 - RNA, 23 nt, Reston Ebola virus (REBOV)
cucaggguuacucuaaggagaaa

SEQ ID NO: 3153400 - RNA, 15 nt, Reston Ebola virus (REBOV)
gaauaagauaaugau

SEQ ID NO: 3153401 - RNA, 17 nt, Reston Ebola virus (REBOV)
aggcaagccacaaccuu

SEQ ID NO: 3153402 - RNA, 19 nt, Reston Ebola virus (REBOV)
acagguuucaccgcgaacc

SEQ ID NO: 3153403 - RNA, 17 nt, Reston Ebola virus (REBOV)
uugacgcuguugaugau

SEQ ID NO: 3153404 - RNA, 15 nt, Reston Ebola virus (REBOV)
ucuauucuaaucaga

SEQ ID NO: 3153405 - RNA, 14 nt, Reston Ebola virus (REBOV)
gcaauuaauaauau

SEQ ID NO: 3153406 - RNA, 18 nt, Reston Ebola virus (REBOV)
cugaggaagauuaagaaa

SEQ ID NO: 3153407 - RNA, 14 nt, Reston Ebola virus (REBOV)
acauuauaagaaug

SEQ ID NO: 3153408 - RNA, 19 nt, Reston Ebola virus (REBOV)
caguuccuaucuuuaaaua

SEQ ID NO: 3153409 - RNA, 19 nt, Reston Ebola virus (REBOV)
ucaaagugauuaaaugaua

SEQ ID NO: 3153410 - RNA, 19 nt, Reston Ebola virus (REBOV)
uagacuaaaaaucugauug

SEQ ID NO: 3153411 - RNA, 12 nt, Reston Ebola virus (REBOV)
uacugaugaaau

SEQ ID NO: 3153412 - RNA, 21 nt, Reston Ebola virus (REBOV)
cuagcuuuaguaguuaagauc

SEQ ID NO: 3153413 - RNA, 16 nt, Reston Ebola virus (REBOV)
aacaagugaugaagau

SEQ ID NO: 3153414 - RNA, 23 nt, Reston Ebola virus (REBOV)
gaacuauugacgcuguugaugau

SEQ ID NO: 3153415 - RNA, 14 nt, Reston Ebola virus (REBOV)
ccaacagcagcaaa

SEQ ID NO: 3153416 - RNA, 23 nt, Reston Ebola virus (REBOV)
gacaauggaucccggcuggaauu

SEQ ID NO: 3153417 - RNA, 18 nt, Reston Ebola virus (REBOV)
accaggaaccagcccagg

SEQ ID NO: 3153418 - RNA, 21 nt, Reston Ebola virus (REBOV)
augaaugagaauuaguugugg

SEQ ID NO: 3153419 - RNA, 15 nt, Reston Ebola virus (REBOV)
gaugacccaggaccc

SEQ ID NO: 3153420 - RNA, 17 nt, Reston Ebola virus (REBOV)
aggaaacaaaagcgauc

SEQ ID NO: 3153421 - RNA, 20 nt, Reston Ebola virus (REBOV)
uuaguaauaaugauucuuaa

SEQ ID NO: 3153422 - RNA, 15 nt, Reston Ebola virus (REBOV)
agcaauauucugaau

SEQ ID NO: 3153423 - RNA, 19 nt, Reston Ebola virus (REBOV)
agucaaaaauaaugucaau

SEQ ID NO: 3153424 - RNA, 14 nt, Reston Ebola virus (REBOV)
uagacugaaaaugc

SEQ ID NO: 3153425 - RNA, 20 nt, Reston Ebola virus (REBOV)
cugauuguauagaauuauaa

SEQ ID NO: 3153426 - RNA, 14 nt, Reston Ebola virus (REBOV)
gcuucuuugcuuga

SEQ ID NO: 3153427 - RNA, 12 nt, Reston Ebola virus (REBOV)
guuuuucugcuu

SEQ ID NO: 3153428 - RNA, 20 nt, Reston Ebola virus (REBOV)
agacuugaccgauucaucua

SEQ ID NO: 3153429 - RNA, 17 nt, Reston Ebola virus (REBOV)
cauuuaguaauaaugau

SEQ ID NO: 3153430 - RNA, 23 nt, Reston Ebola virus (REBOV)
aucuuaaaauaaguacaugaaug

SEQ ID NO: 3153431 - RNA, 22 nt, Reston Ebola virus (REBOV)
aacuauugacgcuguugaugau

SEQ ID NO: 3153432 - RNA, 19 nt, Reston Ebola virus (REBOV)
agccgaacaacacagcauc

SEQ ID NO: 3153433 - RNA, 15 nt, Reston Ebola virus (REBOV)
gagcccacagaccaa

SEQ ID NO: 3153434 - RNA, 20 nt, Reston Ebola virus (REBOV)
uccccgaugacccaggaccc

SEQ ID NO: 3153435 - RNA, 14 nt, Reston Ebola virus (REBOV)
ccagcccaggaagc

SEQ ID NO: 3153436 - RNA, 13 nt, Reston Ebola virus (REBOV)
cugagucccacca

SEQ ID NO: 3153437 - RNA, 12 nt, Reston Ebola virus (REBOV)
gagguauaacaa

SEQ ID NO: 3153438 - RNA, 22 nt, Reston Ebola virus (REBOV)
cagucuugaguaauaaucauuu

SEQ ID NO: 3153439 - RNA, 19 nt, Reston Ebola virus (REBOV)
aggguuacucuaaggagaa

SEQ ID NO: 3153440 - RNA, 15 nt, Reston Ebola virus (REBOV)
acauuauaagaaugu

SEQ ID NO: 3153441 - RNA, 20 nt, Reston Ebola virus (REBOV)
uugaugagggggcagcagua

SEQ ID NO: 3153442 - RNA, 22 nt, Reston Ebola virus (REBOV)
uauuacuuauugauaagaauac

SEQ ID NO: 3153443 - RNA, 14 nt, Reston Ebola virus (REBOV)
uccgcccagagccc

SEQ ID NO: 3153444 - RNA, 18 nt, Reston Ebola virus (REBOV)
gcuaguaauuuuaaucuc

SEQ ID NO: 3153445 - RNA, 18 nt, Human
gaaccccuggcuccaggc

SEQ ID NO: 3153446 - RNA, 22 nt, Human
gaaccccuggcuccaggccagg

SEQ ID NO: 3153447 - RNA, 15 nt, Human
gaacugagcuuggaa

SEQ ID NO: 3153448 - RNA, 16 nt, Human
gaacugagcuuggaag

SEQ ID NO: 3153449 - RNA, 21 nt, Human
gaacugagcuuggaagcuucu

SEQ ID NO: 3153450 - RNA, 22 nt, Human
gaacugagcuuggaagcuucug

SEQ ID NO: 3153451 - RNA, 14 nt, Human
gaacugagcuugga

SEQ ID NO: 3153452 - RNA, 19 nt, Human
gaaaacuuguauuaugugu

SEQ ID NO: 3153453 - RNA, 22 nt, Human
gaaaacuuguauuauguguguu

SEQ ID NO: 3153454 - RNA, 18 nt, Human
gaaaacuuguauuaugug

SEQ ID NO: 3153455 - RNA, 22 nt, Human
gaaaagaaaucuaugauuccag

SEQ ID NO: 3153456 - RNA, 20 nt, Human
gaaaauuauuuuguucauac

SEQ ID NO: 3153457 - RNA, 21 nt, Human
gaaaauuauuuuguucauaca

SEQ ID NO: 3153458 - RNA, 22 nt, Human
gaaaauuauuuuguucauacau

SEQ ID NO: 3153459 - RNA, 23 nt, Human
gaaaauuauuuuguucauacaua

SEQ ID NO: 3153460 - RNA, 11 nt, Human
gaaaugaaaaa

SEQ ID NO: 3153461 - RNA, 20 nt, Human
gaaaucuaugauuccaggug

SEQ ID NO: 3153462 - RNA, 18 nt, Human
gaaaucuaugauuccagg

SEQ ID NO: 3153463 - RNA, 17 nt, Human
cuucuaguucugccagg

SEQ ID NO: 3153464 - RNA, 18 nt, Human
cuucuaguucugccagga

SEQ ID NO: 3153465 - RNA, 16 nt, Human
cuucuaguucugccag

SEQ ID NO: 3153466 - RNA, 13 nt, Human
cuucucacauuua

SEQ ID NO: 3153467 - RNA, 20 nt, Human
cuucucacauuuauauuuuu

SEQ ID NO: 3153468 - RNA, 19 nt, Human
cuucuaguucugccaggag

SEQ ID NO: 3153469 - RNA, 20 nt, Human
cuugauuaagaucucagugg

SEQ ID NO: 3153470 - RNA, 13 nt, Human
cuuuguaaugaaa

SEQ ID NO: 3153471 - RNA, 16 nt, Human
cuuuguaaugaaaacc

SEQ ID NO: 3153472 - RNA, 14 nt, Human
cuuuguaaugaaaa

SEQ ID NO: 3153473 - RNA, 15 nt, Human
cuuuguaaugaaaac

SEQ ID NO: 3153474 - RNA, 14 nt, Human
cuuugaccuguugg

SEQ ID NO: 3153475 - RNA, 13 nt, Human
cuggacuuggagg

SEQ ID NO: 3153476 - RNA, 17 nt, Human
cugccugguccucacac

SEQ ID NO: 3153477 - RNA, 19 nt, Human
cugccugguccucacacuc

SEQ ID NO: 3153478 - RNA, 23 nt, Human
cugccugguccucacacucaccc

SEQ ID NO: 3153479 - RNA, 16 nt, Human
cugccugguccucaca

SEQ ID NO: 3153480 - RNA, 16 nt, Human
cuggggaugucucuca

SEQ ID NO: 3153481 - RNA, 15 nt, Human
cuggggccaggcugg

SEQ ID NO: 3153482 - RNA, 18 nt, Human
cugggaauaagugccagg

SEQ ID NO: 3153483 - RNA, 18 nt, Human
cuggccccugagaucucu

SEQ ID NO: 3153484 - RNA, 22 nt, Human
cuggccccugagaucucugcag

SEQ ID NO: 3153485 - RNA, 23 nt, Human
cuggccccugagaucucugcagg

SEQ ID NO: 3153486 - RNA, 20 nt, Human
cugugccuugucacgccaga

SEQ ID NO: 3153487 - RNA, 16 nt, Human
cugugccuuuugccau

SEQ ID NO: 3153488 - RNA, 15 nt, Human
cuuaggccagcacca

SEQ ID NO: 3153489 - RNA, 14 nt, Human
cuguuuaagagaca

SEQ ID NO: 3153490 - RNA, 12 nt, Human
cuguuuaagaga

SEQ ID NO: 3153491 - RNA, 14 nt, Human
gaugaugacuaugg

SEQ ID NO: 3153492 - RNA, 17 nt, Human
gccaagaggcugcagcc

SEQ ID NO: 3153493 - RNA, 18 nt, Human
gcauggcauauuuuucac

SEQ ID NO: 3153494 - RNA, 19 nt, Human
gccaacuauggccugugga

SEQ ID NO: 3153495 - RNA, 14 nt, Human
gccaacuauggccu

SEQ ID NO: 3153496 - RNA, 15 nt, Human
gccaacuauggccug

SEQ ID NO: 3153497 - RNA, 13 nt, Human
gccaagaggcugc

SEQ ID NO: 3153498 - RNA, 14 nt, Human
gccaagaggcugca

SEQ ID NO: 3153499 - RNA, 12 nt, Human
gccaagaggcug

SEQ ID NO: 3153500 - RNA, 18 nt, Human
gcauuucccuuccuuccu

SEQ ID NO: 3153501 - RNA, 15 nt, Human
gagcagugggccugg

SEQ ID NO: 3153502 - RNA, 17 nt, Human
gagcagugggccuggcc

SEQ ID NO: 3153503 - RNA, 18 nt, Human
gagcagugggccuggcca

SEQ ID NO: 3153504 - RNA, 20 nt, Human
gagcugugcaucagcuagaa

SEQ ID NO: 3153505 - RNA, 21 nt, Human
gagcgagacuugguuucaaaa

SEQ ID NO: 3153506 - RNA, 18 nt, Human
gagguggaauuauuuuaa

SEQ ID NO: 3153507 - RNA, 14 nt, Human
gaggcucuggagcc

SEQ ID NO: 3153508 - RNA, 19 nt, Human
gaggcucuggagcccacug

SEQ ID NO: 3153509 - RNA, 19 nt, Human
gaggcugcagccaggccac

SEQ ID NO: 3153510 - RNA, 18 nt, Human
gacaggggcaggaggaag

SEQ ID NO: 3153511 - RNA, 20 nt, Human
gacaggggcaggaggaaggg

SEQ ID NO: 3153512 - RNA, 22 nt, Human
gacagguuugggaccccuggug

SEQ ID NO: 3153513 - RNA, 19 nt, Human
gacagguuugggaccccug

SEQ ID NO: 3153514 - RNA, 15 nt, Human
gacuauggagcugag

SEQ ID NO: 3153515 - RNA, 15 nt, Human
gacccucaucuuucu

SEQ ID NO: 3153516 - RNA, 19 nt, Human
gacccucaucuuucuucca

SEQ ID NO: 3153517 - RNA, 20 nt, Human
gacccucaucuuucuuccaa

SEQ ID NO: 3153518 - RNA, 14 nt, Human
gacugugugcucag

SEQ ID NO: 3153519 - RNA, 16 nt, Human
gacugugugcucagga

SEQ ID NO: 3153520 - RNA, 17 nt, Human
gacugugugcucaggag

SEQ ID NO: 3153521 - RNA, 20 nt, Human
gacugugugcucaggagccc

SEQ ID NO: 3153522 - RNA, 20 nt, Human
ggcucagaggguguccugca

SEQ ID NO: 3153523 - RNA, 14 nt, Human
ggcucagagugggg

SEQ ID NO: 3153524 - RNA, 21 nt, Human
aaaagauuuucagaaaauauu

SEQ ID NO: 3153525 - RNA, 18 nt, Human
aaaagccaagaggcugca

SEQ ID NO: 3153526 - RNA, 14 nt, Human
aaaaauaacaauga

SEQ ID NO: 3153527 - RNA, 14 nt, Human
ggcugggucgcccu

SEQ ID NO: 3153528 - RNA, 17 nt, Human
ggcugggucgcccugga

SEQ ID NO: 3153529 - RNA, 20 nt, Human
ggcugggucgcccuggacug

SEQ ID NO: 3153530 - RNA, 12 nt, Human
ggcuucauacac

SEQ ID NO: 3153531 - RNA, 9 nt, Human
ggcuucaua

SEQ ID NO: 3153532 - RNA, 11 nt, Human
ggcuucauaca

SEQ ID NO: 3153533 - RNA, 17 nt, Human
gggacaggggcaggagg

SEQ ID NO: 3153534 - RNA, 18 nt, Human
gggacaggggcaggagga

SEQ ID NO: 3153535 - RNA, 22 nt, Human
gggacaccuaggcuaggguggg

SEQ ID NO: 3153536 - RNA, 21 nt, Human
ggccccugccucucugcaggu

SEQ ID NO: 3153537 - RNA, 17 nt, Human
ggccagucccugaggca

SEQ ID NO: 3153538 - RNA, 23 nt, Human
ggccagucccugaggcagguccc

SEQ ID NO: 3153539 - RNA, 15 nt, Human
ggcagggcugaggcc

SEQ ID NO: 3153540 - RNA, 17 nt, Human
aaaguugguaaaccuuu

SEQ ID NO: 3153541 - RNA, 16 nt, Human
aaaguugguaaaccuu

SEQ ID NO: 3153542 - RNA, 14 nt, Human
aaauaaaaauauug

SEQ ID NO: 3153543 - RNA, 20 nt, Human
aaaguuauugauaaguucau

SEQ ID NO: 3153544 - RNA, 20 nt, Human
guaauaggcguaacuaauuu

SEQ ID NO: 3153545 - RNA, 19 nt, Human
guaauagagcaaaauugau

SEQ ID NO: 3153546 - RNA, 22 nt, Human
guaauaacugugaaguuuacau

SEQ ID NO: 3153547 - RNA, 16 nt, Human
guaauaacugugaagu

SEQ ID NO: 3153548 - RNA, 15 nt, Human
guaauaacugugaag

SEQ ID NO: 3153549 - RNA, 20 nt, Human
guaauuuaaaauugugaugu

SEQ ID NO: 3153550 - RNA, 19 nt, Human
guaauuuaaaauugugaug

SEQ ID NO: 3153551 - RNA, 23 nt, Human
guaauuuaaaauugugauguguc

SEQ ID NO: 3153552 - RNA, 21 nt, Human
guaauccaagcaaaugugaau

SEQ ID NO: 3153553 - RNA, 15 nt, Human
guacauuuggagaca

SEQ ID NO: 3153554 - RNA, 20 nt, Human
guaccaagacuacuagggaa

SEQ ID NO: 3153555 - RNA, 23 nt, Human
guaccaagacuacuagggaaaug

SEQ ID NO: 3153556 - RNA, 15 nt, Human
aaauccacuuuaucu

SEQ ID NO: 3153557 - RNA, 14 nt, Human
aaauauuauguguu

SEQ ID NO: 3153558 - RNA, 14 nt, Human
aaaucagacuauga

SEQ ID NO: 3153559 - RNA, 21 nt, Human
aaaucagacuaugaaguuuuu

SEQ ID NO: 3153560 - RNA, 15 nt, Human
aaauauuauguguuu

SEQ ID NO: 3153561 - RNA, 14 nt, Human
guacuuaacuauuc

SEQ ID NO: 3153562 - RNA, 15 nt, Human
guagagccagagguc

SEQ ID NO: 3153563 - RNA, 17 nt, Human
ggggccgggggcagucu

SEQ ID NO: 3153564 - RNA, 18 nt, Human
aaacuaggugcauauuua

SEQ ID NO: 3153565 - RNA, 22 nt, Human
aaacuaggugcauauuuauaaa

SEQ ID NO: 3153566 - RNA, 18 nt, Human
aaaccuuuguuugcaucu

SEQ ID NO: 3153567 - RNA, 18 nt, Human
aaaccuuuuauauuuagu

SEQ ID NO: 3153568 - RNA, 13 nt, Human
gggucgcccugga

SEQ ID NO: 3153569 - RNA, 15 nt, Human
gggucgcccuggacu

SEQ ID NO: 3153570 - RNA, 18 nt, Human
gggggcgcggcugggagg

SEQ ID NO: 3153571 - RNA, 19 nt, Human
gggggugcugggccccugc

SEQ ID NO: 3153572 - RNA, 19 nt, Human
aaagagaugaugaaaauau

SEQ ID NO: 3153573 - RNA, 20 nt, Human
aaagagaugaugaaaauauu

SEQ ID NO: 3153574 - RNA, 22 nt, Human
aaagagaugaugaaaauauuua

SEQ ID NO: 3153575 - RNA, 22 nt, Human
aaagaccuuuggagcaaagcug

SEQ ID NO: 3153576 - RNA, 13 nt, Human
aaagacagugaaa

SEQ ID NO: 3153577 - RNA, 19 nt, Human
ggguggggggcuucauaca

SEQ ID NO: 3153578 - RNA, 18 nt, Human
ggguggggagagacgggc

SEQ ID NO: 3153579 - RNA, 17 nt, Human
ggguggggggcuucaua

SEQ ID NO: 3153580 - RNA, 13 nt, Human
ggguggggagaga

SEQ ID NO: 3153581 - RNA, 14 nt, Human
ggguggggagagac

SEQ ID NO: 3153582 - RNA, 16 nt, Human
aaacuuguauuaugug

SEQ ID NO: 3153583 - RNA, 19 nt, Human
aaacuuguaaauaaaggaa

SEQ ID NO: 3153584 - RNA, 14 nt, Human
aaagguaaaucaga

SEQ ID NO: 3153585 - RNA, 17 nt, Human
aaagggugaaaauuauu

SEQ ID NO: 3153586 - RNA, 20 nt, Human
aaagggacugagaaauuuau

SEQ ID NO: 3153587 - RNA, 14 nt, Human
ggucgcccuggacu

SEQ ID NO: 3153588 - RNA, 13 nt, Human
ggugaaaauuauu

SEQ ID NO: 3153589 - RNA, 14 nt, Human
ggugaaaauuauuu

SEQ ID NO: 3153590 - RNA, 22 nt, Human
ggugaaaauuauuuuguucaua

SEQ ID NO: 3153591 - RNA, 22 nt, Human
ggugcuucuaguucugccagga

SEQ ID NO: 3153592 - RNA, 15 nt, Human
gguggaauuauuuua

SEQ ID NO: 3153593 - RNA, 21 nt, Human
ggugcauauuuauaaaaauaa

SEQ ID NO: 3153594 - RNA, 11 nt, Human
ggugcugggcc

SEQ ID NO: 3153595 - RNA, 13 nt, Human
ggugcugggcccc

SEQ ID NO: 3153596 - RNA, 15 nt, Human
ggugcugggccccug

SEQ ID NO: 3153597 - RNA, 16 nt, Human
ggugcugggccccugc

SEQ ID NO: 3153598 - RNA, 20 nt, Human
ggaacugcugggcuuggcag

SEQ ID NO: 3153599 - RNA, 12 nt, Human
ggaagugugggu

SEQ ID NO: 3153600 - RNA, 22 nt, Human
ggaagugugggucugugugugu

SEQ ID NO: 3153601 - RNA, 21 nt, Human
ggaagugugggucugugugug

SEQ ID NO: 3153602 - RNA, 16 nt, Human
gcuucuaguucugcca

SEQ ID NO: 3153603 - RNA, 17 nt, Human
gcuucuaguucugccag

SEQ ID NO: 3153604 - RNA, 23 nt, Human
gcugggccccugccucucugcag

SEQ ID NO: 3153605 - RNA, 21 nt, Human
gcugggccccugccucucugc

SEQ ID NO: 3153606 - RNA, 22 nt, Human
gcugggccccugccucucugca

SEQ ID NO: 3153607 - RNA, 20 nt, Human
gcugggccccugccucucug

SEQ ID NO: 3153608 - RNA, 11 nt, Human
gccccugccag

SEQ ID NO: 3153609 - RNA, 16 nt, Human
gccccugccagacccc

SEQ ID NO: 3153610 - RNA, 20 nt, Human
gccccugccucucugcaggu

SEQ ID NO: 3153611 - RNA, 23 nt, Human
gccccugccucucugcagguccc

SEQ ID NO: 3153612 - RNA, 17 nt, Human
gccucgacacagagugg

SEQ ID NO: 3153613 - RNA, 23 nt, Human
gccuccauccuacccccugugcc

SEQ ID NO: 3153614 - RNA, 19 nt, Human
gccuggcgacagagcgaga

SEQ ID NO: 3153615 - RNA, 18 nt, Human
gcucccccuccaccugcu

SEQ ID NO: 3153616 - RNA, 17 nt, Human
gcucccccuccaccugc

SEQ ID NO: 3153617 - RNA, 14 nt, Human
gcuaugagggccuu

SEQ ID NO: 3153618 - RNA, 20 nt, Human
gcucaggaaccgaggcaggg

SEQ ID NO: 3153619 - RNA, 21 nt, Human
gcucaggaaccgaggcaggga

SEQ ID NO: 3153620 - RNA, 16 nt, Human
gcucaggaaccgaggc

SEQ ID NO: 3153621 - RNA, 19 nt, Human
gcucaggaaccgaggcagg

SEQ ID NO: 3153622 - RNA, 22 nt, Human
gcuaauucuuugaccuguuggg

SEQ ID NO: 3153623 - RNA, 18 nt, Human
cugacccucaucuuucuu

SEQ ID NO: 3153624 - RNA, 23 nt, Human
cugaggaagagggacuguucuuu

SEQ ID NO: 3153625 - RNA, 18 nt, Human
cugaggaagagggacugu

SEQ ID NO: 3153626 - RNA, 14 nt, Human
cugagcuuggaagc

SEQ ID NO: 3153627 - RNA, 20 nt, Human
cugagcuuggaagcuucugg

SEQ ID NO: 3153628 - RNA, 21 nt, Human
cugagcuuggaagcuucuggu

SEQ ID NO: 3153629 - RNA, 12 nt, Human
cugagcuuggaa

SEQ ID NO: 3153630 - RNA, 21 nt, Human
cugaggugggagauguggaaa

SEQ ID NO: 3153631 - RNA, 21 nt, Human
cugaguaaaaaagcugugugc

SEQ ID NO: 3153632 - RNA, 16 nt, Human
cuccuagccacccacc

SEQ ID NO: 3153633 - RNA, 20 nt, Human
cucucuugauuaagaucuca

SEQ ID NO: 3153634 - RNA, 23 nt, Human
cucaaagugacuauucaguuuuc

SEQ ID NO: 3153635 - RNA, 21 nt, Human
cucacuuaucccaagagaaug

SEQ ID NO: 3153636 - RNA, 12 nt, Human
cucagaauauug

SEQ ID NO: 3153637 - RNA, 20 nt, Human
cuacuagggaaaugccuuug

SEQ ID NO: 3153638 - RNA, 13 nt, Human
cuaguucugccag

SEQ ID NO: 3153639 - RNA, 15 nt, Human
cuaggguggggagag

SEQ ID NO: 3153640 - RNA, 14 nt, Human
cuaguucugccagg

SEQ ID NO: 3153641 - RNA, 15 nt, Human
cuaguucugccagga

SEQ ID NO: 3153642 - RNA, 16 nt, Human
cuaguucugccaggag

SEQ ID NO: 3153643 - RNA, 15 nt, Human
cuaggcuaggguggg

SEQ ID NO: 3153644 - RNA, 10 nt, Human
ccccugccag

SEQ ID NO: 3153645 - RNA, 14 nt, Human
ccauucuuucccaa

SEQ ID NO: 3153646 - RNA, 20 nt, Human
ccauucuuucccaacaccuc

SEQ ID NO: 3153647 - RNA, 12 nt, Human
ccauucuuuccc

SEQ ID NO: 3153648 - RNA, 15 nt, Human
ccagucccugaggca

SEQ ID NO: 3153649 - RNA, 23 nt, Human
ccagggggccagucccugaggca

SEQ ID NO: 3153650 - RNA, 15 nt, Human
ccuccuagccaccca

SEQ ID NO: 3153651 - RNA, 12 nt, Human
ccuaauaaagcu

SEQ ID NO: 3153652 - RNA, 16 nt, Human
ccuagccacccaccac

SEQ ID NO: 3153653 - RNA, 12 nt, Human
ccuagccaccca

SEQ ID NO: 3153654 - RNA, 21 nt, Human
ccugucucccuccucugcccg

SEQ ID NO: 3153655 - RNA, 18 nt, Human
ccuggugguggcucggga

SEQ ID NO: 3153656 - RNA, 21 nt, Human
ccuggugguggcucgggaggc

SEQ ID NO: 3153657 - RNA, 12 nt, Human
ccuggugguuca

SEQ ID NO: 3153658 - RNA, 13 nt, Human
ccuggugguucac

SEQ ID NO: 3153659 - RNA, 22 nt, Human
ccuggugguucacucuuggagc

SEQ ID NO: 3153660 - RNA, 18 nt, Human
ccugacccucaucuuucu

SEQ ID NO: 3153661 - RNA, 19 nt, Human
ccugacccucaucuuucuu

SEQ ID NO: 3153662 - RNA, 17 nt, Human
ccugagaucucugcagg

SEQ ID NO: 3153663 - RNA, 18 nt, Human
ccugagaucucugcagga

SEQ ID NO: 3153664 - RNA, 19 nt, Human
ccugaguuccuagccaccg

SEQ ID NO: 3153665 - RNA, 18 nt, Human
ccugaguuccuagccacc

SEQ ID NO: 3153666 - RNA, 20 nt, Human
ccugaguuccuagccaccgc

SEQ ID NO: 3153667 - RNA, 21 nt, Human
ccugaguuccuagccaccgcc

SEQ ID NO: 3153668 - RNA, 20 nt, Human
ccugccaucauguuuacaga

SEQ ID NO: 3153669 - RNA, 18 nt, Human
ccugccaucauguuuaca

SEQ ID NO: 3153670 - RNA, 14 nt, Human
ccugccucucugca

SEQ ID NO: 3153671 - RNA, 15 nt, Human
ccugccucucugcag

SEQ ID NO: 3153672 - RNA, 13 nt, Human
ccugccucucugc

SEQ ID NO: 3153673 - RNA, 19 nt, Human
cagaaaucuagaagacugu

SEQ ID NO: 3153674 - RNA, 16 nt, Human
cagaaaguuauugaua

SEQ ID NO: 3153675 - RNA, 11 nt, Human
cagaaaguuau

SEQ ID NO: 3153676 - RNA, 19 nt, Human
cacugggagaaaugaaaaa

SEQ ID NO: 3153677 - RNA, 22 nt, Human
cacuguuuugaaucucauaauu

SEQ ID NO: 3153678 - RNA, 20 nt, Human
auuaguacuccccuccuuga

SEQ ID NO: 3153679 - RNA, 14 nt, Human
auuguguugugaau

SEQ ID NO: 3153680 - RNA, 17 nt, Human
auuguguugugaauguu

SEQ ID NO: 3153681 - RNA, 16 nt, Human
auuuaugcauauuauu

SEQ ID NO: 3153682 - RNA, 22 nt, Human
auuuaugcauauuauuuuaugu

SEQ ID NO: 3153683 - RNA, 16 nt, Human
auuucauaugcuguau

SEQ ID NO: 3153684 - RNA, 13 nt, Human
caagaugguucua

SEQ ID NO: 3153685 - RNA, 16 nt, Human
caagaugguucuagca

SEQ ID NO: 3153686 - RNA, 18 nt, Human
caaagggugaaaauuauu

SEQ ID NO: 3153687 - RNA, 14 nt, Human
caaagguaaaucag

SEQ ID NO: 3153688 - RNA, 16 nt, Human
caaagucaagccacau

SEQ ID NO: 3153689 - RNA, 12 nt, Human
auuuuauaucuu

SEQ ID NO: 3153690 - RNA, 14 nt, Human
auuuuauaucuugu

SEQ ID NO: 3153691 - RNA, 16 nt, Human
auuuuauaucuuguag

SEQ ID NO: 3153692 - RNA, 21 nt, Human
caaaaggauaaugaauacuuu

SEQ ID NO: 3153693 - RNA, 14 nt, Human
caaaccaaauaaaa

SEQ ID NO: 3153694 - RNA, 15 nt, Human
caaaccaaauaaaaa

SEQ ID NO: 3153695 - RNA, 21 nt, Human
cagcagguccccagcuuuggc

SEQ ID NO: 3153696 - RNA, 18 nt, Human
cagucugagagaggccau

SEQ ID NO: 3153697 - RNA, 18 nt, Human
cagguuugggaccccugg

SEQ ID NO: 3153698 - RNA, 15 nt, Human
cagguuugggacccc

SEQ ID NO: 3153699 - RNA, 15 nt, Human
caggccugacucuca

SEQ ID NO: 3153700 - RNA, 15 nt, Human
caggagguggucugg

SEQ ID NO: 3153701 - RNA, 13 nt, Human
caggaggaagggg

SEQ ID NO: 3153702 - RNA, 12 nt, Human
caggaccccuga

SEQ ID NO: 3153703 - RNA, 14 nt, Human
caggaccccugagu

SEQ ID NO: 3153704 - RNA, 17 nt, Human
ccaccgccuccuacagc

SEQ ID NO: 3153705 - RNA, 21 nt, Human
cauuuggagacacaacuauuu

SEQ ID NO: 3153706 - RNA, 19 nt, Human
cauuguaaauaguauuuga

SEQ ID NO: 3153707 - RNA, 12 nt, Human
caugcacaaauu

SEQ ID NO: 3153708 - RNA, 13 nt, Human
cauaauuuauaca

SEQ ID NO: 3153709 - RNA, 20 nt, Human
cauaauuuauacaggucaua

SEQ ID NO: 3153710 - RNA, 21 nt, Human
cauauuauuuuauguugcaua

SEQ ID NO: 3153711 - RNA, 19 nt, Human
cauccauggggcugauugu

SEQ ID NO: 3153712 - RNA, 20 nt, Human
aaugaauacuuuauaaagga

SEQ ID NO: 3153713 - RNA, 17 nt, Human
uaauguaauaacuguga

SEQ ID NO: 3153714 - RNA, 15 nt, Human
uaauguaagacaaau

SEQ ID NO: 3153715 - RNA, 18 nt, Human
uaauacuugcuuuggaaa

SEQ ID NO: 3153716 - RNA, 18 nt, Human
uaaucagugugucuaaau

SEQ ID NO: 3153717 - RNA, 17 nt, Human
uaaucagugugucuaaa

SEQ ID NO: 3153718 - RNA, 22 nt, Human
uaauccaagcaaaugugaauca

SEQ ID NO: 3153719 - RNA, 17 nt, Human
uaaucuuuaauuuuaca

SEQ ID NO: 3153720 - RNA, 13 nt, Human
uaauucauguugc

SEQ ID NO: 3153721 - RNA, 13 nt, Human
aauguaagacaaa

SEQ ID NO: 3153722 - RNA, 19 nt, Human
uacauaaguaauucaagaa

SEQ ID NO: 3153723 - RNA, 17 nt, Human
uacauaaguaauucaag

SEQ ID NO: 3153724 - RNA, 16 nt, Human
uacauaaguaauucaa

SEQ ID NO: 3153725 - RNA, 15 nt, Human
uacauaaguaauuca

SEQ ID NO: 3153726 - RNA, 15 nt, Human
aauguaugcuucaua

SEQ ID NO: 3153727 - RNA, 16 nt, Human
aauguaugcuucauac

SEQ ID NO: 3153728 - RNA, 12 nt, Human
aauguagagggg

SEQ ID NO: 3153729 - RNA, 19 nt, Human
aaugugaacagcggcugga

SEQ ID NO: 3153730 - RNA, 19 nt, Human
aauuaacaugaauauuuag

SEQ ID NO: 3153731 - RNA, 22 nt, Human
aauuaaauuuugaguucuacau

SEQ ID NO: 3153732 - RNA, 17 nt, Human
uacauguacugauuacu

SEQ ID NO: 3153733 - RNA, 20 nt, Human
uacauuguacgaagaguauu

SEQ ID NO: 3153734 - RNA, 22 nt, Human
uacauuguacgaagaguauuuu

SEQ ID NO: 3153735 - RNA, 23 nt, Human
uacauuguacgaagaguauuuuu

SEQ ID NO: 3153736 - RNA, 20 nt, Human
acaaaaaaauauauuuaaug

SEQ ID NO: 3153737 - RNA, 17 nt, Human
acaaaaaaauauauuua

SEQ ID NO: 3153738 - RNA, 13 nt, Human
acaaaaaaauaua

SEQ ID NO: 3153739 - RNA, 18 nt, Human
acaagcacuaaacaaaga

SEQ ID NO: 3153740 - RNA, 21 nt, Human
uagcaugucgucaaagcugaa

SEQ ID NO: 3153741 - RNA, 18 nt, Human
uagcaugucgucaaagcu

SEQ ID NO: 3153742 - RNA, 17 nt, Human
uagaucacgagaucaag

SEQ ID NO: 3153743 - RNA, 16 nt, Human
uagaucacgagaucaa

SEQ ID NO: 3153744 - RNA, 15 nt, Human
aauuugaaacacuuu

SEQ ID NO: 3153745 - RNA, 20 nt, Human
aauuugaaacacuuugcaua

SEQ ID NO: 3153746 - RNA, 14 nt, Human
aauuuaugugaugg

SEQ ID NO: 3153747 - RNA, 21 nt, Human
aauucuugccaaauauaaaua

SEQ ID NO: 3153748 - RNA, 21 nt, Human
aauucuugaaggaaaaugaua

SEQ ID NO: 3153749 - RNA, 16 nt, Human
aauucuugaaggaaaa

SEQ ID NO: 3153750 - RNA, 15 nt, Human
aauucuugaaggaaa

SEQ ID NO: 3153751 - RNA, 22 nt, Human
aauucuuugaccuguugggagu

SEQ ID NO: 3153752 - RNA, 18 nt, Human
aauucuuugaccuguugg

SEQ ID NO: 3153753 - RNA, 19 nt, Human
uauuuaguguucauaaaua

SEQ ID NO: 3153754 - RNA, 19 nt, Human
uauuuaaugauaaguaaau

SEQ ID NO: 3153755 - RNA, 14 nt, Human
uauuuaauucaugu

SEQ ID NO: 3153756 - RNA, 19 nt, Human
acaguucggugagcuacaa

SEQ ID NO: 3153757 - RNA, 22 nt, Human
acaguucggugagcuacaaaug

SEQ ID NO: 3153758 - RNA, 23 nt, Human
acaguucggugagcuacaaaugc

SEQ ID NO: 3153759 - RNA, 11 nt, Human
acaguguuccg

SEQ ID NO: 3153760 - RNA, 20 nt, Human
acagugaaagaaaauaacaa

SEQ ID NO: 3153761 - RNA, 14 nt, Human
uauucauaauuauu

SEQ ID NO: 3153762 - RNA, 16 nt, Human
uauucaggagaguaga

SEQ ID NO: 3153763 - RNA, 23 nt, Human
uauguguguguguuguguguggg

SEQ ID NO: 3153764 - RNA, 11 nt, Human
uaugugugugu

SEQ ID NO: 3153765 - RNA, 22 nt, Human
uauguguguguguugugugugg

SEQ ID NO: 3153766 - RNA, 14 nt, Human
uauguguguguguu

SEQ ID NO: 3153767 - RNA, 14 nt, Human
uauauuuacaaaug

SEQ ID NO: 3153768 - RNA, 15 nt, Human
uauauuuacaaaugg

SEQ ID NO: 3153769 - RNA, 21 nt, Human
acagacacucccacuuggcau

SEQ ID NO: 3153770 - RNA, 16 nt, Human
uauauugauccagaaa

SEQ ID NO: 3153771 - RNA, 14 nt, Human
uaucuaguaugaaa

SEQ ID NO: 3153772 - RNA, 16 nt, Human
uaucuaguaugaaauu

SEQ ID NO: 3153773 - RNA, 17 nt, Human
uaucuaguaugaaauua

SEQ ID NO: 3153774 - RNA, 22 nt, Human
acagaguggacuguucccugag

SEQ ID NO: 3153775 - RNA, 13 nt, Human
acagcccaccugg

SEQ ID NO: 3153776 - RNA, 18 nt, Human
uaugagcuuccuucugug

SEQ ID NO: 3153777 - RNA, 15 nt, Human
uaucuugaauaaugu

SEQ ID NO: 3153778 - RNA, 21 nt, Human
uaugagcuuccuucugugaaa

SEQ ID NO: 3153779 - RNA, 22 nt, Human
uauggccugugagcuaggaauu

SEQ ID NO: 3153780 - RNA, 14 nt, Human
uauggccuguggau

SEQ ID NO: 3153781 - RNA, 12 nt, Human
acagccuggcug

SEQ ID NO: 3153782 - RNA, 19 nt, Human
uauggggauagaugugugg

SEQ ID NO: 3153783 - RNA, 18 nt, Human
uauggggauagaugugug

SEQ ID NO: 3153784 - RNA, 17 nt, Human
uauggggauagaugugu

SEQ ID NO: 3153785 - RNA, 14 nt, Human
uauaaaagccuguu

SEQ ID NO: 3153786 - RNA, 17 nt, Human
uauaaaagccuguuuaa

SEQ ID NO: 3153787 - RNA, 12 nt, Human
uauaaaagccug

SEQ ID NO: 3153788 - RNA, 14 nt, Human
uaguucugccagga

SEQ ID NO: 3153789 - RNA, 13 nt, Human
uaguucugccagg

SEQ ID NO: 3153790 - RNA, 16 nt, Human
uauauccuuucuaaca

SEQ ID NO: 3153791 - RNA, 13 nt, Human
uauauaucaaaua

SEQ ID NO: 3153792 - RNA, 23 nt, Human
acaccuaggcuaggguggggaga

SEQ ID NO: 3153793 - RNA, 20 nt, Human
acaccuaggcuagggugggg

SEQ ID NO: 3153794 - RNA, 15 nt, Human
aagaugcaauguaga

SEQ ID NO: 3153795 - RNA, 14 nt, Human
aagcaaaugugaau

SEQ ID NO: 3153796 - RNA, 13 nt, Human
aagcaaaugugaa

SEQ ID NO: 3153797 - RNA, 20 nt, Human
gugguucacucuuggagccu

SEQ ID NO: 3153798 - RNA, 13 nt, Human
guguucugugaua

SEQ ID NO: 3153799 - RNA, 14 nt, Human
guguguguaugugg

SEQ ID NO: 3153800 - RNA, 17 nt, Human
guguguguugugugugg

SEQ ID NO: 3153801 - RNA, 16 nt, Human
gugugugggagugugu

SEQ ID NO: 3153802 - RNA, 13 nt, Human
guguguguaugug

SEQ ID NO: 3153803 - RNA, 20 nt, Human
aagagaugaugaaaauauuu

SEQ ID NO: 3153804 - RNA, 20 nt, Human
guggguagaucacgagauca

SEQ ID NO: 3153805 - RNA, 14 nt, Human
gugggggucugugu

SEQ ID NO: 3153806 - RNA, 16 nt, Human
gugggggucugugugu

SEQ ID NO: 3153807 - RNA, 15 nt, Human
gugggggucugugug

SEQ ID NO: 3153808 - RNA, 18 nt, Human
guggggggggugcugggc

SEQ ID NO: 3153809 - RNA, 17 nt, Human
guggaagagggcugcaa

SEQ ID NO: 3153810 - RNA, 14 nt, Human
guggaagagggcug

SEQ ID NO: 3153811 - RNA, 20 nt, Human
guggaauuauuuuaaaagau

SEQ ID NO: 3153812 - RNA, 19 nt, Human
gugcugggccccugccucu

SEQ ID NO: 3153813 - RNA, 16 nt, Human
gugcugggccccugcc

SEQ ID NO: 3153814 - RNA, 15 nt, Human
aagaauauuugaaug

SEQ ID NO: 3153815 - RNA, 11 nt, Human
aagaauauuug

SEQ ID NO: 3153816 - RNA, 17 nt, Human
guggcacuggggcaggg

SEQ ID NO: 3153817 - RNA, 18 nt, Human
guggcacuggggcagggg

SEQ ID NO: 3153818 - RNA, 21 nt, Human
gugagguggaauuauuuuaaa

SEQ ID NO: 3153819 - RNA, 16 nt, Human
gugaagugaaugaaac

SEQ ID NO: 3153820 - RNA, 12 nt, Human
aacauaauuaaa

SEQ ID NO: 3153821 - RNA, 22 nt, Human
aacauuuguucuauagcuuuuc

SEQ ID NO: 3153822 - RNA, 14 nt, Human
gucgcccuggacug

SEQ ID NO: 3153823 - RNA, 15 nt, Human
guccugcaccggggc

SEQ ID NO: 3153824 - RNA, 19 nt, Human
guccugcaccggggccugg

SEQ ID NO: 3153825 - RNA, 20 nt, Human
guccugcaccggggccuggg

SEQ ID NO: 3153826 - RNA, 16 nt, Human
uaaagacuuuuaugau

SEQ ID NO: 3153827 - RNA, 19 nt, Human
uaaaccucaaaaugucuaa

SEQ ID NO: 3153828 - RNA, 18 nt, Human
uaaaccucaaaaugucua

SEQ ID NO: 3153829 - RNA, 19 nt, Human
uaaaauuuuuaaucuuuaa

SEQ ID NO: 3153830 - RNA, 17 nt, Human
uaaaauuuuuaaucuuu

SEQ ID NO: 3153831 - RNA, 19 nt, Human
aaguuuacauuguaaauag

SEQ ID NO: 3153832 - RNA, 18 nt, Human
aaguuuacauuguaaaua

SEQ ID NO: 3153833 - RNA, 22 nt, Human
aaguuauugauaaguucauaca

SEQ ID NO: 3153834 - RNA, 23 nt, Human
aaguuauugauaaguucauacau

SEQ ID NO: 3153835 - RNA, 12 nt, Human
aaguucauacau

SEQ ID NO: 3153836 - RNA, 13 nt, Human
aaguucauacauu

SEQ ID NO: 3153837 - RNA, 15 nt, Human
aaguucauacauugu

SEQ ID NO: 3153838 - RNA, 19 nt, Human
aaguuauugauaaguucau

SEQ ID NO: 3153839 - RNA, 20 nt, Human
aaguuauugauaaguucaua

SEQ ID NO: 3153840 - RNA, 17 nt, Human
guuuuuuuuuaaagacu

SEQ ID NO: 3153841 - RNA, 12 nt, Human
aauaaaaauaau

SEQ ID NO: 3153842 - RNA, 22 nt, Human
aauaaaaauauuguguugugaa

SEQ ID NO: 3153843 - RNA, 15 nt, Human
aauaacaauaaaaga

SEQ ID NO: 3153844 - RNA, 15 nt, Human
aauaacgauaaaaga

SEQ ID NO: 3153845 - RNA, 18 nt, Human
uaaauaguauuugagagu

SEQ ID NO: 3153846 - RNA, 20 nt, Human
uaaauguuuuuuuuuaaaga

SEQ ID NO: 3153847 - RNA, 23 nt, Human
uaacaaaaaaauauauuuaauga

SEQ ID NO: 3153848 - RNA, 20 nt, Human
uaacaaaaaaauauauuuaa

SEQ ID NO: 3153849 - RNA, 16 nt, Human
uaaauuuugaguucua

SEQ ID NO: 3153850 - RNA, 14 nt, Human
uaaauuuuauaucu

SEQ ID NO: 3153851 - RNA, 15 nt, Human
guuuuuuuuuaaaga

SEQ ID NO: 3153852 - RNA, 13 nt, Human
aaguauucuaaau

SEQ ID NO: 3153853 - RNA, 15 nt, Human
aaguauucuaaauuu

SEQ ID NO: 3153854 - RNA, 22 nt, Human
aaguaaaaacaaagaaauuaug

SEQ ID NO: 3153855 - RNA, 16 nt, Human
aaggaaaaaauaacaa

SEQ ID NO: 3153856 - RNA, 16 nt, Human
aagcuuuuaugugaaa

SEQ ID NO: 3153857 - RNA, 12 nt, Human
guguuuaugugu

SEQ ID NO: 3153858 - RNA, 16 nt, Human
guguuuaugugugugu

SEQ ID NO: 3153859 - RNA, 21 nt, Human
guugggagaaugucaguaugu

SEQ ID NO: 3153860 - RNA, 14 nt, Human
guugggagaauguc

SEQ ID NO: 3153861 - RNA, 14 nt, Human
aaggaucuucaucu

SEQ ID NO: 3153862 - RNA, 11 nt, Human
aaggauaaagu

SEQ ID NO: 3153863 - RNA, 21 nt, Human
aaggauaaaguugguaaaccu

SEQ ID NO: 3153864 - RNA, 23 nt, Human
aaggauaaaguugguaaaccuuu

SEQ ID NO: 3153865 - RNA, 12 nt, Human
aaggaaaaugau

SEQ ID NO: 3153866 - RNA, 14 nt, Human
aaggaaaaugauac

SEQ ID NO: 3153867 - RNA, 22 nt, Human
aaggagcaagucagaauagaaa

SEQ ID NO: 3153868 - RNA, 14 nt, Human
acugaggaucagag

SEQ ID NO: 3153869 - RNA, 13 nt, Human
acugagcuuggaa

SEQ ID NO: 3153870 - RNA, 16 nt, Human
acugagcuuggaagcu

SEQ ID NO: 3153871 - RNA, 12 nt, Human
acugagcuugga

SEQ ID NO: 3153872 - RNA, 17 nt, Human
acugagcuuggaagcuu

SEQ ID NO: 3153873 - RNA, 20 nt, Human
uccugcaccggggccugggc

SEQ ID NO: 3153874 - RNA, 21 nt, Human
uccugcaccggggccugggca

SEQ ID NO: 3153875 - RNA, 14 nt, Human
acuggggcaggggc

SEQ ID NO: 3153876 - RNA, 16 nt, Human
acuguaaggcaaucau

SEQ ID NO: 3153877 - RNA, 17 nt, Human
acugggagaaaugaaaa

SEQ ID NO: 3153878 - RNA, 12 nt, Human
acugggagccua

SEQ ID NO: 3153879 - RNA, 23 nt, Human
acugggagccuacccacccccag

SEQ ID NO: 3153880 - RNA, 20 nt, Human
acuguacagacagaaaaaac

SEQ ID NO: 3153881 - RNA, 22 nt, Human
ucgagaucccaacacugccagc

SEQ ID NO: 3153882 - RNA, 23 nt, Human
ucgagaucccaacacugccagca

SEQ ID NO: 3153883 - RNA, 12 nt, Human
ucgacacagagu

SEQ ID NO: 3153884 - RNA, 12 nt, Human
acuaaaagaucg

SEQ ID NO: 3153885 - RNA, 15 nt, Human
ucccagugaauucuu

SEQ ID NO: 3153886 - RNA, 22 nt, Human
acuaugaaguuuuuuuuauaca

SEQ ID NO: 3153887 - RNA, 11 nt, Human
uccucagcccc

SEQ ID NO: 3153888 - RNA, 21 nt, Human
acucuggagguuuguuuagaa

SEQ ID NO: 3153889 - RNA, 15 nt, Human
acucaugugacucuu

SEQ ID NO: 3153890 - RNA, 16 nt, Human
acucaugugacucuuu

SEQ ID NO: 3153891 - RNA, 17 nt, Human
acucaugugacucuuuc

SEQ ID NO: 3153892 - RNA, 16 nt, Human
acucaucuagguaaau

SEQ ID NO: 3153893 - RNA, 18 nt, Human
acucaucuagguaaauua

SEQ ID NO: 3153894 - RNA, 16 nt, Human
acccccaggaccccug

SEQ ID NO: 3153895 - RNA, 19 nt, Human
ucagccuggcuucaaauug

SEQ ID NO: 3153896 - RNA, 19 nt, Human
accccuggcuccaggccag

SEQ ID NO: 3153897 - RNA, 20 nt, Human
accccuggcuccaggccagg

SEQ ID NO: 3153898 - RNA, 22 nt, Human
accccuggcuccaggccagggg

SEQ ID NO: 3153899 - RNA, 22 nt, Human
ucagauuugccuuauuggcagc

SEQ ID NO: 3153900 - RNA, 22 nt, Human
acccagcuaugguucucucgca

SEQ ID NO: 3153901 - RNA, 16 nt, Human
ucagccccgcguggaa

SEQ ID NO: 3153902 - RNA, 17 nt, Human
ucaggaaccgaggcagg

SEQ ID NO: 3153903 - RNA, 18 nt, Human
ucaggaaccgaggcaggg

SEQ ID NO: 3153904 - RNA, 15 nt, Human
ucaggccgaaggagg

SEQ ID NO: 3153905 - RNA, 14 nt, Human
ucaggcccaaagcc

SEQ ID NO: 3153906 - RNA, 15 nt, Human
acccuccacucuccu

SEQ ID NO: 3153907 - RNA, 23 nt, Human
acccucccucuacugggagccua

SEQ ID NO: 3153908 - RNA, 19 nt, Human
acccacuugcuuuuaaaau

SEQ ID NO: 3153909 - RNA, 20 nt, Human
accagagaaaaagggagggg

SEQ ID NO: 3153910 - RNA, 18 nt, Human
accagagaaaaagggagg

SEQ ID NO: 3153911 - RNA, 19 nt, Human
ucauauuaauauauuucca

SEQ ID NO: 3153912 - RNA, 16 nt, Human
accgccuccuacagcc

SEQ ID NO: 3153913 - RNA, 21 nt, Human
ucauuggauucugagagcugu

SEQ ID NO: 3153914 - RNA, 22 nt, Human
accugaagcuaucguaaaauua

SEQ ID NO: 3153915 - RNA, 14 nt, Human
ucaugugaaaucau

SEQ ID NO: 3153916 - RNA, 22 nt, Human
ucaugauagaaggcuaugggga

SEQ ID NO: 3153917 - RNA, 17 nt, Human
accuuccaagagccuga

SEQ ID NO: 3153918 - RNA, 22 nt, Human
uccaccaagccuggucagccca

SEQ ID NO: 3153919 - RNA, 23 nt, Human
uccaccaagccuggucagcccaa

SEQ ID NO: 3153920 - RNA, 18 nt, Human
uccaccaagccuggucag

SEQ ID NO: 3153921 - RNA, 18 nt, Human
accugaauaaagaaugaa

SEQ ID NO: 3153922 - RNA, 23 nt, Human
uccaaagucucuggaauuugaaa

SEQ ID NO: 3153923 - RNA, 22 nt, Human
acuuuuuuuuuuuaagaguaaa

SEQ ID NO: 3153924 - RNA, 14 nt, Human
acuuuuggcauuuu

SEQ ID NO: 3153925 - RNA, 12 nt, Human
agaaaacagaaa

SEQ ID NO: 3153926 - RNA, 16 nt, Human
agaaaacagaaaacaa

SEQ ID NO: 3153927 - RNA, 12 nt, Human
ucuggauuauau

SEQ ID NO: 3153928 - RNA, 18 nt, Human
ucuggauuauauuaugaa

SEQ ID NO: 3153929 - RNA, 11 nt, Human
ucuggcccuau

SEQ ID NO: 3153930 - RNA, 20 nt, Human
agaauugucuuucugucucu

SEQ ID NO: 3153931 - RNA, 14 nt, Human
ucuugaugccuggc

SEQ ID NO: 3153932 - RNA, 20 nt, Human
ucuugaugccuggcggggug

SEQ ID NO: 3153933 - RNA, 13 nt, Human
ucuuggagccugc

SEQ ID NO: 3153934 - RNA, 14 nt, Human
ucuuggagccugca

SEQ ID NO: 3153935 - RNA, 12 nt, Human
ucuuggagccug

SEQ ID NO: 3153936 - RNA, 15 nt, Human
ucuuggagccugcag

SEQ ID NO: 3153937 - RNA, 18 nt, Human
ucuuggagccugcagagc

SEQ ID NO: 3153938 - RNA, 19 nt, Human
ucuuggagccugcagagcu

SEQ ID NO: 3153939 - RNA, 22 nt, Human
agagaaugaaauugcugaaaga

SEQ ID NO: 3153940 - RNA, 14 nt, Human
agacuuaucaacau

SEQ ID NO: 3153941 - RNA, 18 nt, Human
ugaagguggaaauaaacu

SEQ ID NO: 3153942 - RNA, 19 nt, Human
agauaaucagugugucuaa

SEQ ID NO: 3153943 - RNA, 15 nt, Human
agaucaagagaucaa

SEQ ID NO: 3153944 - RNA, 22 nt, Human
ugaacuuguaaaggaauuuaaa

SEQ ID NO: 3153945 - RNA, 13 nt, Human
ucuuuguaaugaa

SEQ ID NO: 3153946 - RNA, 15 nt, Human
ucuuuguaaugaaaa

SEQ ID NO: 3153947 - RNA, 12 nt, Human
ucuuuguaauga

SEQ ID NO: 3153948 - RNA, 21 nt, Human
agaggcgcaugaauuugugaa

SEQ ID NO: 3153949 - RNA, 24 nt, Human
agaggcaccacuaaaagaucgcag

SEQ ID NO: 3153950 - RNA, 14 nt, Human
agauuuaugcauau

SEQ ID NO: 3153951 - RNA, 12 nt, Human
agauuuucagaa

SEQ ID NO: 3153952 - RNA, 17 nt, Human
agauuuucagaaaauau

SEQ ID NO: 3153953 - RNA, 18 nt, Human
ugacucacuuaucccaag

SEQ ID NO: 3153954 - RNA, 15 nt, Human
agauguguucacaau

SEQ ID NO: 3153955 - RNA, 18 nt, Human
agauguguucacaaugga

SEQ ID NO: 3153956 - RNA, 14 nt, Human
agaucgcaguuugc

SEQ ID NO: 3153957 - RNA, 15 nt, Human
agaucgcaguuugcc

SEQ ID NO: 3153958 - RNA, 12 nt, Human
agaucauuguga

SEQ ID NO: 3153959 - RNA, 21 nt, Human
agaucauugugaaauuauuca

SEQ ID NO: 3153960 - RNA, 17 nt, Human
ugacagguuugggaccc

SEQ ID NO: 3153961 - RNA, 15 nt, Human
agcagaaaucuagaa

SEQ ID NO: 3153962 - RNA, 16 nt, Human
ugagcuacaaaugcau

SEQ ID NO: 3153963 - RNA, 14 nt, Human
ugagcuaggaauug

SEQ ID NO: 3153964 - RNA, 13 nt, Human
ugagcuacaaaug

SEQ ID NO: 3153965 - RNA, 14 nt, Human
ugagcuacaaaugc

SEQ ID NO: 3153966 - RNA, 17 nt, Human
ugaggaagagggacugu

SEQ ID NO: 3153967 - RNA, 22 nt, Human
ugagggugacuauggagcugag

SEQ ID NO: 3153968 - RNA, 21 nt, Human
agcagauggaaugcuguguua

SEQ ID NO: 3153969 - RNA, 17 nt, Human
aguuuaaauuguaauag

SEQ ID NO: 3153970 - RNA, 20 nt, Human
aguuuaaauuguaauaggcg

SEQ ID NO: 3153971 - RNA, 13 nt, Human
aguuuacauugua

SEQ ID NO: 3153972 - RNA, 17 nt, Human
aguuuacauuguaaaua

SEQ ID NO: 3153973 - RNA, 15 nt, Human
aguuuacauuguaaa

SEQ ID NO: 3153974 - RNA, 12 nt, Human
uuaaaaugagaa

SEQ ID NO: 3153975 - RNA, 19 nt, Human
uuaaaaugagaaaucuaaa

SEQ ID NO: 3153976 - RNA, 15 nt, Human
aguuuguugaaacac

SEQ ID NO: 3153977 - RNA, 20 nt, Human
uuaaauuuugaguucuacau

SEQ ID NO: 3153978 - RNA, 15 nt, Human
uuaaauuuugaguuc

SEQ ID NO: 3153979 - RNA, 13 nt, Human
uuaaucuuuaauu

SEQ ID NO: 3153980 - RNA, 17 nt, Human
uuaaucuuuaauuuuac

SEQ ID NO: 3153981 - RNA, 22 nt, Human
uuaagacgaaacauuuguucua

SEQ ID NO: 3153982 - RNA, 15 nt, Human
aguuuuuuuuauaca

SEQ ID NO: 3153983 - RNA, 19 nt, Human
auaaaagccuguuuaagag

SEQ ID NO: 3153984 - RNA, 20 nt, Human
auaaaagccuguuuaagaga

SEQ ID NO: 3153985 - RNA, 19 nt, Human
uuaagacgaaacauuuguu

SEQ ID NO: 3153986 - RNA, 23 nt, Human
uuacuguacagacagaaaaaacu

SEQ ID NO: 3153987 - RNA, 13 nt, Human
uuacaguguuccg

SEQ ID NO: 3153988 - RNA, 14 nt, Human
uuaguaaucauauu

SEQ ID NO: 3153989 - RNA, 13 nt, Human
uuaguaaucauau

SEQ ID NO: 3153990 - RNA, 21 nt, Human
uuauaaaaauaaaaaacacug

SEQ ID NO: 3153991 - RNA, 22 nt, Human
uuauaaaaauaaaaaacacugg

SEQ ID NO: 3153992 - RNA, 15 nt, Human
uuauaaaaauaaaaa

SEQ ID NO: 3153993 - RNA, 19 nt, Human
uuaguacuccccuccuuga

SEQ ID NO: 3153994 - RNA, 23 nt, Human
auaauucacauuguauucagagu

SEQ ID NO: 3153995 - RNA, 19 nt, Human
auaauuuauacaggucaua

SEQ ID NO: 3153996 - RNA, 21 nt, Human
auaauuuauacaggucauauu

SEQ ID NO: 3153997 - RNA, 17 nt, Human
auaauucagaaggaucu

SEQ ID NO: 3153998 - RNA, 14 nt, Human
auaauuuuaaaugu

SEQ ID NO: 3153999 - RNA, 12 nt, Human
auaauuuuaaau

SEQ ID NO: 3154000 - RNA, 13 nt, Human
auaauuuuaaaug

SEQ ID NO: 3154001 - RNA, 18 nt, Human
auaaucacaacccuucag

SEQ ID NO: 3154002 - RNA, 23 nt, Human
auacgcaacauaauuaaauuuug

SEQ ID NO: 3154003 - RNA, 21 nt, Human
auacaggaugaugacuaugga

SEQ ID NO: 3154004 - RNA, 12 nt, Human
uuauaaacuuuu

SEQ ID NO: 3154005 - RNA, 16 nt, Human
uuauaaacuuuuuucu

SEQ ID NO: 3154006 - RNA, 22 nt, Human
uuauaaacuuuuuucuuacugu

SEQ ID NO: 3154007 - RNA, 20 nt, Human
uuaugauacuugaaaauuaa

SEQ ID NO: 3154008 - RNA, 20 nt, Human
uuaugaagcuuuuaugugaa

SEQ ID NO: 3154009 - RNA, 10 nt, Human
uuaugugugu

SEQ ID NO: 3154010 - RNA, 14 nt, Human
uuaugugugugugu

SEQ ID NO: 3154011 - RNA, 12 nt, Human
uuaugugugugu

SEQ ID NO: 3154012 - RNA, 22 nt, Human
uuaugugccagauuuaugcaua

SEQ ID NO: 3154013 - RNA, 15 nt, Human
uuaugugaaacaugu

SEQ ID NO: 3154014 - RNA, 13 nt, Human
uuaugugaaacau

SEQ ID NO: 3154015 - RNA, 14 nt, Human
uuauuauauuuaca

SEQ ID NO: 3154016 - RNA, 15 nt, Human
uuauuauauuuacaa

SEQ ID NO: 3154017 - RNA, 12 nt, Human
uuauucauaauu

SEQ ID NO: 3154018 - RNA, 22 nt, Human
auagaauaaaauuuuuaaucuu

SEQ ID NO: 3154019 - RNA, 14 nt, Human
auagaauaaaauuu

SEQ ID NO: 3154020 - RNA, 19 nt, Human
auagaauaaaauuuuuaau

SEQ ID NO: 3154021 - RNA, 13 nt, Human
auagaaguaaaaa

SEQ ID NO: 3154022 - RNA, 19 nt, Human
auagaaggcuauggggaua

SEQ ID NO: 3154023 - RNA, 18 nt, Human
auagauaggucagugcaa

SEQ ID NO: 3154024 - RNA, 19 nt, Human
auagaguguacuuaacuau

SEQ ID NO: 3154025 - RNA, 14 nt, Human
auagaguguacuua

SEQ ID NO: 3154026 - RNA, 21 nt, Human
auagaguguacuuaacuauuc

SEQ ID NO: 3154027 - RNA, 22 nt, Human
auagagcaaaauugauguguuu

SEQ ID NO: 3154028 - RNA, 21 nt, Human
auagagcaaaauugauguguu

SEQ ID NO: 3154029 - RNA, 17 nt, Human
auagagcaaaauugaug

SEQ ID NO: 3154030 - RNA, 15 nt, Human
auagagcaaaauuga

SEQ ID NO: 3154031 - RNA, 11 nt, Human
auagaugugug

SEQ ID NO: 3154032 - RNA, 13 nt, Human
auagaugugugga

SEQ ID NO: 3154033 - RNA, 12 nt, Human
auagaugugugg

SEQ ID NO: 3154034 - RNA, 14 nt, Human
auagauguguggac

SEQ ID NO: 3154035 - RNA, 14 nt, Human
aguauuugugggga

SEQ ID NO: 3154036 - RNA, 16 nt, Human
aguccaucagccucca

SEQ ID NO: 3154037 - RNA, 14 nt, Human
aggugugcaagaga

SEQ ID NO: 3154038 - RNA, 13 nt, Human
aguaauagagcaa

SEQ ID NO: 3154039 - RNA, 16 nt, Human
aguaaaaacaaagaaa

SEQ ID NO: 3154040 - RNA, 23 nt, Human
aguaaaaacaaagaaauuaugug

SEQ ID NO: 3154041 - RNA, 19 nt, Human
aguacauuuggagacacaa

SEQ ID NO: 3154042 - RNA, 19 nt, Human
aguaauucaagaaaacaac

SEQ ID NO: 3154043 - RNA, 18 nt, Human
uguauauccuuucuaaca

SEQ ID NO: 3154044 - RNA, 20 nt, Human
uguagugauuuuuaugccac

SEQ ID NO: 3154045 - RNA, 16 nt, Human
aguacauuuggagaca

SEQ ID NO: 3154046 - RNA, 16 nt, Human
agucuuucacauuuaa

SEQ ID NO: 3154047 - RNA, 21 nt, Human
ugugcucaggagcccugggag

SEQ ID NO: 3154048 - RNA, 19 nt, Human
ugugcucuccaagcccagu

SEQ ID NO: 3154049 - RNA, 14 nt, Human
ugugcucuccaagc

SEQ ID NO: 3154050 - RNA, 20 nt, Human
ugugcucaggagcccuggga

SEQ ID NO: 3154051 - RNA, 21 nt, Human
uguggaucaaauccagccugc

SEQ ID NO: 3154052 - RNA, 21 nt, Human
agugauuuuuaugccaccuga

SEQ ID NO: 3154053 - RNA, 16 nt, Human
agugauuuuuaugcca

SEQ ID NO: 3154054 - RNA, 20 nt, Human
agugauuuuuaugccaccug

SEQ ID NO: 3154055 - RNA, 14 nt, Human
agugaggaugucug

SEQ ID NO: 3154056 - RNA, 18 nt, Human
agugccaggauggaauga

SEQ ID NO: 3154057 - RNA, 18 nt, Human
aguguguguuuuucauaa

SEQ ID NO: 3154058 - RNA, 21 nt, Human
aguguucauaaauaaaguuug

SEQ ID NO: 3154059 - RNA, 21 nt, Human
aguguuccgugguuaaacucg

SEQ ID NO: 3154060 - RNA, 15 nt, Human
uguugcauagaauaa

SEQ ID NO: 3154061 - RNA, 9 nt, Human
aguguguaa

SEQ ID NO: 3154062 - RNA, 16 nt, Human
aguguggcaguuuggc

SEQ ID NO: 3154063 - RNA, 17 nt, Human
aguguggcaguuuggca

SEQ ID NO: 3154064 - RNA, 18 nt, Human
uguguguuguguguggga

SEQ ID NO: 3154065 - RNA, 22 nt, Human
ugugucuaaauuugaauguuaa

SEQ ID NO: 3154066 - RNA, 19 nt, Human
ugugucuaaauuugaaugu

SEQ ID NO: 3154067 - RNA, 14 nt, Human
uguguaaaauguga

SEQ ID NO: 3154068 - RNA, 16 nt, Human
agugggguagguuggg

SEQ ID NO: 3154069 - RNA, 21 nt, Human
aguggacuguucccugaggug

SEQ ID NO: 3154070 - RNA, 22 nt, Human
uguguuaaguauguguaaaaug

SEQ ID NO: 3154071 - RNA, 23 nt, Human
uguuaagcagauggaaugcugug

SEQ ID NO: 3154072 - RNA, 17 nt, Human
uguuacaaauuguagaa

SEQ ID NO: 3154073 - RNA, 18 nt, Human
uguuacaaauuguagaag

SEQ ID NO: 3154074 - RNA, 14 nt, Human
uguuacaaauugua

SEQ ID NO: 3154075 - RNA, 15 nt, Human
ugggagaaaugaaaa

SEQ ID NO: 3154076 - RNA, 14 nt, Human
ugggaggcucugga

SEQ ID NO: 3154077 - RNA, 17 nt, Human
ugggaggcucuggagcc

SEQ ID NO: 3154078 - RNA, 23 nt, Human
ugggaggcucuggagcccacugu

SEQ ID NO: 3154079 - RNA, 16 nt, Human
ugggagaaaugaaaaa

SEQ ID NO: 3154080 - RNA, 16 nt, Human
ugggauuuggucaaca

SEQ ID NO: 3154081 - RNA, 20 nt, Human
aggcugggucgcccuggacu

SEQ ID NO: 3154082 - RNA, 21 nt, Human
aggcugggucgcccuggacug

SEQ ID NO: 3154083 - RNA, 10 nt, Human
aggcuggguc

SEQ ID NO: 3154084 - RNA, 15 nt, Human
aggcugggucgcccu

SEQ ID NO: 3154085 - RNA, 18 nt, Human
aggcugggucgcccugga

SEQ ID NO: 3154086 - RNA, 15 nt, Human
aggcuuuuuuaucau

SEQ ID NO: 3154087 - RNA, 18 nt, Human
aggcuuuuuuaucaugug

SEQ ID NO: 3154088 - RNA, 21 nt, Human
aggcuuuuuuaucaugugaaa

SEQ ID NO: 3154089 - RNA, 18 nt, Human
ugggaaacaaaaggauaa

SEQ ID NO: 3154090 - RNA, 20 nt, Human
uggcuguggccuaaccugcc

SEQ ID NO: 3154091 - RNA, 17 nt, Human
uggcuguggcauccaga

SEQ ID NO: 3154092 - RNA, 16 nt, Human
uggcuguggagugugg

SEQ ID NO: 3154093 - RNA, 15 nt, Human
uggcugcagagcagu

SEQ ID NO: 3154094 - RNA, 18 nt, Human
uggcugcagagcaguggg

SEQ ID NO: 3154095 - RNA, 22 nt, Human
uggcugcagagcagugggccug

SEQ ID NO: 3154096 - RNA, 16 nt, Human
uggagcccacuguacu

SEQ ID NO: 3154097 - RNA, 19 nt, Human
uggagcccacuguacuugc

SEQ ID NO: 3154098 - RNA, 23 nt, Human
uggagcccacuguacuugcucuu

SEQ ID NO: 3154099 - RNA, 16 nt, Human
uggagccugcagagcu

SEQ ID NO: 3154100 - RNA, 11 nt, Human
uggagccugca

SEQ ID NO: 3154101 - RNA, 16 nt, Human
aggcagguccccagac

SEQ ID NO: 3154102 - RNA, 12 nt, Human
aggcaggucccc

SEQ ID NO: 3154103 - RNA, 13 nt, Human
aggcaggucccca

SEQ ID NO: 3154104 - RNA, 14 nt, Human
aggcagguccccag

SEQ ID NO: 3154105 - RNA, 15 nt, Human
aggcagguccccaga

SEQ ID NO: 3154106 - RNA, 11 nt, Human
aggcagguccc

SEQ ID NO: 3154107 - RNA, 20 nt, Human
aggcaggaguuucguuuuca

SEQ ID NO: 3154108 - RNA, 14 nt, Human
uggaauuugaaaca

SEQ ID NO: 3154109 - RNA, 21 nt, Human
uggaacaagaugguucuagca

SEQ ID NO: 3154110 - RNA, 19 nt, Human
aggaguuucguuuucaaaa

SEQ ID NO: 3154111 - RNA, 14 nt, Human
uggaaguguggguc

SEQ ID NO: 3154112 - RNA, 13 nt, Human
uggaagugugggu

SEQ ID NO: 3154113 - RNA, 14 nt, Human
uggaagugcuaauu

SEQ ID NO: 3154114 - RNA, 20 nt, Human
uggaagugugggucugugug

SEQ ID NO: 3154115 - RNA, 18 nt, Human
aggcucagaggguguccu

SEQ ID NO: 3154116 - RNA, 19 nt, Human
aggcucagaggguguccug

SEQ ID NO: 3154117 - RNA, 20 nt, Human
aggcucagaggguguccugc

SEQ ID NO: 3154118 - RNA, 18 nt, Human
aggcgaagcguuguccuc

SEQ ID NO: 3154119 - RNA, 14 nt, Human
aggccauucuuucc

SEQ ID NO: 3154120 - RNA, 22 nt, Human
uggcacagccuggcuguggccu

SEQ ID NO: 3154121 - RNA, 21 nt, Human
uggcauccagagucccugccu

SEQ ID NO: 3154122 - RNA, 22 nt, Human
uggcauccagagucccugccug

SEQ ID NO: 3154123 - RNA, 20 nt, Human
uggcauccagagucccugcc

SEQ ID NO: 3154124 - RNA, 16 nt, Human
aggccugacucucagc

SEQ ID NO: 3154125 - RNA, 19 nt, Human
ugcucugugcccacccucc

SEQ ID NO: 3154126 - RNA, 22 nt, Human
aggaauuuuauuuuuuucugaa

SEQ ID NO: 3154127 - RNA, 20 nt, Human
aggaauuuuauuuuuuucug

SEQ ID NO: 3154128 - RNA, 23 nt, Human
aggaaaccaguuaggucucaaua

SEQ ID NO: 3154129 - RNA, 19 nt, Human
ugccucucugcaggucccu

SEQ ID NO: 3154130 - RNA, 20 nt, Human
ugccucucugcaggucccua

SEQ ID NO: 3154131 - RNA, 16 nt, Human
ugccucucugcagguc

SEQ ID NO: 3154132 - RNA, 18 nt, Human
ugccucucugcagguccc

SEQ ID NO: 3154133 - RNA, 17 nt, Human
agcuggggccaggcugg

SEQ ID NO: 3154134 - RNA, 15 nt, Human
agcuggggaugucuc

SEQ ID NO: 3154135 - RNA, 20 nt, Human
agcuggggccaggcuggguc

SEQ ID NO: 3154136 - RNA, 17 nt, Human
ugccuugucacgccaga

SEQ ID NO: 3154137 - RNA, 19 nt, Human
ugccuugugaaggaauuau

SEQ ID NO: 3154138 - RNA, 20 nt, Human
agcggcuggaauuggguggg

SEQ ID NO: 3154139 - RNA, 19 nt, Human
agcuacuaauuuuaaaaug

SEQ ID NO: 3154140 - RNA, 17 nt, Human
ugcaggucccuaauaaa

SEQ ID NO: 3154141 - RNA, 18 nt, Human
ugcaggucccuaauaaag

SEQ ID NO: 3154142 - RNA, 19 nt, Human
ugcaggucccuaauaaagc

SEQ ID NO: 3154143 - RNA, 20 nt, Human
ugcaggucccuaauaaagcu

SEQ ID NO: 3154144 - RNA, 15 nt, Human
ugcauaauggucaga

SEQ ID NO: 3154145 - RNA, 19 nt, Human
agccugacccucaucuuuc

SEQ ID NO: 3154146 - RNA, 19 nt, Human
agccugcaauuucauaugc

SEQ ID NO: 3154147 - RNA, 21 nt, Human
agccugcaauuucauaugcug

SEQ ID NO: 3154148 - RNA, 12 nt, Human
agccugcagagc

SEQ ID NO: 3154149 - RNA, 13 nt, Human
agccugcagagcu

SEQ ID NO: 3154150 - RNA, 14 nt, Human
agccugcagagcug

SEQ ID NO: 3154151 - RNA, 15 nt, Human
agccugcagagcugc

SEQ ID NO: 3154152 - RNA, 18 nt, Human
agccugccacucaggccc

SEQ ID NO: 3154153 - RNA, 18 nt, Human
auucuagcuaauguaaua

SEQ ID NO: 3154154 - RNA, 15 nt, Human
auucuagcuaaugua

SEQ ID NO: 3154155 - RNA, 17 nt, Human
auuauauuuacaaaugg

SEQ ID NO: 3154156 - RNA, 14 nt, Human
auuauauuaugaag

SEQ ID NO: 3154157 - RNA, 15 nt, Human
auuauuauuuggccc

SEQ ID NO: 3154158 - RNA, 17 nt, Human
auuauuuuguucauaca

SEQ ID NO: 3154159 - RNA, 18 nt, Human
auuauuuuguucauacau

SEQ ID NO: 3154160 - RNA, 19 nt, Human
auuauuuuguucauacaua

SEQ ID NO: 3154161 - RNA, 15 nt, Human
auuauuuuguucaua

SEQ ID NO: 3154162 - RNA, 16 nt, Human
auuauuuuguucauac

SEQ ID NO: 3154163 - RNA, 14 nt, Human
auucuaaauuuuau

SEQ ID NO: 3154164 - RNA, 12 nt, Human
auuccagaggaa

SEQ ID NO: 3154165 - RNA, 18 nt, Human
auucagaaggaucuucau

SEQ ID NO: 3154166 - RNA, 13 nt, Human
auucacauuguau

SEQ ID NO: 3154167 - RNA, 20 nt, Human
auucacauuguauucagagu

SEQ ID NO: 3154168 - RNA, 24 nt, Human
auucagaaggaucuucaucugacu

SEQ ID NO: 3154169 - RNA, 14 nt, Human
auuuucuauaauuu

SEQ ID NO: 3154170 - RNA, 15 nt, Human
auuuucuauaauuua

SEQ ID NO: 3154171 - RNA, 15 nt, Human
auuuuaauaaacacu

SEQ ID NO: 3154172 - RNA, 16 nt, Human
auuuuaauaaacacuc

SEQ ID NO: 3154173 - RNA, 17 nt, Human
auuuuaauaaacacucu

SEQ ID NO: 3154174 - RNA, 15 nt, Human
auuuugcccuugaca

SEQ ID NO: 3154175 - RNA, 23 nt, Human
auuuugcccuugacaaagucaag

SEQ ID NO: 3154176 - RNA, 12 nt, Human
auuuuguucaua

SEQ ID NO: 3154177 - RNA, 17 nt, Human
auuuuguguuuaggaac

SEQ ID NO: 3154178 - RNA, 14 nt, Human
auuuuguucauaca

SEQ ID NO: 3154179 - RNA, 15 nt, Human
auuuuguucauacau

SEQ ID NO: 3154180 - RNA, 16 nt, Human
auuuuguucauacaua

SEQ ID NO: 3154181 - RNA, 18 nt, Human
auuuuguucauacauauu

SEQ ID NO: 3154182 - RNA, 22 nt, Human
auuuuugugauuuugugauuga

SEQ ID NO: 3154183 - RNA, 20 nt, Human
auuuuuguagcacugacaga

SEQ ID NO: 3154184 - RNA, 21 nt, Human
auuuuuguagcacugacagau

SEQ ID NO: 3154185 - RNA, 12 nt, Human
auuuuugacaga

SEQ ID NO: 3154186 - RNA, 13 nt, Human
auuuuugacagaa

SEQ ID NO: 3154187 - RNA, 14 nt, Human
auuuuugacagaau

SEQ ID NO: 3154188 - RNA, 15 nt, Human
auuuuugacagaaua

SEQ ID NO: 3154189 - RNA, 22 nt, Human
auuuuugacagaauauguuuca

SEQ ID NO: 3154190 - RNA, 15 nt, Human
auuuuuccaaaauaa

SEQ ID NO: 3154191 - RNA, 12 nt, Human
auuuuucucaug

SEQ ID NO: 3154192 - RNA, 18 nt, Human
auuuuucacauaucuagu

SEQ ID NO: 3154193 - RNA, 21 nt, Human
auuuuucacauaucuaguaug

SEQ ID NO: 3154194 - RNA, 15 nt, Human
auuuuucacauaucu

SEQ ID NO: 3154195 - RNA, 16 nt, Human
auuguacgaagaguau

SEQ ID NO: 3154196 - RNA, 19 nt, Human
auuggacaguaaaauccac

SEQ ID NO: 3154197 - RNA, 18 nt, Human
auugcuuuggucauauga

SEQ ID NO: 3154198 - RNA, 14 nt, Human
auugcuuuggucau

SEQ ID NO: 3154199 - RNA, 23 nt, Human
auuggguggggggcuucauacac

SEQ ID NO: 3154200 - RNA, 22 nt, Human
auuggguggggggcuucauaca

SEQ ID NO: 3154201 - RNA, 19 nt, Human
auuggauucugagagcugu

SEQ ID NO: 3154202 - RNA, 22 nt, Human
auuggauucugagagcugugca

SEQ ID NO: 3154203 - RNA, 18 nt, Human
auuugugaagguggaaau

SEQ ID NO: 3154204 - RNA, 21 nt, Human
auuugugaagguggaaauaaa

SEQ ID NO: 3154205 - RNA, 20 nt, Human
auuuuaaaagauaaauauua

SEQ ID NO: 3154206 - RNA, 20 nt, Human
auuuuaaaagaugcaaugua

SEQ ID NO: 3154207 - RNA, 18 nt, Human
auuuguaaauuuauguga

SEQ ID NO: 3154208 - RNA, 19 nt, Human
auuuguaaauuuaugugau

SEQ ID NO: 3154209 - RNA, 16 nt, Human
auuucccuuccuuccu

SEQ ID NO: 3154210 - RNA, 17 nt, Human
auuucccugaaggaacc

SEQ ID NO: 3154211 - RNA, 23 nt, Human
auuucccugaaggaaccaaagcg

SEQ ID NO: 3154212 - RNA, 18 nt, Human
auuugaaacacuuugcau

SEQ ID NO: 3154213 - RNA, 21 nt, Human
augaauauuuaguguucauaa

SEQ ID NO: 3154214 - RNA, 23 nt, Human
uuggggacaggggcaggaggaag

SEQ ID NO: 3154215 - RNA, 21 nt, Human
augaaauuauauaaguauucu

SEQ ID NO: 3154216 - RNA, 19 nt, Human
augaaauuauauaaguauu

SEQ ID NO: 3154217 - RNA, 16 nt, Human
augaauauuuaguguu

SEQ ID NO: 3154218 - RNA, 20 nt, Human
uuggagacacaacuauuuuu

SEQ ID NO: 3154219 - RNA, 18 nt, Human
uuggagacacaacuauuu

SEQ ID NO: 3154220 - RNA, 12 nt, Human
aucuguuuacag

SEQ ID NO: 3154221 - RNA, 15 nt, Human
aucuguuuacagugu

SEQ ID NO: 3154222 - RNA, 17 nt, Human
aucuguuuacaguguuc

SEQ ID NO: 3154223 - RNA, 18 nt, Human
aucuuguagcuuuaucaa

SEQ ID NO: 3154224 - RNA, 19 nt, Human
aucuuguagcuuuaucaaa

SEQ ID NO: 3154225 - RNA, 20 nt, Human
aucuuguagcuuuaucaaag

SEQ ID NO: 3154226 - RNA, 22 nt, Human
uugauuaagaucucagugguua

SEQ ID NO: 3154227 - RNA, 12 nt, Human
aucuagaagacu

SEQ ID NO: 3154228 - RNA, 16 nt, Human
uugagauguguucaca

SEQ ID NO: 3154229 - RNA, 20 nt, Human
uugacagaauauguuucaaa

SEQ ID NO: 3154230 - RNA, 17 nt, Human
uugacagaauauguuuc

SEQ ID NO: 3154231 - RNA, 19 nt, Human
auccauagcaccuccacau

SEQ ID NO: 3154232 - RNA, 18 nt, Human
auccaagcaaaugugaau

SEQ ID NO: 3154233 - RNA, 20 nt, Human
aucauuuuaccuuugacaaa

SEQ ID NO: 3154234 - RNA, 13 nt, Human
uucugccaggaga

SEQ ID NO: 3154235 - RNA, 23 nt, Human
uucuuaaccagaucauugugaaa

SEQ ID NO: 3154236 - RNA, 15 nt, Human
uucuuuguaaugaaa

SEQ ID NO: 3154237 - RNA, 17 nt, Human
uugaaauuguauuacaa

SEQ ID NO: 3154238 - RNA, 14 nt, Human
auccuacccccugu

SEQ ID NO: 3154239 - RNA, 16 nt, Human
auccuacccccugugc

SEQ ID NO: 3154240 - RNA, 12 nt, Human
auauuuuucaca

SEQ ID NO: 3154241 - RNA, 13 nt, Human
auauuuuucacau

SEQ ID NO: 3154242 - RNA, 14 nt, Human
auauuuuucacaua

SEQ ID NO: 3154243 - RNA, 15 nt, Human
auauuuuucacauau

SEQ ID NO: 3154244 - RNA, 19 nt, Human
uuccguagguuauuuucag

SEQ ID NO: 3154245 - RNA, 14 nt, Human
uucuagcauggcau

SEQ ID NO: 3154246 - RNA, 15 nt, Human
uucuagcauggcaua

SEQ ID NO: 3154247 - RNA, 18 nt, Human
uucuagcauggcauauuu

SEQ ID NO: 3154248 - RNA, 20 nt, Human
uucuagcauggcauauuuuu

SEQ ID NO: 3154249 - RNA, 21 nt, Human
uucuagcauggcauauuuuuc

SEQ ID NO: 3154250 - RNA, 17 nt, Human
uucuagcuaauguaaua

SEQ ID NO: 3154251 - RNA, 22 nt, Human
uucuagcauggcauauuuuuca

SEQ ID NO: 3154252 - RNA, 14 nt, Human
uucuaaauuuuaua

SEQ ID NO: 3154253 - RNA, 16 nt, Human
aucaggccauuguccc

SEQ ID NO: 3154254 - RNA, 13 nt, Human
aucaggccauugu

SEQ ID NO: 3154255 - RNA, 17 nt, Human
augauaaguaaaugcua

SEQ ID NO: 3154256 - RNA, 20 nt, Human
uuguguuaaguauguguaaa

SEQ ID NO: 3154257 - RNA, 21 nt, Human
augauacuugaaaauuaacau

SEQ ID NO: 3154258 - RNA, 17 nt, Human
augauacuugaaaauua

SEQ ID NO: 3154259 - RNA, 22 nt, Human
augcagauuuugcccuugacaa

SEQ ID NO: 3154260 - RNA, 18 nt, Human
augcuagguuaauuccaa

SEQ ID NO: 3154261 - RNA, 21 nt, Human
uuuaucaaagggugaaaauua

SEQ ID NO: 3154262 - RNA, 17 nt, Human
uuuaucaugugaaauca

SEQ ID NO: 3154263 - RNA, 18 nt, Human
uuuaucaugugaaaucau

SEQ ID NO: 3154264 - RNA, 22 nt, Human
uuucaaaauuguuacaaauugu

SEQ ID NO: 3154265 - RNA, 20 nt, Human
uuuauuuuguguuuaggaac

SEQ ID NO: 3154266 - RNA, 16 nt, Human
uuuauuuuguguuuag

SEQ ID NO: 3154267 - RNA, 18 nt, Human
auggcauauuuuucacau

SEQ ID NO: 3154268 - RNA, 20 nt, Human
auggcauauuuuucacauau

SEQ ID NO: 3154269 - RNA, 21 nt, Human
auggcauauuuuucacauauc

SEQ ID NO: 3154270 - RNA, 22 nt, Human
auggcauauuuuucacauaucu

SEQ ID NO: 3154271 - RNA, 23 nt, Human
auggcauauuuuucacauaucua

SEQ ID NO: 3154272 - RNA, 14 nt, Human
uuucaaacuuugga

SEQ ID NO: 3154273 - RNA, 20 nt, Human
auggggauagauguguggac

SEQ ID NO: 3154274 - RNA, 16 nt, Human
augguucucaggccug

SEQ ID NO: 3154275 - RNA, 13 nt, Human
augguuguacaua

SEQ ID NO: 3154276 - RNA, 17 nt, Human
auguacauguacugauu

SEQ ID NO: 3154277 - RNA, 19 nt, Human
augguguucaaaaaacuug

SEQ ID NO: 3154278 - RNA, 23 nt, Human
uuuggcaaacucuccaccacacg

SEQ ID NO: 3154279 - RNA, 19 nt, Human
auguagaggggaaaagaga

SEQ ID NO: 3154280 - RNA, 22 nt, Human
uuugacagaauauguuucaaac

SEQ ID NO: 3154281 - RNA, 19 nt, Human
auguagccccucuccugga

SEQ ID NO: 3154282 - RNA, 16 nt, Human
augucaguauguggaa

SEQ ID NO: 3154283 - RNA, 15 nt, Human
auguaugcuucauac

SEQ ID NO: 3154284 - RNA, 14 nt, Human
auguaugcuucaua

SEQ ID NO: 3154285 - RNA, 12 nt, Human
uuuguauaaaag

SEQ ID NO: 3154286 - RNA, 13 nt, Human
uuuguaaugaaaa

SEQ ID NO: 3154287 - RNA, 14 nt, Human
uuuguaaugaaaac

SEQ ID NO: 3154288 - RNA, 20 nt, Human
uuugugaagguggaaauaaa

SEQ ID NO: 3154289 - RNA, 12 nt, Human
augugacucuuu

SEQ ID NO: 3154290 - RNA, 16 nt, Human
augugacucuuuccaa

SEQ ID NO: 3154291 - RNA, 21 nt, Human
augugacucuuuccaaccggc

SEQ ID NO: 3154292 - RNA, 18 nt, Human
auaaaggauuaaugucaa

SEQ ID NO: 3154293 - RNA, 14 nt, Human
auaaaaauauugug

SEQ ID NO: 3154294 - RNA, 20 nt, Human
auaaacuuuuuucuuacugu

SEQ ID NO: 3154295 - RNA, 15 nt, Human
auaaagcaggcagaa

SEQ ID NO: 3154296 - RNA, 18 nt, Human
auaaagcuguguggcagu

SEQ ID NO: 3154297 - RNA, 20 nt, Human
auaauuaaauuuugaguucu

SEQ ID NO: 3154298 - RNA, 15 nt, Human
auagguuuaauaauu

SEQ ID NO: 3154299 - RNA, 21 nt, Human
auaguauuugagaguucuaaa

SEQ ID NO: 3154300 - RNA, 20 nt, Human
auaguauuugagaguucuaa

SEQ ID NO: 3154301 - RNA, 23 nt, Human
auaguauuugagaguucuaaauu

SEQ ID NO: 3154302 - RNA, 23 nt, Human
auauuaugaagcuuuuaugugaa

SEQ ID NO: 3154303 - RNA, 16 nt, Human
auaucaaauauauuca

SEQ ID NO: 3154304 - RNA, 12 nt, Human
aguccuguaaug

SEQ ID NO: 3154305 - RNA, 14 nt, Human
aguaugaaauuaua

SEQ ID NO: 3154306 - RNA, 16 nt, Human
aguaucuuuuuauuca

SEQ ID NO: 3154307 - RNA, 16 nt, Human
aguaugaaauuauaua

SEQ ID NO: 3154308 - RNA, 23 nt, Human
aguugaaaaucuuauaauuuaaa

SEQ ID NO: 3154309 - RNA, 22 nt, Human
aguugaaaaucuuauaauuuaa

SEQ ID NO: 3154310 - RNA, 15 nt, Human
aguucauacauugua

SEQ ID NO: 3154311 - RNA, 18 nt, Human
aguucauaaauuuauggu

SEQ ID NO: 3154312 - RNA, 10 nt, Human
aguucauaca

SEQ ID NO: 3154313 - RNA, 11 nt, Human
aguucauacau

SEQ ID NO: 3154314 - RNA, 16 nt, Human
aguggcuggaucugug

SEQ ID NO: 3154315 - RNA, 16 nt, Human
auggcuguggagugug

SEQ ID NO: 3154316 - RNA, 21 nt, Human
augcauagguuuagcaguaua

SEQ ID NO: 3154317 - RNA, 17 nt, Human
augcauagguuuagcag

SEQ ID NO: 3154318 - RNA, 16 nt, Human
augcauauuauuuuau

SEQ ID NO: 3154319 - RNA, 20 nt, Human
auguauucuagcuaauguaa

SEQ ID NO: 3154320 - RNA, 19 nt, Human
auguauucuagcuaaugua

SEQ ID NO: 3154321 - RNA, 15 nt, Human
augugaaacauguuu

SEQ ID NO: 3154322 - RNA, 14 nt, Human
auguuucaaacuuu

SEQ ID NO: 3154323 - RNA, 17 nt, Human
auguuucaaacuuugga

SEQ ID NO: 3154324 - RNA, 12 nt, Human
auguuucaaacu

SEQ ID NO: 3154325 - RNA, 13 nt, Human
auguuucaaacuu

SEQ ID NO: 3154326 - RNA, 18 nt, Human
auccagaaagaaaacuug

SEQ ID NO: 3154327 - RNA, 16 nt, Human
auccagaaagaaaacu

SEQ ID NO: 3154328 - RNA, 15 nt, Human
aucaugugaaaucau

SEQ ID NO: 3154329 - RNA, 14 nt, Human
aucaugugaaauca

SEQ ID NO: 3154330 - RNA, 16 nt, Human
aucaugugaaaucauu

SEQ ID NO: 3154331 - RNA, 14 nt, Human
aucagccugugcca

SEQ ID NO: 3154332 - RNA, 19 nt, Human
augagcuccuuaaggcucu

SEQ ID NO: 3154333 - RNA, 21 nt, Human
augaagcuuuuaugugaaaca

SEQ ID NO: 3154334 - RNA, 23 nt, Human
augaaaaaauauauaucaaauau

SEQ ID NO: 3154335 - RNA, 19 nt, Human
augaaguuuuuuuuauaca

SEQ ID NO: 3154336 - RNA, 22 nt, Human
augaagcuuuuaugugaaacau

SEQ ID NO: 3154337 - RNA, 18 nt, Human
aucuugaauaauguaaga

SEQ ID NO: 3154338 - RNA, 17 nt, Human
agguggaauuauuuuaa

SEQ ID NO: 3154339 - RNA, 21 nt, Human
agguggaauuauuuuaaaaga

SEQ ID NO: 3154340 - RNA, 13 nt, Human
aggucccuaauaa

SEQ ID NO: 3154341 - RNA, 15 nt, Human
aggucccuaauaaag

SEQ ID NO: 3154342 - RNA, 20 nt, Human
agguaaaagcaucacaugaa

SEQ ID NO: 3154343 - RNA, 18 nt, Human
agguaaaucagacuauga

SEQ ID NO: 3154344 - RNA, 12 nt, Human
aggucccuaaua

SEQ ID NO: 3154345 - RNA, 11 nt, Human
aggucccuaau

SEQ ID NO: 3154346 - RNA, 23 nt, Human
agguaaaucagacuaugaaguuu

SEQ ID NO: 3154347 - RNA, 23 nt, Human
aggcuacuguaaggcaaucaugg

SEQ ID NO: 3154348 - RNA, 21 nt, Human
aggagucccugccaucauguu

SEQ ID NO: 3154349 - RNA, 21 nt, Human
agcuuuucccuuuuuuuaagu

SEQ ID NO: 3154350 - RNA, 22 nt, Human
agcuccuuaaggcucuuuugua

SEQ ID NO: 3154351 - RNA, 18 nt, Human
agcuccuuaaggcucuuu

SEQ ID NO: 3154352 - RNA, 14 nt, Human
agcugagcaggugu

SEQ ID NO: 3154353 - RNA, 14 nt, Human
agcugcuccccacg

SEQ ID NO: 3154354 - RNA, 17 nt, Human
agcugcuccccacguca

SEQ ID NO: 3154355 - RNA, 21 nt, Human
agcuucuggugaccuuccaag

SEQ ID NO: 3154356 - RNA, 22 nt, Human
agcuucuggugaccuuccaaga

SEQ ID NO: 3154357 - RNA, 20 nt, Human
agaggacaguauuugugggg

SEQ ID NO: 3154358 - RNA, 17 nt, Human
agagggaugcauggaga

SEQ ID NO: 3154359 - RNA, 18 nt, Human
agcagugggccuggccag

SEQ ID NO: 3154360 - RNA, 18 nt, Human
agcacugacagauuucca

SEQ ID NO: 3154361 - RNA, 13 nt, Human
agcacugacagau

SEQ ID NO: 3154362 - RNA, 14 nt, Human
agcacugacagauu

SEQ ID NO: 3154363 - RNA, 14 nt, Human
agccgggagccuga

SEQ ID NO: 3154364 - RNA, 21 nt, Human
acaggaugaugacuauggaaa

SEQ ID NO: 3154365 - RNA, 17 nt, Human
acagccaacuauggccu

SEQ ID NO: 3154366 - RNA, 19 nt, Human
acagccaacuauggccugu

SEQ ID NO: 3154367 - RNA, 11 nt, Human
acacugccagc

SEQ ID NO: 3154368 - RNA, 19 nt, Human
acauguuucuuuguaauga

SEQ ID NO: 3154369 - RNA, 22 nt, Human
acauguuucuuuguaaugaaaa

SEQ ID NO: 3154370 - RNA, 19 nt, Human
acauuuguucuauagcuuu

SEQ ID NO: 3154371 - RNA, 13 nt, Human
accagaucauugu

SEQ ID NO: 3154372 - RNA, 13 nt, Human
acccccugugccu

SEQ ID NO: 3154373 - RNA, 22 nt, Human
acuuuauuuucuauaauuuaaa

SEQ ID NO: 3154374 - RNA, 22 nt, Human
acuuuaucuugaauaauguaag

SEQ ID NO: 3154375 - RNA, 12 nt, Human
acuuuuaugaua

SEQ ID NO: 3154376 - RNA, 16 nt, Human
acuuuuaugauacuug

SEQ ID NO: 3154377 - RNA, 14 nt, Human
agaaaauaacaaua

SEQ ID NO: 3154378 - RNA, 23 nt, Human
acuuuuaugauacuugaaaauua

SEQ ID NO: 3154379 - RNA, 20 nt, Human
acuuuauacccagaaaguua

SEQ ID NO: 3154380 - RNA, 22 nt, Human
acuuuauacccagaaaguuauu

SEQ ID NO: 3154381 - RNA, 11 nt, Human
agaaaguuauu

SEQ ID NO: 3154382 - RNA, 23 nt, Human
agaaaguuauugauaaguucaua

SEQ ID NO: 3154383 - RNA, 16 nt, Human
agaaaggauaaaguug

SEQ ID NO: 3154384 - RNA, 22 nt, Human
acugugaaguuuacauuguaaa

SEQ ID NO: 3154385 - RNA, 18 nt, Human
acugguaggaaacuaggu

SEQ ID NO: 3154386 - RNA, 12 nt, Human
acugccagcauu

SEQ ID NO: 3154387 - RNA, 21 nt, Human
acucauaaaaagccugcaauu

SEQ ID NO: 3154388 - RNA, 21 nt, Human
acucagcccucauuggcucuu

SEQ ID NO: 3154389 - RNA, 17 nt, Human
acucagcccucauuggc

SEQ ID NO: 3154390 - RNA, 22 nt, Human
acuauucaggagaguagaacag

SEQ ID NO: 3154391 - RNA, 16 nt, Human
accugccgagagucca

SEQ ID NO: 3154392 - RNA, 23 nt, Human
accugccgagaguccaucagccu

SEQ ID NO: 3154393 - RNA, 14 nt, Human
aaaauugauguguu

SEQ ID NO: 3154394 - RNA, 12 nt, Human
aaaauugaugug

SEQ ID NO: 3154395 - RNA, 21 nt, Human
aaaauugaugggauuugguca

SEQ ID NO: 3154396 - RNA, 21 nt, Human
aaaauugauguguuuauuuau

SEQ ID NO: 3154397 - RNA, 24 nt, Human
aaacacucaguuguucaauaauaa

SEQ ID NO: 3154398 - RNA, 21 nt, Human
aaacacugggagaaaugaaaa

SEQ ID NO: 3154399 - RNA, 22 nt, Human
aaacacugggagaaaugaaaaa

SEQ ID NO: 3154400 - RNA, 17 nt, Human
aaaaucaguuguacagu

SEQ ID NO: 3154401 - RNA, 15 nt, Human
aaagaaauauaccua

SEQ ID NO: 3154402 - RNA, 17 nt, Human
aaagaaauauaccuaaa

SEQ ID NO: 3154403 - RNA, 15 nt, Human
aaagccaaugugaac

SEQ ID NO: 3154404 - RNA, 17 nt, Human
aaagccaaugugaacag

SEQ ID NO: 3154405 - RNA, 22 nt, Human
aacuuuauacccagaaaguuau

SEQ ID NO: 3154406 - RNA, 23 nt, Human
aacuuuauacccagaaaguuauu

SEQ ID NO: 3154407 - RNA, 17 nt, Human
aaaucuuauaauuuaaa

SEQ ID NO: 3154408 - RNA, 15 nt, Human
aaaugccuuuguacu

SEQ ID NO: 3154409 - RNA, 22 nt, Human
aaccacuggaaaguuuaugguu

SEQ ID NO: 3154410 - RNA, 18 nt, Human
aaccaccagaagcccaga

SEQ ID NO: 3154411 - RNA, 19 nt, Human
aaccaccagaagcccagaa

SEQ ID NO: 3154412 - RNA, 20 nt, Human
aagcagauggaaugcugugu

SEQ ID NO: 3154413 - RNA, 19 nt, Human
aagcagauggaaugcugug

SEQ ID NO: 3154414 - RNA, 17 nt, Human
aagcagauggaaugcug

SEQ ID NO: 3154415 - RNA, 21 nt, Human
aagcugugugcucuccaagcc

SEQ ID NO: 3154416 - RNA, 18 nt, Human
aagcuguguggcagucug

SEQ ID NO: 3154417 - RNA, 17 nt, Human
aaguaguguaucacagu

SEQ ID NO: 3154418 - RNA, 14 nt, Human
aagucuccaaaguc

SEQ ID NO: 3154419 - RNA, 20 nt, Human
aaggugaggagcuugaaacc

SEQ ID NO: 3154420 - RNA, 15 nt, Human
aagucuccaaagucu

SEQ ID NO: 3154421 - RNA, 13 nt, Human
aauccagccugcu

SEQ ID NO: 3154422 - RNA, 17 nt, Human
aauccaagcaaauguga

SEQ ID NO: 3154423 - RNA, 18 nt, Human
aauccaagcaaaugugaa

SEQ ID NO: 3154424 - RNA, 15 nt, Human
aaucaccaaaggcuc

SEQ ID NO: 3154425 - RNA, 13 nt, Human
aauauguuucaaa

SEQ ID NO: 3154426 - RNA, 15 nt, Human
aauauguuucaaacu

SEQ ID NO: 3154427 - RNA, 16 nt, Human
aauauguuucaaacuu

SEQ ID NO: 3154428 - RNA, 17 nt, Human
aauauguuucaaacuuu

SEQ ID NO: 3154429 - RNA, 16 nt, Human
aauauauaucaaauau

SEQ ID NO: 3154430 - RNA, 15 nt, Human
aaugucaguaugugg

SEQ ID NO: 3154431 - RNA, 13 nt, Human
aaugucaguaugu

SEQ ID NO: 3154432 - RNA, 21 nt, Human
aaugcuagguuaauuccaauu

SEQ ID NO: 3154433 - RNA, 19 nt, Human
aaugcuagguuaauuccaa

SEQ ID NO: 3154434 - RNA, 18 nt, Human
aaugcuagguuaauucca

SEQ ID NO: 3154435 - RNA, 22 nt, Human
aauguuuuuuuuuaaagacuuu

SEQ ID NO: 3154436 - RNA, 15 nt, Human
aauguuuuuuuuuaa

SEQ ID NO: 3154437 - RNA, 20 nt, Human
aauguuuuuuuuuaaagacu

SEQ ID NO: 3154438 - RNA, 21 nt, Human
cacaaauucugucucuggauu

SEQ ID NO: 3154439 - RNA, 19 nt, Human
cacaacuauuuuuccaaaa

SEQ ID NO: 3154440 - RNA, 14 nt, Human
cacaacuauuuuuc

SEQ ID NO: 3154441 - RNA, 23 nt, Human
cacauaucuaguaugaaauuaua

SEQ ID NO: 3154442 - RNA, 20 nt, Human
caccaagccuggucagccca

SEQ ID NO: 3154443 - RNA, 21 nt, Human
caccaagccuggucagcccaa

SEQ ID NO: 3154444 - RNA, 19 nt, Human
caccaagccuggucagccc

SEQ ID NO: 3154445 - RNA, 18 nt, Human
cacauuggagauguuuag

SEQ ID NO: 3154446 - RNA, 22 nt, Human
caccaagccuggucagcccaaa

SEQ ID NO: 3154447 - RNA, 22 nt, Human
cacauggugacuuuugaaaaga

SEQ ID NO: 3154448 - RNA, 20 nt, Human
caaggaaaaaauaacaauga

SEQ ID NO: 3154449 - RNA, 17 nt, Human
caagcacuaaacaaaga

SEQ ID NO: 3154450 - RNA, 15 nt, Human
caaauucugucucug

SEQ ID NO: 3154451 - RNA, 12 nt, Human
caacuuuauacc

SEQ ID NO: 3154452 - RNA, 18 nt, Human
caagaaaacaacuucaau

SEQ ID NO: 3154453 - RNA, 12 nt, Human
caacuuuguaua

SEQ ID NO: 3154454 - RNA, 11 nt, Human
caacuuuguau

SEQ ID NO: 3154455 - RNA, 23 nt, Human
caaaaaaauauauuuaaugauaa

SEQ ID NO: 3154456 - RNA, 12 nt, Human
caaauauauuca

SEQ ID NO: 3154457 - RNA, 16 nt, Human
caccccgacuuuuguu

SEQ ID NO: 3154458 - RNA, 16 nt, Human
caccagaagcccagaa

SEQ ID NO: 3154459 - RNA, 17 nt, Human
caccagaagcccagaau

SEQ ID NO: 3154460 - RNA, 13 nt, Human
caccagaagccca

SEQ ID NO: 3154461 - RNA, 14 nt, Human
caccagaagcccag

SEQ ID NO: 3154462 - RNA, 15 nt, Human
caccagaagcccaga

SEQ ID NO: 3154463 - RNA, 16 nt, Human
cuaagauaguaacaau

SEQ ID NO: 3154464 - RNA, 15 nt, Human
cuaaauuuuauaucu

SEQ ID NO: 3154465 - RNA, 16 nt, Human
cuaaauuuuauaucuu

SEQ ID NO: 3154466 - RNA, 13 nt, Human
cuaaauuuuauau

SEQ ID NO: 3154467 - RNA, 20 nt, Human
cuaaauuuuauaucuuguag

SEQ ID NO: 3154468 - RNA, 20 nt, Human
cgggaggcagagguugcagu

SEQ ID NO: 3154469 - RNA, 22 nt, Human
cgggaggcagagguugcagugu

SEQ ID NO: 3154470 - RNA, 23 nt, Human
cuacacgagauacagaauuuuau

SEQ ID NO: 3154471 - RNA, 14 nt, Human
cuaauaaagcugug

SEQ ID NO: 3154472 - RNA, 18 nt, Human
cuaauaaucauuggauuc

SEQ ID NO: 3154473 - RNA, 21 nt, Human
cuaagcuucacuguaaaauaa

SEQ ID NO: 3154474 - RNA, 12 nt, Human
cuauaauuuaaa

SEQ ID NO: 3154475 - RNA, 22 nt, Human
cuaugaaguuuuuuuuauacag

SEQ ID NO: 3154476 - RNA, 21 nt, Human
cuauucaggagaguagaacag

SEQ ID NO: 3154477 - RNA, 21 nt, Human
cuauggggauagaugugugga

SEQ ID NO: 3154478 - RNA, 20 nt, Human
cuauggggauagaugugugg

SEQ ID NO: 3154479 - RNA, 19 nt, Human
cuauggggauagaugugug

SEQ ID NO: 3154480 - RNA, 13 nt, Human
cucacacucaccc

SEQ ID NO: 3154481 - RNA, 22 nt, Human
cuagcuaauguaauaacuguga

SEQ ID NO: 3154482 - RNA, 22 nt, Human
cuacucuggagguuuguuuaga

SEQ ID NO: 3154483 - RNA, 18 nt, Human
cuacugggagccuaccca

SEQ ID NO: 3154484 - RNA, 14 nt, Human
cuacugggagccua

SEQ ID NO: 3154485 - RNA, 15 nt, Human
cuacugggagccuac

SEQ ID NO: 3154486 - RNA, 20 nt, Human
cucacugcuaagaauauuug

SEQ ID NO: 3154487 - RNA, 21 nt, Human
cucacugcuaagaauauuuga

SEQ ID NO: 3154488 - RNA, 22 nt, Human
cucacugcuaagaauauuugaa

SEQ ID NO: 3154489 - RNA, 23 nt, Human
cucacugcuaagaauauuugaau

SEQ ID NO: 3154490 - RNA, 16 nt, Human
cucagaggguguccug

SEQ ID NO: 3154491 - RNA, 17 nt, Human
cucagccccgcguggaa

SEQ ID NO: 3154492 - RNA, 24 nt, Human
cucaggagcccugggaggcucugg

SEQ ID NO: 3154493 - RNA, 18 nt, Human
cucaggaaccgaggcagg

SEQ ID NO: 3154494 - RNA, 19 nt, Human
cucaggaaccgaggcaggg

SEQ ID NO: 3154495 - RNA, 17 nt, Human
cucaggaaccgaggcag

SEQ ID NO: 3154496 - RNA, 12 nt, Human
cucaggagcccu

SEQ ID NO: 3154497 - RNA, 13 nt, Human
cucaggagcccug

SEQ ID NO: 3154498 - RNA, 14 nt, Human
cucaggagcccugg

SEQ ID NO: 3154499 - RNA, 15 nt, Human
cucaggagcccuggg

SEQ ID NO: 3154500 - RNA, 16 nt, Human
cucaggagcccuggga

SEQ ID NO: 3154501 - RNA, 17 nt, Human
cucaggagcccugggag

SEQ ID NO: 3154502 - RNA, 20 nt, Human
cucaggagcccugggaggcu

SEQ ID NO: 3154503 - RNA, 21 nt, Human
cucaggagcccugggaggcuc

SEQ ID NO: 3154504 - RNA, 22 nt, Human
cucaggagcccugggaggcucu

SEQ ID NO: 3154505 - RNA, 23 nt, Human
cucaggagcccugggaggcucug

SEQ ID NO: 3154506 - RNA, 20 nt, Human
cuccccacgucagcugggac

SEQ ID NO: 3154507 - RNA, 16 nt, Human
cucaguucucuucacu

SEQ ID NO: 3154508 - RNA, 17 nt, Human
cucaguucucuucacuc

SEQ ID NO: 3154509 - RNA, 22 nt, Human
cuccacucaugugacucuuucc

SEQ ID NO: 3154510 - RNA, 16 nt, Human
cuccacucaugugacu

SEQ ID NO: 3154511 - RNA, 14 nt, Human
cuccacucuccucu

SEQ ID NO: 3154512 - RNA, 20 nt, Human
ccugguccucacacucaccc

SEQ ID NO: 3154513 - RNA, 22 nt, Human
ccugccgagaguccaucagccu

SEQ ID NO: 3154514 - RNA, 23 nt, Human
ccugccgagaguccaucagccuc

SEQ ID NO: 3154515 - RNA, 14 nt, Human
ccugccgagagucc

SEQ ID NO: 3154516 - RNA, 17 nt, Human
ccugcaccggggccugg

SEQ ID NO: 3154517 - RNA, 15 nt, Human
ccugcaccggggccu

SEQ ID NO: 3154518 - RNA, 19 nt, Human
ccugaagagaagggcaggg

SEQ ID NO: 3154519 - RNA, 15 nt, Human
ccucuuccaggcccc

SEQ ID NO: 3154520 - RNA, 18 nt, Human
cgggaauuuucaucuagg

SEQ ID NO: 3154521 - RNA, 18 nt, Human
cgggacaccuaggcuagg

SEQ ID NO: 3154522 - RNA, 19 nt, Human
cgggacaccuaggcuaggg

SEQ ID NO: 3154523 - RNA, 20 nt, Human
cgggaauuuucaucuaggau

SEQ ID NO: 3154524 - RNA, 11 nt, Human
cgcggcuggga

SEQ ID NO: 3154525 - RNA, 12 nt, Human
cgcggcugggag

SEQ ID NO: 3154526 - RNA, 16 nt, Human
cgcggcugggaggagg

SEQ ID NO: 3154527 - RNA, 17 nt, Human
ccugugccuuuugccau

SEQ ID NO: 3154528 - RNA, 18 nt, Human
ccuguggaucaaauccag

SEQ ID NO: 3154529 - RNA, 14 nt, Human
ccuuugucccagaa

SEQ ID NO: 3154530 - RNA, 15 nt, Human
cgaagcguuguccuc

SEQ ID NO: 3154531 - RNA, 16 nt, Human
cgaagcguuguccuca

SEQ ID NO: 3154532 - RNA, 17 nt, Human
cgaagcguuguccucag

SEQ ID NO: 3154533 - RNA, 21 nt, Human
cgaagcguuguccucagcccc

SEQ ID NO: 3154534 - RNA, 23 nt, Human
cgaagaguauuuuugacagaaua

SEQ ID NO: 3154535 - RNA, 18 nt, Human
cgagacuugguuucaaaa

SEQ ID NO: 3154536 - RNA, 21 nt, Human
cccugaggcagguccccagac

SEQ ID NO: 3154537 - RNA, 18 nt, Human
cccugaggcaggucccca

SEQ ID NO: 3154538 - RNA, 20 nt, Human
cccugaggcagguccccaga

SEQ ID NO: 3154539 - RNA, 17 nt, Human
cccugaggcaggucccc

SEQ ID NO: 3154540 - RNA, 13 nt, Human
cccugccucucug

SEQ ID NO: 3154541 - RNA, 14 nt, Human
cccugccucucugc

SEQ ID NO: 3154542 - RNA, 15 nt, Human
cccugccucucugca

SEQ ID NO: 3154543 - RNA, 17 nt, Human
ccgccuccuacagccca

SEQ ID NO: 3154544 - RNA, 21 nt, Human
ccgggggcagucugagagagg

SEQ ID NO: 3154545 - RNA, 20 nt, Human
ccggggccugggcaggaggg

SEQ ID NO: 3154546 - RNA, 20 nt, Human
ccgagaguccaucagccucc

SEQ ID NO: 3154547 - RNA, 21 nt, Human
ccgagaguccaucagccucca

SEQ ID NO: 3154548 - RNA, 12 nt, Human
ccuaaccugccg

SEQ ID NO: 3154549 - RNA, 13 nt, Human
ccuaaccugccga

SEQ ID NO: 3154550 - RNA, 23 nt, Human
ccguggcuguggcauccagaguc

SEQ ID NO: 3154551 - RNA, 13 nt, Human
ccccuccaccugc

SEQ ID NO: 3154552 - RNA, 17 nt, Human
ccccaucauugguaccc

SEQ ID NO: 3154553 - RNA, 14 nt, Human
ccccugugccuugu

SEQ ID NO: 3154554 - RNA, 20 nt, Human
ccccuggcuccaggccaggg

SEQ ID NO: 3154555 - RNA, 12 nt, Human
ccccuggugguu

SEQ ID NO: 3154556 - RNA, 14 nt, Human
ccccugccucucug

SEQ ID NO: 3154557 - RNA, 15 nt, Human
ccccugccucucugc

SEQ ID NO: 3154558 - RNA, 19 nt, Human
ccccugccucucugcaggu

SEQ ID NO: 3154559 - RNA, 16 nt, Human
ccccugccucucugca

SEQ ID NO: 3154560 - RNA, 17 nt, Human
ccccugccucucugcag

SEQ ID NO: 3154561 - RNA, 14 nt, Human
cccaugagcuccuu

SEQ ID NO: 3154562 - RNA, 15 nt, Human
cccaugagcuccuua

SEQ ID NO: 3154563 - RNA, 22 nt, Human
cccaugagcuccuuaaggcucu

SEQ ID NO: 3154564 - RNA, 13 nt, Human
cccaugagcuccu

SEQ ID NO: 3154565 - RNA, 17 nt, Human
cccagaaugaggcugcu

SEQ ID NO: 3154566 - RNA, 16 nt, Human
ccacccccaggacccc

SEQ ID NO: 3154567 - RNA, 18 nt, Human
ccacccccaggaccccug

SEQ ID NO: 3154568 - RNA, 19 nt, Human
ccacccccaggaccccuga

SEQ ID NO: 3154569 - RNA, 15 nt, Human
ccagaaugaggcugc

SEQ ID NO: 3154570 - RNA, 15 nt, Human
ccagaagcccagaau

SEQ ID NO: 3154571 - RNA, 18 nt, Human
ccagaaaccuuuguuugc

SEQ ID NO: 3154572 - RNA, 10 nt, Human
ccagccugcc

SEQ ID NO: 3154573 - RNA, 14 nt, Human
ccagcccugaguuc

SEQ ID NO: 3154574 - RNA, 18 nt, Human
ccagcccugaguuccuag

SEQ ID NO: 3154575 - RNA, 23 nt, Human
ccagugaauucuugaaggaaaau

SEQ ID NO: 3154576 - RNA, 23 nt, Human
ccaggccacuggccccugagauc

SEQ ID NO: 3154577 - RNA, 16 nt, Human
ccaggccacuggcccc

SEQ ID NO: 3154578 - RNA, 12 nt, Human
ccaggcuggguc

SEQ ID NO: 3154579 - RNA, 16 nt, Human
ccaggcugggucgccc

SEQ ID NO: 3154580 - RNA, 21 nt, Human
ccaggcugggucgcccuggac

SEQ ID NO: 3154581 - RNA, 22 nt, Human
ccaggcugggucgcccuggacu

SEQ ID NO: 3154582 - RNA, 23 nt, Human
ccaggcugggucgcccuggacug

SEQ ID NO: 3154583 - RNA, 24 nt, Human
ccaggcugggucgcccuggacugu

SEQ ID NO: 3154584 - RNA, 15 nt, Human
cccacgucagcuggg

SEQ ID NO: 3154585 - RNA, 15 nt, Human
cccacggcuccucga

SEQ ID NO: 3154586 - RNA, 24 nt, Human
cccagaauaaacuggcagcucagc

SEQ ID NO: 3154587 - RNA, 22 nt, Human
cccagaauaaacuggcagcuca

SEQ ID NO: 3154588 - RNA, 16 nt, Human
cccagaaugaggcugc

SEQ ID NO: 3154589 - RNA, 15 nt, Human
cccaacacugccagc

SEQ ID NO: 3154590 - RNA, 16 nt, Human
cccaacacugccagca

SEQ ID NO: 3154591 - RNA, 14 nt, Human
cccaacacugccag

SEQ ID NO: 3154592 - RNA, 23 nt, Human
cuggcugcagagcagugggccug

SEQ ID NO: 3154593 - RNA, 21 nt, Human
cuggccaguggcuggaucugu

SEQ ID NO: 3154594 - RNA, 17 nt, Human
cuggagguuuguuuaga

SEQ ID NO: 3154595 - RNA, 12 nt, Human
cuggagguuugu

SEQ ID NO: 3154596 - RNA, 14 nt, Human
cuggaccagccucu

SEQ ID NO: 3154597 - RNA, 18 nt, Human
cuggaccagccucuccac

SEQ ID NO: 3154598 - RNA, 13 nt, Human
cuggaauuugaaa

SEQ ID NO: 3154599 - RNA, 20 nt, Human
cugccucucugcaggucccu

SEQ ID NO: 3154600 - RNA, 21 nt, Human
cugccucucugcaggucccua

SEQ ID NO: 3154601 - RNA, 22 nt, Human
cugccucucugcaggucccuaa

SEQ ID NO: 3154602 - RNA, 19 nt, Human
cugccucucugcagguccc

SEQ ID NO: 3154603 - RNA, 23 nt, Human
cugccgagaguccaucagccucc

SEQ ID NO: 3154604 - RNA, 22 nt, Human
cugccgagaguccaucagccuc

SEQ ID NO: 3154605 - RNA, 11 nt, Human
cugcugggcuu

SEQ ID NO: 3154606 - RNA, 19 nt, Human
cugugaggggcucucucau

SEQ ID NO: 3154607 - RNA, 21 nt, Human
cugucucccuccucugcccgg

SEQ ID NO: 3154608 - RNA, 17 nt, Human
cuguguguuuaugugug

SEQ ID NO: 3154609 - RNA, 16 nt, Human
cuguguguuuaugugu

SEQ ID NO: 3154610 - RNA, 21 nt, Human
cuguguguguguauguggggg

SEQ ID NO: 3154611 - RNA, 15 nt, Human
cuguguggcagucug

SEQ ID NO: 3154612 - RNA, 23 nt, Human
cugugugcucaggagcccuggga

SEQ ID NO: 3154613 - RNA, 19 nt, Human
cugugugcucaggagcccu

SEQ ID NO: 3154614 - RNA, 16 nt, Human
cugugugcucaggagc

SEQ ID NO: 3154615 - RNA, 20 nt, Human
cugugugcucaggagcccug

SEQ ID NO: 3154616 - RNA, 21 nt, Human
cugugugcucaggagcccugg

SEQ ID NO: 3154617 - RNA, 14 nt, Human
cuucugugaaagua

SEQ ID NO: 3154618 - RNA, 18 nt, Human
cuugaaaauuaacaugaa

SEQ ID NO: 3154619 - RNA, 12 nt, Human
cuugaaaauuaa

SEQ ID NO: 3154620 - RNA, 13 nt, Human
cuugaaaauuaac

SEQ ID NO: 3154621 - RNA, 12 nt, Human
cuugaaaaaugc

SEQ ID NO: 3154622 - RNA, 18 nt, Human
cuugaaaaaugcauguug

SEQ ID NO: 3154623 - RNA, 18 nt, Human
cuucuggugaccuuccaa

SEQ ID NO: 3154624 - RNA, 20 nt, Human
cuucuggugaccuuccaaga

SEQ ID NO: 3154625 - RNA, 21 nt, Human
cuucuggugaccuuccaagag

SEQ ID NO: 3154626 - RNA, 13 nt, Human
cuuauauuaugga

SEQ ID NO: 3154627 - RNA, 13 nt, Human
cuucccuuucugc

SEQ ID NO: 3154628 - RNA, 21 nt, Human
gaaagaguacucuuguuuccu

SEQ ID NO: 3154629 - RNA, 20 nt, Human
gaaaaugauacgcaacauaa

SEQ ID NO: 3154630 - RNA, 21 nt, Human
gaaaauauuauguguuuccau

SEQ ID NO: 3154631 - RNA, 13 nt, Human
gaaaauauuuaaa

SEQ ID NO: 3154632 - RNA, 14 nt, Human
cuuuguggcacugg

SEQ ID NO: 3154633 - RNA, 17 nt, Human
cuuuuuauggccuguga

SEQ ID NO: 3154634 - RNA, 19 nt, Human
cuugaguuuaaauuguaau

SEQ ID NO: 3154635 - RNA, 16 nt, Human
cuugucacgccagacu

SEQ ID NO: 3154636 - RNA, 13 nt, Human
cuugucacgccag

SEQ ID NO: 3154637 - RNA, 21 nt, Human
cuuuaucaaagggugaaaauu

SEQ ID NO: 3154638 - RNA, 22 nt, Human
cuuuaucaaagggugaaaauua

SEQ ID NO: 3154639 - RNA, 23 nt, Human
cuuuaucuugaauaauguaagac

SEQ ID NO: 3154640 - RNA, 18 nt, Human
cuuuaucuugaauaaugu

SEQ ID NO: 3154641 - RNA, 21 nt, Human
cuuuaucuugaauaauguaag

SEQ ID NO: 3154642 - RNA, 22 nt, Human
cuuucuuccaaacaggcucaga

SEQ ID NO: 3154643 - RNA, 16 nt, Human
cuuucugcuuguguua

SEQ ID NO: 3154644 - RNA, 19 nt, Human
cuuuggcuaugagggccuu

SEQ ID NO: 3154645 - RNA, 16 nt, Human
gauguuuaguaaucau

SEQ ID NO: 3154646 - RNA, 24 nt, Human
gaugguguucaaaaaacuuguaaa

SEQ ID NO: 3154647 - RNA, 21 nt, Human
gaugggucaguuguaucagca

SEQ ID NO: 3154648 - RNA, 15 nt, Human
gaugggucaguugua

SEQ ID NO: 3154649 - RNA, 23 nt, Human
gcaaaugugaaucauuuuaccuu

SEQ ID NO: 3154650 - RNA, 21 nt, Human
gcaaagcugaugacaacuucc

SEQ ID NO: 3154651 - RNA, 17 nt, Human
gauugggccccugccag

SEQ ID NO: 3154652 - RNA, 23 nt, Human
gauugcaggagucccugccauca

SEQ ID NO: 3154653 - RNA, 23 nt, Human
gcacaaauucugucucuggauua

SEQ ID NO: 3154654 - RNA, 14 nt, Human
gcaauuucauaugc

SEQ ID NO: 3154655 - RNA, 22 nt, Human
gcaauguagaggggaaaagaga

SEQ ID NO: 3154656 - RNA, 23 nt, Human
gcacuggggcaggggccgggggc

SEQ ID NO: 3154657 - RNA, 15 nt, Human
gcacuggggcagggg

SEQ ID NO: 3154658 - RNA, 18 nt, Human
gcacuggggcaggggccg

SEQ ID NO: 3154659 - RNA, 22 nt, Human
gcaccccagcuggggccaggcu

SEQ ID NO: 3154660 - RNA, 13 nt, Human
gaggguguccugc

SEQ ID NO: 3154661 - RNA, 21 nt, Human
gagguagcuuugagguggaag

SEQ ID NO: 3154662 - RNA, 23 nt, Human
gagggucuugguuccagccugcc

SEQ ID NO: 3154663 - RNA, 14 nt, Human
gagggggagagggc

SEQ ID NO: 3154664 - RNA, 14 nt, Human
gaggcagggaagga

SEQ ID NO: 3154665 - RNA, 21 nt, Human
gaggcgaagcguuguccucag

SEQ ID NO: 3154666 - RNA, 21 nt, Human
gaggcgcaugaauuugugaag

SEQ ID NO: 3154667 - RNA, 20 nt, Human
gaggcgaagcguuguccuca

SEQ ID NO: 3154668 - RNA, 22 nt, Human
gaggccucucauuccagaggaa

SEQ ID NO: 3154669 - RNA, 22 nt, Human
gaguaauccaagcaaaugugaa

SEQ ID NO: 3154670 - RNA, 13 nt, Human
gagguugcagugu

SEQ ID NO: 3154671 - RNA, 21 nt, Human
gagucccugccuggaccagcc

SEQ ID NO: 3154672 - RNA, 23 nt, Human
gagucccugccuggaccagccuc

SEQ ID NO: 3154673 - RNA, 13 nt, Human
gaguguguaauuu

SEQ ID NO: 3154674 - RNA, 18 nt, Human
gaguguacuuaacuauuc

SEQ ID NO: 3154675 - RNA, 22 nt, Human
gauagauguguggacacauugg

SEQ ID NO: 3154676 - RNA, 14 nt, Human
gauagaugugugga

SEQ ID NO: 3154677 - RNA, 15 nt, Human
gauauaagugugugu

SEQ ID NO: 3154678 - RNA, 14 nt, Human
gaccagccucucca

SEQ ID NO: 3154679 - RNA, 22 nt, Human
gaauuggguggggggcuucaua

SEQ ID NO: 3154680 - RNA, 23 nt, Human
gaauuggguggggggcuucauac

SEQ ID NO: 3154681 - RNA, 20 nt, Human
gaauuggguggggggcuuca

SEQ ID NO: 3154682 - RNA, 16 nt, Human
gacaaggaaaaaauaa

SEQ ID NO: 3154683 - RNA, 13 nt, Human
gacacaacuauuu

SEQ ID NO: 3154684 - RNA, 18 nt, Human
gaauucuugaaggaaaau

SEQ ID NO: 3154685 - RNA, 15 nt, Human
gaauguuaagcagau

SEQ ID NO: 3154686 - RNA, 19 nt, Human
gaaugucaguauguggaag

SEQ ID NO: 3154687 - RNA, 14 nt, Human
gaauguuaagcaga

SEQ ID NO: 3154688 - RNA, 13 nt, Human
gaaugucaguaug

SEQ ID NO: 3154689 - RNA, 18 nt, Human
gaaugucaguauguggaa

SEQ ID NO: 3154690 - RNA, 16 nt, Human
gaaugucaguaugugg

SEQ ID NO: 3154691 - RNA, 14 nt, Human
gaaugcuguguuaa

SEQ ID NO: 3154692 - RNA, 13 nt, Human
gaaugcuguguua

SEQ ID NO: 3154693 - RNA, 19 nt, Human
gaaucucauaauuuauaca

SEQ ID NO: 3154694 - RNA, 16 nt, Human
gaaugaaauugcugaa

SEQ ID NO: 3154695 - RNA, 18 nt, Human
gaaucucauaauuuauac

SEQ ID NO: 3154696 - RNA, 23 nt, Human
gacucuaccucauaucaguuugc

SEQ ID NO: 3154697 - RNA, 19 nt, Human
gacucuaccucauaucagu

SEQ ID NO: 3154698 - RNA, 21 nt, Human
gagaaaugaaaaaauauauau

SEQ ID NO: 3154699 - RNA, 12 nt, Human
gagaaaugaaaa

SEQ ID NO: 3154700 - RNA, 13 nt, Human
gagagacgggccc

SEQ ID NO: 3154701 - RNA, 15 nt, Human
gagaguagaacagau

SEQ ID NO: 3154702 - RNA, 17 nt, Human
gagaaugucaguaugug

SEQ ID NO: 3154703 - RNA, 23 nt, Human
gagcccacuguacuugcucuuga

SEQ ID NO: 3154704 - RNA, 18 nt, Human
gagaucccaacacugcca

SEQ ID NO: 3154705 - RNA, 19 nt, Human
gagaucccaacacugccag

SEQ ID NO: 3154706 - RNA, 20 nt, Human
gagaucccaacacugccagc

SEQ ID NO: 3154707 - RNA, 18 nt, Human
gagaugaugaaaauauuu

SEQ ID NO: 3154708 - RNA, 13 nt, Human
gagcaaagcugau

SEQ ID NO: 3154709 - RNA, 19 nt, Human
gccucucugcaggucccua

SEQ ID NO: 3154710 - RNA, 15 nt, Human
gccugcaauuucaua

SEQ ID NO: 3154711 - RNA, 12 nt, Human
gccugcagagcu

SEQ ID NO: 3154712 - RNA, 18 nt, Human
gccugcuuuuuauggccu

SEQ ID NO: 3154713 - RNA, 19 nt, Human
gccugcuuuuuauggccug

SEQ ID NO: 3154714 - RNA, 22 nt, Human
gccugcuuuuuauggccuguga

SEQ ID NO: 3154715 - RNA, 18 nt, Human
gccucucugcaggucccu

SEQ ID NO: 3154716 - RNA, 20 nt, Human
gccucucugcaggucccuaa

SEQ ID NO: 3154717 - RNA, 21 nt, Human
gccucucugcaggucccuaau

SEQ ID NO: 3154718 - RNA, 23 nt, Human
gccuggccagcagguccccagcu

SEQ ID NO: 3154719 - RNA, 12 nt, Human
gcccuggacugu

SEQ ID NO: 3154720 - RNA, 16 nt, Human
gcccuggacugugugc

SEQ ID NO: 3154721 - RNA, 22 nt, Human
gcccuggacugugugcucagga

SEQ ID NO: 3154722 - RNA, 16 nt, Human
gcccugaguuccuagc

SEQ ID NO: 3154723 - RNA, 18 nt, Human
gcccugaguuccuagcca

SEQ ID NO: 3154724 - RNA, 23 nt, Human
gcccuggugguggcucgggaggc

SEQ ID NO: 3154725 - RNA, 13 nt, Human
gcccugggaggcu

SEQ ID NO: 3154726 - RNA, 14 nt, Human
gcccugggaggcuc

SEQ ID NO: 3154727 - RNA, 15 nt, Human
gcccugggaggcucu

SEQ ID NO: 3154728 - RNA, 16 nt, Human
gcccugggaggcucug

SEQ ID NO: 3154729 - RNA, 23 nt, Human
gcccugggaggcucuggagccca

SEQ ID NO: 3154730 - RNA, 17 nt, Human
gcccugggaggcucugg

SEQ ID NO: 3154731 - RNA, 18 nt, Human
gcccugggaggcucugga

SEQ ID NO: 3154732 - RNA, 19 nt, Human
gcccugggaggcucuggag

SEQ ID NO: 3154733 - RNA, 21 nt, Human
gcccugggaggcucuggagcc

SEQ ID NO: 3154734 - RNA, 17 nt, Human
gcucuugaugccuggcg

SEQ ID NO: 3154735 - RNA, 14 nt, Human
gcucuugaugccug

SEQ ID NO: 3154736 - RNA, 15 nt, Human
gcucuugaugccugg

SEQ ID NO: 3154737 - RNA, 16 nt, Human
gcucuugaugccuggc

SEQ ID NO: 3154738 - RNA, 23 nt, Human
gccugugagcuaggaauuguguu

SEQ ID NO: 3154739 - RNA, 22 nt, Human
gcucagugucuggcugcagagc

SEQ ID NO: 3154740 - RNA, 21 nt, Human
gcucagaggguguccugcacc

SEQ ID NO: 3154741 - RNA, 17 nt, Human
gcuaugagcuggggaug

SEQ ID NO: 3154742 - RNA, 20 nt, Human
ggccauucuuucccaacacc

SEQ ID NO: 3154743 - RNA, 12 nt, Human
ggcagcucagcu

SEQ ID NO: 3154744 - RNA, 18 nt, Human
ggauugggccccugccag

SEQ ID NO: 3154745 - RNA, 17 nt, Human
ggauugggccccugcca

SEQ ID NO: 3154746 - RNA, 19 nt, Human
ggcaaucauggugcucaga

SEQ ID NO: 3154747 - RNA, 17 nt, Human
ggauggaaugauggguc

SEQ ID NO: 3154748 - RNA, 16 nt, Human
ggaugcauggagauag

SEQ ID NO: 3154749 - RNA, 12 nt, Human
ggcccugugccu

SEQ ID NO: 3154750 - RNA, 21 nt, Human
ggccuaaccugccgagagucc

SEQ ID NO: 3154751 - RNA, 22 nt, Human
ggccuaaccugccgagagucca

SEQ ID NO: 3154752 - RNA, 16 nt, Human
ggcuaggguggggaga

SEQ ID NO: 3154753 - RNA, 21 nt, Human
ggcuauggggauagaugugug

SEQ ID NO: 3154754 - RNA, 18 nt, Human
ggcuccaggccagggggc

SEQ ID NO: 3154755 - RNA, 14 nt, Human
ggcuccaggccagg

SEQ ID NO: 3154756 - RNA, 16 nt, Human
ggcuccaggccagggg

SEQ ID NO: 3154757 - RNA, 13 nt, Human
ggccugggcagga

SEQ ID NO: 3154758 - RNA, 14 nt, Human
ggccugggcaggag

SEQ ID NO: 3154759 - RNA, 11 nt, Human
ggccugugagc

SEQ ID NO: 3154760 - RNA, 16 nt, Human
ggcgcggcugggagga

SEQ ID NO: 3154761 - RNA, 11 nt, Human
gcuucauacag

SEQ ID NO: 3154762 - RNA, 11 nt, Human
gcuucauacac

SEQ ID NO: 3154763 - RNA, 22 nt, Human
gcuucauacagggaugguguuc

SEQ ID NO: 3154764 - RNA, 21 nt, Human
ggaaccaaagcgaauuuuaaa

SEQ ID NO: 3154765 - RNA, 22 nt, Human
ggaaccaaagcgaauuuuaaaa

SEQ ID NO: 3154766 - RNA, 22 nt, Human
gcuuuguggcacuggggcaggg

SEQ ID NO: 3154767 - RNA, 14 nt, Human
gcuuuguggcacug

SEQ ID NO: 3154768 - RNA, 20 nt, Human
ggaaaagccaagaggcugca

SEQ ID NO: 3154769 - RNA, 22 nt, Human
ggagaaugucaguauguggaag

SEQ ID NO: 3154770 - RNA, 20 nt, Human
ggagauagccccacaggagg

SEQ ID NO: 3154771 - RNA, 21 nt, Human
ggagauagccccacaggaggu

SEQ ID NO: 3154772 - RNA, 12 nt, Human
ggaauuguguuu

SEQ ID NO: 3154773 - RNA, 23 nt, Human
ggaauuggguggggggcuucaua

SEQ ID NO: 3154774 - RNA, 19 nt, Human
ggaauuuucaucuaggauu

SEQ ID NO: 3154775 - RNA, 16 nt, Human
ggaauuauuuuaaaag

SEQ ID NO: 3154776 - RNA, 17 nt, Human
ggaauuauuuuaaaaga

SEQ ID NO: 3154777 - RNA, 14 nt, Human
ggaauuauuuuaaa

SEQ ID NO: 3154778 - RNA, 15 nt, Human
ggaauuauuuuaaaa

SEQ ID NO: 3154779 - RNA, 14 nt, Human
ggaaugcuguguua

SEQ ID NO: 3154780 - RNA, 18 nt, Human
ggaagugcuaauuuugaa

SEQ ID NO: 3154781 - RNA, 22 nt, Human
ggaaggaucccaugagcuccuu

SEQ ID NO: 3154782 - RNA, 23 nt, Human
ggaagggacaccaagccuuggcu

SEQ ID NO: 3154783 - RNA, 15 nt, Human
guaaauaguauuuga

SEQ ID NO: 3154784 - RNA, 17 nt, Human
guaaauaguauuugaga

SEQ ID NO: 3154785 - RNA, 16 nt, Human
guaaauaguauuugag

SEQ ID NO: 3154786 - RNA, 16 nt, Human
guaaauaaaggaacca

SEQ ID NO: 3154787 - RNA, 20 nt, Human
guaaaaacaaagaaauuaug

SEQ ID NO: 3154788 - RNA, 18 nt, Human
guaaaaacaaagaaauua

SEQ ID NO: 3154789 - RNA, 15 nt, Human
guacgaagaguauuu

SEQ ID NO: 3154790 - RNA, 23 nt, Human
guacuuuauuuucuauaauuuaa

SEQ ID NO: 3154791 - RNA, 22 nt, Human
guacuugcucuugaugccuggc

SEQ ID NO: 3154792 - RNA, 15 nt, Human
guacuugcucuugau

SEQ ID NO: 3154793 - RNA, 16 nt, Human
guacuugcucuugaug

SEQ ID NO: 3154794 - RNA, 18 nt, Human
guacuugcucuugaugcc

SEQ ID NO: 3154795 - RNA, 19 nt, Human
guacuugcucuugaugccu

SEQ ID NO: 3154796 - RNA, 14 nt, Human
guacuugcucuuga

SEQ ID NO: 3154797 - RNA, 15 nt, Human
guacagacagaaaaa

SEQ ID NO: 3154798 - RNA, 11 nt, Human
guaaugaaaac

SEQ ID NO: 3154799 - RNA, 13 nt, Human
guaaugaaaacca

SEQ ID NO: 3154800 - RNA, 15 nt, Human
guaaugaaacuugga

SEQ ID NO: 3154801 - RNA, 16 nt, Human
guaaugaaacuuggau

SEQ ID NO: 3154802 - RNA, 14 nt, Human
guaauucaagaaaa

SEQ ID NO: 3154803 - RNA, 13 nt, Human
guaauucaagaaa

SEQ ID NO: 3154804 - RNA, 23 nt, Human
ggucagcccaaaccaccagaagc

SEQ ID NO: 3154805 - RNA, 18 nt, Human
gggugcugggccccugcc

SEQ ID NO: 3154806 - RNA, 19 nt, Human
gggugcugggccccugccu

SEQ ID NO: 3154807 - RNA, 19 nt, Human
ggguuccagcaccacacuc

SEQ ID NO: 3154808 - RNA, 20 nt, Human
ggugcccagaaugaggcugc

SEQ ID NO: 3154809 - RNA, 18 nt, Human
ggucccuaauaaagcugu

SEQ ID NO: 3154810 - RNA, 12 nt, Human
ggucccuaauaa

SEQ ID NO: 3154811 - RNA, 13 nt, Human
ggucccuaauaaa

SEQ ID NO: 3154812 - RNA, 16 nt, Human
ggucccuaauaaagcu

SEQ ID NO: 3154813 - RNA, 17 nt, Human
ggucccuaauaaagcug

SEQ ID NO: 3154814 - RNA, 18 nt, Human
ggggaguuuagggugggg

SEQ ID NO: 3154815 - RNA, 13 nt, Human
ggggauagaugug

SEQ ID NO: 3154816 - RNA, 19 nt, Human
gggcuucauacacaugaga

SEQ ID NO: 3154817 - RNA, 13 nt, Human
gggcuucauacac

SEQ ID NO: 3154818 - RNA, 14 nt, Human
gggcgcggcuggga

SEQ ID NO: 3154819 - RNA, 23 nt, Human
gucuaagauaguaacaaugaaga

SEQ ID NO: 3154820 - RNA, 22 nt, Human
gucccugccuggaccagccucu

SEQ ID NO: 3154821 - RNA, 23 nt, Human
gucccugccuggaccagccucuc

SEQ ID NO: 3154822 - RNA, 20 nt, Human
gucccugccuggaccagccu

SEQ ID NO: 3154823 - RNA, 21 nt, Human
gucccugccuggaccagccuc

SEQ ID NO: 3154824 - RNA, 14 nt, Human
gucccugccuggac

SEQ ID NO: 3154825 - RNA, 12 nt, Human
guccucagcccc

SEQ ID NO: 3154826 - RNA, 13 nt, Human
guccucacacuca

SEQ ID NO: 3154827 - RNA, 21 nt, Human
guauuugagaguucuaaauuu

SEQ ID NO: 3154828 - RNA, 19 nt, Human
guauuugagaguucuaaau

SEQ ID NO: 3154829 - RNA, 15 nt, Human
guauuauguguguuu

SEQ ID NO: 3154830 - RNA, 20 nt, Human
gucccagaaugccuccugca

SEQ ID NO: 3154831 - RNA, 14 nt, Human
gucacgccagacuu

SEQ ID NO: 3154832 - RNA, 23 nt, Human
gucagcccaaaccaccagaagcc

SEQ ID NO: 3154833 - RNA, 22 nt, Human
gucagcccaaaccaccagaagc

SEQ ID NO: 3154834 - RNA, 19 nt, Human
gugccuugucacgccagac

SEQ ID NO: 3154835 - RNA, 23 nt, Human
guggaaaagccaagaggcugcag

SEQ ID NO: 3154836 - RNA, 21 nt, Human
gugcuucuaguucugccagga

SEQ ID NO: 3154837 - RNA, 22 nt, Human
gugcuucuaguucugccaggag

SEQ ID NO: 3154838 - RNA, 20 nt, Human
gugcuucuaguucugccagg

SEQ ID NO: 3154839 - RNA, 16 nt, Human
guggcucgggaggcga

SEQ ID NO: 3154840 - RNA, 18 nt, Human
guggcucgggaggcgaag

SEQ ID NO: 3154841 - RNA, 14 nt, Human
guggcauccagagu

SEQ ID NO: 3154842 - RNA, 15 nt, Human
guggcaguuuggcaa

SEQ ID NO: 3154843 - RNA, 11 nt, Human
guggcagucug

SEQ ID NO: 3154844 - RNA, 19 nt, Human
gugaaagaaaauaacaaua

SEQ ID NO: 3154845 - RNA, 12 nt, Human
gugaaaauuauu

SEQ ID NO: 3154846 - RNA, 15 nt, Human
gugaaaauuauuuug

SEQ ID NO: 3154847 - RNA, 17 nt, Human
gugaaaguacauuugga

SEQ ID NO: 3154848 - RNA, 13 nt, Human
gugaaaucauuca

SEQ ID NO: 3154849 - RNA, 18 nt, Human
gugaaauuauucauaauu

SEQ ID NO: 3154850 - RNA, 20 nt, Human
gugaaauuauucauaauuau

SEQ ID NO: 3154851 - RNA, 14 nt, Human
gugagcuacaaaug

SEQ ID NO: 3154852 - RNA, 12 nt, Human
gugacucuuucc

SEQ ID NO: 3154853 - RNA, 19 nt, Human
gugaccuuccaagagccug

SEQ ID NO: 3154854 - RNA, 20 nt, Human
gugaccuuccaagagccuga

SEQ ID NO: 3154855 - RNA, 17 nt, Human
gugauuuuuaugccacc

SEQ ID NO: 3154856 - RNA, 19 nt, Human
gugauuuuuaugccaccug

SEQ ID NO: 3154857 - RNA, 20 nt, Human
gugauuuuuaugccaccuga

SEQ ID NO: 3154858 - RNA, 16 nt, Human
gugauuuuuaugccac

SEQ ID NO: 3154859 - RNA, 15 nt, Human
gugaggaugucuggg

SEQ ID NO: 3154860 - RNA, 18 nt, Human
ugcuguguuaaauaaacc

SEQ ID NO: 3154861 - RNA, 11 nt, Human
ugcuguguuaa

SEQ ID NO: 3154862 - RNA, 16 nt, Human
ugcuguuaucccugcc

SEQ ID NO: 3154863 - RNA, 13 nt, Human
ugcugguuuuagu

SEQ ID NO: 3154864 - RNA, 15 nt, Human
ugcugccugcuuuuu

SEQ ID NO: 3154865 - RNA, 17 nt, Human
ugcugccugcuuuuuau

SEQ ID NO: 3154866 - RNA, 14 nt, Human
ugcugggccccugc

SEQ ID NO: 3154867 - RNA, 16 nt, Human
ugcugggccccugccu

SEQ ID NO: 3154868 - RNA, 17 nt, Human
ugcugggccccugccuc

SEQ ID NO: 3154869 - RNA, 18 nt, Human
ugcugggccccugccucu

SEQ ID NO: 3154870 - RNA, 19 nt, Human
ugcugggccccugccucuc

SEQ ID NO: 3154871 - RNA, 21 nt, Human
ugcugggccccugccucucug

SEQ ID NO: 3154872 - RNA, 22 nt, Human
ugcugggccccugccucucugc

SEQ ID NO: 3154873 - RNA, 23 nt, Human
ugcugggccccugccucucugca

SEQ ID NO: 3154874 - RNA, 24 nt, Human
ugcugggccccugccucucugcag

SEQ ID NO: 3154875 - RNA, 15 nt, Human
ugcucaggagcccug

SEQ ID NO: 3154876 - RNA, 20 nt, Human
ugcucaggagcccugggagg

SEQ ID NO: 3154877 - RNA, 19 nt, Human
ugcucagugucuggcugca

SEQ ID NO: 3154878 - RNA, 18 nt, Human
ugcucaggagcccuggga

SEQ ID NO: 3154879 - RNA, 19 nt, Human
ugcucaggagcccugggag

SEQ ID NO: 3154880 - RNA, 17 nt, Human
ugcucuugaugccuggc

SEQ ID NO: 3154881 - RNA, 20 nt, Human
ugccuugcauaauggucaga

SEQ ID NO: 3154882 - RNA, 17 nt, Human
ugcuaagaauauuugaa

SEQ ID NO: 3154883 - RNA, 21 nt, Human
ugcuaagaauauuugaaugua

SEQ ID NO: 3154884 - RNA, 22 nt, Human
ugcuaagaauauuugaauguau

SEQ ID NO: 3154885 - RNA, 18 nt, Human
ugcauauuauuuuauguu

SEQ ID NO: 3154886 - RNA, 16 nt, Human
ugcauagguuuagcag

SEQ ID NO: 3154887 - RNA, 19 nt, Human
ugcccagaaugaggcugcu

SEQ ID NO: 3154888 - RNA, 15 nt, Human
uggaccagccucucc

SEQ ID NO: 3154889 - RNA, 19 nt, Human
uggaucugugaggggcucu

SEQ ID NO: 3154890 - RNA, 19 nt, Human
uggcaaacucuccaccaca

SEQ ID NO: 3154891 - RNA, 15 nt, Human
uggaucugugagggg

SEQ ID NO: 3154892 - RNA, 20 nt, Human
uggcuccauugguguugaca

SEQ ID NO: 3154893 - RNA, 15 nt, Human
uggcgggguggggug

SEQ ID NO: 3154894 - RNA, 21 nt, Human
uggugaccuuccaagagccug

SEQ ID NO: 3154895 - RNA, 22 nt, Human
uggugaccuuccaagagccuga

SEQ ID NO: 3154896 - RNA, 14 nt, Human
ugguccucacacuc

SEQ ID NO: 3154897 - RNA, 13 nt, Human
ugggcaggaggga

SEQ ID NO: 3154898 - RNA, 15 nt, Human
ugggcaggagggagg

SEQ ID NO: 3154899 - RNA, 16 nt, Human
ugggcaggagggaggu

SEQ ID NO: 3154900 - RNA, 18 nt, Human
ugggcaggagggaggugc

SEQ ID NO: 3154901 - RNA, 20 nt, Human
ugggccccugccucucugca

SEQ ID NO: 3154902 - RNA, 21 nt, Human
ugggccccugccucucugcag

SEQ ID NO: 3154903 - RNA, 23 nt, Human
ugggccccugccucucugcaggu

SEQ ID NO: 3154904 - RNA, 22 nt, Human
ugggagugaggaugucugggcc

SEQ ID NO: 3154905 - RNA, 13 nt, Human
ugggaguguguaa

SEQ ID NO: 3154906 - RNA, 11 nt, Human
ugggagugugu

SEQ ID NO: 3154907 - RNA, 20 nt, Human
uggggaguuuaggguggggg

SEQ ID NO: 3154908 - RNA, 20 nt, Human
uggggauagauguguggaca

SEQ ID NO: 3154909 - RNA, 18 nt, Human
uggggauagaugugugga

SEQ ID NO: 3154910 - RNA, 17 nt, Human
uggggauagaugugugg

SEQ ID NO: 3154911 - RNA, 16 nt, Human
uggggauagaugugug

SEQ ID NO: 3154912 - RNA, 20 nt, Human
uggggccaggcugggucgcc

SEQ ID NO: 3154913 - RNA, 21 nt, Human
uggggccaggcugggucgccc

SEQ ID NO: 3154914 - RNA, 22 nt, Human
uggggccaggcugggucgcccu

SEQ ID NO: 3154915 - RNA, 14 nt, Human
ugggggucugugug

SEQ ID NO: 3154916 - RNA, 13 nt, Human
uggggggggugcu

SEQ ID NO: 3154917 - RNA, 21 nt, Human
ucuuuccacuccuccuagcca

SEQ ID NO: 3154918 - RNA, 22 nt, Human
ucuuuccacuccuccuagccac

SEQ ID NO: 3154919 - RNA, 12 nt, Human
ucuuugccaagu

SEQ ID NO: 3154920 - RNA, 17 nt, Human
ucuuucacauuuaaaua

SEQ ID NO: 3154921 - RNA, 19 nt, Human
ugaaauggacuuuuguaca

SEQ ID NO: 3154922 - RNA, 12 nt, Human
ugaaauuauuca

SEQ ID NO: 3154923 - RNA, 21 nt, Human
ugaacagcggcuggacuugga

SEQ ID NO: 3154924 - RNA, 22 nt, Human
ugaacagcggcuggacuuggag

SEQ ID NO: 3154925 - RNA, 15 nt, Human
ugaacagcggcugga

SEQ ID NO: 3154926 - RNA, 16 nt, Human
ugaauuauuuucucuc

SEQ ID NO: 3154927 - RNA, 22 nt, Human
ugaaucauuuuaccuuugacaa

SEQ ID NO: 3154928 - RNA, 23 nt, Human
ugaaucauuuuaccuuugacaaa

SEQ ID NO: 3154929 - RNA, 16 nt, Human
ugacagaauauguuuc

SEQ ID NO: 3154930 - RNA, 17 nt, Human
ugacauacauccaacau

SEQ ID NO: 3154931 - RNA, 23 nt, Human
ugacauaaguauuuaauucaugu

SEQ ID NO: 3154932 - RNA, 20 nt, Human
ugaugcuacaggauuugaaa

SEQ ID NO: 3154933 - RNA, 11 nt, Human
ugaugccuggc

SEQ ID NO: 3154934 - RNA, 13 nt, Human
ugaugguuguaca

SEQ ID NO: 3154935 - RNA, 14 nt, Human
ugaugguuguacau

SEQ ID NO: 3154936 - RNA, 21 nt, Human
ugauguauucuagcuaaugua

SEQ ID NO: 3154937 - RNA, 18 nt, Human
ugauguguuuauuuauag

SEQ ID NO: 3154938 - RNA, 14 nt, Human
ugauguguuuauuu

SEQ ID NO: 3154939 - RNA, 13 nt, Human
ugauuauauguca

SEQ ID NO: 3154940 - RNA, 22 nt, Human
ugaguucuacauaaguaauuca

SEQ ID NO: 3154941 - RNA, 14 nt, Human
ugaggugggagaug

SEQ ID NO: 3154942 - RNA, 20 nt, Human
ugagcuggggaugucucuca

SEQ ID NO: 3154943 - RNA, 16 nt, Human
ugaggagcuugaaacc

SEQ ID NO: 3154944 - RNA, 14 nt, Human
ugaggcaggucccc

SEQ ID NO: 3154945 - RNA, 16 nt, Human
ugaggcagguccccag

SEQ ID NO: 3154946 - RNA, 17 nt, Human
ugaggcagguccccaga

SEQ ID NO: 3154947 - RNA, 23 nt, Human
ugagacguuuuuggaagaguagu

SEQ ID NO: 3154948 - RNA, 17 nt, Human
ugagaaauuuauaaacu

SEQ ID NO: 3154949 - RNA, 19 nt, Human
ugagcuccuuaaggcucuu

SEQ ID NO: 3154950 - RNA, 21 nt, Human
ugagcuccuuaaggcucuuuu

SEQ ID NO: 3154951 - RNA, 14 nt, Human
uccagcaccacacu

SEQ ID NO: 3154952 - RNA, 18 nt, Human
uccagagucccugccugg

SEQ ID NO: 3154953 - RNA, 19 nt, Human
uccagagucccugccugga

SEQ ID NO: 3154954 - RNA, 20 nt, Human
uccagagucccugccuggac

SEQ ID NO: 3154955 - RNA, 21 nt, Human
uccagagucccugccuggacc

SEQ ID NO: 3154956 - RNA, 23 nt, Human
uccagaaagaaaacuuguauuau

SEQ ID NO: 3154957 - RNA, 16 nt, Human
ucaucuccccaucauu

SEQ ID NO: 3154958 - RNA, 14 nt, Human
ucauggugcucaga

SEQ ID NO: 3154959 - RNA, 22 nt, Human
uccaaaaagauuuucagaaaau

SEQ ID NO: 3154960 - RNA, 14 nt, Human
uccaaacaggcuca

SEQ ID NO: 3154961 - RNA, 16 nt, Human
uccaaaccaaauaaaa

SEQ ID NO: 3154962 - RNA, 22 nt, Human
ucagucuuuaaucugagaggcc

SEQ ID NO: 3154963 - RNA, 11 nt, Human
ucaggagcccu

SEQ ID NO: 3154964 - RNA, 12 nt, Human
ucaggagcccug

SEQ ID NO: 3154965 - RNA, 14 nt, Human
ucaggagcccuggg

SEQ ID NO: 3154966 - RNA, 15 nt, Human
ucaggagcccuggga

SEQ ID NO: 3154967 - RNA, 13 nt, Human
uccuacccccugu

SEQ ID NO: 3154968 - RNA, 15 nt, Human
uccuacccccugugc

SEQ ID NO: 3154969 - RNA, 16 nt, Human
uccuacccccugugcc

SEQ ID NO: 3154970 - RNA, 17 nt, Human
uccuacccccugugccu

SEQ ID NO: 3154971 - RNA, 15 nt, Human
uccugucucccuccu

SEQ ID NO: 3154972 - RNA, 23 nt, Human
uccugucucccuccucugcccgg

SEQ ID NO: 3154973 - RNA, 16 nt, Human
ucuacugggagccuac

SEQ ID NO: 3154974 - RNA, 19 nt, Human
ucuacugggagccuaccca

SEQ ID NO: 3154975 - RNA, 23 nt, Human
ucucauaauuuauacaggucaua

SEQ ID NO: 3154976 - RNA, 13 nt, Human
uauguguguuuua

SEQ ID NO: 3154977 - RNA, 14 nt, Human
uauggaggcaggag

SEQ ID NO: 3154978 - RNA, 12 nt, Human
uauuauguguuu

SEQ ID NO: 3154979 - RNA, 20 nt, Human
uauuauggaggcaggaguuu

SEQ ID NO: 3154980 - RNA, 17 nt, Human
uauuauauuuacaaaug

SEQ ID NO: 3154981 - RNA, 14 nt, Human
uauugauaaguuca

SEQ ID NO: 3154982 - RNA, 16 nt, Human
uauugauaaguucaua

SEQ ID NO: 3154983 - RNA, 23 nt, Human
uauugauaaguucauacauugua

SEQ ID NO: 3154984 - RNA, 21 nt, Human
uauuugaauguaugcuucaua

SEQ ID NO: 3154985 - RNA, 22 nt, Human
uauuugaauguaugcuucauac

SEQ ID NO: 3154986 - RNA, 23 nt, Human
uauuugaauguaugcuucauaca

SEQ ID NO: 3154987 - RNA, 15 nt, Human
ucaaagagagaaaau

SEQ ID NO: 3154988 - RNA, 20 nt, Human
ucaaagagagaaaauaaaga

SEQ ID NO: 3154989 - RNA, 12 nt, Human
ucacauuuaaau

SEQ ID NO: 3154990 - RNA, 22 nt, Human
ucacauuguauucagaguugau

SEQ ID NO: 3154991 - RNA, 15 nt, Human
uauaauucacauugu

SEQ ID NO: 3154992 - RNA, 20 nt, Human
uaguugcaacuuuguauaaa

SEQ ID NO: 3154993 - RNA, 15 nt, Human
uaguaugaaauuaua

SEQ ID NO: 3154994 - RNA, 23 nt, Human
uaguaugaaauuauauaaguauu

SEQ ID NO: 3154995 - RNA, 13 nt, Human
uaguaugaaauua

SEQ ID NO: 3154996 - RNA, 16 nt, Human
uaggaauuguguuuau

SEQ ID NO: 3154997 - RNA, 16 nt, Human
uaggucagugcaaaua

SEQ ID NO: 3154998 - RNA, 16 nt, Human
uagguaaauuacaguu

SEQ ID NO: 3154999 - RNA, 15 nt, Human
uaggcuagggugggg

SEQ ID NO: 3155000 - RNA, 16 nt, Human
uaggcuagggugggga

SEQ ID NO: 3155001 - RNA, 20 nt, Human
uaugaaguuuuuuuuauaca

SEQ ID NO: 3155002 - RNA, 17 nt, Human
uaucuguuuacaguguu

SEQ ID NO: 3155003 - RNA, 16 nt, Human
uaucuguuuacagugu

SEQ ID NO: 3155004 - RNA, 19 nt, Human
uaugacauaaaaacaacuu

SEQ ID NO: 3155005 - RNA, 22 nt, Human
uaugacauaaaaacaacuuuau

SEQ ID NO: 3155006 - RNA, 23 nt, Human
uaugacauaaaaacaacuuuaua

SEQ ID NO: 3155007 - RNA, 17 nt, Human
uauccuuucuaacaaaa

SEQ ID NO: 3155008 - RNA, 15 nt, Human
uaucguaaaauuaag

SEQ ID NO: 3155009 - RNA, 18 nt, Human
uaucguaaaauuaagaaa

SEQ ID NO: 3155010 - RNA, 12 nt, Human
uaugcuucauac

SEQ ID NO: 3155011 - RNA, 13 nt, Human
uaugcuucauaca

SEQ ID NO: 3155012 - RNA, 14 nt, Human
uaugcuucauacag

SEQ ID NO: 3155013 - RNA, 16 nt, Human
uaugcuucauacaggg

SEQ ID NO: 3155014 - RNA, 20 nt, Human
uaugcauauuauuuuauguu

SEQ ID NO: 3155015 - RNA, 17 nt, Human
uaugcuucauacaggga

SEQ ID NO: 3155016 - RNA, 23 nt, Human
uaugagcuggggaugucucucau

SEQ ID NO: 3155017 - RNA, 14 nt, Human
uuaguguucauaaa

SEQ ID NO: 3155018 - RNA, 21 nt, Human
uuacuaggugcccagaaugag

SEQ ID NO: 3155019 - RNA, 17 nt, Human
uuacugucuuuuuucua

SEQ ID NO: 3155020 - RNA, 19 nt, Human
uuacugucuuuuuucuaaa

SEQ ID NO: 3155021 - RNA, 13 nt, Human
uuaauauauuucc

SEQ ID NO: 3155022 - RNA, 14 nt, Human
uuaauauauuucca

SEQ ID NO: 3155023 - RNA, 21 nt, Human
uuaaugauaaguaaaugcuag

SEQ ID NO: 3155024 - RNA, 17 nt, Human
uuaaugauaaguaaaug

SEQ ID NO: 3155025 - RNA, 21 nt, Human
uuaaauguuuuuuuuuaaaga

SEQ ID NO: 3155026 - RNA, 23 nt, Human
uuaaauguuuuuuuuuaaagacu

SEQ ID NO: 3155027 - RNA, 21 nt, Human
uuaagcagauggaaugcugug

SEQ ID NO: 3155028 - RNA, 12 nt, Human
uuaacucagucu

SEQ ID NO: 3155029 - RNA, 18 nt, Human
uguuuuuuuuuaaagacu

SEQ ID NO: 3155030 - RNA, 21 nt, Human
uuaaaagaugcaauguagagg

SEQ ID NO: 3155031 - RNA, 19 nt, Human
uguuuagaagaaguguguc

SEQ ID NO: 3155032 - RNA, 16 nt, Human
uguuuagaagaagugu

SEQ ID NO: 3155033 - RNA, 16 nt, Human
uuccacuccuccuagc

SEQ ID NO: 3155034 - RNA, 18 nt, Human
uuccacuccuccuagcca

SEQ ID NO: 3155035 - RNA, 21 nt, Human
uuccacuccuccuagccaccc

SEQ ID NO: 3155036 - RNA, 21 nt, Human
uuccaaaauaauuuuaagaaa

SEQ ID NO: 3155037 - RNA, 13 nt, Human
uuccaaaauaauu

SEQ ID NO: 3155038 - RNA, 19 nt, Human
uucaugcauagguuuagca

SEQ ID NO: 3155039 - RNA, 17 nt, Human
uucaugcaaacuuuauu

SEQ ID NO: 3155040 - RNA, 12 nt, Human
uuccaaaauaau

SEQ ID NO: 3155041 - RNA, 20 nt, Human
uuccuucugugaaaguacau

SEQ ID NO: 3155042 - RNA, 12 nt, Human
uucccugaggug

SEQ ID NO: 3155043 - RNA, 16 nt, Human
uucccugaaggaacca

SEQ ID NO: 3155044 - RNA, 20 nt, Human
uuauuuuauguugcauagaa

SEQ ID NO: 3155045 - RNA, 21 nt, Human
uucagaguugaugguuguaca

SEQ ID NO: 3155046 - RNA, 22 nt, Human
uucagaguugaugguuguacau

SEQ ID NO: 3155047 - RNA, 15 nt, Human
uuauugauaaguuca

SEQ ID NO: 3155048 - RNA, 19 nt, Human
uuauugauaaguucauaca

SEQ ID NO: 3155049 - RNA, 20 nt, Human
uuauugauaaguucauacau

SEQ ID NO: 3155050 - RNA, 20 nt, Human
uuaucuugaauaauguaaga

SEQ ID NO: 3155051 - RNA, 13 nt, Human
uuaguugcaacuu

SEQ ID NO: 3155052 - RNA, 20 nt, Human
uuaguugcaacuuuguauaa

SEQ ID NO: 3155053 - RNA, 16 nt, Human
uuaugccaccugaaua

SEQ ID NO: 3155054 - RNA, 13 nt, Human
uuaugccaccuga

SEQ ID NO: 3155055 - RNA, 20 nt, Human
uuuaaaagauaaauauuaua

SEQ ID NO: 3155056 - RNA, 18 nt, Human
uuuaaaagaugcaaugua

SEQ ID NO: 3155057 - RNA, 12 nt, Human
uuuaaaaugucu

SEQ ID NO: 3155058 - RNA, 16 nt, Human
uuuaaaaugagaaauc

SEQ ID NO: 3155059 - RNA, 16 nt, Human
uuuaaaauugugaugu

SEQ ID NO: 3155060 - RNA, 18 nt, Human
uuguuuagaagaagugug

SEQ ID NO: 3155061 - RNA, 15 nt, Human
uuguuuagaagaagu

SEQ ID NO: 3155062 - RNA, 19 nt, Human
uuguucaauaauaaauauu

SEQ ID NO: 3155063 - RNA, 17 nt, Human
uuuaguugcaacuuugu

SEQ ID NO: 3155064 - RNA, 18 nt, Human
uuuaguugcaacuuugua

SEQ ID NO: 3155065 - RNA, 15 nt, Human
uuuauacaggucaua

SEQ ID NO: 3155066 - RNA, 22 nt, Human
uuuaauaaacacucuugaaaaa

SEQ ID NO: 3155067 - RNA, 14 nt, Human
uuuaauaaacacuc

SEQ ID NO: 3155068 - RNA, 15 nt, Human
uuuaauaaacacucu

SEQ ID NO: 3155069 - RNA, 20 nt, Human
uuuacagaggacaguauuug

SEQ ID NO: 3155070 - RNA, 21 nt, Human
uuugaaauuguauuacaaauc

SEQ ID NO: 3155071 - RNA, 18 nt, Human
uuucuuaaccagaucauu

SEQ ID NO: 3155072 - RNA, 16 nt, Human
uuugagaguucuaaau

SEQ ID NO: 3155073 - RNA, 14 nt, Human
uuugagaguucuaa

SEQ ID NO: 3155074 - RNA, 13 nt, Human
uuugaguucuaca

SEQ ID NO: 3155075 - RNA, 12 nt, Human
uuugaguucuac

SEQ ID NO: 3155076 - RNA, 14 nt, Human
uuucuaaaguaaaa

SEQ ID NO: 3155077 - RNA, 22 nt, Human
uuucuaaaguaaaaacaaagaa

SEQ ID NO: 3155078 - RNA, 17 nt, Human
uuucuaaaguaaaaaca

SEQ ID NO: 3155079 - RNA, 20 nt, Human
uuuccuaaauauauuuuaag

SEQ ID NO: 3155080 - RNA, 18 nt, Human
uuuccacuccuccuagcc

SEQ ID NO: 3155081 - RNA, 19 nt, Human
uuuccacuccuccuagcca

SEQ ID NO: 3155082 - RNA, 14 nt, Human
uuuaugccaccuga

SEQ ID NO: 3155083 - RNA, 15 nt, Human
uuucacauaucuagu

SEQ ID NO: 3155084 - RNA, 21 nt, Human
uuucacauaucuaguaugaaa

SEQ ID NO: 3155085 - RNA, 20 nt, Human
uugcaguguggugagaucau

SEQ ID NO: 3155086 - RNA, 16 nt, Human
uugcauaacguauaaa

SEQ ID NO: 3155087 - RNA, 17 nt, Human
uugauccagaaagaaaa

SEQ ID NO: 3155088 - RNA, 18 nt, Human
uugaaaauuaacaugaau

SEQ ID NO: 3155089 - RNA, 21 nt, Human
uugaaaaucuuauaauuuaaa

SEQ ID NO: 3155090 - RNA, 17 nt, Human
uugaauguuaagcagau

SEQ ID NO: 3155091 - RNA, 14 nt, Human
uugaauguuaagca

SEQ ID NO: 3155092 - RNA, 16 nt, Human
uuguacgaagaguauu

SEQ ID NO: 3155093 - RNA, 19 nt, Human
uuguacgaagaguauuuuu

SEQ ID NO: 3155094 - RNA, 14 nt, Human
uuguagcacugaca

SEQ ID NO: 3155095 - RNA, 16 nt, Human
uuguagcacugacaga

SEQ ID NO: 3155096 - RNA, 17 nt, Human
uuguagcacugacagau

SEQ ID NO: 3155097 - RNA, 18 nt, Human
uuguagcacugacagauu

SEQ ID NO: 3155098 - RNA, 22 nt, Human
uuguagcacugacagauuucca

SEQ ID NO: 3155099 - RNA, 18 nt, Human
uuguacuuuagggaagua

SEQ ID NO: 3155100 - RNA, 14 nt, Human
uugggaccccuggu

SEQ ID NO: 3155101 - RNA, 15 nt, Human
uugggaccccuggug

SEQ ID NO: 3155102 - RNA, 16 nt, Human
uugggaccccuggugg

SEQ ID NO: 3155103 - RNA, 20 nt, Human
uugggaccccuggugguuca

SEQ ID NO: 3155104 - RNA, 16 nt, Human
uuggcagcucuacucu

SEQ ID NO: 3155105 - RNA, 11 nt, Human
uuuguggggag

SEQ ID NO: 3155106 - RNA, 12 nt, Human
aaaaacaacuuu

SEQ ID NO: 3155107 - RNA, 12 nt, Human
aaaacaacuuua

SEQ ID NO: 3155108 - RNA, 19 nt, Human
aaaaacuucaguaaguacg

SEQ ID NO: 3155109 - RNA, 21 nt, Human
aaaauuauuuuguucauacau

SEQ ID NO: 3155110 - RNA, 13 nt, Human
aaacacucuugaa

SEQ ID NO: 3155111 - RNA, 14 nt, Human
aaacacucuugaaa

SEQ ID NO: 3155112 - RNA, 17 nt, Human
aaacacucuugaaaaau

SEQ ID NO: 3155113 - RNA, 13 nt, Human
aaagaaauuaugu

SEQ ID NO: 3155114 - RNA, 11 nt, Human
aaagaacaucc

SEQ ID NO: 3155115 - RNA, 15 nt, Human
aaagaaauuaugugc

SEQ ID NO: 3155116 - RNA, 17 nt, Human
aaagaguacucuuguuu

SEQ ID NO: 3155117 - RNA, 12 nt, Human
aaagaguacucu

SEQ ID NO: 3155118 - RNA, 12 nt, Human
aaagaaaacuug

SEQ ID NO: 3155119 - RNA, 20 nt, Human
aaagaaaacuuguauuaugu

SEQ ID NO: 3155120 - RNA, 12 nt, Human
aaauaacaauga

SEQ ID NO: 3155121 - RNA, 13 nt, Human
aaauaaaggaacc

SEQ ID NO: 3155122 - RNA, 20 nt, Human
aaagucucuggaauuugaaa

SEQ ID NO: 3155123 - RNA, 22 nt, Human
aaagucucuggaauuugaaaca

SEQ ID NO: 3155124 - RNA, 19 nt, Human
aaagucucuggaauuugaa

SEQ ID NO: 3155125 - RNA, 16 nt, Human
aaagggacugagaaau

SEQ ID NO: 3155126 - RNA, 14 nt, Human
aaauaguauuugag

SEQ ID NO: 3155127 - RNA, 16 nt, Human
aacuuuggaacaagau

SEQ ID NO: 3155128 - RNA, 15 nt, Human
aacaaagaaauuaug

SEQ ID NO: 3155129 - RNA, 17 nt, Human
aacaaagaaauuaugug

SEQ ID NO: 3155130 - RNA, 21 nt, Human
aaauugauguguuuauuuaua

SEQ ID NO: 3155131 - RNA, 14 nt, Human
aaccagaucauugu

SEQ ID NO: 3155132 - RNA, 12 nt, Human
aaccagaucauu

SEQ ID NO: 3155133 - RNA, 13 nt, Human
aacaugauuuggg

SEQ ID NO: 3155134 - RNA, 22 nt, Human
aagaaauuaugugccagauuua

SEQ ID NO: 3155135 - RNA, 13 nt, Human
aagaaauuaugug

SEQ ID NO: 3155136 - RNA, 21 nt, Human
aauaauccuaaacauaugaau

SEQ ID NO: 3155137 - RNA, 13 nt, Human
aauaaucauugga

SEQ ID NO: 3155138 - RNA, 12 nt, Human
aauaauguaaga

SEQ ID NO: 3155139 - RNA, 19 nt, Human
aauaauguaagacaaauau

SEQ ID NO: 3155140 - RNA, 17 nt, Human
aauaagugccaggaugg

SEQ ID NO: 3155141 - RNA, 19 nt, Human
aauaaacuauuuguaaagu

SEQ ID NO: 3155142 - RNA, 18 nt, Human
aauaaacuggcagcucag

SEQ ID NO: 3155143 - RNA, 19 nt, Human
aagucucuggaauuugaaa

SEQ ID NO: 3155144 - RNA, 14 nt, Human
aaguacuuuuggca

SEQ ID NO: 3155145 - RNA, 15 nt, Human
aaguacuuuuggcau

SEQ ID NO: 3155146 - RNA, 23 nt, Human
aaguccaggcuuuuuuaucaugu

SEQ ID NO: 3155147 - RNA, 14 nt, Human
aauauuauguguuu

SEQ ID NO: 3155148 - RNA, 18 nt, Human
aaugauaaguaaaugcua

SEQ ID NO: 3155149 - RNA, 21 nt, Human
aaugauaaguaaaugcuaggu

SEQ ID NO: 3155150 - RNA, 18 nt, Human
aaucucauaauuuauaca

SEQ ID NO: 3155151 - RNA, 22 nt, Human
aaugucaguauguggaagugug

SEQ ID NO: 3155152 - RNA, 16 nt, Human
aaugucaguaugugga

SEQ ID NO: 3155153 - RNA, 14 nt, Human
aauuaaauuuugag

SEQ ID NO: 3155154 - RNA, 19 nt, Human
acuuuauacccagaaaguu

SEQ ID NO: 3155155 - RNA, 13 nt, Human
acuuuagggaagu

SEQ ID NO: 3155156 - RNA, 23 nt, Human
acuuuagggaaguacuuuuggca

SEQ ID NO: 3155157 - RNA, 23 nt, Human
agaaaauauuauguguuuccaua

SEQ ID NO: 3155158 - RNA, 12 nt, Human
acuguuuugaau

SEQ ID NO: 3155159 - RNA, 19 nt, Human
acuuguaaaggaauuuaaa

SEQ ID NO: 3155160 - RNA, 20 nt, Human
acuuguaaaggaauuuaaaa

SEQ ID NO: 3155161 - RNA, 18 nt, Human
acuuguaaaggaauuuaa

SEQ ID NO: 3155162 - RNA, 22 nt, Human
acuucugccagcauaauacuug

SEQ ID NO: 3155163 - RNA, 22 nt, Human
acucuaccucauaucaguuugc

SEQ ID NO: 3155164 - RNA, 13 nt, Human
acucuaccucaua

SEQ ID NO: 3155165 - RNA, 14 nt, Human
acuagcuauggugu

SEQ ID NO: 3155166 - RNA, 13 nt, Human
acucagucuuuaa

SEQ ID NO: 3155167 - RNA, 17 nt, Human
acucaggcccaaagccu

SEQ ID NO: 3155168 - RNA, 16 nt, Human
acucaggcccaaagcc

SEQ ID NO: 3155169 - RNA, 12 nt, Human
acuccccuccuu

SEQ ID NO: 3155170 - RNA, 16 nt, Human
acgccagacuucccac

SEQ ID NO: 3155171 - RNA, 22 nt, Human
acgccagacuucccacggcucc

SEQ ID NO: 3155172 - RNA, 15 nt, Human
acacugauccagccc

SEQ ID NO: 3155173 - RNA, 16 nt, Human
acagaauauguuucaa

SEQ ID NO: 3155174 - RNA, 17 nt, Human
acagaauauguuucaaa

SEQ ID NO: 3155175 - RNA, 19 nt, Human
acagaauauguuucaaacu

SEQ ID NO: 3155176 - RNA, 21 nt, Human
acagaauauguuucaaacuuu

SEQ ID NO: 3155177 - RNA, 19 nt, Human
acaggucauauuaauauau

SEQ ID NO: 3155178 - RNA, 15 nt, Human
acaggggcaggagga

SEQ ID NO: 3155179 - RNA, 20 nt, Human
aauuuugaguucuacauaag

SEQ ID NO: 3155180 - RNA, 15 nt, Human
aauuuuauaucuugu

SEQ ID NO: 3155181 - RNA, 13 nt, Human
aauuuugaaaaac

SEQ ID NO: 3155182 - RNA, 16 nt, Human
acaacuauuuuuccaa

SEQ ID NO: 3155183 - RNA, 17 nt, Human
acaacuucaauauccaa

SEQ ID NO: 3155184 - RNA, 18 nt, Human
acaacuucccagugaauu

SEQ ID NO: 3155185 - RNA, 13 nt, Human
acaacuuuauacc

SEQ ID NO: 3155186 - RNA, 14 nt, Human
acaacuuuauaccc

SEQ ID NO: 3155187 - RNA, 23 nt, Human
accacuaaaagaucgcaguuugc

SEQ ID NO: 3155188 - RNA, 19 nt, Human
accaagccuggucagccca

SEQ ID NO: 3155189 - RNA, 20 nt, Human
accaagccuggucagcccaa

SEQ ID NO: 3155190 - RNA, 18 nt, Human
accaagccuggucagccc

SEQ ID NO: 3155191 - RNA, 15 nt, Human
acagguuagcugcuc

SEQ ID NO: 3155192 - RNA, 15 nt, Human
acagguuugggaccc

SEQ ID NO: 3155193 - RNA, 18 nt, Human
acagguuugggaccccug

SEQ ID NO: 3155194 - RNA, 12 nt, Human
accccgacuuuu

SEQ ID NO: 3155195 - RNA, 15 nt, Human
accccgacuuuuguu

SEQ ID NO: 3155196 - RNA, 14 nt, Human
agcaugcacaaauu

SEQ ID NO: 3155197 - RNA, 13 nt, Human
agccagaggucug

SEQ ID NO: 3155198 - RNA, 21 nt, Human
agauaggucagugcaaauacu

SEQ ID NO: 3155199 - RNA, 18 nt, Human
agaggggaaaagagauga

SEQ ID NO: 3155200 - RNA, 16 nt, Human
agaggggaaaagagau

SEQ ID NO: 3155201 - RNA, 16 nt, Human
agaggguguccugcac

SEQ ID NO: 3155202 - RNA, 14 nt, Human
agacgggcccuggu

SEQ ID NO: 3155203 - RNA, 14 nt, Human
agacacaacuauuu

SEQ ID NO: 3155204 - RNA, 15 nt, Human
agaccauagugacca

SEQ ID NO: 3155205 - RNA, 18 nt, Human
agcuucacuguaaaauaa

SEQ ID NO: 3155206 - RNA, 19 nt, Human
agcuuccuucugugaaagu

SEQ ID NO: 3155207 - RNA, 15 nt, Human
agcuuuucccuuuuu

SEQ ID NO: 3155208 - RNA, 21 nt, Human
agcuuuuaugugaaacauguu

SEQ ID NO: 3155209 - RNA, 20 nt, Human
aggaaauggcuguggagugu

SEQ ID NO: 3155210 - RNA, 15 nt, Human
aggaacuacugagga

SEQ ID NO: 3155211 - RNA, 19 nt, Human
aggcuauggggauagaugu

SEQ ID NO: 3155212 - RNA, 22 nt, Human
aggcuauggggauagaugugug

SEQ ID NO: 3155213 - RNA, 21 nt, Human
aggcuauggggauagaugugu

SEQ ID NO: 3155214 - RNA, 18 nt, Human
aggcugcagccaggccac

SEQ ID NO: 3155215 - RNA, 17 nt, Human
agguucaugcaaacuuu

SEQ ID NO: 3155216 - RNA, 22 nt, Human
agguuaauuccaauuauaugag

SEQ ID NO: 3155217 - RNA, 15 nt, Human
agguuaauuccaauu

SEQ ID NO: 3155218 - RNA, 23 nt, Human
agguggcaucagugucuuuccac

SEQ ID NO: 3155219 - RNA, 22 nt, Human
agguggcaucagugucuuucca

SEQ ID NO: 3155220 - RNA, 23 nt, Human
aggugcuucuaguucugccagga

SEQ ID NO: 3155221 - RNA, 16 nt, Human
agguggaagagggcug

SEQ ID NO: 3155222 - RNA, 21 nt, Human
aggugcuucuaguucugccag

SEQ ID NO: 3155223 - RNA, 22 nt, Human
aggugcuucuaguucugccagg

SEQ ID NO: 3155224 - RNA, 15 nt, Human
agguggaaauaaacu

SEQ ID NO: 3155225 - RNA, 17 nt, Human
aggggccgggggcaguc

SEQ ID NO: 3155226 - RNA, 17 nt, Human
aggucccuaauaaagcu

SEQ ID NO: 3155227 - RNA, 18 nt, Human
aggucccuaauaaagcug

SEQ ID NO: 3155228 - RNA, 19 nt, Human
aggucccuaauaaagcugu

SEQ ID NO: 3155229 - RNA, 16 nt, Human
aggucccuaauaaagc

SEQ ID NO: 3155230 - RNA, 20 nt, Human
aggucccuaauaaagcugug

SEQ ID NO: 3155231 - RNA, 18 nt, Human
auauuuaguguucauaaa

SEQ ID NO: 3155232 - RNA, 16 nt, Human
auauuuauaaaaauaa

SEQ ID NO: 3155233 - RNA, 16 nt, Human
auauccuuucuaacaa

SEQ ID NO: 3155234 - RNA, 15 nt, Human
auauccuuucuaaca

SEQ ID NO: 3155235 - RNA, 22 nt, Human
auauaaguauucuaaauuuuau

SEQ ID NO: 3155236 - RNA, 19 nt, Human
auauaaguauucuaaauuu

SEQ ID NO: 3155237 - RNA, 15 nt, Human
auauaagugauugcu

SEQ ID NO: 3155238 - RNA, 15 nt, Human
auauaaguguguguu

SEQ ID NO: 3155239 - RNA, 15 nt, Human
auacuugaaaauuaa

SEQ ID NO: 3155240 - RNA, 16 nt, Human
auacuugaaaauuaac

SEQ ID NO: 3155241 - RNA, 19 nt, Human
auaaguauuuaauucaugu

SEQ ID NO: 3155242 - RNA, 19 nt, Human
auaaguguguguuuuucau

SEQ ID NO: 3155243 - RNA, 22 nt, Human
auaaguguguguuuuucauaaa

SEQ ID NO: 3155244 - RNA, 16 nt, Human
agugucuuuccacucc

SEQ ID NO: 3155245 - RNA, 23 nt, Human
aguuguaucagcacguguggccu

SEQ ID NO: 3155246 - RNA, 20 nt, Human
aguuguaucagcacgugugg

SEQ ID NO: 3155247 - RNA, 22 nt, Human
aucuuauaauuuaaaauaugcu

SEQ ID NO: 3155248 - RNA, 16 nt, Human
aucuuauaauuuaaaa

SEQ ID NO: 3155249 - RNA, 20 nt, Human
augaaacacucaguuguuca

SEQ ID NO: 3155250 - RNA, 22 nt, Human
augaaaaaauauauaucaaaua

SEQ ID NO: 3155251 - RNA, 14 nt, Human
augaaaaaauauau

SEQ ID NO: 3155252 - RNA, 17 nt, Human
augaaaaaauauauauc

SEQ ID NO: 3155253 - RNA, 14 nt, Human
augacucagaauau

SEQ ID NO: 3155254 - RNA, 18 nt, Human
augaagcuuuuaugugaa

SEQ ID NO: 3155255 - RNA, 19 nt, Human
augaagcuuuuaugugaaa

SEQ ID NO: 3155256 - RNA, 20 nt, Human
augaagcuuuuaugugaaac

SEQ ID NO: 3155257 - RNA, 13 nt, Human
auccuuucuaaca

SEQ ID NO: 3155258 - RNA, 21 nt, Human
augccuuuguacuuuagggaa

SEQ ID NO: 3155259 - RNA, 17 nt, Human
auguaauaacugugaag

SEQ ID NO: 3155260 - RNA, 23 nt, Human
auggugacuuuugaaaagaggug

SEQ ID NO: 3155261 - RNA, 18 nt, Human
augugggggucugugugu

SEQ ID NO: 3155262 - RNA, 17 nt, Human
augugggggucugugug

SEQ ID NO: 3155263 - RNA, 16 nt, Human
augugggggucugugu

SEQ ID NO: 3155264 - RNA, 18 nt, Human
auguuucuuuguaaugaa

SEQ ID NO: 3155265 - RNA, 13 nt, Human
ggccccugccucu

SEQ ID NO: 3155266 - RNA, 17 nt, Human
ggccccugccucucugc

SEQ ID NO: 3155267 - RNA, 18 nt, Human
ggccccugccucucugca

SEQ ID NO: 3155268 - RNA, 19 nt, Human
ggccccugccucucugcag

SEQ ID NO: 3155269 - RNA, 20 nt, Human
ggcuaagcuucacuguaaaa

SEQ ID NO: 3155270 - RNA, 18 nt, Human
ggcucuugaacugagcuu

SEQ ID NO: 3155271 - RNA, 19 nt, Human
ggcucuugaacugagcuug

SEQ ID NO: 3155272 - RNA, 20 nt, Human
ggcucuugaacugagcuugg

SEQ ID NO: 3155273 - RNA, 23 nt, Human
aaaaagauuuucagaaaauauua

SEQ ID NO: 3155274 - RNA, 14 nt, Human
aaaaauaaaaaaca

SEQ ID NO: 3155275 - RNA, 14 nt, Human
ggagggggagaggg

SEQ ID NO: 3155276 - RNA, 22 nt, Human
ggaguguguaauuuaaaauugu

SEQ ID NO: 3155277 - RNA, 11 nt, Human
ggaguguguaa

SEQ ID NO: 3155278 - RNA, 23 nt, Human
ggaucuucaucugacuaugacau

SEQ ID NO: 3155279 - RNA, 22 nt, Human
ggaucuucaucugacuaugaca

SEQ ID NO: 3155280 - RNA, 14 nt, Human
ggauuguaguccca

SEQ ID NO: 3155281 - RNA, 12 nt, Human
ggcaggggccgg

SEQ ID NO: 3155282 - RNA, 14 nt, Human
ggcaggagggaggu

SEQ ID NO: 3155283 - RNA, 22 nt, Human
ggcaucggggagccgggagccu

SEQ ID NO: 3155284 - RNA, 16 nt, Human
ggcauccagagucccu

SEQ ID NO: 3155285 - RNA, 18 nt, Human
ggcauccagagucccugc

SEQ ID NO: 3155286 - RNA, 23 nt, Human
ggcaucggggagccgggagccug

SEQ ID NO: 3155287 - RNA, 14 nt, Human
aaaauauuuaaagg

SEQ ID NO: 3155288 - RNA, 16 nt, Human
aaaauauauuuaauga

SEQ ID NO: 3155289 - RNA, 15 nt, Human
aaaauauauuuaaug

SEQ ID NO: 3155290 - RNA, 11 nt, Human
aaaaugagaaa

SEQ ID NO: 3155291 - RNA, 12 nt, Human
aaaaugagaaau

SEQ ID NO: 3155292 - RNA, 22 nt, Human
gggggcuucauacacaugagau

SEQ ID NO: 3155293 - RNA, 22 nt, Human
gggggcagucugagagaggcca

SEQ ID NO: 3155294 - RNA, 18 nt, Human
gggucauucauggccugg

SEQ ID NO: 3155295 - RNA, 21 nt, Human
gggucaucuguaccucugccu

SEQ ID NO: 3155296 - RNA, 15 nt, Human
aaaccaccagaagcc

SEQ ID NO: 3155297 - RNA, 18 nt, Human
aaaccaccagaagcccag

SEQ ID NO: 3155298 - RNA, 14 nt, Human
aaaccaccagaagc

SEQ ID NO: 3155299 - RNA, 19 nt, Human
aaaccaccagaagcccaga

SEQ ID NO: 3155300 - RNA, 14 nt, Human
ggucagugcaaaua

SEQ ID NO: 3155301 - RNA, 21 nt, Human
aaacuucccuuucugcuugug

SEQ ID NO: 3155302 - RNA, 16 nt, Human
gguaggaacugcuggg

SEQ ID NO: 3155303 - RNA, 18 nt, Human
gguaggaacugcugggcu

SEQ ID NO: 3155304 - RNA, 17 nt, Human
ggguguccugcaccggg

SEQ ID NO: 3155305 - RNA, 21 nt, Human
ggguguccugcaccggggccu

SEQ ID NO: 3155306 - RNA, 22 nt, Human
gguaaaucagacuaugaaguuu

SEQ ID NO: 3155307 - RNA, 15 nt, Human
aaauauauuuaauga

SEQ ID NO: 3155308 - RNA, 16 nt, Human
aaauauauuuuaagac

SEQ ID NO: 3155309 - RNA, 22 nt, Human
aaauauauuuuaagacgaaaca

SEQ ID NO: 3155310 - RNA, 18 nt, Human
aaauauaugcuaagucuu

SEQ ID NO: 3155311 - RNA, 14 nt, Human
aaauauauaucaaa

SEQ ID NO: 3155312 - RNA, 14 nt, Human
aaauauauuuaaug

SEQ ID NO: 3155313 - RNA, 20 nt, Human
aaauauuguguugugaaugu

SEQ ID NO: 3155314 - RNA, 13 nt, Human
guaaaccuuuuau

SEQ ID NO: 3155315 - RNA, 15 nt, Human
guaauagagcaaaau

SEQ ID NO: 3155316 - RNA, 14 nt, Human
aaagcuguguggca

SEQ ID NO: 3155317 - RNA, 18 nt, Human
aaagguucaugcaaacuu

SEQ ID NO: 3155318 - RNA, 21 nt, Human
aaaguaaaaacaaagaaauua

SEQ ID NO: 3155319 - RNA, 14 nt, Human
gguuugggaccccu

SEQ ID NO: 3155320 - RNA, 22 nt, Human
gguuuguuuagaagaagugugu

SEQ ID NO: 3155321 - RNA, 22 nt, Human
gguggggggggggcgcggcugg

SEQ ID NO: 3155322 - RNA, 16 nt, Human
gguggggggcuucaua

SEQ ID NO: 3155323 - RNA, 18 nt, Human
gguggggggcuucauaca

SEQ ID NO: 3155324 - RNA, 14 nt, Human
gguuccagccugcc

SEQ ID NO: 3155325 - RNA, 15 nt, Human
gguuccagccugcca

SEQ ID NO: 3155326 - RNA, 16 nt, Human
gguuccagccugccac

SEQ ID NO: 3155327 - RNA, 20 nt, Human
gguucuagcauggcauauuu

SEQ ID NO: 3155328 - RNA, 15 nt, Human
gcggcuggacuugga

SEQ ID NO: 3155329 - RNA, 16 nt, Human
gcggcuggacuuggag

SEQ ID NO: 3155330 - RNA, 21 nt, Human
gcguggaacucgugucuggca

SEQ ID NO: 3155331 - RNA, 21 nt, Human
gcuaggaauuguguuuauaau

SEQ ID NO: 3155332 - RNA, 17 nt, Human
gcuaggguggggagaga

SEQ ID NO: 3155333 - RNA, 18 nt, Human
gcuaggguggggagagac

SEQ ID NO: 3155334 - RNA, 18 nt, Human
gcucagaggguguccugc

SEQ ID NO: 3155335 - RNA, 19 nt, Human
gcucagaggguguccugca

SEQ ID NO: 3155336 - RNA, 22 nt, Human
gcucaggagcccugggaggcuc

SEQ ID NO: 3155337 - RNA, 21 nt, Human
gcucaggagcccugggaggcu

SEQ ID NO: 3155338 - RNA, 23 nt, Human
gcucaggagcccugggaggcucu

SEQ ID NO: 3155339 - RNA, 16 nt, Human
gcucagagcaguguuu

SEQ ID NO: 3155340 - RNA, 21 nt, Human
gcucacugcuaagaauauuug

SEQ ID NO: 3155341 - RNA, 19 nt, Human
gccauucuuucccaacacc

SEQ ID NO: 3155342 - RNA, 12 nt, Human
gccauucuuucc

SEQ ID NO: 3155343 - RNA, 22 nt, Human
gcccacuguacuugcucuugau

SEQ ID NO: 3155344 - RNA, 15 nt, Human
gcccacuguacuugc

SEQ ID NO: 3155345 - RNA, 20 nt, Human
gcccacuguacuugcucuug

SEQ ID NO: 3155346 - RNA, 22 nt, Human
gcuuuuccucaaagggagagag

SEQ ID NO: 3155347 - RNA, 21 nt, Human
gcuuuucccuuuuuuuaagua

SEQ ID NO: 3155348 - RNA, 20 nt, Human
gcuuuucccuuuuuuuaagu

SEQ ID NO: 3155349 - RNA, 17 nt, Human
gcuuuucuuucuaccaa

SEQ ID NO: 3155350 - RNA, 16 nt, Human
ggaaaaaauaacaaug

SEQ ID NO: 3155351 - RNA, 21 nt, Human
ggaaacuaggugcauauuuau

SEQ ID NO: 3155352 - RNA, 19 nt, Human
ggacaguauuuguggggag

SEQ ID NO: 3155353 - RNA, 18 nt, Human
ggacaguauuugugggga

SEQ ID NO: 3155354 - RNA, 17 nt, Human
ggacaggggcaggagga

SEQ ID NO: 3155355 - RNA, 16 nt, Human
ggacaccuaggcuagg

SEQ ID NO: 3155356 - RNA, 16 nt, Human
ggacaccccgacuuuu

SEQ ID NO: 3155357 - RNA, 18 nt, Human
ggaaugaagcaaugcuuc

SEQ ID NO: 3155358 - RNA, 13 nt, Human
gcuggacuuggag

SEQ ID NO: 3155359 - RNA, 20 nt, Human
gcugggaauaagugccagga

SEQ ID NO: 3155360 - RNA, 18 nt, Human
gcugggccccugccucuc

SEQ ID NO: 3155361 - RNA, 12 nt, Human
gcugggccccug

SEQ ID NO: 3155362 - RNA, 13 nt, Human
gcugggccccugc

SEQ ID NO: 3155363 - RNA, 14 nt, Human
gcugggccccugcc

SEQ ID NO: 3155364 - RNA, 23 nt, Human
gcugcagccaggccacuggcccc

SEQ ID NO: 3155365 - RNA, 15 nt, Human
gcugcagccaggcca

SEQ ID NO: 3155366 - RNA, 11 nt, Human
gaaacuuggau

SEQ ID NO: 3155367 - RNA, 16 nt, Human
gaacaagaugguucua

SEQ ID NO: 3155368 - RNA, 19 nt, Human
gaaaucaaagagagaaaau

SEQ ID NO: 3155369 - RNA, 18 nt, Human
cuuuuaugugaaacaugu

SEQ ID NO: 3155370 - RNA, 19 nt, Human
cuuuuaugugaaacauguu

SEQ ID NO: 3155371 - RNA, 14 nt, Human
gaaaauuaacauga

SEQ ID NO: 3155372 - RNA, 14 nt, Human
gaaaaaauauauau

SEQ ID NO: 3155373 - RNA, 14 nt, Human
cuuuugucccagaa

SEQ ID NO: 3155374 - RNA, 13 nt, Human
cuugaugccuggc

SEQ ID NO: 3155375 - RNA, 17 nt, Human
cuugguuccagccugcc

SEQ ID NO: 3155376 - RNA, 19 nt, Human
cuugguuccagccugccac

SEQ ID NO: 3155377 - RNA, 20 nt, Human
cuugguuccagccugccacu

SEQ ID NO: 3155378 - RNA, 17 nt, Human
cuucuaccucuuggcug

SEQ ID NO: 3155379 - RNA, 15 nt, Human
cuuccucuccugucu

SEQ ID NO: 3155380 - RNA, 19 nt, Human
cuuccucuccugucucccu

SEQ ID NO: 3155381 - RNA, 23 nt, Human
cuggcccuaugcuuccggccucc

SEQ ID NO: 3155382 - RNA, 23 nt, Human
cugugaaguuuacauuguaaaua

SEQ ID NO: 3155383 - RNA, 18 nt, Human
cugugaaguuuacauugu

SEQ ID NO: 3155384 - RNA, 19 nt, Human
cuguuaucccugccugguc

SEQ ID NO: 3155385 - RNA, 22 nt, Human
cuggugaccuuccaagagccug

SEQ ID NO: 3155386 - RNA, 23 nt, Human
cuggugaccuuccaagagccuga

SEQ ID NO: 3155387 - RNA, 16 nt, Human
cuguacuugcucuuga

SEQ ID NO: 3155388 - RNA, 19 nt, Human
cuguacuugcucuugaugc

SEQ ID NO: 3155389 - RNA, 20 nt, Human
cuguacuugcucuugaugcc

SEQ ID NO: 3155390 - RNA, 15 nt, Human
gacaaagucaagcca

SEQ ID NO: 3155391 - RNA, 13 nt, Human
gaauuauuuuaaa

SEQ ID NO: 3155392 - RNA, 16 nt, Human
gaauuauuuuaaaaga

SEQ ID NO: 3155393 - RNA, 18 nt, Human
gaauuauuuuaaaagaua

SEQ ID NO: 3155394 - RNA, 12 nt, Human
gagcccugggag

SEQ ID NO: 3155395 - RNA, 16 nt, Human
gagcccugggaggcuc

SEQ ID NO: 3155396 - RNA, 18 nt, Human
gagcccugggaggcucug

SEQ ID NO: 3155397 - RNA, 19 nt, Human
gagcccugggaggcucugg

SEQ ID NO: 3155398 - RNA, 20 nt, Human
gagcccugggaggcucugga

SEQ ID NO: 3155399 - RNA, 20 nt, Human
gaggcucuggagcccacugu

SEQ ID NO: 3155400 - RNA, 22 nt, Human
gaggacaguauuuguggggagg

SEQ ID NO: 3155401 - RNA, 16 nt, Human
gagacgggcccuggug

SEQ ID NO: 3155402 - RNA, 18 nt, Human
gaucccaacacugccagc

SEQ ID NO: 3155403 - RNA, 19 nt, Human
gaucccaacacugccagca

SEQ ID NO: 3155404 - RNA, 17 nt, Human
gaucccaacacugccag

SEQ ID NO: 3155405 - RNA, 23 nt, Human
gauccagcccugaguuccuagcc

SEQ ID NO: 3155406 - RNA, 23 nt, Human
gaucucugcaggaaauggcugug

SEQ ID NO: 3155407 - RNA, 12 nt, Human
gaucucugcagg

SEQ ID NO: 3155408 - RNA, 17 nt, Human
gauacuugaaaauuaac

SEQ ID NO: 3155409 - RNA, 13 nt, Human
gauggaaugaugg

SEQ ID NO: 3155410 - RNA, 20 nt, Human
gcagccaggccacuggcccc

SEQ ID NO: 3155411 - RNA, 17 nt, Human
gcagagcugcgggcugg

SEQ ID NO: 3155412 - RNA, 19 nt, Human
gcagagcugcgggcugggu

SEQ ID NO: 3155413 - RNA, 22 nt, Human
gcauccagagucccugccugga

SEQ ID NO: 3155414 - RNA, 23 nt, Human
gcauccagagucccugccuggac

SEQ ID NO: 3155415 - RNA, 21 nt, Human
gcauccagagucccugccugg

SEQ ID NO: 3155416 - RNA, 17 nt, Human
gcaucggggagccggga

SEQ ID NO: 3155417 - RNA, 17 nt, Human
cauggcucccccuccac

SEQ ID NO: 3155418 - RNA, 19 nt, Human
cauauuaauauauuuccau

SEQ ID NO: 3155419 - RNA, 14 nt, Human
cauauuaauauauu

SEQ ID NO: 3155420 - RNA, 15 nt, Human
cauauuaauauauuu

SEQ ID NO: 3155421 - RNA, 23 nt, Human
cauaugcuguauauccuuucuaa

SEQ ID NO: 3155422 - RNA, 21 nt, Human
ccaccacacugauccagcccu

SEQ ID NO: 3155423 - RNA, 13 nt, Human
ccaccgccuccua

SEQ ID NO: 3155424 - RNA, 14 nt, Human
ccacuccuccuagc

SEQ ID NO: 3155425 - RNA, 13 nt, Human
cagcauaauacuu

SEQ ID NO: 3155426 - RNA, 21 nt, Human
cagaguaauccaagcaaaugu

SEQ ID NO: 3155427 - RNA, 17 nt, Human
cagagguugcagugugg

SEQ ID NO: 3155428 - RNA, 17 nt, Human
cagaggguguccugcac

SEQ ID NO: 3155429 - RNA, 18 nt, Human
cagggcugaggccucuca

SEQ ID NO: 3155430 - RNA, 16 nt, Human
cagggcugaggccucu

SEQ ID NO: 3155431 - RNA, 16 nt, Human
cagggaugguguucaa

SEQ ID NO: 3155432 - RNA, 23 nt, Human
cagguuugggaccccuggugguu

SEQ ID NO: 3155433 - RNA, 23 nt, Human
caguaaagaacaucccuccuggg

SEQ ID NO: 3155434 - RNA, 17 nt, Human
cagucugagagaggcca

SEQ ID NO: 3155435 - RNA, 21 nt, Human
cagugggccuggccagcaggu

SEQ ID NO: 3155436 - RNA, 14 nt, Human
cagugggccuggcc

SEQ ID NO: 3155437 - RNA, 15 nt, Human
cagugggccuggcca

SEQ ID NO: 3155438 - RNA, 17 nt, Human
cacucuugaaaaaugca

SEQ ID NO: 3155439 - RNA, 15 nt, Human
cacucuuggagccug

SEQ ID NO: 3155440 - RNA, 16 nt, Human
cacucuuggagccugc

SEQ ID NO: 3155441 - RNA, 14 nt, Human
cacucuuggagccu

SEQ ID NO: 3155442 - RNA, 17 nt, Human
cacucuuggagccugca

SEQ ID NO: 3155443 - RNA, 19 nt, Human
cacucuuggagccugcaga

SEQ ID NO: 3155444 - RNA, 13 nt, Human
cacuggggcaggg

SEQ ID NO: 3155445 - RNA, 23 nt, Human
cacuggggauugggccccugcca

SEQ ID NO: 3155446 - RNA, 15 nt, Human
cacuggggcaggggc

SEQ ID NO: 3155447 - RNA, 15 nt, Human
cacuggggauugggc

SEQ ID NO: 3155448 - RNA, 16 nt, Human
cacuggggauugggcc

SEQ ID NO: 3155449 - RNA, 17 nt, Human
cacuggggauugggccc

SEQ ID NO: 3155450 - RNA, 18 nt, Human
cacuggggauugggcccc

SEQ ID NO: 3155451 - RNA, 13 nt, Human
cagaauauguuuc

SEQ ID NO: 3155452 - RNA, 14 nt, Human
cagaauauguuuca

SEQ ID NO: 3155453 - RNA, 15 nt, Human
cagaauauguuucaa

SEQ ID NO: 3155454 - RNA, 17 nt, Human
cagaauauguuucaaac

SEQ ID NO: 3155455 - RNA, 18 nt, Human
cagaauauguuucaaacu

SEQ ID NO: 3155456 - RNA, 20 nt, Human
cagaauauguuucaaacuuu

SEQ ID NO: 3155457 - RNA, 13 nt, Human
cagaauauugcuu

SEQ ID NO: 3155458 - RNA, 12 nt, Human
cagaauauguuu

SEQ ID NO: 3155459 - RNA, 21 nt, Human
cagaauaaacuggcagcucag

SEQ ID NO: 3155460 - RNA, 20 nt, Human
caacuauuuuuccaaaauaa

SEQ ID NO: 3155461 - RNA, 20 nt, Human
caaauccuugugggaaaaga

SEQ ID NO: 3155462 - RNA, 22 nt, Human
caaauccagccugcugccugcu

SEQ ID NO: 3155463 - RNA, 22 nt, Human
caaaugagggucuugguuccag

SEQ ID NO: 3155464 - RNA, 18 nt, Human
caacaccucuuggggagu

SEQ ID NO: 3155465 - RNA, 18 nt, Human
caaaaaaauauauuuaau

SEQ ID NO: 3155466 - RNA, 15 nt, Human
caaaccaccagaagc

SEQ ID NO: 3155467 - RNA, 16 nt, Human
caaaccaccagaagcc

SEQ ID NO: 3155468 - RNA, 20 nt, Human
caaaccaccagaagcccaga

SEQ ID NO: 3155469 - RNA, 22 nt, Human
caaaccaccagaagcccagaau

SEQ ID NO: 3155470 - RNA, 19 nt, Human
auuuauacaggucauauua

SEQ ID NO: 3155471 - RNA, 22 nt, Human
auuuaaugauaaguaaaugcua

SEQ ID NO: 3155472 - RNA, 18 nt, Human
auuguaagcaugcacaaa

SEQ ID NO: 3155473 - RNA, 22 nt, Human
auugauccagaaagaaaacuug

SEQ ID NO: 3155474 - RNA, 18 nt, Human
auugauccagaaagaaaa

SEQ ID NO: 3155475 - RNA, 19 nt, Human
auugauccagaaagaaaac

SEQ ID NO: 3155476 - RNA, 14 nt, Human
auuguaaauaguau

SEQ ID NO: 3155477 - RNA, 22 nt, Human
auucaagaaaacaacuucaaua

SEQ ID NO: 3155478 - RNA, 18 nt, Human
auuaaauuuugaguucua

SEQ ID NO: 3155479 - RNA, 23 nt, Human
auuaugugccagauuuaugcaua

SEQ ID NO: 3155480 - RNA, 15 nt, Human
auuauguguguuuua

SEQ ID NO: 3155481 - RNA, 20 nt, Human
auuauguguguuuuaaaaug

SEQ ID NO: 3155482 - RNA, 21 nt, Human
auuauguguguuuuaaaauga

SEQ ID NO: 3155483 - RNA, 16 nt, Human
auugauccagaaagaa

SEQ ID NO: 3155484 - RNA, 17 nt, Human
auugauccagaaagaaa

SEQ ID NO: 3155485 - RNA, 17 nt, Human
auucuugccaaauauaa

SEQ ID NO: 3155486 - RNA, 13 nt, Human
auucugagagcug

SEQ ID NO: 3155487 - RNA, 14 nt, Human
auucugagagcugu

SEQ ID NO: 3155488 - RNA, 19 nt, Human
auucuuugaccuguuggga

SEQ ID NO: 3155489 - RNA, 22 nt, Human
ccagggggccagucccugaggc

SEQ ID NO: 3155490 - RNA, 23 nt, Human
cgccacuguuuugaaucucauaa

SEQ ID NO: 3155491 - RNA, 16 nt, Human
cgaauuuuaaaagaug

SEQ ID NO: 3155492 - RNA, 16 nt, Human
cgacagagcgagacuu

SEQ ID NO: 3155493 - RNA, 14 nt, Human
cguaaaauuaagaa

SEQ ID NO: 3155494 - RNA, 19 nt, Human
cuagccaccgccuccuaca

SEQ ID NO: 3155495 - RNA, 17 nt, Human
cuaucguaaaauuaaga

SEQ ID NO: 3155496 - RNA, 18 nt, Human
cuaucguaaaauuaagaa

SEQ ID NO: 3155497 - RNA, 22 nt, Human
cuaauucuuugaccuguuggga

SEQ ID NO: 3155498 - RNA, 21 nt, Human
cuaauucuuugaccuguuggg

SEQ ID NO: 3155499 - RNA, 23 nt, Human
cuccaagcccaguucagcuuggg

SEQ ID NO: 3155500 - RNA, 18 nt, Human
cucaugugacucuuucca

SEQ ID NO: 3155501 - RNA, 14 nt, Human
cucaugugacucuu

SEQ ID NO: 3155502 - RNA, 12 nt, Human
cuccuacagccc

SEQ ID NO: 3155503 - RNA, 15 nt, Human
cucgugucuggcaca

SEQ ID NO: 3155504 - RNA, 13 nt, Human
cucugcagguccc

SEQ ID NO: 3155505 - RNA, 14 nt, Human
cucugcaggucccu

SEQ ID NO: 3155506 - RNA, 15 nt, Human
cucugcaggucccua

SEQ ID NO: 3155507 - RNA, 16 nt, Human
cucugcaggucccuaa

SEQ ID NO: 3155508 - RNA, 17 nt, Human
cucugcaggucccuaau

SEQ ID NO: 3155509 - RNA, 22 nt, Human
cugaaaauugaugggauuuggu

SEQ ID NO: 3155510 - RNA, 13 nt, Human
cugaaacuucccu

SEQ ID NO: 3155511 - RNA, 13 nt, Human
cucuugaugccug

SEQ ID NO: 3155512 - RNA, 15 nt, Human
cucuugaugccuggc

SEQ ID NO: 3155513 - RNA, 16 nt, Human
cucuugaugccuggcg

SEQ ID NO: 3155514 - RNA, 21 nt, Human
cucuugaugccuggcggggug

SEQ ID NO: 3155515 - RNA, 21 nt, Human
cugaagcuaucguaaaauuaa

SEQ ID NO: 3155516 - RNA, 22 nt, Human
cugaagcuaucguaaaauuaag

SEQ ID NO: 3155517 - RNA, 14 nt, Human
cugagagaggccau

SEQ ID NO: 3155518 - RNA, 21 nt, Human
cugagagaggccauucuuucc

SEQ ID NO: 3155519 - RNA, 22 nt, Human
cugagagaggccauucuuuccc

SEQ ID NO: 3155520 - RNA, 13 nt, Human
cugagagaggcca

SEQ ID NO: 3155521 - RNA, 12 nt, Human
cugagaggccac

SEQ ID NO: 3155522 - RNA, 16 nt, Human
cugagaucucugcagg

SEQ ID NO: 3155523 - RNA, 17 nt, Human
cugagaucucugcagga

SEQ ID NO: 3155524 - RNA, 18 nt, Human
cugagaucucugcaggaa

SEQ ID NO: 3155525 - RNA, 23 nt, Human
aaauuaugugccagauuuaugca

SEQ ID NO: 3155526 - RNA, 17 nt, Human
aaauuguauuacaaauc

SEQ ID NO: 3155527 - RNA, 19 nt, Human
aaauucuauuacaguaugu

SEQ ID NO: 3155528 - RNA, 15 nt, Human
aaauucuacaacaca

SEQ ID NO: 3155529 - RNA, 17 nt, Human
aaauuccaagugauuga

SEQ ID NO: 3155530 - RNA, 21 nt, Human
guauucuaaauuuuauaucuu

SEQ ID NO: 3155531 - RNA, 24 nt, Human
guauucuaaauuuuauaucuugua

SEQ ID NO: 3155532 - RNA, 19 nt, Human
guauucuagcuaauguaau

SEQ ID NO: 3155533 - RNA, 16 nt, Human
aaaucauucauuuucu

SEQ ID NO: 3155534 - RNA, 18 nt, Human
gucgcccuggacugugug

SEQ ID NO: 3155535 - RNA, 21 nt, Human
aacacugggagaaaugaaaaa

SEQ ID NO: 3155536 - RNA, 15 nt, Human
guccaucagccucca

SEQ ID NO: 3155537 - RNA, 22 nt, Human
guccccagacuccaccaagccu

SEQ ID NO: 3155538 - RNA, 22 nt, Human
gucccgggacaccuaggcuagg

SEQ ID NO: 3155539 - RNA, 12 nt, Human
gucccuaauaaa

SEQ ID NO: 3155540 - RNA, 23 nt, Human
aacuauucaggagaguagaacag

SEQ ID NO: 3155541 - RNA, 12 nt, Human
aacuauggccug

SEQ ID NO: 3155542 - RNA, 21 nt, Human
aacuaggugcauauuuauaaa

SEQ ID NO: 3155543 - RNA, 19 nt, Human
gucuuauauauuguagaua

SEQ ID NO: 3155544 - RNA, 22 nt, Human
gucuuuccacuccuccuagcca

SEQ ID NO: 3155545 - RNA, 14 nt, Human
gugaaguuuacauu

SEQ ID NO: 3155546 - RNA, 19 nt, Human
aacugugaaguuuacauug

SEQ ID NO: 3155547 - RNA, 17 nt, Human
aacugugaaguuuacau

SEQ ID NO: 3155548 - RNA, 10 nt, Human
gugauguguc

SEQ ID NO: 3155549 - RNA, 23 nt, Human
aagaaagagcaacaauccaucuc

SEQ ID NO: 3155550 - RNA, 14 nt, Human
aagaaaacaacuuc

SEQ ID NO: 3155551 - RNA, 19 nt, Human
gugccagauuuaugcauau

SEQ ID NO: 3155552 - RNA, 19 nt, Human
aagaagugugucacccuua

SEQ ID NO: 3155553 - RNA, 15 nt, Human
gugcucuccaagccc

SEQ ID NO: 3155554 - RNA, 19 nt, Human
gugcucaggagcccuggga

SEQ ID NO: 3155555 - RNA, 18 nt, Human
gugcucaggagcccuggg

SEQ ID NO: 3155556 - RNA, 16 nt, Human
gugcucaggagcccug

SEQ ID NO: 3155557 - RNA, 12 nt, Human
aaguaaaugcua

SEQ ID NO: 3155558 - RNA, 19 nt, Human
aaguauguguaaaauguga

SEQ ID NO: 3155559 - RNA, 18 nt, Human
aaguauguguaaaaugug

SEQ ID NO: 3155560 - RNA, 21 nt, Human
aagucacuggccaguggcugg

SEQ ID NO: 3155561 - RNA, 17 nt, Human
guuuuaaaaugagaaau

SEQ ID NO: 3155562 - RNA, 21 nt, Human
uaaaaauauuguguugugaau

SEQ ID NO: 3155563 - RNA, 14 nt, Human
uaaaaauauugugu

SEQ ID NO: 3155564 - RNA, 22 nt, Human
uaaaaagccugcaauuucauau

SEQ ID NO: 3155565 - RNA, 19 nt, Human
uaaaaagccugcaauuuca

SEQ ID NO: 3155566 - RNA, 11 nt, Human
uaaaaugugaa

SEQ ID NO: 3155567 - RNA, 16 nt, Human
uaaaauugugaugugu

SEQ ID NO: 3155568 - RNA, 15 nt, Human
uaaaauugugaugug

SEQ ID NO: 3155569 - RNA, 13 nt, Human
uaaaaugugaagu

SEQ ID NO: 3155570 - RNA, 18 nt, Human
aagugugggucugugugu

SEQ ID NO: 3155571 - RNA, 17 nt, Human
aagugugggucugugug

SEQ ID NO: 3155572 - RNA, 10 nt, Human
aagugugggu

SEQ ID NO: 3155573 - RNA, 20 nt, Human
aagugugggucugugugugu

SEQ ID NO: 3155574 - RNA, 12 nt, Human
aaguguguguuu

SEQ ID NO: 3155575 - RNA, 16 nt, Human
aaguguguguuuuuca

SEQ ID NO: 3155576 - RNA, 21 nt, Human
aaguguguguuuuucauaaag

SEQ ID NO: 3155577 - RNA, 19 nt, Human
aaggaaaaaauaacaauga

SEQ ID NO: 3155578 - RNA, 19 nt, Human
guucuagcauggcauauuu

SEQ ID NO: 3155579 - RNA, 22 nt, Human
guucuagcauggcauauuuuuc

SEQ ID NO: 3155580 - RNA, 19 nt, Human
aagcuuuuaugugaaacau

SEQ ID NO: 3155581 - RNA, 21 nt, Human
aagcuuuuaugugaaacaugu

SEQ ID NO: 3155582 - RNA, 19 nt, Human
guuaauuccaauuauauga

SEQ ID NO: 3155583 - RNA, 17 nt, Human
guuauuauauuuacaaa

SEQ ID NO: 3155584 - RNA, 18 nt, Human
guuauugauaaguucaua

SEQ ID NO: 3155585 - RNA, 21 nt, Human
guuauugauaaguucauacau

SEQ ID NO: 3155586 - RNA, 22 nt, Human
guuauugauaaguucauacauu

SEQ ID NO: 3155587 - RNA, 19 nt, Human
guuauuauauuuacaaaug

SEQ ID NO: 3155588 - RNA, 12 nt, Human
guucagcuuggg

SEQ ID NO: 3155589 - RNA, 17 nt, Human
aagccuggucagcccaa

SEQ ID NO: 3155590 - RNA, 18 nt, Human
aagccuggucagcccaaa

SEQ ID NO: 3155591 - RNA, 15 nt, Human
aagccuguuuaagag

SEQ ID NO: 3155592 - RNA, 18 nt, Human
aagccuguuuaagagaca

SEQ ID NO: 3155593 - RNA, 16 nt, Human
aagcacuaaacaaaga

SEQ ID NO: 3155594 - RNA, 23 nt, Human
aagcaugcacaaauucugucucu

SEQ ID NO: 3155595 - RNA, 16 nt, Human
aagaggugugcaagag

SEQ ID NO: 3155596 - RNA, 18 nt, Human
aagaggugugcaagagag

SEQ ID NO: 3155597 - RNA, 22 nt, Human
gugguucacucuuggagccugc

SEQ ID NO: 3155598 - RNA, 23 nt, Human
gugguucacucuuggagccugca

SEQ ID NO: 3155599 - RNA, 21 nt, Human
gugguucacucuuggagccug

SEQ ID NO: 3155600 - RNA, 15 nt, Human
guguaaaaugugaag

SEQ ID NO: 3155601 - RNA, 21 nt, Human
guguaugugggggucugugug

SEQ ID NO: 3155602 - RNA, 13 nt, Human
guguauguggggg

SEQ ID NO: 3155603 - RNA, 20 nt, Human
aagcaaaugugaaucauuuu

SEQ ID NO: 3155604 - RNA, 19 nt, Human
uauccaaaccaaauaaaaa

SEQ ID NO: 3155605 - RNA, 17 nt, Human
uauaaguguguguuuuu

SEQ ID NO: 3155606 - RNA, 23 nt, Human
uauaaguguguguuuuucauaaa

SEQ ID NO: 3155607 - RNA, 16 nt, Human
uauauuuaguaucuuu

SEQ ID NO: 3155608 - RNA, 19 nt, Human
uaugaaauuauauaaguau

SEQ ID NO: 3155609 - RNA, 20 nt, Human
acagauuuccauccuaguca

SEQ ID NO: 3155610 - RNA, 19 nt, Human
acagcggcuggacuuggag

SEQ ID NO: 3155611 - RNA, 20 nt, Human
uauggggauagaugugugga

SEQ ID NO: 3155612 - RNA, 15 nt, Human
uauucagcucaugga

SEQ ID NO: 3155613 - RNA, 21 nt, Human
uauucagcucauggacuucug

SEQ ID NO: 3155614 - RNA, 22 nt, Human
acagcggcuggacuuggaggua

SEQ ID NO: 3155615 - RNA, 21 nt, Human
acagcggcuggacuuggaggu

SEQ ID NO: 3155616 - RNA, 17 nt, Human
uauguguaaaaugugaa

SEQ ID NO: 3155617 - RNA, 16 nt, Human
uauguggaaguguggg

SEQ ID NO: 3155618 - RNA, 12 nt, Human
uauguggaagug

SEQ ID NO: 3155619 - RNA, 23 nt, Human
uaugugccagauuuaugcauauu

SEQ ID NO: 3155620 - RNA, 17 nt, Human
uaugugaaacauguuuc

SEQ ID NO: 3155621 - RNA, 14 nt, Human
uaugugaaacaugu

SEQ ID NO: 3155622 - RNA, 21 nt, Human
uagcauggcauauuuuucaca

SEQ ID NO: 3155623 - RNA, 22 nt, Human
uagcauggcauauuuuucacau

SEQ ID NO: 3155624 - RNA, 22 nt, Human
uagagcaaaauugauguguuua

SEQ ID NO: 3155625 - RNA, 21 nt, Human
uagagcaaaauugauguguuu

SEQ ID NO: 3155626 - RNA, 14 nt, Human
uagagcaaaauuga

SEQ ID NO: 3155627 - RNA, 16 nt, Human
aauuguuacaaauugu

SEQ ID NO: 3155628 - RNA, 20 nt, Human
aauuguguuuauaauuuuaa

SEQ ID NO: 3155629 - RNA, 21 nt, Human
aauuguguuuauaauuuuaaa

SEQ ID NO: 3155630 - RNA, 19 nt, Human
uagcuaauguaauaacugu

SEQ ID NO: 3155631 - RNA, 12 nt, Human
uagcuaauguaa

SEQ ID NO: 3155632 - RNA, 18 nt, Human
uaggcaaccuuuauuuuu

SEQ ID NO: 3155633 - RNA, 24 nt, Human
uagugaaaccccaucucuacugaa

SEQ ID NO: 3155634 - RNA, 19 nt, Human
acaauggauaggcacagga

SEQ ID NO: 3155635 - RNA, 19 nt, Human
uauaaaagccuguuuaaga

SEQ ID NO: 3155636 - RNA, 22 nt, Human
uauaaaagggacugagaaauuu

SEQ ID NO: 3155637 - RNA, 19 nt, Human
uauaaaaauaaaaaacacu

SEQ ID NO: 3155638 - RNA, 20 nt, Human
uauaaaagccuguuuaagag

SEQ ID NO: 3155639 - RNA, 15 nt, Human
uauaaguguguguuu

SEQ ID NO: 3155640 - RNA, 16 nt, Human
acaccucuuggggagu

SEQ ID NO: 3155641 - RNA, 23 nt, Human
uacaggucauauuaauauauuuc

SEQ ID NO: 3155642 - RNA, 22 nt, Human
uacauauaagugauugcugguu

SEQ ID NO: 3155643 - RNA, 17 nt, Human
uacauuguaaauaguau

SEQ ID NO: 3155644 - RNA, 20 nt, Human
aauuaagaaaggauaaaguu

SEQ ID NO: 3155645 - RNA, 21 nt, Human
aauuaagaaaggauaaaguug

SEQ ID NO: 3155646 - RNA, 13 nt, Human
aauguuaagcaga

SEQ ID NO: 3155647 - RNA, 12 nt, Human
aaugcuguguua

SEQ ID NO: 3155648 - RNA, 13 nt, Human
aaugcuguguuaa

SEQ ID NO: 3155649 - RNA, 16 nt, Human
aaugcuucaucccuuu

SEQ ID NO: 3155650 - RNA, 18 nt, Human
aauuccaagugauugaaa

SEQ ID NO: 3155651 - RNA, 16 nt, Human
aauuauuauuuggccc

SEQ ID NO: 3155652 - RNA, 21 nt, Human
aauuauuuuguucauacauau

SEQ ID NO: 3155653 - RNA, 22 nt, Human
aauuauuuuguucauacauauu

SEQ ID NO: 3155654 - RNA, 16 nt, Human
aauuauuuuguucaua

SEQ ID NO: 3155655 - RNA, 18 nt, Human
aauuauuuuguucauaca

SEQ ID NO: 3155656 - RNA, 19 nt, Human
aauuauuuuguucauacau

SEQ ID NO: 3155657 - RNA, 20 nt, Human
aauuauuuuguucauacaua

SEQ ID NO: 3155658 - RNA, 19 nt, Human
uacauuguacgaagaguau

SEQ ID NO: 3155659 - RNA, 14 nt, Human
aauugauguguuua

SEQ ID NO: 3155660 - RNA, 13 nt, Human
aauugauguguuu

SEQ ID NO: 3155661 - RNA, 19 nt, Human
aauugaugggauuugguca

SEQ ID NO: 3155662 - RNA, 18 nt, Human
uacuguaaggcaaucaug

SEQ ID NO: 3155663 - RNA, 19 nt, Human
uacuguaaggcaaucaugg

SEQ ID NO: 3155664 - RNA, 16 nt, Human
aaucuuauaauuuaaa

SEQ ID NO: 3155665 - RNA, 21 nt, Human
uaauagagcaaaauugaugug

SEQ ID NO: 3155666 - RNA, 12 nt, Human
uaauagagcaaa

SEQ ID NO: 3155667 - RNA, 18 nt, Human
uaauguaauaacugugaa

SEQ ID NO: 3155668 - RNA, 15 nt, Human
aaucuuuaauuuuac

SEQ ID NO: 3155669 - RNA, 16 nt, Human
aaucuuuaauuuuaca

SEQ ID NO: 3155670 - RNA, 19 nt, Human
aaugaaacacucaguuguu

SEQ ID NO: 3155671 - RNA, 14 nt, Human
aaugaaacuuggau

SEQ ID NO: 3155672 - RNA, 12 nt, Human
uaauaaacacuc

SEQ ID NO: 3155673 - RNA, 18 nt, Human
uaauaaacacucuugaaa

SEQ ID NO: 3155674 - RNA, 13 nt, Human
uaaguaaaugcua

SEQ ID NO: 3155675 - RNA, 14 nt, Human
uaaguucauacauu

SEQ ID NO: 3155676 - RNA, 16 nt, Human
uaaguauucuaaauuu

SEQ ID NO: 3155677 - RNA, 12 nt, Human
aauccgcccauc

SEQ ID NO: 3155678 - RNA, 19 nt, Human
aaucuuauaauuuaaaaua

SEQ ID NO: 3155679 - RNA, 21 nt, Human
aauauuugaauguaugcuuca

SEQ ID NO: 3155680 - RNA, 23 nt, Human
aauauuugaauguaugcuucaua

SEQ ID NO: 3155681 - RNA, 14 nt, Human
aauauuugaaugua

SEQ ID NO: 3155682 - RNA, 12 nt, Human
aauauuuagugu

SEQ ID NO: 3155683 - RNA, 17 nt, Human
aauauuguguugugaau

SEQ ID NO: 3155684 - RNA, 22 nt, Human
aauaguauuugagaguucuaaa

SEQ ID NO: 3155685 - RNA, 20 nt, Human
aauaguauuugagaguucua

SEQ ID NO: 3155686 - RNA, 23 nt, Human
aauaguauuugagaguucuaaau

SEQ ID NO: 3155687 - RNA, 15 nt, Human
aauaguauuugagag

SEQ ID NO: 3155688 - RNA, 14 nt, Human
aauauauuuuaaga

SEQ ID NO: 3155689 - RNA, 15 nt, Human
aauauauuuuaagac

SEQ ID NO: 3155690 - RNA, 13 nt, Human
uaagaauauuuga

SEQ ID NO: 3155691 - RNA, 13 nt, Human
uaagacaaauaug

SEQ ID NO: 3155692 - RNA, 14 nt, Human
uaagaauauuugaa

SEQ ID NO: 3155693 - RNA, 20 nt, Human
uaacgauaaaagacagugaa

SEQ ID NO: 3155694 - RNA, 22 nt, Human
uaacuuaaaagaacauguauau

SEQ ID NO: 3155695 - RNA, 21 nt, Human
uccacuccuccuagccaccca

SEQ ID NO: 3155696 - RNA, 18 nt, Human
accuuuggagcaaagcug

SEQ ID NO: 3155697 - RNA, 22 nt, Human
accuuuguuugcaucugaaaau

SEQ ID NO: 3155698 - RNA, 17 nt, Human
accuuugacaaagguaa

SEQ ID NO: 3155699 - RNA, 18 nt, Human
accuuugacaaagguaaa

SEQ ID NO: 3155700 - RNA, 20 nt, Human
uccagccugcugccugcuuu

SEQ ID NO: 3155701 - RNA, 11 nt, Human
uccagccugcc

SEQ ID NO: 3155702 - RNA, 13 nt, Human
uccagccugccac

SEQ ID NO: 3155703 - RNA, 20 nt, Human
uccagcccugaguuccuagc

SEQ ID NO: 3155704 - RNA, 22 nt, Human
uccagcccugaguuccuagcca

SEQ ID NO: 3155705 - RNA, 15 nt, Human
acuaauuuuaaaaug

SEQ ID NO: 3155706 - RNA, 18 nt, Human
acguaaugaaacuuggau

SEQ ID NO: 3155707 - RNA, 13 nt, Human
ucccuuuuuuuaa

SEQ ID NO: 3155708 - RNA, 16 nt, Human
ucccuuuuuuuaagua

SEQ ID NO: 3155709 - RNA, 21 nt, Human
ucccuuuuuuuaaguaaggaa

SEQ ID NO: 3155710 - RNA, 21 nt, Human
acucuugaaaaaugcauguug

SEQ ID NO: 3155711 - RNA, 22 nt, Human
acucuuggagccugcagagcug

SEQ ID NO: 3155712 - RNA, 23 nt, Human
acucuuggagccugcagagcugc

SEQ ID NO: 3155713 - RNA, 15 nt, Human
acucuuggagccugc

SEQ ID NO: 3155714 - RNA, 16 nt, Human
acucuuggagccugca

SEQ ID NO: 3155715 - RNA, 14 nt, Human
acucuuggagccug

SEQ ID NO: 3155716 - RNA, 12 nt, Human
acugagaaauuu

SEQ ID NO: 3155717 - RNA, 17 nt, Human
acugagaaauuuauaaa

SEQ ID NO: 3155718 - RNA, 21 nt, Human
acugagaaauuuauaaacuuu

SEQ ID NO: 3155719 - RNA, 15 nt, Human
acucuuguuuccuua

SEQ ID NO: 3155720 - RNA, 23 nt, Human
uccuggaagugcuaauuuugaaa

SEQ ID NO: 3155721 - RNA, 18 nt, Human
uccugcaccggggccugg

SEQ ID NO: 3155722 - RNA, 19 nt, Human
uccugcaccggggccuggg

SEQ ID NO: 3155723 - RNA, 20 nt, Human
acaugaauauuuaguguuca

SEQ ID NO: 3155724 - RNA, 18 nt, Human
ucaauauccaaaccaaau

SEQ ID NO: 3155725 - RNA, 17 nt, Human
ucaagaaaacaacuuca

SEQ ID NO: 3155726 - RNA, 19 nt, Human
acauucuuccaaaaagauu

SEQ ID NO: 3155727 - RNA, 19 nt, Human
acauuguacgaagaguauu

SEQ ID NO: 3155728 - RNA, 16 nt, Human
ucaauucuugccaaau

SEQ ID NO: 3155729 - RNA, 16 nt, Human
accaaagcgaauuuua

SEQ ID NO: 3155730 - RNA, 23 nt, Human
ucacagcaagucacuggccagug

SEQ ID NO: 3155731 - RNA, 14 nt, Human
ucacauaucuagua

SEQ ID NO: 3155732 - RNA, 24 nt, Human
accacauuggagauguuuaguaau

SEQ ID NO: 3155733 - RNA, 23 nt, Human
ucaugcaaacuuuauuuuguguu

SEQ ID NO: 3155734 - RNA, 14 nt, Human
ucaugugacucuuu

SEQ ID NO: 3155735 - RNA, 17 nt, Human
ucaugugacucuuucca

SEQ ID NO: 3155736 - RNA, 17 nt, Human
ucaugugaaaucauuca

SEQ ID NO: 3155737 - RNA, 16 nt, Human
ucaugugaaaucauuc

SEQ ID NO: 3155738 - RNA, 18 nt, Human
ucaugugacucuuuccaa

SEQ ID NO: 3155739 - RNA, 19 nt, Human
ucaugugacucuuuccaac

SEQ ID NO: 3155740 - RNA, 17 nt, Human
ucauguuuacagaggac

SEQ ID NO: 3155741 - RNA, 14 nt, Human
ucaugcaaacuuua

SEQ ID NO: 3155742 - RNA, 13 nt, Human
ucaucuaggauuu

SEQ ID NO: 3155743 - RNA, 12 nt, Human
accuaggcuagg

SEQ ID NO: 3155744 - RNA, 17 nt, Human
accuaggcuaggguggg

SEQ ID NO: 3155745 - RNA, 15 nt, Human
ucaguuuuugugaaa

SEQ ID NO: 3155746 - RNA, 17 nt, Human
ucaguuuuugugaaaag

SEQ ID NO: 3155747 - RNA, 22 nt, Human
ucauaaaaagccugcaauuuca

SEQ ID NO: 3155748 - RNA, 12 nt, Human
ucaguaugugga

SEQ ID NO: 3155749 - RNA, 14 nt, Human
ucaguauguggaag

SEQ ID NO: 3155750 - RNA, 13 nt, Human
accgaggcaggga

SEQ ID NO: 3155751 - RNA, 16 nt, Human
ucauaaauuuaugguu

SEQ ID NO: 3155752 - RNA, 16 nt, Human
accccuggugguucac

SEQ ID NO: 3155753 - RNA, 12 nt, Human
ucagcucaugga

SEQ ID NO: 3155754 - RNA, 14 nt, Human
accccugcuucuga

SEQ ID NO: 3155755 - RNA, 17 nt, Human
ucagauuugccuuauug

SEQ ID NO: 3155756 - RNA, 15 nt, Human
acuuuggaacaagau

SEQ ID NO: 3155757 - RNA, 15 nt, Human
acuuguauuaugugu

SEQ ID NO: 3155758 - RNA, 18 nt, Human
acuuguauuauguguguu

SEQ ID NO: 3155759 - RNA, 19 nt, Human
acuuguauuauguguguuu

SEQ ID NO: 3155760 - RNA, 14 nt, Human
acuugcuuuuaaaa

SEQ ID NO: 3155761 - RNA, 16 nt, Human
acuugcucuugaugcc

SEQ ID NO: 3155762 - RNA, 14 nt, Human
acuugcucuugaug

SEQ ID NO: 3155763 - RNA, 20 nt, Human
acuugcucuugaugccuggc

SEQ ID NO: 3155764 - RNA, 17 nt, Human
acuugcucuugaugccu

SEQ ID NO: 3155765 - RNA, 18 nt, Human
acuugcucuugaugccug

SEQ ID NO: 3155766 - RNA, 23 nt, Human
acuuaacuauucaggagaguaga

SEQ ID NO: 3155767 - RNA, 15 nt, Human
ucuaguucugccagg

SEQ ID NO: 3155768 - RNA, 16 nt, Human
ucuaguucugccagga

SEQ ID NO: 3155769 - RNA, 17 nt, Human
ucuaguucugccaggag

SEQ ID NO: 3155770 - RNA, 14 nt, Human
ucuaguucugccag

SEQ ID NO: 3155771 - RNA, 21 nt, Human
ucuagcauggcauauuuuuca

SEQ ID NO: 3155772 - RNA, 18 nt, Human
ucuagcauggcauauuuu

SEQ ID NO: 3155773 - RNA, 22 nt, Human
ucuagcauggcauauuuuucac

SEQ ID NO: 3155774 - RNA, 23 nt, Human
ucuagcauggcauauuuuucaca

SEQ ID NO: 3155775 - RNA, 13 nt, Human
agaauauguuuca

SEQ ID NO: 3155776 - RNA, 17 nt, Human
agaauauguuucaaacu

SEQ ID NO: 3155777 - RNA, 18 nt, Human
agaauauguuucaaacuu

SEQ ID NO: 3155778 - RNA, 19 nt, Human
agaauauguuucaaacuuu

SEQ ID NO: 3155779 - RNA, 21 nt, Human
agaauauguuucaaacuuugg

SEQ ID NO: 3155780 - RNA, 17 nt, Human
agaauaaaauuuuuaau

SEQ ID NO: 3155781 - RNA, 12 nt, Human
agaauaaaauuu

SEQ ID NO: 3155782 - RNA, 14 nt, Human
agaauaaaauuuuu

SEQ ID NO: 3155783 - RNA, 14 nt, Human
ucugcuuguguuaa

SEQ ID NO: 3155784 - RNA, 16 nt, Human
ucugugaaaguacauu

SEQ ID NO: 3155785 - RNA, 14 nt, Human
ucuguuuacagugu

SEQ ID NO: 3155786 - RNA, 15 nt, Human
ucugaauuauuuucu

SEQ ID NO: 3155787 - RNA, 10 nt, Human
ucugaauuau

SEQ ID NO: 3155788 - RNA, 13 nt, Human
ucugcaggucccu

SEQ ID NO: 3155789 - RNA, 11 nt, Human
ucugcaggucc

SEQ ID NO: 3155790 - RNA, 12 nt, Human
ucugcagguccc

SEQ ID NO: 3155791 - RNA, 12 nt, Human
agaagcccagaa

SEQ ID NO: 3155792 - RNA, 13 nt, Human
agaagcccagaau

SEQ ID NO: 3155793 - RNA, 11 nt, Human
agaagcccaga

SEQ ID NO: 3155794 - RNA, 14 nt, Human
agaagaaguguguc

SEQ ID NO: 3155795 - RNA, 18 nt, Human
agaguaauccaagcaaau

SEQ ID NO: 3155796 - RNA, 20 nt, Human
agaguaauccaagcaaaugu

SEQ ID NO: 3155797 - RNA, 16 nt, Human
agaggcugcagccagg

SEQ ID NO: 3155798 - RNA, 23 nt, Human
ugaauaauguaagacaaauaugu

SEQ ID NO: 3155799 - RNA, 18 nt, Human
ugaauauuuaguguucau

SEQ ID NO: 3155800 - RNA, 12 nt, Human
agacuccaccaa

SEQ ID NO: 3155801 - RNA, 16 nt, Human
agacuccaccaagccu

SEQ ID NO: 3155802 - RNA, 16 nt, Human
ucuuuguaaugaaaac

SEQ ID NO: 3155803 - RNA, 21 nt, Human
ucuuuuuucuaaaguaaaaac

SEQ ID NO: 3155804 - RNA, 22 nt, Human
ucuuuuuucuaaaguaaaaaca

SEQ ID NO: 3155805 - RNA, 12 nt, Human
agacuuuuauga

SEQ ID NO: 3155806 - RNA, 15 nt, Human
agacuuuuaugauac

SEQ ID NO: 3155807 - RNA, 20 nt, Human
ugaaaaucuuauaauuuaaa

SEQ ID NO: 3155808 - RNA, 13 nt, Human
ugaaagaaaauaa

SEQ ID NO: 3155809 - RNA, 14 nt, Human
ugacuaugacauaa

SEQ ID NO: 3155810 - RNA, 22 nt, Human
agauguagccccucuccuggaa

SEQ ID NO: 3155811 - RNA, 21 nt, Human
agauguagccccucuccugga

SEQ ID NO: 3155812 - RNA, 15 nt, Human
ugacagguuugggac

SEQ ID NO: 3155813 - RNA, 15 nt, Human
agcaagucagaauag

SEQ ID NO: 3155814 - RNA, 14 nt, Human
ugagauguguucac

SEQ ID NO: 3155815 - RNA, 23 nt, Human
ugagauguagccccucuccugga

SEQ ID NO: 3155816 - RNA, 13 nt, Human
ugagagaggccau

SEQ ID NO: 3155817 - RNA, 17 nt, Human
ugagagcugugcaucag

SEQ ID NO: 3155818 - RNA, 17 nt, Human
auguuuaguaaucauau

SEQ ID NO: 3155819 - RNA, 15 nt, Human
uuuuccaaaauaauu

SEQ ID NO: 3155820 - RNA, 17 nt, Human
auguugcauagaauaaa

SEQ ID NO: 3155821 - RNA, 18 nt, Human
auguugcauagaauaaaa

SEQ ID NO: 3155822 - RNA, 15 nt, Human
auguugcauagaaua

SEQ ID NO: 3155823 - RNA, 20 nt, Human
auguugcccuguugcugccu

SEQ ID NO: 3155824 - RNA, 13 nt, Human
auguuaagcagau

SEQ ID NO: 3155825 - RNA, 14 nt, Human
uuuuaauaaacacu

SEQ ID NO: 3155826 - RNA, 10 nt, Human
augugugugu

SEQ ID NO: 3155827 - RNA, 15 nt, Human
auguguguuuuaaaa

SEQ ID NO: 3155828 - RNA, 23 nt, Human
auguguguuuuaaaaugagaaau

SEQ ID NO: 3155829 - RNA, 13 nt, Human
auguggaagugug

SEQ ID NO: 3155830 - RNA, 16 nt, Human
auguggaagugugggu

SEQ ID NO: 3155831 - RNA, 15 nt, Human
auguggaaguguggg

SEQ ID NO: 3155832 - RNA, 23 nt, Human
auguggaagugugggucugugug

SEQ ID NO: 3155833 - RNA, 22 nt, Human
auguggaagugugggucugugu

SEQ ID NO: 3155834 - RNA, 19 nt, Human
uuuuugugaaaagcuccau

SEQ ID NO: 3155835 - RNA, 20 nt, Human
auuauauaaguauucuaaau

SEQ ID NO: 3155836 - RNA, 14 nt, Human
auuauauaaguauu

SEQ ID NO: 3155837 - RNA, 17 nt, Human
auuauauaaguauucua

SEQ ID NO: 3155838 - RNA, 12 nt, Human
uuuuuaucaugu

SEQ ID NO: 3155839 - RNA, 16 nt, Human
uuuuguuuaccagaga

SEQ ID NO: 3155840 - RNA, 17 nt, Human
uuuuguucauacauauu

SEQ ID NO: 3155841 - RNA, 14 nt, Human
uuuuguucauacau

SEQ ID NO: 3155842 - RNA, 14 nt, Human
uuuugaguucuaca

SEQ ID NO: 3155843 - RNA, 17 nt, Human
auucagaguugaugguu

SEQ ID NO: 3155844 - RNA, 23 nt, Human
auuugugaagguggaaauaaacu

SEQ ID NO: 3155845 - RNA, 22 nt, Human
auuuucaguuauuauauuuaca

SEQ ID NO: 3155846 - RNA, 17 nt, Human
auuuucagaaaauauua

SEQ ID NO: 3155847 - RNA, 14 nt, Human
auuuucagaaaaua

SEQ ID NO: 3155848 - RNA, 21 nt, Human
auuuuauuuuuuucugaauua

SEQ ID NO: 3155849 - RNA, 16 nt, Human
auugggccccugccag

SEQ ID NO: 3155850 - RNA, 15 nt, Human
auugggccccugcca

SEQ ID NO: 3155851 - RNA, 20 nt, Human
auuggguggggggcuucaua

SEQ ID NO: 3155852 - RNA, 21 nt, Human
auuggguggggggcuucauac

SEQ ID NO: 3155853 - RNA, 24 nt, Human
auucugucucuggauuauauuaug

SEQ ID NO: 3155854 - RNA, 15 nt, Human
auuguauuacaaauc

SEQ ID NO: 3155855 - RNA, 12 nt, Human
auugguguugac

SEQ ID NO: 3155856 - RNA, 13 nt, Human
auuguauucagag

SEQ ID NO: 3155857 - RNA, 15 nt, Human
auugugauguguccu

SEQ ID NO: 3155858 - RNA, 14 nt, Human
auugugaugugucc

SEQ ID NO: 3155859 - RNA, 13 nt, Human
auugugauguguc

SEQ ID NO: 3155860 - RNA, 20 nt, Human
auuuaguaucuuuuuauuca

SEQ ID NO: 3155861 - RNA, 13 nt, Human
auuuaguguucau

SEQ ID NO: 3155862 - RNA, 17 nt, Human
auuuauaaaaauaaaaa

SEQ ID NO: 3155863 - RNA, 22 nt, Human
auuuauaaaaauaaaaaacacu

SEQ ID NO: 3155864 - RNA, 20 nt, Human
auuucccuuccuuccucucc

SEQ ID NO: 3155865 - RNA, 15 nt, Human
auauuuuuguagcac

SEQ ID NO: 3155866 - RNA, 16 nt, Human
auauuuuuguagcacu

SEQ ID NO: 3155867 - RNA, 23 nt, Human
auauuuuuguagcacugacagau

SEQ ID NO: 3155868 - RNA, 18 nt, Human
auauuuuucacauaucua

SEQ ID NO: 3155869 - RNA, 17 nt, Human
auauuuuucacauaucu

SEQ ID NO: 3155870 - RNA, 15 nt, Human
uucccuuuuuuuaag

SEQ ID NO: 3155871 - RNA, 21 nt, Human
auauuugaauguaugcuucau

SEQ ID NO: 3155872 - RNA, 20 nt, Human
uuccuaaauauauuuuaaga

SEQ ID NO: 3155873 - RNA, 21 nt, Human
uuccuaaauauauuuuaagac

SEQ ID NO: 3155874 - RNA, 22 nt, Human
auauuuaaaggcccuaucuguu

SEQ ID NO: 3155875 - RNA, 13 nt, Human
auauuuacaaaug

SEQ ID NO: 3155876 - RNA, 23 nt, Human
auauuuaaugauaaguaaaugcu

SEQ ID NO: 3155877 - RNA, 13 nt, Human
auauuuaaugaua

SEQ ID NO: 3155878 - RNA, 12 nt, Human
auauuuaaugau

SEQ ID NO: 3155879 - RNA, 13 nt, Human
auauguuucaaac

SEQ ID NO: 3155880 - RNA, 14 nt, Human
auauguuucaaacu

SEQ ID NO: 3155881 - RNA, 16 nt, Human
auauguuucaaacuuu

SEQ ID NO: 3155882 - RNA, 17 nt, Human
uucccagugaauucuug

SEQ ID NO: 3155883 - RNA, 16 nt, Human
auauguucugacauaa

SEQ ID NO: 3155884 - RNA, 21 nt, Human
auaugagcuuccuucugugaa

SEQ ID NO: 3155885 - RNA, 22 nt, Human
auaugagcuuccuucugugaaa

SEQ ID NO: 3155886 - RNA, 13 nt, Human
auauaugcuaagu

SEQ ID NO: 3155887 - RNA, 15 nt, Human
auauauuuaaugaua

SEQ ID NO: 3155888 - RNA, 16 nt, Human
auauauuuaaugauaa

SEQ ID NO: 3155889 - RNA, 15 nt, Human
auauauuuuaagacg

SEQ ID NO: 3155890 - RNA, 9 nt, Human
auauauuuc

SEQ ID NO: 3155891 - RNA, 16 nt, Human
uucagauuugccuuau

SEQ ID NO: 3155892 - RNA, 22 nt, Human
uucuuaaccagaucauugugaa

SEQ ID NO: 3155893 - RNA, 16 nt, Human
auccaagcaaauguga

SEQ ID NO: 3155894 - RNA, 20 nt, Human
auccauggggcugauuguau

SEQ ID NO: 3155895 - RNA, 19 nt, Human
aucauugugaaauuauuca

SEQ ID NO: 3155896 - RNA, 13 nt, Human
aucauugugaaau

SEQ ID NO: 3155897 - RNA, 15 nt, Human
aucauugugaaauua

SEQ ID NO: 3155898 - RNA, 23 nt, Human
aucagugugucuaaauuugaaug

SEQ ID NO: 3155899 - RNA, 20 nt, Human
aucagugugucuaaauuuga

SEQ ID NO: 3155900 - RNA, 20 nt, Human
aucauuaucagccugugcca

SEQ ID NO: 3155901 - RNA, 22 nt, Human
aucaguuugcuagcagaaaucu

SEQ ID NO: 3155902 - RNA, 17 nt, Human
uugaagggaaauuucag

SEQ ID NO: 3155903 - RNA, 17 nt, Human
uugaaggaaaaugauac

SEQ ID NO: 3155904 - RNA, 14 nt, Human
uugagaguucuaaa

SEQ ID NO: 3155905 - RNA, 17 nt, Human
uugauaaguucauacau

SEQ ID NO: 3155906 - RNA, 16 nt, Human
uugauaaguucauaca

SEQ ID NO: 3155907 - RNA, 16 nt, Human
aucggggagccgggag

SEQ ID NO: 3155908 - RNA, 18 nt, Human
aucggggagccgggagcc

SEQ ID NO: 3155909 - RNA, 12 nt, Human
aucguaaaauua

SEQ ID NO: 3155910 - RNA, 17 nt, Human
aucguaaaauuaagaaa

SEQ ID NO: 3155911 - RNA, 13 nt, Human
aucguaaaauuaa

SEQ ID NO: 3155912 - RNA, 14 nt, Human
aucguaaaauuaag

SEQ ID NO: 3155913 - RNA, 22 nt, Human
uuucagaaaauauuauguguuu

SEQ ID NO: 3155914 - RNA, 12 nt, Human
uuucauaaagca

SEQ ID NO: 3155915 - RNA, 17 nt, Human
uuuauuuuuuucugaau

SEQ ID NO: 3155916 - RNA, 19 nt, Human
augcuguauauccuuucua

SEQ ID NO: 3155917 - RNA, 15 nt, Human
uuuaugugaaacaug

SEQ ID NO: 3155918 - RNA, 14 nt, Human
uuuaugugaaacau

SEQ ID NO: 3155919 - RNA, 17 nt, Human
uuuaaaggcccuaucug

SEQ ID NO: 3155920 - RNA, 17 nt, Human
uuugaaacacuuugcau

SEQ ID NO: 3155921 - RNA, 19 nt, Human
uuugaaacacuuugcauaa

SEQ ID NO: 3155922 - RNA, 22 nt, Human
uuguaagcaugcacaaauucug

SEQ ID NO: 3155923 - RNA, 12 nt, Human
uuguaaugaaaa

SEQ ID NO: 3155924 - RNA, 13 nt, Human
uuguaaugaaaac

SEQ ID NO: 3155925 - RNA, 20 nt, Human
uugcuaugagcuggggaugu

SEQ ID NO: 3155926 - RNA, 14 nt, Human
uugcugaaagaucu

SEQ ID NO: 3155927 - RNA, 16 nt, Human
uugcuuuuaaaaucca

SEQ ID NO: 3155928 - RNA, 22 nt, Human
augcaaacuuuauuuuguguuu

SEQ ID NO: 3155929 - RNA, 17 nt, Human
uugugaagguggaaaua

SEQ ID NO: 3155930 - RNA, 18 nt, Human
uugugaagguggaaauaa

SEQ ID NO: 3155931 - RNA, 16 nt, Human
uugugugugggagugu

SEQ ID NO: 3155932 - RNA, 13 nt, Human
uugugugugggag

SEQ ID NO: 3155933 - RNA, 10 nt, Human
uugugugugg

SEQ ID NO: 3155934 - RNA, 19 nt, Human
augacauaaaaacaacuuu

SEQ ID NO: 3155935 - RNA, 22 nt, Human
uuguccucagccccgcguggaa

SEQ ID NO: 3155936 - RNA, 18 nt, Human
uugucccugaagagaagg

SEQ ID NO: 3155937 - RNA, 13 nt, Human
uugugaaauuauu

SEQ ID NO: 3155938 - RNA, 13 nt, Human
uugucacgccaga

SEQ ID NO: 3155939 - RNA, 20 nt, Human
uugucacgccagacuuccca

SEQ ID NO: 3155940 - RNA, 22 nt, Human
uggcugccuugugaaggaauua

SEQ ID NO: 3155941 - RNA, 16 nt, Human
uggcuaugagggccuu

SEQ ID NO: 3155942 - RNA, 16 nt, Human
uggcucuugaacugag

SEQ ID NO: 3155943 - RNA, 22 nt, Human
uggcucuugaacugagcuugga

SEQ ID NO: 3155944 - RNA, 13 nt, Human
aggcucuggagcc

SEQ ID NO: 3155945 - RNA, 14 nt, Human
aggcucuggagccc

SEQ ID NO: 3155946 - RNA, 15 nt, Human
aggcucuggagccca

SEQ ID NO: 3155947 - RNA, 18 nt, Human
aggcucuggagcccacug

SEQ ID NO: 3155948 - RNA, 19 nt, Human
aggcucuggagcccacugu

SEQ ID NO: 3155949 - RNA, 15 nt, Human
aggcugcuuuccaaa

SEQ ID NO: 3155950 - RNA, 17 nt, Human
aggcugcuuuccaaagc

SEQ ID NO: 3155951 - RNA, 18 nt, Human
aggcugcuuuccaaagcc

SEQ ID NO: 3155952 - RNA, 19 nt, Human
aggcugcuuuccaaagcca

SEQ ID NO: 3155953 - RNA, 21 nt, Human
aggcugcuuuccaaagccaau

SEQ ID NO: 3155954 - RNA, 13 nt, Human
aggcugcuuucca

SEQ ID NO: 3155955 - RNA, 14 nt, Human
aggcugcuuuccaa

SEQ ID NO: 3155956 - RNA, 15 nt, Human
aggccauucuuuccc

SEQ ID NO: 3155957 - RNA, 18 nt, Human
uggacgagaaaacaauaa

SEQ ID NO: 3155958 - RNA, 22 nt, Human
uggaccuuuccugaggaagagg

SEQ ID NO: 3155959 - RNA, 21 nt, Human
aggccucucauuccagaggaa

SEQ ID NO: 3155960 - RNA, 17 nt, Human
aggccauucuuucccaa

SEQ ID NO: 3155961 - RNA, 18 nt, Human
aggccauucuuucccaac

SEQ ID NO: 3155962 - RNA, 19 nt, Human
aggccauucuuucccaaca

SEQ ID NO: 3155963 - RNA, 12 nt, Human
aggcccaaagcc

SEQ ID NO: 3155964 - RNA, 13 nt, Human
aggcccaaagccu

SEQ ID NO: 3155965 - RNA, 15 nt, Human
aggcccaaagccucg

SEQ ID NO: 3155966 - RNA, 15 nt, Human
uggccaguggcugga

SEQ ID NO: 3155967 - RNA, 14 nt, Human
uggccaguggcugg

SEQ ID NO: 3155968 - RNA, 16 nt, Human
uggccaguggcuggau

SEQ ID NO: 3155969 - RNA, 11 nt, Human
ugcuucauaca

SEQ ID NO: 3155970 - RNA, 14 nt, Human
ugcuucauacaggg

SEQ ID NO: 3155971 - RNA, 15 nt, Human
ugcuucauacaggga

SEQ ID NO: 3155972 - RNA, 16 nt, Human
ugcuucauacagggau

SEQ ID NO: 3155973 - RNA, 23 nt, Human
aggaauuguguuuauaauuuuaa

SEQ ID NO: 3155974 - RNA, 11 nt, Human
aggaauuuaaa

SEQ ID NO: 3155975 - RNA, 13 nt, Human
ugcuccccacguc

SEQ ID NO: 3155976 - RNA, 18 nt, Human
ugcuauuguagagccaga

SEQ ID NO: 3155977 - RNA, 22 nt, Human
ugcuauuguagagccagagguc

SEQ ID NO: 3155978 - RNA, 19 nt, Human
aggagcccugggaggcucu

SEQ ID NO: 3155979 - RNA, 18 nt, Human
aggagcccugggaggcuc

SEQ ID NO: 3155980 - RNA, 22 nt, Human
uggaauuggguggggggcuuca

SEQ ID NO: 3155981 - RNA, 16 nt, Human
uggaccagccucucca

SEQ ID NO: 3155982 - RNA, 22 nt, Human
uggaccagccucuccacucaug

SEQ ID NO: 3155983 - RNA, 15 nt, Human
agccacgguguucug

SEQ ID NO: 3155984 - RNA, 14 nt, Human
ugaugggauuuggu

SEQ ID NO: 3155985 - RNA, 14 nt, Human
agcccacuguacuu

SEQ ID NO: 3155986 - RNA, 16 nt, Human
agcccacuguacuugc

SEQ ID NO: 3155987 - RNA, 19 nt, Human
agcuauggugucauaggcu

SEQ ID NO: 3155988 - RNA, 17 nt, Human
agcuaucguaaaauuaa

SEQ ID NO: 3155989 - RNA, 17 nt, Human
agcggcuggacuuggag

SEQ ID NO: 3155990 - RNA, 21 nt, Human
agcggcuggacuuggagguag

SEQ ID NO: 3155991 - RNA, 11 nt, Human
ugccucucugc

SEQ ID NO: 3155992 - RNA, 12 nt, Human
ugccucucugca

SEQ ID NO: 3155993 - RNA, 14 nt, Human
agcugccugugccu

SEQ ID NO: 3155994 - RNA, 15 nt, Human
ugccucucugcaggu

SEQ ID NO: 3155995 - RNA, 23 nt, Human
ugccucucugcaggucccuaaua

SEQ ID NO: 3155996 - RNA, 21 nt, Human
ugccucucugcaggucccuaa

SEQ ID NO: 3155997 - RNA, 19 nt, Human
aguugcaacuuuguauaaa

SEQ ID NO: 3155998 - RNA, 15 nt, Human
uguuugcaucugaaa

SEQ ID NO: 3155999 - RNA, 20 nt, Human
aguucucuucacucaaggau

SEQ ID NO: 3156000 - RNA, 16 nt, Human
aguuucguuuucaaaa

SEQ ID NO: 3156001 - RNA, 15 nt, Human
aguuucguuuucaaa

SEQ ID NO: 3156002 - RNA, 22 nt, Human
aguugcauagguuuaauaauuu

SEQ ID NO: 3156003 - RNA, 20 nt, Human
aguuauuauauuuacaaaug

SEQ ID NO: 3156004 - RNA, 17 nt, Human
aguuauugauaaguuca

SEQ ID NO: 3156005 - RNA, 19 nt, Human
aguuauugauaaguucaua

SEQ ID NO: 3156006 - RNA, 21 nt, Human
aguuauugauaaguucauaca

SEQ ID NO: 3156007 - RNA, 22 nt, Human
aguuauugauaaguucauacau

SEQ ID NO: 3156008 - RNA, 23 nt, Human
aguuauugauaaguucauacauu

SEQ ID NO: 3156009 - RNA, 20 nt, Human
aguucggugagcuacaaaug

SEQ ID NO: 3156010 - RNA, 18 nt, Human
uguugggagugaggaugu

SEQ ID NO: 3156011 - RNA, 15 nt, Human
aguucuaaauuuugu

SEQ ID NO: 3156012 - RNA, 18 nt, Human
auaaacuggcagcucagc

SEQ ID NO: 3156013 - RNA, 14 nt, Human
auaaauaaaaauaa

SEQ ID NO: 3156014 - RNA, 23 nt, Human
auaaacacucuugaaaaaugcau

SEQ ID NO: 3156015 - RNA, 16 nt, Human
auaaaccucaaaaugu

SEQ ID NO: 3156016 - RNA, 18 nt, Human
auaaacacucuugaaaaa

SEQ ID NO: 3156017 - RNA, 13 nt, Human
auaaauaaaguuu

SEQ ID NO: 3156018 - RNA, 19 nt, Human
auaaauaaaguuuguugaa

SEQ ID NO: 3156019 - RNA, 12 nt, Human
auaacugugaag

SEQ ID NO: 3156020 - RNA, 11 nt, Human
auaaguucaua

SEQ ID NO: 3156021 - RNA, 13 nt, Human
auaaguucauaca

SEQ ID NO: 3156022 - RNA, 14 nt, Human
auaaguucauacau

SEQ ID NO: 3156023 - RNA, 15 nt, Human
auaaguucauacauu

SEQ ID NO: 3156024 - RNA, 21 nt, Human
auaaguucauacauuguacga

SEQ ID NO: 3156025 - RNA, 20 nt, Human
auaaucagugugucuaaauu

SEQ ID NO: 3156026 - RNA, 14 nt, Human
auaaugaauacuuu

SEQ ID NO: 3156027 - RNA, 14 nt, Human
uuauauaaguauuc

SEQ ID NO: 3156028 - RNA, 16 nt, Human
uuauauaaguauucua

SEQ ID NO: 3156029 - RNA, 13 nt, Human
uuauauaaguauu

SEQ ID NO: 3156030 - RNA, 21 nt, Human
auaauuuuaagaaaucaaaga

SEQ ID NO: 3156031 - RNA, 15 nt, Human
auaauuuuaagaaau

SEQ ID NO: 3156032 - RNA, 14 nt, Human
auaauuuuaagaaa

SEQ ID NO: 3156033 - RNA, 19 nt, Human
uuauauauauauauauuuc

SEQ ID NO: 3156034 - RNA, 18 nt, Human
uuauacccagaaaguuau

SEQ ID NO: 3156035 - RNA, 19 nt, Human
uuauacccagaaaguuauu

SEQ ID NO: 3156036 - RNA, 23 nt, Human
uuauacccagaaaguuauugaua

SEQ ID NO: 3156037 - RNA, 23 nt, Human
uuauagaguguacuuaacuauuc

SEQ ID NO: 3156038 - RNA, 21 nt, Human
auacaguucggugagcuacaa

SEQ ID NO: 3156039 - RNA, 15 nt, Human
auacaggucauauua

SEQ ID NO: 3156040 - RNA, 21 nt, Human
auacaggucauauuaauauau

SEQ ID NO: 3156041 - RNA, 16 nt, Human
auacagggaugguguu

SEQ ID NO: 3156042 - RNA, 19 nt, Human
auacauauuuuuguagcac

SEQ ID NO: 3156043 - RNA, 14 nt, Human
auacauuguacgaa

SEQ ID NO: 3156044 - RNA, 21 nt, Human
auacauuguacgaagaguauu

SEQ ID NO: 3156045 - RNA, 22 nt, Human
auacauuguacgaagaguauuu

SEQ ID NO: 3156046 - RNA, 14 nt, Human
uuaucaacauuugu

SEQ ID NO: 3156047 - RNA, 22 nt, Human
uuaucaaagggugaaaauuauu

SEQ ID NO: 3156048 - RNA, 22 nt, Human
uuaucaugugaaaucauucauu

SEQ ID NO: 3156049 - RNA, 18 nt, Human
uuaucaugugaaaucauu

SEQ ID NO: 3156050 - RNA, 20 nt, Human
uuaucaugugaaaucauuca

SEQ ID NO: 3156051 - RNA, 17 nt, Human
uuaucaugugaaaucau

SEQ ID NO: 3156052 - RNA, 14 nt, Human
uguacauauaagug

SEQ ID NO: 3156053 - RNA, 15 nt, Human
uguaaggcaaucaug

SEQ ID NO: 3156054 - RNA, 15 nt, Human
uguacuuaacuauuc

SEQ ID NO: 3156055 - RNA, 15 nt, Human
uguacuugcucuuga

SEQ ID NO: 3156056 - RNA, 22 nt, Human
ugguguucaaaaaacuuguaaa

SEQ ID NO: 3156057 - RNA, 21 nt, Human
ugguguucaaaaaacuuguaa

SEQ ID NO: 3156058 - RNA, 20 nt, Human
ugguucacucuuggagccug

SEQ ID NO: 3156059 - RNA, 21 nt, Human
ugguucacucuuggagccugc

SEQ ID NO: 3156060 - RNA, 22 nt, Human
ugguucacucuuggagccugca

SEQ ID NO: 3156061 - RNA, 17 nt, Human
ugguucacucuuggagc

SEQ ID NO: 3156062 - RNA, 18 nt, Human
ugguuuuaguugcaacuu

SEQ ID NO: 3156063 - RNA, 15 nt, Human
aggucagugcaaaua

SEQ ID NO: 3156064 - RNA, 23 nt, Human
agguagcuuugagguggaagagg

SEQ ID NO: 3156065 - RNA, 16 nt, Human
uggucugggacucucu

SEQ ID NO: 3156066 - RNA, 22 nt, Human
ugguccaugggccauaugaaaa

SEQ ID NO: 3156067 - RNA, 15 nt, Human
agggugaaaauuauu

SEQ ID NO: 3156068 - RNA, 13 nt, Human
ugggucugugugu

SEQ ID NO: 3156069 - RNA, 15 nt, Human
ugggucugugugugu

SEQ ID NO: 3156070 - RNA, 22 nt, Human
agggucuugguuccagccugcc

SEQ ID NO: 3156071 - RNA, 21 nt, Human
agggucuugguuccagccugc

SEQ ID NO: 3156072 - RNA, 23 nt, Human
ugggaauaagugccaggauggaa

SEQ ID NO: 3156073 - RNA, 21 nt, Human
aguauuuaauucauguugccu

SEQ ID NO: 3156074 - RNA, 14 nt, Human
aguauguguaaaau

SEQ ID NO: 3156075 - RNA, 22 nt, Human
uguauccauccauggggcugau

SEQ ID NO: 3156076 - RNA, 16 nt, Human
agguuugggaccccug

SEQ ID NO: 3156077 - RNA, 21 nt, Human
agguuugggaccccugguggu

SEQ ID NO: 3156078 - RNA, 22 nt, Human
uguaugugggggucuguguguu

SEQ ID NO: 3156079 - RNA, 21 nt, Human
uguaugugggggucugugugu

SEQ ID NO: 3156080 - RNA, 20 nt, Human
uguaugugggggucugugug

SEQ ID NO: 3156081 - RNA, 22 nt, Human
uguauuacaaauccaaugaaau

SEQ ID NO: 3156082 - RNA, 14 nt, Human
ugucuaagauagua

SEQ ID NO: 3156083 - RNA, 15 nt, Human
ugucuaagauaguaa

SEQ ID NO: 3156084 - RNA, 18 nt, Human
ugucuaaauuugaauguu

SEQ ID NO: 3156085 - RNA, 22 nt, Human
aguccaggcuuuuuuaucaugu

SEQ ID NO: 3156086 - RNA, 13 nt, Human
aguccaucagccu

SEQ ID NO: 3156087 - RNA, 14 nt, Human
aguccaucagccuc

SEQ ID NO: 3156088 - RNA, 22 nt, Human
ugucucuggauuauauuaugaa

SEQ ID NO: 3156089 - RNA, 13 nt, Human
agucccugccugg

SEQ ID NO: 3156090 - RNA, 19 nt, Human
agucuccaaagucucugga

SEQ ID NO: 3156091 - RNA, 17 nt, Human
agugaaagaaaauaaca

SEQ ID NO: 3156092 - RNA, 11 nt, Human
ugugauguguc

SEQ ID NO: 3156093 - RNA, 16 nt, Human
ugugauguauucuagc

SEQ ID NO: 3156094 - RNA, 21 nt, Human
caaauuguaagcaugcacaaa

SEQ ID NO: 3156095 - RNA, 17 nt, Human
caaauuguaagcaugca

SEQ ID NO: 3156096 - RNA, 16 nt, Human
caaaauugauguguuu

SEQ ID NO: 3156097 - RNA, 15 nt, Human
caaaauugauguguu

SEQ ID NO: 3156098 - RNA, 22 nt, Human
caaaauugauguguuuauuuau

SEQ ID NO: 3156099 - RNA, 16 nt, Human
caaaauuguuacaaau

SEQ ID NO: 3156100 - RNA, 19 nt, Human
caaagcugaugacaacuuc

SEQ ID NO: 3156101 - RNA, 20 nt, Human
caaagcgaauuuuaaaagau

SEQ ID NO: 3156102 - RNA, 14 nt, Human
caaagcgaauuuua

SEQ ID NO: 3156103 - RNA, 19 nt, Human
caaagcgaauuuuaaaaga

SEQ ID NO: 3156104 - RNA, 16 nt, Human
caaaaauucucaguuc

SEQ ID NO: 3156105 - RNA, 19 nt, Human
caauguagaggggaaaaga

SEQ ID NO: 3156106 - RNA, 15 nt, Human
caagaaaacaacuuc

SEQ ID NO: 3156107 - RNA, 14 nt, Human
caagaggcugcagc

SEQ ID NO: 3156108 - RNA, 16 nt, Human
caagaggcugcagcca

SEQ ID NO: 3156109 - RNA, 13 nt, Human
caacacugccagc

SEQ ID NO: 3156110 - RNA, 14 nt, Human
caacacugccagca

SEQ ID NO: 3156111 - RNA, 12 nt, Human
caacacugccag

SEQ ID NO: 3156112 - RNA, 13 nt, Human
caaccggcuuugu

SEQ ID NO: 3156113 - RNA, 22 nt, Human
caaccggcuuuguggcacuggg

SEQ ID NO: 3156114 - RNA, 21 nt, Human
caggucauauuaauauauuuc

SEQ ID NO: 3156115 - RNA, 20 nt, Human
caggucauauuaauauauuu

SEQ ID NO: 3156116 - RNA, 13 nt, Human
cagguccccagac

SEQ ID NO: 3156117 - RNA, 18 nt, Human
cagguccccagcuuuggc

SEQ ID NO: 3156118 - RNA, 12 nt, Human
cagguccccaga

SEQ ID NO: 3156119 - RNA, 11 nt, Human
caggucccuaa

SEQ ID NO: 3156120 - RNA, 12 nt, Human
caggucccuaau

SEQ ID NO: 3156121 - RNA, 13 nt, Human
caggucccuaaua

SEQ ID NO: 3156122 - RNA, 14 nt, Human
caggucccuaauaa

SEQ ID NO: 3156123 - RNA, 15 nt, Human
caggucccuaauaaa

SEQ ID NO: 3156124 - RNA, 16 nt, Human
caggucccuaauaaag

SEQ ID NO: 3156125 - RNA, 17 nt, Human
caggucccuaauaaagc

SEQ ID NO: 3156126 - RNA, 18 nt, Human
caggucccuaauaaagcu

SEQ ID NO: 3156127 - RNA, 19 nt, Human
caggucccuaauaaagcug

SEQ ID NO: 3156128 - RNA, 20 nt, Human
caggucccuaauaaagcugu

SEQ ID NO: 3156129 - RNA, 21 nt, Human
caggucccuaauaaagcugug

SEQ ID NO: 3156130 - RNA, 22 nt, Human
caggucccuaauaaagcugugu

SEQ ID NO: 3156131 - RNA, 12 nt, Human
cagguguucuuc

SEQ ID NO: 3156132 - RNA, 22 nt, Human
caguaguagccuccagguuucc

SEQ ID NO: 3156133 - RNA, 12 nt, Human
caguauguggaa

SEQ ID NO: 3156134 - RNA, 20 nt, Human
cagucccugaggcagguccc

SEQ ID NO: 3156135 - RNA, 23 nt, Human
cagucccugaggcagguccccag

SEQ ID NO: 3156136 - RNA, 14 nt, Human
cagucccugaggca

SEQ ID NO: 3156137 - RNA, 12 nt, Human
cagugaauucuu

SEQ ID NO: 3156138 - RNA, 16 nt, Human
cagugaaagaaaauaa

SEQ ID NO: 3156139 - RNA, 20 nt, Human
cagugaaagaaaauaacaau

SEQ ID NO: 3156140 - RNA, 22 nt, Human
cagucuuuaaucugagaggcca

SEQ ID NO: 3156141 - RNA, 15 nt, Human
caggcucagagggug

SEQ ID NO: 3156142 - RNA, 11 nt, Human
caggcucagag

SEQ ID NO: 3156143 - RNA, 21 nt, Human
caggcugggucgcccuggacu

SEQ ID NO: 3156144 - RNA, 23 nt, Human
caggcugggucgcccuggacugu

SEQ ID NO: 3156145 - RNA, 23 nt, Human
caggcuuuuuuaucaugugaaau

SEQ ID NO: 3156146 - RNA, 14 nt, Human
caggggcaggagga

SEQ ID NO: 3156147 - RNA, 22 nt, Human
cagggggccagucccugaggca

SEQ ID NO: 3156148 - RNA, 13 nt, Human
cagggaaggaucc

SEQ ID NO: 3156149 - RNA, 18 nt, Human
cagggaaggaucccauga

SEQ ID NO: 3156150 - RNA, 19 nt, Human
caggaguuucguuuucaaa

SEQ ID NO: 3156151 - RNA, 12 nt, Human
caggagaguaga

SEQ ID NO: 3156152 - RNA, 23 nt, Human
caggagacagguuagcugcuccc

SEQ ID NO: 3156153 - RNA, 14 nt, Human
caggagucccugcc

SEQ ID NO: 3156154 - RNA, 21 nt, Human
caggagucccugccaucaugu

SEQ ID NO: 3156155 - RNA, 15 nt, Human
caggagucccugcca

SEQ ID NO: 3156156 - RNA, 21 nt, Human
caggagcccugggaggcucug

SEQ ID NO: 3156157 - RNA, 11 nt, Human
caggagcccug

SEQ ID NO: 3156158 - RNA, 14 nt, Human
caggagcccuggga

SEQ ID NO: 3156159 - RNA, 16 nt, Human
caggagcccugggagg

SEQ ID NO: 3156160 - RNA, 18 nt, Human
caggagcccugggaggcu

SEQ ID NO: 3156161 - RNA, 19 nt, Human
caggagcccugggaggcuc

SEQ ID NO: 3156162 - RNA, 21 nt, Human
caggcccccagaaccccuggc

SEQ ID NO: 3156163 - RNA, 21 nt, Human
caggccagggggccagucccu

SEQ ID NO: 3156164 - RNA, 22 nt, Human
caggaugaugacuauggaaaga

SEQ ID NO: 3156165 - RNA, 18 nt, Human
caggaugaugacuaugga

SEQ ID NO: 3156166 - RNA, 20 nt, Human
caggaugaugacuauggaaa

SEQ ID NO: 3156167 - RNA, 20 nt, Human
caggcaucggggagccggga

SEQ ID NO: 3156168 - RNA, 21 nt, Human
caggcaucggggagccgggag

SEQ ID NO: 3156169 - RNA, 18 nt, Human
cagcccucauuggcucuu

SEQ ID NO: 3156170 - RNA, 18 nt, Human
cagcccugaguuccuagc

SEQ ID NO: 3156171 - RNA, 19 nt, Human
cagcccugaguuccuagcc

SEQ ID NO: 3156172 - RNA, 21 nt, Human
cagcccugaguuccuagccac

SEQ ID NO: 3156173 - RNA, 18 nt, Human
cagccuccauccuacccc

SEQ ID NO: 3156174 - RNA, 21 nt, Human
cagccuccauccuacccccug

SEQ ID NO: 3156175 - RNA, 23 nt, Human
cagccuggcuguggccuaaccug

SEQ ID NO: 3156176 - RNA, 23 nt, Human
cagccucuccacucaugugacuc

SEQ ID NO: 3156177 - RNA, 21 nt, Human
cagcuggggccaggcuggguc

SEQ ID NO: 3156178 - RNA, 22 nt, Human
cagcuggggccaggcugggucg

SEQ ID NO: 3156179 - RNA, 18 nt, Human
cagcuggggccaggcugg

SEQ ID NO: 3156180 - RNA, 19 nt, Human
cagcuggggccaggcuggg

SEQ ID NO: 3156181 - RNA, 20 nt, Human
cagcuggggccaggcugggu

SEQ ID NO: 3156182 - RNA, 15 nt, Human
caggaaccgaggcag

SEQ ID NO: 3156183 - RNA, 17 nt, Human
caggaaccgaggcaggg

SEQ ID NO: 3156184 - RNA, 18 nt, Human
caggaaccgaggcaggga

SEQ ID NO: 3156185 - RNA, 21 nt, Human
cagauggaaugcuguguuaaa

SEQ ID NO: 3156186 - RNA, 19 nt, Human
cagauggaaugcuguguua

SEQ ID NO: 3156187 - RNA, 17 nt, Human
cagauggaaugcugugu

SEQ ID NO: 3156188 - RNA, 16 nt, Human
cagauggaaugcugug

SEQ ID NO: 3156189 - RNA, 18 nt, Human
cagccaacuauggccugu

SEQ ID NO: 3156190 - RNA, 15 nt, Human
cagcauuucccuucc

SEQ ID NO: 3156191 - RNA, 16 nt, Human
cagcccaccuggcuuu

SEQ ID NO: 3156192 - RNA, 20 nt, Human
cagcccaaaccaccagaagc

SEQ ID NO: 3156193 - RNA, 21 nt, Human
cagcccaaaccaccagaagcc

SEQ ID NO: 3156194 - RNA, 23 nt, Human
cagcccaaaccaccagaagccca

SEQ ID NO: 3156195 - RNA, 16 nt, Human
cagcccaaaccaccag

SEQ ID NO: 3156196 - RNA, 19 nt, Human
cagcccaaaccaccagaag

SEQ ID NO: 3156197 - RNA, 22 nt, Human
cagauaaagguucaugcaaacu

SEQ ID NO: 3156198 - RNA, 14 nt, Human
cagauaaucagugu

SEQ ID NO: 3156199 - RNA, 14 nt, Human
cagagucccugccu

SEQ ID NO: 3156200 - RNA, 18 nt, Human
cagagucccugccuggac

SEQ ID NO: 3156201 - RNA, 23 nt, Human
cagaggcgcaugaauuugugaag

SEQ ID NO: 3156202 - RNA, 22 nt, Human
cagaggacaguauuugugggga

SEQ ID NO: 3156203 - RNA, 15 nt, Human
cagagcagugggccu

SEQ ID NO: 3156204 - RNA, 17 nt, Human
cagagcagugggccugg

SEQ ID NO: 3156205 - RNA, 20 nt, Human
cagagcagugggccuggcca

SEQ ID NO: 3156206 - RNA, 21 nt, Human
cagagcagugggccuggccag

SEQ ID NO: 3156207 - RNA, 22 nt, Human
cagagcagugggccuggccagc

SEQ ID NO: 3156208 - RNA, 19 nt, Human
cagaaaauauuauguguuu

SEQ ID NO: 3156209 - RNA, 12 nt, Human
cacuuugcauaa

SEQ ID NO: 3156210 - RNA, 12 nt, Human
cagaagcccaga

SEQ ID NO: 3156211 - RNA, 14 nt, Human
cagaagcccagaau

SEQ ID NO: 3156212 - RNA, 11 nt, Human
cagaagcccag

SEQ ID NO: 3156213 - RNA, 23 nt, Human
cagaaccccuggcuccaggccag

SEQ ID NO: 3156214 - RNA, 17 nt, Human
cagaaggaucuucaucu

SEQ ID NO: 3156215 - RNA, 14 nt, Human
cagaaugaggcugc

SEQ ID NO: 3156216 - RNA, 15 nt, Human
cagaaugaggcugcu

SEQ ID NO: 3156217 - RNA, 12 nt, Human
cagacuucccac

SEQ ID NO: 3156218 - RNA, 22 nt, Human
cagacuucccacggcuccucga

SEQ ID NO: 3156219 - RNA, 17 nt, Human
cagagaaaaagggaggg

SEQ ID NO: 3156220 - RNA, 18 nt, Human
cagagaaaaagggagggg

SEQ ID NO: 3156221 - RNA, 12 nt, Human
cagagaaaaagg

SEQ ID NO: 3156222 - RNA, 15 nt, Human
cagacccccuggaga

SEQ ID NO: 3156223 - RNA, 14 nt, Human
caccggggccuggg

SEQ ID NO: 3156224 - RNA, 21 nt, Human
caccggggccugggcaggagg

SEQ ID NO: 3156225 - RNA, 22 nt, Human
caccggggccugggcaggaggg

SEQ ID NO: 3156226 - RNA, 17 nt, Human
caccgccuccuacagcc

SEQ ID NO: 3156227 - RNA, 13 nt, Human
cacugacagauuu

SEQ ID NO: 3156228 - RNA, 11 nt, Human
cacugacagau

SEQ ID NO: 3156229 - RNA, 17 nt, Human
cacugacagauuuccau

SEQ ID NO: 3156230 - RNA, 22 nt, Human
cacugacagauuuccauccuag

SEQ ID NO: 3156231 - RNA, 14 nt, Human
cacugauccagccc

SEQ ID NO: 3156232 - RNA, 15 nt, Human
cacugauccagcccu

SEQ ID NO: 3156233 - RNA, 16 nt, Human
cacugauccagcccug

SEQ ID NO: 3156234 - RNA, 18 nt, Human
cacugcuaagaauauuug

SEQ ID NO: 3156235 - RNA, 19 nt, Human
cacuguacuugcucuugau

SEQ ID NO: 3156236 - RNA, 15 nt, Human
cacuguacuugcucu

SEQ ID NO: 3156237 - RNA, 18 nt, Human
cacuguacuugcucuuga

SEQ ID NO: 3156238 - RNA, 17 nt, Human
cacuggccccugagauc

SEQ ID NO: 3156239 - RNA, 19 nt, Human
cacuguucugaaagugacu

SEQ ID NO: 3156240 - RNA, 21 nt, Human
cacuaugaagauguuucaaaa

SEQ ID NO: 3156241 - RNA, 14 nt, Human
cacuaugaagaugu

SEQ ID NO: 3156242 - RNA, 16 nt, Human
cacuaacaugauuugg

SEQ ID NO: 3156243 - RNA, 16 nt, Human
cacucaugugacucuu

SEQ ID NO: 3156244 - RNA, 22 nt, Human
cacucaugugacucuuuccaac

SEQ ID NO: 3156245 - RNA, 18 nt, Human
cacuccuccuagccaccc

SEQ ID NO: 3156246 - RNA, 13 nt, Human
cacuccuccuagc

SEQ ID NO: 3156247 - RNA, 13 nt, Human
cacuaaacaaaga

SEQ ID NO: 3156248 - RNA, 19 nt, Human
cacguguggccuguucuuc

SEQ ID NO: 3156249 - RNA, 16 nt, Human
cacguaaugaaacuug

SEQ ID NO: 3156250 - RNA, 19 nt, Human
cacguaaugaaacuuggau

SEQ ID NO: 3156251 - RNA, 20 nt, Human
cacggcuccucgagauccca

SEQ ID NO: 3156252 - RNA, 22 nt, Human
cacggcuccucgagaucccaac

SEQ ID NO: 3156253 - RNA, 12 nt, Human
ggauuauauuau

SEQ ID NO: 3156254 - RNA, 16 nt, Human
ggauucugagagcugu

SEQ ID NO: 3156255 - RNA, 18 nt, Human
ggaugaugacuauggaaa

SEQ ID NO: 3156256 - RNA, 14 nt, Human
ggacugagaaauuu

SEQ ID NO: 3156257 - RNA, 18 nt, Human
ggacugagaaauuuauaa

SEQ ID NO: 3156258 - RNA, 19 nt, Human
ggagacagguuagcugcuc

SEQ ID NO: 3156259 - RNA, 12 nt, Human
ggaccagccucu

SEQ ID NO: 3156260 - RNA, 21 nt, Human
gcuuuuaugugaaacauguuu

SEQ ID NO: 3156261 - RNA, 19 nt, Human
gcuuuuaugugaaacaugu

SEQ ID NO: 3156262 - RNA, 20 nt, Human
gcuuuuaugugaaacauguu

SEQ ID NO: 3156263 - RNA, 20 nt, Human
ggagcccugggaggcucugg

SEQ ID NO: 3156264 - RNA, 16 nt, Human
ggagccuacccacccc

SEQ ID NO: 3156265 - RNA, 16 nt, Human
ggagcccugggaggcu

SEQ ID NO: 3156266 - RNA, 19 nt, Human
ggagcccugggaggcucug

SEQ ID NO: 3156267 - RNA, 21 nt, Human
ggagcucaggaaccgaggcag

SEQ ID NO: 3156268 - RNA, 17 nt, Human
ggagccugcagagcugc

SEQ ID NO: 3156269 - RNA, 14 nt, Human
ggagggcaggcauc

SEQ ID NO: 3156270 - RNA, 17 nt, Human
ggaggcaggaguuucgu

SEQ ID NO: 3156271 - RNA, 21 nt, Human
ggcuguggcauccagaguccc

SEQ ID NO: 3156272 - RNA, 23 nt, Human
ggcuguggcauccagagucccug

SEQ ID NO: 3156273 - RNA, 20 nt, Human
ggcugggaggagggcaggca

SEQ ID NO: 3156274 - RNA, 21 nt, Human
ggcugggaggagggcaggcau

SEQ ID NO: 3156275 - RNA, 13 nt, Human
ggcugggaggagg

SEQ ID NO: 3156276 - RNA, 23 nt, Human
ggcucuggagcccacuguacuug

SEQ ID NO: 3156277 - RNA, 13 nt, Human
ggcuggacuugga

SEQ ID NO: 3156278 - RNA, 18 nt, Human
ggcuggacuuggagguag

SEQ ID NO: 3156279 - RNA, 15 nt, Human
gggacugagaaauuu

SEQ ID NO: 3156280 - RNA, 14 nt, Human
gggacaccuaggcu

SEQ ID NO: 3156281 - RNA, 20 nt, Human
gggacaccaagccuuggcuc

SEQ ID NO: 3156282 - RNA, 12 nt, Human
gggaggagggca

SEQ ID NO: 3156283 - RNA, 16 nt, Human
gggaggagggcaggca

SEQ ID NO: 3156284 - RNA, 12 nt, Human
gggagcucagga

SEQ ID NO: 3156285 - RNA, 22 nt, Human
gggagcucaggaaccgaggcag

SEQ ID NO: 3156286 - RNA, 23 nt, Human
gggagcucaggaaccgaggcagg

SEQ ID NO: 3156287 - RNA, 13 nt, Human
gggagccgggagc

SEQ ID NO: 3156288 - RNA, 16 nt, Human
ggcucuggagcccacu

SEQ ID NO: 3156289 - RNA, 17 nt, Human
ggcucuggagcccacug

SEQ ID NO: 3156290 - RNA, 19 nt, Human
ggcucuggagcccacugua

SEQ ID NO: 3156291 - RNA, 20 nt, Human
ggccucucauuccagaggaa

SEQ ID NO: 3156292 - RNA, 15 nt, Human
ggccuaaccugccga

SEQ ID NO: 3156293 - RNA, 16 nt, Human
ggccuaaccugccgag

SEQ ID NO: 3156294 - RNA, 19 nt, Human
ggccugggcaggagggagg

SEQ ID NO: 3156295 - RNA, 15 nt, Human
ggccugggcaggagg

SEQ ID NO: 3156296 - RNA, 17 nt, Human
ggccugggcaggaggga

SEQ ID NO: 3156297 - RNA, 16 nt, Human
ggccugacucucagca

SEQ ID NO: 3156298 - RNA, 17 nt, Human
gcuaucguaaaauuaag

SEQ ID NO: 3156299 - RNA, 15 nt, Human
gcuaucguaaaauua

SEQ ID NO: 3156300 - RNA, 16 nt, Human
gcuaucguaaaauuaa

SEQ ID NO: 3156301 - RNA, 18 nt, Human
gcucauggacuucugcca

SEQ ID NO: 3156302 - RNA, 20 nt, Human
gcuccauuuuuagugaaaua

SEQ ID NO: 3156303 - RNA, 18 nt, Human
gcuccaggccagggggcc

SEQ ID NO: 3156304 - RNA, 17 nt, Human
gcuccaggccagggggc

SEQ ID NO: 3156305 - RNA, 15 nt, Human
gcuccuuaaggcucu

SEQ ID NO: 3156306 - RNA, 17 nt, Human
gcuccuuaaggcucuuu

SEQ ID NO: 3156307 - RNA, 21 nt, Human
gcuccuuaaggcucuuuugua

SEQ ID NO: 3156308 - RNA, 17 nt, Human
gccuggaccagccucuc

SEQ ID NO: 3156309 - RNA, 16 nt, Human
gccuggaccagccucu

SEQ ID NO: 3156310 - RNA, 16 nt, Human
gccugggcaggaggga

SEQ ID NO: 3156311 - RNA, 14 nt, Human
gccuggucagccca

SEQ ID NO: 3156312 - RNA, 15 nt, Human
gccuggucagcccaa

SEQ ID NO: 3156313 - RNA, 13 nt, Human
gccuggucagccc

SEQ ID NO: 3156314 - RNA, 15 nt, Human
gccuugucacgccag

SEQ ID NO: 3156315 - RNA, 16 nt, Human
gccuugucacgccaga

SEQ ID NO: 3156316 - RNA, 17 nt, Human
gccuugucacgccagac

SEQ ID NO: 3156317 - RNA, 17 nt, Human
gcgaagcguuguccuca

SEQ ID NO: 3156318 - RNA, 15 nt, Human
gcgaauuuuaaaaga

SEQ ID NO: 3156319 - RNA, 16 nt, Human
gcgaauuuuaaaagau

SEQ ID NO: 3156320 - RNA, 14 nt, Human
gcgaauuuuaaaag

SEQ ID NO: 3156321 - RNA, 15 nt, Human
gcucuccaagcccag

SEQ ID NO: 3156322 - RNA, 19 nt, Human
gcucuugaugccuggcggg

SEQ ID NO: 3156323 - RNA, 14 nt, Human
gcugauuguauuua

SEQ ID NO: 3156324 - RNA, 10 nt, Human
gcuucauaca

SEQ ID NO: 3156325 - RNA, 12 nt, Human
gcuuguguuaag

SEQ ID NO: 3156326 - RNA, 13 nt, Human
gcuuuuaugugaa

SEQ ID NO: 3156327 - RNA, 15 nt, Human
gcuuuuaugugaaac

SEQ ID NO: 3156328 - RNA, 14 nt, Human
gcuuuccaaagcca

SEQ ID NO: 3156329 - RNA, 14 nt, Human
gcuggggaugucuc

SEQ ID NO: 3156330 - RNA, 21 nt, Human
gcugggaggagggcaggcauc

SEQ ID NO: 3156331 - RNA, 22 nt, Human
gcugggcuuggcagcccggguc

SEQ ID NO: 3156332 - RNA, 19 nt, Human
gcuguggccuaaccugccg

SEQ ID NO: 3156333 - RNA, 20 nt, Human
gcuguggccuaaccugccga

SEQ ID NO: 3156334 - RNA, 16 nt, Human
gcuguguggcagucug

SEQ ID NO: 3156335 - RNA, 16 nt, Human
gcugugugcucuccaa

SEQ ID NO: 3156336 - RNA, 18 nt, Human
gcuguguuaaauaaaccu

SEQ ID NO: 3156337 - RNA, 15 nt, Human
gcaccacacucagcc

SEQ ID NO: 3156338 - RNA, 17 nt, Human
gcaccacacucagcccu

SEQ ID NO: 3156339 - RNA, 22 nt, Human
gcagauggaaugcuguguuaaa

SEQ ID NO: 3156340 - RNA, 18 nt, Human
gcaggaaauggcugugga

SEQ ID NO: 3156341 - RNA, 20 nt, Human
gcaucuagcaugucgucaaa

SEQ ID NO: 3156342 - RNA, 23 nt, Human
gcaggucccuaauaaagcugugu

SEQ ID NO: 3156343 - RNA, 20 nt, Human
gcaggucccuaauaaagcug

SEQ ID NO: 3156344 - RNA, 21 nt, Human
gcaggucccuaauaaagcugu

SEQ ID NO: 3156345 - RNA, 16 nt, Human
gcaggucccuaauaaa

SEQ ID NO: 3156346 - RNA, 17 nt, Human
gcaggucccuaauaaag

SEQ ID NO: 3156347 - RNA, 18 nt, Human
gcaggucccuaauaaagc

SEQ ID NO: 3156348 - RNA, 19 nt, Human
gcaggucccuaauaaagcu

SEQ ID NO: 3156349 - RNA, 16 nt, Human
gcagugggccuggcca

SEQ ID NO: 3156350 - RNA, 15 nt, Human
gcagugggccuggcc

SEQ ID NO: 3156351 - RNA, 17 nt, Human
gcagugggccuggccag

SEQ ID NO: 3156352 - RNA, 14 nt, Human
gcaggucccuaaua

SEQ ID NO: 3156353 - RNA, 15 nt, Human
gcaggucccuaauaa

SEQ ID NO: 3156354 - RNA, 23 nt, Human
gcaggcaucggggagccgggagc

SEQ ID NO: 3156355 - RNA, 21 nt, Human
gcaggcaucggggagccggga

SEQ ID NO: 3156356 - RNA, 22 nt, Human
gcaggcaucggggagccgggag

SEQ ID NO: 3156357 - RNA, 21 nt, Human
gcccaaaccaccagaagccca

SEQ ID NO: 3156358 - RNA, 22 nt, Human
gcccaaaccaccagaagcccag

SEQ ID NO: 3156359 - RNA, 23 nt, Human
gcccaaaccaccagaagcccaga

SEQ ID NO: 3156360 - RNA, 13 nt, Human
gccaggcuggguc

SEQ ID NO: 3156361 - RNA, 20 nt, Human
gccaaugugaacagcggcug

SEQ ID NO: 3156362 - RNA, 21 nt, Human
gccagacuucccacggcuccu

SEQ ID NO: 3156363 - RNA, 16 nt, Human
gccaccugaauaaaga

SEQ ID NO: 3156364 - RNA, 19 nt, Human
gccaccgccuccuacagcc

SEQ ID NO: 3156365 - RNA, 15 nt, Human
gccacgauugcagga

SEQ ID NO: 3156366 - RNA, 13 nt, Human
gaggagggcaggc

SEQ ID NO: 3156367 - RNA, 14 nt, Human
gaggagggcaggca

SEQ ID NO: 3156368 - RNA, 15 nt, Human
gaggagggcaggcau

SEQ ID NO: 3156369 - RNA, 15 nt, Human
gaggaugucugggcc

SEQ ID NO: 3156370 - RNA, 12 nt, Human
gagcuacaaaug

SEQ ID NO: 3156371 - RNA, 13 nt, Human
gagcuacaaaugc

SEQ ID NO: 3156372 - RNA, 12 nt, Human
gagccugcagag

SEQ ID NO: 3156373 - RNA, 15 nt, Human
gagccugcagagcug

SEQ ID NO: 3156374 - RNA, 14 nt, Human
gagcuacaaaugca

SEQ ID NO: 3156375 - RNA, 23 nt, Human
gagcucaggaaccgaggcaggga

SEQ ID NO: 3156376 - RNA, 22 nt, Human
gagcucaggaaccgaggcaggg

SEQ ID NO: 3156377 - RNA, 21 nt, Human
gaguugaaaaucuuauaauuu

SEQ ID NO: 3156378 - RNA, 13 nt, Human
gaguuccuagcca

SEQ ID NO: 3156379 - RNA, 17 nt, Human
gauauaaguguguguuu

SEQ ID NO: 3156380 - RNA, 21 nt, Human
gauauaaguguguguuuuuca

SEQ ID NO: 3156381 - RNA, 21 nt, Human
gauaaucagugugucuaaauu

SEQ ID NO: 3156382 - RNA, 22 nt, Human
gagguuuguuuagaagaagugu

SEQ ID NO: 3156383 - RNA, 16 nt, Human
gagucccugccuggac

SEQ ID NO: 3156384 - RNA, 19 nt, Human
gagucccugccuggaccag

SEQ ID NO: 3156385 - RNA, 14 nt, Human
gagucccugccugg

SEQ ID NO: 3156386 - RNA, 15 nt, Human
gagucccugccugga

SEQ ID NO: 3156387 - RNA, 14 nt, Human
gagucccugccauc

SEQ ID NO: 3156388 - RNA, 14 nt, Human
gaguauuuuugaca

SEQ ID NO: 3156389 - RNA, 16 nt, Human
gaguauuuuugacaga

SEQ ID NO: 3156390 - RNA, 17 nt, Human
gaguauuuuugacagaa

SEQ ID NO: 3156391 - RNA, 18 nt, Human
gaguauuuuugacagaau

SEQ ID NO: 3156392 - RNA, 21 nt, Human
gaugccuggcgggguggggug

SEQ ID NO: 3156393 - RNA, 13 nt, Human
gaugcauggagau

SEQ ID NO: 3156394 - RNA, 20 nt, Human
gaugcauggagauagcccca

SEQ ID NO: 3156395 - RNA, 17 nt, Human
gaugcaauguagagggg

SEQ ID NO: 3156396 - RNA, 14 nt, Human
gaugacuauggaaa

SEQ ID NO: 3156397 - RNA, 23 nt, Human
gaucuucaucugacuaugacaua

SEQ ID NO: 3156398 - RNA, 16 nt, Human
gaucuucaucugacua

SEQ ID NO: 3156399 - RNA, 18 nt, Human
gaucgcaguuugccuggu

SEQ ID NO: 3156400 - RNA, 13 nt, Human
gaucgcaguuugc

SEQ ID NO: 3156401 - RNA, 21 nt, Human
gauguguccugauaagcugag

SEQ ID NO: 3156402 - RNA, 21 nt, Human
gauguggaaaagccaagaggc

SEQ ID NO: 3156403 - RNA, 23 nt, Human
gauguggaaaagccaagaggcug

SEQ ID NO: 3156404 - RNA, 22 nt, Human
gauuaagaucucagugguuaag

SEQ ID NO: 3156405 - RNA, 12 nt, Human
cugaauuauuuu

SEQ ID NO: 3156406 - RNA, 12 nt, Human
cugagcaggugu

SEQ ID NO: 3156407 - RNA, 19 nt, Human
cucuggauuauauuaugaa

SEQ ID NO: 3156408 - RNA, 20 nt, Human
cucuggauuauauuaugaag

SEQ ID NO: 3156409 - RNA, 20 nt, Human
cucugcccgggagcucagga

SEQ ID NO: 3156410 - RNA, 14 nt, Human
cucugcccgggagc

SEQ ID NO: 3156411 - RNA, 19 nt, Human
cucugcaggucccuaauaa

SEQ ID NO: 3156412 - RNA, 20 nt, Human
cucugcaggucccuaauaaa

SEQ ID NO: 3156413 - RNA, 21 nt, Human
cucugcaggucccuaauaaag

SEQ ID NO: 3156414 - RNA, 18 nt, Human
cucugcaggucccuaaua

SEQ ID NO: 3156415 - RNA, 15 nt, Human
cugaguuccuagcca

SEQ ID NO: 3156416 - RNA, 16 nt, Human
cugaguuccuagccac

SEQ ID NO: 3156417 - RNA, 17 nt, Human
cugaguuccuagccacc

SEQ ID NO: 3156418 - RNA, 18 nt, Human
cugaguuccuagccaccg

SEQ ID NO: 3156419 - RNA, 13 nt, Human
cugauuguauuua

SEQ ID NO: 3156420 - RNA, 16 nt, Human
cugccacucaggccca

SEQ ID NO: 3156421 - RNA, 23 nt, Human
cugccacucaggcccaaagccuc

SEQ ID NO: 3156422 - RNA, 15 nt, Human
cugccucucugcagg

SEQ ID NO: 3156423 - RNA, 16 nt, Human
cugccucucugcaggu

SEQ ID NO: 3156424 - RNA, 17 nt, Human
cugccucucugcagguc

SEQ ID NO: 3156425 - RNA, 18 nt, Human
cugccucucugcaggucc

SEQ ID NO: 3156426 - RNA, 17 nt, Human
cugccuggaccagccuc

SEQ ID NO: 3156427 - RNA, 15 nt, Human
cucauaucaguuugc

SEQ ID NO: 3156428 - RNA, 13 nt, Human
cuccaccugcucu

SEQ ID NO: 3156429 - RNA, 23 nt, Human
cuccaccaagccuggucagccca

SEQ ID NO: 3156430 - RNA, 21 nt, Human
cuccaaugcuguuaucccugc

SEQ ID NO: 3156431 - RNA, 12 nt, Human
cuccuccuagcc

SEQ ID NO: 3156432 - RNA, 13 nt, Human
cucgagaucccaa

SEQ ID NO: 3156433 - RNA, 21 nt, Human
cucgagaucccaacacugcca

SEQ ID NO: 3156434 - RNA, 22 nt, Human
cucgagaucccaacacugccag

SEQ ID NO: 3156435 - RNA, 23 nt, Human
cucgagaucccaacacugccagc

SEQ ID NO: 3156436 - RNA, 22 nt, Human
cuagguaaauuacaguuccuag

SEQ ID NO: 3156437 - RNA, 13 nt, Human
cuauggccugugg

SEQ ID NO: 3156438 - RNA, 13 nt, Human
cuaugagggccuu

SEQ ID NO: 3156439 - RNA, 16 nt, Human
cuaucuguuuacagug

SEQ ID NO: 3156440 - RNA, 15 nt, Human
cuaugagggccuuga

SEQ ID NO: 3156441 - RNA, 17 nt, Human
cuaugagggccuugagu

SEQ ID NO: 3156442 - RNA, 13 nt, Human
cuauaauuuaaau

SEQ ID NO: 3156443 - RNA, 13 nt, Human
cucacauuuauau

SEQ ID NO: 3156444 - RNA, 14 nt, Human
cuauuguagagcca

SEQ ID NO: 3156445 - RNA, 12 nt, Human
cucaaauuugga

SEQ ID NO: 3156446 - RNA, 22 nt, Human
gaaaacaauaacgauaaaagac

SEQ ID NO: 3156447 - RNA, 14 nt, Human
cuuuuuucuaaagu

SEQ ID NO: 3156448 - RNA, 20 nt, Human
gaaaaucuuauaauuuaaaa

SEQ ID NO: 3156449 - RNA, 16 nt, Human
gaaacacuuugcauaa

SEQ ID NO: 3156450 - RNA, 19 nt, Human
gaaaauaacaauaaaagac

SEQ ID NO: 3156451 - RNA, 19 nt, Human
gaaaauaacgauaaaagac

SEQ ID NO: 3156452 - RNA, 19 nt, Human
gaaaaucuuauaauuuaaa

SEQ ID NO: 3156453 - RNA, 18 nt, Human
gaaaaucuuauaauuuaa

SEQ ID NO: 3156454 - RNA, 17 nt, Human
gaaaauauuauguguuu

SEQ ID NO: 3156455 - RNA, 20 nt, Human
cuuuuacguccaucucuugu

SEQ ID NO: 3156456 - RNA, 19 nt, Human
cuuguaaaggaauuuaaaa

SEQ ID NO: 3156457 - RNA, 18 nt, Human
cuuguaaaggaauuuaaa

SEQ ID NO: 3156458 - RNA, 20 nt, Human
cuuggggacaggggcaggag

SEQ ID NO: 3156459 - RNA, 17 nt, Human
cuuggagguagcuuuga

SEQ ID NO: 3156460 - RNA, 19 nt, Human
cuuguguuaaguaugugua

SEQ ID NO: 3156461 - RNA, 13 nt, Human
cuuucccaacacc

SEQ ID NO: 3156462 - RNA, 17 nt, Human
cuuucccaacaccucuu

SEQ ID NO: 3156463 - RNA, 18 nt, Human
gaaauuguauuacaaauc

SEQ ID NO: 3156464 - RNA, 22 nt, Human
gaacucaucuagguaaauuaca

SEQ ID NO: 3156465 - RNA, 21 nt, Human
gaacuuguaaaggaauuuaaa

SEQ ID NO: 3156466 - RNA, 13 nt, Human
gaacuauuagagc

SEQ ID NO: 3156467 - RNA, 22 nt, Human
gaagcuucuggugaccuuccaa

SEQ ID NO: 3156468 - RNA, 18 nt, Human
gaagcuuuuaugugaaac

SEQ ID NO: 3156469 - RNA, 10 nt, Human
gaagcccaga

SEQ ID NO: 3156470 - RNA, 12 nt, Human
gaagcccagaau

SEQ ID NO: 3156471 - RNA, 22 nt, Human
gaagccacgguguucugugaua

SEQ ID NO: 3156472 - RNA, 19 nt, Human
gaaggaucccaugagcucc

SEQ ID NO: 3156473 - RNA, 14 nt, Human
gaaggaaaaugaua

SEQ ID NO: 3156474 - RNA, 17 nt, Human
gaauaaagaaugaaugg

SEQ ID NO: 3156475 - RNA, 17 nt, Human
gaaguuuacauuguaaa

SEQ ID NO: 3156476 - RNA, 16 nt, Human
gaaguuuacauuguaa

SEQ ID NO: 3156477 - RNA, 12 nt, Human
gaauaaaauuuu

SEQ ID NO: 3156478 - RNA, 14 nt, Human
gaauacuuuauaaa

SEQ ID NO: 3156479 - RNA, 20 nt, Human
gaauaauccuaaacauauga

SEQ ID NO: 3156480 - RNA, 20 nt, Human
gaauaagugccaggauggaa

SEQ ID NO: 3156481 - RNA, 14 nt, Human
gaaugccuccugca

SEQ ID NO: 3156482 - RNA, 19 nt, Human
cuuccaaacaggcucagag

SEQ ID NO: 3156483 - RNA, 17 nt, Human
cuuaaccagaucauugu

SEQ ID NO: 3156484 - RNA, 15 nt, Human
cuuaaggcucuuuug

SEQ ID NO: 3156485 - RNA, 13 nt, Human
cugggucgcccug

SEQ ID NO: 3156486 - RNA, 15 nt, Human
cugggucgcccugga

SEQ ID NO: 3156487 - RNA, 16 nt, Human
cugggggccucuucug

SEQ ID NO: 3156488 - RNA, 19 nt, Human
cugggccccugccucucug

SEQ ID NO: 3156489 - RNA, 20 nt, Human
cugggccccugccucucugc

SEQ ID NO: 3156490 - RNA, 23 nt, Human
cugggccccugccucucugcagg

SEQ ID NO: 3156491 - RNA, 14 nt, Human
cuggugguggcucg

SEQ ID NO: 3156492 - RNA, 22 nt, Human
cuggugguggcucgggaggcga

SEQ ID NO: 3156493 - RNA, 12 nt, Human
cuggugguucac

SEQ ID NO: 3156494 - RNA, 20 nt, Human
cuggugguucacucuuggag

SEQ ID NO: 3156495 - RNA, 21 nt, Human
cuggugguucacucuuggagc

SEQ ID NO: 3156496 - RNA, 23 nt, Human
cuggugguucacucuuggagccu

SEQ ID NO: 3156497 - RNA, 21 nt, Human
cugucuuuuuucuaaaguaaa

SEQ ID NO: 3156498 - RNA, 18 nt, Human
cugugaaaguacauuugg

SEQ ID NO: 3156499 - RNA, 17 nt, Human
cugugcccacccuccac

SEQ ID NO: 3156500 - RNA, 23 nt, Human
cugugcccacccuccacucuccu

SEQ ID NO: 3156501 - RNA, 14 nt, Human
cugugugcucagga

SEQ ID NO: 3156502 - RNA, 14 nt, Human
cuguguguguguau

SEQ ID NO: 3156503 - RNA, 16 nt, Human
cuguguguguguaugu

SEQ ID NO: 3156504 - RNA, 15 nt, Human
cuguguguguguaug

SEQ ID NO: 3156505 - RNA, 20 nt, Human
cuguguguuuaugugugugu

SEQ ID NO: 3156506 - RNA, 18 nt, Human
cuguguguuuaugugugu

SEQ ID NO: 3156507 - RNA, 20 nt, Human
cuguguguguguaugugggg

SEQ ID NO: 3156508 - RNA, 18 nt, Human
cuguguguguguaugugg

SEQ ID NO: 3156509 - RNA, 18 nt, Human
cuguggccuaaccugccg

SEQ ID NO: 3156510 - RNA, 14 nt, Human
cuguggaucaaauc

SEQ ID NO: 3156511 - RNA, 24 nt, Human
cuguggaucaaauccagccugcug

SEQ ID NO: 3156512 - RNA, 21 nt, Human
cccacaggagguggucuggga

SEQ ID NO: 3156513 - RNA, 16 nt, Human
cccacaggaggugguc

SEQ ID NO: 3156514 - RNA, 17 nt, Human
cccaccacacccucccu

SEQ ID NO: 3156515 - RNA, 15 nt, Human
cccuggacugugugc

SEQ ID NO: 3156516 - RNA, 13 nt, Human
cccugccagaccc

SEQ ID NO: 3156517 - RNA, 21 nt, Human
cccugccagacccccuggaga

SEQ ID NO: 3156518 - RNA, 13 nt, Human
cccuccaccugcu

SEQ ID NO: 3156519 - RNA, 23 nt, Human
cccuccacucuccucuuccaggc

SEQ ID NO: 3156520 - RNA, 16 nt, Human
ccuaggcuaggguggg

SEQ ID NO: 3156521 - RNA, 18 nt, Human
ccuaaauauauuuuaaga

SEQ ID NO: 3156522 - RNA, 16 nt, Human
ccuaaauauauuuuaa

SEQ ID NO: 3156523 - RNA, 22 nt, Human
ccgggucaucuguaccucugcc

SEQ ID NO: 3156524 - RNA, 12 nt, Human
ccggguuccagc

SEQ ID NO: 3156525 - RNA, 15 nt, Human
ccggguuccagcacc

SEQ ID NO: 3156526 - RNA, 19 nt, Human
ccgggacaccuaggcuagg

SEQ ID NO: 3156527 - RNA, 20 nt, Human
ccgggacaccuaggcuaggg

SEQ ID NO: 3156528 - RNA, 15 nt, Human
ccgaggcagggaagg

SEQ ID NO: 3156529 - RNA, 21 nt, Human
ccucaucuccccaucauuggu

SEQ ID NO: 3156530 - RNA, 18 nt, Human
ccucuccacucaugugac

SEQ ID NO: 3156531 - RNA, 18 nt, Human
ccucucauuccagaggaa

SEQ ID NO: 3156532 - RNA, 16 nt, Human
ccuuccaagagccuga

SEQ ID NO: 3156533 - RNA, 17 nt, Human
ccuuccaagagccugag

SEQ ID NO: 3156534 - RNA, 15 nt, Human
ccuuccaagagccug

SEQ ID NO: 3156535 - RNA, 13 nt, Human
ccuugaacuagga

SEQ ID NO: 3156536 - RNA, 15 nt, Human
ccuucugugaaagua

SEQ ID NO: 3156537 - RNA, 15 nt, Human
ccuugucacgccaga

SEQ ID NO: 3156538 - RNA, 18 nt, Human
ccuugucacgccagacuu

SEQ ID NO: 3156539 - RNA, 12 nt, Human
ccuguuuaagag

SEQ ID NO: 3156540 - RNA, 15 nt, Human
ccuguuuaagagaca

SEQ ID NO: 3156541 - RNA, 16 nt, Human
ccuuaaggcucuuuug

SEQ ID NO: 3156542 - RNA, 18 nt, Human
ccuuaaggcucuuuugua

SEQ ID NO: 3156543 - RNA, 13 nt, Human
ccuuaaggcucuu

SEQ ID NO: 3156544 - RNA, 22 nt, Human
cgagaucccaacacugccagca

SEQ ID NO: 3156545 - RNA, 15 nt, Human
cgagaucccaacacu

SEQ ID NO: 3156546 - RNA, 21 nt, Human
cgagaucccaacacugccagc

SEQ ID NO: 3156547 - RNA, 13 nt, Human
cgagaucccaaca

SEQ ID NO: 3156548 - RNA, 21 nt, Human
cgaagaguauuuuugacagaa

SEQ ID NO: 3156549 - RNA, 18 nt, Human
ccugccugguccucacac

SEQ ID NO: 3156550 - RNA, 12 nt, Human
ccugggcaggag

SEQ ID NO: 3156551 - RNA, 14 nt, Human
ccugggcaggaggg

SEQ ID NO: 3156552 - RNA, 14 nt, Human
ccuggucagcccaa

SEQ ID NO: 3156553 - RNA, 12 nt, Human
ccuggucagccc

SEQ ID NO: 3156554 - RNA, 19 nt, Human
ccuggagacuaaccccacc

SEQ ID NO: 3156555 - RNA, 15 nt, Human
ccuggcuccaggcca

SEQ ID NO: 3156556 - RNA, 16 nt, Human
ccuggcuccaggccag

SEQ ID NO: 3156557 - RNA, 17 nt, Human
ccuggcuccaggccagg

SEQ ID NO: 3156558 - RNA, 19 nt, Human
ccugcaauuucauaugcug

SEQ ID NO: 3156559 - RNA, 22 nt, Human
ccugccacucaggcccaaagcc

SEQ ID NO: 3156560 - RNA, 23 nt, Human
ccugccacucaggcccaaagccu

SEQ ID NO: 3156561 - RNA, 14 nt, Human
ccugccagaccccc

SEQ ID NO: 3156562 - RNA, 14 nt, Human
ccugccacucaggc

SEQ ID NO: 3156563 - RNA, 19 nt, Human
ccugaggaagagggacugu

SEQ ID NO: 3156564 - RNA, 20 nt, Human
ccacuguacuugcucuugau

SEQ ID NO: 3156565 - RNA, 17 nt, Human
ccacuguacuugcucuu

SEQ ID NO: 3156566 - RNA, 18 nt, Human
ccacuguacuugcucuug

SEQ ID NO: 3156567 - RNA, 19 nt, Human
ccacuguacuugcucuuga

SEQ ID NO: 3156568 - RNA, 18 nt, Human
ccagacccccuggagacu

SEQ ID NO: 3156569 - RNA, 12 nt, Human
ccagacccccug

SEQ ID NO: 3156570 - RNA, 16 nt, Human
ccagacccccuggaga

SEQ ID NO: 3156571 - RNA, 13 nt, Human
ccagauuuaugca

SEQ ID NO: 3156572 - RNA, 22 nt, Human
ccagauuuaugcauauuauuuu

SEQ ID NO: 3156573 - RNA, 23 nt, Human
ccagcauaauacuugcuuuggaa

SEQ ID NO: 3156574 - RNA, 16 nt, Human
ccagcauuucccuucc

SEQ ID NO: 3156575 - RNA, 21 nt, Human
ccagcauuucccuuccuuccu

SEQ ID NO: 3156576 - RNA, 20 nt, Human
ccaccugaauaaagaaugaa

SEQ ID NO: 3156577 - RNA, 15 nt, Human
ccacccuccacucuc

SEQ ID NO: 3156578 - RNA, 22 nt, Human
ccacucaugugacucuuuccaa

SEQ ID NO: 3156579 - RNA, 19 nt, Human
ccacucaugugacucuuuc

SEQ ID NO: 3156580 - RNA, 22 nt, Human
ccacuaaaagaucgcaguuugc

SEQ ID NO: 3156581 - RNA, 20 nt, Human
ccaaaccaccagaagcccag

SEQ ID NO: 3156582 - RNA, 22 nt, Human
ccacacugauccagcccugagu

SEQ ID NO: 3156583 - RNA, 19 nt, Human
ccacacugauccagcccug

SEQ ID NO: 3156584 - RNA, 22 nt, Human
ccaccaagccuggucagcccaa

SEQ ID NO: 3156585 - RNA, 21 nt, Human
ccaccaagccuggucagccca

SEQ ID NO: 3156586 - RNA, 18 nt, Human
ccauccuacccccugugc

SEQ ID NO: 3156587 - RNA, 17 nt, Human
ccauccuacccccugug

SEQ ID NO: 3156588 - RNA, 21 nt, Human
cccaaaacaccggguuccagc

SEQ ID NO: 3156589 - RNA, 19 nt, Human
cccaaaacaccggguucca

SEQ ID NO: 3156590 - RNA, 19 nt, Human
ccaggccagggggccaguc

SEQ ID NO: 3156591 - RNA, 13 nt, Human
ccaggagacaggu

SEQ ID NO: 3156592 - RNA, 18 nt, Human
caugagauaauaugcaga

SEQ ID NO: 3156593 - RNA, 19 nt, Human
caugaguuggcugggaaua

SEQ ID NO: 3156594 - RNA, 23 nt, Human
caugagcuccuuaaggcucuuuu

SEQ ID NO: 3156595 - RNA, 15 nt, Human
cauccuacccccugu

SEQ ID NO: 3156596 - RNA, 18 nt, Human
cauccuacccccugugcc

SEQ ID NO: 3156597 - RNA, 17 nt, Human
caucugacuaugacaua

SEQ ID NO: 3156598 - RNA, 16 nt, Human
caucucuuguuuaaau

SEQ ID NO: 3156599 - RNA, 17 nt, Human
cauaucuaguaugaaau

SEQ ID NO: 3156600 - RNA, 18 nt, Human
cauaucuaguaugaaauu

SEQ ID NO: 3156601 - RNA, 15 nt, Human
cauaucuaguaugaa

SEQ ID NO: 3156602 - RNA, 16 nt, Human
cauauaagugauugcu

SEQ ID NO: 3156603 - RNA, 16 nt, Human
cauagguuuaauaauu

SEQ ID NO: 3156604 - RNA, 21 nt, Human
cauaucuaguaugaaauuaua

SEQ ID NO: 3156605 - RNA, 19 nt, Human
cauauuguuacugguacca

SEQ ID NO: 3156606 - RNA, 13 nt, Human
cauauuguuacug

SEQ ID NO: 3156607 - RNA, 13 nt, Human
caucccuccuggg

SEQ ID NO: 3156608 - RNA, 13 nt, Human
cauccagaguccc

SEQ ID NO: 3156609 - RNA, 17 nt, Human
cauccagagucccugcc

SEQ ID NO: 3156610 - RNA, 18 nt, Human
cauccagagucccugccu

SEQ ID NO: 3156611 - RNA, 20 nt, Human
cauccagagucccugccugg

SEQ ID NO: 3156612 - RNA, 13 nt, Human
caucauguuuaca

SEQ ID NO: 3156613 - RNA, 21 nt, Human
caucauguuuacagaggacag

SEQ ID NO: 3156614 - RNA, 19 nt, Human
caucauguuuacagaggac

SEQ ID NO: 3156615 - RNA, 15 nt, Human
cauggcauauuuuuc

SEQ ID NO: 3156616 - RNA, 19 nt, Human
cauggcauauuuuucacau

SEQ ID NO: 3156617 - RNA, 23 nt, Human
cauggcauauuuuucacauaucu

SEQ ID NO: 3156618 - RNA, 13 nt, Human
cauggcauauuuu

SEQ ID NO: 3156619 - RNA, 16 nt, Human
caugugacucuuucca

SEQ ID NO: 3156620 - RNA, 17 nt, Human
caugugacucuuuccaa

SEQ ID NO: 3156621 - RNA, 14 nt, Human
caugugacucuuuc

SEQ ID NO: 3156622 - RNA, 21 nt, Human
cauuaaaaaaucaguuguaca

SEQ ID NO: 3156623 - RNA, 19 nt, Human
cauuguacgaagaguauuu

SEQ ID NO: 3156624 - RNA, 23 nt, Human
cauuuuaccuuugacaaagguaa

SEQ ID NO: 3156625 - RNA, 17 nt, Human
ccaaaccaccagaagcc

SEQ ID NO: 3156626 - RNA, 13 nt, Human
cauucuggaauaa

SEQ ID NO: 3156627 - RNA, 14 nt, Human
cauucuuucccaac

SEQ ID NO: 3156628 - RNA, 12 nt, Human
cauucuuuccca

SEQ ID NO: 3156629 - RNA, 13 nt, Human
cauuccagaggaa

SEQ ID NO: 3156630 - RNA, 19 nt, Human
cauucauuuucuggguguu

SEQ ID NO: 3156631 - RNA, 14 nt, Human
cauuccagaggaag

SEQ ID NO: 3156632 - RNA, 13 nt, Human
uuuuuaaucuuua

SEQ ID NO: 3156633 - RNA, 23 nt, Human
uuuugacagaauauguuucaaac

SEQ ID NO: 3156634 - RNA, 22 nt, Human
uuuugacagaauauguuucaaa

SEQ ID NO: 3156635 - RNA, 11 nt, Human
uuuugacagaa

SEQ ID NO: 3156636 - RNA, 18 nt, Human
uuugcauaacguauaaaa

SEQ ID NO: 3156637 - RNA, 15 nt, Human
uuuggucaacacuaa

SEQ ID NO: 3156638 - RNA, 14 nt, Human
uuuuaaaauccacu

SEQ ID NO: 3156639 - RNA, 23 nt, Human
uuuuaaaauccacuuuaucuuga

SEQ ID NO: 3156640 - RNA, 21 nt, Human
uuuucuuaaccagaucauugu

SEQ ID NO: 3156641 - RNA, 22 nt, Human
uuuucagaaaauauuauguguu

SEQ ID NO: 3156642 - RNA, 16 nt, Human
uuuucacauaucuagu

SEQ ID NO: 3156643 - RNA, 21 nt, Human
uuuucaaaauuguuacaaauu

SEQ ID NO: 3156644 - RNA, 23 nt, Human
uuuucagaaaauauuauguguuu

SEQ ID NO: 3156645 - RNA, 21 nt, Human
uuuuaaaguaacccuacaaaa

SEQ ID NO: 3156646 - RNA, 19 nt, Human
uuuuacguccaucucuugu

SEQ ID NO: 3156647 - RNA, 21 nt, Human
uuuuauuuuucucaugaugag

SEQ ID NO: 3156648 - RNA, 23 nt, Human
uucaguuauuauauuuacaaaug

SEQ ID NO: 3156649 - RNA, 20 nt, Human
uucauaaauaaaguuuguug

SEQ ID NO: 3156650 - RNA, 20 nt, Human
uucaucugacuaugacauaa

SEQ ID NO: 3156651 - RNA, 13 nt, Human
uucagcuugggga

SEQ ID NO: 3156652 - RNA, 21 nt, Human
uuccaaaaagauuuucagaaa

SEQ ID NO: 3156653 - RNA, 14 nt, Human
uuauuuuguucaua

SEQ ID NO: 3156654 - RNA, 16 nt, Human
uucaauaauaaauauu

SEQ ID NO: 3156655 - RNA, 13 nt, Human
uuauuuuaaaaga

SEQ ID NO: 3156656 - RNA, 12 nt, Human
uuauaauuuaaa

SEQ ID NO: 3156657 - RNA, 12 nt, Human
uuauaauuuuaa

SEQ ID NO: 3156658 - RNA, 17 nt, Human
uuauaauuuuaaauguu

SEQ ID NO: 3156659 - RNA, 21 nt, Human
uuauaauuuuaaauguuuuuu

SEQ ID NO: 3156660 - RNA, 14 nt, Human
uuauacaggucaua

SEQ ID NO: 3156661 - RNA, 22 nt, Human
uuauacaggucauauuaauaua

SEQ ID NO: 3156662 - RNA, 15 nt, Human
uuauaucuuguagcu

SEQ ID NO: 3156663 - RNA, 22 nt, Human
uuauaucuuguagcuuuaucaa

SEQ ID NO: 3156664 - RNA, 16 nt, Human
uuauauuaugaagcuu

SEQ ID NO: 3156665 - RNA, 16 nt, Human
uuauauuuacaaaugg

SEQ ID NO: 3156666 - RNA, 16 nt, Human
uuaucuugaauaaugu

SEQ ID NO: 3156667 - RNA, 14 nt, Human
uuaucuugaauaau

SEQ ID NO: 3156668 - RNA, 17 nt, Human
uuauguugcauagaaua

SEQ ID NO: 3156669 - RNA, 18 nt, Human
uucugcuuguguuaagua

SEQ ID NO: 3156670 - RNA, 17 nt, Human
uucuuccaaaaagauuu

SEQ ID NO: 3156671 - RNA, 13 nt, Human
uugaaaagaggug

SEQ ID NO: 3156672 - RNA, 14 nt, Human
uugaaaagaggugu

SEQ ID NO: 3156673 - RNA, 21 nt, Human
uugaaaagaggugugcaagag

SEQ ID NO: 3156674 - RNA, 19 nt, Human
uugacaaagucaagccaca

SEQ ID NO: 3156675 - RNA, 20 nt, Human
uugacaaagucaagccacau

SEQ ID NO: 3156676 - RNA, 13 nt, Human
uucugagagcugu

SEQ ID NO: 3156677 - RNA, 19 nt, Human
uucugagagcugugcauca

SEQ ID NO: 3156678 - RNA, 22 nt, Human
uucuacauaaguaauucaagaa

SEQ ID NO: 3156679 - RNA, 14 nt, Human
uucuauagcuuuuc

SEQ ID NO: 3156680 - RNA, 18 nt, Human
uucggugagcuacaaaug

SEQ ID NO: 3156681 - RNA, 21 nt, Human
uuccugaggaagagggacugu

SEQ ID NO: 3156682 - RNA, 13 nt, Human
uuguguugugaau

SEQ ID NO: 3156683 - RNA, 17 nt, Human
uuguaaauaguauuuga

SEQ ID NO: 3156684 - RNA, 21 nt, Human
uuguauucagaguugaugguu

SEQ ID NO: 3156685 - RNA, 23 nt, Human
uuguacgaagaguauuuuugaca

SEQ ID NO: 3156686 - RNA, 21 nt, Human
uuguacgaagaguauuuuuga

SEQ ID NO: 3156687 - RNA, 20 nt, Human
uuuacauuguaaauaguauu

SEQ ID NO: 3156688 - RNA, 21 nt, Human
uuuauaaaaauaaaaaacacu

SEQ ID NO: 3156689 - RNA, 23 nt, Human
uuuauaaaaauaaaaaacacugg

SEQ ID NO: 3156690 - RNA, 19 nt, Human
uuuaacucuauaauguguu

SEQ ID NO: 3156691 - RNA, 19 nt, Human
uuuccaaccggcuuugugg

SEQ ID NO: 3156692 - RNA, 12 nt, Human
ugcuuguguuaa

SEQ ID NO: 3156693 - RNA, 15 nt, Human
ugcuuguguuaagua

SEQ ID NO: 3156694 - RNA, 17 nt, Human
ugcuuuggaaaacccag

SEQ ID NO: 3156695 - RNA, 16 nt, Human
uggaaaagccaagagg

SEQ ID NO: 3156696 - RNA, 19 nt, Human
uggaaaagccaagaggcug

SEQ ID NO: 3156697 - RNA, 17 nt, Human
uggagacacaacuauuu

SEQ ID NO: 3156698 - RNA, 19 nt, Human
uggaucaaauccagccugc

SEQ ID NO: 3156699 - RNA, 14 nt, Human
ugggaggagggcag

SEQ ID NO: 3156700 - RNA, 17 nt, Human
ugggaggagggcaggca

SEQ ID NO: 3156701 - RNA, 18 nt, Human
ugggaggagggcaggcau

SEQ ID NO: 3156702 - RNA, 17 nt, Human
uggggggcuucauacac

SEQ ID NO: 3156703 - RNA, 17 nt, Human
uggggccaggcuggguc

SEQ ID NO: 3156704 - RNA, 21 nt, Human
uggcuugaguuuaaauuguaa

SEQ ID NO: 3156705 - RNA, 14 nt, Human
ugggaaugaagcaa

SEQ ID NO: 3156706 - RNA, 15 nt, Human
uggcuccaggccagg

SEQ ID NO: 3156707 - RNA, 16 nt, Human
uggccuaaccugccga

SEQ ID NO: 3156708 - RNA, 14 nt, Human
uggccccugagauc

SEQ ID NO: 3156709 - RNA, 23 nt, Human
uggccuaaccugccgagagucca

SEQ ID NO: 3156710 - RNA, 15 nt, Human
ugguuccagccugcc

SEQ ID NO: 3156711 - RNA, 16 nt, Human
ugguuccagccugcca

SEQ ID NO: 3156712 - RNA, 20 nt, Human
ugguuguacauauaagugau

SEQ ID NO: 3156713 - RNA, 17 nt, Human
uguaaugaaaaccacau

SEQ ID NO: 3156714 - RNA, 11 nt, Human
uguaaugaaaa

SEQ ID NO: 3156715 - RNA, 12 nt, Human
uguaaugaaaac

SEQ ID NO: 3156716 - RNA, 13 nt, Human
uguaaugaaaacc

SEQ ID NO: 3156717 - RNA, 17 nt, Human
uguaaauuuaugugaug

SEQ ID NO: 3156718 - RNA, 22 nt, Human
uguaauaacugugaaguuuaca

SEQ ID NO: 3156719 - RNA, 14 nt, Human
uguaauaacuguga

SEQ ID NO: 3156720 - RNA, 14 nt, Human
uguagcuuuaucaa

SEQ ID NO: 3156721 - RNA, 15 nt, Human
uguagcuuuaucaaa

SEQ ID NO: 3156722 - RNA, 13 nt, Human
uguaugcuucaua

SEQ ID NO: 3156723 - RNA, 14 nt, Human
uguaugcuucauac

SEQ ID NO: 3156724 - RNA, 16 nt, Human
uguaugcuucauacag

SEQ ID NO: 3156725 - RNA, 19 nt, Human
uguaugcuucauacaggga

SEQ ID NO: 3156726 - RNA, 18 nt, Human
uguccugcaccggggccu

SEQ ID NO: 3156727 - RNA, 13 nt, Human
uguccucagcccc

SEQ ID NO: 3156728 - RNA, 13 nt, Human
ugagaaaucuaaa

SEQ ID NO: 3156729 - RNA, 17 nt, Human
ugagaaaucuaaaaaac

SEQ ID NO: 3156730 - RNA, 21 nt, Human
ugacccucaucuuucuuccaa

SEQ ID NO: 3156731 - RNA, 19 nt, Human
ucuugaaggaaaaugauac

SEQ ID NO: 3156732 - RNA, 16 nt, Human
ucuugaauaauguaag

SEQ ID NO: 3156733 - RNA, 17 nt, Human
ugauauaaguguguguu

SEQ ID NO: 3156734 - RNA, 23 nt, Human
ugauauaaguguguguuuuucau

SEQ ID NO: 3156735 - RNA, 20 nt, Human
ugauguauucuagcuaaugu

SEQ ID NO: 3156736 - RNA, 14 nt, Human
ugauguauucuagc

SEQ ID NO: 3156737 - RNA, 13 nt, Human
ugauguauucuag

SEQ ID NO: 3156738 - RNA, 13 nt, Human
ugauguacaugua

SEQ ID NO: 3156739 - RNA, 21 nt, Human
ugaugguuguacauauaagug

SEQ ID NO: 3156740 - RNA, 23 nt, Human
ugaugcuacaggauuugaaauug

SEQ ID NO: 3156741 - RNA, 14 nt, Human
ugaugaaaauauuu

SEQ ID NO: 3156742 - RNA, 17 nt, Human
ugaguuggcugggaaua

SEQ ID NO: 3156743 - RNA, 16 nt, Human
ugaguuggcugggaau

SEQ ID NO: 3156744 - RNA, 14 nt, Human
ugaguuggcuggga

SEQ ID NO: 3156745 - RNA, 19 nt, Human
ugagguggaagagggcugc

SEQ ID NO: 3156746 - RNA, 16 nt, Human
ugaggcugcuuuccaa

SEQ ID NO: 3156747 - RNA, 20 nt, Human
ugaggcugcuuuccaaagcc

SEQ ID NO: 3156748 - RNA, 23 nt, Human
ugaggcugcuuuccaaagccaau

SEQ ID NO: 3156749 - RNA, 18 nt, Human
ugcccgggagcucaggaa

SEQ ID NO: 3156750 - RNA, 17 nt, Human
ugcccgggagcucagga

SEQ ID NO: 3156751 - RNA, 17 nt, Human
ugcccagaaugaggcug

SEQ ID NO: 3156752 - RNA, 18 nt, Human
ugcccagaaugaggcugc

SEQ ID NO: 3156753 - RNA, 17 nt, Human
ugccugguccucacacu

SEQ ID NO: 3156754 - RNA, 21 nt, Human
ugcauuauauuuguaaauuua

SEQ ID NO: 3156755 - RNA, 22 nt, Human
ugccaucauguuuacagaggac

SEQ ID NO: 3156756 - RNA, 20 nt, Human
ugcaauuucauaugcuguau

SEQ ID NO: 3156757 - RNA, 14 nt, Human
ugcaauuucauaug

SEQ ID NO: 3156758 - RNA, 22 nt, Human
ugcaauguagaggggaaaagag

SEQ ID NO: 3156759 - RNA, 17 nt, Human
ugcaaugguuaacaucu

SEQ ID NO: 3156760 - RNA, 18 nt, Human
ugauuuuuaugccaccug

SEQ ID NO: 3156761 - RNA, 18 nt, Human
ugcaacuuuguauaaaag

SEQ ID NO: 3156762 - RNA, 20 nt, Human
uccuaauaaucauuggauuc

SEQ ID NO: 3156763 - RNA, 21 nt, Human
ucccgggacaccuaggcuagg

SEQ ID NO: 3156764 - RNA, 14 nt, Human
ucccuaauaaagcu

SEQ ID NO: 3156765 - RNA, 15 nt, Human
ucccuaauaaagcug

SEQ ID NO: 3156766 - RNA, 16 nt, Human
ucccuccucugcccgg

SEQ ID NO: 3156767 - RNA, 11 nt, Human
ucccuccuggg

SEQ ID NO: 3156768 - RNA, 19 nt, Human
ucccuccugggaaugaagc

SEQ ID NO: 3156769 - RNA, 17 nt, Human
ucccucuacugggagcc

SEQ ID NO: 3156770 - RNA, 15 nt, Human
ucccucuacugggag

SEQ ID NO: 3156771 - RNA, 16 nt, Human
ucccuaauaaagcugu

SEQ ID NO: 3156772 - RNA, 13 nt, Human
ucccugccuggac

SEQ ID NO: 3156773 - RNA, 23 nt, Human
ucccugccugguccucacacuca

SEQ ID NO: 3156774 - RNA, 16 nt, Human
ucccuuccuuccucuc

SEQ ID NO: 3156775 - RNA, 19 nt, Human
ucccuuccuuccucuccug

SEQ ID NO: 3156776 - RNA, 22 nt, Human
ucuaugauuccagguggcauca

SEQ ID NO: 3156777 - RNA, 14 nt, Human
ucgugucuggcaca

SEQ ID NO: 3156778 - RNA, 21 nt, Human
ucgugucuggcacagccuggc

SEQ ID NO: 3156779 - RNA, 15 nt, Human
ucucugcaggucccu

SEQ ID NO: 3156780 - RNA, 16 nt, Human
ucucugcaggucccua

SEQ ID NO: 3156781 - RNA, 13 nt, Human
ucucugcaggucc

SEQ ID NO: 3156782 - RNA, 14 nt, Human
ucucugcagguccc

SEQ ID NO: 3156783 - RNA, 21 nt, Human
ucuccuggaagugcuaauuuu

SEQ ID NO: 3156784 - RNA, 14 nt, Human
ucugaaaauugaug

SEQ ID NO: 3156785 - RNA, 22 nt, Human
ucugaaaauugaugggauuugg

SEQ ID NO: 3156786 - RNA, 15 nt, Human
ucugacauaaguauu

SEQ ID NO: 3156787 - RNA, 19 nt, Human
ucuucaucugacuaugaca

SEQ ID NO: 3156788 - RNA, 13 nt, Human
ucuugaaaaaugc

SEQ ID NO: 3156789 - RNA, 22 nt, Human
ucuuaaccagaucauugugaaa

SEQ ID NO: 3156790 - RNA, 16 nt, Human
ucuuaaccagaucauu

SEQ ID NO: 3156791 - RNA, 17 nt, Human
ucuuaaccagaucauug

SEQ ID NO: 3156792 - RNA, 22 nt, Human
ucugucucuggauuauauuaug

SEQ ID NO: 3156793 - RNA, 15 nt, Human
ucugccaggagacag

SEQ ID NO: 3156794 - RNA, 19 nt, Human
ucaggagcccugggaggcu

SEQ ID NO: 3156795 - RNA, 18 nt, Human
ucaggagcccugggaggc

SEQ ID NO: 3156796 - RNA, 20 nt, Human
ucaggagcccugggaggcuc

SEQ ID NO: 3156797 - RNA, 23 nt, Human
ucaggagcccugggaggcucugg

SEQ ID NO: 3156798 - RNA, 20 nt, Human
ucaggaugauacacuaugaa

SEQ ID NO: 3156799 - RNA, 19 nt, Human
ucacugcuaagaauauuug

SEQ ID NO: 3156800 - RNA, 19 nt, Human
ucagaggguguccugcacc

SEQ ID NO: 3156801 - RNA, 21 nt, Human
ucagaguaauccaagcaaaug

SEQ ID NO: 3156802 - RNA, 22 nt, Human
ucagaguaauccaagcaaaugu

SEQ ID NO: 3156803 - RNA, 14 nt, Human
uccagguggcauca

SEQ ID NO: 3156804 - RNA, 19 nt, Human
uccaaaauaauuuuaagaa

SEQ ID NO: 3156805 - RNA, 15 nt, Human
uccaaaauaauuuua

SEQ ID NO: 3156806 - RNA, 17 nt, Human
ucaucugacuaugacau

SEQ ID NO: 3156807 - RNA, 18 nt, Human
ucaucugacuaugacaua

SEQ ID NO: 3156808 - RNA, 12 nt, Human
ucauugugaaau

SEQ ID NO: 3156809 - RNA, 15 nt, Human
ucauugugaaauuau

SEQ ID NO: 3156810 - RNA, 17 nt, Human
ucauugugaaauuauuc

SEQ ID NO: 3156811 - RNA, 18 nt, Human
ucauugugaaauuauuca

SEQ ID NO: 3156812 - RNA, 14 nt, Human
ucauuccagaggaa

SEQ ID NO: 3156813 - RNA, 21 nt, Human
ucaaauauauucagccuggcu

SEQ ID NO: 3156814 - RNA, 22 nt, Human
ucaaauauauucagccuggcuu

SEQ ID NO: 3156815 - RNA, 23 nt, Human
ucaaauauauucagccuggcuuc

SEQ ID NO: 3156816 - RNA, 14 nt, Human
ucaaaaaacuugua

SEQ ID NO: 3156817 - RNA, 15 nt, Human
ucaaaaaacuuguaa

SEQ ID NO: 3156818 - RNA, 17 nt, Human
ucaaauuguaagcaugc

SEQ ID NO: 3156819 - RNA, 20 nt, Human
ucaaauuguaagcaugcaca

SEQ ID NO: 3156820 - RNA, 22 nt, Human
uauuuuuuucugaauuauuuuc

SEQ ID NO: 3156821 - RNA, 17 nt, Human
uauuuuauguugcauag

SEQ ID NO: 3156822 - RNA, 12 nt, Human
uauuaauauauu

SEQ ID NO: 3156823 - RNA, 13 nt, Human
uauguuucaaacu

SEQ ID NO: 3156824 - RNA, 15 nt, Human
uauguuucaaacuuu

SEQ ID NO: 3156825 - RNA, 16 nt, Human
uauguuucaaacuuug

SEQ ID NO: 3156826 - RNA, 16 nt, Human
uauguugcauagaaua

SEQ ID NO: 3156827 - RNA, 12 nt, Human
uauguugcauag

SEQ ID NO: 3156828 - RNA, 24 nt, Human
uauuuauaaaaauaaaaaacacug

SEQ ID NO: 3156829 - RNA, 14 nt, Human
uauuguguugugaa

SEQ ID NO: 3156830 - RNA, 12 nt, Human
uauucccaugag

SEQ ID NO: 3156831 - RNA, 14 nt, Human
uauucuaaauuuua

SEQ ID NO: 3156832 - RNA, 15 nt, Human
uauucuaaauuuuau

SEQ ID NO: 3156833 - RNA, 19 nt, Human
uauucuaaauuuuauaucu

SEQ ID NO: 3156834 - RNA, 20 nt, Human
uauucuaaauuuuauaucuu

SEQ ID NO: 3156835 - RNA, 19 nt, Human
uauucuagcuaauguaaua

SEQ ID NO: 3156836 - RNA, 15 nt, Human
auguguaaaauguga

SEQ ID NO: 3156837 - RNA, 16 nt, Human
augugaacagcggcug

SEQ ID NO: 3156838 - RNA, 17 nt, Human
augugaaaucauucauu

SEQ ID NO: 3156839 - RNA, 18 nt, Human
augugaaaucauucauuu

SEQ ID NO: 3156840 - RNA, 14 nt, Human
augugaaaucauuc

SEQ ID NO: 3156841 - RNA, 14 nt, Human
augugaaacauguu

SEQ ID NO: 3156842 - RNA, 13 nt, Human
augaugaaaauau

SEQ ID NO: 3156843 - RNA, 15 nt, Human
augaugaaaauauuu

SEQ ID NO: 3156844 - RNA, 19 nt, Human
augaugaaaauauuuaaag

SEQ ID NO: 3156845 - RNA, 16 nt, Human
augaugggucaguugu

SEQ ID NO: 3156846 - RNA, 23 nt, Human
augcacaaauucugucucuggau

SEQ ID NO: 3156847 - RNA, 15 nt, Human
augcacaaauucugu

SEQ ID NO: 3156848 - RNA, 22 nt, Human
augcacaaauucugucucugga

SEQ ID NO: 3156849 - RNA, 17 nt, Human
auggauaggcacaggaa

SEQ ID NO: 3156850 - RNA, 18 nt, Human
auggauaggcacaggaaa

SEQ ID NO: 3156851 - RNA, 13 nt, Human
augagggucuugg

SEQ ID NO: 3156852 - RNA, 12 nt, Human
augaaaauauuu

SEQ ID NO: 3156853 - RNA, 13 nt, Human
augaaaauauuua

SEQ ID NO: 3156854 - RNA, 14 nt, Human
augaaaauauuuaa

SEQ ID NO: 3156855 - RNA, 16 nt, Human
augaaaauauuuaaag

SEQ ID NO: 3156856 - RNA, 15 nt, Human
aucuaguaugaaauu

SEQ ID NO: 3156857 - RNA, 16 nt, Human
aucuaguaugaaauua

SEQ ID NO: 3156858 - RNA, 17 nt, Human
aucuaguaugaaauuau

SEQ ID NO: 3156859 - RNA, 18 nt, Human
aucuaguaugaaauuaua

SEQ ID NO: 3156860 - RNA, 19 nt, Human
aucuaguaugaaauuauau

SEQ ID NO: 3156861 - RNA, 14 nt, Human
aucuaguaugaaau

SEQ ID NO: 3156862 - RNA, 18 nt, Human
aucugggggccucuucug

SEQ ID NO: 3156863 - RNA, 22 nt, Human
aucucugcaggaaauggcugug

SEQ ID NO: 3156864 - RNA, 22 nt, Human
aucaaauauauucagccuggcu

SEQ ID NO: 3156865 - RNA, 21 nt, Human
auauuucccugaaggaaccaa

SEQ ID NO: 3156866 - RNA, 14 nt, Human
aucaaauauauuca

SEQ ID NO: 3156867 - RNA, 12 nt, Human
aucaugugaaau

SEQ ID NO: 3156868 - RNA, 19 nt, Human
auccucaguuuuugugaaa

SEQ ID NO: 3156869 - RNA, 20 nt, Human
auccagagucccugccugga

SEQ ID NO: 3156870 - RNA, 21 nt, Human
auccagagucccugccuggac

SEQ ID NO: 3156871 - RNA, 19 nt, Human
auccagagucccugccugg

SEQ ID NO: 3156872 - RNA, 13 nt, Human
auaauggucagag

SEQ ID NO: 3156873 - RNA, 17 nt, Human
auacccagaaaguuauu

SEQ ID NO: 3156874 - RNA, 14 nt, Human
auaacaaugaaagu

SEQ ID NO: 3156875 - RNA, 22 nt, Human
auaaaaagccugcaauuucaua

SEQ ID NO: 3156876 - RNA, 20 nt, Human
auaaaaagccugcaauuuca

SEQ ID NO: 3156877 - RNA, 18 nt, Human
aguuuggcaaacucucca

SEQ ID NO: 3156878 - RNA, 16 nt, Human
aguuuggcaaacucuc

SEQ ID NO: 3156879 - RNA, 19 nt, Human
auauuucccugaaggaacc

SEQ ID NO: 3156880 - RNA, 14 nt, Human
auauuauuuuaugu

SEQ ID NO: 3156881 - RNA, 15 nt, Human
auauuauuuuauguu

SEQ ID NO: 3156882 - RNA, 22 nt, Human
auauuauuuuauguugcauaga

SEQ ID NO: 3156883 - RNA, 17 nt, Human
auauuauguguuuccau

SEQ ID NO: 3156884 - RNA, 13 nt, Human
auauuauguguuu

SEQ ID NO: 3156885 - RNA, 17 nt, Human
auaugcagauuuugccc

SEQ ID NO: 3156886 - RNA, 13 nt, Human
auaucaguuugcu

SEQ ID NO: 3156887 - RNA, 12 nt, Human
agugucuggcug

SEQ ID NO: 3156888 - RNA, 13 nt, Human
agugucuggcugc

SEQ ID NO: 3156889 - RNA, 14 nt, Human
agugucuggcugca

SEQ ID NO: 3156890 - RNA, 18 nt, Human
agugcuaauuuugaaaaa

SEQ ID NO: 3156891 - RNA, 20 nt, Human
agugcuaauuuugaaaaacu

SEQ ID NO: 3156892 - RNA, 15 nt, Human
agugcuaauuuugaa

SEQ ID NO: 3156893 - RNA, 13 nt, Human
aguucagcuuggg

SEQ ID NO: 3156894 - RNA, 14 nt, Human
aguucagcuugggg

SEQ ID NO: 3156895 - RNA, 22 nt, Human
aguaaaugcuagguuaauucca

SEQ ID NO: 3156896 - RNA, 11 nt, Human
aguaaaugcua

SEQ ID NO: 3156897 - RNA, 23 nt, Human
aguaaaugcuagguuaauuccaa

SEQ ID NO: 3156898 - RNA, 19 nt, Human
aguaacaaugaagauaaaa

SEQ ID NO: 3156899 - RNA, 16 nt, Human
aguauuuuugacagaa

SEQ ID NO: 3156900 - RNA, 17 nt, Human
aguauuuuugacagaau

SEQ ID NO: 3156901 - RNA, 18 nt, Human
aguauuuuugacagaaua

SEQ ID NO: 3156902 - RNA, 13 nt, Human
aguauuuuugaca

SEQ ID NO: 3156903 - RNA, 23 nt, Human
agucugagagaggccauucuuuc

SEQ ID NO: 3156904 - RNA, 16 nt, Human
agucugagagaggcca

SEQ ID NO: 3156905 - RNA, 20 nt, Human
agugaauucuugaaggaaaa

SEQ ID NO: 3156906 - RNA, 12 nt, Human
aggggcaggagg

SEQ ID NO: 3156907 - RNA, 13 nt, Human
aggggcaggagga

SEQ ID NO: 3156908 - RNA, 18 nt, Human
aggggcaggaggaagggg

SEQ ID NO: 3156909 - RNA, 14 nt, Human
agggaugguguuca

SEQ ID NO: 3156910 - RNA, 16 nt, Human
agggaugguguucaaa

SEQ ID NO: 3156911 - RNA, 23 nt, Human
aggucccuaauaaagcugugugg

SEQ ID NO: 3156912 - RNA, 17 nt, Human
agggacugagaaauuua

SEQ ID NO: 3156913 - RNA, 16 nt, Human
aggaacugcugggcuu

SEQ ID NO: 3156914 - RNA, 16 nt, Human
aggaaccgaggcaggg

SEQ ID NO: 3156915 - RNA, 22 nt, Human
aggaacugcugggcuuggcagc

SEQ ID NO: 3156916 - RNA, 13 nt, Human
aggaaccaaagcg

SEQ ID NO: 3156917 - RNA, 15 nt, Human
aggaaccaaagcgaa

SEQ ID NO: 3156918 - RNA, 16 nt, Human
aggaaccauaaucaau

SEQ ID NO: 3156919 - RNA, 15 nt, Human
agcuuuuaugugaaa

SEQ ID NO: 3156920 - RNA, 18 nt, Human
agccuggcuucaaauugu

SEQ ID NO: 3156921 - RNA, 17 nt, Human
agccuggcuucaaauug

SEQ ID NO: 3156922 - RNA, 19 nt, Human
agcuaauucuuugaccugu

SEQ ID NO: 3156923 - RNA, 23 nt, Human
agcuaauguaauaacugugaagu

SEQ ID NO: 3156924 - RNA, 15 nt, Human
agcugcgggcugggu

SEQ ID NO: 3156925 - RNA, 16 nt, Human
agcuccuuaaggcucu

SEQ ID NO: 3156926 - RNA, 17 nt, Human
agcuccuuaaggcucuu

SEQ ID NO: 3156927 - RNA, 15 nt, Human
agccaagaggcugca

SEQ ID NO: 3156928 - RNA, 23 nt, Human
agcaaagcugaugacaacuuccc

SEQ ID NO: 3156929 - RNA, 21 nt, Human
agcaaagcugaugacaacuuc

SEQ ID NO: 3156930 - RNA, 14 nt, Human
agaugguucuagca

SEQ ID NO: 3156931 - RNA, 23 nt, Human
agaugaugaaaauauuuaaaggc

SEQ ID NO: 3156932 - RNA, 18 nt, Human
agaugaugaaaauauuua

SEQ ID NO: 3156933 - RNA, 20 nt, Human
agaaugaaauugcugaaaga

SEQ ID NO: 3156934 - RNA, 22 nt, Human
agacagccaacuauggccugug

SEQ ID NO: 3156935 - RNA, 23 nt, Human
agagaggccauucuuucccaaca

SEQ ID NO: 3156936 - RNA, 15 nt, Human
agagccugagaguga

SEQ ID NO: 3156937 - RNA, 10 nt, Human
agagggcugc

SEQ ID NO: 3156938 - RNA, 15 nt, Human
aaagccaagaggcug

SEQ ID NO: 3156939 - RNA, 20 nt, Human
aaauaaaaauauuguguugu

SEQ ID NO: 3156940 - RNA, 19 nt, Human
aaauaaaccucaaaauguc

SEQ ID NO: 3156941 - RNA, 22 nt, Human
aaaccucaaaaugucuaagaua

SEQ ID NO: 3156942 - RNA, 17 nt, Human
aaaccucaaaaugucua

SEQ ID NO: 3156943 - RNA, 16 nt, Human
aaagauaaauauuaua

SEQ ID NO: 3156944 - RNA, 14 nt, Human
aaagauaaauauua

SEQ ID NO: 3156945 - RNA, 15 nt, Human
aaagauaaauauuau

SEQ ID NO: 3156946 - RNA, 13 nt, Human
aaagauaaauauu

SEQ ID NO: 3156947 - RNA, 13 nt, Human
aaagaggugugca

SEQ ID NO: 3156948 - RNA, 20 nt, Human
aaaauuauuuuguucauaca

SEQ ID NO: 3156949 - RNA, 16 nt, Human
aaaauuauuuuguuca

SEQ ID NO: 3156950 - RNA, 18 nt, Human
aaaauuauuuuguucaua

SEQ ID NO: 3156951 - RNA, 22 nt, Human
aaaauuaacaugaauauuuagu

SEQ ID NO: 3156952 - RNA, 12 nt, Human
aaaauuaagaaa

SEQ ID NO: 3156953 - RNA, 13 nt, Human
aaaauuaagaaag

SEQ ID NO: 3156954 - RNA, 20 nt, Human
aaaauuaagaaaggauaaag

SEQ ID NO: 3156955 - RNA, 15 nt, Human
aaaauaaaaaacacu

SEQ ID NO: 3156956 - RNA, 21 nt, Human
aaaauccacuuuaucuugaau

SEQ ID NO: 3156957 - RNA, 20 nt, Human
aaaugcuagguuaauuccaa

SEQ ID NO: 3156958 - RNA, 17 nt, Human
aaaucugaccaaaacaa

SEQ ID NO: 3156959 - RNA, 18 nt, Human
aaauguuuuuuuuuaaag

SEQ ID NO: 3156960 - RNA, 21 nt, Human
aaauguuuuuuuuuaaagacu

SEQ ID NO: 3156961 - RNA, 22 nt, Human
aaauguuuuuuuuuaaagacuu

SEQ ID NO: 3156962 - RNA, 14 nt, Human
aaauugauguguuu

SEQ ID NO: 3156963 - RNA, 18 nt, Human
aaauugaugggauuuggu

SEQ ID NO: 3156964 - RNA, 17 nt, Human
aacacuaacaugauuug

SEQ ID NO: 3156965 - RNA, 13 nt, Human
aacugagcuugga

SEQ ID NO: 3156966 - RNA, 17 nt, Human
aacugagcuuggaagcu

SEQ ID NO: 3156967 - RNA, 21 nt, Human
aacugagcuuggaagcuucug

SEQ ID NO: 3156968 - RNA, 15 nt, Human
aacguauaaaagccu

SEQ ID NO: 3156969 - RNA, 20 nt, Human
aacagcggcuggacuuggag

SEQ ID NO: 3156970 - RNA, 15 nt, Human
aacaucccuccuggg

SEQ ID NO: 3156971 - RNA, 17 nt, Human
aauaaaccucaaaaugu

SEQ ID NO: 3156972 - RNA, 12 nt, Human
aauaaaauuuuu

SEQ ID NO: 3156973 - RNA, 14 nt, Human
aauaauaaauauuu

SEQ ID NO: 3156974 - RNA, 20 nt, Human
aauaaaccucaaaaugucua

SEQ ID NO: 3156975 - RNA, 11 nt, Human
aauaaagcugu

SEQ ID NO: 3156976 - RNA, 19 nt, Human
aauaaagcuguguggcagu

SEQ ID NO: 3156977 - RNA, 15 nt, Human
aauccaaugaaauga

SEQ ID NO: 3156978 - RNA, 12 nt, Human
aaggaauuuuau

SEQ ID NO: 3156979 - RNA, 13 nt, Human
aagggagggggag

SEQ ID NO: 3156980 - RNA, 15 nt, Human
aagggacugagaaau

SEQ ID NO: 3156981 - RNA, 17 nt, Human
aagggacugagaaauuu

SEQ ID NO: 3156982 - RNA, 13 nt, Human
aagauuuucagaa

SEQ ID NO: 3156983 - RNA, 23 nt, Human
aagacagugaaagaaaauaacaa

SEQ ID NO: 3156984 - RNA, 21 nt, Human
aagacauucuuccaaaaagau

SEQ ID NO: 3156985 - RNA, 15 nt, Human
aagacuuuuaugaua

SEQ ID NO: 3156986 - RNA, 18 nt, Human
aagagaagggcagggcug

SEQ ID NO: 3156987 - RNA, 15 nt, Human
acuuuauuuuguguu

SEQ ID NO: 3156988 - RNA, 14 nt, Human
acugauuacugccu

SEQ ID NO: 3156989 - RNA, 22 nt, Human
acuaggugcccagaaugaggcu

SEQ ID NO: 3156990 - RNA, 19 nt, Human
accggggccugggcaggag

SEQ ID NO: 3156991 - RNA, 12 nt, Human
acaaagaaauua

SEQ ID NO: 3156992 - RNA, 14 nt, Human
acaaagaaauuaug

SEQ ID NO: 3156993 - RNA, 16 nt, Human
acaaagaaauuaugug

SEQ ID NO: 3156994 - RNA, 18 nt, Human
aauuuucaucuaggauuu

SEQ ID NO: 3156995 - RNA, 11 nt, Human
aauugugaugu

SEQ ID NO: 3156996 - RNA, 15 nt, Human
aauugugaugugucc

SEQ ID NO: 3156997 - RNA, 14 nt, Human
aauugugauguguc

SEQ ID NO: 3156998 - RNA, 21 nt, Human
aauuggguggggggcuucaua

SEQ ID NO: 3156999 - RNA, 22 nt, Human
aauuggguggggggcuucauac

SEQ ID NO: 3157000 - RNA, 23 nt, Human
aauuggguggggggcuucauaca

SEQ ID NO: 3157001 - RNA, 20 nt, Human
acacugggagaaaugaaaaa

SEQ ID NO: 3157002 - RNA, 23 nt, Human
acagaggacaguauuugugggga

SEQ ID NO: 3157003 - RNA, 20 nt, Human
acacguaaugaaacuuggau

SEQ ID NO: 3157004 - RNA, 19 nt, Human
acauaauuaaauuuugagu

SEQ ID NO: 3157005 - RNA, 15 nt, Human
acauaaguaauucaa

SEQ ID NO: 3157006 - RNA, 16 nt, Human
acauuuccuaaauaua

SEQ ID NO: 3157007 - RNA, 17 nt, Human
acauuuccuaaauauau

SEQ ID NO: 3157008 - RNA, 14 nt, Human
accaucucuuuacc

SEQ ID NO: 3157009 - RNA, 14 nt, Human
cuuuuaugugaaac

SEQ ID NO: 3157010 - RNA, 15 nt, Human
cuuuuggcauuuuac

SEQ ID NO: 3157011 - RNA, 16 nt, Human
cuugacaaagucaagc

SEQ ID NO: 3157012 - RNA, 19 nt, Human
cuugacaaagucaagccac

SEQ ID NO: 3157013 - RNA, 12 nt, Human
cuugaugccugg

SEQ ID NO: 3157014 - RNA, 18 nt, Human
cuuauuggcagcucuacu

SEQ ID NO: 3157015 - RNA, 15 nt, Human
cuucacuguaaaaua

SEQ ID NO: 3157016 - RNA, 9 nt, Human
cuucauaca

SEQ ID NO: 3157017 - RNA, 10 nt, Human
cuucauacac

SEQ ID NO: 3157018 - RNA, 21 nt, Human
cuucaucugacuaugacauaa

SEQ ID NO: 3157019 - RNA, 19 nt, Human
cuucaucugacuaugacau

SEQ ID NO: 3157020 - RNA, 12 nt, Human
cuucauacaggg

SEQ ID NO: 3157021 - RNA, 13 nt, Human
cuucauacaggga

SEQ ID NO: 3157022 - RNA, 22 nt, Human
cuucauacagggaugguguuca

SEQ ID NO: 3157023 - RNA, 20 nt, Human
cuucaugcauagguuuagca

SEQ ID NO: 3157024 - RNA, 22 nt, Human
cugccaucauguuuacagagga

SEQ ID NO: 3157025 - RNA, 17 nt, Human
cugccaucauguuuaca

SEQ ID NO: 3157026 - RNA, 23 nt, Human
cugccaucauguuuacagaggac

SEQ ID NO: 3157027 - RNA, 17 nt, Human
cugcuuuuuauggccug

SEQ ID NO: 3157028 - RNA, 18 nt, Human
cugcuuuuuauggccugu

SEQ ID NO: 3157029 - RNA, 13 nt, Human
cuggacugugugc

SEQ ID NO: 3157030 - RNA, 22 nt, Human
cuggggaugucucucaugacca

SEQ ID NO: 3157031 - RNA, 17 nt, Human
cuggggaugucucucau

SEQ ID NO: 3157032 - RNA, 18 nt, Human
cuggggauugggccccug

SEQ ID NO: 3157033 - RNA, 22 nt, Human
cuggggauugggccccugccag

SEQ ID NO: 3157034 - RNA, 16 nt, Human
cuggggauugggcccc

SEQ ID NO: 3157035 - RNA, 18 nt, Human
cuggggccaggcuggguc

SEQ ID NO: 3157036 - RNA, 16 nt, Human
cuggcuccaggccagg

SEQ ID NO: 3157037 - RNA, 17 nt, Human
cuggagacuaaccccac

SEQ ID NO: 3157038 - RNA, 16 nt, Human
cuggacugugugcuca

SEQ ID NO: 3157039 - RNA, 21 nt, Human
cuguacuugcucuugaugccu

SEQ ID NO: 3157040 - RNA, 22 nt, Human
cuguacuugcucuugaugccug

SEQ ID NO: 3157041 - RNA, 23 nt, Human
cuguacuugcucuugaugccugg

SEQ ID NO: 3157042 - RNA, 18 nt, Human
gauuacugccuauuuuaa

SEQ ID NO: 3157043 - RNA, 12 nt, Human
gaucccaacacu

SEQ ID NO: 3157044 - RNA, 16 nt, Human
gaucccaacacugcca

SEQ ID NO: 3157045 - RNA, 23 nt, Human
gaucucagugguuaagauuccua

SEQ ID NO: 3157046 - RNA, 13 nt, Human
gaguuggcuggga

SEQ ID NO: 3157047 - RNA, 19 nt, Human
gaguggacuguucccugag

SEQ ID NO: 3157048 - RNA, 16 nt, Human
gaguuuaaauuguaau

SEQ ID NO: 3157049 - RNA, 14 nt, Human
gaguuuaggguggg

SEQ ID NO: 3157050 - RNA, 15 nt, Human
gaguuuagggugggg

SEQ ID NO: 3157051 - RNA, 13 nt, Human
gaguccaucagcc

SEQ ID NO: 3157052 - RNA, 14 nt, Human
gaguccaucagccu

SEQ ID NO: 3157053 - RNA, 15 nt, Human
gaguccaucagccuc

SEQ ID NO: 3157054 - RNA, 16 nt, Human
gaguccaucagccucc

SEQ ID NO: 3157055 - RNA, 18 nt, Human
gagugaggaugucugggc

SEQ ID NO: 3157056 - RNA, 16 nt, Human
gauacuugaaaauuaa

SEQ ID NO: 3157057 - RNA, 13 nt, Human
gauucugagagcu

SEQ ID NO: 3157058 - RNA, 20 nt, Human
gcaauaaccucaaagugacu

SEQ ID NO: 3157059 - RNA, 20 nt, Human
gcaccggggccugggcagga

SEQ ID NO: 3157060 - RNA, 19 nt, Human
gcaccggggccugggcagg

SEQ ID NO: 3157061 - RNA, 15 nt, Human
gcagaaaucuagaag

SEQ ID NO: 3157062 - RNA, 14 nt, Human
gcagaaaucuagaa

SEQ ID NO: 3157063 - RNA, 21 nt, Human
gcagagcagugggccuggcca

SEQ ID NO: 3157064 - RNA, 17 nt, Human
gcacugacagauuucca

SEQ ID NO: 3157065 - RNA, 12 nt, Human
gcacugacagau

SEQ ID NO: 3157066 - RNA, 22 nt, Human
gcauaacguauaaaagccuguu

SEQ ID NO: 3157067 - RNA, 21 nt, Human
gcaguuugccuggugcagugg

SEQ ID NO: 3157068 - RNA, 19 nt, Human
gagcuggggaugucucuca

SEQ ID NO: 3157069 - RNA, 14 nt, Human
gagauguagccccu

SEQ ID NO: 3157070 - RNA, 20 nt, Human
gagaugaugaaaauauuuaa

SEQ ID NO: 3157071 - RNA, 19 nt, Human
gagaugaugaaaauauuua

SEQ ID NO: 3157072 - RNA, 22 nt, Human
gagacguuuuuggaagaguagu

SEQ ID NO: 3157073 - RNA, 23 nt, Human
gagacuaaccccaccacacccuc

SEQ ID NO: 3157074 - RNA, 18 nt, Human
gacuuuugaaaagaggug

SEQ ID NO: 3157075 - RNA, 13 nt, Human
gacuaugacauaa

SEQ ID NO: 3157076 - RNA, 14 nt, Human
gacuauucaguuuu

SEQ ID NO: 3157077 - RNA, 16 nt, Human
gacagaauauguuuca

SEQ ID NO: 3157078 - RNA, 15 nt, Human
gacaguauuuguggg

SEQ ID NO: 3157079 - RNA, 16 nt, Human
gacagguuagcugcuc

SEQ ID NO: 3157080 - RNA, 20 nt, Human
gaauuugugaagguggaaau

SEQ ID NO: 3157081 - RNA, 12 nt, Human
gaauuuuaaaag

SEQ ID NO: 3157082 - RNA, 15 nt, Human
gaauuuuaaaagaug

SEQ ID NO: 3157083 - RNA, 21 nt, Human
gaauuuuaaaagaugcaaugu

SEQ ID NO: 3157084 - RNA, 23 nt, Human
gaauuuuaaaagaugcaauguag

SEQ ID NO: 3157085 - RNA, 18 nt, Human
gaagugugggucugugug

SEQ ID NO: 3157086 - RNA, 17 nt, Human
gaagugugggucugugu

SEQ ID NO: 3157087 - RNA, 19 nt, Human
gaagugugggucugugugu

SEQ ID NO: 3157088 - RNA, 19 nt, Human
gaagggcagggcugaggcc

SEQ ID NO: 3157089 - RNA, 15 nt, Human
gaaggcuauggggau

SEQ ID NO: 3157090 - RNA, 17 nt, Human
ggcccugugccuuggug

SEQ ID NO: 3157091 - RNA, 15 nt, Human
ggcacuggggcaggg

SEQ ID NO: 3157092 - RNA, 15 nt, Human
ggcauauuuuucaca

SEQ ID NO: 3157093 - RNA, 17 nt, Human
ggcauauuuuucacaua

SEQ ID NO: 3157094 - RNA, 22 nt, Human
ggcauccagagucccugccugg

SEQ ID NO: 3157095 - RNA, 18 nt, Human
ggcauuuuacuguacaga

SEQ ID NO: 3157096 - RNA, 19 nt, Human
ggccaguggcuggaucugu

SEQ ID NO: 3157097 - RNA, 20 nt, Human
ggccuguggaucaaauccag

SEQ ID NO: 3157098 - RNA, 22 nt, Human
ggcgaagcguuguccucagccc

SEQ ID NO: 3157099 - RNA, 16 nt, Human
ggccuugaguccccca

SEQ ID NO: 3157100 - RNA, 21 nt, Human
ggagguagcuuugagguggaa

SEQ ID NO: 3157101 - RNA, 22 nt, Human
ggagcccacuguacuugcucuu

SEQ ID NO: 3157102 - RNA, 13 nt, Human
ggcacagccuggc

SEQ ID NO: 3157103 - RNA, 12 nt, Human
ggcacagccugg

SEQ ID NO: 3157104 - RNA, 23 nt, Human
aaaguuauugauaaguucauaca

SEQ ID NO: 3157105 - RNA, 16 nt, Human
aaaguuuguugaaaca

SEQ ID NO: 3157106 - RNA, 17 nt, Human
guaaauuuaugugaugg

SEQ ID NO: 3157107 - RNA, 16 nt, Human
guaaauuuaugugaug

SEQ ID NO: 3157108 - RNA, 17 nt, Human
guaacaaugaagauaaa

SEQ ID NO: 3157109 - RNA, 16 nt, Human
guaaagacuguagaag

SEQ ID NO: 3157110 - RNA, 22 nt, Human
guaaaaugugaagugaaugaaa

SEQ ID NO: 3157111 - RNA, 20 nt, Human
guaaaaugugaagugaauga

SEQ ID NO: 3157112 - RNA, 19 nt, Human
guaaaaugugaagugaaug

SEQ ID NO: 3157113 - RNA, 12 nt, Human
guaaaaugugaa

SEQ ID NO: 3157114 - RNA, 17 nt, Human
gguggggggggugcugg

SEQ ID NO: 3157115 - RNA, 21 nt, Human
gguggggagagacgggcccug

SEQ ID NO: 3157116 - RNA, 16 nt, Human
aaagccuguuuaagag

SEQ ID NO: 3157117 - RNA, 18 nt, Human
aaagccuguuuaagagac

SEQ ID NO: 3157118 - RNA, 19 nt, Human
aaagcaggcagaacucauc

SEQ ID NO: 3157119 - RNA, 17 nt, Human
aaagcaggcagaacuca

SEQ ID NO: 3157120 - RNA, 21 nt, Human
ggugcuucuaguucugccagg

SEQ ID NO: 3157121 - RNA, 21 nt, Human
ggucuguguguguguaugugg

SEQ ID NO: 3157122 - RNA, 20 nt, Human
ggucuguguguguguaugug

SEQ ID NO: 3157123 - RNA, 20 nt, Human
ggugcugggccccugccucu

SEQ ID NO: 3157124 - RNA, 19 nt, Human
ggugcugggccccugccuc

SEQ ID NO: 3157125 - RNA, 13 nt, Human
aaagauuuucaga

SEQ ID NO: 3157126 - RNA, 20 nt, Human
ggucgcccuggacugugugc

SEQ ID NO: 3157127 - RNA, 17 nt, Human
ggucuguguguguguau

SEQ ID NO: 3157128 - RNA, 11 nt, Human
ggucugugugu

SEQ ID NO: 3157129 - RNA, 17 nt, Human
gguagcuuugaggugga

SEQ ID NO: 3157130 - RNA, 23 nt, Human
ggguguccugcaccggggccugg

SEQ ID NO: 3157131 - RNA, 15 nt, Human
ggguggggggggugc

SEQ ID NO: 3157132 - RNA, 18 nt, Human
ggguggggggggugcugg

SEQ ID NO: 3157133 - RNA, 13 nt, Human
gggccaggcuggg

SEQ ID NO: 3157134 - RNA, 21 nt, Human
gggccaggcugggucgcccug

SEQ ID NO: 3157135 - RNA, 14 nt, Human
gggccaggcugggu

SEQ ID NO: 3157136 - RNA, 15 nt, Human
gggccaggcuggguc

SEQ ID NO: 3157137 - RNA, 21 nt, Human
gggccagucccugaggcaggu

SEQ ID NO: 3157138 - RNA, 18 nt, Human
gggccagucccugaggca

SEQ ID NO: 3157139 - RNA, 22 nt, Human
gggcccuggugguggcucggga

SEQ ID NO: 3157140 - RNA, 17 nt, Human
aaacaccggguuccagc

SEQ ID NO: 3157141 - RNA, 20 nt, Human
aaacaagcacuaaacaaaga

SEQ ID NO: 3157142 - RNA, 12 nt, Human
aaaaugugaagu

SEQ ID NO: 3157143 - RNA, 18 nt, Human
gggcucagagugggguag

SEQ ID NO: 3157144 - RNA, 15 nt, Human
aaaacccagauaaag

SEQ ID NO: 3157145 - RNA, 15 nt, Human
aaaaauauauuuaau

SEQ ID NO: 3157146 - RNA, 13 nt, Human
aaaaauauauuua

SEQ ID NO: 3157147 - RNA, 19 nt, Human
aaaaauauauuuaaugaua

SEQ ID NO: 3157148 - RNA, 15 nt, Human
gggauugggccccug

SEQ ID NO: 3157149 - RNA, 14 nt, Human
aaaagggaggggga

SEQ ID NO: 3157150 - RNA, 19 nt, Human
aaaagggacugagaaauuu

SEQ ID NO: 3157151 - RNA, 19 nt, Human
gggagaaugucaguaugug

SEQ ID NO: 3157152 - RNA, 22 nt, Human
gggagaaugucaguauguggaa

SEQ ID NO: 3157153 - RNA, 15 nt, Human
aaaagaugcaaugua

SEQ ID NO: 3157154 - RNA, 14 nt, Human
gggaugucucucau

SEQ ID NO: 3157155 - RNA, 16 nt, Human
gggaugguguucaaaa

SEQ ID NO: 3157156 - RNA, 22 nt, Human
gggaggcucuggagcccacugu

SEQ ID NO: 3157157 - RNA, 15 nt, Human
ggaacugcugggcuu

SEQ ID NO: 3157158 - RNA, 14 nt, Human
ggaacugcugggcu

SEQ ID NO: 3157159 - RNA, 15 nt, Human
gcuuuuuuaucaugu

SEQ ID NO: 3157160 - RNA, 18 nt, Human
gcuuuuuuaucaugugaa

SEQ ID NO: 3157161 - RNA, 20 nt, Human
gcuuuuuuaucaugugaaau

SEQ ID NO: 3157162 - RNA, 19 nt, Human
gcuugaaacccguggcgcu

SEQ ID NO: 3157163 - RNA, 19 nt, Human
gcuuuccucaucaggccau

SEQ ID NO: 3157164 - RNA, 19 nt, Human
gcuuugagguggaagaggg

SEQ ID NO: 3157165 - RNA, 22 nt, Human
gcuuugagguggaagagggcug

SEQ ID NO: 3157166 - RNA, 16 nt, Human
gcuucaaauuguaagc

SEQ ID NO: 3157167 - RNA, 20 nt, Human
gcuguagacauuugcuauga

SEQ ID NO: 3157168 - RNA, 13 nt, Human
gcuggaucuguga

SEQ ID NO: 3157169 - RNA, 21 nt, Human
gcugcagagcagugggccugg

SEQ ID NO: 3157170 - RNA, 20 nt, Human
gcugcagagcagugggccug

SEQ ID NO: 3157171 - RNA, 13 nt, Human
gcugcuccccacg

SEQ ID NO: 3157172 - RNA, 22 nt, Human
gcugcuccccacgucagcuggg

SEQ ID NO: 3157173 - RNA, 15 nt, Human
gcucuggagcccacu

SEQ ID NO: 3157174 - RNA, 16 nt, Human
gcucuggagcccacug

SEQ ID NO: 3157175 - RNA, 17 nt, Human
gcucugugcccacccuc

SEQ ID NO: 3157176 - RNA, 14 nt, Human
gcugaggccucuca

SEQ ID NO: 3157177 - RNA, 18 nt, Human
gcuccucgagaucccaac

SEQ ID NO: 3157178 - RNA, 15 nt, Human
gccccugccucucug

SEQ ID NO: 3157179 - RNA, 16 nt, Human
gccccugccucucugc

SEQ ID NO: 3157180 - RNA, 17 nt, Human
gccccugccucucugca

SEQ ID NO: 3157181 - RNA, 18 nt, Human
gccccugccucucugcag

SEQ ID NO: 3157182 - RNA, 11 nt, Human
gcccuaucugu

SEQ ID NO: 3157183 - RNA, 14 nt, Human
gccaggauggaaug

SEQ ID NO: 3157184 - RNA, 23 nt, Human
gccaguggcuggaucugugaggg

SEQ ID NO: 3157185 - RNA, 14 nt, Human
gccaguggcuggau

SEQ ID NO: 3157186 - RNA, 17 nt, Human
gcggcugggaggagggc

SEQ ID NO: 3157187 - RNA, 18 nt, Human
gcggcugggaggagggca

SEQ ID NO: 3157188 - RNA, 19 nt, Human
gcggcugggaggagggcag

SEQ ID NO: 3157189 - RNA, 22 nt, Human
gcggcugggaggagggcaggca

SEQ ID NO: 3157190 - RNA, 13 nt, Human
gcggcugggagga

SEQ ID NO: 3157191 - RNA, 14 nt, Human
gcggcugggaggag

SEQ ID NO: 3157192 - RNA, 18 nt, Human
gcuacuguaaggcaauca

SEQ ID NO: 3157193 - RNA, 19 nt, Human
gcuacuguaaggcaaucau

SEQ ID NO: 3157194 - RNA, 18 nt, Human
gcuaauuuugaaaaacug

SEQ ID NO: 3157195 - RNA, 19 nt, Human
ccaaaaagauuuucagaaa

SEQ ID NO: 3157196 - RNA, 12 nt, Human
ccaaaacaaaca

SEQ ID NO: 3157197 - RNA, 18 nt, Human
ccaaaacaaacaaacaga

SEQ ID NO: 3157198 - RNA, 22 nt, Human
ccaaaaaauucuacaacacaca

SEQ ID NO: 3157199 - RNA, 20 nt, Human
ccaaaaaauucuacaacaca

SEQ ID NO: 3157200 - RNA, 22 nt, Human
cauuggcucuugaacugagcuu

SEQ ID NO: 3157201 - RNA, 20 nt, Human
cauuggauucugagagcugu

SEQ ID NO: 3157202 - RNA, 22 nt, Human
ccaaaugagggucuugguucca

SEQ ID NO: 3157203 - RNA, 19 nt, Human
ccaaugugaacagcggcug

SEQ ID NO: 3157204 - RNA, 11 nt, Human
ccaccagaagc

SEQ ID NO: 3157205 - RNA, 12 nt, Human
ccaccagaagcc

SEQ ID NO: 3157206 - RNA, 13 nt, Human
ccaccagaagccc

SEQ ID NO: 3157207 - RNA, 14 nt, Human
ccaccagaagccca

SEQ ID NO: 3157208 - RNA, 15 nt, Human
ccaccagaagcccag

SEQ ID NO: 3157209 - RNA, 16 nt, Human
ccaccagaagcccaga

SEQ ID NO: 3157210 - RNA, 18 nt, Human
ccaccagaagcccagaau

SEQ ID NO: 3157211 - RNA, 17 nt, Human
caguuuggcaaacucuc

SEQ ID NO: 3157212 - RNA, 14 nt, Human
caugaauuugugaa

SEQ ID NO: 3157213 - RNA, 15 nt, Human
caguauuugugggga

SEQ ID NO: 3157214 - RNA, 16 nt, Human
cagagcugcgggcugg

SEQ ID NO: 3157215 - RNA, 23 nt, Human
cagaucauuaucagccugugcca

SEQ ID NO: 3157216 - RNA, 22 nt, Human
cagaucauugugaaauuauuca

SEQ ID NO: 3157217 - RNA, 16 nt, Human
cagaucauugugaaau

SEQ ID NO: 3157218 - RNA, 24 nt, Human
cagccucuccacucaugugacucu

SEQ ID NO: 3157219 - RNA, 11 nt, Human
cagccugccac

SEQ ID NO: 3157220 - RNA, 12 nt, Human
cagccugccacu

SEQ ID NO: 3157221 - RNA, 16 nt, Human
cagccugccacucagg

SEQ ID NO: 3157222 - RNA, 17 nt, Human
cagccugccacucaggc

SEQ ID NO: 3157223 - RNA, 17 nt, Human
cagcggcuggaauuggg

SEQ ID NO: 3157224 - RNA, 16 nt, Human
cagcggcuggacuugg

SEQ ID NO: 3157225 - RNA, 18 nt, Human
cagcggcuggacuuggag

SEQ ID NO: 3157226 - RNA, 24 nt, Human
cagccccgcguggaacucgugucu

SEQ ID NO: 3157227 - RNA, 21 nt, Human
caaagucucuggaauuugaaa

SEQ ID NO: 3157228 - RNA, 22 nt, Human
caaagguaaaucagacuaugaa

SEQ ID NO: 3157229 - RNA, 17 nt, Human
caacaaucccaaggccc

SEQ ID NO: 3157230 - RNA, 14 nt, Human
caacacuaacauga

SEQ ID NO: 3157231 - RNA, 14 nt, Human
caaacaggcucaga

SEQ ID NO: 3157232 - RNA, 15 nt, Human
caaacaggcucagag

SEQ ID NO: 3157233 - RNA, 19 nt, Human
auuuuauagcuacuaauuu

SEQ ID NO: 3157234 - RNA, 17 nt, Human
auuuuauagcuacuaau

SEQ ID NO: 3157235 - RNA, 22 nt, Human
auuuguggggagggauuugggg

SEQ ID NO: 3157236 - RNA, 20 nt, Human
auuugcuaugagcuggggau

SEQ ID NO: 3157237 - RNA, 16 nt, Human
auuugcuaugagcugg

SEQ ID NO: 3157238 - RNA, 21 nt, Human
auucauaauuauuauuuggcc

SEQ ID NO: 3157239 - RNA, 23 nt, Human
auuguaauaggcguaacuaauuu

SEQ ID NO: 3157240 - RNA, 13 nt, Human
auucuuucccaac

SEQ ID NO: 3157241 - RNA, 16 nt, Human
auucuuucccaacacc

SEQ ID NO: 3157242 - RNA, 19 nt, Human
auucuuucccaacaccucu

SEQ ID NO: 3157243 - RNA, 18 nt, Human
auucuugaaggaaaauga

SEQ ID NO: 3157244 - RNA, 15 nt, Human
auucuugaaggaaaa

SEQ ID NO: 3157245 - RNA, 22 nt, Human
auugauaaguucauacauugua

SEQ ID NO: 3157246 - RNA, 21 nt, Human
auugauaaguucauacauugu

SEQ ID NO: 3157247 - RNA, 15 nt, Human
caauucuugccaaau

SEQ ID NO: 3157248 - RNA, 21 nt, Human
cacucuuggagccugcagagc

SEQ ID NO: 3157249 - RNA, 22 nt, Human
cacucuuggagccugcagagcu

SEQ ID NO: 3157250 - RNA, 23 nt, Human
cacucuuggagccugcagagcug

SEQ ID NO: 3157251 - RNA, 19 nt, Human
cacuggggcaggggccggg

SEQ ID NO: 3157252 - RNA, 18 nt, Human
cacugggagaaaugaaaa

SEQ ID NO: 3157253 - RNA, 18 nt, Human
cacugccagcauuucccu

SEQ ID NO: 3157254 - RNA, 22 nt, Human
cacugccagcauuucccuuccu

SEQ ID NO: 3157255 - RNA, 15 nt, Human
ccuauuuuaauaaac

SEQ ID NO: 3157256 - RNA, 13 nt, Human
ccuaauaaagcug

SEQ ID NO: 3157257 - RNA, 14 nt, Human
ccuaauaaagcugu

SEQ ID NO: 3157258 - RNA, 23 nt, Human
ccuaauaaagcuguguggcaguc

SEQ ID NO: 3157259 - RNA, 16 nt, Human
ccguagguuauuuuca

SEQ ID NO: 3157260 - RNA, 20 nt, Human
cccugugccuugucacgcca

SEQ ID NO: 3157261 - RNA, 22 nt, Human
cccugugccuugucacgccaga

SEQ ID NO: 3157262 - RNA, 15 nt, Human
cccugugccuuguca

SEQ ID NO: 3157263 - RNA, 24 nt, Human
cccugugccuuggugugcuguauc

SEQ ID NO: 3157264 - RNA, 13 nt, Human
cccuggcuccagg

SEQ ID NO: 3157265 - RNA, 16 nt, Human
cccuggcuccaggcca

SEQ ID NO: 3157266 - RNA, 23 nt, Human
ccucucugcaggucccuaauaaa

SEQ ID NO: 3157267 - RNA, 21 nt, Human
ccucucugcaggucccuaaua

SEQ ID NO: 3157268 - RNA, 22 nt, Human
ccucucugcaggucccuaauaa

SEQ ID NO: 3157269 - RNA, 13 nt, Human
ccucucugcaggu

SEQ ID NO: 3157270 - RNA, 20 nt, Human
ccucucugcaggucccuaau

SEQ ID NO: 3157271 - RNA, 14 nt, Human
ccugacucucagca

SEQ ID NO: 3157272 - RNA, 22 nt, Human
ccugacccucaucuuucuucca

SEQ ID NO: 3157273 - RNA, 22 nt, Human
ccugaguaaaaaagcugugugc

SEQ ID NO: 3157274 - RNA, 15 nt, Human
ccaguucagcuuggg

SEQ ID NO: 3157275 - RNA, 17 nt, Human
ccagagucccugccugg

SEQ ID NO: 3157276 - RNA, 18 nt, Human
ccagagucccugccugga

SEQ ID NO: 3157277 - RNA, 19 nt, Human
ccagagucccugccuggac

SEQ ID NO: 3157278 - RNA, 22 nt, Human
ccagagucccugccuggaccag

SEQ ID NO: 3157279 - RNA, 16 nt, Human
ccagagucccugccug

SEQ ID NO: 3157280 - RNA, 23 nt, Human
cccgggaggcagagguugcagug

SEQ ID NO: 3157281 - RNA, 14 nt, Human
cccgggagcucagg

SEQ ID NO: 3157282 - RNA, 21 nt, Human
ccccagacuccaccaagccug

SEQ ID NO: 3157283 - RNA, 20 nt, Human
ccccagacuccaccaagccu

SEQ ID NO: 3157284 - RNA, 14 nt, Human
ccccgacuuuuguu

SEQ ID NO: 3157285 - RNA, 23 nt, Human
cggcuccucgagaucccaacacu

SEQ ID NO: 3157286 - RNA, 18 nt, Human
cuagccaccgccuccuac

SEQ ID NO: 3157287 - RNA, 22 nt, Human
cuacauaaguaauucaagaaaa

SEQ ID NO: 3157288 - RNA, 23 nt, Human
cuacauaaguaauucaagaaaac

SEQ ID NO: 3157289 - RNA, 19 nt, Human
cuaaccugccgagagucca

SEQ ID NO: 3157290 - RNA, 21 nt, Human
cuaaccugccgagaguccauc

SEQ ID NO: 3157291 - RNA, 12 nt, Human
cuaaccugccga

SEQ ID NO: 3157292 - RNA, 14 nt, Human
cgugucuggcacag

SEQ ID NO: 3157293 - RNA, 13 nt, Human
cgugucuggcaca

SEQ ID NO: 3157294 - RNA, 21 nt, Human
cgugucuggcacagccuggcu

SEQ ID NO: 3157295 - RNA, 14 nt, Human
cucuuggagccugc

SEQ ID NO: 3157296 - RNA, 16 nt, Human
cucaggcccaaagccu

SEQ ID NO: 3157297 - RNA, 16 nt, Human
cuccaaagucucugga

SEQ ID NO: 3157298 - RNA, 16 nt, Human
cucaucuuucuuccaa

SEQ ID NO: 3157299 - RNA, 14 nt, Human
cucccuccucugcc

SEQ ID NO: 3157300 - RNA, 13 nt, Human
cucccuccucugc

SEQ ID NO: 3157301 - RNA, 12 nt, Human
uaguaaucauau

SEQ ID NO: 3157302 - RNA, 19 nt, Human
uagccaccgccuccuacag

SEQ ID NO: 3157303 - RNA, 18 nt, Human
uagccacccaccacacug

SEQ ID NO: 3157304 - RNA, 18 nt, Human
uagccaccgccuccuaca

SEQ ID NO: 3157305 - RNA, 14 nt, Human
uagcacugacagau

SEQ ID NO: 3157306 - RNA, 19 nt, Human
uagcacugacagauuucca

SEQ ID NO: 3157307 - RNA, 24 nt, Human
uagaggggaaaagagaugaugaaa

SEQ ID NO: 3157308 - RNA, 18 nt, Human
acaaaaggauaaugaaua

SEQ ID NO: 3157309 - RNA, 19 nt, Human
acaaaaauucucaguucuc

SEQ ID NO: 3157310 - RNA, 12 nt, Human
aauuuuacauuu

SEQ ID NO: 3157311 - RNA, 14 nt, Human
uagaagaagugugu

SEQ ID NO: 3157312 - RNA, 16 nt, Human
aauuccacacccucac

SEQ ID NO: 3157313 - RNA, 17 nt, Human
aauuccaauuauaugag

SEQ ID NO: 3157314 - RNA, 21 nt, Human
uagacauuugcuaugagcugg

SEQ ID NO: 3157315 - RNA, 16 nt, Human
aauuuggauugcuaau

SEQ ID NO: 3157316 - RNA, 23 nt, Human
uaugaagcuuuuaugugaaacau

SEQ ID NO: 3157317 - RNA, 20 nt, Human
uaugaagcuuuuaugugaaa

SEQ ID NO: 3157318 - RNA, 22 nt, Human
uaugaagcuuuuaugugaaaca

SEQ ID NO: 3157319 - RNA, 21 nt, Human
uaugguaggaacugcugggcu

SEQ ID NO: 3157320 - RNA, 18 nt, Human
acagcggcuggacuugga

SEQ ID NO: 3157321 - RNA, 20 nt, Human
uaugccaccugaauaaagaa

SEQ ID NO: 3157322 - RNA, 17 nt, Human
uaugauacuugaaaauu

SEQ ID NO: 3157323 - RNA, 19 nt, Human
uauaagugauugcugguuu

SEQ ID NO: 3157324 - RNA, 15 nt, Human
uauacaggucauauu

SEQ ID NO: 3157325 - RNA, 16 nt, Human
uauacaggucauauua

SEQ ID NO: 3157326 - RNA, 21 nt, Human
uauacaggucauauuaauaua

SEQ ID NO: 3157327 - RNA, 16 nt, Human
acacucaguuguucaa

SEQ ID NO: 3157328 - RNA, 20 nt, Human
uauauccuuucuaacaaaaa

SEQ ID NO: 3157329 - RNA, 17 nt, Human
uauauccuuucuaacaa

SEQ ID NO: 3157330 - RNA, 11 nt, Human
uauauauuucc

SEQ ID NO: 3157331 - RNA, 18 nt, Human
uaucaaagggugaaaauu

SEQ ID NO: 3157332 - RNA, 19 nt, Human
uaucaaagggugaaaauua

SEQ ID NO: 3157333 - RNA, 22 nt, Human
uaucaaagggugaaaauuauuu

SEQ ID NO: 3157334 - RNA, 14 nt, Human
uaucagcacgugug

SEQ ID NO: 3157335 - RNA, 17 nt, Human
uaacaaugaagauaaaa

SEQ ID NO: 3157336 - RNA, 22 nt, Human
aauagagcaaaauugauguguu

SEQ ID NO: 3157337 - RNA, 20 nt, Human
aauagagcaaaauugaugug

SEQ ID NO: 3157338 - RNA, 13 nt, Human
uaacguauaaaag

SEQ ID NO: 3157339 - RNA, 17 nt, Human
uaacguauaaaagccug

SEQ ID NO: 3157340 - RNA, 14 nt, Human
aauauauuuaauga

SEQ ID NO: 3157341 - RNA, 21 nt, Human
aauauauuuuaagacgaaaca

SEQ ID NO: 3157342 - RNA, 21 nt, Human
aauauauucagccuggcuuca

SEQ ID NO: 3157343 - RNA, 14 nt, Human
uaacaugaauauuu

SEQ ID NO: 3157344 - RNA, 20 nt, Human
uaacaugaauauuuaguguu

SEQ ID NO: 3157345 - RNA, 21 nt, Human
uaacaugaauauuuaguguuc

SEQ ID NO: 3157346 - RNA, 19 nt, Human
uaacaugaauauuuagugu

SEQ ID NO: 3157347 - RNA, 18 nt, Human
aauauauuuuaagacgaa

SEQ ID NO: 3157348 - RNA, 20 nt, Human
aauccucaguuuuugugaaa

SEQ ID NO: 3157349 - RNA, 22 nt, Human
aaucagugugucuaaauuugaa

SEQ ID NO: 3157350 - RNA, 18 nt, Human
aaucagugugucuaaauu

SEQ ID NO: 3157351 - RNA, 17 nt, Human
aaucagugugucuaaau

SEQ ID NO: 3157352 - RNA, 14 nt, Human
aaucagugugucua

SEQ ID NO: 3157353 - RNA, 15 nt, Human
aaucuaugauuccag

SEQ ID NO: 3157354 - RNA, 18 nt, Human
aaucuaugauuccaggug

SEQ ID NO: 3157355 - RNA, 17 nt, Human
uaaguguguguuuuuca

SEQ ID NO: 3157356 - RNA, 16 nt, Human
uaaguaauucaagaaa

SEQ ID NO: 3157357 - RNA, 22 nt, Human
uaagcagauggaaugcuguguu

SEQ ID NO: 3157358 - RNA, 22 nt, Human
uaaggaauuuuauuuuuuucug

SEQ ID NO: 3157359 - RNA, 13 nt, Human
uacagaauuuuau

SEQ ID NO: 3157360 - RNA, 12 nt, Human
aaugagaaaucu

SEQ ID NO: 3157361 - RNA, 22 nt, Human
aaugagaaaucuaaaaaacgaa

SEQ ID NO: 3157362 - RNA, 16 nt, Human
uaauuuauacagguca

SEQ ID NO: 3157363 - RNA, 22 nt, Human
uaauuccguagguuauuuucag

SEQ ID NO: 3157364 - RNA, 20 nt, Human
uaauuuaaaauugugaugug

SEQ ID NO: 3157365 - RNA, 19 nt, Human
uaauuuaaaauugugaugu

SEQ ID NO: 3157366 - RNA, 17 nt, Human
uacagggaugguguuca

SEQ ID NO: 3157367 - RNA, 19 nt, Human
uaccagagaaaaagggagg

SEQ ID NO: 3157368 - RNA, 13 nt, Human
uacauuuccuaaa

SEQ ID NO: 3157369 - RNA, 20 nt, Human
aauucaagaaaacaacuuca

SEQ ID NO: 3157370 - RNA, 12 nt, Human
aauucaagaaaa

SEQ ID NO: 3157371 - RNA, 15 nt, Human
aauuauuuuaaaaga

SEQ ID NO: 3157372 - RNA, 12 nt, Human
aauuauuuuaaa

SEQ ID NO: 3157373 - RNA, 21 nt, Human
aauucagaaggaucuucaucu

SEQ ID NO: 3157374 - RNA, 15 nt, Human
aauucagaaggaucu

SEQ ID NO: 3157375 - RNA, 22 nt, Human
aauuaugugccagauuuaugca

SEQ ID NO: 3157376 - RNA, 15 nt, Human
uacccccugugccuu

SEQ ID NO: 3157377 - RNA, 13 nt, Human
uaccucuuggcug

SEQ ID NO: 3157378 - RNA, 23 nt, Human
uaccugaagcuaucguaaaauua

SEQ ID NO: 3157379 - RNA, 22 nt, Human
aagucuuauauauuguagauaa

SEQ ID NO: 3157380 - RNA, 16 nt, Human
aagucuuucacauuua

SEQ ID NO: 3157381 - RNA, 15 nt, Human
guuuuucauaaagca

SEQ ID NO: 3157382 - RNA, 12 nt, Human
uaaaagaauugu

SEQ ID NO: 3157383 - RNA, 18 nt, Human
uaaaaauaaaaaacacug

SEQ ID NO: 3157384 - RNA, 19 nt, Human
uaaaaauaaaaaacacugg

SEQ ID NO: 3157385 - RNA, 22 nt, Human
uaaaaauauuguguugugaaug

SEQ ID NO: 3157386 - RNA, 21 nt, Human
uaaaaauaaaaaacacuggga

SEQ ID NO: 3157387 - RNA, 20 nt, Human
uaaaagacagugaaagaaaa

SEQ ID NO: 3157388 - RNA, 22 nt, Human
aaggaaccaaagcgaauuuuaa

SEQ ID NO: 3157389 - RNA, 23 nt, Human
aaggaaccaaagcgaauuuuaaa

SEQ ID NO: 3157390 - RNA, 13 nt, Human
aaggauaaugaau

SEQ ID NO: 3157391 - RNA, 22 nt, Human
aaggcccuaucuguuuacagug

SEQ ID NO: 3157392 - RNA, 16 nt, Human
aagggugaaaauuauu

SEQ ID NO: 3157393 - RNA, 15 nt, Human
aagggugaaaauuau

SEQ ID NO: 3157394 - RNA, 14 nt, Human
aaggcucuuuugua

SEQ ID NO: 3157395 - RNA, 16 nt, Human
aaguaaggaauuuuau

SEQ ID NO: 3157396 - RNA, 13 nt, Human
guuuacaguguuc

SEQ ID NO: 3157397 - RNA, 15 nt, Human
guuuacaguguuccg

SEQ ID NO: 3157398 - RNA, 12 nt, Human
guuucaaacuuu

SEQ ID NO: 3157399 - RNA, 20 nt, Human
guuauuauauuuacaaaugg

SEQ ID NO: 3157400 - RNA, 14 nt, Human
guuaagauuccuaa

SEQ ID NO: 3157401 - RNA, 22 nt, Human
aagccugcaauuucauaugcug

SEQ ID NO: 3157402 - RNA, 17 nt, Human
aagccugcaauuucaua

SEQ ID NO: 3157403 - RNA, 18 nt, Human
aagccaagaggcugcagc

SEQ ID NO: 3157404 - RNA, 22 nt, Human
aagccaagaggcugcagccagg

SEQ ID NO: 3157405 - RNA, 18 nt, Human
aagcccaguucagcuugg

SEQ ID NO: 3157406 - RNA, 19 nt, Human
aagcccaguucagcuuggg

SEQ ID NO: 3157407 - RNA, 18 nt, Human
aagaucucagugguuaag

SEQ ID NO: 3157408 - RNA, 19 nt, Human
gugggguagguugggagaa

SEQ ID NO: 3157409 - RNA, 14 nt, Human
aagaggcugcagcc

SEQ ID NO: 3157410 - RNA, 15 nt, Human
guguguauguggggg

SEQ ID NO: 3157411 - RNA, 13 nt, Human
guguguauguggg

SEQ ID NO: 3157412 - RNA, 20 nt, Human
gugugucacccuuaggccag

SEQ ID NO: 3157413 - RNA, 14 nt, Human
gugugggucugugu

SEQ ID NO: 3157414 - RNA, 12 nt, Human
guguguaugugg

SEQ ID NO: 3157415 - RNA, 23 nt, Human
aagaccuugcuuaugauugcaga

SEQ ID NO: 3157416 - RNA, 21 nt, Human
aagaccuuuggagcaaagcug

SEQ ID NO: 3157417 - RNA, 21 nt, Human
guggccuaaccugccgagagu

SEQ ID NO: 3157418 - RNA, 22 nt, Human
guggccuaaccugccgagaguc

SEQ ID NO: 3157419 - RNA, 19 nt, Human
guauaaaagggacugagaa

SEQ ID NO: 3157420 - RNA, 18 nt, Human
guauaaaagggacugaga

SEQ ID NO: 3157421 - RNA, 12 nt, Human
guaugcuucaua

SEQ ID NO: 3157422 - RNA, 13 nt, Human
guaugcuucauac

SEQ ID NO: 3157423 - RNA, 14 nt, Human
guaugcuucauaca

SEQ ID NO: 3157424 - RNA, 15 nt, Human
guaugcuucauacag

SEQ ID NO: 3157425 - RNA, 21 nt, Human
guaugcuucauacagggaugg

SEQ ID NO: 3157426 - RNA, 14 nt, Human
aaauuaagaaagga

SEQ ID NO: 3157427 - RNA, 17 nt, Human
gucaacacuaacaugau

SEQ ID NO: 3157428 - RNA, 12 nt, Human
guauuuuugaca

SEQ ID NO: 3157429 - RNA, 15 nt, Human
guauuuuugacagaa

SEQ ID NO: 3157430 - RNA, 15 nt, Human
aaauuuaugugaugg

SEQ ID NO: 3157431 - RNA, 12 nt, Human
aaauuuauguga

SEQ ID NO: 3157432 - RNA, 12 nt, Human
aaauugugaugu

SEQ ID NO: 3157433 - RNA, 15 nt, Human
aaauugugauguguc

SEQ ID NO: 3157434 - RNA, 20 nt, Human
aaauuguaagcaugcacaaa

SEQ ID NO: 3157435 - RNA, 19 nt, Human
aaauuguaagcaugcacaa

SEQ ID NO: 3157436 - RNA, 18 nt, Human
aaauucugucucuggauu

SEQ ID NO: 3157437 - RNA, 16 nt, Human
aaauucugucucugga

SEQ ID NO: 3157438 - RNA, 13 nt, Human
aacagauaaucag

SEQ ID NO: 3157439 - RNA, 12 nt, Human
aacaauaaaaga

SEQ ID NO: 3157440 - RNA, 19 nt, Human
aacaagaugguucuagcau

SEQ ID NO: 3157441 - RNA, 17 nt, Human
gucaguauguggaagug

SEQ ID NO: 3157442 - RNA, 21 nt, Human
gucaguauguggaaguguggg

SEQ ID NO: 3157443 - RNA, 13 nt, Human
gucaguuguauca

SEQ ID NO: 3157444 - RNA, 13 nt, Human
gucagaauagaaa

SEQ ID NO: 3157445 - RNA, 17 nt, Human
gucagaauagaaauuag

SEQ ID NO: 3157446 - RNA, 12 nt, Human
gugcaagagagg

SEQ ID NO: 3157447 - RNA, 18 nt, Human
aacuucccagugaauucu

SEQ ID NO: 3157448 - RNA, 22 nt, Human
aacucaucuagguaaauuacag

SEQ ID NO: 3157449 - RNA, 16 nt, Human
gucuuucacauuuaaa

SEQ ID NO: 3157450 - RNA, 17 nt, Human
gucuggcacagccuggc

SEQ ID NO: 3157451 - RNA, 19 nt, Human
gucuggcacagccuggcug

SEQ ID NO: 3157452 - RNA, 14 nt, Human
aacccagauaaagg

SEQ ID NO: 3157453 - RNA, 17 nt, Human
aaccccccauuucuucc

SEQ ID NO: 3157454 - RNA, 20 nt, Human
aaccccuggcuccaggccag

SEQ ID NO: 3157455 - RNA, 22 nt, Human
aacccaagguggguagaucacg

SEQ ID NO: 3157456 - RNA, 14 nt, Human
aaccaccagaagcc

SEQ ID NO: 3157457 - RNA, 17 nt, Human
aaccaccagaagcccag

SEQ ID NO: 3157458 - RNA, 19 nt, Human
gucucccuccucugcccgg

SEQ ID NO: 3157459 - RNA, 20 nt, Human
aaccacauuggagauguuua

SEQ ID NO: 3157460 - RNA, 15 nt, Human
agauggaaugcugug

SEQ ID NO: 3157461 - RNA, 13 nt, Human
agauggaaugcug

SEQ ID NO: 3157462 - RNA, 18 nt, Human
agauggaaugcuguguua

SEQ ID NO: 3157463 - RNA, 18 nt, Human
ugaccuuccaagagccug

SEQ ID NO: 3157464 - RNA, 19 nt, Human
ugaccuuccaagagccuga

SEQ ID NO: 3157465 - RNA, 20 nt, Human
ugaccuuccaagagccugag

SEQ ID NO: 3157466 - RNA, 15 nt, Human
ugaauacuuuauaaa

SEQ ID NO: 3157467 - RNA, 17 nt, Human
agaguauuuuugacaga

SEQ ID NO: 3157468 - RNA, 18 nt, Human
agaguauuuuugacagaa

SEQ ID NO: 3157469 - RNA, 14 nt, Human
ugaauguaugcuuc

SEQ ID NO: 3157470 - RNA, 19 nt, Human
ugaauguaugcuucauaca

SEQ ID NO: 3157471 - RNA, 20 nt, Human
ugaauguaugcuucauacag

SEQ ID NO: 3157472 - RNA, 23 nt, Human
ugaauguaugcuucauacaggga

SEQ ID NO: 3157473 - RNA, 22 nt, Human
agagggacuguucuuuuguccc

SEQ ID NO: 3157474 - RNA, 14 nt, Human
ugaaaguacauuug

SEQ ID NO: 3157475 - RNA, 23 nt, Human
ugaaaguacauuuggagacacaa

SEQ ID NO: 3157476 - RNA, 14 nt, Human
agaguauuuuugac

SEQ ID NO: 3157477 - RNA, 15 nt, Human
agaguauuuuugaca

SEQ ID NO: 3157478 - RNA, 22 nt, Human
agaggugugcaagagagggaug

SEQ ID NO: 3157479 - RNA, 23 nt, Human
agaggugugcaagagagggaugc

SEQ ID NO: 3157480 - RNA, 20 nt, Human
ugaagcuaucguaaaauuaa

SEQ ID NO: 3157481 - RNA, 23 nt, Human
ugaauuugugaagguggaaauaa

SEQ ID NO: 3157482 - RNA, 13 nt, Human
ugaauuugugaag

SEQ ID NO: 3157483 - RNA, 21 nt, Human
ugaauuugugaagguggaaau

SEQ ID NO: 3157484 - RNA, 20 nt, Human
agaguauuuuugacagaaua

SEQ ID NO: 3157485 - RNA, 22 nt, Human
ugaaaaagaccuuuggagcaaa

SEQ ID NO: 3157486 - RNA, 23 nt, Human
ugaaaaaauauauaucaaauaua

SEQ ID NO: 3157487 - RNA, 20 nt, Human
ugaaaagcuccauuuuuagu

SEQ ID NO: 3157488 - RNA, 13 nt, Human
ugaaaauauuuaa

SEQ ID NO: 3157489 - RNA, 14 nt, Human
ugaaaauauuuaaa

SEQ ID NO: 3157490 - RNA, 11 nt, Human
ugaaaauauuu

SEQ ID NO: 3157491 - RNA, 12 nt, Human
ugaaaauauuua

SEQ ID NO: 3157492 - RNA, 12 nt, Human
ugaaacuuggau

SEQ ID NO: 3157493 - RNA, 17 nt, Human
agagacgggcccuggug

SEQ ID NO: 3157494 - RNA, 14 nt, Human
agagagaaaauaaa

SEQ ID NO: 3157495 - RNA, 20 nt, Human
agagcaaaauugauguguuu

SEQ ID NO: 3157496 - RNA, 19 nt, Human
agacauucuuccaaaaaga

SEQ ID NO: 3157497 - RNA, 13 nt, Human
agacccccuggag

SEQ ID NO: 3157498 - RNA, 14 nt, Human
agacccccuggaga

SEQ ID NO: 3157499 - RNA, 15 nt, Human
agacccccuggagac

SEQ ID NO: 3157500 - RNA, 19 nt, Human
agacccccuggagacuaac

SEQ ID NO: 3157501 - RNA, 21 nt, Human
ucuugaugccuggcggggugg

SEQ ID NO: 3157502 - RNA, 22 nt, Human
ucuuggggaguuuagggugggg

SEQ ID NO: 3157503 - RNA, 23 nt, Human
ucuuggggaguuuaggguggggg

SEQ ID NO: 3157504 - RNA, 15 nt, Human
ucuuuaacucauaaa

SEQ ID NO: 3157505 - RNA, 12 nt, Human
agaaaugaaaaa

SEQ ID NO: 3157506 - RNA, 14 nt, Human
agaaaucuagaaga

SEQ ID NO: 3157507 - RNA, 13 nt, Human
agaaaugaaaaaa

SEQ ID NO: 3157508 - RNA, 15 nt, Human
agaaaucuaaaaaac

SEQ ID NO: 3157509 - RNA, 18 nt, Human
ucucugcaggucccuaau

SEQ ID NO: 3157510 - RNA, 20 nt, Human
agaaaacaaaaaaaccucua

SEQ ID NO: 3157511 - RNA, 22 nt, Human
ucucugcaggucccuaauaaag

SEQ ID NO: 3157512 - RNA, 19 nt, Human
ucucugcaggucccuaaua

SEQ ID NO: 3157513 - RNA, 20 nt, Human
ucucugcaggucccuaauaa

SEQ ID NO: 3157514 - RNA, 21 nt, Human
ucucugcaggucccuaauaaa

SEQ ID NO: 3157515 - RNA, 19 nt, Human
acuuuguauaaaagggacu

SEQ ID NO: 3157516 - RNA, 21 nt, Human
ucugcaggucccuaauaaagc

SEQ ID NO: 3157517 - RNA, 19 nt, Human
ucugcaggucccuaauaaa

SEQ ID NO: 3157518 - RNA, 22 nt, Human
ucugcaggucccuaauaaagcu

SEQ ID NO: 3157519 - RNA, 23 nt, Human
ucugcaggucccuaauaaagcug

SEQ ID NO: 3157520 - RNA, 13 nt, Human
agaauaaacuggc

SEQ ID NO: 3157521 - RNA, 16 nt, Human
agaaggaucuucaucu

SEQ ID NO: 3157522 - RNA, 22 nt, Human
ucuggcacagccuggcuguggc

SEQ ID NO: 3157523 - RNA, 17 nt, Human
acuugaaaauuaacaug

SEQ ID NO: 3157524 - RNA, 16 nt, Human
acuugaaaauuaacau

SEQ ID NO: 3157525 - RNA, 18 nt, Human
acuugaaaauuaacauga

SEQ ID NO: 3157526 - RNA, 13 nt, Human
acuuguauuaugu

SEQ ID NO: 3157527 - RNA, 14 nt, Human
acuuguauuaugug

SEQ ID NO: 3157528 - RNA, 23 nt, Human
acuugucccgggacaccuaggcu

SEQ ID NO: 3157529 - RNA, 14 nt, Human
acuucccuuucugc

SEQ ID NO: 3157530 - RNA, 22 nt, Human
acuucccuuucugcuuguguua

SEQ ID NO: 3157531 - RNA, 17 nt, Human
ucuagcauggcauauuu

SEQ ID NO: 3157532 - RNA, 17 nt, Human
acuucccagugaauucu

SEQ ID NO: 3157533 - RNA, 13 nt, Human
ucuauaauuuaaa

SEQ ID NO: 3157534 - RNA, 15 nt, Human
ucuaccucuuggcug

SEQ ID NO: 3157535 - RNA, 21 nt, Human
ucuaagauaguaacaaugaag

SEQ ID NO: 3157536 - RNA, 20 nt, Human
ucggggagccgggagccuga

SEQ ID NO: 3157537 - RNA, 18 nt, Human
acuguacagacagaaaaa

SEQ ID NO: 3157538 - RNA, 23 nt, Human
acuguacuugcucuugaugccug

SEQ ID NO: 3157539 - RNA, 15 nt, Human
acuguacuugcucuu

SEQ ID NO: 3157540 - RNA, 18 nt, Human
ucgcccuggacugugugc

SEQ ID NO: 3157541 - RNA, 16 nt, Human
acuggggcaggggccg

SEQ ID NO: 3157542 - RNA, 22 nt, Human
acuaugacauaaaaacaacuuu

SEQ ID NO: 3157543 - RNA, 14 nt, Human
acuccaccaagccu

SEQ ID NO: 3157544 - RNA, 21 nt, Human
acucaucuagguaaauuacag

SEQ ID NO: 3157545 - RNA, 23 nt, Human
acucaucuagguaaauuacaguu

SEQ ID NO: 3157546 - RNA, 14 nt, Human
acucagaauauugc

SEQ ID NO: 3157547 - RNA, 20 nt, Human
uccuagccacccaccacacu

SEQ ID NO: 3157548 - RNA, 21 nt, Human
uccuagccaccgccuccuaca

SEQ ID NO: 3157549 - RNA, 22 nt, Human
acucgugucuggcacagccugg

SEQ ID NO: 3157550 - RNA, 23 nt, Human
acucgugucuggcacagccuggc

SEQ ID NO: 3157551 - RNA, 13 nt, Human
acucuugaaaaau

SEQ ID NO: 3157552 - RNA, 13 nt, Human
uccucuccugucu

SEQ ID NO: 3157553 - RNA, 14 nt, Human
acucuugaaaaaug

SEQ ID NO: 3157554 - RNA, 19 nt, Human
acucuugaaaaaugcaugu

SEQ ID NO: 3157555 - RNA, 16 nt, Human
uccucugcccgggagc

SEQ ID NO: 3157556 - RNA, 22 nt, Human
uccucugcccgggagcucagga

SEQ ID NO: 3157557 - RNA, 13 nt, Human
acugaaacuuccc

SEQ ID NO: 3157558 - RNA, 16 nt, Human
ucauaauaaguugcau

SEQ ID NO: 3157559 - RNA, 19 nt, Human
uccaaaaagauuuucagaa

SEQ ID NO: 3157560 - RNA, 20 nt, Human
uccaaaaagauuuucagaaa

SEQ ID NO: 3157561 - RNA, 20 nt, Human
accuggcuuuucuuucuacc

SEQ ID NO: 3157562 - RNA, 15 nt, Human
accuuccaagagccu

SEQ ID NO: 3157563 - RNA, 16 nt, Human
accuuccaagagccug

SEQ ID NO: 3157564 - RNA, 22 nt, Human
acgaagaguauuuuugacagaa

SEQ ID NO: 3157565 - RNA, 20 nt, Human
acgaagaguauuuuugacag

SEQ ID NO: 3157566 - RNA, 20 nt, Human
uccaucucuuguuuaaauuc

SEQ ID NO: 3157567 - RNA, 16 nt, Human
uccauccuacccccug

SEQ ID NO: 3157568 - RNA, 20 nt, Human
uccauccuacccccugugcc

SEQ ID NO: 3157569 - RNA, 19 nt, Human
accccagcuggggccaggc

SEQ ID NO: 3157570 - RNA, 16 nt, Human
ucagaauagaaauuag

SEQ ID NO: 3157571 - RNA, 21 nt, Human
acccagauaaagguucaugca

SEQ ID NO: 3157572 - RNA, 14 nt, Human
ucacucuuggagcc

SEQ ID NO: 3157573 - RNA, 16 nt, Human
ucacucuuggagccug

SEQ ID NO: 3157574 - RNA, 17 nt, Human
ucacucuuggagccugc

SEQ ID NO: 3157575 - RNA, 18 nt, Human
ucacucuuggagccugca

SEQ ID NO: 3157576 - RNA, 19 nt, Human
ucacuuaucccaagagaau

SEQ ID NO: 3157577 - RNA, 16 nt, Human
ucaguauguggaagug

SEQ ID NO: 3157578 - RNA, 19 nt, Human
ucaguuugcuagcagaaau

SEQ ID NO: 3157579 - RNA, 18 nt, Human
ucauaaauaaaguuuguu

SEQ ID NO: 3157580 - RNA, 24 nt, Human
ucauaaagcaggcagaacucaucu

SEQ ID NO: 3157581 - RNA, 21 nt, Human
acauuguaaauaguauuugag

SEQ ID NO: 3157582 - RNA, 19 nt, Human
acauuguaaauaguauuug

SEQ ID NO: 3157583 - RNA, 17 nt, Human
acauuguaaauaguauu

SEQ ID NO: 3157584 - RNA, 18 nt, Human
accaaauaaaaauauugu

SEQ ID NO: 3157585 - RNA, 16 nt, Human
accaaauaaaaauauu

SEQ ID NO: 3157586 - RNA, 15 nt, Human
uauuuuuguagcacu

SEQ ID NO: 3157587 - RNA, 19 nt, Human
uauuuuuguagcacugaca

SEQ ID NO: 3157588 - RNA, 13 nt, Human
ucaaauauauuca

SEQ ID NO: 3157589 - RNA, 17 nt, Human
uauuuuaauaaacacuc

SEQ ID NO: 3157590 - RNA, 14 nt, Human
uauuuuaauaaaca

SEQ ID NO: 3157591 - RNA, 15 nt, Human
uauuuuguucauaca

SEQ ID NO: 3157592 - RNA, 16 nt, Human
uauuuuguucauacau

SEQ ID NO: 3157593 - RNA, 20 nt, Human
uauuuuguguuuaggaacua

SEQ ID NO: 3157594 - RNA, 17 nt, Human
uauuuuguguuuaggaa

SEQ ID NO: 3157595 - RNA, 12 nt, Human
uauuuuucacau

SEQ ID NO: 3157596 - RNA, 13 nt, Human
uauuuuucacaua

SEQ ID NO: 3157597 - RNA, 13 nt, Human
uauuuuuguagca

SEQ ID NO: 3157598 - RNA, 21 nt, Human
uauuuuaaaagauaaauauua

SEQ ID NO: 3157599 - RNA, 14 nt, Human
uauuuuaagacgaa

SEQ ID NO: 3157600 - RNA, 22 nt, Human
uauuuuaagacgaaacauuugu

SEQ ID NO: 3157601 - RNA, 20 nt, Human
uaugugggggucuguguguu

SEQ ID NO: 3157602 - RNA, 19 nt, Human
uaugugggggucugugugu

SEQ ID NO: 3157603 - RNA, 18 nt, Human
uaugugggggucugugug

SEQ ID NO: 3157604 - RNA, 14 nt, Human
uaugugccagauuu

SEQ ID NO: 3157605 - RNA, 19 nt, Human
uaugugccagauuuaugca

SEQ ID NO: 3157606 - RNA, 14 nt, Human
uauguguaaaaugu

SEQ ID NO: 3157607 - RNA, 18 nt, Human
auaaaagccuguuuaaga

SEQ ID NO: 3157608 - RNA, 13 nt, Human
auaaaagccuguu

SEQ ID NO: 3157609 - RNA, 14 nt, Human
uuaaguauguguaa

SEQ ID NO: 3157610 - RNA, 14 nt, Human
aguuuaaauuguaa

SEQ ID NO: 3157611 - RNA, 13 nt, Human
uuaccuuugacaa

SEQ ID NO: 3157612 - RNA, 20 nt, Human
uuaccuuugacaaagguaaa

SEQ ID NO: 3157613 - RNA, 14 nt, Human
auaacguauaaaag

SEQ ID NO: 3157614 - RNA, 22 nt, Human
auaacgauaaaagacagugaaa

SEQ ID NO: 3157615 - RNA, 13 nt, Human
auaacugugaagu

SEQ ID NO: 3157616 - RNA, 13 nt, Human
auaaauaaaaaua

SEQ ID NO: 3157617 - RNA, 17 nt, Human
auaaagguucaugcaaa

SEQ ID NO: 3157618 - RNA, 15 nt, Human
auaaagguucaugca

SEQ ID NO: 3157619 - RNA, 18 nt, Human
auaaauauuuuugccaua

SEQ ID NO: 3157620 - RNA, 18 nt, Human
auaauccuaaacauauga

SEQ ID NO: 3157621 - RNA, 19 nt, Human
auaauacuugcuuuggaaa

SEQ ID NO: 3157622 - RNA, 16 nt, Human
uuagccuuugucccag

SEQ ID NO: 3157623 - RNA, 19 nt, Human
aguguguguuuuucauaaa

SEQ ID NO: 3157624 - RNA, 23 nt, Human
agugugggucuguguguguguau

SEQ ID NO: 3157625 - RNA, 19 nt, Human
agugugggucugugugugu

SEQ ID NO: 3157626 - RNA, 15 nt, Human
agugugggucugugu

SEQ ID NO: 3157627 - RNA, 17 nt, Human
agugugggucugugugu

SEQ ID NO: 3157628 - RNA, 16 nt, Human
agugugggucugugug

SEQ ID NO: 3157629 - RNA, 19 nt, Human
aguucggugagcuacaaau

SEQ ID NO: 3157630 - RNA, 15 nt, Human
aguucuacauaagua

SEQ ID NO: 3157631 - RNA, 17 nt, Human
aguuccuagccaccgcc

SEQ ID NO: 3157632 - RNA, 16 nt, Human
uguugugugugggagu

SEQ ID NO: 3157633 - RNA, 15 nt, Human
uguugugugugggag

SEQ ID NO: 3157634 - RNA, 14 nt, Human
uguuguguguggga

SEQ ID NO: 3157635 - RNA, 20 nt, Human
uguugugauguauucuagcu

SEQ ID NO: 3157636 - RNA, 14 nt, Human
uguugugauguauu

SEQ ID NO: 3157637 - RNA, 13 nt, Human
uguugugaauguu

SEQ ID NO: 3157638 - RNA, 12 nt, Human
uguugugaaugu

SEQ ID NO: 3157639 - RNA, 13 nt, Human
uguuuaguaauca

SEQ ID NO: 3157640 - RNA, 14 nt, Human
uguuuaguaaucau

SEQ ID NO: 3157641 - RNA, 17 nt, Human
uguuuaguaaucauauu

SEQ ID NO: 3157642 - RNA, 19 nt, Human
uguggcacuggggcagggg

SEQ ID NO: 3157643 - RNA, 13 nt, Human
uguggucuccacu

SEQ ID NO: 3157644 - RNA, 13 nt, Human
uguguugugaaug

SEQ ID NO: 3157645 - RNA, 13 nt, Human
uguguguguguau

SEQ ID NO: 3157646 - RNA, 16 nt, Human
uguguguguguaugug

SEQ ID NO: 3157647 - RNA, 20 nt, Human
uguaauuuaaaauugugaug

SEQ ID NO: 3157648 - RNA, 18 nt, Human
uguaauuuaaaauuguga

SEQ ID NO: 3157649 - RNA, 17 nt, Human
uguaauuuaaaauugug

SEQ ID NO: 3157650 - RNA, 23 nt, Human
agguugggagaaugucaguaugu

SEQ ID NO: 3157651 - RNA, 18 nt, Human
agguccccagcuuuggcu

SEQ ID NO: 3157652 - RNA, 10 nt, Human
aggucccuaa

SEQ ID NO: 3157653 - RNA, 11 nt, Human
agguccccaga

SEQ ID NO: 3157654 - RNA, 17 nt, Human
agguccccagcuuuggc

SEQ ID NO: 3157655 - RNA, 21 nt, Human
aguaauccaagcaaaugugaa

SEQ ID NO: 3157656 - RNA, 15 nt, Human
aguaauccaagcaaa

SEQ ID NO: 3157657 - RNA, 19 nt, Human
aguacuuuuggcauuuuac

SEQ ID NO: 3157658 - RNA, 19 nt, Human
aguagaacagauaaucagu

SEQ ID NO: 3157659 - RNA, 13 nt, Human
aguagaacagaua

SEQ ID NO: 3157660 - RNA, 23 nt, Human
aguaaggaauuuuauuuuuuucu

SEQ ID NO: 3157661 - RNA, 22 nt, Human
uguaauuuaaaauugugaugug

SEQ ID NO: 3157662 - RNA, 21 nt, Human
uguaauuuaaaauugugaugu

SEQ ID NO: 3157663 - RNA, 22 nt, Human
agucccugccuggaccagccuc

SEQ ID NO: 3157664 - RNA, 23 nt, Human
agucccugccuggaccagccucu

SEQ ID NO: 3157665 - RNA, 15 nt, Human
agucccugccuggac

SEQ ID NO: 3157666 - RNA, 21 nt, Human
agucccugccuggaccagccu

SEQ ID NO: 3157667 - RNA, 14 nt, Human
agucccugccugga

SEQ ID NO: 3157668 - RNA, 22 nt, Human
agucccugaggcagguccccag

SEQ ID NO: 3157669 - RNA, 23 nt, Human
agucccugaggcagguccccaga

SEQ ID NO: 3157670 - RNA, 19 nt, Human
agucccugaggcagguccc

SEQ ID NO: 3157671 - RNA, 20 nt, Human
agucccugaggcaggucccc

SEQ ID NO: 3157672 - RNA, 11 nt, Human
uguauuaugug

SEQ ID NO: 3157673 - RNA, 16 nt, Human
aguauuugagaguucu

SEQ ID NO: 3157674 - RNA, 19 nt, Human
aguauguggaagugugggu

SEQ ID NO: 3157675 - RNA, 17 nt, Human
aguauguggaagugugg

SEQ ID NO: 3157676 - RNA, 15 nt, Human
aguauguggaagugu

SEQ ID NO: 3157677 - RNA, 22 nt, Human
ugucaguauguggaaguguggg

SEQ ID NO: 3157678 - RNA, 18 nt, Human
ugucaguauguggaagug

SEQ ID NO: 3157679 - RNA, 20 nt, Human
ugucaguauguggaagugug

SEQ ID NO: 3157680 - RNA, 19 nt, Human
ugucaguauguggaagugu

SEQ ID NO: 3157681 - RNA, 20 nt, Human
uggggacaggggcaggagga

SEQ ID NO: 3157682 - RNA, 22 nt, Human
uggggacaggggcaggaggaag

SEQ ID NO: 3157683 - RNA, 18 nt, Human
uggggaguuuaggguggg

SEQ ID NO: 3157684 - RNA, 19 nt, Human
uggggaguuuagggugggg

SEQ ID NO: 3157685 - RNA, 15 nt, Human
ugggguagguuggga

SEQ ID NO: 3157686 - RNA, 21 nt, Human
ugggguagguugggagaaugu

SEQ ID NO: 3157687 - RNA, 14 nt, Human
uggggcugauugua

SEQ ID NO: 3157688 - RNA, 23 nt, Human
agguauaauucacauuguauuca

SEQ ID NO: 3157689 - RNA, 18 nt, Human
aggucauauuaauauauu

SEQ ID NO: 3157690 - RNA, 19 nt, Human
aggucauauuaauauauuu

SEQ ID NO: 3157691 - RNA, 16 nt, Human
aggucauauuaauaua

SEQ ID NO: 3157692 - RNA, 11 nt, Human
uggucagccca

SEQ ID NO: 3157693 - RNA, 12 nt, Human
uggucagcccaa

SEQ ID NO: 3157694 - RNA, 10 nt, Human
uggucagccc

SEQ ID NO: 3157695 - RNA, 14 nt, Human
uggucuccacuggg

SEQ ID NO: 3157696 - RNA, 16 nt, Human
uggguggggggcuuca

SEQ ID NO: 3157697 - RNA, 20 nt, Human
ugguaggaacugcugggcuu

SEQ ID NO: 3157698 - RNA, 13 nt, Human
ugguaggaacugc

SEQ ID NO: 3157699 - RNA, 12 nt, Human
ugggucugugug

SEQ ID NO: 3157700 - RNA, 21 nt, Human
ugggucgcccuggacugugug

SEQ ID NO: 3157701 - RNA, 15 nt, Human
agggggagagggcug

SEQ ID NO: 3157702 - RNA, 16 nt, Human
agggggagagggcugc

SEQ ID NO: 3157703 - RNA, 23 nt, Human
agcuuggggacaggggcaggagg

SEQ ID NO: 3157704 - RNA, 15 nt, Human
ugccugcccuauucu

SEQ ID NO: 3157705 - RNA, 20 nt, Human
agcugugugcucuccaagcc

SEQ ID NO: 3157706 - RNA, 21 nt, Human
agcugggacaccccgacuuuu

SEQ ID NO: 3157707 - RNA, 18 nt, Human
agcugugugcucuccaag

SEQ ID NO: 3157708 - RNA, 14 nt, Human
agcuguguggcagu

SEQ ID NO: 3157709 - RNA, 16 nt, Human
agcuguguggcagucu

SEQ ID NO: 3157710 - RNA, 23 nt, Human
agcuuuaucaaagggugaaaauu

SEQ ID NO: 3157711 - RNA, 14 nt, Human
ugcuucaucccuuu

SEQ ID NO: 3157712 - RNA, 23 nt, Human
ugcuguauccauccauggggcug

SEQ ID NO: 3157713 - RNA, 15 nt, Human
ugcuguagacauuug

SEQ ID NO: 3157714 - RNA, 15 nt, Human
uggacugugugcuca

SEQ ID NO: 3157715 - RNA, 13 nt, Human
aggcaaucauggu

SEQ ID NO: 3157716 - RNA, 20 nt, Human
uggaauuauuuuaaaagaua

SEQ ID NO: 3157717 - RNA, 19 nt, Human
uggaauuauuuuaaaagau

SEQ ID NO: 3157718 - RNA, 19 nt, Human
aggacaguauuugugggga

SEQ ID NO: 3157719 - RNA, 12 nt, Human
aggacaguauuu

SEQ ID NO: 3157720 - RNA, 19 nt, Human
aggaucccaugagcuccuu

SEQ ID NO: 3157721 - RNA, 20 nt, Human
uggaagcuucuggugaccuu

SEQ ID NO: 3157722 - RNA, 17 nt, Human
uggauuauauuaugaag

SEQ ID NO: 3157723 - RNA, 16 nt, Human
uggcauauuuuucaca

SEQ ID NO: 3157724 - RNA, 17 nt, Human
uggcauauuuuucacau

SEQ ID NO: 3157725 - RNA, 23 nt, Human
uggccaguggcuggaucugugag

SEQ ID NO: 3157726 - RNA, 21 nt, Human
uggccuguucuucuauggguu

SEQ ID NO: 3157727 - RNA, 20 nt, Human
agccuggucagcccaaacca

SEQ ID NO: 3157728 - RNA, 13 nt, Human
agccuguuuaaga

SEQ ID NO: 3157729 - RNA, 15 nt, Human
agccuggucagccca

SEQ ID NO: 3157730 - RNA, 16 nt, Human
agccuggucagcccaa

SEQ ID NO: 3157731 - RNA, 17 nt, Human
ugccagacccccuggag

SEQ ID NO: 3157732 - RNA, 21 nt, Human
agcucaggaaccgaggcaggg

SEQ ID NO: 3157733 - RNA, 22 nt, Human
agcucaggaaccgaggcaggga

SEQ ID NO: 3157734 - RNA, 20 nt, Human
agcucaggaaccgaggcagg

SEQ ID NO: 3157735 - RNA, 18 nt, Human
agcuaggaauuguguuua

SEQ ID NO: 3157736 - RNA, 18 nt, Human
agcccaguucagcuuggg

SEQ ID NO: 3157737 - RNA, 18 nt, Human
agccugacccucaucuuu

SEQ ID NO: 3157738 - RNA, 11 nt, Human
ugcaggucccu

SEQ ID NO: 3157739 - RNA, 22 nt, Human
ugcauaacguauaaaagccugu

SEQ ID NO: 3157740 - RNA, 23 nt, Human
ugcauaacguauaaaagccuguu

SEQ ID NO: 3157741 - RNA, 12 nt, Human
ugcaggucccua

SEQ ID NO: 3157742 - RNA, 14 nt, Human
ugcaggucccuaau

SEQ ID NO: 3157743 - RNA, 15 nt, Human
ugcaggucccuaaua

SEQ ID NO: 3157744 - RNA, 16 nt, Human
ugcaggucccuaauaa

SEQ ID NO: 3157745 - RNA, 15 nt, Human
ugauccagcccugag

SEQ ID NO: 3157746 - RNA, 17 nt, Human
ugauccagcccugaguu

SEQ ID NO: 3157747 - RNA, 18 nt, Human
ugauccagcccugaguuc

SEQ ID NO: 3157748 - RNA, 15 nt, Human
agccaggccacuggc

SEQ ID NO: 3157749 - RNA, 17 nt, Human
agcaugucgucaaagcu

SEQ ID NO: 3157750 - RNA, 20 nt, Human
agcaugucgucaaagcugaa

SEQ ID NO: 3157751 - RNA, 18 nt, Human
agcauggcauauuuuuca

SEQ ID NO: 3157752 - RNA, 19 nt, Human
agcauggcauauuuuucac

SEQ ID NO: 3157753 - RNA, 21 nt, Human
agcauggcauauuuuucacau

SEQ ID NO: 3157754 - RNA, 22 nt, Human
agcauggcauauuuuucacaua

SEQ ID NO: 3157755 - RNA, 17 nt, Human
agcauuucccuuccuuc

SEQ ID NO: 3157756 - RNA, 21 nt, Human
ugauagaaggcuauggggaua

SEQ ID NO: 3157757 - RNA, 22 nt, Human
ugaguaacugauuuguaacaag

SEQ ID NO: 3157758 - RNA, 21 nt, Human
agcauaauacuugcuuuggaa

SEQ ID NO: 3157759 - RNA, 18 nt, Human
ugaguucauaaauuuaug

SEQ ID NO: 3157760 - RNA, 24 nt, Human
ugaguuacuugcugcccugugcuc

SEQ ID NO: 3157761 - RNA, 24 nt, Human
ugauaagcagucauccucagauca

SEQ ID NO: 3157762 - RNA, 12 nt, Human
ugauaaguaaau

SEQ ID NO: 3157763 - RNA, 19 nt, Human
ugauacgcaacauaauuaa

SEQ ID NO: 3157764 - RNA, 23 nt, Human
ugauacacuaugaagauguuuca

SEQ ID NO: 3157765 - RNA, 14 nt, Human
uuccaagagccuga

SEQ ID NO: 3157766 - RNA, 22 nt, Human
uuccaagagccugagagugagg

SEQ ID NO: 3157767 - RNA, 13 nt, Human
uuccaagagccug

SEQ ID NO: 3157768 - RNA, 13 nt, Human
uucauacauugua

SEQ ID NO: 3157769 - RNA, 19 nt, Human
uucauacauuguacgaaga

SEQ ID NO: 3157770 - RNA, 13 nt, Human
uucauaugcugua

SEQ ID NO: 3157771 - RNA, 12 nt, Human
uucauacauauu

SEQ ID NO: 3157772 - RNA, 23 nt, Human
uucauacauauuuuuguagcacu

SEQ ID NO: 3157773 - RNA, 21 nt, Human
uucauacagggaugguguuca

SEQ ID NO: 3157774 - RNA, 19 nt, Human
uucauaauuauuauuuggc

SEQ ID NO: 3157775 - RNA, 13 nt, Human
auauauuuaauga

SEQ ID NO: 3157776 - RNA, 12 nt, Human
auauauuuuaag

SEQ ID NO: 3157777 - RNA, 13 nt, Human
auauauuuuaaga

SEQ ID NO: 3157778 - RNA, 14 nt, Human
auaucuaguaugaa

SEQ ID NO: 3157779 - RNA, 15 nt, Human
auaucuaguaugaaa

SEQ ID NO: 3157780 - RNA, 17 nt, Human
auaucuaguaugaaauu

SEQ ID NO: 3157781 - RNA, 14 nt, Human
auauauuuuaagac

SEQ ID NO: 3157782 - RNA, 13 nt, Human
auaucuuguagcu

SEQ ID NO: 3157783 - RNA, 17 nt, Human
auaggcguaacuaauuu

SEQ ID NO: 3157784 - RNA, 22 nt, Human
auagcuuuucccuuuuuuuaag

SEQ ID NO: 3157785 - RNA, 16 nt, Human
uucaaaauuguuacaa

SEQ ID NO: 3157786 - RNA, 21 nt, Human
uucaaaauuguuacaaauugu

SEQ ID NO: 3157787 - RNA, 17 nt, Human
uuauuuuguucauacau

SEQ ID NO: 3157788 - RNA, 21 nt, Human
uuauuuuguucauacauauuu

SEQ ID NO: 3157789 - RNA, 16 nt, Human
uuauuuuguucauaca

SEQ ID NO: 3157790 - RNA, 13 nt, Human
uuauuuuuuucug

SEQ ID NO: 3157791 - RNA, 17 nt, Human
uuauuuuuuucugaauu

SEQ ID NO: 3157792 - RNA, 15 nt, Human
auauauauauauauu

SEQ ID NO: 3157793 - RNA, 13 nt, Human
auagucuuucagu

SEQ ID NO: 3157794 - RNA, 16 nt, Human
uucuuuguaaugaaaa

SEQ ID NO: 3157795 - RNA, 20 nt, Human
auccuagucacuaccuucau

SEQ ID NO: 3157796 - RNA, 21 nt, Human
aucauuggauucugagagcug

SEQ ID NO: 3157797 - RNA, 22 nt, Human
aucauuggauucugagagcugu

SEQ ID NO: 3157798 - RNA, 14 nt, Human
auauuuuaagacga

SEQ ID NO: 3157799 - RNA, 20 nt, Human
uucuaacaaaaaaauauauu

SEQ ID NO: 3157800 - RNA, 19 nt, Human
uucuaacaaaaaaauauau

SEQ ID NO: 3157801 - RNA, 13 nt, Human
uucuaaaguaaaa

SEQ ID NO: 3157802 - RNA, 15 nt, Human
uucuaaaguaaaaac

SEQ ID NO: 3157803 - RNA, 13 nt, Human
uucuauaauuuaa

SEQ ID NO: 3157804 - RNA, 14 nt, Human
uucuauaauuuaaa

SEQ ID NO: 3157805 - RNA, 15 nt, Human
uucuaguucugccag

SEQ ID NO: 3157806 - RNA, 19 nt, Human
aucagacuaugaaguuuuu

SEQ ID NO: 3157807 - RNA, 14 nt, Human
uuuaaauguuuuuu

SEQ ID NO: 3157808 - RNA, 12 nt, Human
uuuaauuuuaca

SEQ ID NO: 3157809 - RNA, 15 nt, Human
augauuccagguggc

SEQ ID NO: 3157810 - RNA, 16 nt, Human
augauuccagguggca

SEQ ID NO: 3157811 - RNA, 13 nt, Human
augcuucauacag

SEQ ID NO: 3157812 - RNA, 15 nt, Human
augcuucauacaggg

SEQ ID NO: 3157813 - RNA, 16 nt, Human
augcuucauacaggga

SEQ ID NO: 3157814 - RNA, 19 nt, Human
augcuucauacagggaugg

SEQ ID NO: 3157815 - RNA, 11 nt, Human
augcuucauac

SEQ ID NO: 3157816 - RNA, 12 nt, Human
augcuucauaca

SEQ ID NO: 3157817 - RNA, 10 nt, Human
augcuucaua

SEQ ID NO: 3157818 - RNA, 23 nt, Human
augcuucauacagggaugguguu

SEQ ID NO: 3157819 - RNA, 16 nt, Human
uuuaguaucuuuuuau

SEQ ID NO: 3157820 - RNA, 12 nt, Human
uuuaugugaugg

SEQ ID NO: 3157821 - RNA, 13 nt, Human
uuuaugugugugu

SEQ ID NO: 3157822 - RNA, 11 nt, Human
uuuaugugugu

SEQ ID NO: 3157823 - RNA, 16 nt, Human
auggccugggggaugu

SEQ ID NO: 3157824 - RNA, 21 nt, Human
auggaaugaugggucaguugu

SEQ ID NO: 3157825 - RNA, 16 nt, Human
auggaaugcuguguua

SEQ ID NO: 3157826 - RNA, 15 nt, Human
uuucauaugcuguau

SEQ ID NO: 3157827 - RNA, 13 nt, Human
aucuuuuuauuca

SEQ ID NO: 3157828 - RNA, 22 nt, Human
aucuuuaauuuuacauuuccua

SEQ ID NO: 3157829 - RNA, 16 nt, Human
aucuuuaauuuuacau

SEQ ID NO: 3157830 - RNA, 21 nt, Human
aucuuuaauuuuacauuuccu

SEQ ID NO: 3157831 - RNA, 15 nt, Human
augagaaaucuaaaa

SEQ ID NO: 3157832 - RNA, 18 nt, Human
augagaaaucuaaaaaac

SEQ ID NO: 3157833 - RNA, 23 nt, Human
augagaaaucuaaaaaacgaaaa

SEQ ID NO: 3157834 - RNA, 18 nt, Human
aucucauaauuuauacag

SEQ ID NO: 3157835 - RNA, 17 nt, Human
aucucauaauuuauaca

SEQ ID NO: 3157836 - RNA, 23 nt, Human
aucucagugguuaagauuccuaa

SEQ ID NO: 3157837 - RNA, 16 nt, Human
aucuccccaucauugg

SEQ ID NO: 3157838 - RNA, 15 nt, Human
uugaugggauuuggu

SEQ ID NO: 3157839 - RNA, 12 nt, Human
uugaugccuggc

SEQ ID NO: 3157840 - RNA, 11 nt, Human
uugauguguuu

SEQ ID NO: 3157841 - RNA, 14 nt, Human
uugcaucugaaaau

SEQ ID NO: 3157842 - RNA, 20 nt, Human
aucugagaggccacagugca

SEQ ID NO: 3157843 - RNA, 16 nt, Human
aucuguaccucugccu

SEQ ID NO: 3157844 - RNA, 15 nt, Human
auuaauauauuucca

SEQ ID NO: 3157845 - RNA, 16 nt, Human
auuaagaucucagugg

SEQ ID NO: 3157846 - RNA, 15 nt, Human
auuauauuuacaaau

SEQ ID NO: 3157847 - RNA, 18 nt, Human
auuauuuuauguugcaua

SEQ ID NO: 3157848 - RNA, 16 nt, Human
auuauuuuauguugca

SEQ ID NO: 3157849 - RNA, 14 nt, Human
auuauuuuaaaaga

SEQ ID NO: 3157850 - RNA, 13 nt, Human
auuauuuuaaaag

SEQ ID NO: 3157851 - RNA, 16 nt, Human
auuauauuuacaaaug

SEQ ID NO: 3157852 - RNA, 14 nt, Human
auucagcucaugga

SEQ ID NO: 3157853 - RNA, 11 nt, Human
uuuuaagaaau

SEQ ID NO: 3157854 - RNA, 16 nt, Human
uuuuaaguaaggaauu

SEQ ID NO: 3157855 - RNA, 17 nt, Human
uuuguaaauuuauguga

SEQ ID NO: 3157856 - RNA, 19 nt, Human
uuuguagcacugacagauu

SEQ ID NO: 3157857 - RNA, 17 nt, Human
uuuguagcacugacaga

SEQ ID NO: 3157858 - RNA, 19 nt, Human
uuugcuaugagcuggggau

SEQ ID NO: 3157859 - RNA, 23 nt, Human
uuugcucagugucuggcugcaga

SEQ ID NO: 3157860 - RNA, 14 nt, Human
augucaguaugugg

SEQ ID NO: 3157861 - RNA, 13 nt, Human
augucaguaugug

SEQ ID NO: 3157862 - RNA, 17 nt, Human
auguaugcuucauacag

SEQ ID NO: 3157863 - RNA, 16 nt, Human
auguaugcuucauaca

SEQ ID NO: 3157864 - RNA, 20 nt, Human
auguaugcuucauacaggga

SEQ ID NO: 3157865 - RNA, 19 nt, Human
uuuuaguugcaacuuugua

SEQ ID NO: 3157866 - RNA, 16 nt, Human
uuuucuauaauuuaaa

SEQ ID NO: 3157867 - RNA, 21 nt, Human
uuuuauucagcucauggacuu

SEQ ID NO: 3157868 - RNA, 18 nt, Human
uuuuaugugaaacauguu

SEQ ID NO: 3157869 - RNA, 19 nt, Human
uuuuaugugaaacauguuu

SEQ ID NO: 3157870 - RNA, 21 nt, Human
auuaacaugaauauuuagugu

SEQ ID NO: 3157871 - RNA, 20 nt, Human
auuaaaaaaucaguuguaca

SEQ ID NO: 3157872 - RNA, 19 nt, Human
auguuuacagaggacagua

SEQ ID NO: 3157873 - RNA, 17 nt, Human
auguuuacagaggacag

SEQ ID NO: 3157874 - RNA, 15 nt, Human
auguuuacagaggac

SEQ ID NO: 3157875 - RNA, 15 nt, Human
auguugugauguauu

SEQ ID NO: 3157876 - RNA, 20 nt, Human
auuuggagacacaacuauuu

SEQ ID NO: 3157877 - RNA, 22 nt, Human
auuugaauguaugcuucauaca

SEQ ID NO: 3157878 - RNA, 20 nt, Human
auuugaauguaugcuucaua

SEQ ID NO: 3157879 - RNA, 21 nt, Human
auuugaauguaugcuucauac

SEQ ID NO: 3157880 - RNA, 17 nt, Human
auuugaauguaugcuuc

SEQ ID NO: 3157881 - RNA, 18 nt, Human
auuugaauguaugcuuca

SEQ ID NO: 3157882 - RNA, 22 nt, Human
auuuuacuguacagacagaaaa

SEQ ID NO: 3157883 - RNA, 20 nt, Human
auuuuacuguacagacagaa

SEQ ID NO: 3157884 - RNA, 17 nt, Human
auuuuaccuuugacaaa

SEQ ID NO: 3157885 - RNA, 14 nt, Human
auuuuauguugcau

SEQ ID NO: 3157886 - RNA, 21 nt, Human
auuuuauguugcauagaauaa

SEQ ID NO: 3157887 - RNA, 18 nt, Human
auuuuauguugcauagaa

SEQ ID NO: 3157888 - RNA, 14 nt, Human
auuguauuacaaau

SEQ ID NO: 3157889 - RNA, 15 nt, Human
auugugaaauuauuc

SEQ ID NO: 3157890 - RNA, 21 nt, Human
auugcuaaucaccaaaggcuc

SEQ ID NO: 3157891 - RNA, 21 nt, Human
auuggcucuugaacugagcuu

SEQ ID NO: 3157892 - RNA, 16 nt, Human
auuuacaaaugggaaa

SEQ ID NO: 3157893 - RNA, 20 nt, Human
auuuaaaauugugauguguc

SEQ ID NO: 3157894 - RNA, 19 nt, Human
auuuaaaauugugaugugu

SEQ ID NO: 3157895 - RNA, 18 nt, Human
auuuaaaggcccuaucug

SEQ ID NO: 3157896 - RNA, 20 nt, Human
auuuaaaggcccuaucuguu

SEQ ID NO: 3157897 - RNA, 21 nt, Human
auuuaaaggcccuaucuguuu

SEQ ID NO: 3157898 - RNA, 23 nt, Human
auugcaggagucccugccaucau

SEQ ID NO: 3157899 - RNA, 13 nt, Human
cacaggaaaccag

SEQ ID NO: 3157900 - RNA, 22 nt, Human
caaaauaauuuuaagaaaucaa

SEQ ID NO: 3157901 - RNA, 18 nt, Human
caaaauaauuuuaagaaa

SEQ ID NO: 3157902 - RNA, 23 nt, Human
caaauauauucagccuggcuuca

SEQ ID NO: 3157903 - RNA, 18 nt, Human
caaauaaaaauauugugu

SEQ ID NO: 3157904 - RNA, 16 nt, Human
caaauaaaaauauugu

SEQ ID NO: 3157905 - RNA, 15 nt, Human
caaauaaaaauauug

SEQ ID NO: 3157906 - RNA, 16 nt, Human
caaagagagaaaauaa

SEQ ID NO: 3157907 - RNA, 15 nt, Human
caaagaaauuaugug

SEQ ID NO: 3157908 - RNA, 19 nt, Human
caaagagagaaaauaaaga

SEQ ID NO: 3157909 - RNA, 19 nt, Human
caauaauaaauauuuuugc

SEQ ID NO: 3157910 - RNA, 18 nt, Human
caaggaaaaaauaacaau

SEQ ID NO: 3157911 - RNA, 17 nt, Human
caagccuuggcucuacc

SEQ ID NO: 3157912 - RNA, 12 nt, Human
caagccugguca

SEQ ID NO: 3157913 - RNA, 15 nt, Human
caagccuggucagcc

SEQ ID NO: 3157914 - RNA, 16 nt, Human
caagccuggucagccc

SEQ ID NO: 3157915 - RNA, 17 nt, Human
caagccuggucagccca

SEQ ID NO: 3157916 - RNA, 18 nt, Human
caagccuggucagcccaa

SEQ ID NO: 3157917 - RNA, 13 nt, Human
ccuaaacauauga

SEQ ID NO: 3157918 - RNA, 15 nt, Human
ccuacagcccaccug

SEQ ID NO: 3157919 - RNA, 22 nt, Human
ccuagguauaauucacauugua

SEQ ID NO: 3157920 - RNA, 13 nt, Human
cccuggugguuca

SEQ ID NO: 3157921 - RNA, 17 nt, Human
ccggcuuuguggcacug

SEQ ID NO: 3157922 - RNA, 19 nt, Human
ccggcuuuguggcacuggg

SEQ ID NO: 3157923 - RNA, 16 nt, Human
ccggcuuuguggcacu

SEQ ID NO: 3157924 - RNA, 13 nt, Human
ccgggagcucagg

SEQ ID NO: 3157925 - RNA, 15 nt, Human
ccgggagcucaggaa

SEQ ID NO: 3157926 - RNA, 19 nt, Human
ccggggccugggcaggagg

SEQ ID NO: 3157927 - RNA, 15 nt, Human
ccggggccugggcag

SEQ ID NO: 3157928 - RNA, 22 nt, Human
ccuaucuguuuacaguguuccg

SEQ ID NO: 3157929 - RNA, 14 nt, Human
ccucacacucaccc

SEQ ID NO: 3157930 - RNA, 18 nt, Human
ccucagccccgcguggaa

SEQ ID NO: 3157931 - RNA, 17 nt, Human
ccuccauccuacccccu

SEQ ID NO: 3157932 - RNA, 22 nt, Human
ccuccauccuacccccugugcc

SEQ ID NO: 3157933 - RNA, 23 nt, Human
ccuccauccuacccccugugccu

SEQ ID NO: 3157934 - RNA, 13 nt, Human
ccuccacucuccu

SEQ ID NO: 3157935 - RNA, 14 nt, Human
ccucuacugggagc

SEQ ID NO: 3157936 - RNA, 17 nt, Human
cccucuacugggagccu

SEQ ID NO: 3157937 - RNA, 20 nt, Human
cccucuacugggagccuacc

SEQ ID NO: 3157938 - RNA, 20 nt, Human
cccugccaucauguuuacag

SEQ ID NO: 3157939 - RNA, 11 nt, Human
cccugccucuc

SEQ ID NO: 3157940 - RNA, 18 nt, Human
cccugccucucugcaggu

SEQ ID NO: 3157941 - RNA, 12 nt, Human
cccugccuggac

SEQ ID NO: 3157942 - RNA, 13 nt, Human
cccugccuggacc

SEQ ID NO: 3157943 - RNA, 18 nt, Human
cccugccuggaccagccu

SEQ ID NO: 3157944 - RNA, 16 nt, Human
cccugccucucugcag

SEQ ID NO: 3157945 - RNA, 21 nt, Human
cccugccucucugcagguccc

SEQ ID NO: 3157946 - RNA, 22 nt, Human
cccugccucucugcaggucccu

SEQ ID NO: 3157947 - RNA, 21 nt, Human
cccuggacugugugcucagga

SEQ ID NO: 3157948 - RNA, 15 nt, Human
cccugggaggcucug

SEQ ID NO: 3157949 - RNA, 16 nt, Human
cccugggaggcucugg

SEQ ID NO: 3157950 - RNA, 17 nt, Human
cccugggaggcucugga

SEQ ID NO: 3157951 - RNA, 18 nt, Human
cccugggaggcucuggag

SEQ ID NO: 3157952 - RNA, 21 nt, Human
ccccagcuggggccaggcugg

SEQ ID NO: 3157953 - RNA, 22 nt, Human
ccccagcuggggccaggcuggg

SEQ ID NO: 3157954 - RNA, 23 nt, Human
ccccacaggagguggucugggac

SEQ ID NO: 3157955 - RNA, 23 nt, Human
ccccuggugguucacucuuggag

SEQ ID NO: 3157956 - RNA, 12 nt, Human
cccuaauaaagc

SEQ ID NO: 3157957 - RNA, 13 nt, Human
cccuaauaaagcu

SEQ ID NO: 3157958 - RNA, 14 nt, Human
cccuaauaaagcug

SEQ ID NO: 3157959 - RNA, 15 nt, Human
cccuaauaaagcugu

SEQ ID NO: 3157960 - RNA, 18 nt, Human
cccuaauaaagcugugug

SEQ ID NO: 3157961 - RNA, 23 nt, Human
cccucccucuacugggagccuac

SEQ ID NO: 3157962 - RNA, 14 nt, Human
cccucaucuuucuu

SEQ ID NO: 3157963 - RNA, 19 nt, Human
cccucauuggcucuugaac

SEQ ID NO: 3157964 - RNA, 18 nt, Human
cccagaaugccuccugca

SEQ ID NO: 3157965 - RNA, 21 nt, Human
cccagcuaugguucucucgca

SEQ ID NO: 3157966 - RNA, 16 nt, Human
cccaggaccccugagu

SEQ ID NO: 3157967 - RNA, 22 nt, Human
ccaucauguuuacagaggacag

SEQ ID NO: 3157968 - RNA, 20 nt, Human
ccaucauguuuacagaggac

SEQ ID NO: 3157969 - RNA, 12 nt, Human
ccaagagccuga

SEQ ID NO: 3157970 - RNA, 12 nt, Human
ccaagaggcugc

SEQ ID NO: 3157971 - RNA, 13 nt, Human
ccaagaggcugca

SEQ ID NO: 3157972 - RNA, 16 nt, Human
ccaagagccugagagu

SEQ ID NO: 3157973 - RNA, 20 nt, Human
ccaagguggguagaucacga

SEQ ID NO: 3157974 - RNA, 20 nt, Human
cauguuucuuuguaaugaaa

SEQ ID NO: 3157975 - RNA, 21 nt, Human
cauguuucuuuguaaugaaaa

SEQ ID NO: 3157976 - RNA, 22 nt, Human
cauguuucuuuguaaugaaaac

SEQ ID NO: 3157977 - RNA, 20 nt, Human
cauggugacuuuugaaaaga

SEQ ID NO: 3157978 - RNA, 15 nt, Human
caugugaaaucauuc

SEQ ID NO: 3157979 - RNA, 16 nt, Human
caugugaaaucauuca

SEQ ID NO: 3157980 - RNA, 17 nt, Human
caugugaaaucauucau

SEQ ID NO: 3157981 - RNA, 22 nt, Human
cauuaccucagugagaagccag

SEQ ID NO: 3157982 - RNA, 21 nt, Human
cauuaccucagugagaagcca

SEQ ID NO: 3157983 - RNA, 22 nt, Human
cauggacuucugccagcauaau

SEQ ID NO: 3157984 - RNA, 19 nt, Human
cauggggcugauuguauuu

SEQ ID NO: 3157985 - RNA, 21 nt, Human
cauggagauagccccacagga

SEQ ID NO: 3157986 - RNA, 19 nt, Human
caugccacuacacuccagc

SEQ ID NO: 3157987 - RNA, 15 nt, Human
cauaaaaacaacuuu

SEQ ID NO: 3157988 - RNA, 17 nt, Human
cauaaaaacaacuuuau

SEQ ID NO: 3157989 - RNA, 20 nt, Human
cauaaaaacaacuuuauacc

SEQ ID NO: 3157990 - RNA, 21 nt, Human
cauaaaaacaacuuuauaccc

SEQ ID NO: 3157991 - RNA, 23 nt, Human
cauaaaaacaacuuuauacccag

SEQ ID NO: 3157992 - RNA, 23 nt, Human
cauaaaaagccugcaauuucaua

SEQ ID NO: 3157993 - RNA, 14 nt, Human
cauaaagcaggcag

SEQ ID NO: 3157994 - RNA, 16 nt, Human
cauaaagcaggcagaa

SEQ ID NO: 3157995 - RNA, 12 nt, Human
cauacauauuuu

SEQ ID NO: 3157996 - RNA, 19 nt, Human
cauacauauuuuuguagca

SEQ ID NO: 3157997 - RNA, 15 nt, Human
cauacauuguacgaa

SEQ ID NO: 3157998 - RNA, 18 nt, Human
cauaaucacaacccuuca

SEQ ID NO: 3157999 - RNA, 11 nt, Human
cauacauauuu

SEQ ID NO: 3158000 - RNA, 15 nt, Human
cauaauacuugcuuu

SEQ ID NO: 3158001 - RNA, 17 nt, Human
cauaaguaauucaagaa

SEQ ID NO: 3158002 - RNA, 16 nt, Human
cauaaguaauucaaga

SEQ ID NO: 3158003 - RNA, 22 nt, Human
cauaaguaauucaagaaaacaa

SEQ ID NO: 3158004 - RNA, 18 nt, Human
cauaaguaauucaagaaa

SEQ ID NO: 3158005 - RNA, 15 nt, Human
cauaccuggcccugu

SEQ ID NO: 3158006 - RNA, 16 nt, Human
caguucucuucacuca

SEQ ID NO: 3158007 - RNA, 22 nt, Human
caguucggugagcuacaaaugc

SEQ ID NO: 3158008 - RNA, 18 nt, Human
caguguuccgugguuaaa

SEQ ID NO: 3158009 - RNA, 14 nt, Human
cagugugucuaaau

SEQ ID NO: 3158010 - RNA, 23 nt, Human
cagugugucuaaauuugaauguu

SEQ ID NO: 3158011 - RNA, 17 nt, Human
cagugucuggcugcaga

SEQ ID NO: 3158012 - RNA, 19 nt, Human
cagugucuggcugcagagc

SEQ ID NO: 3158013 - RNA, 16 nt, Human
caguggcuggaucugu

SEQ ID NO: 3158014 - RNA, 20 nt, Human
caguggcuggaucugugagg

SEQ ID NO: 3158015 - RNA, 18 nt, Human
caguggcuggaucuguga

SEQ ID NO: 3158016 - RNA, 11 nt, Human
cagugguuaag

SEQ ID NO: 3158017 - RNA, 22 nt, Human
caucaagucuuucacauuuaaa

SEQ ID NO: 3158018 - RNA, 21 nt, Human
cauauuuuucacauaucuagu

SEQ ID NO: 3158019 - RNA, 14 nt, Human
cauauuuuucacau

SEQ ID NO: 3158020 - RNA, 18 nt, Human
cauauuuuucacauaucu

SEQ ID NO: 3158021 - RNA, 12 nt, Human
cauauuuauaaa

SEQ ID NO: 3158022 - RNA, 17 nt, Human
cauauuuauaaaaauaa

SEQ ID NO: 3158023 - RNA, 21 nt, Human
cauaugauguacauguacuga

SEQ ID NO: 3158024 - RNA, 15 nt, Human
cauaugauguacaug

SEQ ID NO: 3158025 - RNA, 17 nt, Human
cauaugauguacaugua

SEQ ID NO: 3158026 - RNA, 14 nt, Human
cauagaauaaaauu

SEQ ID NO: 3158027 - RNA, 20 nt, Human
cauagaauaaaauuuuuaau

SEQ ID NO: 3158028 - RNA, 21 nt, Human
cauccagagucccugccugga

SEQ ID NO: 3158029 - RNA, 18 nt, Human
caucuagguaaauuacag

SEQ ID NO: 3158030 - RNA, 17 nt, Human
caucuagguaaauuaca

SEQ ID NO: 3158031 - RNA, 12 nt, Human
caucuaggauuu

SEQ ID NO: 3158032 - RNA, 19 nt, Human
cauccuacccccugugccu

SEQ ID NO: 3158033 - RNA, 17 nt, Human
gcccgggagcucaggaa

SEQ ID NO: 3158034 - RNA, 19 nt, Human
gcccgggagcucaggaacc

SEQ ID NO: 3158035 - RNA, 15 nt, Human
gcccgggagcucagg

SEQ ID NO: 3158036 - RNA, 16 nt, Human
gccccugagaucucug

SEQ ID NO: 3158037 - RNA, 17 nt, Human
gcccagaaugaggcugc

SEQ ID NO: 3158038 - RNA, 16 nt, Human
gcccagaaugaggcug

SEQ ID NO: 3158039 - RNA, 21 nt, Human
gccaucauguuuacagaggac

SEQ ID NO: 3158040 - RNA, 17 nt, Human
gccaucauguuuacaga

SEQ ID NO: 3158041 - RNA, 16 nt, Human
gccagucccugaggca

SEQ ID NO: 3158042 - RNA, 22 nt, Human
gccagucccugaggcagguccc

SEQ ID NO: 3158043 - RNA, 23 nt, Human
gccaggcugggucgcccuggacu

SEQ ID NO: 3158044 - RNA, 17 nt, Human
gccaggcugggucgccc

SEQ ID NO: 3158045 - RNA, 19 nt, Human
gccucucauuccagaggaa

SEQ ID NO: 3158046 - RNA, 20 nt, Human
gccuccuacagcccaccugg

SEQ ID NO: 3158047 - RNA, 17 nt, Human
gccugacccucaucuuu

SEQ ID NO: 3158048 - RNA, 21 nt, Human
gccucuccacucaugugacuc

SEQ ID NO: 3158049 - RNA, 20 nt, Human
gccucucauuccagaggaag

SEQ ID NO: 3158050 - RNA, 24 nt, Human
gccucuccacucaugugacucuuu

SEQ ID NO: 3158051 - RNA, 17 nt, Human
gcuaagaauauuugaau

SEQ ID NO: 3158052 - RNA, 16 nt, Human
gcuaagaauauuugaa

SEQ ID NO: 3158053 - RNA, 18 nt, Human
gcgcggcugggaggaggg

SEQ ID NO: 3158054 - RNA, 12 nt, Human
gcgcggcuggga

SEQ ID NO: 3158055 - RNA, 12 nt, Human
gccuguuuaaga

SEQ ID NO: 3158056 - RNA, 13 nt, Human
gccuguuuaagag

SEQ ID NO: 3158057 - RNA, 15 nt, Human
gccugccacucaggc

SEQ ID NO: 3158058 - RNA, 23 nt, Human
gccugccacucaggcccaaagcc

SEQ ID NO: 3158059 - RNA, 13 nt, Human
gccuggugcagug

SEQ ID NO: 3158060 - RNA, 17 nt, Human
gccugguccucacacuc

SEQ ID NO: 3158061 - RNA, 18 nt, Human
gccuuuggacuugucccg

SEQ ID NO: 3158062 - RNA, 13 nt, Human
gcauagaaguaaa

SEQ ID NO: 3158063 - RNA, 17 nt, Human
gcauagguuuaauaauu

SEQ ID NO: 3158064 - RNA, 14 nt, Human
gcauauuuuucaca

SEQ ID NO: 3158065 - RNA, 15 nt, Human
gcauauuuuucacau

SEQ ID NO: 3158066 - RNA, 16 nt, Human
gcauauuuuucacaua

SEQ ID NO: 3158067 - RNA, 19 nt, Human
gcauauuuuucacauaucu

SEQ ID NO: 3158068 - RNA, 20 nt, Human
gcauauuuuucacauaucua

SEQ ID NO: 3158069 - RNA, 19 nt, Human
gcauauuuauaaaaauaaa

SEQ ID NO: 3158070 - RNA, 13 nt, Human
gcagguccccaga

SEQ ID NO: 3158071 - RNA, 19 nt, Human
gcaggggccgggggcaguc

SEQ ID NO: 3158072 - RNA, 20 nt, Human
gcaggggccgggggcagucu

SEQ ID NO: 3158073 - RNA, 18 nt, Human
gcauggagauagccccac

SEQ ID NO: 3158074 - RNA, 16 nt, Human
gcaucugaaaauugau

SEQ ID NO: 3158075 - RNA, 18 nt, Human
gcauuauauuuguaaauu

SEQ ID NO: 3158076 - RNA, 17 nt, Human
gcaaaauugauguguuu

SEQ ID NO: 3158077 - RNA, 20 nt, Human
gcaaauccuugugggaaaag

SEQ ID NO: 3158078 - RNA, 22 nt, Human
gcaaauccuugugggaaaagaa

SEQ ID NO: 3158079 - RNA, 20 nt, Human
gauuuggggcucagaguggg

SEQ ID NO: 3158080 - RNA, 23 nt, Human
gauuugcucagugucuggcugca

SEQ ID NO: 3158081 - RNA, 22 nt, Human
gauuuggucaacacuaacauga

SEQ ID NO: 3158082 - RNA, 17 nt, Human
gauuccagguggcauca

SEQ ID NO: 3158083 - RNA, 20 nt, Human
gauggcaaagaaggagagca

SEQ ID NO: 3158084 - RNA, 17 nt, Human
gaugacaacuucccagu

SEQ ID NO: 3158085 - RNA, 17 nt, Human
gaugaaaauauuuaaag

SEQ ID NO: 3158086 - RNA, 15 nt, Human
gaugaaaauauuuaa

SEQ ID NO: 3158087 - RNA, 16 nt, Human
gaugaaaauauuuaaa

SEQ ID NO: 3158088 - RNA, 14 nt, Human
gaugaaaauauuua

SEQ ID NO: 3158089 - RNA, 21 nt, Human
gaucugugaggggcucucuca

SEQ ID NO: 3158090 - RNA, 22 nt, Human
gauaaauauuauauuauauaua

SEQ ID NO: 3158091 - RNA, 15 nt, Human
gauaaauauuauauu

SEQ ID NO: 3158092 - RNA, 14 nt, Human
gauaaguucauaca

SEQ ID NO: 3158093 - RNA, 16 nt, Human
gauaaguucauacauu

SEQ ID NO: 3158094 - RNA, 12 nt, Human
gauaaguucaua

SEQ ID NO: 3158095 - RNA, 19 nt, Human
gauaaaguugguaaaccuu

SEQ ID NO: 3158096 - RNA, 23 nt, Human
gauagauaggucagugcaaauac

SEQ ID NO: 3158097 - RNA, 17 nt, Human
gauaggucagugcaaau

SEQ ID NO: 3158098 - RNA, 13 nt, Human
gauagaugugugg

SEQ ID NO: 3158099 - RNA, 17 nt, Human
gaucccaugagcuccuu

SEQ ID NO: 3158100 - RNA, 15 nt, Human
gaucccaugagcucc

SEQ ID NO: 3158101 - RNA, 14 nt, Human
gaucauuaucagcc

SEQ ID NO: 3158102 - RNA, 14 nt, Human
gaucauugugaaau

SEQ ID NO: 3158103 - RNA, 20 nt, Human
gaucauugugaaauuauuca

SEQ ID NO: 3158104 - RNA, 14 nt, Human
gauagucuuucagu

SEQ ID NO: 3158105 - RNA, 15 nt, Human
gauaguaacaaugaa

SEQ ID NO: 3158106 - RNA, 22 nt, Human
gauagucuuucaguuaaggaga

SEQ ID NO: 3158107 - RNA, 22 nt, Human
gagcuugaaacccguggcgcuu

SEQ ID NO: 3158108 - RNA, 20 nt, Human
gagcuccuuaaggcucuuuu

SEQ ID NO: 3158109 - RNA, 21 nt, Human
gagcucaggaaccgaggcagg

SEQ ID NO: 3158110 - RNA, 20 nt, Human
gagcucaggaaccgaggcag

SEQ ID NO: 3158111 - RNA, 21 nt, Human
gagccugacccucaucuuucu

SEQ ID NO: 3158112 - RNA, 15 nt, Human
gagccuacccacccc

SEQ ID NO: 3158113 - RNA, 17 nt, Human
gagccuacccaccccca

SEQ ID NO: 3158114 - RNA, 18 nt, Human
gagcccacuguacuugcu

SEQ ID NO: 3158115 - RNA, 21 nt, Human
gagcccacuguacuugcucuu

SEQ ID NO: 3158116 - RNA, 14 nt, Human
gagaaauuuauaaa

SEQ ID NO: 3158117 - RNA, 18 nt, Human
gacuugucccgggacacc

SEQ ID NO: 3158118 - RNA, 16 nt, Human
gagacagccaacuaug

SEQ ID NO: 3158119 - RNA, 22 nt, Human
gagaagccagcuuuccucauca

SEQ ID NO: 3158120 - RNA, 17 nt, Human
gagauacagaauuuuau

SEQ ID NO: 3158121 - RNA, 15 nt, Human
gagagugagguggaa

SEQ ID NO: 3158122 - RNA, 13 nt, Human
gagagaggccauu

SEQ ID NO: 3158123 - RNA, 21 nt, Human
gagagaggccauucuuuccca

SEQ ID NO: 3158124 - RNA, 22 nt, Human
gacagccaacuauggccugugg

SEQ ID NO: 3158125 - RNA, 19 nt, Human
gacagccaacuauggccug

SEQ ID NO: 3158126 - RNA, 15 nt, Human
gacaccuaggcuagg

SEQ ID NO: 3158127 - RNA, 16 nt, Human
gacaccuaggcuaggg

SEQ ID NO: 3158128 - RNA, 20 nt, Human
gacaccuaggcuaggguggg

SEQ ID NO: 3158129 - RNA, 23 nt, Human
gaccugauuucugagcauuuaau

SEQ ID NO: 3158130 - RNA, 17 nt, Human
gaccuuuccugaggaag

SEQ ID NO: 3158131 - RNA, 17 nt, Human
cuugaacugagcuugga

SEQ ID NO: 3158132 - RNA, 19 nt, Human
cuugaacugagcuuggaag

SEQ ID NO: 3158133 - RNA, 17 nt, Human
cuugccaaauauaaaua

SEQ ID NO: 3158134 - RNA, 20 nt, Human
cuugcugcccugugcuccuc

SEQ ID NO: 3158135 - RNA, 15 nt, Human
cuugcuuuuaaaauc

SEQ ID NO: 3158136 - RNA, 19 nt, Human
cuuggagccugcagagcug

SEQ ID NO: 3158137 - RNA, 20 nt, Human
cuuggagccugcagagcugc

SEQ ID NO: 3158138 - RNA, 15 nt, Human
cuuggagccugcaga

SEQ ID NO: 3158139 - RNA, 16 nt, Human
cuuggagccugcagag

SEQ ID NO: 3158140 - RNA, 17 nt, Human
cuuggagccugcagagc

SEQ ID NO: 3158141 - RNA, 18 nt, Human
cuuggagccugcagagcu

SEQ ID NO: 3158142 - RNA, 13 nt, Human
cuuggagccugca

SEQ ID NO: 3158143 - RNA, 18 nt, Human
cuuguauuauguguguuu

SEQ ID NO: 3158144 - RNA, 18 nt, Human
cuugucacgccagacuuc

SEQ ID NO: 3158145 - RNA, 23 nt, Human
cuugucacgccagacuucccacg

SEQ ID NO: 3158146 - RNA, 13 nt, Human
cuuguauuaugug

SEQ ID NO: 3158147 - RNA, 20 nt, Human
cuuggggaguuuaggguggg

SEQ ID NO: 3158148 - RNA, 21 nt, Human
cuuggggaguuuagggugggg

SEQ ID NO: 3158149 - RNA, 18 nt, Human
cuuguaaagacuguagaa

SEQ ID NO: 3158150 - RNA, 19 nt, Human
cuuuuuuaucaugugaaau

SEQ ID NO: 3158151 - RNA, 16 nt, Human
cuuuucuuucuaccaa

SEQ ID NO: 3158152 - RNA, 12 nt, Human
cuuuggacuugu

SEQ ID NO: 3158153 - RNA, 16 nt, Human
cuuuggaacaagaugg

SEQ ID NO: 3158154 - RNA, 21 nt, Human
cuuuauuuucuauaauuuaaa

SEQ ID NO: 3158155 - RNA, 19 nt, Human
cuuuauuuuguguuuagga

SEQ ID NO: 3158156 - RNA, 21 nt, Human
cuuuccacuccuccuagccac

SEQ ID NO: 3158157 - RNA, 18 nt, Human
cuuuccacuccuccuagc

SEQ ID NO: 3158158 - RNA, 23 nt, Human
cuuuccaaagccaaugugaacag

SEQ ID NO: 3158159 - RNA, 20 nt, Human
cuuuccaaagccaaugugaa

SEQ ID NO: 3158160 - RNA, 19 nt, Human
cuuucuuccaaacaggcuc

SEQ ID NO: 3158161 - RNA, 13 nt, Human
cuuucuuccaaac

SEQ ID NO: 3158162 - RNA, 23 nt, Human
gaaaguuauugauaaguucauac

SEQ ID NO: 3158163 - RNA, 19 nt, Human
gaaacuaggugcauauuua

SEQ ID NO: 3158164 - RNA, 20 nt, Human
gaaacuaggugcauauuuau

SEQ ID NO: 3158165 - RNA, 14 nt, Human
gaacaucccuccug

SEQ ID NO: 3158166 - RNA, 20 nt, Human
gaaccaaagcgaauuuuaaa

SEQ ID NO: 3158167 - RNA, 23 nt, Human
gaaccaaagcgaauuuuaaaaga

SEQ ID NO: 3158168 - RNA, 11 nt, Human
gaaccaaagcg

SEQ ID NO: 3158169 - RNA, 17 nt, Human
gaaauuauauaaguauu

SEQ ID NO: 3158170 - RNA, 23 nt, Human
gaaauuauauaaguauucuaaau

SEQ ID NO: 3158171 - RNA, 23 nt, Human
gaaauuaguacuccccuccuuga

SEQ ID NO: 3158172 - RNA, 21 nt, Human
gaaggugaggagcuugaaacc

SEQ ID NO: 3158173 - RNA, 21 nt, Human
gaaggaucccaugagcuccuu

SEQ ID NO: 3158174 - RNA, 23 nt, Human
gaaggaaccaaagcgaauuuuaa

SEQ ID NO: 3158175 - RNA, 22 nt, Human
gaacuuguaaaggaauuuaaaa

SEQ ID NO: 3158176 - RNA, 20 nt, Human
gaagaguauuuuugacagaa

SEQ ID NO: 3158177 - RNA, 13 nt, Human
gaagaaguguguc

SEQ ID NO: 3158178 - RNA, 17 nt, Human
gaagauugagauguguu

SEQ ID NO: 3158179 - RNA, 22 nt, Human
gaagauugagauguguucacaa

SEQ ID NO: 3158180 - RNA, 15 nt, Human
cugcucugugcccac

SEQ ID NO: 3158181 - RNA, 14 nt, Human
cugcugccugcuuu

SEQ ID NO: 3158182 - RNA, 23 nt, Human
cugcugccugcuuuuuauggccu

SEQ ID NO: 3158183 - RNA, 22 nt, Human
cugccugcuuuuuauggccugu

SEQ ID NO: 3158184 - RNA, 22 nt, Human
cugcgggcuggguguggucucc

SEQ ID NO: 3158185 - RNA, 23 nt, Human
cugcagagcugcgggcugggugu

SEQ ID NO: 3158186 - RNA, 23 nt, Human
cugcaggucccuaauaaagcugu

SEQ ID NO: 3158187 - RNA, 19 nt, Human
cugcaggucccuaauaaag

SEQ ID NO: 3158188 - RNA, 20 nt, Human
cugcaggucccuaauaaagc

SEQ ID NO: 3158189 - RNA, 21 nt, Human
cugcaggucccuaauaaagcu

SEQ ID NO: 3158190 - RNA, 22 nt, Human
cugcaggucccuaauaaagcug

SEQ ID NO: 3158191 - RNA, 11 nt, Human
cugcagguccc

SEQ ID NO: 3158192 - RNA, 12 nt, Human
cugcaggucccu

SEQ ID NO: 3158193 - RNA, 13 nt, Human
cugcaggucccua

SEQ ID NO: 3158194 - RNA, 14 nt, Human
cugcaggucccuaa

SEQ ID NO: 3158195 - RNA, 15 nt, Human
cugcaggucccuaau

SEQ ID NO: 3158196 - RNA, 16 nt, Human
cugcaggucccuaaua

SEQ ID NO: 3158197 - RNA, 17 nt, Human
cugcaggucccuaauaa

SEQ ID NO: 3158198 - RNA, 18 nt, Human
cugcaggucccuaauaaa

SEQ ID NO: 3158199 - RNA, 19 nt, Human
cugcccgggagcucaggaa

SEQ ID NO: 3158200 - RNA, 18 nt, Human
cugcccgggagcucagga

SEQ ID NO: 3158201 - RNA, 11 nt, Human
cugccaggaga

SEQ ID NO: 3158202 - RNA, 19 nt, Human
cugccagacccccuggaga

SEQ ID NO: 3158203 - RNA, 17 nt, Human
cugccagacccccugga

SEQ ID NO: 3158204 - RNA, 18 nt, Human
cuggcuguggccuaaccu

SEQ ID NO: 3158205 - RNA, 19 nt, Human
cugggaggagggcaggcau

SEQ ID NO: 3158206 - RNA, 19 nt, Human
cugggagccuacccacccc

SEQ ID NO: 3158207 - RNA, 22 nt, Human
cugggagccuacccacccccag

SEQ ID NO: 3158208 - RNA, 16 nt, Human
cugggagccuacccac

SEQ ID NO: 3158209 - RNA, 17 nt, Human
cugggaggcucuggagc

SEQ ID NO: 3158210 - RNA, 18 nt, Human
cugggaggcucuggagcc

SEQ ID NO: 3158211 - RNA, 20 nt, Human
cugggaggcucuggagccca

SEQ ID NO: 3158212 - RNA, 21 nt, Human
cugggaggcucuggagcccac

SEQ ID NO: 3158213 - RNA, 16 nt, Human
cuggcacagccuggcu

SEQ ID NO: 3158214 - RNA, 21 nt, Human
cuggcacagccuggcuguggc

SEQ ID NO: 3158215 - RNA, 15 nt, Human
cuggcacagccuggc

SEQ ID NO: 3158216 - RNA, 23 nt, Human
cuggcacagccuggcuguggccu

SEQ ID NO: 3158217 - RNA, 20 nt, Human
cuggaagugcuaauuuugaa

SEQ ID NO: 3158218 - RNA, 18 nt, Human
cuguaaggcaaucauggu

SEQ ID NO: 3158219 - RNA, 22 nt, Human
cugggucgcccuggacugugug

SEQ ID NO: 3158220 - RNA, 17 nt, Human
cugggucgcccuggacu

SEQ ID NO: 3158221 - RNA, 18 nt, Human
cugggucgcccuggacug

SEQ ID NO: 3158222 - RNA, 16 nt, Human
cugggucgcccuggac

SEQ ID NO: 3158223 - RNA, 12 nt, Human
cuggucagccca

SEQ ID NO: 3158224 - RNA, 13 nt, Human
cuggucagcccaa

SEQ ID NO: 3158225 - RNA, 14 nt, Human
cuguaccucugccu

SEQ ID NO: 3158226 - RNA, 21 nt, Human
cuccucgagaucccaacacug

SEQ ID NO: 3158227 - RNA, 24 nt, Human
cuccucgagaucccaacacugcca

SEQ ID NO: 3158228 - RNA, 17 nt, Human
cuccucgagaucccaac

SEQ ID NO: 3158229 - RNA, 20 nt, Human
cuccauccuacccccugugc

SEQ ID NO: 3158230 - RNA, 22 nt, Human
cuccauccuacccccugugccu

SEQ ID NO: 3158231 - RNA, 23 nt, Human
cuccauccuacccccugugccuu

SEQ ID NO: 3158232 - RNA, 18 nt, Human
cuccauccuacccccugu

SEQ ID NO: 3158233 - RNA, 20 nt, Human
cucuaccucauaucaguuug

SEQ ID NO: 3158234 - RNA, 18 nt, Human
cucuacugggagccuacc

SEQ ID NO: 3158235 - RNA, 21 nt, Human
cucuacugggagccuacccac

SEQ ID NO: 3158236 - RNA, 21 nt, Human
cucuccugauagucuuucagu

SEQ ID NO: 3158237 - RNA, 18 nt, Human
cucuccugucucccuccu

SEQ ID NO: 3158238 - RNA, 15 nt, Human
cucuccugucucccu

SEQ ID NO: 3158239 - RNA, 17 nt, Human
cucuccugucucccucc

SEQ ID NO: 3158240 - RNA, 22 nt, Human
cucuccacucaugugacucuuu

SEQ ID NO: 3158241 - RNA, 21 nt, Human
cucuccacucaugugacucuu

SEQ ID NO: 3158242 - RNA, 14 nt, Human
cugaggcagguccc

SEQ ID NO: 3158243 - RNA, 17 nt, Human
cugaggcagguccccag

SEQ ID NO: 3158244 - RNA, 18 nt, Human
cugaggcagguccccaga

SEQ ID NO: 3158245 - RNA, 19 nt, Human
cugaggcagguccccagac

SEQ ID NO: 3158246 - RNA, 17 nt, Human
cugaggaucagaguaau

SEQ ID NO: 3158247 - RNA, 16 nt, Human
cugaggcaagagaauu

SEQ ID NO: 3158248 - RNA, 19 nt, Human
cugaggaucagaguaaucc

SEQ ID NO: 3158249 - RNA, 11 nt, Human
cugagaaauuu

SEQ ID NO: 3158250 - RNA, 14 nt, Human
cugagaaauuuaua

SEQ ID NO: 3158251 - RNA, 15 nt, Human
cugacuaugacauaa

SEQ ID NO: 3158252 - RNA, 11 nt, Human
cugacagauuu

SEQ ID NO: 3158253 - RNA, 15 nt, Human
cugacagauuuccau

SEQ ID NO: 3158254 - RNA, 19 nt, Human
cucuggagcccacuguacu

SEQ ID NO: 3158255 - RNA, 22 nt, Human
cucugugcccacccuccacucu

SEQ ID NO: 3158256 - RNA, 23 nt, Human
cucuuggggaguuuagggugggg

SEQ ID NO: 3158257 - RNA, 21 nt, Human
cucuuggggaguuuagggugg

SEQ ID NO: 3158258 - RNA, 16 nt, Human
cgcccuggacugugug

SEQ ID NO: 3158259 - RNA, 15 nt, Human
cggcuggacuuggag

SEQ ID NO: 3158260 - RNA, 17 nt, Human
cggugagcuacaaaugc

SEQ ID NO: 3158261 - RNA, 15 nt, Human
cgggucaucuguacc

SEQ ID NO: 3158262 - RNA, 22 nt, Human
cgggucaucuguaccucugccu

SEQ ID NO: 3158263 - RNA, 19 nt, Human
cggggccugggcaggaggg

SEQ ID NO: 3158264 - RNA, 17 nt, Human
cggggccugggcaggag

SEQ ID NO: 3158265 - RNA, 18 nt, Human
cgggggcagucugagaga

SEQ ID NO: 3158266 - RNA, 21 nt, Human
cgggggcagucugagagaggc

SEQ ID NO: 3158267 - RNA, 17 nt, Human
cgggggcagucugagag

SEQ ID NO: 3158268 - RNA, 17 nt, Human
cgggagccugacccuca

SEQ ID NO: 3158269 - RNA, 12 nt, Human
cggcugggagga

SEQ ID NO: 3158270 - RNA, 23 nt, Human
cguggcuguggcauccagagucc

SEQ ID NO: 3158271 - RNA, 23 nt, Human
cuaaauuugaauguuaagcagau

SEQ ID NO: 3158272 - RNA, 15 nt, Human
cuaacaugauuuggg

SEQ ID NO: 3158273 - RNA, 17 nt, Human
cuaaauauauuuuaaga

SEQ ID NO: 3158274 - RNA, 18 nt, Human
cuaaauauauuuuaagac

SEQ ID NO: 3158275 - RNA, 20 nt, Human
cuaaauauauuuuaagacga

SEQ ID NO: 3158276 - RNA, 16 nt, Human
cguuguccucagcccc

SEQ ID NO: 3158277 - RNA, 18 nt, Human
cuauuuuaauaaacacuc

SEQ ID NO: 3158278 - RNA, 22 nt, Human
cuauuuuaauaaacacucuuga

SEQ ID NO: 3158279 - RNA, 21 nt, Human
cuaugacauaaaaacaacuuu

SEQ ID NO: 3158280 - RNA, 16 nt, Human
cuaguaugaaauuaua

SEQ ID NO: 3158281 - RNA, 17 nt, Human
cuagcagaaaucuagaa

SEQ ID NO: 3158282 - RNA, 20 nt, Human
cuaucuguuuacaguguucc

SEQ ID NO: 3158283 - RNA, 17 nt, Human
cuaucuguuuacagugu

SEQ ID NO: 3158284 - RNA, 21 nt, Human
cuaucuguuuacaguguuccg

SEQ ID NO: 3158285 - RNA, 18 nt, Human
cuaugacauaaaaacaac

SEQ ID NO: 3158286 - RNA, 15 nt, Human
cuacuugagaggcug

SEQ ID NO: 3158287 - RNA, 21 nt, Human
cuacuguaaggcaaucauggu

SEQ ID NO: 3158288 - RNA, 13 nt, Human
cuacccccugugc

SEQ ID NO: 3158289 - RNA, 14 nt, Human
cuacccccugugcc

SEQ ID NO: 3158290 - RNA, 19 nt, Human
cuaauguaauaacugugaa

SEQ ID NO: 3158291 - RNA, 13 nt, Human
cuaauaaagcugu

SEQ ID NO: 3158292 - RNA, 12 nt, Human
cuaauaaagcug

SEQ ID NO: 3158293 - RNA, 18 nt, Human
uuuuuaaagacuuuuaug

SEQ ID NO: 3158294 - RNA, 12 nt, Human
uuuuuaaagacu

SEQ ID NO: 3158295 - RNA, 13 nt, Human
uuuuuaaagacuu

SEQ ID NO: 3158296 - RNA, 18 nt, Human
uuuuguagcacugacaga

SEQ ID NO: 3158297 - RNA, 19 nt, Human
uuuuguagcacugacagau

SEQ ID NO: 3158298 - RNA, 18 nt, Human
uuuucuaaaguaaaaaca

SEQ ID NO: 3158299 - RNA, 20 nt, Human
uuuugaaucucauaauuuau

SEQ ID NO: 3158300 - RNA, 12 nt, Human
uuucuaaaguaa

SEQ ID NO: 3158301 - RNA, 18 nt, Human
uuugaaucaucaagucuu

SEQ ID NO: 3158302 - RNA, 16 nt, Human
uuugaaucucauaauu

SEQ ID NO: 3158303 - RNA, 19 nt, Human
uuugaaucucauaauuuau

SEQ ID NO: 3158304 - RNA, 20 nt, Human
uuugaaucucauaauuuaua

SEQ ID NO: 3158305 - RNA, 21 nt, Human
uuugaaucucauaauuuauac

SEQ ID NO: 3158306 - RNA, 22 nt, Human
uuugaaucucauaauuuauaca

SEQ ID NO: 3158307 - RNA, 20 nt, Human
uuuuaaaagaugcaauguag

SEQ ID NO: 3158308 - RNA, 18 nt, Human
uuuuaaagacuuuuauga

SEQ ID NO: 3158309 - RNA, 15 nt, Human
uuugcaucugaaaau

SEQ ID NO: 3158310 - RNA, 17 nt, Human
uuugaauguaugcuuca

SEQ ID NO: 3158311 - RNA, 22 nt, Human
uuugaauguaugcuucauacag

SEQ ID NO: 3158312 - RNA, 18 nt, Human
gucccuaauaaagcugug

SEQ ID NO: 3158313 - RNA, 20 nt, Human
gucccuaauaaagcugugug

SEQ ID NO: 3158314 - RNA, 16 nt, Human
gucccugaagagaagg

SEQ ID NO: 3158315 - RNA, 18 nt, Human
gucccugaggcagguccc

SEQ ID NO: 3158316 - RNA, 22 nt, Human
gucccugaggcagguccccaga

SEQ ID NO: 3158317 - RNA, 15 nt, Human
gucccuaauaaagcu

SEQ ID NO: 3158318 - RNA, 16 nt, Human
gucccuaauaaagcug

SEQ ID NO: 3158319 - RNA, 17 nt, Human
gucccuaauaaagcugu

SEQ ID NO: 3158320 - RNA, 22 nt, Human
gucagcugggacaccccgacuu

SEQ ID NO: 3158321 - RNA, 13 nt, Human
guaugaaauuaua

SEQ ID NO: 3158322 - RNA, 23 nt, Human
guaugaaauuauauaaguauucu

SEQ ID NO: 3158323 - RNA, 14 nt, Human
guagcacugacaga

SEQ ID NO: 3158324 - RNA, 15 nt, Human
guagcacugacagau

SEQ ID NO: 3158325 - RNA, 17 nt, Human
guauaauucacauugua

SEQ ID NO: 3158326 - RNA, 19 nt, Human
guagugauuuuuaugccac

SEQ ID NO: 3158327 - RNA, 14 nt, Human
guagguugggagaa

SEQ ID NO: 3158328 - RNA, 21 nt, Human
gugccaggauggaaugauggg

SEQ ID NO: 3158329 - RNA, 14 nt, Human
gugccuuuugccau

SEQ ID NO: 3158330 - RNA, 21 nt, Human
gugauuuuuaugccaccugaa

SEQ ID NO: 3158331 - RNA, 22 nt, Human
gugaauucuugaaggaaaauga

SEQ ID NO: 3158332 - RNA, 18 nt, Human
gugaauucuugaaggaaa

SEQ ID NO: 3158333 - RNA, 21 nt, Human
gugaccuuccaagagccugag

SEQ ID NO: 3158334 - RNA, 22 nt, Human
gugaccuuccaagagccugaga

SEQ ID NO: 3158335 - RNA, 21 nt, Human
gugacuauggagcugagcagg

SEQ ID NO: 3158336 - RNA, 18 nt, Human
gugaggagcuugaaaccc

SEQ ID NO: 3158337 - RNA, 19 nt, Human
gugauauaaguguguguuu

SEQ ID NO: 3158338 - RNA, 13 nt, Human
gucugagagaggc

SEQ ID NO: 3158339 - RNA, 14 nt, Human
gucugagagaggcc

SEQ ID NO: 3158340 - RNA, 15 nt, Human
gucugagagaggcca

SEQ ID NO: 3158341 - RNA, 18 nt, Human
gucugagagaggccauuc

SEQ ID NO: 3158342 - RNA, 22 nt, Human
gucuguguguuuaugugugugu

SEQ ID NO: 3158343 - RNA, 21 nt, Human
gucuguguguuuaugugugug

SEQ ID NO: 3158344 - RNA, 11 nt, Human
gucuguguguu

SEQ ID NO: 3158345 - RNA, 20 nt, Human
gucuguguguguguaugugg

SEQ ID NO: 3158346 - RNA, 16 nt, Human
gucuguguguguguau

SEQ ID NO: 3158347 - RNA, 12 nt, Human
gucugugugugu

SEQ ID NO: 3158348 - RNA, 11 nt, Human
gucugugugug

SEQ ID NO: 3158349 - RNA, 17 nt, Human
gucuugguuccagccug

SEQ ID NO: 3158350 - RNA, 19 nt, Human
gucuugguuccagccugcc

SEQ ID NO: 3158351 - RNA, 16 nt, Human
gucuugguuccagccu

SEQ ID NO: 3158352 - RNA, 17 nt, Human
gucucuggaauuugaaa

SEQ ID NO: 3158353 - RNA, 21 nt, Human
gucucuggauuauauuaugaa

SEQ ID NO: 3158354 - RNA, 18 nt, Human
gucgucaaagcugaaaug

SEQ ID NO: 3158355 - RNA, 21 nt, Human
gucuaagauaguaacaaugaa

SEQ ID NO: 3158356 - RNA, 13 nt, Human
gucuaaauuugaa

SEQ ID NO: 3158357 - RNA, 13 nt, Human
gucccugccugga

SEQ ID NO: 3158358 - RNA, 18 nt, Human
guucaauaauaaauauuu

SEQ ID NO: 3158359 - RNA, 17 nt, Human
guucacucuuggagccu

SEQ ID NO: 3158360 - RNA, 18 nt, Human
guucacucuuggagccug

SEQ ID NO: 3158361 - RNA, 19 nt, Human
guucacucuuggagccugc

SEQ ID NO: 3158362 - RNA, 20 nt, Human
guucacucuuggagccugca

SEQ ID NO: 3158363 - RNA, 24 nt, Human
guucacucuuggagccugcagagc

SEQ ID NO: 3158364 - RNA, 16 nt, Human
guuccuagccaccgcc

SEQ ID NO: 3158365 - RNA, 15 nt, Human
guuccagccugccac

SEQ ID NO: 3158366 - RNA, 13 nt, Human
guuccagccugcc

SEQ ID NO: 3158367 - RNA, 14 nt, Human
guuccagccugcca

SEQ ID NO: 3158368 - RNA, 14 nt, Human
guuccagcaccaca

SEQ ID NO: 3158369 - RNA, 14 nt, Human
guugcaacuuugua

SEQ ID NO: 3158370 - RNA, 16 nt, Human
guugcaacuuuguaua

SEQ ID NO: 3158371 - RNA, 13 nt, Human
guucugccaggag

SEQ ID NO: 3158372 - RNA, 14 nt, Human
guucugccaggaga

SEQ ID NO: 3158373 - RNA, 12 nt, Human
guucugccagga

SEQ ID NO: 3158374 - RNA, 18 nt, Human
guguuuuucauaaagcag

SEQ ID NO: 3158375 - RNA, 19 nt, Human
guguguuuuaaaaugagaa

SEQ ID NO: 3158376 - RNA, 13 nt, Human
guguguuuuaaaa

SEQ ID NO: 3158377 - RNA, 16 nt, Human
guguguuuuaaaauga

SEQ ID NO: 3158378 - RNA, 14 nt, Human
guguguuuuucaua

SEQ ID NO: 3158379 - RNA, 17 nt, Human
guuaaacucgcucacug

SEQ ID NO: 3158380 - RNA, 16 nt, Human
gugugcucaggagccc

SEQ ID NO: 3158381 - RNA, 17 nt, Human
gugugcucaggagcccu

SEQ ID NO: 3158382 - RNA, 18 nt, Human
gugugcucaggagcccug

SEQ ID NO: 3158383 - RNA, 19 nt, Human
gugugcucaggagcccugg

SEQ ID NO: 3158384 - RNA, 17 nt, Human
guguguuguguguggga

SEQ ID NO: 3158385 - RNA, 14 nt, Human
guguguugugugug

SEQ ID NO: 3158386 - RNA, 12 nt, Human
guguguugugug

SEQ ID NO: 3158387 - RNA, 15 nt, Human
guguguuuaugugug

SEQ ID NO: 3158388 - RNA, 14 nt, Human
guguguuuaugugu

SEQ ID NO: 3158389 - RNA, 16 nt, Human
guguguuuaugugugu

SEQ ID NO: 3158390 - RNA, 12 nt, Human
guguguuuuaaa

SEQ ID NO: 3158391 - RNA, 17 nt, Human
gugugggaguguguaau

SEQ ID NO: 3158392 - RNA, 17 nt, Human
gugucuggcacagccug

SEQ ID NO: 3158393 - RNA, 14 nt, Human
gugucuggcugcag

SEQ ID NO: 3158394 - RNA, 21 nt, Human
guguccugcaccggggccugg

SEQ ID NO: 3158395 - RNA, 13 nt, Human
gugcuaauuuuga

SEQ ID NO: 3158396 - RNA, 15 nt, Human
gugcuaauuuugaaa

SEQ ID NO: 3158397 - RNA, 17 nt, Human
guggcuggaucugugag

SEQ ID NO: 3158398 - RNA, 13 nt, Human
gugggccuggcca

SEQ ID NO: 3158399 - RNA, 21 nt, Human
guggggagagacgggcccugg

SEQ ID NO: 3158400 - RNA, 13 nt, Human
guggugagaucau

SEQ ID NO: 3158401 - RNA, 18 nt, Human
guggucuccacuggggau

SEQ ID NO: 3158402 - RNA, 20 nt, Human
guguaauuuaaaauugugau

SEQ ID NO: 3158403 - RNA, 23 nt, Human
guguaauuuaaaauugugaugug

SEQ ID NO: 3158404 - RNA, 22 nt, Human
guguaauuuaaaauugugaugu

SEQ ID NO: 3158405 - RNA, 15 nt, Human
guguacuuaacuauu

SEQ ID NO: 3158406 - RNA, 13 nt, Human
uacuuaacuauuc

SEQ ID NO: 3158407 - RNA, 13 nt, Human
uacuugcucuuga

SEQ ID NO: 3158408 - RNA, 14 nt, Human
uacuugcucuugau

SEQ ID NO: 3158409 - RNA, 18 nt, Human
uacuugcucuugaugccu

SEQ ID NO: 3158410 - RNA, 19 nt, Human
uacuugcucuugaugccug

SEQ ID NO: 3158411 - RNA, 15 nt, Human
uacuccccuccuuga

SEQ ID NO: 3158412 - RNA, 21 nt, Human
uacugccuauuuuaauaaaca

SEQ ID NO: 3158413 - RNA, 14 nt, Human
uacugccuauuuua

SEQ ID NO: 3158414 - RNA, 14 nt, Human
uacccagaaaguua

SEQ ID NO: 3158415 - RNA, 23 nt, Human
uacaguucggugagcuacaaaug

SEQ ID NO: 3158416 - RNA, 18 nt, Human
uacaguuccuagguauaa

SEQ ID NO: 3158417 - RNA, 20 nt, Human
uacaggaugaugacuaugga

SEQ ID NO: 3158418 - RNA, 16 nt, Human
uagccccucuccugga

SEQ ID NO: 3158419 - RNA, 17 nt, Human
uagcauggcauauuuuu

SEQ ID NO: 3158420 - RNA, 18 nt, Human
uagcauggcauauuuuuc

SEQ ID NO: 3158421 - RNA, 15 nt, Human
uagcauggcauauuu

SEQ ID NO: 3158422 - RNA, 15 nt, Human
uaggucucaauaccu

SEQ ID NO: 3158423 - RNA, 22 nt, Human
uagguuaauuccaauuauauga

SEQ ID NO: 3158424 - RNA, 22 nt, Human
uauaaacaugcuugcauuauau

SEQ ID NO: 3158425 - RNA, 14 nt, Human
uauaucuuguagcu

SEQ ID NO: 3158426 - RNA, 23 nt, Human
uaucaguuugcuagcagaaaucu

SEQ ID NO: 3158427 - RNA, 20 nt, Human
uauauuuguaaauuuaugug

SEQ ID NO: 3158428 - RNA, 17 nt, Human
uaaaagauaaauauuau

SEQ ID NO: 3158429 - RNA, 22 nt, Human
uaaaacaagcacuaaacaaaga

SEQ ID NO: 3158430 - RNA, 21 nt, Human
uaaaaagacauucuuccaaaa

SEQ ID NO: 3158431 - RNA, 18 nt, Human
uaaaaacaacuuuauacc

SEQ ID NO: 3158432 - RNA, 19 nt, Human
uaaaaacaacuuuauaccc

SEQ ID NO: 3158433 - RNA, 13 nt, Human
uaaaaacaacuuu

SEQ ID NO: 3158434 - RNA, 21 nt, Human
uaaaaacaaagaaauuaugug

SEQ ID NO: 3158435 - RNA, 17 nt, Human
uaaaaacaaagaaauua

SEQ ID NO: 3158436 - RNA, 18 nt, Human
uaaacacucuugaaaaau

SEQ ID NO: 3158437 - RNA, 15 nt, Human
uaaacacucuugaaa

SEQ ID NO: 3158438 - RNA, 17 nt, Human
uaaacacucuugaaaaa

SEQ ID NO: 3158439 - RNA, 14 nt, Human
uaaaguguuugaaa

SEQ ID NO: 3158440 - RNA, 21 nt, Human
uaaaggcccuaucuguuuaca

SEQ ID NO: 3158441 - RNA, 18 nt, Human
uaaagcaggcagaacuca

SEQ ID NO: 3158442 - RNA, 19 nt, Human
guuuaggaacuacugagga

SEQ ID NO: 3158443 - RNA, 16 nt, Human
guuuagaagaagugug

SEQ ID NO: 3158444 - RNA, 17 nt, Human
guuguccucagccccgc

SEQ ID NO: 3158445 - RNA, 23 nt, Human
guuguccucagccccgcguggaa

SEQ ID NO: 3158446 - RNA, 22 nt, Human
guugugugugggaguguguaau

SEQ ID NO: 3158447 - RNA, 16 nt, Human
guugugugugggagug

SEQ ID NO: 3158448 - RNA, 14 nt, Human
guugugugugggag

SEQ ID NO: 3158449 - RNA, 13 nt, Human
guuguguguggga

SEQ ID NO: 3158450 - RNA, 12 nt, Human
guuguguguggg

SEQ ID NO: 3158451 - RNA, 14 nt, Human
guugugaauguugu

SEQ ID NO: 3158452 - RNA, 19 nt, Human
guuucuuuguaaugaaaac

SEQ ID NO: 3158453 - RNA, 18 nt, Human
guuucuuuguaaugaaaa

SEQ ID NO: 3158454 - RNA, 20 nt, Human
guuuucaaaauuguuacaaa

SEQ ID NO: 3158455 - RNA, 15 nt, Human
guuuuaaaaugagaa

SEQ ID NO: 3158456 - RNA, 16 nt, Human
guuuuaaaaugagaaa

SEQ ID NO: 3158457 - RNA, 13 nt, Human
uaaccagaucauu

SEQ ID NO: 3158458 - RNA, 17 nt, Human
uaacugugaaguuuaca

SEQ ID NO: 3158459 - RNA, 13 nt, Human
uaacugugaaguu

SEQ ID NO: 3158460 - RNA, 18 nt, Human
uaacugugaaguuuacau

SEQ ID NO: 3158461 - RNA, 19 nt, Human
uaagaaaucaaagagagaa

SEQ ID NO: 3158462 - RNA, 16 nt, Human
uaaaguugguaaaccu

SEQ ID NO: 3158463 - RNA, 17 nt, Human
uaaaguugguaaaccuu

SEQ ID NO: 3158464 - RNA, 13 nt, Human
uaaauuuauguga

SEQ ID NO: 3158465 - RNA, 22 nt, Human
uaaauuugaauguuaagcagau

SEQ ID NO: 3158466 - RNA, 14 nt, Human
uaaauuugaauguu

SEQ ID NO: 3158467 - RNA, 22 nt, Human
uaaucuacuccuuguaaagacu

SEQ ID NO: 3158468 - RNA, 23 nt, Human
uaauaaucauuggauucugagag

SEQ ID NO: 3158469 - RNA, 22 nt, Human
uaagugccaggauggaaugaug

SEQ ID NO: 3158470 - RNA, 22 nt, Human
uaagugauugcugguuuuaguu

SEQ ID NO: 3158471 - RNA, 21 nt, Human
uaauaacugugaaguuuacau

SEQ ID NO: 3158472 - RNA, 11 nt, Human
uaauaaagcug

SEQ ID NO: 3158473 - RNA, 12 nt, Human
uaauaaagcugu

SEQ ID NO: 3158474 - RNA, 19 nt, Human
uguuuccauauuuuauagg

SEQ ID NO: 3158475 - RNA, 13 nt, Human
uuacauuguaaau

SEQ ID NO: 3158476 - RNA, 12 nt, Human
uuacauuguaaa

SEQ ID NO: 3158477 - RNA, 16 nt, Human
uuaaugauaaguaaau

SEQ ID NO: 3158478 - RNA, 12 nt, Human
uuaagaguaaaa

SEQ ID NO: 3158479 - RNA, 14 nt, Human
uguucauacauauu

SEQ ID NO: 3158480 - RNA, 23 nt, Human
uguucauacauauuuuuguagca

SEQ ID NO: 3158481 - RNA, 12 nt, Human
uguucauacaua

SEQ ID NO: 3158482 - RNA, 17 nt, Human
uguucauaaauaaaguu

SEQ ID NO: 3158483 - RNA, 12 nt, Human
uguguauguggg

SEQ ID NO: 3158484 - RNA, 11 nt, Human
uguguaugugg

SEQ ID NO: 3158485 - RNA, 13 nt, Human
ugugugcucucca

SEQ ID NO: 3158486 - RNA, 15 nt, Human
ugugugggagugugu

SEQ ID NO: 3158487 - RNA, 14 nt, Human
ugugugggagugug

SEQ ID NO: 3158488 - RNA, 18 nt, Human
uguguuuuucauaaagca

SEQ ID NO: 3158489 - RNA, 15 nt, Human
uguguuuuucauaaa

SEQ ID NO: 3158490 - RNA, 16 nt, Human
ugugugggagugugua

SEQ ID NO: 3158491 - RNA, 18 nt, Human
uguuggcacaugccugua

SEQ ID NO: 3158492 - RNA, 12 nt, Human
uguuuaagagac

SEQ ID NO: 3158493 - RNA, 12 nt, Human
uguuuacagugu

SEQ ID NO: 3158494 - RNA, 16 nt, Human
uguucuuuugucccag

SEQ ID NO: 3158495 - RNA, 18 nt, Human
uguguaauuuaaaauugu

SEQ ID NO: 3158496 - RNA, 11 nt, Human
uguguaauuua

SEQ ID NO: 3158497 - RNA, 23 nt, Human
uguguaauuuaaaauugugaugu

SEQ ID NO: 3158498 - RNA, 22 nt, Human
uguguaauuuaaaauugugaug

SEQ ID NO: 3158499 - RNA, 19 nt, Human
uguguaauuuaaaauugug

SEQ ID NO: 3158500 - RNA, 15 nt, Human
uguggccuaaccugc

SEQ ID NO: 3158501 - RNA, 15 nt, Human
uguggaagugugggu

SEQ ID NO: 3158502 - RNA, 15 nt, Human
ugugggaguguguaa

SEQ ID NO: 3158503 - RNA, 14 nt, Human
ugugggagugugua

SEQ ID NO: 3158504 - RNA, 16 nt, Human
ugugccuuuugccauc

SEQ ID NO: 3158505 - RNA, 17 nt, Human
ugugcucaggagcccug

SEQ ID NO: 3158506 - RNA, 15 nt, Human
ugugcucaggagccc

SEQ ID NO: 3158507 - RNA, 16 nt, Human
ugugcucaggagcccu

SEQ ID NO: 3158508 - RNA, 17 nt, Human
ugugccuugucacgcca

SEQ ID NO: 3158509 - RNA, 17 nt, Human
ugugccuuggugugcug

SEQ ID NO: 3158510 - RNA, 19 nt, Human
ugugccuugucacgccaga

SEQ ID NO: 3158511 - RNA, 20 nt, Human
ugugccuugucacgccagac

SEQ ID NO: 3158512 - RNA, 21 nt, Human
ugugaauguugugauguauuc

SEQ ID NO: 3158513 - RNA, 18 nt, Human
ugugaagugaaugaaaca

SEQ ID NO: 3158514 - RNA, 13 nt, Human
ugugauauaagug

SEQ ID NO: 3158515 - RNA, 16 nt, Human
ugugauauaagugugu

SEQ ID NO: 3158516 - RNA, 17 nt, Human
ugucuggcacagccugg

SEQ ID NO: 3158517 - RNA, 21 nt, Human
ugucuuuccacuccuccuagc

SEQ ID NO: 3158518 - RNA, 22 nt, Human
uguauaaaagggacugagaaau

SEQ ID NO: 3158519 - RNA, 22 nt, Human
ugucacccuuaggccagcacca

SEQ ID NO: 3158520 - RNA, 21 nt, Human
uguccucagccccgcguggaa

SEQ ID NO: 3158521 - RNA, 18 nt, Human
uguagccccucuccugga

SEQ ID NO: 3158522 - RNA, 17 nt, Human
uguagauaauacaguuc

SEQ ID NO: 3158523 - RNA, 14 nt, Human
uguaccucugccuc

SEQ ID NO: 3158524 - RNA, 14 nt, Human
uguacgaagaguau

SEQ ID NO: 3158525 - RNA, 22 nt, Human
uguacgaagaguauuuuugaca

SEQ ID NO: 3158526 - RNA, 17 nt, Human
ugcucuccaagcccagu

SEQ ID NO: 3158527 - RNA, 17 nt, Human
ugcucagagcaguguuu

SEQ ID NO: 3158528 - RNA, 15 nt, Human
ugccuggcggggugg

SEQ ID NO: 3158529 - RNA, 9 nt, Human
ugccucucu

SEQ ID NO: 3158530 - RNA, 16 nt, Human
ugcaccggggccuggg

SEQ ID NO: 3158531 - RNA, 22 nt, Human
ugcaccggggccugggcaggag

SEQ ID NO: 3158532 - RNA, 12 nt, Human
ugcaccggggcc

SEQ ID NO: 3158533 - RNA, 11 nt, Human
ugcagagcugc

SEQ ID NO: 3158534 - RNA, 22 nt, Human
ugcagagcagugggccuggcca

SEQ ID NO: 3158535 - RNA, 17 nt, Human
ugcccacccuccacucu

SEQ ID NO: 3158536 - RNA, 17 nt, Human
ugccaaauauaaauaaa

SEQ ID NO: 3158537 - RNA, 18 nt, Human
ugccaaauauaaauaaaa

SEQ ID NO: 3158538 - RNA, 20 nt, Human
ugcauauuuauaaaaauaaa

SEQ ID NO: 3158539 - RNA, 21 nt, Human
ugcauauuuauaaaaauaaaa

SEQ ID NO: 3158540 - RNA, 19 nt, Human
ugccaaauauaaauaaaaa

SEQ ID NO: 3158541 - RNA, 22 nt, Human
ugccaaauauaaauaaaaauaa

SEQ ID NO: 3158542 - RNA, 18 nt, Human
ugccaggauggaaugaug

SEQ ID NO: 3158543 - RNA, 14 nt, Human
ugggaguacaaaag

SEQ ID NO: 3158544 - RNA, 21 nt, Human
ugggagugaggaugucugggc

SEQ ID NO: 3158545 - RNA, 21 nt, Human
ugggacaccccgacuuuuguu

SEQ ID NO: 3158546 - RNA, 14 nt, Human
ugggagauguggaa

SEQ ID NO: 3158547 - RNA, 20 nt, Human
uggguggggggcuucauaca

SEQ ID NO: 3158548 - RNA, 21 nt, Human
uggguggggggcuucauacac

SEQ ID NO: 3158549 - RNA, 18 nt, Human
uggguggggggcuucaua

SEQ ID NO: 3158550 - RNA, 11 nt, Human
ugggggaugua

SEQ ID NO: 3158551 - RNA, 15 nt, Human
ugggggucugugugu

SEQ ID NO: 3158552 - RNA, 18 nt, Human
ugggggucuguguguuua

SEQ ID NO: 3158553 - RNA, 20 nt, Human
uggggauugggccccugcca

SEQ ID NO: 3158554 - RNA, 14 nt, Human
uggaaagaguacuc

SEQ ID NO: 3158555 - RNA, 22 nt, Human
uggaauaauccuaaacauauga

SEQ ID NO: 3158556 - RNA, 18 nt, Human
uggaacucgugucuggca

SEQ ID NO: 3158557 - RNA, 20 nt, Human
uggaaugaugggucaguugu

SEQ ID NO: 3158558 - RNA, 16 nt, Human
uggaaugcuguguuaa

SEQ ID NO: 3158559 - RNA, 16 nt, Human
uccucgagaucccaac

SEQ ID NO: 3158560 - RNA, 23 nt, Human
uccucgagaucccaacacugcca

SEQ ID NO: 3158561 - RNA, 23 nt, Human
ucccaugagcuccuuaaggcucu

SEQ ID NO: 3158562 - RNA, 18 nt, Human
ucccucuacugggagccu

SEQ ID NO: 3158563 - RNA, 22 nt, Human
ucccucuacugggagccuaccc

SEQ ID NO: 3158564 - RNA, 23 nt, Human
ucccucuacugggagccuaccca

SEQ ID NO: 3158565 - RNA, 15 nt, Human
ucuagguaaauuaca

SEQ ID NO: 3158566 - RNA, 19 nt, Human
ucuacuccuuguaaagacu

SEQ ID NO: 3158567 - RNA, 16 nt, Human
ucucauaauuuauaca

SEQ ID NO: 3158568 - RNA, 22 nt, Human
ucucauaauuuauacaggucau

SEQ ID NO: 3158569 - RNA, 19 nt, Human
uccugucccucauccauag

SEQ ID NO: 3158570 - RNA, 20 nt, Human
ucagaucauuaucagccugu

SEQ ID NO: 3158571 - RNA, 22 nt, Human
ucaggagaguagaacagauaau

SEQ ID NO: 3158572 - RNA, 23 nt, Human
ucagccuccauccuacccccugu

SEQ ID NO: 3158573 - RNA, 19 nt, Human
ucagugugucuaaauuuga

SEQ ID NO: 3158574 - RNA, 24 nt, Human
ucauggacuucugccagcauaaua

SEQ ID NO: 3158575 - RNA, 12 nt, Human
ucaucuuucuuc

SEQ ID NO: 3158576 - RNA, 14 nt, Human
ucaucuuucuucca

SEQ ID NO: 3158577 - RNA, 17 nt, Human
ucaucuuucuuccaaac

SEQ ID NO: 3158578 - RNA, 17 nt, Human
ucaguucucuucacuca

SEQ ID NO: 3158579 - RNA, 14 nt, Human
ucaguucucuucac

SEQ ID NO: 3158580 - RNA, 14 nt, Human
ucccaacacugcca

SEQ ID NO: 3158581 - RNA, 15 nt, Human
ucccaacacugccag

SEQ ID NO: 3158582 - RNA, 16 nt, Human
ucccaacacugccagc

SEQ ID NO: 3158583 - RNA, 15 nt, Human
uccaagcaaauguga

SEQ ID NO: 3158584 - RNA, 17 nt, Human
uccaagcaaaugugaau

SEQ ID NO: 3158585 - RNA, 14 nt, Human
uccaagagccugag

SEQ ID NO: 3158586 - RNA, 13 nt, Human
uccaagagccuga

SEQ ID NO: 3158587 - RNA, 22 nt, Human
uccaagcccaguucagcuuggg

SEQ ID NO: 3158588 - RNA, 15 nt, Human
uccagagucccugcc

SEQ ID NO: 3158589 - RNA, 17 nt, Human
uccacuuuaucuugaau

SEQ ID NO: 3158590 - RNA, 15 nt, Human
uccacuuuaucuuga

SEQ ID NO: 3158591 - RNA, 18 nt, Human
ucuggugaccuuccaaga

SEQ ID NO: 3158592 - RNA, 23 nt, Human
ucuggugaccuuccaagagccug

SEQ ID NO: 3158593 - RNA, 16 nt, Human
ucuggugaccuuccaa

SEQ ID NO: 3158594 - RNA, 12 nt, Human
ucuggagcccac

SEQ ID NO: 3158595 - RNA, 16 nt, Human
ucuggagcccacugua

SEQ ID NO: 3158596 - RNA, 22 nt, Human
ucuggagcccacuguacuugcu

SEQ ID NO: 3158597 - RNA, 15 nt, Human
ucuggcugcagagca

SEQ ID NO: 3158598 - RNA, 14 nt, Human
ucuggcugcagagc

SEQ ID NO: 3158599 - RNA, 14 nt, Human
ucuggaauuugaaa

SEQ ID NO: 3158600 - RNA, 12 nt, Human
ucugagagcugu

SEQ ID NO: 3158601 - RNA, 17 nt, Human
ucuugaacugagcuugg

SEQ ID NO: 3158602 - RNA, 15 nt, Human
ucuugaacugagcuu

SEQ ID NO: 3158603 - RNA, 18 nt, Human
ucuugaacugagcuugga

SEQ ID NO: 3158604 - RNA, 19 nt, Human
ucuugccaaauauaaauaa

SEQ ID NO: 3158605 - RNA, 18 nt, Human
ucuuguagcuuuaucaaa

SEQ ID NO: 3158606 - RNA, 13 nt, Human
ucuuauaauuuaa

SEQ ID NO: 3158607 - RNA, 14 nt, Human
ucuuauaauuuaaa

SEQ ID NO: 3158608 - RNA, 11 nt, Human
ucugugugugu

SEQ ID NO: 3158609 - RNA, 22 nt, Human
ucuucauuaccucagugagaag

SEQ ID NO: 3158610 - RNA, 19 nt, Human
ucuuuccaaccggcuuugu

SEQ ID NO: 3158611 - RNA, 19 nt, Human
ugaaaauuauuuuguucau

SEQ ID NO: 3158612 - RNA, 14 nt, Human
ugaaaauuaacaug

SEQ ID NO: 3158613 - RNA, 18 nt, Human
ugaaaaccacauuggaga

SEQ ID NO: 3158614 - RNA, 23 nt, Human
ugaaacacucaguuguucaauaa

SEQ ID NO: 3158615 - RNA, 15 nt, Human
ugaaacacuuugcau

SEQ ID NO: 3158616 - RNA, 22 nt, Human
ugaaaauuauuuuguucauaca

SEQ ID NO: 3158617 - RNA, 23 nt, Human
ugaaaauuauuuuguucauacau

SEQ ID NO: 3158618 - RNA, 13 nt, Human
ugaggcagguccc

SEQ ID NO: 3158619 - RNA, 19 nt, Human
ugaggaucagaguaaucca

SEQ ID NO: 3158620 - RNA, 13 nt, Human
ugaggaucagagu

SEQ ID NO: 3158621 - RNA, 17 nt, Human
ugaggaucagaguaauc

SEQ ID NO: 3158622 - RNA, 19 nt, Human
ugacucuuuccaaccggcu

SEQ ID NO: 3158623 - RNA, 13 nt, Human
ugacucuuuccaa

SEQ ID NO: 3158624 - RNA, 14 nt, Human
ugacucuuuccaac

SEQ ID NO: 3158625 - RNA, 16 nt, Human
ugacucuuuccaaccg

SEQ ID NO: 3158626 - RNA, 20 nt, Human
ugacaaagguaaaucagacu

SEQ ID NO: 3158627 - RNA, 22 nt, Human
ugacaacuucccagugaauucu

SEQ ID NO: 3158628 - RNA, 21 nt, Human
ugacagaauauguuucaaacu

SEQ ID NO: 3158629 - RNA, 22 nt, Human
ugacagaauauguuucaaacuu

SEQ ID NO: 3158630 - RNA, 18 nt, Human
ugacagaauauguuucaa

SEQ ID NO: 3158631 - RNA, 23 nt, Human
ugacagaauauguuucaaacuuu

SEQ ID NO: 3158632 - RNA, 13 nt, Human
ugaaucucauaau

SEQ ID NO: 3158633 - RNA, 20 nt, Human
ugaaucucauaauuuauaca

SEQ ID NO: 3158634 - RNA, 20 nt, Human
ugaaguuuacauuguaaaua

SEQ ID NO: 3158635 - RNA, 16 nt, Human
ugaaguuuacauugua

SEQ ID NO: 3158636 - RNA, 14 nt, Human
ugaaguuuacauug

SEQ ID NO: 3158637 - RNA, 22 nt, Human
ugaagagaagggcagggcugag

SEQ ID NO: 3158638 - RNA, 20 nt, Human
ugaagagaagggcagggcug

SEQ ID NO: 3158639 - RNA, 15 nt, Human
ugaaggaaaaugaua

SEQ ID NO: 3158640 - RNA, 16 nt, Human
ugaagcuuuuauguga

SEQ ID NO: 3158641 - RNA, 21 nt, Human
ugaagcuuuuaugugaaacau

SEQ ID NO: 3158642 - RNA, 16 nt, Human
ugaaggaaccaaagcg

SEQ ID NO: 3158643 - RNA, 13 nt, Human
ugaaacauguuuc

SEQ ID NO: 3158644 - RNA, 16 nt, Human
ugaaacacuuugcaua

SEQ ID NO: 3158645 - RNA, 22 nt, Human
cuugacaaagucaagccacaug

SEQ ID NO: 3158646 - RNA, 22 nt, Human
cuuugagguggaagagggcugc

SEQ ID NO: 3158647 - RNA, 16 nt, Human
cuuugagguggaagag

SEQ ID NO: 3158648 - RNA, 17 nt, Human
cuuugagguggaagagg

SEQ ID NO: 3158649 - RNA, 14 nt, Human
cuuugagguggaag

SEQ ID NO: 3158650 - RNA, 18 nt, Human
cuucaucugacuaugaca

SEQ ID NO: 3158651 - RNA, 12 nt, Human
cuucaucugacu

SEQ ID NO: 3158652 - RNA, 17 nt, Human
cugcaggaaauggcugu

SEQ ID NO: 3158653 - RNA, 18 nt, Human
cugcaccggggccugggc

SEQ ID NO: 3158654 - RNA, 19 nt, Human
cugcaccggggccugggca

SEQ ID NO: 3158655 - RNA, 14 nt, Human
cugcaccggggccu

SEQ ID NO: 3158656 - RNA, 16 nt, Human
cugcaccggggccugg

SEQ ID NO: 3158657 - RNA, 16 nt, Human
cugcaaauccuugugg

SEQ ID NO: 3158658 - RNA, 19 nt, Human
cugcaaauccuugugggaa

SEQ ID NO: 3158659 - RNA, 23 nt, Human
cuggacugugugcucaggagccc

SEQ ID NO: 3158660 - RNA, 19 nt, Human
cuggacugugugcucagga

SEQ ID NO: 3158661 - RNA, 22 nt, Human
cuggacugugugcucaggagcc

SEQ ID NO: 3158662 - RNA, 14 nt, Human
cuggaucugugagg

SEQ ID NO: 3158663 - RNA, 17 nt, Human
cugggagaaaugaaaaa

SEQ ID NO: 3158664 - RNA, 16 nt, Human
cugggagaaaugaaaa

SEQ ID NO: 3158665 - RNA, 13 nt, Human
cuggcccugugcc

SEQ ID NO: 3158666 - RNA, 12 nt, Human
cuggugcagugg

SEQ ID NO: 3158667 - RNA, 13 nt, Human
cugggcaggaggg

SEQ ID NO: 3158668 - RNA, 14 nt, Human
gacagugaaagaaa

SEQ ID NO: 3158669 - RNA, 23 nt, Human
gacucacuuaucccaagagaaug

SEQ ID NO: 3158670 - RNA, 22 nt, Human
gacugugugcucaggagcccug

SEQ ID NO: 3158671 - RNA, 12 nt, Human
gaaccgaggcag

SEQ ID NO: 3158672 - RNA, 15 nt, Human
gaaccgaggcaggga

SEQ ID NO: 3158673 - RNA, 20 nt, Human
gaacugcugggcuuggcagc

SEQ ID NO: 3158674 - RNA, 17 nt, Human
gaacugcugggcuuggc

SEQ ID NO: 3158675 - RNA, 20 nt, Human
gaagcaaugcuucaucccuu

SEQ ID NO: 3158676 - RNA, 20 nt, Human
gaagcuaucguaaaauuaag

SEQ ID NO: 3158677 - RNA, 22 nt, Human
gaauauugcuuuggucauauga

SEQ ID NO: 3158678 - RNA, 14 nt, Human
gaauauguuucaaa

SEQ ID NO: 3158679 - RNA, 15 nt, Human
gaauauguuucaaac

SEQ ID NO: 3158680 - RNA, 20 nt, Human
gaauauguuucaaacuuugg

SEQ ID NO: 3158681 - RNA, 24 nt, Human
gaagugugggucugugugugugua

SEQ ID NO: 3158682 - RNA, 21 nt, Human
gaagugugggucugugugugu

SEQ ID NO: 3158683 - RNA, 14 nt, Human
gauucugagagcug

SEQ ID NO: 3158684 - RNA, 14 nt, Human
gauuauauuaugaa

SEQ ID NO: 3158685 - RNA, 14 nt, Human
gaugguucuagcau

SEQ ID NO: 3158686 - RNA, 18 nt, Human
gcaagucagaauagaaau

SEQ ID NO: 3158687 - RNA, 16 nt, Human
gcaccggggccugggc

SEQ ID NO: 3158688 - RNA, 14 nt, Human
gcaccggggccugg

SEQ ID NO: 3158689 - RNA, 17 nt, Human
gaguccaucagccucca

SEQ ID NO: 3158690 - RNA, 18 nt, Human
gagucagggagagcugaa

SEQ ID NO: 3158691 - RNA, 22 nt, Human
gaggugcuucuaguucugccag

SEQ ID NO: 3158692 - RNA, 23 nt, Human
gaggugcuucuaguucugccagg

SEQ ID NO: 3158693 - RNA, 17 nt, Human
gagguggaagagggcug

SEQ ID NO: 3158694 - RNA, 20 nt, Human
gagguggaagagggcugcaa

SEQ ID NO: 3158695 - RNA, 9 nt, Human
gagggcugc

SEQ ID NO: 3158696 - RNA, 16 nt, Human
gagggcugccuuugga

SEQ ID NO: 3158697 - RNA, 18 nt, Human
gaggcugcagccaggcca

SEQ ID NO: 3158698 - RNA, 13 nt, Human
gaggcaggucccc

SEQ ID NO: 3158699 - RNA, 16 nt, Human
gaggcagguccccaga

SEQ ID NO: 3158700 - RNA, 12 nt, Human
gaggcagguccc

SEQ ID NO: 3158701 - RNA, 18 nt, Human
gaggcuacuguaaggcaa

SEQ ID NO: 3158702 - RNA, 21 nt, Human
ggaggcucuggagcccacugu

SEQ ID NO: 3158703 - RNA, 15 nt, Human
ggaggcucuggagcc

SEQ ID NO: 3158704 - RNA, 17 nt, Human
ggaggcucuggagccca

SEQ ID NO: 3158705 - RNA, 20 nt, Human
ggaggcucuggagcccacug

SEQ ID NO: 3158706 - RNA, 18 nt, Human
ggagcccacuguacuugc

SEQ ID NO: 3158707 - RNA, 15 nt, Human
ggagcccacuguacu

SEQ ID NO: 3158708 - RNA, 18 nt, Human
ggaccccuggugguucac

SEQ ID NO: 3158709 - RNA, 15 nt, Human
ggagagacgggcccu

SEQ ID NO: 3158710 - RNA, 17 nt, Human
ggagagacgggcccugg

SEQ ID NO: 3158711 - RNA, 17 nt, Human
ggacugugugcucagga

SEQ ID NO: 3158712 - RNA, 23 nt, Human
ggacugugugcucaggagcccug

SEQ ID NO: 3158713 - RNA, 22 nt, Human
ggacugugugcucaggagcccu

SEQ ID NO: 3158714 - RNA, 18 nt, Human
ggagaaaugaaaaaauau

SEQ ID NO: 3158715 - RNA, 16 nt, Human
ggacuuggagguagcu

SEQ ID NO: 3158716 - RNA, 13 nt, Human
ggaugucugggcc

SEQ ID NO: 3158717 - RNA, 15 nt, Human
ggaugguguucaaaa

SEQ ID NO: 3158718 - RNA, 23 nt, Human
ggcaggcaucggggagccgggag

SEQ ID NO: 3158719 - RNA, 18 nt, Human
ggccagcaccaucucuuu

SEQ ID NO: 3158720 - RNA, 15 nt, Human
aaaaagggaggggga

SEQ ID NO: 3158721 - RNA, 20 nt, Human
aaaaagccugcaauuucaua

SEQ ID NO: 3158722 - RNA, 17 nt, Human
ggcuggaucugugaggg

SEQ ID NO: 3158723 - RNA, 20 nt, Human
ggcuccucgagaucccaaca

SEQ ID NO: 3158724 - RNA, 22 nt, Human
aaaaaucugaccaaaacaaaca

SEQ ID NO: 3158725 - RNA, 19 nt, Human
aaaacugcucauaugaugu

SEQ ID NO: 3158726 - RNA, 20 nt, Human
gggaggcagagguugcagug

SEQ ID NO: 3158727 - RNA, 22 nt, Human
aaaagcuccauuuuuagugaaa

SEQ ID NO: 3158728 - RNA, 19 nt, Human
aaaagccugcaauuucaua

SEQ ID NO: 3158729 - RNA, 16 nt, Human
aaaagccuguuuaaga

SEQ ID NO: 3158730 - RNA, 18 nt, Human
aaaagccuguuuaagaga

SEQ ID NO: 3158731 - RNA, 14 nt, Human
aaaauauauuuaau

SEQ ID NO: 3158732 - RNA, 18 nt, Human
aaaauauauaucaaauau

SEQ ID NO: 3158733 - RNA, 16 nt, Human
aaaagggacugagaaa

SEQ ID NO: 3158734 - RNA, 14 nt, Human
gggagggggagagg

SEQ ID NO: 3158735 - RNA, 15 nt, Human
aaagauuuucagaaa

SEQ ID NO: 3158736 - RNA, 14 nt, Human
aaagauuuucagaa

SEQ ID NO: 3158737 - RNA, 14 nt, Human
aaagaugcaaugua

SEQ ID NO: 3158738 - RNA, 21 nt, Human
ggucauauuaauauauuucca

SEQ ID NO: 3158739 - RNA, 18 nt, Human
ggucauauuaauauauuu

SEQ ID NO: 3158740 - RNA, 13 nt, Human
aaaggaauuuaaa

SEQ ID NO: 3158741 - RNA, 14 nt, Human
aaagcgaauuuuaa

SEQ ID NO: 3158742 - RNA, 21 nt, Human
aaagauuuucagaaaauauua

SEQ ID NO: 3158743 - RNA, 20 nt, Human
ggucuugguuccagccugcc

SEQ ID NO: 3158744 - RNA, 21 nt, Human
ggucuugguuccagccugcca

SEQ ID NO: 3158745 - RNA, 21 nt, Human
aaaccacauuggagauguuua

SEQ ID NO: 3158746 - RNA, 23 nt, Human
ggggucuguguguuuaugugugu

SEQ ID NO: 3158747 - RNA, 15 nt, Human
ggggccugggcagga

SEQ ID NO: 3158748 - RNA, 12 nt, Human
ggggccugggca

SEQ ID NO: 3158749 - RNA, 19 nt, Human
aaacauguuucuuuguaau

SEQ ID NO: 3158750 - RNA, 22 nt, Human
aaacauguuucuuuguaaugaa

SEQ ID NO: 3158751 - RNA, 23 nt, Human
aaacauguuucuuuguaaugaaa

SEQ ID NO: 3158752 - RNA, 16 nt, Human
ggggccaggcuggguc

SEQ ID NO: 3158753 - RNA, 13 nt, Human
ggggccaggcugg

SEQ ID NO: 3158754 - RNA, 14 nt, Human
ggggccaggcuggg

SEQ ID NO: 3158755 - RNA, 19 nt, Human
aaacaacuucaauauccaa

SEQ ID NO: 3158756 - RNA, 13 nt, Human
aaacaaagaaauu

SEQ ID NO: 3158757 - RNA, 19 nt, Human
aaaauuuuuaaucuuuaau

SEQ ID NO: 3158758 - RNA, 16 nt, Human
aaaauugugauguguc

SEQ ID NO: 3158759 - RNA, 15 nt, Human
aaaauuuuuaaucuu

SEQ ID NO: 3158760 - RNA, 16 nt, Human
aaaauuuuuaaucuuu

SEQ ID NO: 3158761 - RNA, 15 nt, Human
aaaauauuauguguu

SEQ ID NO: 3158762 - RNA, 14 nt, Human
aaaauauuaugugu

SEQ ID NO: 3158763 - RNA, 21 nt, Human
aaaauauuauguguuuccaua

SEQ ID NO: 3158764 - RNA, 16 nt, Human
gccuacccacccccag

SEQ ID NO: 3158765 - RNA, 17 nt, Human
gccuacccacccccagg

SEQ ID NO: 3158766 - RNA, 16 nt, Human
gccauaugaaaaggcu

SEQ ID NO: 3158767 - RNA, 19 nt, Human
gccaggccacuggccccug

SEQ ID NO: 3158768 - RNA, 17 nt, Human
gccagacccccuggaga

SEQ ID NO: 3158769 - RNA, 21 nt, Human
gccacuguuuugaaucucaua

SEQ ID NO: 3158770 - RNA, 16 nt, Human
gccaccgccuccuaca

SEQ ID NO: 3158771 - RNA, 19 nt, Human
gcugggucgcccuggacug

SEQ ID NO: 3158772 - RNA, 12 nt, Human
gcugggucgccc

SEQ ID NO: 3158773 - RNA, 16 nt, Human
gcugggucgcccugga

SEQ ID NO: 3158774 - RNA, 17 nt, Human
gcugggucgcccuggac

SEQ ID NO: 3158775 - RNA, 18 nt, Human
gcugggucgcccuggacu

SEQ ID NO: 3158776 - RNA, 22 nt, Human
gcuuccuucugugaaaguacau

SEQ ID NO: 3158777 - RNA, 19 nt, Human
gcuauggggauagaugugu

SEQ ID NO: 3158778 - RNA, 21 nt, Human
gcuauggggauagaugugugg

SEQ ID NO: 3158779 - RNA, 15 nt, Human
gcucaggagcccugg

SEQ ID NO: 3158780 - RNA, 18 nt, Human
gcucaggagcccugggag

SEQ ID NO: 3158781 - RNA, 14 nt, Human
gcucaggagcccug

SEQ ID NO: 3158782 - RNA, 23 nt, Human
gcucuggagcccacuguacuugc

SEQ ID NO: 3158783 - RNA, 17 nt, Human
gcucuggagcccacugu

SEQ ID NO: 3158784 - RNA, 14 nt, Human
ccuugcauaauggu

SEQ ID NO: 3158785 - RNA, 23 nt, Human
cuaaaguaaaaacaaagaaauua

SEQ ID NO: 3158786 - RNA, 20 nt, Human
cucugcaggaaauggcugug

SEQ ID NO: 3158787 - RNA, 13 nt, Human
cucccucuacugg

SEQ ID NO: 3158788 - RNA, 19 nt, Human
cucccucuacugggagccu

SEQ ID NO: 3158789 - RNA, 20 nt, Human
cucccucuacugggagccua

SEQ ID NO: 3158790 - RNA, 14 nt, Human
cuccucuuccaggc

SEQ ID NO: 3158791 - RNA, 16 nt, Human
cuccuuguaaagacug

SEQ ID NO: 3158792 - RNA, 16 nt, Human
cuccugucucccuccu

SEQ ID NO: 3158793 - RNA, 22 nt, Human
cuccucugcccgggagcucagg

SEQ ID NO: 3158794 - RNA, 24 nt, Human
cuccucugcccgggagcucaggaa

SEQ ID NO: 3158795 - RNA, 23 nt, Human
cucaugauagaaggcuaugggga

SEQ ID NO: 3158796 - RNA, 23 nt, Human
cucaggccgaaggaggagucagg

SEQ ID NO: 3158797 - RNA, 20 nt, Human
cucaggccugacucucagca

SEQ ID NO: 3158798 - RNA, 14 nt, Human
cccugaaggaacca

SEQ ID NO: 3158799 - RNA, 18 nt, Human
cccugagaucucugcagg

SEQ ID NO: 3158800 - RNA, 23 nt, Human
ccgaaggugaggagcuugaaacc

SEQ ID NO: 3158801 - RNA, 21 nt, Human
ccucugcccgggagcucagga

SEQ ID NO: 3158802 - RNA, 22 nt, Human
ccucugcccgggagcucaggaa

SEQ ID NO: 3158803 - RNA, 15 nt, Human
ccucucugcaggucc

SEQ ID NO: 3158804 - RNA, 18 nt, Human
ccucucugcaggucccua

SEQ ID NO: 3158805 - RNA, 19 nt, Human
ccucucugcaggucccuaa

SEQ ID NO: 3158806 - RNA, 16 nt, Human
ccucucugcagguccc

SEQ ID NO: 3158807 - RNA, 17 nt, Human
ccucucugcaggucccu

SEQ ID NO: 3158808 - RNA, 22 nt, Human
ccucuuggggaguuuagggugg

SEQ ID NO: 3158809 - RNA, 15 nt, Human
ccucuuggcugccuu

SEQ ID NO: 3158810 - RNA, 23 nt, Human
ccucuuggggaguuuaggguggg

SEQ ID NO: 3158811 - RNA, 12 nt, Human
ccugcagagcug

SEQ ID NO: 3158812 - RNA, 13 nt, Human
ccugcagagcugc

SEQ ID NO: 3158813 - RNA, 14 nt, Human
ccugcagagcugcg

SEQ ID NO: 3158814 - RNA, 17 nt, Human
ccugcagagcugcgggc

SEQ ID NO: 3158815 - RNA, 14 nt, Human
ccugaguuccuagc

SEQ ID NO: 3158816 - RNA, 19 nt, Human
ccugccuggaccagccucu

SEQ ID NO: 3158817 - RNA, 12 nt, Human
ccugccuggacc

SEQ ID NO: 3158818 - RNA, 20 nt, Human
ccugccucucugcagguccc

SEQ ID NO: 3158819 - RNA, 21 nt, Human
ccugccucucugcaggucccu

SEQ ID NO: 3158820 - RNA, 17 nt, Human
ccugccucucugcaggu

SEQ ID NO: 3158821 - RNA, 21 nt, Human
ccaugagcuccuuaaggcucu

SEQ ID NO: 3158822 - RNA, 12 nt, Human
ccaugagcuccu

SEQ ID NO: 3158823 - RNA, 13 nt, Human
ccauugguguuga

SEQ ID NO: 3158824 - RNA, 23 nt, Human
cccacuguacuugcucuugaugc

SEQ ID NO: 3158825 - RNA, 18 nt, Human
cccacuguacuugcucuu

SEQ ID NO: 3158826 - RNA, 19 nt, Human
cccacuguacuugcucuug

SEQ ID NO: 3158827 - RNA, 22 nt, Human
cccccugugccuugucacgcca

SEQ ID NO: 3158828 - RNA, 21 nt, Human
ccccgcguggaacucgugucu

SEQ ID NO: 3158829 - RNA, 20 nt, Human
cccagcuggggccaggcugg

SEQ ID NO: 3158830 - RNA, 22 nt, Human
cccagcuggggccaggcugggu

SEQ ID NO: 3158831 - RNA, 23 nt, Human
cccagcuggggccaggcuggguc

SEQ ID NO: 3158832 - RNA, 14 nt, Human
ccagacuccaccaa

SEQ ID NO: 3158833 - RNA, 18 nt, Human
ccagacuccaccaagccu

SEQ ID NO: 3158834 - RNA, 23 nt, Human
ccagacuucccacggcuccucga

SEQ ID NO: 3158835 - RNA, 18 nt, Human
ccagagaaaaagggaggg

SEQ ID NO: 3158836 - RNA, 18 nt, Human
cagccaggccacuggccc

SEQ ID NO: 3158837 - RNA, 17 nt, Human
cagcacguguggccugu

SEQ ID NO: 3158838 - RNA, 13 nt, Human
cagauuuaugcau

SEQ ID NO: 3158839 - RNA, 16 nt, Human
ccaacuauggccugug

SEQ ID NO: 3158840 - RNA, 14 nt, Human
ccaacuauggccug

SEQ ID NO: 3158841 - RNA, 15 nt, Human
ccaacuauggccugu

SEQ ID NO: 3158842 - RNA, 19 nt, Human
ccaauucgaacuuuuucca

SEQ ID NO: 3158843 - RNA, 22 nt, Human
ccaauuauaugagacguuuuug

SEQ ID NO: 3158844 - RNA, 15 nt, Human
cauuggauucugaga

SEQ ID NO: 3158845 - RNA, 16 nt, Human
cauuggagauguuuag

SEQ ID NO: 3158846 - RNA, 16 nt, Human
caugaauuugugaagg

SEQ ID NO: 3158847 - RNA, 21 nt, Human
caugaauauuuaguguucaua

SEQ ID NO: 3158848 - RNA, 14 nt, Human
caguucagcuuggg

SEQ ID NO: 3158849 - RNA, 15 nt, Human
caguucagcuugggg

SEQ ID NO: 3158850 - RNA, 22 nt, Human
caguuauuauauuuacaaaugg

SEQ ID NO: 3158851 - RNA, 17 nt, Human
caguuauuauauuuaca

SEQ ID NO: 3158852 - RNA, 21 nt, Human
caguuauuauauuuacaaaug

SEQ ID NO: 3158853 - RNA, 19 nt, Human
cauacagggaugguguuca

SEQ ID NO: 3158854 - RNA, 16 nt, Human
cauacagggauggugu

SEQ ID NO: 3158855 - RNA, 18 nt, Human
cauaauuauuauuuggcc

SEQ ID NO: 3158856 - RNA, 23 nt, Human
caguuguucaauaauaaauauuu

SEQ ID NO: 3158857 - RNA, 17 nt, Human
caucuguaccucugccu

SEQ ID NO: 3158858 - RNA, 13 nt, Human
auuaugugccaga

SEQ ID NO: 3158859 - RNA, 21 nt, Human
auuaugugccagauuuaugca

SEQ ID NO: 3158860 - RNA, 17 nt, Human
auucauggccuggggga

SEQ ID NO: 3158861 - RNA, 20 nt, Human
auuaaauuuugaguucuaca

SEQ ID NO: 3158862 - RNA, 16 nt, Human
auuucagcagcugcag

SEQ ID NO: 3158863 - RNA, 16 nt, Human
auugauaaguucauac

SEQ ID NO: 3158864 - RNA, 17 nt, Human
auugauaaguucauaca

SEQ ID NO: 3158865 - RNA, 18 nt, Human
auugauaaguucauacau

SEQ ID NO: 3158866 - RNA, 19 nt, Human
auugauaaguucauacauu

SEQ ID NO: 3158867 - RNA, 12 nt, Human
auugauaaguuc

SEQ ID NO: 3158868 - RNA, 15 nt, Human
auugauaaguucaua

SEQ ID NO: 3158869 - RNA, 17 nt, Human
auuuucuauaauuuaaa

SEQ ID NO: 3158870 - RNA, 18 nt, Human
auuuucuauaauuuaaau

SEQ ID NO: 3158871 - RNA, 19 nt, Human
auuuucuauaauuuaaaua

SEQ ID NO: 3158872 - RNA, 13 nt, Human
auuuugaaaaacu

SEQ ID NO: 3158873 - RNA, 15 nt, Human
auuuugaaaaacugc

SEQ ID NO: 3158874 - RNA, 19 nt, Human
auuuguucuauagcuuuuc

SEQ ID NO: 3158875 - RNA, 17 nt, Human
auuuuuaugccaccuga

SEQ ID NO: 3158876 - RNA, 15 nt, Human
auuuuuuucugaauu

SEQ ID NO: 3158877 - RNA, 15 nt, Human
caagcaaaugugaau

SEQ ID NO: 3158878 - RNA, 17 nt, Human
caagcaaaugugaauca

SEQ ID NO: 3158879 - RNA, 19 nt, Human
caagcaaaugugaaucauu

SEQ ID NO: 3158880 - RNA, 13 nt, Human
caacuauggccug

SEQ ID NO: 3158881 - RNA, 15 nt, Human
caacuauuuuuccaa

SEQ ID NO: 3158882 - RNA, 14 nt, Human
caacuauggccugu

SEQ ID NO: 3158883 - RNA, 18 nt, Human
caccuaggcuaggguggg

SEQ ID NO: 3158884 - RNA, 19 nt, Human
caccuaggcuagggugggg

SEQ ID NO: 3158885 - RNA, 17 nt, Human
caccuaggcuagggugg

SEQ ID NO: 3158886 - RNA, 22 nt, Human
uaaagguucaugcaaacuuuau

SEQ ID NO: 3158887 - RNA, 19 nt, Human
uaaaguaaaaacaaagaaa

SEQ ID NO: 3158888 - RNA, 21 nt, Human
uaaaguaaaaacaaagaaauu

SEQ ID NO: 3158889 - RNA, 22 nt, Human
uaaaguaaaaacaaagaaauua

SEQ ID NO: 3158890 - RNA, 21 nt, Human
aauaacaaugaaaguugauaa

SEQ ID NO: 3158891 - RNA, 13 nt, Human
aauaacugugaag

SEQ ID NO: 3158892 - RNA, 18 nt, Human
aauaaccucaaagugacu

SEQ ID NO: 3158893 - RNA, 21 nt, Human
aauaauuuuaagaaaucaaag

SEQ ID NO: 3158894 - RNA, 16 nt, Human
aauaacugugaaguuu

SEQ ID NO: 3158895 - RNA, 14 nt, Human
aauaacugugaagu

SEQ ID NO: 3158896 - RNA, 20 nt, Human
aauaacugugaaguuuacau

SEQ ID NO: 3158897 - RNA, 12 nt, Human
uaaauaaaguuu

SEQ ID NO: 3158898 - RNA, 21 nt, Human
uaaauaaaguuuguugaaaca

SEQ ID NO: 3158899 - RNA, 17 nt, Human
uaaauuuugaguucuac

SEQ ID NO: 3158900 - RNA, 24 nt, Human
uaaauguuuuuuuuuaaagacuuu

SEQ ID NO: 3158901 - RNA, 23 nt, Human
uaaauguuuuuuuuuaaagacuu

SEQ ID NO: 3158902 - RNA, 15 nt, Human
uaagaauauuugaau

SEQ ID NO: 3158903 - RNA, 18 nt, Human
uaagaauauuugaaugua

SEQ ID NO: 3158904 - RNA, 18 nt, Human
aauauuguguugugaaug

SEQ ID NO: 3158905 - RNA, 20 nt, Human
aauauugcuuuggucauaug

SEQ ID NO: 3158906 - RNA, 18 nt, Human
aauaggcguaacuaauuu

SEQ ID NO: 3158907 - RNA, 19 nt, Human
uaaauuuugaguucuacau

SEQ ID NO: 3158908 - RNA, 18 nt, Human
uaaauuuugaguucuaca

SEQ ID NO: 3158909 - RNA, 20 nt, Human
uaaauuuugucuuuaacuca

SEQ ID NO: 3158910 - RNA, 14 nt, Human
uaacaugauuuggg

SEQ ID NO: 3158911 - RNA, 15 nt, Human
aaucaucaagucuuu

SEQ ID NO: 3158912 - RNA, 17 nt, Human
aaucauggugcucagag

SEQ ID NO: 3158913 - RNA, 20 nt, Human
uaaguauguguaaaauguga

SEQ ID NO: 3158914 - RNA, 14 nt, Human
aaucagacuaugaa

SEQ ID NO: 3158915 - RNA, 17 nt, Human
aaucagacuaugaaguu

SEQ ID NO: 3158916 - RNA, 12 nt, Human
uaaguucauaca

SEQ ID NO: 3158917 - RNA, 13 nt, Human
uaaguucauacau

SEQ ID NO: 3158918 - RNA, 14 nt, Human
aaucuuauaauuua

SEQ ID NO: 3158919 - RNA, 15 nt, Human
aaugaaaaccacauu

SEQ ID NO: 3158920 - RNA, 22 nt, Human
aaugacagguuugggaccccug

SEQ ID NO: 3158921 - RNA, 20 nt, Human
aaugacucagaauauugcuu

SEQ ID NO: 3158922 - RNA, 14 nt, Human
uaaugguguuuuaa

SEQ ID NO: 3158923 - RNA, 23 nt, Human
uaaucagugugucuaaauuugaa

SEQ ID NO: 3158924 - RNA, 15 nt, Human
uaaugaaacuuggau

SEQ ID NO: 3158925 - RNA, 14 nt, Human
uaaugaaacuugga

SEQ ID NO: 3158926 - RNA, 21 nt, Human
aauguaugcuucauacaggga

SEQ ID NO: 3158927 - RNA, 18 nt, Human
aauguaugcuucauacag

SEQ ID NO: 3158928 - RNA, 17 nt, Human
aauguaugcuucauaca

SEQ ID NO: 3158929 - RNA, 17 nt, Human
uacauauuuuuguagca

SEQ ID NO: 3158930 - RNA, 18 nt, Human
uacauauuuuuguagcac

SEQ ID NO: 3158931 - RNA, 19 nt, Human
uacauauaagugauugcug

SEQ ID NO: 3158932 - RNA, 19 nt, Human
aauggacuuuuguacauag

SEQ ID NO: 3158933 - RNA, 18 nt, Human
uacagaggacaguauuug

SEQ ID NO: 3158934 - RNA, 14 nt, Human
uacagaggacagua

SEQ ID NO: 3158935 - RNA, 13 nt, Human
uaauucaagaaaa

SEQ ID NO: 3158936 - RNA, 16 nt, Human
uaauuuaaaauuguga

SEQ ID NO: 3158937 - RNA, 15 nt, Human
uaauuuaaaauugug

SEQ ID NO: 3158938 - RNA, 17 nt, Human
uaauuuauacaggucau

SEQ ID NO: 3158939 - RNA, 18 nt, Human
uacuagggaaaugccuuu

SEQ ID NO: 3158940 - RNA, 16 nt, Human
uacugggagccuaccc

SEQ ID NO: 3158941 - RNA, 19 nt, Human
uacuguacagacagaaaaa

SEQ ID NO: 3158942 - RNA, 23 nt, Human
uacuguacagacagaaaaaacug

SEQ ID NO: 3158943 - RNA, 15 nt, Human
uacuugaaaauuaac

SEQ ID NO: 3158944 - RNA, 16 nt, Human
aauuuauacaggucau

SEQ ID NO: 3158945 - RNA, 17 nt, Human
aauuuauacaggucaua

SEQ ID NO: 3158946 - RNA, 22 nt, Human
aauuuauaaacuuuuuucuuac

SEQ ID NO: 3158947 - RNA, 17 nt, Human
acaagaugguucuagca

SEQ ID NO: 3158948 - RNA, 18 nt, Human
acaaauucugucucugga

SEQ ID NO: 3158949 - RNA, 21 nt, Human
acaaauucugucucuggauua

SEQ ID NO: 3158950 - RNA, 16 nt, Human
uagcuacuaauuuuaa

SEQ ID NO: 3158951 - RNA, 18 nt, Human
acaaugaagauaaaaaga

SEQ ID NO: 3158952 - RNA, 22 nt, Human
aauuuuuaaucuuuaauuuuac

SEQ ID NO: 3158953 - RNA, 22 nt, Human
uagauaggucagugcaaauacu

SEQ ID NO: 3158954 - RNA, 20 nt, Human
acacuguucugaaagugacu

SEQ ID NO: 3158955 - RNA, 14 nt, Human
acacuguucugaaa

SEQ ID NO: 3158956 - RNA, 16 nt, Human
uauaaguauucuaaau

SEQ ID NO: 3158957 - RNA, 16 nt, Human
acacucacccaacaau

SEQ ID NO: 3158958 - RNA, 12 nt, Human
uauauuuacaaa

SEQ ID NO: 3158959 - RNA, 15 nt, Human
uauauuuaaugauaa

SEQ ID NO: 3158960 - RNA, 16 nt, Human
uaucuuguagcuuuau

SEQ ID NO: 3158961 - RNA, 14 nt, Human
acagauaaucagug

SEQ ID NO: 3158962 - RNA, 18 nt, Human
acacaacuauuuuuccaa

SEQ ID NO: 3158963 - RNA, 14 nt, Human
uaguaauagagcaa

SEQ ID NO: 3158964 - RNA, 13 nt, Human
uaguguucauaaa

SEQ ID NO: 3158965 - RNA, 20 nt, Human
uaguaauagagcaaaauuga

SEQ ID NO: 3158966 - RNA, 20 nt, Human
uauaaaaauaaaaaacacug

SEQ ID NO: 3158967 - RNA, 21 nt, Human
uauaaaaauaaaaaacacugg

SEQ ID NO: 3158968 - RNA, 17 nt, Human
acaccccgacuuuuguu

SEQ ID NO: 3158969 - RNA, 17 nt, Human
aagcuaucguaaaauua

SEQ ID NO: 3158970 - RNA, 18 nt, Human
guucuagcauggcauauu

SEQ ID NO: 3158971 - RNA, 10 nt, Human
guucauacau

SEQ ID NO: 3158972 - RNA, 13 nt, Human
guucauacauauu

SEQ ID NO: 3158973 - RNA, 14 nt, Human
guucauacauauuu

SEQ ID NO: 3158974 - RNA, 23 nt, Human
guucauacauauuuuuguagcac

SEQ ID NO: 3158975 - RNA, 9 nt, Human
guucauaca

SEQ ID NO: 3158976 - RNA, 11 nt, Human
guucauacauu

SEQ ID NO: 3158977 - RNA, 14 nt, Human
guucauacauugua

SEQ ID NO: 3158978 - RNA, 15 nt, Human
aagccucgacacaga

SEQ ID NO: 3158979 - RNA, 15 nt, Human
aagccuggucagccc

SEQ ID NO: 3158980 - RNA, 14 nt, Human
guuaaguaugugua

SEQ ID NO: 3158981 - RNA, 18 nt, Human
guguuuuaaaaugagaaa

SEQ ID NO: 3158982 - RNA, 21 nt, Human
aagggguaggauuacuaggug

SEQ ID NO: 3158983 - RNA, 13 nt, Human
aaguaaaaacaaa

SEQ ID NO: 3158984 - RNA, 20 nt, Human
aaguaaaaacaaagaaauua

SEQ ID NO: 3158985 - RNA, 16 nt, Human
guuuucuuaacuuaaa

SEQ ID NO: 3158986 - RNA, 20 nt, Human
guuuucuuaaccagaucauu

SEQ ID NO: 3158987 - RNA, 22 nt, Human
guuugggaccccuggugguuca

SEQ ID NO: 3158988 - RNA, 16 nt, Human
guuugggaccccuggu

SEQ ID NO: 3158989 - RNA, 19 nt, Human
guuugcaucugaaaauuga

SEQ ID NO: 3158990 - RNA, 16 nt, Human
guuuaugugugugugu

SEQ ID NO: 3158991 - RNA, 13 nt, Human
guuuaugugugug

SEQ ID NO: 3158992 - RNA, 18 nt, Human
guuguaucagcacgugug

SEQ ID NO: 3158993 - RNA, 23 nt, Human
aaggcuauggggauagaugugug

SEQ ID NO: 3158994 - RNA, 13 nt, Human
aagaaauauaccu

SEQ ID NO: 3158995 - RNA, 15 nt, Human
aacuuguauuaugug

SEQ ID NO: 3158996 - RNA, 16 nt, Human
aacuuguauuaugugu

SEQ ID NO: 3158997 - RNA, 20 nt, Human
aagaauugucuuucugucuc

SEQ ID NO: 3158998 - RNA, 14 nt, Human
guggcacuggggca

SEQ ID NO: 3158999 - RNA, 22 nt, Human
guggaagugugggucugugugu

SEQ ID NO: 3159000 - RNA, 21 nt, Human
guggaagugugggucugugug

SEQ ID NO: 3159001 - RNA, 16 nt, Human
guggaauuauuuuaaa

SEQ ID NO: 3159002 - RNA, 18 nt, Human
guggaauuauuuuaaaag

SEQ ID NO: 3159003 - RNA, 15 nt, Human
guggaauuauuuuaa

SEQ ID NO: 3159004 - RNA, 19 nt, Human
guggaauuauuuuaaaaga

SEQ ID NO: 3159005 - RNA, 20 nt, Human
guggaagugugggucugugu

SEQ ID NO: 3159006 - RNA, 19 nt, Human
guggaagugugggucugug

SEQ ID NO: 3159007 - RNA, 15 nt, Human
guggaaguguggguc

SEQ ID NO: 3159008 - RNA, 14 nt, Human
guggaagugugggu

SEQ ID NO: 3159009 - RNA, 23 nt, Human
gugcuauuguagagccagagguc

SEQ ID NO: 3159010 - RNA, 15 nt, Human
gugcucaggagcccu

SEQ ID NO: 3159011 - RNA, 14 nt, Human
gugggaguguguaa

SEQ ID NO: 3159012 - RNA, 13 nt, Human
gugggagugugua

SEQ ID NO: 3159013 - RNA, 14 nt, Human
gugguggcucggga

SEQ ID NO: 3159014 - RNA, 16 nt, Human
gugggucugugugugu

SEQ ID NO: 3159015 - RNA, 13 nt, Human
gugggucugugug

SEQ ID NO: 3159016 - RNA, 23 nt, Human
guggggggggggcgcggcuggga

SEQ ID NO: 3159017 - RNA, 16 nt, Human
guggggggcuucauac

SEQ ID NO: 3159018 - RNA, 15 nt, Human
guggggggcuucaua

SEQ ID NO: 3159019 - RNA, 14 nt, Human
guguguaauuuaaa

SEQ ID NO: 3159020 - RNA, 17 nt, Human
gugucuuuccacuccuc

SEQ ID NO: 3159021 - RNA, 15 nt, Human
guguuguguguggga

SEQ ID NO: 3159022 - RNA, 13 nt, Human
guguuuauuuaua

SEQ ID NO: 3159023 - RNA, 18 nt, Human
guguuuccauauuuuaua

SEQ ID NO: 3159024 - RNA, 11 nt, Human
aaaugagaaau

SEQ ID NO: 3159025 - RNA, 9 nt, Human
aaaugaggg

SEQ ID NO: 3159026 - RNA, 16 nt, Human
aaaugagaaaucuaaa

SEQ ID NO: 3159027 - RNA, 13 nt, Human
aaaugagaaaucu

SEQ ID NO: 3159028 - RNA, 14 nt, Human
aaaugagaaaucua

SEQ ID NO: 3159029 - RNA, 14 nt, Human
aaaugcauuucuaa

SEQ ID NO: 3159030 - RNA, 13 nt, Human
aaaugcauguugc

SEQ ID NO: 3159031 - RNA, 14 nt, Human
aaaucuaugauucc

SEQ ID NO: 3159032 - RNA, 16 nt, Human
aaaucuaugauuccag

SEQ ID NO: 3159033 - RNA, 14 nt, Human
aaaugaaaaaauau

SEQ ID NO: 3159034 - RNA, 13 nt, Human
guaggauuacuag

SEQ ID NO: 3159035 - RNA, 16 nt, Human
guaggaacugcugggc

SEQ ID NO: 3159036 - RNA, 17 nt, Human
aaauuucagcagcugca

SEQ ID NO: 3159037 - RNA, 18 nt, Human
aaauuucagcagcugcag

SEQ ID NO: 3159038 - RNA, 20 nt, Human
guauuuuugacagaauaugu

SEQ ID NO: 3159039 - RNA, 16 nt, Human
guauuuuugacagaau

SEQ ID NO: 3159040 - RNA, 20 nt, Human
aaauuauuuuguucauacau

SEQ ID NO: 3159041 - RNA, 21 nt, Human
aaauuauuuuguucauacaua

SEQ ID NO: 3159042 - RNA, 22 nt, Human
aaauuauuuuguucauacauau

SEQ ID NO: 3159043 - RNA, 17 nt, Human
aaauuauuuuguucaua

SEQ ID NO: 3159044 - RNA, 19 nt, Human
aaauuauuuuguucauaca

SEQ ID NO: 3159045 - RNA, 22 nt, Human
aaauuauauaaguauucuaaau

SEQ ID NO: 3159046 - RNA, 16 nt, Human
aaauuauauaaguauu

SEQ ID NO: 3159047 - RNA, 18 nt, Human
aaauuauauaaguauucu

SEQ ID NO: 3159048 - RNA, 16 nt, Human
guauuuaauucauguu

SEQ ID NO: 3159049 - RNA, 17 nt, Human
guauaaaagccuguuua

SEQ ID NO: 3159050 - RNA, 22 nt, Human
guauauugauccagaaagaaaa

SEQ ID NO: 3159051 - RNA, 18 nt, Human
guauaaaagccuguuuaa

SEQ ID NO: 3159052 - RNA, 21 nt, Human
guauaaaagccuguuuaagag

SEQ ID NO: 3159053 - RNA, 15 nt, Human
guauguggaagugug

SEQ ID NO: 3159054 - RNA, 17 nt, Human
guauguggaaguguggg

SEQ ID NO: 3159055 - RNA, 16 nt, Human
guauguggaagugugg

SEQ ID NO: 3159056 - RNA, 20 nt, Human
guaugugggggucugugugu

SEQ ID NO: 3159057 - RNA, 19 nt, Human
guaugugggggucugugug

SEQ ID NO: 3159058 - RNA, 21 nt, Human
guauguggaagugugggucug

SEQ ID NO: 3159059 - RNA, 18 nt, Human
guauguggaagugugggu

SEQ ID NO: 3159060 - RNA, 12 nt, Human
gucuggcugcag

SEQ ID NO: 3159061 - RNA, 13 nt, Human
gucuggcugcaga

SEQ ID NO: 3159062 - RNA, 14 nt, Human
gucuggcugcagag

SEQ ID NO: 3159063 - RNA, 19 nt, Human
aacucgugucuggcacagc

SEQ ID NO: 3159064 - RNA, 17 nt, Human
aaccucaaaaugucuaa

SEQ ID NO: 3159065 - RNA, 15 nt, Human
aaccucaaagugacu

SEQ ID NO: 3159066 - RNA, 12 nt, Human
gucucccuccuc

SEQ ID NO: 3159067 - RNA, 16 nt, Human
gucucccuccucugcc

SEQ ID NO: 3159068 - RNA, 19 nt, Human
aaccaaagcgaauuuuaaa

SEQ ID NO: 3159069 - RNA, 20 nt, Human
aacauuuguucuauagcuuu

SEQ ID NO: 3159070 - RNA, 21 nt, Human
aacaagccuccuuuuaaagua

SEQ ID NO: 3159071 - RNA, 23 nt, Human
aaauuuuuaaucuuuaauuuuac

SEQ ID NO: 3159072 - RNA, 14 nt, Human
aacaaugaagauaa

SEQ ID NO: 3159073 - RNA, 18 nt, Human
aacaaugaagauaaaaag

SEQ ID NO: 3159074 - RNA, 12 nt, Human
aacacugccagc

SEQ ID NO: 3159075 - RNA, 22 nt, Human
aacacugccagcauuucccuuc

SEQ ID NO: 3159076 - RNA, 19 nt, Human
agagaauuguuugaacccg

SEQ ID NO: 3159077 - RNA, 19 nt, Human
agacuucccacggcuccuc

SEQ ID NO: 3159078 - RNA, 21 nt, Human
agacugucagcuuccaaacau

SEQ ID NO: 3159079 - RNA, 13 nt, Human
ucuuucuuccaaa

SEQ ID NO: 3159080 - RNA, 17 nt, Human
ucuugguuccagccugc

SEQ ID NO: 3159081 - RNA, 18 nt, Human
ucuugguuccagccugcc

SEQ ID NO: 3159082 - RNA, 19 nt, Human
ucuugguuccagccugcca

SEQ ID NO: 3159083 - RNA, 13 nt, Human
ucuugguuccagc

SEQ ID NO: 3159084 - RNA, 14 nt, Human
ucuuuaauuuuaca

SEQ ID NO: 3159085 - RNA, 21 nt, Human
agacauuugcuaugagcuggg

SEQ ID NO: 3159086 - RNA, 19 nt, Human
ucuuacugucuuuuuucua

SEQ ID NO: 3159087 - RNA, 12 nt, Human
agacagaaaaaa

SEQ ID NO: 3159088 - RNA, 20 nt, Human
agacacaacuauuuuuccaa

SEQ ID NO: 3159089 - RNA, 19 nt, Human
agacacaacuauuuuucca

SEQ ID NO: 3159090 - RNA, 19 nt, Human
agaaugucaguauguggaa

SEQ ID NO: 3159091 - RNA, 17 nt, Human
agaaugucaguaugugg

SEQ ID NO: 3159092 - RNA, 13 nt, Human
agaaugucaguau

SEQ ID NO: 3159093 - RNA, 16 nt, Human
agaaugucaguaugug

SEQ ID NO: 3159094 - RNA, 15 nt, Human
agaaugucaguaugu

SEQ ID NO: 3159095 - RNA, 22 nt, Human
agaaccccuggcuccaggccag

SEQ ID NO: 3159096 - RNA, 20 nt, Human
agaguugaugguuguacaua

SEQ ID NO: 3159097 - RNA, 14 nt, Human
agagucccugccug

SEQ ID NO: 3159098 - RNA, 17 nt, Human
agagucccugccuggac

SEQ ID NO: 3159099 - RNA, 23 nt, Human
agaguccaucagccuccauccua

SEQ ID NO: 3159100 - RNA, 14 nt, Human
agauaaauauuaua

SEQ ID NO: 3159101 - RNA, 17 nt, Human
agauaaagguucaugca

SEQ ID NO: 3159102 - RNA, 12 nt, Human
agauaaauauua

SEQ ID NO: 3159103 - RNA, 17 nt, Human
ugacauaaaaacaacuu

SEQ ID NO: 3159104 - RNA, 18 nt, Human
ugacauaaaaacaacuuu

SEQ ID NO: 3159105 - RNA, 20 nt, Human
ugacauaaaaacaacuuuau

SEQ ID NO: 3159106 - RNA, 22 nt, Human
agauguggaaaagccaagaggc

SEQ ID NO: 3159107 - RNA, 17 nt, Human
agauguggaaaagccaa

SEQ ID NO: 3159108 - RNA, 19 nt, Human
agaucccaacacugccagc

SEQ ID NO: 3159109 - RNA, 20 nt, Human
agaucccaacacugccagca

SEQ ID NO: 3159110 - RNA, 18 nt, Human
agaucccaacacugccag

SEQ ID NO: 3159111 - RNA, 14 nt, Human
agagcaaaauugau

SEQ ID NO: 3159112 - RNA, 16 nt, Human
agagcagugggccugg

SEQ ID NO: 3159113 - RNA, 11 nt, Human
ugaaagugacu

SEQ ID NO: 3159114 - RNA, 15 nt, Human
ugaaauuguauuaca

SEQ ID NO: 3159115 - RNA, 14 nt, Human
agagcugcgggcug

SEQ ID NO: 3159116 - RNA, 21 nt, Human
ugaacuaggauuguaguccca

SEQ ID NO: 3159117 - RNA, 22 nt, Human
agaguaauccaagcaaauguga

SEQ ID NO: 3159118 - RNA, 21 nt, Human
agaggccauucuuucccaaca

SEQ ID NO: 3159119 - RNA, 22 nt, Human
ucuacauaaguaauucaagaaa

SEQ ID NO: 3159120 - RNA, 16 nt, Human
acuguucccugaggug

SEQ ID NO: 3159121 - RNA, 19 nt, Human
acuguucccugagguggga

SEQ ID NO: 3159122 - RNA, 20 nt, Human
ucuaaagccauuguaguccu

SEQ ID NO: 3159123 - RNA, 20 nt, Human
ucuacauaaguaauucaaga

SEQ ID NO: 3159124 - RNA, 17 nt, Human
ucuacauaaguaauuca

SEQ ID NO: 3159125 - RNA, 16 nt, Human
acugggagaaaugaaa

SEQ ID NO: 3159126 - RNA, 12 nt, Human
acugugugcuca

SEQ ID NO: 3159127 - RNA, 15 nt, Human
acugugugcucagga

SEQ ID NO: 3159128 - RNA, 19 nt, Human
acugugugcucaggagccc

SEQ ID NO: 3159129 - RNA, 20 nt, Human
acugugugcucaggagcccu

SEQ ID NO: 3159130 - RNA, 21 nt, Human
acugugugcucaggagcccug

SEQ ID NO: 3159131 - RNA, 22 nt, Human
ucguuuucaaaauuguuacaaa

SEQ ID NO: 3159132 - RNA, 16 nt, Human
ucguaaaauuaagaaa

SEQ ID NO: 3159133 - RNA, 13 nt, Human
ucguaaaauuaag

SEQ ID NO: 3159134 - RNA, 16 nt, Human
acugcuaagaauauuu

SEQ ID NO: 3159135 - RNA, 18 nt, Human
acugcuaagaauauuuga

SEQ ID NO: 3159136 - RNA, 16 nt, Human
acugccuauuuuaaua

SEQ ID NO: 3159137 - RNA, 21 nt, Human
acugccuauuuuaauaaacac

SEQ ID NO: 3159138 - RNA, 18 nt, Human
ucgagaucccaacacugc

SEQ ID NO: 3159139 - RNA, 21 nt, Human
ucgagaucccaacacugccag

SEQ ID NO: 3159140 - RNA, 17 nt, Human
ucgagaucccaacacug

SEQ ID NO: 3159141 - RNA, 22 nt, Human
uccuuucuaacaaaaaaauaua

SEQ ID NO: 3159142 - RNA, 23 nt, Human
acuggccaguggcuggaucugug

SEQ ID NO: 3159143 - RNA, 16 nt, Human
ucucauuccagaggaa

SEQ ID NO: 3159144 - RNA, 19 nt, Human
ucucuggaauuugaaacac

SEQ ID NO: 3159145 - RNA, 15 nt, Human
ucucuggaauuugaa

SEQ ID NO: 3159146 - RNA, 20 nt, Human
agaaaaagcaauaaccucaa

SEQ ID NO: 3159147 - RNA, 21 nt, Human
agaaaacuuguauuaugugug

SEQ ID NO: 3159148 - RNA, 19 nt, Human
agaaaacuuguauuaugug

SEQ ID NO: 3159149 - RNA, 16 nt, Human
agaaaugaaaaaauau

SEQ ID NO: 3159150 - RNA, 18 nt, Human
agaaaugaaaaaauauau

SEQ ID NO: 3159151 - RNA, 23 nt, Human
agaaaugaaaaaauauauaucaa

SEQ ID NO: 3159152 - RNA, 17 nt, Human
agaaaucaaagagagaa

SEQ ID NO: 3159153 - RNA, 17 nt, Human
agaaaugaaaaaauaua

SEQ ID NO: 3159154 - RNA, 12 nt, Human
agaaaucuaaaa

SEQ ID NO: 3159155 - RNA, 14 nt, Human
ucugagagaggcca

SEQ ID NO: 3159156 - RNA, 20 nt, Human
ucugagagaggccauucuuu

SEQ ID NO: 3159157 - RNA, 14 nt, Human
ucugacuaugacau

SEQ ID NO: 3159158 - RNA, 16 nt, Human
ucugacuaugacauaa

SEQ ID NO: 3159159 - RNA, 15 nt, Human
ucugcaggucccuaa

SEQ ID NO: 3159160 - RNA, 16 nt, Human
ucugcaggucccuaau

SEQ ID NO: 3159161 - RNA, 17 nt, Human
ucugcaggucccuaaua

SEQ ID NO: 3159162 - RNA, 22 nt, Human
agaaauuaugugccagauuuau

SEQ ID NO: 3159163 - RNA, 16 nt, Human
agaaauuuauaaacuu

SEQ ID NO: 3159164 - RNA, 17 nt, Human
agaaauuuauaaacuuu

SEQ ID NO: 3159165 - RNA, 12 nt, Human
agaaauuaugug

SEQ ID NO: 3159166 - RNA, 14 nt, Human
ucugcaggucccua

SEQ ID NO: 3159167 - RNA, 18 nt, Human
ucugcaggucccuaauaa

SEQ ID NO: 3159168 - RNA, 13 nt, Human
agaaauuaugugc

SEQ ID NO: 3159169 - RNA, 21 nt, Human
agaaauuaugugccagauuua

SEQ ID NO: 3159170 - RNA, 22 nt, Human
acguauaaaagccuguuuaaga

SEQ ID NO: 3159171 - RNA, 14 nt, Human
acuacuagggaaau

SEQ ID NO: 3159172 - RNA, 21 nt, Human
acuacuagggaaaugccuuug

SEQ ID NO: 3159173 - RNA, 20 nt, Human
ucccugaggcagguccccag

SEQ ID NO: 3159174 - RNA, 21 nt, Human
ucccugaggcagguccccaga

SEQ ID NO: 3159175 - RNA, 22 nt, Human
ucccugaggcagguccccagac

SEQ ID NO: 3159176 - RNA, 11 nt, Human
ucccugaggca

SEQ ID NO: 3159177 - RNA, 20 nt, Human
ucccugaaggaaccaaagcg

SEQ ID NO: 3159178 - RNA, 19 nt, Human
ucccuuucugcuuguguua

SEQ ID NO: 3159179 - RNA, 19 nt, Human
uccuaaauauauuuuaaga

SEQ ID NO: 3159180 - RNA, 18 nt, Human
acucaugugacucuuucc

SEQ ID NO: 3159181 - RNA, 19 nt, Human
acucaugugacucuuucca

SEQ ID NO: 3159182 - RNA, 14 nt, Human
acuccuccuagcca

SEQ ID NO: 3159183 - RNA, 13 nt, Human
acuccuccuagcc

SEQ ID NO: 3159184 - RNA, 15 nt, Human
acuccuccuagccac

SEQ ID NO: 3159185 - RNA, 16 nt, Human
acuccuccuagccacc

SEQ ID NO: 3159186 - RNA, 18 nt, Human
acuccuccuagccaccca

SEQ ID NO: 3159187 - RNA, 19 nt, Human
acuccagccuggcgacaga

SEQ ID NO: 3159188 - RNA, 14 nt, Human
ucaucuaggauuuu

SEQ ID NO: 3159189 - RNA, 18 nt, Human
ucaucuagguaaauuaca

SEQ ID NO: 3159190 - RNA, 19 nt, Human
accucaaaaugucuaagau

SEQ ID NO: 3159191 - RNA, 16 nt, Human
accucaaaaugucuaa

SEQ ID NO: 3159192 - RNA, 21 nt, Human
uccaaccggcuuuguggcacu

SEQ ID NO: 3159193 - RNA, 19 nt, Human
acgagaucaagagaucaag

SEQ ID NO: 3159194 - RNA, 14 nt, Human
acgagaaaacaaua

SEQ ID NO: 3159195 - RNA, 18 nt, Human
uccaggccagggggccag

SEQ ID NO: 3159196 - RNA, 16 nt, Human
uccaggccagggggcc

SEQ ID NO: 3159197 - RNA, 14 nt, Human
uccacucaugugac

SEQ ID NO: 3159198 - RNA, 21 nt, Human
uccacucaugugacucuuucc

SEQ ID NO: 3159199 - RNA, 15 nt, Human
uccacuccuccuagc

SEQ ID NO: 3159200 - RNA, 18 nt, Human
uccacuccuccuagccac

SEQ ID NO: 3159201 - RNA, 18 nt, Human
uccacuggggauugggcc

SEQ ID NO: 3159202 - RNA, 14 nt, Human
accagaagcccaga

SEQ ID NO: 3159203 - RNA, 16 nt, Human
accagaagcccagaau

SEQ ID NO: 3159204 - RNA, 13 nt, Human
accagaagcccag

SEQ ID NO: 3159205 - RNA, 17 nt, Human
ucacuaccuucaugcau

SEQ ID NO: 3159206 - RNA, 15 nt, Human
ucaauucuugccaaa

SEQ ID NO: 3159207 - RNA, 22 nt, Human
accacacguaaugaaacuugga

SEQ ID NO: 3159208 - RNA, 17 nt, Human
ucacauaucuaguauga

SEQ ID NO: 3159209 - RNA, 21 nt, Human
ucacauaucuaguaugaaauu

SEQ ID NO: 3159210 - RNA, 22 nt, Human
ucacauaucuaguaugaaauua

SEQ ID NO: 3159211 - RNA, 19 nt, Human
ucacaccuguaaucccaac

SEQ ID NO: 3159212 - RNA, 21 nt, Human
ucagcccaaaccaccagaagc

SEQ ID NO: 3159213 - RNA, 22 nt, Human
ucagcccaaaccaccagaagcc

SEQ ID NO: 3159214 - RNA, 23 nt, Human
accccagcuggggccaggcuggg

SEQ ID NO: 3159215 - RNA, 22 nt, Human
accccagcuggggccaggcugg

SEQ ID NO: 3159216 - RNA, 23 nt, Human
accauuucuugagguaaaagcau

SEQ ID NO: 3159217 - RNA, 13 nt, Human
ucacucuuggagc

SEQ ID NO: 3159218 - RNA, 16 nt, Human
acauaaaaacaacuuu

SEQ ID NO: 3159219 - RNA, 19 nt, Human
acauaaaaacaacuuuaua

SEQ ID NO: 3159220 - RNA, 21 nt, Human
acauaaaaacaacuuuauacc

SEQ ID NO: 3159221 - RNA, 21 nt, Human
uauuuccauuaaaaaaucagu

SEQ ID NO: 3159222 - RNA, 22 nt, Human
uauuucccugaaggaaccaaag

SEQ ID NO: 3159223 - RNA, 20 nt, Human
acauaucuaguaugaaauua

SEQ ID NO: 3159224 - RNA, 22 nt, Human
acauaucuaguaugaaauuaua

SEQ ID NO: 3159225 - RNA, 23 nt, Human
acauaucuaguaugaaauuauau

SEQ ID NO: 3159226 - RNA, 17 nt, Human
acauaucuaguaugaaa

SEQ ID NO: 3159227 - RNA, 14 nt, Human
ucaaagcugaaaug

SEQ ID NO: 3159228 - RNA, 17 nt, Human
ucaaagggugaaaauua

SEQ ID NO: 3159229 - RNA, 14 nt, Human
ucaaaaugucuaag

SEQ ID NO: 3159230 - RNA, 16 nt, Human
ucaaaauuguuacaaa

SEQ ID NO: 3159231 - RNA, 19 nt, Human
ucaaaauuguuacaaauug

SEQ ID NO: 3159232 - RNA, 19 nt, Human
uauuuuugacagaauaugu

SEQ ID NO: 3159233 - RNA, 23 nt, Human
uauuuuugacagaauauguuuca

SEQ ID NO: 3159234 - RNA, 14 nt, Human
uauuuuugacagaa

SEQ ID NO: 3159235 - RNA, 15 nt, Human
uauuuuugacagaau

SEQ ID NO: 3159236 - RNA, 13 nt, Human
uauuuuugacaga

SEQ ID NO: 3159237 - RNA, 16 nt, Human
uauuuguaaauuuaug

SEQ ID NO: 3159238 - RNA, 22 nt, Human
uauuuguaaauuuaugugaugg

SEQ ID NO: 3159239 - RNA, 17 nt, Human
uauuuguaaauuuaugu

SEQ ID NO: 3159240 - RNA, 21 nt, Human
uguuccgugguuaaacucgcu

SEQ ID NO: 3159241 - RNA, 14 nt, Human
agugugucuaaauu

SEQ ID NO: 3159242 - RNA, 15 nt, Human
uguucugugauauaa

SEQ ID NO: 3159243 - RNA, 18 nt, Human
uguucugugauauaagug

SEQ ID NO: 3159244 - RNA, 17 nt, Human
aguguacuuaacuauuc

SEQ ID NO: 3159245 - RNA, 20 nt, Human
ugugggucugugugugugua

SEQ ID NO: 3159246 - RNA, 14 nt, Human
uguguguguaugug

SEQ ID NO: 3159247 - RNA, 20 nt, Human
ugugugugggaguguguaau

SEQ ID NO: 3159248 - RNA, 12 nt, Human
ugugugugggag

SEQ ID NO: 3159249 - RNA, 16 nt, Human
uguuaaguauguguaa

SEQ ID NO: 3159250 - RNA, 15 nt, Human
uguuaaguaugugua

SEQ ID NO: 3159251 - RNA, 19 nt, Human
uguguuaaguauguguaaa

SEQ ID NO: 3159252 - RNA, 15 nt, Human
agugaaagaaaauaa

SEQ ID NO: 3159253 - RNA, 14 nt, Human
ugugauguauucua

SEQ ID NO: 3159254 - RNA, 18 nt, Human
ugugccagauuuaugcau

SEQ ID NO: 3159255 - RNA, 20 nt, Human
ugugccagauuuaugcauau

SEQ ID NO: 3159256 - RNA, 14 nt, Human
ugugcccacccucc

SEQ ID NO: 3159257 - RNA, 23 nt, Human
ugugcccacccuccacucuccuc

SEQ ID NO: 3159258 - RNA, 16 nt, Human
uguggcauccagaguc

SEQ ID NO: 3159259 - RNA, 23 nt, Human
uguggcaguuuggcaaacucucc

SEQ ID NO: 3159260 - RNA, 19 nt, Human
uguggcauccagagucccu

SEQ ID NO: 3159261 - RNA, 21 nt, Human
uguggcauccagagucccugc

SEQ ID NO: 3159262 - RNA, 18 nt, Human
agucacuaccuucaugca

SEQ ID NO: 3159263 - RNA, 12 nt, Human
ugugaaauuauu

SEQ ID NO: 3159264 - RNA, 12 nt, Human
ugugacucuuuc

SEQ ID NO: 3159265 - RNA, 14 nt, Human
ugugacucuuucca

SEQ ID NO: 3159266 - RNA, 15 nt, Human
ugugaacagcggcug

SEQ ID NO: 3159267 - RNA, 18 nt, Human
agucuuucacauuuaaau

SEQ ID NO: 3159268 - RNA, 15 nt, Human
ugugacucuuuccaa

SEQ ID NO: 3159269 - RNA, 17 nt, Human
ugugacucuuuccaacc

SEQ ID NO: 3159270 - RNA, 22 nt, Human
auaaaagggacugagaaauuua

SEQ ID NO: 3159271 - RNA, 18 nt, Human
uuaaguaaggaauuuuau

SEQ ID NO: 3159272 - RNA, 17 nt, Human
uuaauuccaauuauaug

SEQ ID NO: 3159273 - RNA, 17 nt, Human
uuaauaaacacucuuga

SEQ ID NO: 3159274 - RNA, 13 nt, Human
uuaauaaacacuc

SEQ ID NO: 3159275 - RNA, 20 nt, Human
auaaaauuuuuaaucuuuaa

SEQ ID NO: 3159276 - RNA, 22 nt, Human
auaaaauucuauuacaguaugu

SEQ ID NO: 3159277 - RNA, 22 nt, Human
auaaauauuauauuauauauau

SEQ ID NO: 3159278 - RNA, 12 nt, Human
auaaauauuaua

SEQ ID NO: 3159279 - RNA, 15 nt, Human
uuagaagaagugugu

SEQ ID NO: 3159280 - RNA, 14 nt, Human
uuagaagaagugug

SEQ ID NO: 3159281 - RNA, 16 nt, Human
uuagaagaaguguguc

SEQ ID NO: 3159282 - RNA, 12 nt, Human
aguuuagggugg

SEQ ID NO: 3159283 - RNA, 13 nt, Human
aguuuaggguggg

SEQ ID NO: 3159284 - RNA, 14 nt, Human
aguuuagggugggg

SEQ ID NO: 3159285 - RNA, 18 nt, Human
uuaaaauugugauguguc

SEQ ID NO: 3159286 - RNA, 13 nt, Human
uuaaaauugugau

SEQ ID NO: 3159287 - RNA, 13 nt, Human
uguuuaugugugu

SEQ ID NO: 3159288 - RNA, 16 nt, Human
uguuuaugugugugug

SEQ ID NO: 3159289 - RNA, 19 nt, Human
uguugccuugcauaauggu

SEQ ID NO: 3159290 - RNA, 24 nt, Human
uguuuauuuauagaguguacuuaa

SEQ ID NO: 3159291 - RNA, 14 nt, Human
uguuuauuuauaga

SEQ ID NO: 3159292 - RNA, 18 nt, Human
uguuucuuuguaaugaaa

SEQ ID NO: 3159293 - RNA, 19 nt, Human
uguuucuuuguaaugaaaa

SEQ ID NO: 3159294 - RNA, 19 nt, Human
uguuuugaaucucauaauu

SEQ ID NO: 3159295 - RNA, 12 nt, Human
aguucugccagg

SEQ ID NO: 3159296 - RNA, 13 nt, Human
aguucugccagga

SEQ ID NO: 3159297 - RNA, 14 nt, Human
aguucugccaggag

SEQ ID NO: 3159298 - RNA, 20 nt, Human
aguucugccaggagacaggu

SEQ ID NO: 3159299 - RNA, 15 nt, Human
ugggccccugccucu

SEQ ID NO: 3159300 - RNA, 19 nt, Human
ugggccccugccucucugc

SEQ ID NO: 3159301 - RNA, 15 nt, Human
ugggccccugccaga

SEQ ID NO: 3159302 - RNA, 13 nt, Human
agggaaauuucag

SEQ ID NO: 3159303 - RNA, 22 nt, Human
aggcccuaucuguuuacagugu

SEQ ID NO: 3159304 - RNA, 23 nt, Human
agggaaggaucccaugagcuccu

SEQ ID NO: 3159305 - RNA, 15 nt, Human
agggaaggaucccau

SEQ ID NO: 3159306 - RNA, 22 nt, Human
agggaaggaucccaugagcucc

SEQ ID NO: 3159307 - RNA, 22 nt, Human
ugggagaaugucaguaugugga

SEQ ID NO: 3159308 - RNA, 20 nt, Human
ugggagaaugucaguaugug

SEQ ID NO: 3159309 - RNA, 19 nt, Human
ugggagaaugucaguaugu

SEQ ID NO: 3159310 - RNA, 16 nt, Human
ugggucgcccuggacu

SEQ ID NO: 3159311 - RNA, 18 nt, Human
ugggucgcccuggacugu

SEQ ID NO: 3159312 - RNA, 21 nt, Human
aggguggggggggggcgcggc

SEQ ID NO: 3159313 - RNA, 14 nt, Human
uggggagggauuug

SEQ ID NO: 3159314 - RNA, 13 nt, Human
uggggagagacgg

SEQ ID NO: 3159315 - RNA, 22 nt, Human
uggggagggauuuggggcucag

SEQ ID NO: 3159316 - RNA, 15 nt, Human
uggggcucagagugg

SEQ ID NO: 3159317 - RNA, 16 nt, Human
uguaaaggaauuuaaa

SEQ ID NO: 3159318 - RNA, 17 nt, Human
uguaaauaaaggaacca

SEQ ID NO: 3159319 - RNA, 16 nt, Human
uguaaauaguauuuga

SEQ ID NO: 3159320 - RNA, 20 nt, Human
aggugcauauuuauaaaaau

SEQ ID NO: 3159321 - RNA, 18 nt, Human
aggugcccagaaugaggc

SEQ ID NO: 3159322 - RNA, 22 nt, Human
aggugcccagaaugaggcugcu

SEQ ID NO: 3159323 - RNA, 16 nt, Human
aguaguaauagagcaa

SEQ ID NO: 3159324 - RNA, 22 nt, Human
uguauucuagcuaauguaauaa

SEQ ID NO: 3159325 - RNA, 13 nt, Human
uguauuacaaauc

SEQ ID NO: 3159326 - RNA, 20 nt, Human
uguauucuagcuaauguaau

SEQ ID NO: 3159327 - RNA, 12 nt, Human
uguauguggggg

SEQ ID NO: 3159328 - RNA, 14 nt, Human
aguaauagagcaaa

SEQ ID NO: 3159329 - RNA, 13 nt, Human
aguaaaauccaca

SEQ ID NO: 3159330 - RNA, 19 nt, Human
agguuuuuguagugauuuu

SEQ ID NO: 3159331 - RNA, 23 nt, Human
agguuuguuuagaagaagugugu

SEQ ID NO: 3159332 - RNA, 19 nt, Human
uguacuugcucuugaugcc

SEQ ID NO: 3159333 - RNA, 22 nt, Human
uguacuugcucuugaugccugg

SEQ ID NO: 3159334 - RNA, 23 nt, Human
uguacuugcucuugaugccuggc

SEQ ID NO: 3159335 - RNA, 21 nt, Human
uguagugauuuuuaugccacc

SEQ ID NO: 3159336 - RNA, 15 nt, Human
aguaauucaagaaaa

SEQ ID NO: 3159337 - RNA, 17 nt, Human
uggacuguucccugagg

SEQ ID NO: 3159338 - RNA, 16 nt, Human
uggacuguucccugag

SEQ ID NO: 3159339 - RNA, 15 nt, Human
uggagcaaagcugau

SEQ ID NO: 3159340 - RNA, 14 nt, Human
uggaguugaaaauc

SEQ ID NO: 3159341 - RNA, 16 nt, Human
uggauucugagagcug

SEQ ID NO: 3159342 - RNA, 17 nt, Human
uggauucugagagcugu

SEQ ID NO: 3159343 - RNA, 16 nt, Human
ugcuuuuuauggccug

SEQ ID NO: 3159344 - RNA, 15 nt, Human
uggaagagggcugca

SEQ ID NO: 3159345 - RNA, 17 nt, Human
aggagaguagaacagau

SEQ ID NO: 3159346 - RNA, 23 nt, Human
aggagcccugggaggcucuggag

SEQ ID NO: 3159347 - RNA, 21 nt, Human
agcuuuggcuaugagggccuu

SEQ ID NO: 3159348 - RNA, 20 nt, Human
agcuuuggcuaugagggccu

SEQ ID NO: 3159349 - RNA, 22 nt, Human
agcuuugagguggaagagggcu

SEQ ID NO: 3159350 - RNA, 16 nt, Human
ugcuaauuuugaaaaa

SEQ ID NO: 3159351 - RNA, 18 nt, Human
ugcuaauuuugaaaaacu

SEQ ID NO: 3159352 - RNA, 19 nt, Human
ugcuaauuuugaaaaacug

SEQ ID NO: 3159353 - RNA, 20 nt, Human
ugcuaauuuugaaaaacugc

SEQ ID NO: 3159354 - RNA, 15 nt, Human
ugccuugucacgcca

SEQ ID NO: 3159355 - RNA, 16 nt, Human
ugccuuggugugcugu

SEQ ID NO: 3159356 - RNA, 16 nt, Human
ugcuaugagcugggga

SEQ ID NO: 3159357 - RNA, 20 nt, Human
ugcuaugagcuggggauguc

SEQ ID NO: 3159358 - RNA, 19 nt, Human
ugcuaugagcuggggaugu

SEQ ID NO: 3159359 - RNA, 22 nt, Human
ugcuaugagcuggggaugucuc

SEQ ID NO: 3159360 - RNA, 22 nt, Human
ugccugcuuuuuauggccugug

SEQ ID NO: 3159361 - RNA, 20 nt, Human
ugccugcuuuuuauggccug

SEQ ID NO: 3159362 - RNA, 21 nt, Human
ugccugcuuuuuauggccugu

SEQ ID NO: 3159363 - RNA, 16 nt, Human
ugccaucauguuuaca

SEQ ID NO: 3159364 - RNA, 22 nt, Human
ugccgagaguccaucagccucc

SEQ ID NO: 3159365 - RNA, 17 nt, Human
agcccugggaggcucug

SEQ ID NO: 3159366 - RNA, 18 nt, Human
agcccugggaggcucugg

SEQ ID NO: 3159367 - RNA, 20 nt, Human
agcccugggaggcucuggag

SEQ ID NO: 3159368 - RNA, 23 nt, Human
agccccgcguggaacucgugucu

SEQ ID NO: 3159369 - RNA, 18 nt, Human
agcccugaguuccuagcc

SEQ ID NO: 3159370 - RNA, 20 nt, Human
agcccugaguuccuagccac

SEQ ID NO: 3159371 - RNA, 23 nt, Human
agcccugaguuccuagccaccgc

SEQ ID NO: 3159372 - RNA, 14 nt, Human
agcccugaguuccu

SEQ ID NO: 3159373 - RNA, 15 nt, Human
agccuguuuaagaga

SEQ ID NO: 3159374 - RNA, 17 nt, Human
ugcauagaauaaaauuu

SEQ ID NO: 3159375 - RNA, 16 nt, Human
agccucuccacucaug

SEQ ID NO: 3159376 - RNA, 17 nt, Human
agccucgacacagagug

SEQ ID NO: 3159377 - RNA, 18 nt, Human
agccucgacacagagugg

SEQ ID NO: 3159378 - RNA, 21 nt, Human
ugcaggucccuaauaaagcug

SEQ ID NO: 3159379 - RNA, 22 nt, Human
ugcaggucccuaauaaagcugu

SEQ ID NO: 3159380 - RNA, 14 nt, Human
ugaguuccuagcca

SEQ ID NO: 3159381 - RNA, 18 nt, Human
ugaguuccuagccaccgc

SEQ ID NO: 3159382 - RNA, 13 nt, Human
ugauaaguucaua

SEQ ID NO: 3159383 - RNA, 15 nt, Human
ugauaaguucauaca

SEQ ID NO: 3159384 - RNA, 17 nt, Human
ugauaaguucauacauu

SEQ ID NO: 3159385 - RNA, 19 nt, Human
ugauaaguucauacauugu

SEQ ID NO: 3159386 - RNA, 16 nt, Human
ugauaaguaaaugcua

SEQ ID NO: 3159387 - RNA, 20 nt, Human
ugaguucuacauaaguaauu

SEQ ID NO: 3159388 - RNA, 15 nt, Human
ugaguucuacauaag

SEQ ID NO: 3159389 - RNA, 21 nt, Human
agcagguccccagcuuuggcu

SEQ ID NO: 3159390 - RNA, 20 nt, Human
agcagguccccagcuuuggc

SEQ ID NO: 3159391 - RNA, 20 nt, Human
agcaucacaugaacuuguaa

SEQ ID NO: 3159392 - RNA, 23 nt, Human
ugauccagaaagaaaacuuguau

SEQ ID NO: 3159393 - RNA, 13 nt, Human
ugauccagaaaga

SEQ ID NO: 3159394 - RNA, 15 nt, Human
ugaugaaaauauuua

SEQ ID NO: 3159395 - RNA, 18 nt, Human
ugaugaaaauauuuaaag

SEQ ID NO: 3159396 - RNA, 15 nt, Human
ugaugggucaguugu

SEQ ID NO: 3159397 - RNA, 12 nt, Human
auugauguguuu

SEQ ID NO: 3159398 - RNA, 18 nt, Human
auugaugggauuugguca

SEQ ID NO: 3159399 - RNA, 19 nt, Human
auugauguguuuauuuaua

SEQ ID NO: 3159400 - RNA, 17 nt, Human
auuguacgaagaguauu

SEQ ID NO: 3159401 - RNA, 20 nt, Human
auuucuugagguaaaagcau

SEQ ID NO: 3159402 - RNA, 18 nt, Human
auuugaauguuaagcaga

SEQ ID NO: 3159403 - RNA, 13 nt, Human
auuugaauguuaa

SEQ ID NO: 3159404 - RNA, 23 nt, Human
auuugaauguaugcuucauacag

SEQ ID NO: 3159405 - RNA, 19 nt, Human
auuugaauguuaagcagau

SEQ ID NO: 3159406 - RNA, 21 nt, Human
auuuggagacacaacuauuuu

SEQ ID NO: 3159407 - RNA, 21 nt, Human
auuuccuaaauauauuuuaag

SEQ ID NO: 3159408 - RNA, 14 nt, Human
auuuccuaaauaua

SEQ ID NO: 3159409 - RNA, 16 nt, Human
auuguaguccuguaau

SEQ ID NO: 3159410 - RNA, 18 nt, Human
auuguagagccagagguc

SEQ ID NO: 3159411 - RNA, 17 nt, Human
auuguagagccagaggu

SEQ ID NO: 3159412 - RNA, 15 nt, Human
auuuaaaauugugau

SEQ ID NO: 3159413 - RNA, 16 nt, Human
auuuaguguucauaaa

SEQ ID NO: 3159414 - RNA, 23 nt, Human
auuuauaaaaauaaaaaacacug

SEQ ID NO: 3159415 - RNA, 17 nt, Human
auuuaguguucauaaau

SEQ ID NO: 3159416 - RNA, 15 nt, Human
auuuauaaacuuuuu

SEQ ID NO: 3159417 - RNA, 15 nt, Human
uuuuugaagcuguau

SEQ ID NO: 3159418 - RNA, 12 nt, Human
uuuuugacagaa

SEQ ID NO: 3159419 - RNA, 13 nt, Human
uuuuugacagaau

SEQ ID NO: 3159420 - RNA, 20 nt, Human
uuuuuguagcacugacagau

SEQ ID NO: 3159421 - RNA, 21 nt, Human
uuuuuguagcacugacagauu

SEQ ID NO: 3159422 - RNA, 17 nt, Human
uuuuuguagcacugaca

SEQ ID NO: 3159423 - RNA, 19 nt, Human
uuuuuguagcacugacaga

SEQ ID NO: 3159424 - RNA, 21 nt, Human
auuauuuuguucauacauauu

SEQ ID NO: 3159425 - RNA, 20 nt, Human
auuauauggcuugaguuuaa

SEQ ID NO: 3159426 - RNA, 17 nt, Human
auuccaagugauugaaa

SEQ ID NO: 3159427 - RNA, 14 nt, Human
auucagccuggcuu

SEQ ID NO: 3159428 - RNA, 22 nt, Human
auucaggagaguagaacagaua

SEQ ID NO: 3159429 - RNA, 21 nt, Human
auucaggagaguagaacagau

SEQ ID NO: 3159430 - RNA, 15 nt, Human
auucagccuggcuuc

SEQ ID NO: 3159431 - RNA, 22 nt, Human
uuuuauguugcauagaauaaaa

SEQ ID NO: 3159432 - RNA, 15 nt, Human
auguuuuuuuuuaaa

SEQ ID NO: 3159433 - RNA, 23 nt, Human
auguguguguguuguguguggga

SEQ ID NO: 3159434 - RNA, 22 nt, Human
auguguguguguuguguguggg

SEQ ID NO: 3159435 - RNA, 18 nt, Human
auguguguguguugugug

SEQ ID NO: 3159436 - RNA, 23 nt, Human
auguggaaaagccaagaggcugc

SEQ ID NO: 3159437 - RNA, 12 nt, Human
auguguuuccau

SEQ ID NO: 3159438 - RNA, 12 nt, Human
auguuaagcaga

SEQ ID NO: 3159439 - RNA, 17 nt, Human
auguauauaaacaugcu

SEQ ID NO: 3159440 - RNA, 18 nt, Human
uuuggcaaacucuccacc

SEQ ID NO: 3159441 - RNA, 18 nt, Human
uuugacaaagguaaauca

SEQ ID NO: 3159442 - RNA, 18 nt, Human
uuugacagaauauguuuc

SEQ ID NO: 3159443 - RNA, 19 nt, Human
uuugacagaauauguuuca

SEQ ID NO: 3159444 - RNA, 20 nt, Human
uuugacagaauauguuucaa

SEQ ID NO: 3159445 - RNA, 21 nt, Human
uuugacagaauauguuucaaa

SEQ ID NO: 3159446 - RNA, 19 nt, Human
uuucccuuccuuccucucc

SEQ ID NO: 3159447 - RNA, 23 nt, Human
uuugaccuguugggagugaggau

SEQ ID NO: 3159448 - RNA, 13 nt, Human
uuugagaguucua

SEQ ID NO: 3159449 - RNA, 23 nt, Human
augucgucaaagcugaaauggac

SEQ ID NO: 3159450 - RNA, 18 nt, Human
uuuguaagguuuuuguag

SEQ ID NO: 3159451 - RNA, 22 nt, Human
uuuguagugauuuuuaugccac

SEQ ID NO: 3159452 - RNA, 15 nt, Human
uuuguagugauuuuu

SEQ ID NO: 3159453 - RNA, 17 nt, Human
auauaaguauucuaaau

SEQ ID NO: 3159454 - RNA, 21 nt, Human
uucagaaaauauuauguguuu

SEQ ID NO: 3159455 - RNA, 20 nt, Human
uucagaaaauauuauguguu

SEQ ID NO: 3159456 - RNA, 14 nt, Human
uucagaaaauauua

SEQ ID NO: 3159457 - RNA, 13 nt, Human
uucagaaaauauu

SEQ ID NO: 3159458 - RNA, 18 nt, Human
auauauucagccuggcuu

SEQ ID NO: 3159459 - RNA, 16 nt, Human
uucaaacuuuggaaca

SEQ ID NO: 3159460 - RNA, 16 nt, Human
uucaaaaaacuuguaa

SEQ ID NO: 3159461 - RNA, 22 nt, Human
uucaagaaaacaacuucaauau

SEQ ID NO: 3159462 - RNA, 17 nt, Human
auaggcacaggaaacca

SEQ ID NO: 3159463 - RNA, 20 nt, Human
uucacauaucuaguaugaaa

SEQ ID NO: 3159464 - RNA, 21 nt, Human
uucacauaucuaguaugaaau

SEQ ID NO: 3159465 - RNA, 19 nt, Human
uucacauuguauucagagu

SEQ ID NO: 3159466 - RNA, 14 nt, Human
auagcuacuaauuu

SEQ ID NO: 3159467 - RNA, 17 nt, Human
auagcuacuaauuuuaa

SEQ ID NO: 3159468 - RNA, 18 nt, Human
auagcuacuaauuuuaaa

SEQ ID NO: 3159469 - RNA, 17 nt, Human
auauguuucaaacuuug

SEQ ID NO: 3159470 - RNA, 15 nt, Human
auauugauccagaaa

SEQ ID NO: 3159471 - RNA, 22 nt, Human
auauugauccagaaagaaaacu

SEQ ID NO: 3159472 - RNA, 18 nt, Human
auauuguguugugaaugu

SEQ ID NO: 3159473 - RNA, 17 nt, Human
auauuguguugugaaug

SEQ ID NO: 3159474 - RNA, 20 nt, Human
auauuuguaaauuuauguga

SEQ ID NO: 3159475 - RNA, 13 nt, Human
uucucuucacuca

SEQ ID NO: 3159476 - RNA, 12 nt, Human
uucugccaggag

SEQ ID NO: 3159477 - RNA, 11 nt, Human
aucccaacacu

SEQ ID NO: 3159478 - RNA, 15 nt, Human
aucccaacacugcca

SEQ ID NO: 3159479 - RNA, 16 nt, Human
aucccaacacugccag

SEQ ID NO: 3159480 - RNA, 17 nt, Human
aucccaacacugccagc

SEQ ID NO: 3159481 - RNA, 16 nt, Human
uucuaguucugccagg

SEQ ID NO: 3159482 - RNA, 17 nt, Human
uucuaguucugccagga

SEQ ID NO: 3159483 - RNA, 23 nt, Human
aucauguuuacagaggacaguau

SEQ ID NO: 3159484 - RNA, 18 nt, Human
aucauguuuacagaggac

SEQ ID NO: 3159485 - RNA, 14 nt, Human
aucauucauuuucu

SEQ ID NO: 3159486 - RNA, 19 nt, Human
aucagugugucuaaauuug

SEQ ID NO: 3159487 - RNA, 16 nt, Human
aucagugucuuuccac

SEQ ID NO: 3159488 - RNA, 16 nt, Human
aucucuuguuuaaauu

SEQ ID NO: 3159489 - RNA, 14 nt, Human
aucugacuaugaca

SEQ ID NO: 3159490 - RNA, 17 nt, Human
aucugacuaugacauaa

SEQ ID NO: 3159491 - RNA, 20 nt, Human
uugauguguuuauuuauaga

SEQ ID NO: 3159492 - RNA, 18 nt, Human
uugcaacuuuguauaaaa

SEQ ID NO: 3159493 - RNA, 16 nt, Human
uugcaacuuuguauaa

SEQ ID NO: 3159494 - RNA, 17 nt, Human
uugcaacuuuguauaaa

SEQ ID NO: 3159495 - RNA, 18 nt, Human
augaacuuguaaaggaau

SEQ ID NO: 3159496 - RNA, 14 nt, Human
augaagcaaugcuu

SEQ ID NO: 3159497 - RNA, 22 nt, Human
augaagauguuucaaaaaaucu

SEQ ID NO: 3159498 - RNA, 15 nt, Human
augaagcaaugcuuc

SEQ ID NO: 3159499 - RNA, 18 nt, Human
uuggagccugcagagcug

SEQ ID NO: 3159500 - RNA, 19 nt, Human
uuguaaauuuaugugaugg

SEQ ID NO: 3159501 - RNA, 18 nt, Human
uugcucuugaugccuggc

SEQ ID NO: 3159502 - RNA, 14 nt, Human
uugcucuugaugcc

SEQ ID NO: 3159503 - RNA, 17 nt, Human
uugcucuugaugccugg

SEQ ID NO: 3159504 - RNA, 16 nt, Human
uuggacuugucccggg

SEQ ID NO: 3159505 - RNA, 15 nt, Human
uuggagccugcagag

SEQ ID NO: 3159506 - RNA, 11 nt, Human
uuggagccugc

SEQ ID NO: 3159507 - RNA, 15 nt, Human
aucuuauaauuuaaa

SEQ ID NO: 3159508 - RNA, 14 nt, Human
aucuuauaauuuaa

SEQ ID NO: 3159509 - RNA, 22 nt, Human
aucugugaggggcucucucaug

SEQ ID NO: 3159510 - RNA, 21 nt, Human
aucugugaggggcucucucau

SEQ ID NO: 3159511 - RNA, 22 nt, Human
uuucacauaucuaguaugaaau

SEQ ID NO: 3159512 - RNA, 17 nt, Human
auggaaugcuguguuaa

SEQ ID NO: 3159513 - RNA, 21 nt, Human
auggaaugcuguguuaaauaa

SEQ ID NO: 3159514 - RNA, 18 nt, Human
augcuacaggauuugaaa

SEQ ID NO: 3159515 - RNA, 18 nt, Human
uuuaaauauaugcuaagu

SEQ ID NO: 3159516 - RNA, 21 nt, Human
uuuaaauauaugcuaagucuu

SEQ ID NO: 3159517 - RNA, 20 nt, Human
uuuaagacgaaacauuuguu

SEQ ID NO: 3159518 - RNA, 14 nt, Human
uuuaagagacagcc

SEQ ID NO: 3159519 - RNA, 18 nt, Human
uuuaaaaaaauuccaagu

SEQ ID NO: 3159520 - RNA, 16 nt, Human
uuguucauacauauuu

SEQ ID NO: 3159521 - RNA, 18 nt, Human
uuguucauacauauuuuu

SEQ ID NO: 3159522 - RNA, 16 nt, Human
uuguagcuuuaucaaa

SEQ ID NO: 3159523 - RNA, 17 nt, Human
uuguagcuuuaucaaag

SEQ ID NO: 3159524 - RNA, 20 nt, Human
augagggucuugguuccagc

SEQ ID NO: 3159525 - RNA, 18 nt, Human
augaguuggcugggaaua

SEQ ID NO: 3159526 - RNA, 12 nt, Human
uugugauguguc

SEQ ID NO: 3159527 - RNA, 13 nt, Human
uuguucauacaua

SEQ ID NO: 3159528 - RNA, 22 nt, Human
uuguucaauaauaaauauuuuu

SEQ ID NO: 3159529 - RNA, 20 nt, Human
uuguucaauaauaaauauuu

SEQ ID NO: 3159530 - RNA, 20 nt, Human
aucaaagggugaaaauuauu

SEQ ID NO: 3159531 - RNA, 18 nt, Human
aucaaagagagaaaauaa

SEQ ID NO: 3159532 - RNA, 21 nt, Human
auccagcccugaguuccuagc

SEQ ID NO: 3159533 - RNA, 23 nt, Human
auccacuuuaucuugaauaaugu

SEQ ID NO: 3159534 - RNA, 23 nt, Human
auggagauagccccacaggaggu

SEQ ID NO: 3159535 - RNA, 20 nt, Human
augcauauuauuuuauguug

SEQ ID NO: 3159536 - RNA, 24 nt, Human
augcauauuauuuuauguugcaua

SEQ ID NO: 3159537 - RNA, 19 nt, Human
aucuaggauuuuaagggaa

SEQ ID NO: 3159538 - RNA, 11 nt, Human
aucuaggauuu

SEQ ID NO: 3159539 - RNA, 13 nt, Human
augaaacuuggau

SEQ ID NO: 3159540 - RNA, 23 nt, Human
augaaguuuuuuuuauacaggau

SEQ ID NO: 3159541 - RNA, 22 nt, Human
augaggcugcuuuccaaagcca

SEQ ID NO: 3159542 - RNA, 20 nt, Human
aguuguucaauaauaaauau

SEQ ID NO: 3159543 - RNA, 16 nt, Human
auaaaagacagugaaa

SEQ ID NO: 3159544 - RNA, 15 nt, Human
auaaaagacagugaa

SEQ ID NO: 3159545 - RNA, 23 nt, Human
auaaaaauauuguguugugaaug

SEQ ID NO: 3159546 - RNA, 22 nt, Human
auaaaaauauuguguugugaau

SEQ ID NO: 3159547 - RNA, 14 nt, Human
auaaaaacaacuuu

SEQ ID NO: 3159548 - RNA, 20 nt, Human
auaaaaagacauucuuccaa

SEQ ID NO: 3159549 - RNA, 23 nt, Human
aguuugcuagcagaaaucuagaa

SEQ ID NO: 3159550 - RNA, 17 nt, Human
auaaguaauucaagaaa

SEQ ID NO: 3159551 - RNA, 15 nt, Human
auaaguaaaugcuag

SEQ ID NO: 3159552 - RNA, 21 nt, Human
auacacuaugaagauguuuca

SEQ ID NO: 3159553 - RNA, 19 nt, Human
auacuugaaaauuaacaug

SEQ ID NO: 3159554 - RNA, 22 nt, Human
aguauauugauccagaaagaaa

SEQ ID NO: 3159555 - RNA, 13 nt, Human
agugaaugaaaca

SEQ ID NO: 3159556 - RNA, 13 nt, Human
agcuacaaaugca

SEQ ID NO: 3159557 - RNA, 12 nt, Human
agcuacaaaugc

SEQ ID NO: 3159558 - RNA, 15 nt, Human
agcgaauuuuaaaag

SEQ ID NO: 3159559 - RNA, 16 nt, Human
agcgaauuuuaaaaga

SEQ ID NO: 3159560 - RNA, 13 nt, Human
agcgaauuuuaaa

SEQ ID NO: 3159561 - RNA, 17 nt, Human
agccugcugccugcuuu

SEQ ID NO: 3159562 - RNA, 18 nt, Human
aggaaaaaauaacaauga

SEQ ID NO: 3159563 - RNA, 15 nt, Human
aggagggcaggcauc

SEQ ID NO: 3159564 - RNA, 15 nt, Human
aggagggaggugcuu

SEQ ID NO: 3159565 - RNA, 13 nt, Human
aggagggcaggca

SEQ ID NO: 3159566 - RNA, 20 nt, Human
aggagacagguuagcugcuc

SEQ ID NO: 3159567 - RNA, 18 nt, Human
aggaguuucguuuucaaa

SEQ ID NO: 3159568 - RNA, 13 nt, Human
aggaugucugggc

SEQ ID NO: 3159569 - RNA, 22 nt, Human
aggcagaacucaucuagguaaa

SEQ ID NO: 3159570 - RNA, 19 nt, Human
aggccagggggccaguccc

SEQ ID NO: 3159571 - RNA, 23 nt, Human
aggccagggggccagucccugag

SEQ ID NO: 3159572 - RNA, 19 nt, Human
aggcaucggggagccggga

SEQ ID NO: 3159573 - RNA, 15 nt, Human
agggaugcauggaga

SEQ ID NO: 3159574 - RNA, 22 nt, Human
agggauuuggggcucagagugg

SEQ ID NO: 3159575 - RNA, 15 nt, Human
agggacugagaaauu

SEQ ID NO: 3159576 - RNA, 13 nt, Human
agggacugagaaa

SEQ ID NO: 3159577 - RNA, 14 nt, Human
agggacugagaaau

SEQ ID NO: 3159578 - RNA, 14 nt, Human
aggcuagggugggg

SEQ ID NO: 3159579 - RNA, 15 nt, Human
aggcuagggugggga

SEQ ID NO: 3159580 - RNA, 16 nt, Human
aggcuaggguggggag

SEQ ID NO: 3159581 - RNA, 19 nt, Human
aggcuaggguggggagaga

SEQ ID NO: 3159582 - RNA, 22 nt, Human
aggcucuggagcccacuguacu

SEQ ID NO: 3159583 - RNA, 20 nt, Human
agauagauaggucagugcaa

SEQ ID NO: 3159584 - RNA, 19 nt, Human
agauagccccacaggaggu

SEQ ID NO: 3159585 - RNA, 19 nt, Human
agagugggguagguuggga

SEQ ID NO: 3159586 - RNA, 17 nt, Human
agauugagauguguuca

SEQ ID NO: 3159587 - RNA, 19 nt, Human
agcaaaauugauguguuua

SEQ ID NO: 3159588 - RNA, 13 nt, Human
agcaaaauugaug

SEQ ID NO: 3159589 - RNA, 23 nt, Human
agcaaaauugauguguuuauuua

SEQ ID NO: 3159590 - RNA, 14 nt, Human
agcagugggccugg

SEQ ID NO: 3159591 - RNA, 17 nt, Human
agcccaaaccaccagaa

SEQ ID NO: 3159592 - RNA, 19 nt, Human
agcccaaaccaccagaagc

SEQ ID NO: 3159593 - RNA, 20 nt, Human
agcccaaaccaccagaagcc

SEQ ID NO: 3159594 - RNA, 22 nt, Human
agcccaaaccaccagaagccca

SEQ ID NO: 3159595 - RNA, 14 nt, Human
agccaagaggcugc

SEQ ID NO: 3159596 - RNA, 17 nt, Human
agccaacuauggccugu

SEQ ID NO: 3159597 - RNA, 13 nt, Human
agcaucucccagu

SEQ ID NO: 3159598 - RNA, 13 nt, Human
agaacaucccucc

SEQ ID NO: 3159599 - RNA, 17 nt, Human
agaacaucccuccuggg

SEQ ID NO: 3159600 - RNA, 19 nt, Human
agaacagauaaucagugug

SEQ ID NO: 3159601 - RNA, 12 nt, Human
agaaugaggcug

SEQ ID NO: 3159602 - RNA, 13 nt, Human
agaaugaggcugc

SEQ ID NO: 3159603 - RNA, 14 nt, Human
agaaugaggcugcu

SEQ ID NO: 3159604 - RNA, 20 nt, Human
agaaugaggcugcuuuccaa

SEQ ID NO: 3159605 - RNA, 19 nt, Human
agacaaggaaaaaauaaca

SEQ ID NO: 3159606 - RNA, 18 nt, Human
agacgaaacauuuguucu

SEQ ID NO: 3159607 - RNA, 12 nt, Human
agagaggccauu

SEQ ID NO: 3159608 - RNA, 22 nt, Human
agagaggccauucuuucccaac

SEQ ID NO: 3159609 - RNA, 13 nt, Human
accaccagaagcc

SEQ ID NO: 3159610 - RNA, 15 nt, Human
accaccagaagccca

SEQ ID NO: 3159611 - RNA, 16 nt, Human
accaccagaagcccag

SEQ ID NO: 3159612 - RNA, 17 nt, Human
accaccagaagcccaga

SEQ ID NO: 3159613 - RNA, 21 nt, Human
acauaaguaauucaagaaaac

SEQ ID NO: 3159614 - RNA, 20 nt, Human
acauaaguauuuaauucaug

SEQ ID NO: 3159615 - RNA, 20 nt, Human
acauaaguaauucaagaaaa

SEQ ID NO: 3159616 - RNA, 23 nt, Human
acauguuucuuuguaaugaaaac

SEQ ID NO: 3159617 - RNA, 11 nt, Human
aauuguaauag

SEQ ID NO: 3159618 - RNA, 18 nt, Human
aauuucauaugcuguaua

SEQ ID NO: 3159619 - RNA, 16 nt, Human
aauuucauaugcugua

SEQ ID NO: 3159620 - RNA, 15 nt, Human
aauuauauaaguauu

SEQ ID NO: 3159621 - RNA, 16 nt, Human
aauuauauaaguauuc

SEQ ID NO: 3159622 - RNA, 17 nt, Human
aauuauauaaguauucu

SEQ ID NO: 3159623 - RNA, 16 nt, Human
acugacagauuuccau

SEQ ID NO: 3159624 - RNA, 16 nt, Human
acugauccagcccuga

SEQ ID NO: 3159625 - RNA, 17 nt, Human
acugauccagcccugag

SEQ ID NO: 3159626 - RNA, 12 nt, Human
acuugaaaauua

SEQ ID NO: 3159627 - RNA, 14 nt, Human
acuugaaaauuaac

SEQ ID NO: 3159628 - RNA, 17 nt, Human
acuguaaaauaauaacu

SEQ ID NO: 3159629 - RNA, 15 nt, Human
acugccuauuuuaau

SEQ ID NO: 3159630 - RNA, 22 nt, Human
acugucuuuuuucuaaaguaaa

SEQ ID NO: 3159631 - RNA, 23 nt, Human
acugucuuuuuucuaaaguaaaa

SEQ ID NO: 3159632 - RNA, 16 nt, Human
acugucuuuuuucuaa

SEQ ID NO: 3159633 - RNA, 13 nt, Human
accggggccuggg

SEQ ID NO: 3159634 - RNA, 16 nt, Human
acccucaucuuucuuc

SEQ ID NO: 3159635 - RNA, 19 nt, Human
acccucaucuuucuuccaa

SEQ ID NO: 3159636 - RNA, 13 nt, Human
acccucaucuuuc

SEQ ID NO: 3159637 - RNA, 14 nt, Human
acccucaucuuucu

SEQ ID NO: 3159638 - RNA, 21 nt, Human
aagacaaggaaaaaauaacaa

SEQ ID NO: 3159639 - RNA, 14 nt, Human
aagagagaaaauaa

SEQ ID NO: 3159640 - RNA, 19 nt, Human
aagaguauuuuugacagaa

SEQ ID NO: 3159641 - RNA, 16 nt, Human
aagaguaguaauagag

SEQ ID NO: 3159642 - RNA, 16 nt, Human
aaucucauaauuuaua

SEQ ID NO: 3159643 - RNA, 14 nt, Human
aaugaagcaaugcu

SEQ ID NO: 3159644 - RNA, 11 nt, Human
aauaaacacuc

SEQ ID NO: 3159645 - RNA, 16 nt, Human
aauaaacacucuugaa

SEQ ID NO: 3159646 - RNA, 19 nt, Human
aauaaacacucuugaaaaa

SEQ ID NO: 3159647 - RNA, 18 nt, Human
aaagccugcaauuucaua

SEQ ID NO: 3159648 - RNA, 13 nt, Human
aaagccugcaauu

SEQ ID NO: 3159649 - RNA, 20 nt, Human
aaaagacaaggaaaaaauaa

SEQ ID NO: 3159650 - RNA, 16 nt, Human
aaaagagaugaugaaa

SEQ ID NO: 3159651 - RNA, 19 nt, Human
aaaagagaugaugaaaaua

SEQ ID NO: 3159652 - RNA, 14 nt, Human
aaaagauaaauauu

SEQ ID NO: 3159653 - RNA, 17 nt, Human
aaaagauaaauauuaua

SEQ ID NO: 3159654 - RNA, 13 nt, Human
aaaagaucgcagu

SEQ ID NO: 3159655 - RNA, 23 nt, Human
aaaucucaaauuuggauugcuaa

SEQ ID NO: 3159656 - RNA, 14 nt, Human
aacaggcucagagg

SEQ ID NO: 3159657 - RNA, 18 nt, Human
aaccuuuguuugcaucug

SEQ ID NO: 3159658 - RNA, 15 nt, Human
cacaugagauaauau

SEQ ID NO: 3159659 - RNA, 16 nt, Human
cacaugagauaauaug

SEQ ID NO: 3159660 - RNA, 19 nt, Human
cacacguaaugaaacuugg

SEQ ID NO: 3159661 - RNA, 20 nt, Human
cacacguaaugaaacuugga

SEQ ID NO: 3159662 - RNA, 14 nt, Human
caccacacucagcc

SEQ ID NO: 3159663 - RNA, 15 nt, Human
caccacacucagccc

SEQ ID NO: 3159664 - RNA, 19 nt, Human
caccacacugauccagccc

SEQ ID NO: 3159665 - RNA, 20 nt, Human
caagcccaguucagcuuggg

SEQ ID NO: 3159666 - RNA, 11 nt, Human
caagagccuga

SEQ ID NO: 3159667 - RNA, 13 nt, Human
caagagccugaga

SEQ ID NO: 3159668 - RNA, 23 nt, Human
caagagccugagagugaggugga

SEQ ID NO: 3159669 - RNA, 13 nt, Human
caaagaaauuaug

SEQ ID NO: 3159670 - RNA, 12 nt, Human
caaagaaauuau

SEQ ID NO: 3159671 - RNA, 18 nt, Human
caaauucugucucuggau

SEQ ID NO: 3159672 - RNA, 22 nt, Human
ggcuugaguuuaaauuguaaua

SEQ ID NO: 3159673 - RNA, 20 nt, Human
gggaccccuggugguucacu

SEQ ID NO: 3159674 - RNA, 15 nt, Human
gggaaggaucccaug

SEQ ID NO: 3159675 - RNA, 13 nt, Human
ggcucuggagccc

SEQ ID NO: 3159676 - RNA, 14 nt, Human
ggcucuggagccca

SEQ ID NO: 3159677 - RNA, 20 nt, Human
ggccccugccagacccccug

SEQ ID NO: 3159678 - RNA, 22 nt, Human
ggcugcagccaggccacuggcc

SEQ ID NO: 3159679 - RNA, 16 nt, Human
ggcugcagccaggcca

SEQ ID NO: 3159680 - RNA, 15 nt, Human
ggcugcuuuccaaag

SEQ ID NO: 3159681 - RNA, 18 nt, Human
gggcagucugagagaggc

SEQ ID NO: 3159682 - RNA, 19 nt, Human
gggcagucugagagaggcc

SEQ ID NO: 3159683 - RNA, 17 nt, Human
gggcagucugagagagg

SEQ ID NO: 3159684 - RNA, 23 nt, Human
gggaggugcuucuaguucugcca

SEQ ID NO: 3159685 - RNA, 13 nt, Human
gggacugagaaau

SEQ ID NO: 3159686 - RNA, 16 nt, Human
gggaguuuaggguggg

SEQ ID NO: 3159687 - RNA, 11 nt, Human
gggagugugua

SEQ ID NO: 3159688 - RNA, 14 nt, Human
gggauagaugugug

SEQ ID NO: 3159689 - RNA, 13 nt, Human
gggauagaugugu

SEQ ID NO: 3159690 - RNA, 22 nt, Human
gggccccugccucucugcaggu

SEQ ID NO: 3159691 - RNA, 13 nt, Human
gggccugggcagg

SEQ ID NO: 3159692 - RNA, 15 nt, Human
gggccugggcaggag

SEQ ID NO: 3159693 - RNA, 12 nt, Human
gggccugggcag

SEQ ID NO: 3159694 - RNA, 13 nt, Human
gggccccugccuc

SEQ ID NO: 3159695 - RNA, 15 nt, Human
gggccccugccucuc

SEQ ID NO: 3159696 - RNA, 13 nt, Human
gggccccugccag

SEQ ID NO: 3159697 - RNA, 17 nt, Human
gggccccugccucucug

SEQ ID NO: 3159698 - RNA, 18 nt, Human
gggccccugccucucugc

SEQ ID NO: 3159699 - RNA, 19 nt, Human
gggccccugccucucugca

SEQ ID NO: 3159700 - RNA, 21 nt, Human
gggccccugccucucugcagg

SEQ ID NO: 3159701 - RNA, 20 nt, Human
gggcagucugagagaggcca

SEQ ID NO: 3159702 - RNA, 21 nt, Human
gggcagucugagagaggccau

SEQ ID NO: 3159703 - RNA, 18 nt, Human
gguagaucacgagaucaa

SEQ ID NO: 3159704 - RNA, 17 nt, Human
gggugcugggccccugc

SEQ ID NO: 3159705 - RNA, 20 nt, Human
gggucuugguuccagccugc

SEQ ID NO: 3159706 - RNA, 19 nt, Human
ggggcagucugagagaggc

SEQ ID NO: 3159707 - RNA, 18 nt, Human
ggggcagucugagagagg

SEQ ID NO: 3159708 - RNA, 15 nt, Human
ggggcagucugagag

SEQ ID NO: 3159709 - RNA, 15 nt, Human
ggggcgcggcuggga

SEQ ID NO: 3159710 - RNA, 16 nt, Human
ggggcgcggcugggag

SEQ ID NO: 3159711 - RNA, 16 nt, Human
gggccugggcaggagg

SEQ ID NO: 3159712 - RNA, 17 nt, Human
gggccugggcaggaggg

SEQ ID NO: 3159713 - RNA, 15 nt, Human
ggggaaaagagauga

SEQ ID NO: 3159714 - RNA, 15 nt, Human
gggggagagggcugc

SEQ ID NO: 3159715 - RNA, 18 nt, Human
ggggugcugggccccugc

SEQ ID NO: 3159716 - RNA, 20 nt, Human
gggguggggggggugcuggg

SEQ ID NO: 3159717 - RNA, 19 nt, Human
ggugaccuuccaagagccu

SEQ ID NO: 3159718 - RNA, 20 nt, Human
ggugaccuuccaagagccug

SEQ ID NO: 3159719 - RNA, 21 nt, Human
ggugaccuuccaagagccuga

SEQ ID NO: 3159720 - RNA, 21 nt, Human
gguguccugcaccggggccug

SEQ ID NO: 3159721 - RNA, 17 nt, Human
gguguuuuaaaaaaucu

SEQ ID NO: 3159722 - RNA, 19 nt, Human
gguucacucuuggagccug

SEQ ID NO: 3159723 - RNA, 20 nt, Human
gguucacucuuggagccugc

SEQ ID NO: 3159724 - RNA, 21 nt, Human
gguucacucuuggagccugca

SEQ ID NO: 3159725 - RNA, 23 nt, Human
gguucacucuuggagccugcaga

SEQ ID NO: 3159726 - RNA, 15 nt, Human
ggugguggcucggga

SEQ ID NO: 3159727 - RNA, 22 nt, Human
ggugguucacucuuggagccug

SEQ ID NO: 3159728 - RNA, 23 nt, Human
ggugguucacucuuggagccugc

SEQ ID NO: 3159729 - RNA, 16 nt, Human
ggagccgggagccuga

SEQ ID NO: 3159730 - RNA, 14 nt, Human
ggaggagggcaggc

SEQ ID NO: 3159731 - RNA, 15 nt, Human
ggaggagggcaggca

SEQ ID NO: 3159732 - RNA, 20 nt, Human
ggaggagggcaggcaucggg

SEQ ID NO: 3159733 - RNA, 13 nt, Human
ggagggcaggcau

SEQ ID NO: 3159734 - RNA, 12 nt, Human
ggagggauuugg

SEQ ID NO: 3159735 - RNA, 15 nt, Human
ggauagaugugugga

SEQ ID NO: 3159736 - RNA, 14 nt, Human
ggauagaugugugg

SEQ ID NO: 3159737 - RNA, 13 nt, Human
ggauagaugugug

SEQ ID NO: 3159738 - RNA, 13 nt, Human
ggagcccugggag

SEQ ID NO: 3159739 - RNA, 12 nt, Human
ggagcccuggga

SEQ ID NO: 3159740 - RNA, 17 nt, Human
ggaaggaucccaugagc

SEQ ID NO: 3159741 - RNA, 17 nt, Human
ggccccugccagacccc

SEQ ID NO: 3159742 - RNA, 19 nt, Human
ggccccugccagacccccu

SEQ ID NO: 3159743 - RNA, 17 nt, Human
ggccccugagaucucug

SEQ ID NO: 3159744 - RNA, 21 nt, Human
ggccccugagaucucugcagg

SEQ ID NO: 3159745 - RNA, 20 nt, Human
ggcagucugagagaggccau

SEQ ID NO: 3159746 - RNA, 18 nt, Human
ggccaggcugggucgccc

SEQ ID NO: 3159747 - RNA, 22 nt, Human
ggccaggcugggucgcccugga

SEQ ID NO: 3159748 - RNA, 14 nt, Human
ggcagguccccaga

SEQ ID NO: 3159749 - RNA, 19 nt, Human
ggcagguccccagacucca

SEQ ID NO: 3159750 - RNA, 20 nt, Human
ggaucccaugagcuccuuaa

SEQ ID NO: 3159751 - RNA, 17 nt, Human
ggaucccaugagcuccu

SEQ ID NO: 3159752 - RNA, 17 nt, Human
gcugggaggagggcagg

SEQ ID NO: 3159753 - RNA, 19 nt, Human
gcugggaggagggcaggca

SEQ ID NO: 3159754 - RNA, 16 nt, Human
gcuggggccaggcugg

SEQ ID NO: 3159755 - RNA, 19 nt, Human
gcuggggccaggcuggguc

SEQ ID NO: 3159756 - RNA, 23 nt, Human
gcuagcagaaaucuagaagacug

SEQ ID NO: 3159757 - RNA, 15 nt, Human
gcugccuuuggacuu

SEQ ID NO: 3159758 - RNA, 20 nt, Human
gcugccuuuggacuuguccc

SEQ ID NO: 3159759 - RNA, 23 nt, Human
gcugggacaccccgacuuuuguu

SEQ ID NO: 3159760 - RNA, 15 nt, Human
ggaaccgaggcaggg

SEQ ID NO: 3159761 - RNA, 16 nt, Human
ggaaccgaggcaggga

SEQ ID NO: 3159762 - RNA, 20 nt, Human
ggaaccgaggcagggaagga

SEQ ID NO: 3159763 - RNA, 17 nt, Human
ggaacucgugucuggca

SEQ ID NO: 3159764 - RNA, 20 nt, Human
ggaaaaaauaacaaugaaag

SEQ ID NO: 3159765 - RNA, 14 nt, Human
gcuuuaucaaaggg

SEQ ID NO: 3159766 - RNA, 19 nt, Human
gcuucuggugaccuuccaa

SEQ ID NO: 3159767 - RNA, 18 nt, Human
gcuucuaguucugccagg

SEQ ID NO: 3159768 - RNA, 19 nt, Human
gcuucuaguucugccagga

SEQ ID NO: 3159769 - RNA, 20 nt, Human
gcuucuaguucugccaggag

SEQ ID NO: 3159770 - RNA, 21 nt, Human
gcuucuaguucugccaggaga

SEQ ID NO: 3159771 - RNA, 22 nt, Human
gccacucaggcccaaagccucg

SEQ ID NO: 3159772 - RNA, 14 nt, Human
gccacucaggccca

SEQ ID NO: 3159773 - RNA, 22 nt, Human
gcccaucugggggccucuucug

SEQ ID NO: 3159774 - RNA, 20 nt, Human
gccccugagaucucugcagg

SEQ ID NO: 3159775 - RNA, 13 nt, Human
gccccgcguggaa

SEQ ID NO: 3159776 - RNA, 14 nt, Human
gcuaagaauauuug

SEQ ID NO: 3159777 - RNA, 23 nt, Human
gccucucugcaggucccuaauaa

SEQ ID NO: 3159778 - RNA, 16 nt, Human
gccucucugcaggucc

SEQ ID NO: 3159779 - RNA, 17 nt, Human
gccucucugcagguccc

SEQ ID NO: 3159780 - RNA, 10 nt, Human
gccucucugc

SEQ ID NO: 3159781 - RNA, 14 nt, Human
gccucucugcaggu

SEQ ID NO: 3159782 - RNA, 20 nt, Human
gccugcagagcugcgggcug

SEQ ID NO: 3159783 - RNA, 15 nt, Human
gccugcagagcugcg

SEQ ID NO: 3159784 - RNA, 21 nt, Human
gccgagaguccaucagccucc

SEQ ID NO: 3159785 - RNA, 19 nt, Human
gccgggagccugacccuca

SEQ ID NO: 3159786 - RNA, 13 nt, Human
gccgggagccuga

SEQ ID NO: 3159787 - RNA, 14 nt, Human
gccgggagccugac

SEQ ID NO: 3159788 - RNA, 17 nt, Human
gccuaaccugccgagag

SEQ ID NO: 3159789 - RNA, 17 nt, Human
gccuauuuuaauaaaca

SEQ ID NO: 3159790 - RNA, 12 nt, Human
gcaggucccuaa

SEQ ID NO: 3159791 - RNA, 13 nt, Human
gcaggucccuaau

SEQ ID NO: 3159792 - RNA, 23 nt, Human
gcagguccccagacuccaccaag

SEQ ID NO: 3159793 - RNA, 10 nt, Human
gcaggucccu

SEQ ID NO: 3159794 - RNA, 11 nt, Human
gcaggucccua

SEQ ID NO: 3159795 - RNA, 14 nt, Human
gcagguccccagac

SEQ ID NO: 3159796 - RNA, 23 nt, Human
gcauauuauuuuauguugcauag

SEQ ID NO: 3159797 - RNA, 18 nt, Human
gcauauuauuuuauguug

SEQ ID NO: 3159798 - RNA, 17 nt, Human
gcauuuuacuguacaga

SEQ ID NO: 3159799 - RNA, 16 nt, Human
gcauuuuacuguacag

SEQ ID NO: 3159800 - RNA, 17 nt, Human
gcaugaauuugugaagg

SEQ ID NO: 3159801 - RNA, 15 nt, Human
gcaugaauuugugaa

SEQ ID NO: 3159802 - RNA, 18 nt, Human
gcagauggaaugcugugu

SEQ ID NO: 3159803 - RNA, 19 nt, Human
gcagauuuugcccuugaca

SEQ ID NO: 3159804 - RNA, 15 nt, Human
gcaggagggaggugc

SEQ ID NO: 3159805 - RNA, 11 nt, Human
gcaggaggaag

SEQ ID NO: 3159806 - RNA, 20 nt, Human
gcaggaguuucguuuucaaa

SEQ ID NO: 3159807 - RNA, 21 nt, Human
gcaggaguuucguuuucaaaa

SEQ ID NO: 3159808 - RNA, 12 nt, Human
gcacagccuggc

SEQ ID NO: 3159809 - RNA, 19 nt, Human
gcacagccuggcuguggcc

SEQ ID NO: 3159810 - RNA, 19 nt, Human
gcacaugccuguaguccca

SEQ ID NO: 3159811 - RNA, 16 nt, Human
gauugggaauccgccc

SEQ ID NO: 3159812 - RNA, 15 nt, Human
gauugggccccugcc

SEQ ID NO: 3159813 - RNA, 22 nt, Human
gcaacuuuguauaaaagggacu

SEQ ID NO: 3159814 - RNA, 12 nt, Human
gcaaaugugaau

SEQ ID NO: 3159815 - RNA, 20 nt, Human
gcaaacuuuauuuuguguuu

SEQ ID NO: 3159816 - RNA, 18 nt, Human
gcaaacuuuauuuugugu

SEQ ID NO: 3159817 - RNA, 11 nt, Human
gaguucuacau

SEQ ID NO: 3159818 - RNA, 18 nt, Human
gacuucccacggcuccuc

SEQ ID NO: 3159819 - RNA, 22 nt, Human
gaguguguaauuuaaaauugug

SEQ ID NO: 3159820 - RNA, 21 nt, Human
gaguguguaauuuaaaauugu

SEQ ID NO: 3159821 - RNA, 12 nt, Human
gacccccuggag

SEQ ID NO: 3159822 - RNA, 17 nt, Human
gacauaaaaacaacuuu

SEQ ID NO: 3159823 - RNA, 18 nt, Human
gacuaaccccaccacacc

SEQ ID NO: 3159824 - RNA, 16 nt, Human
gaccuuccaagagccu

SEQ ID NO: 3159825 - RNA, 17 nt, Human
gaccuuccaagagccug

SEQ ID NO: 3159826 - RNA, 18 nt, Human
gaccuuccaagagccuga

SEQ ID NO: 3159827 - RNA, 13 nt, Human
gacugagaaauuu

SEQ ID NO: 3159828 - RNA, 11 nt, Human
gacugagaaau

SEQ ID NO: 3159829 - RNA, 21 nt, Human
gaacagcggcuggacuuggag

SEQ ID NO: 3159830 - RNA, 18 nt, Human
gaacagauaaucagugug

SEQ ID NO: 3159831 - RNA, 16 nt, Human
gaaauuguauuacaaa

SEQ ID NO: 3159832 - RNA, 16 nt, Human
gaaauuuauaaacuuu

SEQ ID NO: 3159833 - RNA, 17 nt, Human
gaaauuuauaaacuuuu

SEQ ID NO: 3159834 - RNA, 14 nt, Human
gaacuacugaggau

SEQ ID NO: 3159835 - RNA, 12 nt, Human
gaagagggcugc

SEQ ID NO: 3159836 - RNA, 15 nt, Human
gaagauguuucaaaa

SEQ ID NO: 3159837 - RNA, 20 nt, Human
gaagacugucagcuuccaaa

SEQ ID NO: 3159838 - RNA, 21 nt, Human
gaacucaucuagguaaauuac

SEQ ID NO: 3159839 - RNA, 20 nt, Human
gaacucaucuagguaaauua

SEQ ID NO: 3159840 - RNA, 17 nt, Human
gaagagaagggcagggc

SEQ ID NO: 3159841 - RNA, 23 nt, Human
gaauucuugaaggaaaaugauac

SEQ ID NO: 3159842 - RNA, 15 nt, Human
gaauuguguuuauaa

SEQ ID NO: 3159843 - RNA, 23 nt, Human
gaauuguguuuauaauuuuaaau

SEQ ID NO: 3159844 - RNA, 21 nt, Human
gaauguaugcuucauacaggg

SEQ ID NO: 3159845 - RNA, 16 nt, Human
gaauguaugcuucaua

SEQ ID NO: 3159846 - RNA, 18 nt, Human
gaauguaugcuucauaca

SEQ ID NO: 3159847 - RNA, 17 nt, Human
gaauauuugaauguaug

SEQ ID NO: 3159848 - RNA, 20 nt, Human
gaagcguuguccucagcccc

SEQ ID NO: 3159849 - RNA, 13 nt, Human
gaagcguuguccu

SEQ ID NO: 3159850 - RNA, 19 nt, Human
gaagcguuguccucagccc

SEQ ID NO: 3159851 - RNA, 22 nt, Human
gaagggguaggauuacuaggug

SEQ ID NO: 3159852 - RNA, 15 nt, Human
cuuggaagcuucugg

SEQ ID NO: 3159853 - RNA, 17 nt, Human
cuuguacuuuauuuucu

SEQ ID NO: 3159854 - RNA, 19 nt, Human
cuugcucuugaugccuggc

SEQ ID NO: 3159855 - RNA, 17 nt, Human
cuugcucuugaugccug

SEQ ID NO: 3159856 - RNA, 18 nt, Human
cuugcucuugaugccugg

SEQ ID NO: 3159857 - RNA, 20 nt, Human
cuugcuugauuguauggugg

SEQ ID NO: 3159858 - RNA, 17 nt, Human
cuuugacaaagguaaau

SEQ ID NO: 3159859 - RNA, 14 nt, Human
cuuucugucucucu

SEQ ID NO: 3159860 - RNA, 19 nt, Human
cuuugacaaagguaaauca

SEQ ID NO: 3159861 - RNA, 22 nt, Human
cuuugcauaacguauaaaagcc

SEQ ID NO: 3159862 - RNA, 14 nt, Human
cuuauaauuuaaaa

SEQ ID NO: 3159863 - RNA, 13 nt, Human
cuuauaauuuaaa

SEQ ID NO: 3159864 - RNA, 15 nt, Human
cuuaugauugcagau

SEQ ID NO: 3159865 - RNA, 13 nt, Human
cuguuuacagugu

SEQ ID NO: 3159866 - RNA, 15 nt, Human
cuguuuacaguguuc

SEQ ID NO: 3159867 - RNA, 18 nt, Human
cuguuuugaaucucauaa

SEQ ID NO: 3159868 - RNA, 11 nt, Human
cuuaacuauuc

SEQ ID NO: 3159869 - RNA, 15 nt, Human
cuuccaagagccuga

SEQ ID NO: 3159870 - RNA, 14 nt, Human
cuuccaagagccug

SEQ ID NO: 3159871 - RNA, 14 nt, Human
cuuccuuccucucc

SEQ ID NO: 3159872 - RNA, 23 nt, Human
cucugcaggucccuaauaaagcu

SEQ ID NO: 3159873 - RNA, 22 nt, Human
cucugcaggucccuaauaaagc

SEQ ID NO: 3159874 - RNA, 14 nt, Human
cucuggaauuugaa

SEQ ID NO: 3159875 - RNA, 12 nt, Human
cucuggagccca

SEQ ID NO: 3159876 - RNA, 12 nt, Human
cucucugcaggu

SEQ ID NO: 3159877 - RNA, 13 nt, Human
cucucugcagguc

SEQ ID NO: 3159878 - RNA, 14 nt, Human
cucucugcaggucc

SEQ ID NO: 3159879 - RNA, 16 nt, Human
cucucugcaggucccu

SEQ ID NO: 3159880 - RNA, 17 nt, Human
cucucugcaggucccua

SEQ ID NO: 3159881 - RNA, 19 nt, Human
cucucugcaggucccuaau

SEQ ID NO: 3159882 - RNA, 22 nt, Human
cucucugcaggucccuaauaaa

SEQ ID NO: 3159883 - RNA, 19 nt, Human
cucuccacucaugugacuc

SEQ ID NO: 3159884 - RNA, 15 nt, Human
cucuggagcccacug

SEQ ID NO: 3159885 - RNA, 15 nt, Human
cucuuggagccugca

SEQ ID NO: 3159886 - RNA, 22 nt, Human
cucuuggagccugcagagcugc

SEQ ID NO: 3159887 - RNA, 19 nt, Human
cucuugaacugagcuugga

SEQ ID NO: 3159888 - RNA, 16 nt, Human
cucuugaacugagcuu

SEQ ID NO: 3159889 - RNA, 17 nt, Human
cucuugaacugagcuug

SEQ ID NO: 3159890 - RNA, 21 nt, Human
cugaagagaagggcagggcug

SEQ ID NO: 3159891 - RNA, 22 nt, Human
cuccuuaaggcucuuuuguaag

SEQ ID NO: 3159892 - RNA, 13 nt, Human
cuccuuaaggcuc

SEQ ID NO: 3159893 - RNA, 17 nt, Human
cucaucuccccaucauu

SEQ ID NO: 3159894 - RNA, 21 nt, Human
cucaucuagguaaauuacagu

SEQ ID NO: 3159895 - RNA, 15 nt, Human
cucauuccagaggaa

SEQ ID NO: 3159896 - RNA, 17 nt, Human
cucauuccagaggaagg

SEQ ID NO: 3159897 - RNA, 22 nt, Human
cucauaauuuauacaggucaua

SEQ ID NO: 3159898 - RNA, 13 nt, Human
cucauaauuuaua

SEQ ID NO: 3159899 - RNA, 15 nt, Human
cucauaauuuauaca

SEQ ID NO: 3159900 - RNA, 20 nt, Human
cucagugucuggcugcagag

SEQ ID NO: 3159901 - RNA, 21 nt, Human
cucagugucuggcugcagagc

SEQ ID NO: 3159902 - RNA, 22 nt, Human
cucagugucuggcugcagagca

SEQ ID NO: 3159903 - RNA, 21 nt, Human
cucauaaaaagccugcaauuu

SEQ ID NO: 3159904 - RNA, 21 nt, Human
cuccacucuccucuuccaggc

SEQ ID NO: 3159905 - RNA, 17 nt, Human
cuccauugguguugaca

SEQ ID NO: 3159906 - RNA, 22 nt, Human
cugggaggcucuggagcccacu

SEQ ID NO: 3159907 - RNA, 15 nt, Human
cugggaggcucugga

SEQ ID NO: 3159908 - RNA, 16 nt, Human
cugggaggcucuggag

SEQ ID NO: 3159909 - RNA, 10 nt, Human
cugggccccu

SEQ ID NO: 3159910 - RNA, 12 nt, Human
cugggccccugc

SEQ ID NO: 3159911 - RNA, 16 nt, Human
cugggccccugccucu

SEQ ID NO: 3159912 - RNA, 17 nt, Human
cugggccccugccucuc

SEQ ID NO: 3159913 - RNA, 23 nt, Human
cuggaauaauccuaaacauauga

SEQ ID NO: 3159914 - RNA, 21 nt, Human
cuggaagugcuaauuuugaaa

SEQ ID NO: 3159915 - RNA, 15 nt, Human
cugcuuuccaaagcc

SEQ ID NO: 3159916 - RNA, 17 nt, Human
cugcuuuccaaagccaa

SEQ ID NO: 3159917 - RNA, 12 nt, Human
cuggaccagccu

SEQ ID NO: 3159918 - RNA, 21 nt, Human
cuggagcccacuguacuugcu

SEQ ID NO: 3159919 - RNA, 13 nt, Human
cuggagcccacug

SEQ ID NO: 3159920 - RNA, 15 nt, Human
cuggagcccacugua

SEQ ID NO: 3159921 - RNA, 16 nt, Human
cuggagcccacuguac

SEQ ID NO: 3159922 - RNA, 17 nt, Human
cuggagcccacuguacu

SEQ ID NO: 3159923 - RNA, 20 nt, Human
cuggagcccacuguacuugc

SEQ ID NO: 3159924 - RNA, 14 nt, Human
cuggcacagccugg

SEQ ID NO: 3159925 - RNA, 17 nt, Human
cuggauuauauuaugaa

SEQ ID NO: 3159926 - RNA, 12 nt, Human
cugcagagcugc

SEQ ID NO: 3159927 - RNA, 21 nt, Human
cugcagagcugcgggcugggu

SEQ ID NO: 3159928 - RNA, 21 nt, Human
cugcagagcagugggccuggc

SEQ ID NO: 3159929 - RNA, 23 nt, Human
cugcagagcagugggccuggcca

SEQ ID NO: 3159930 - RNA, 18 nt, Human
cugcagagcagugggccu

SEQ ID NO: 3159931 - RNA, 15 nt, Human
cugcagccaggccac

SEQ ID NO: 3159932 - RNA, 16 nt, Human
cugcagccaggccacu

SEQ ID NO: 3159933 - RNA, 17 nt, Human
cugcagccaggccacug

SEQ ID NO: 3159934 - RNA, 22 nt, Human
cugcagccaggccacuggcccc

SEQ ID NO: 3159935 - RNA, 23 nt, Human
cugcagccaggccacuggccccu

SEQ ID NO: 3159936 - RNA, 18 nt, Human
cugcaauuucauaugcug

SEQ ID NO: 3159937 - RNA, 20 nt, Human
cugcaauuucauaugcugua

SEQ ID NO: 3159938 - RNA, 20 nt, Human
cugauccagcccugaguucc

SEQ ID NO: 3159939 - RNA, 13 nt, Human
cugccuauuuuaa

SEQ ID NO: 3159940 - RNA, 14 nt, Human
cugccucucugcag

SEQ ID NO: 3159941 - RNA, 12 nt, Human
cugccucucugc

SEQ ID NO: 3159942 - RNA, 13 nt, Human
cugccucucugca

SEQ ID NO: 3159943 - RNA, 16 nt, Human
cugccaggagacaggu

SEQ ID NO: 3159944 - RNA, 20 nt, Human
cugccagcauuucccuuccu

SEQ ID NO: 3159945 - RNA, 23 nt, Human
ccuugacaaagucaagccacaug

SEQ ID NO: 3159946 - RNA, 21 nt, Human
ccuugacaaagucaagccaca

SEQ ID NO: 3159947 - RNA, 22 nt, Human
ccugugagcuaggaauuguguu

SEQ ID NO: 3159948 - RNA, 13 nt, Human
ccugggaggcucu

SEQ ID NO: 3159949 - RNA, 21 nt, Human
ccugggaggcucuggagccca

SEQ ID NO: 3159950 - RNA, 12 nt, Human
ccuggcggggug

SEQ ID NO: 3159951 - RNA, 15 nt, Human
ccuggaccagccucu

SEQ ID NO: 3159952 - RNA, 16 nt, Human
ccuggaccagccucuc

SEQ ID NO: 3159953 - RNA, 14 nt, Human
ccuggaccagccuc

SEQ ID NO: 3159954 - RNA, 17 nt, Human
ccuggacugugugcuca

SEQ ID NO: 3159955 - RNA, 20 nt, Human
ccuggacugugugcucagga

SEQ ID NO: 3159956 - RNA, 20 nt, Human
ccugcuuuuuauggccugug

SEQ ID NO: 3159957 - RNA, 13 nt, Human
cguuuucaaaauu

SEQ ID NO: 3159958 - RNA, 19 nt, Human
cgucagcugggacaccccg

SEQ ID NO: 3159959 - RNA, 16 nt, Human
cguauaaaagccuguu

SEQ ID NO: 3159960 - RNA, 17 nt, Human
cguauaaaagccuguuu

SEQ ID NO: 3159961 - RNA, 21 nt, Human
cguauaaaagccuguuuaaga

SEQ ID NO: 3159962 - RNA, 22 nt, Human
cguauaaaagccuguuuaagag

SEQ ID NO: 3159963 - RNA, 22 nt, Human
cggcugggaggagggcaggcau

SEQ ID NO: 3159964 - RNA, 18 nt, Human
cggcugggaggagggcag

SEQ ID NO: 3159965 - RNA, 23 nt, Human
cggcugggaggagggcaggcauc

SEQ ID NO: 3159966 - RNA, 16 nt, Human
cgggagcucaggaacc

SEQ ID NO: 3159967 - RNA, 23 nt, Human
cgauugcaggagucccugccauc

SEQ ID NO: 3159968 - RNA, 21 nt, Human
cgauugcaggagucccugcca

SEQ ID NO: 3159969 - RNA, 14 nt, Human
ccuuugacaaaggu

SEQ ID NO: 3159970 - RNA, 20 nt, Human
ccugaagcuaucguaaaauu

SEQ ID NO: 3159971 - RNA, 22 nt, Human
ccugaagcuaucguaaaauuaa

SEQ ID NO: 3159972 - RNA, 23 nt, Human
ccugaagcuaucguaaaauuaag

SEQ ID NO: 3159973 - RNA, 19 nt, Human
ccugaggcagguccccaga

SEQ ID NO: 3159974 - RNA, 18 nt, Human
ccugaggcagguccccag

SEQ ID NO: 3159975 - RNA, 15 nt, Human
ccugaggcagguccc

SEQ ID NO: 3159976 - RNA, 14 nt, Human
ccuccucugcccgg

SEQ ID NO: 3159977 - RNA, 15 nt, Human
ccuccucugcccggg

SEQ ID NO: 3159978 - RNA, 17 nt, Human
ccuccugggaaugaagc

SEQ ID NO: 3159979 - RNA, 23 nt, Human
ccucuccacucaugugacucuuu

SEQ ID NO: 3159980 - RNA, 22 nt, Human
ccgacuuuuguuuaccagagaa

SEQ ID NO: 3159981 - RNA, 15 nt, Human
cauuuccuaaauaua

SEQ ID NO: 3159982 - RNA, 19 nt, Human
cauugucccugaagagaag

SEQ ID NO: 3159983 - RNA, 23 nt, Human
cauuguauucagaguugaugguu

SEQ ID NO: 3159984 - RNA, 20 nt, Human
cauuguacgaagaguauuuu

SEQ ID NO: 3159985 - RNA, 16 nt, Human
ccaaacaggcucagag

SEQ ID NO: 3159986 - RNA, 16 nt, Human
ccaagaggcugcagcc

SEQ ID NO: 3159987 - RNA, 14 nt, Human
ccaagaggcugcag

SEQ ID NO: 3159988 - RNA, 15 nt, Human
ccaagaggcugcagc

SEQ ID NO: 3159989 - RNA, 14 nt, Human
ccaaagccaaugug

SEQ ID NO: 3159990 - RNA, 16 nt, Human
ccaaaggcucucuccu

SEQ ID NO: 3159991 - RNA, 17 nt, Human
ccaaagcgaauuuuaaa

SEQ ID NO: 3159992 - RNA, 14 nt, Human
ccaacacugccagc

SEQ ID NO: 3159993 - RNA, 15 nt, Human
ccaacacugccagca

SEQ ID NO: 3159994 - RNA, 16 nt, Human
ccaacacugccagcau

SEQ ID NO: 3159995 - RNA, 13 nt, Human
ccaacacugccag

SEQ ID NO: 3159996 - RNA, 19 nt, Human
ccaagccuuggcucuaccc

SEQ ID NO: 3159997 - RNA, 19 nt, Human
ccaagccuggucagcccaa

SEQ ID NO: 3159998 - RNA, 20 nt, Human
ccaagccuggucagcccaaa

SEQ ID NO: 3159999 - RNA, 22 nt, Human
ccacacguaaugaaacuuggau

SEQ ID NO: 3160000 - RNA, 20 nt, Human
ccacacagacuugggcaggg

SEQ ID NO: 3160001 - RNA, 16 nt, Human
ccacacccucacugcu

SEQ ID NO: 3160002 - RNA, 14 nt, Human
ccagaagcccagaa

SEQ ID NO: 3160003 - RNA, 22 nt, Human
ccagaauaaacuggcagcucag

SEQ ID NO: 3160004 - RNA, 12 nt, Human
ccagaagcccag

SEQ ID NO: 3160005 - RNA, 13 nt, Human
ccagaagcccaga

SEQ ID NO: 3160006 - RNA, 21 nt, Human
ccacgucagcugggacacccc

SEQ ID NO: 3160007 - RNA, 14 nt, Human
ccacgguguucugu

SEQ ID NO: 3160008 - RNA, 13 nt, Human
cccaacaccucuu

SEQ ID NO: 3160009 - RNA, 20 nt, Human
ccagugaauucuugaaggaa

SEQ ID NO: 3160010 - RNA, 16 nt, Human
ccagugaauucuugaa

SEQ ID NO: 3160011 - RNA, 19 nt, Human
ccaggcuuuuuuaucaugu

SEQ ID NO: 3160012 - RNA, 17 nt, Human
ccagcuggggccaggcu

SEQ ID NO: 3160013 - RNA, 18 nt, Human
ccagcuggggccaggcug

SEQ ID NO: 3160014 - RNA, 19 nt, Human
ccagcuggggccaggcugg

SEQ ID NO: 3160015 - RNA, 20 nt, Human
ccagcuggggccaggcuggg

SEQ ID NO: 3160016 - RNA, 21 nt, Human
ccagcuggggccaggcugggu

SEQ ID NO: 3160017 - RNA, 22 nt, Human
ccagcuggggccaggcuggguc

SEQ ID NO: 3160018 - RNA, 23 nt, Human
ccagcuggggccaggcugggucg

SEQ ID NO: 3160019 - RNA, 22 nt, Human
cccaaaccaccagaagcccaga

SEQ ID NO: 3160020 - RNA, 17 nt, Human
cccaaaccaccagaagc

SEQ ID NO: 3160021 - RNA, 18 nt, Human
cccaaaccaccagaagcc

SEQ ID NO: 3160022 - RNA, 13 nt, Human
ccaucagccucca

SEQ ID NO: 3160023 - RNA, 14 nt, Human
uugcauagaauaaa

SEQ ID NO: 3160024 - RNA, 18 nt, Human
uugaauguaugcuucaua

SEQ ID NO: 3160025 - RNA, 14 nt, Human
uucugagcauuuaa

SEQ ID NO: 3160026 - RNA, 15 nt, Human
uugaaaaaugcaugu

SEQ ID NO: 3160027 - RNA, 21 nt, Human
uugaaucucauaauuuauaca

SEQ ID NO: 3160028 - RNA, 15 nt, Human
uugaaucucauaauu

SEQ ID NO: 3160029 - RNA, 15 nt, Human
uugaacugagcuugg

SEQ ID NO: 3160030 - RNA, 16 nt, Human
uugaacugagcuugga

SEQ ID NO: 3160031 - RNA, 14 nt, Human
uuguauuacaaauc

SEQ ID NO: 3160032 - RNA, 14 nt, Human
uuguauucagaguu

SEQ ID NO: 3160033 - RNA, 16 nt, Human
uuguaaaggaauuuaa

SEQ ID NO: 3160034 - RNA, 18 nt, Human
uuguaaauaaaggaacca

SEQ ID NO: 3160035 - RNA, 23 nt, Human
uuggcaaacucuccaccacacgu

SEQ ID NO: 3160036 - RNA, 17 nt, Human
uuggguggggggcuuca

SEQ ID NO: 3160037 - RNA, 19 nt, Human
uuggguggggggcuucaua

SEQ ID NO: 3160038 - RNA, 20 nt, Human
uuggguggggggcuucauac

SEQ ID NO: 3160039 - RNA, 21 nt, Human
uuggguggggggcuucauaca

SEQ ID NO: 3160040 - RNA, 22 nt, Human
uuggguggggggcuucauacac

SEQ ID NO: 3160041 - RNA, 12 nt, Human
uugguaaaccuu

SEQ ID NO: 3160042 - RNA, 14 nt, Human
uugguaaaccuuuu

SEQ ID NO: 3160043 - RNA, 16 nt, Human
uuggcaaacucuccac

SEQ ID NO: 3160044 - RNA, 20 nt, Human
uuggcaaacucuccaccaca

SEQ ID NO: 3160045 - RNA, 15 nt, Human
uuggauucugagagc

SEQ ID NO: 3160046 - RNA, 17 nt, Human
uuggauucugagagcug

SEQ ID NO: 3160047 - RNA, 17 nt, Human
uucaucugacuaugaca

SEQ ID NO: 3160048 - RNA, 15 nt, Human
uucaucuaggauuuu

SEQ ID NO: 3160049 - RNA, 21 nt, Human
uuccauccuagucacuaccuu

SEQ ID NO: 3160050 - RNA, 16 nt, Human
uuccagccugccacuc

SEQ ID NO: 3160051 - RNA, 12 nt, Human
uuccagccugcc

SEQ ID NO: 3160052 - RNA, 14 nt, Human
uuccagccugccac

SEQ ID NO: 3160053 - RNA, 18 nt, Human
uucacucuuggagccugc

SEQ ID NO: 3160054 - RNA, 19 nt, Human
uucacucuuggagccugca

SEQ ID NO: 3160055 - RNA, 14 nt, Human
uucacucuuggagc

SEQ ID NO: 3160056 - RNA, 23 nt, Human
uucaaauuguaagcaugcacaaa

SEQ ID NO: 3160057 - RNA, 20 nt, Human
uuccuagguauaauucacau

SEQ ID NO: 3160058 - RNA, 22 nt, Human
uuccuagccaccgccuccuaca

SEQ ID NO: 3160059 - RNA, 15 nt, Human
uuccuagccaccgcc

SEQ ID NO: 3160060 - RNA, 21 nt, Human
uuccuagccaccgccuccuac

SEQ ID NO: 3160061 - RNA, 14 nt, Human
uuccuagccaccgc

SEQ ID NO: 3160062 - RNA, 17 nt, Human
uuccuucugugaaagua

SEQ ID NO: 3160063 - RNA, 13 nt, Human
uuuugaaaaacug

SEQ ID NO: 3160064 - RNA, 20 nt, Human
uuuuuuauacaggaugauga

SEQ ID NO: 3160065 - RNA, 16 nt, Human
uuuucagaaaauauua

SEQ ID NO: 3160066 - RNA, 13 nt, Human
uuuucacauaucu

SEQ ID NO: 3160067 - RNA, 15 nt, Human
uuuucagaaaauauu

SEQ ID NO: 3160068 - RNA, 14 nt, Human
uuuuacuguacaga

SEQ ID NO: 3160069 - RNA, 16 nt, Human
uuuuaugauacuugaa

SEQ ID NO: 3160070 - RNA, 20 nt, Human
uuuuaugauacuugaaaauu

SEQ ID NO: 3160071 - RNA, 15 nt, Human
uuuuaaaaugagaaa

SEQ ID NO: 3160072 - RNA, 22 nt, Human
uuuuaaaaugagaaaucuaaaa

SEQ ID NO: 3160073 - RNA, 16 nt, Human
uuuguucauacauauu

SEQ ID NO: 3160074 - RNA, 13 nt, Human
uuuguucauacau

SEQ ID NO: 3160075 - RNA, 22 nt, Human
uuucuuacugucuuuuuucuaa

SEQ ID NO: 3160076 - RNA, 16 nt, Human
uuugagguggaagagg

SEQ ID NO: 3160077 - RNA, 23 nt, Human
uuuggaacaagaugguucuagca

SEQ ID NO: 3160078 - RNA, 19 nt, Human
uuugcauaacguauaaaag

SEQ ID NO: 3160079 - RNA, 23 nt, Human
uuugcauaacguauaaaagccug

SEQ ID NO: 3160080 - RNA, 15 nt, Human
uuucagcagcugcag

SEQ ID NO: 3160081 - RNA, 14 nt, Human
uuuccaaaauaauu

SEQ ID NO: 3160082 - RNA, 21 nt, Human
uuucuaacaaaaaaauauauu

SEQ ID NO: 3160083 - RNA, 22 nt, Human
uuuaugauacuugaaaauuaac

SEQ ID NO: 3160084 - RNA, 14 nt, Human
uuuaugcauauuau

SEQ ID NO: 3160085 - RNA, 13 nt, Human
uuuacauuguaaa

SEQ ID NO: 3160086 - RNA, 15 nt, Human
uuuacauuguaaaua

SEQ ID NO: 3160087 - RNA, 17 nt, Human
uuuagaagaaguguguc

SEQ ID NO: 3160088 - RNA, 19 nt, Human
uuuagaagaagugugucac

SEQ ID NO: 3160089 - RNA, 13 nt, Human
uguguaugugggg

SEQ ID NO: 3160090 - RNA, 14 nt, Human
uguguauguggggg

SEQ ID NO: 3160091 - RNA, 23 nt, Human
uguguaugugggggucugugugu

SEQ ID NO: 3160092 - RNA, 23 nt, Human
uguguugugugugggagugugua

SEQ ID NO: 3160093 - RNA, 14 nt, Human
uguguugugugugg

SEQ ID NO: 3160094 - RNA, 13 nt, Human
uguguuuaugugu

SEQ ID NO: 3160095 - RNA, 22 nt, Human
uguguuuaggaacuacugagga

SEQ ID NO: 3160096 - RNA, 15 nt, Human
uguguuuaugugugu

SEQ ID NO: 3160097 - RNA, 11 nt, Human
uguguguaugu

SEQ ID NO: 3160098 - RNA, 21 nt, Human
uguuuacagaggacaguauuu

SEQ ID NO: 3160099 - RNA, 14 nt, Human
uguuuacagaggac

SEQ ID NO: 3160100 - RNA, 12 nt, Human
uguucuauagcu

SEQ ID NO: 3160101 - RNA, 13 nt, Human
uguucauaaauaa

SEQ ID NO: 3160102 - RNA, 23 nt, Human
uguuuuaaaaugagaaaucuaaa

SEQ ID NO: 3160103 - RNA, 12 nt, Human
uguuuuaaaaaa

SEQ ID NO: 3160104 - RNA, 18 nt, Human
uguuuuaaaaugagaaau

SEQ ID NO: 3160105 - RNA, 18 nt, Human
uuaaaagauaaauauuau

SEQ ID NO: 3160106 - RNA, 14 nt, Human
uuaaagacuuuuau

SEQ ID NO: 3160107 - RNA, 22 nt, Human
uuaaugucaauucuugccaaau

SEQ ID NO: 3160108 - RNA, 14 nt, Human
uuacauuuccuaaa

SEQ ID NO: 3160109 - RNA, 15 nt, Human
uuacagaggacagua

SEQ ID NO: 3160110 - RNA, 16 nt, Human
ugugggucugugugug

SEQ ID NO: 3160111 - RNA, 14 nt, Human
ugugggucugugug

SEQ ID NO: 3160112 - RNA, 16 nt, Human
ugugggggucugugug

SEQ ID NO: 3160113 - RNA, 21 nt, Human
uguggaaaagccaagaggcug

SEQ ID NO: 3160114 - RNA, 23 nt, Human
uguggaaaagccaagaggcugca

SEQ ID NO: 3160115 - RNA, 19 nt, Human
uguggaaaagccaagaggc

SEQ ID NO: 3160116 - RNA, 16 nt, Human
ugucuggcugcagagc

SEQ ID NO: 3160117 - RNA, 17 nt, Human
ugucuggcugcagagca

SEQ ID NO: 3160118 - RNA, 14 nt, Human
ugucuggcugcaga

SEQ ID NO: 3160119 - RNA, 14 nt, Human
ugugaaguuuacau

SEQ ID NO: 3160120 - RNA, 20 nt, Human
ugugaaguuuacauuguaaa

SEQ ID NO: 3160121 - RNA, 13 nt, Human
ugugaaacauguu

SEQ ID NO: 3160122 - RNA, 14 nt, Human
ugucuuuuuucuaa

SEQ ID NO: 3160123 - RNA, 16 nt, Human
ugugaaucauuuuacc

SEQ ID NO: 3160124 - RNA, 18 nt, Human
ugugaggggcucucucau

SEQ ID NO: 3160125 - RNA, 14 nt, Human
ugugcaagagaggg

SEQ ID NO: 3160126 - RNA, 16 nt, Human
uguaaauuuaugugau

SEQ ID NO: 3160127 - RNA, 15 nt, Human
uguaaauuuauguga

SEQ ID NO: 3160128 - RNA, 20 nt, Human
uguaaaaugugaagugaaug

SEQ ID NO: 3160129 - RNA, 16 nt, Human
uguagcacugacagau

SEQ ID NO: 3160130 - RNA, 17 nt, Human
uguagcacugacagauu

SEQ ID NO: 3160131 - RNA, 22 nt, Human
uguagcacugacagauuuccau

SEQ ID NO: 3160132 - RNA, 14 nt, Human
ugucacgccagacu

SEQ ID NO: 3160133 - RNA, 23 nt, Human
ugcuagguuaauuccaauuauau

SEQ ID NO: 3160134 - RNA, 16 nt, Human
ugcuagguuaauucca

SEQ ID NO: 3160135 - RNA, 14 nt, Human
ugcucaggagcccu

SEQ ID NO: 3160136 - RNA, 17 nt, Human
ugcaggaaauggcugug

SEQ ID NO: 3160137 - RNA, 17 nt, Human
uggaauuauuuuaaaag

SEQ ID NO: 3160138 - RNA, 13 nt, Human
uggagauguuuag

SEQ ID NO: 3160139 - RNA, 14 nt, Human
ugcuuuccaaagcc

SEQ ID NO: 3160140 - RNA, 18 nt, Human
ugcuucuaguucugccag

SEQ ID NO: 3160141 - RNA, 19 nt, Human
ugcuucuaguucugccagg

SEQ ID NO: 3160142 - RNA, 20 nt, Human
ugcuucuaguucugccagga

SEQ ID NO: 3160143 - RNA, 23 nt, Human
uggaagugugggucugugugugu

SEQ ID NO: 3160144 - RNA, 21 nt, Human
uggaagugugggucugugugu

SEQ ID NO: 3160145 - RNA, 15 nt, Human
uggaauuauuuuaaa

SEQ ID NO: 3160146 - RNA, 21 nt, Human
ugggguggggggggugcuggg

SEQ ID NO: 3160147 - RNA, 22 nt, Human
ugggguggggggggugcugggc

SEQ ID NO: 3160148 - RNA, 19 nt, Human
ugggguggggggggugcug

SEQ ID NO: 3160149 - RNA, 18 nt, Human
uggggcaggggccggggg

SEQ ID NO: 3160150 - RNA, 16 nt, Human
uggggcaggggccggg

SEQ ID NO: 3160151 - RNA, 16 nt, Human
uaaaagaugcaaugua

SEQ ID NO: 3160152 - RNA, 13 nt, Human
uaaaagaucgcag

SEQ ID NO: 3160153 - RNA, 17 nt, Human
uaaaagggacugagaaa

SEQ ID NO: 3160154 - RNA, 19 nt, Human
uaaaagggacugagaaauu

SEQ ID NO: 3160155 - RNA, 20 nt, Human
uaaaagggacugagaaauuu

SEQ ID NO: 3160156 - RNA, 21 nt, Human
uaaaagggacugagaaauuua

SEQ ID NO: 3160157 - RNA, 15 nt, Human
uaaaaugagaaaucu

SEQ ID NO: 3160158 - RNA, 16 nt, Human
uaaaaugagaaaucua

SEQ ID NO: 3160159 - RNA, 13 nt, Human
uaaaaugagaaau

SEQ ID NO: 3160160 - RNA, 21 nt, Human
uaaacacucuugaaaaaugca

SEQ ID NO: 3160161 - RNA, 18 nt, Human
uaaauauaugcuaagucu

SEQ ID NO: 3160162 - RNA, 16 nt, Human
uaaauauauuuuaaga

SEQ ID NO: 3160163 - RNA, 22 nt, Human
uaaauauauuuuaagacgaaac

SEQ ID NO: 3160164 - RNA, 22 nt, Human
uaaauaaaccucaaaaugucua

SEQ ID NO: 3160165 - RNA, 20 nt, Human
uaaaucagacuaugaaguuu

SEQ ID NO: 3160166 - RNA, 17 nt, Human
uaaauaaaaauaauccu

SEQ ID NO: 3160167 - RNA, 14 nt, Human
uaaaguuuguugaa

SEQ ID NO: 3160168 - RNA, 14 nt, Human
uaaaggaauuuaaa

SEQ ID NO: 3160169 - RNA, 20 nt, Human
uaaacuuuuuucuuacuguc

SEQ ID NO: 3160170 - RNA, 15 nt, Human
uaaaaaagcugugug

SEQ ID NO: 3160171 - RNA, 12 nt, Human
uaaaaaacacug

SEQ ID NO: 3160172 - RNA, 11 nt, Human
uaaaaaacacu

SEQ ID NO: 3160173 - RNA, 16 nt, Human
guuuccuuauauuaug

SEQ ID NO: 3160174 - RNA, 13 nt, Human
guuuagcaguaua

SEQ ID NO: 3160175 - RNA, 16 nt, Human
guuuaguaaucauauu

SEQ ID NO: 3160176 - RNA, 19 nt, Human
gguugggagaaugucagua

SEQ ID NO: 3160177 - RNA, 14 nt, Human
guuucuuuguaaug

SEQ ID NO: 3160178 - RNA, 17 nt, Human
guuucuuuguaaugaaa

SEQ ID NO: 3160179 - RNA, 14 nt, Human
uaaggcaaucaugg

SEQ ID NO: 3160180 - RNA, 15 nt, Human
uaaggcaaucauggu

SEQ ID NO: 3160181 - RNA, 15 nt, Human
uaagcaugcacaaau

SEQ ID NO: 3160182 - RNA, 13 nt, Human
uaagaucucagug

SEQ ID NO: 3160183 - RNA, 19 nt, Human
uaagaucucagugguuaag

SEQ ID NO: 3160184 - RNA, 15 nt, Human
uaauaacugugaagu

SEQ ID NO: 3160185 - RNA, 19 nt, Human
uaauaaauauuuuugccau

SEQ ID NO: 3160186 - RNA, 19 nt, Human
uaaugauaaguaaaugcua

SEQ ID NO: 3160187 - RNA, 14 nt, Human
uaauauauuuccau

SEQ ID NO: 3160188 - RNA, 13 nt, Human
uaauuuuaagaaa

SEQ ID NO: 3160189 - RNA, 23 nt, Human
uaauuaaauuuugaguucuacau

SEQ ID NO: 3160190 - RNA, 19 nt, Human
uaauucuuugaccuguugg

SEQ ID NO: 3160191 - RNA, 19 nt, Human
uaccuuugacaaagguaaa

SEQ ID NO: 3160192 - RNA, 23 nt, Human
uacgaagaguauuuuugacagaa

SEQ ID NO: 3160193 - RNA, 20 nt, Human
uacgaagaguauuuuugaca

SEQ ID NO: 3160194 - RNA, 22 nt, Human
uacgaagaguauuuuugacaga

SEQ ID NO: 3160195 - RNA, 20 nt, Human
uacuugcucuugaugccugg

SEQ ID NO: 3160196 - RNA, 21 nt, Human
uacuugcucuugaugccuggc

SEQ ID NO: 3160197 - RNA, 17 nt, Human
uagaacagauaaucagu

SEQ ID NO: 3160198 - RNA, 23 nt, Human
uacauuuggagacacaacuauuu

SEQ ID NO: 3160199 - RNA, 14 nt, Human
uacaggauuugaaa

SEQ ID NO: 3160200 - RNA, 17 nt, Human
uacagcccaccuggcuu

SEQ ID NO: 3160201 - RNA, 13 nt, Human
uaauuuugaaaaa

SEQ ID NO: 3160202 - RNA, 17 nt, Human
uaauuuugaaaaacugc

SEQ ID NO: 3160203 - RNA, 11 nt, Human
uagaugugugg

SEQ ID NO: 3160204 - RNA, 16 nt, Human
uagccccacaggaggu

SEQ ID NO: 3160205 - RNA, 14 nt, Human
uaggaauuguguuu

SEQ ID NO: 3160206 - RNA, 18 nt, Human
uaggaacugcugggcuug

SEQ ID NO: 3160207 - RNA, 15 nt, Human
uaggaacugcugggc

SEQ ID NO: 3160208 - RNA, 21 nt, Human
uauauuucccugaaggaacca

SEQ ID NO: 3160209 - RNA, 14 nt, Human
uauauuuuaagacg

SEQ ID NO: 3160210 - RNA, 13 nt, Human
uauauuuuaagac

SEQ ID NO: 3160211 - RNA, 18 nt, Human
uauauaaguauucuaaau

SEQ ID NO: 3160212 - RNA, 15 nt, Human
uaucagcacgugugg

SEQ ID NO: 3160213 - RNA, 17 nt, Human
uaucaugugaaaucauu

SEQ ID NO: 3160214 - RNA, 22 nt, Human
uaucaugugaaaucauucauuu

SEQ ID NO: 3160215 - RNA, 13 nt, Human
uaggcuagggugg

SEQ ID NO: 3160216 - RNA, 20 nt, Human
uagugauuuuuaugccaccu

SEQ ID NO: 3160217 - RNA, 21 nt, Human
uagugauuuuuaugccaccug

SEQ ID NO: 3160218 - RNA, 22 nt, Human
uagugauuuuuaugccaccuga

SEQ ID NO: 3160219 - RNA, 16 nt, Human
uauacccagaaaguua

SEQ ID NO: 3160220 - RNA, 21 nt, Human
uauaauucagaaggaucuuca

SEQ ID NO: 3160221 - RNA, 20 nt, Human
uauaauucacauuguauuca

SEQ ID NO: 3160222 - RNA, 23 nt, Human
ucuggagcccacuguacuugcuc

SEQ ID NO: 3160223 - RNA, 20 nt, Human
ucuguguguuuaugugugug

SEQ ID NO: 3160224 - RNA, 19 nt, Human
ucuguguguuuaugugugu

SEQ ID NO: 3160225 - RNA, 22 nt, Human
ucuguguguguguauguggggg

SEQ ID NO: 3160226 - RNA, 16 nt, Human
ucuguguguuuaugug

SEQ ID NO: 3160227 - RNA, 15 nt, Human
ucuguguguuuaugu

SEQ ID NO: 3160228 - RNA, 13 nt, Human
ucugugugugugu

SEQ ID NO: 3160229 - RNA, 21 nt, Human
ucuguguguguguaugugggg

SEQ ID NO: 3160230 - RNA, 19 nt, Human
ucuguguguguguaugugg

SEQ ID NO: 3160231 - RNA, 18 nt, Human
ucuguguguguguaugug

SEQ ID NO: 3160232 - RNA, 15 nt, Human
ucuguguguguguau

SEQ ID NO: 3160233 - RNA, 16 nt, Human
ugaacugagcuuggaa

SEQ ID NO: 3160234 - RNA, 12 nt, Human
ugaacugagcuu

SEQ ID NO: 3160235 - RNA, 15 nt, Human
ugaacugagcuugga

SEQ ID NO: 3160236 - RNA, 13 nt, Human
ugaaaagaggugu

SEQ ID NO: 3160237 - RNA, 22 nt, Human
ugaaaagaggugugcaagagag

SEQ ID NO: 3160238 - RNA, 15 nt, Human
ugaaaucauucauuu

SEQ ID NO: 3160239 - RNA, 19 nt, Human
ucuuuuguaagguuuuugu

SEQ ID NO: 3160240 - RNA, 15 nt, Human
ucucucgugaguaua

SEQ ID NO: 3160241 - RNA, 22 nt, Human
ucucagugguuaagauuccuaa

SEQ ID NO: 3160242 - RNA, 18 nt, Human
ucucccuccucugcccgg

SEQ ID NO: 3160243 - RNA, 11 nt, Human
ucucugcaggu

SEQ ID NO: 3160244 - RNA, 20 nt, Human
ucuagaagacugucagcuuc

SEQ ID NO: 3160245 - RNA, 21 nt, Human
ucuagaagacugucagcuucc

SEQ ID NO: 3160246 - RNA, 18 nt, Human
ucuaaauuuuauaucuug

SEQ ID NO: 3160247 - RNA, 23 nt, Human
ucuaaauuuuauaucuuguagcu

SEQ ID NO: 3160248 - RNA, 23 nt, Human
ucuaaauuugaauguuaagcaga

SEQ ID NO: 3160249 - RNA, 22 nt, Human
ucuaaauuugaauguuaagcag

SEQ ID NO: 3160250 - RNA, 19 nt, Human
ucuaacaaaaaaauauauu

SEQ ID NO: 3160251 - RNA, 17 nt, Human
ucuaaauuugaauguua

SEQ ID NO: 3160252 - RNA, 13 nt, Human
ucuaaauuugaau

SEQ ID NO: 3160253 - RNA, 15 nt, Human
ucuaguaugaaauua

SEQ ID NO: 3160254 - RNA, 17 nt, Human
ucuaguaugaaauuaua

SEQ ID NO: 3160255 - RNA, 21 nt, Human
ucucaaauuuggauugcuaau

SEQ ID NO: 3160256 - RNA, 16 nt, Human
uccuuaaggcucuuuu

SEQ ID NO: 3160257 - RNA, 19 nt, Human
uccuuaaggcucuuuugua

SEQ ID NO: 3160258 - RNA, 20 nt, Human
uccuucugugaaaguacauu

SEQ ID NO: 3160259 - RNA, 15 nt, Human
ucauaauuuauacag

SEQ ID NO: 3160260 - RNA, 15 nt, Human
ucauaauuauuauuu

SEQ ID NO: 3160261 - RNA, 13 nt, Human
ucauacauuguac

SEQ ID NO: 3160262 - RNA, 15 nt, Human
ucauacauuguacga

SEQ ID NO: 3160263 - RNA, 16 nt, Human
ucauacauuguacgaa

SEQ ID NO: 3160264 - RNA, 13 nt, Human
ucaguuguacagu

SEQ ID NO: 3160265 - RNA, 13 nt, Human
uccaagcaaaugu

SEQ ID NO: 3160266 - RNA, 17 nt, Human
uccaaagccaaugugaa

SEQ ID NO: 3160267 - RNA, 20 nt, Human
uccaugggccauaugaaaag

SEQ ID NO: 3160268 - RNA, 22 nt, Human
uccccagacuccaccaagccug

SEQ ID NO: 3160269 - RNA, 13 nt, Human
ucccuaauaaagc

SEQ ID NO: 3160270 - RNA, 11 nt, Human
ucccuaauaaa

SEQ ID NO: 3160271 - RNA, 12 nt, Human
ucccuaauaaag

SEQ ID NO: 3160272 - RNA, 16 nt, Human
ucccccuccaccugcu

SEQ ID NO: 3160273 - RNA, 16 nt, Human
uauuugagaguucuaa

SEQ ID NO: 3160274 - RNA, 15 nt, Human
uauuugagaguucua

SEQ ID NO: 3160275 - RNA, 19 nt, Human
uauuugagaguucuaaauu

SEQ ID NO: 3160276 - RNA, 18 nt, Human
uauuugagaguucuaaau

SEQ ID NO: 3160277 - RNA, 15 nt, Human
uauuuuauguugcau

SEQ ID NO: 3160278 - RNA, 16 nt, Human
uauuuuauguugcaua

SEQ ID NO: 3160279 - RNA, 22 nt, Human
ucagaguugaugguuguacaua

SEQ ID NO: 3160280 - RNA, 17 nt, Human
ucagaaaauauuaugug

SEQ ID NO: 3160281 - RNA, 20 nt, Human
ucagaaaauauuauguguuu

SEQ ID NO: 3160282 - RNA, 19 nt, Human
ucagaaaauauuauguguu

SEQ ID NO: 3160283 - RNA, 18 nt, Human
ucacgccagacuucccac

SEQ ID NO: 3160284 - RNA, 13 nt, Human
uuuuuucuuacug

SEQ ID NO: 3160285 - RNA, 18 nt, Reston Ebola virus [REBOV]
acagcagcaaaccaggaa

SEQ ID NO: 3160286 - RNA, 14 nt, Reston Ebola virus [REBOV]
uacacuuaagacuu

SEQ ID NO: 3160287 - RNA, 16 nt, Reston Ebola virus [REBOV]
acugagucccaccagg

SEQ ID NO: 3160288 - RNA, 22 nt, Reston Ebola virus [REBOV]
cugucgaauccuaggaccaucu

SEQ ID NO: 3160289 - RNA, 16 nt, Reston Ebola virus [REBOV]
ugcaauugucaagagu

SEQ ID NO: 3160290 - RNA, 16 nt, Reston Ebola virus [REBOV]
caaauuaaacaugacu

SEQ ID NO: 3160291 - RNA, 19 nt, Reston Ebola virus [REBOV]
aauuguuagagguaacaag

SEQ ID NO: 3160292 - RNA, 23 nt, Reston Ebola virus [REBOV]
accaccauugccccaaguccaac

SEQ ID NO: 3160293 - RNA, 20 nt, Reston Ebola virus [REBOV]
acuccgcccagagcccacag

SEQ ID NO: 3160294 - RNA, 14 nt, Reston Ebola virus [REBOV]
cugagguauuuugu

SEQ ID NO: 3160295 - RNA, 14 nt, Reston Ebola virus [REBOV]
accacgccagcacc

SEQ ID NO: 3160296 - RNA, 16 nt, Reston Ebola virus [REBOV]
gagagagaaaaaucuc

SEQ ID NO: 3160297 - RNA, 19 nt, Reston Ebola virus [REBOV]
auugauuuucuucuucaac

SEQ ID NO: 3160298 - RNA, 14 nt, Reston Ebola virus [REBOV]
uuucuuuuguaauu

SEQ ID NO: 3160299 - RNA, 19 nt, Reston Ebola virus [REBOV]
guaagauuuuguguugauu

SEQ ID NO: 3160300 - RNA, 16 nt, Reston Ebola virus [REBOV]
cgacaaaacaccgcua

SEQ ID NO: 3160301 - RNA, 18 nt, Reston Ebola virus [REBOV]
auguaaauauaacaagug

SEQ ID NO: 3160302 - RNA, 12 nt, Reston Ebola virus [REBOV]
ucuauucuaauc

SEQ ID NO: 3160303 - RNA, 14 nt, Reston Ebola virus [REBOV]
gagacaauuuacca

SEQ ID NO: 3160304 - RNA, 22 nt, Reston Ebola virus [REBOV]
cagccgaacaacacagcaucca

SEQ ID NO: 3160305 - RNA, 19 nt, Reston Ebola virus [REBOV]
agcuauuaguuauuacuua

SEQ ID NO: 3160306 - RNA, 23 nt, Reston Ebola virus [REBOV]
ucuucaauuauuucugcgggcca

SEQ ID NO: 3160307 - RNA, 23 nt, Reston Ebola virus [REBOV]
auugacaauccccuaccagacca

SEQ ID NO: 3160308 - RNA, 13 nt, Reston Ebola virus [REBOV]
aaucagaaauugg

SEQ ID NO: 3160309 - RNA, 17 nt, Reston Ebola virus [REBOV]
aagagacggccaacagc

SEQ ID NO: 3160310 - RNA, 17 nt, Reston Ebola virus [REBOV]
aggaaccagcccaggaa

SEQ ID NO: 3160311 - RNA, 15 nt, Reston Ebola virus [REBOV]
auaaauaauacuuua

SEQ ID NO: 3160312 - RNA, 20 nt, Reston Ebola virus [REBOV]
cccgcaagagacggccaaca

SEQ ID NO: 3160313 - RNA, 21 nt, Reston Ebola virus [REBOV]
cucguuaacaaucgcuaguaa

SEQ ID NO: 3160314 - RNA, 16 nt, Reston Ebola virus [REBOV]
cugcuucuuugcuuga

SEQ ID NO: 3160315 - RNA, 22 nt, Reston Ebola virus [REBOV]
uuaagaucaaaugcaaacauua

SEQ ID NO: 3160316 - RNA, 12 nt, Reston Ebola virus [REBOV]
ccagcccaggaa

SEQ ID NO: 3160317 - RNA, 18 nt, Reston Ebola virus [REBOV]
caaugaaacuacccaggc

SEQ ID NO: 3160318 - RNA, 17 nt, Reston Ebola virus [REBOV]
aaagcuauugauuuucu

SEQ ID NO: 3160319 - RNA, 15 nt, Reston Ebola virus [REBOV]
ugcauaaucagaaug

SEQ ID NO: 3160320 - RNA, 17 nt, Reston Ebola virus [REBOV]
accaggaaccagcccag

SEQ ID NO: 3160321 - RNA, 23 nt, Reston Ebola virus [REBOV]
ccaagugaacagccgaacaacac

SEQ ID NO: 3160322 - RNA, 19 nt, Reston Ebola virus [REBOV]
uugaaauggagauuaucag

SEQ ID NO: 3160323 - RNA, 12 nt, Reston Ebola virus [REBOV]
agauaaauggac

SEQ ID NO: 3160324 - RNA, 13 nt, Reston Ebola virus [REBOV]
gccagcacccaca

SEQ ID NO: 3160325 - RNA, 13 nt, Reston Ebola virus [REBOV]
ccaaucuuuuccu

SEQ ID NO: 3160326 - RNA, 13 nt, Reston Ebola virus [REBOV]
ccgaugacccagg

SEQ ID NO: 3160327 - RNA, 13 nt, Reston Ebola virus [REBOV]
gaugauaauauau

SEQ ID NO: 3160328 - RNA, 12 nt, Reston Ebola virus [REBOV]
caggcucuucaa

SEQ ID NO: 3160329 - RNA, 22 nt, Reston Ebola virus [REBOV]
aggacuuacucacuucuuaaca

SEQ ID NO: 3160330 - RNA, 20 nt, Reston Ebola virus [REBOV]
ggagagacaaucacagguuu

SEQ ID NO: 3160331 - RNA, 20 nt, Reston Ebola virus [REBOV]
cgcaagagacggccaacagc

SEQ ID NO: 3160332 - RNA, 18 nt, Reston Ebola virus [REBOV]
uaacacaucauaacuuua

SEQ ID NO: 3160333 - RNA, 22 nt, Reston Ebola virus [REBOV]
uacauugaggguguaaugcaua

SEQ ID NO: 3160334 - RNA, 15 nt, Reston Ebola virus [REBOV]
ggucuuuuugaaaug

SEQ ID NO: 3160335 - RNA, 13 nt, Reston Ebola virus [REBOV]
ggaagauuaagaa

SEQ ID NO: 3160336 - RNA, 14 nt, Reston Ebola virus [REBOV]
gaaccagcccagga

SEQ ID NO: 3160337 - RNA, 13 nt, Reston Ebola virus [REBOV]
ugcuugauuuaca

SEQ ID NO: 3160338 - RNA, 20 nt, Reston Ebola virus [REBOV]
aagaguuuaaguaauauaca

SEQ ID NO: 3160339 - RNA, 13 nt, Reston Ebola virus [REBOV]
aaaaaauauuacu

SEQ ID NO: 3160340 - RNA, 21 nt, Reston Ebola virus [REBOV]
uaagaagagauuggaguaaaa

SEQ ID NO: 3160341 - RNA, 18 nt, Reston Ebola virus [REBOV]
aacuaaaccaagcaauau

SEQ ID NO: 3160342 - RNA, 14 nt, Reston Ebola virus [REBOV]
cccaucggcaagca

SEQ ID NO: 3160343 - RNA, 14 nt, Reston Ebola virus [REBOV]
caguuaaguaacau

SEQ ID NO: 3160344 - RNA, 14 nt, Reston Ebola virus [REBOV]
auuucucuuaauaa

SEQ ID NO: 3160345 - RNA, 21 nt, Reston Ebola virus [REBOV]
aagagacggccaacagcagca

SEQ ID NO: 3160346 - RNA, 23 nt, Reston Ebola virus [REBOV]
ggguuacucuaaggagaaauauu

SEQ ID NO: 3160347 - RNA, 20 nt, Reston Ebola virus [REBOV]
cgggccacaacagaacugag

SEQ ID NO: 3160348 - RNA, 21 nt, Reston Ebola virus [REBOV]
uaacauagacugaaaaugcua

SEQ ID NO: 3160349 - RNA, 14 nt, Reston Ebola virus [REBOV]
caggaaccagccca

SEQ ID NO: 3160350 - RNA, 17 nt, Reston Ebola virus [REBOV]
uaauccuaguauuuauu

SEQ ID NO: 3160351 - RNA, 14 nt, Reston Ebola virus [REBOV]
auugauaagaauac

SEQ ID NO: 3160352 - RNA, 16 nt, Reston Ebola virus [REBOV]
agcccacagaccaaga

SEQ ID NO: 3160353 - RNA, 14 nt, Reston Ebola virus [REBOV]
uauucuaaucagag

SEQ ID NO: 3160354 - RNA, 20 nt, Reston Ebola virus [REBOV]
gaucuuuacuauuggacagc

SEQ ID NO: 3160355 - RNA, 17 nt, Reston Ebola virus [REBOV]
cauagacugaaaaugcu

SEQ ID NO: 3160356 - RNA, 18 nt, Reston Ebola virus [REBOV]
uuacgccuagauaacuaa

SEQ ID NO: 3160357 - RNA, 21 nt, Reston Ebola virus [REBOV]
uuaagcgcacacaaaaacauu

SEQ ID NO: 3160358 - RNA, 14 nt, Reston Ebola virus [REBOV]
augaaacuacccag

SEQ ID NO: 3160359 - RNA, 21 nt, Reston Ebola virus [REBOV]
gucagcuagccaaugaaacua

SEQ ID NO: 3160360 - RNA, 17 nt, Reston Ebola virus [REBOV]
ugacuugaauguaauaa

SEQ ID NO: 3160361 - RNA, 14 nt, Reston Ebola virus [REBOV]
gagggggcagcagu

SEQ ID NO: 3160362 - RNA, 17 nt, Reston Ebola virus [REBOV]
agcagcaaaccaggaac

SEQ ID NO: 3160363 - RNA, 21 nt, Reston Ebola virus [REBOV]
augcaaacauuauaagaaugu

SEQ ID NO: 3160364 - RNA, 15 nt, Reston Ebola virus [REBOV]
acuuaucuuaaauga

SEQ ID NO: 3160365 - RNA, 17 nt, Reston Ebola virus [REBOV]
cugagucccaccaggaa

SEQ ID NO: 3160366 - RNA, 15 nt, Reston Ebola virus [REBOV]
gaacagccgaacaac

SEQ ID NO: 3160367 - RNA, 15 nt, Reston Ebola virus [REBOV]
auccgauccaaggcu

SEQ ID NO: 3160368 - RNA, 21 nt, Reston Ebola virus [REBOV]
ggccacaacagaacugaggac

SEQ ID NO: 3160369 - RNA, 15 nt, Reston Ebola virus [REBOV]
uccauuuaguaauaa

SEQ ID NO: 3160370 - RNA, 15 nt, Reston Ebola virus [REBOV]
ccaggaaccagccca

SEQ ID NO: 3160371 - RNA, 20 nt, Reston Ebola virus [REBOV]
ucauauuuugaucaaguaau

SEQ ID NO: 3160372 - RNA, 18 nt, Reston Ebola virus [REBOV]
aauuggagauaaauggac

SEQ ID NO: 3160373 - RNA, 16 nt, Reston Ebola virus [REBOV]
cgaugacccaggaccc

SEQ ID NO: 3160374 - RNA, 15 nt, Reston Ebola virus [REBOV]
cuccgcccagagccc

SEQ ID NO: 3160375 - RNA, 21 nt, Reston Ebola virus [REBOV]
ccauugccccaaguccaacca

SEQ ID NO: 3160376 - RNA, 18 nt, Reston Ebola virus [REBOV]
ugucaaugcuauacuguu

SEQ ID NO: 3160377 - RNA, 12 nt, Reston Ebola virus [REBOV]
ggcucgaacaac

SEQ ID NO: 3160378 - RNA, 21 nt, Reston Ebola virus [REBOV]
aacaugucaaugcuauacugu

SEQ ID NO: 3160379 - RNA, 20 nt, Reston Ebola virus [REBOV]
guauauaaccaaucuuuucc

SEQ ID NO: 3160380 - RNA, 18 nt, Reston Ebola virus [REBOV]
uccccgaugacccaggac

SEQ ID NO: 3160381 - RNA, 16 nt, Reston Ebola virus [REBOV]
auaugagugauaaugu

SEQ ID NO: 3160382 - RNA, 23 nt, Reston Ebola virus [REBOV]
uguugcauugagccacaugauug

SEQ ID NO: 3160383 - RNA, 18 nt, Reston Ebola virus [REBOV]
agguauuuugucuagagu

SEQ ID NO: 3160384 - RNA, 22 nt, Reston Ebola virus [REBOV]
uaaggaguuuuuuaaucuaauu

SEQ ID NO: 3160385 - RNA, 13 nt, Reston Ebola virus [REBOV]
uauuuaacaaggc

SEQ ID NO: 3160386 - RNA, 19 nt, Reston Ebola virus [REBOV]
aaccaggaaccagcccagg

SEQ ID NO: 3160387 - RNA, 15 nt, Reston Ebola virus [REBOV]
caacuccgcccagag

SEQ ID NO: 3160388 - RNA, 15 nt, Reston Ebola virus [REBOV]
cagucaaaacuaaac

SEQ ID NO: 3160389 - RNA, 18 nt, Reston Ebola virus [REBOV]
ugaacagccgaacaacac

SEQ ID NO: 3160390 - RNA, 15 nt, Reston Ebola virus [REBOV]
cuuuuugaaauggag

SEQ ID NO: 3160391 - RNA, 16 nt, Reston Ebola virus [REBOV]
agcuaaauacacuuaa

SEQ ID NO: 3160392 - RNA, 18 nt, Reston Ebola virus [REBOV]
ggcuuccauuuuuacaug

SEQ ID NO: 3160393 - RNA, 18 nt, Reston Ebola virus [REBOV]
uggagauuaucagcauuu

SEQ ID NO: 3160394 - RNA, 12 nt, Reston Ebola virus [REBOV]
ugcagcagaagg

SEQ ID NO: 3160395 - RNA, 20 nt, Reston Ebola virus [REBOV]
ggaagcgcagccggaccaag

SEQ ID NO: 3160396 - RNA, 14 nt, Reston Ebola virus [REBOV]
caauagacuaaaaa

SEQ ID NO: 3160397 - RNA, 18 nt, Reston Ebola virus [REBOV]
aacaaucgcuaguaauuu

SEQ ID NO: 3160398 - RNA, 14 nt, Reston Ebola virus [REBOV]
cgggcuacgucagc

SEQ ID NO: 3160399 - RNA, 21 nt, Reston Ebola virus [REBOV]
auuaucagcauuucuuaaaug

SEQ ID NO: 3160400 - RNA, 15 nt, Reston Ebola virus [REBOV]
gcgggccacaacaga

SEQ ID NO: 3160401 - RNA, 18 nt, Reston Ebola virus [REBOV]
uaucugcaguaaccagaa

SEQ ID NO: 3160402 - RNA, 17 nt, Reston Ebola virus [REBOV]
cagcagcaaaccaggaa

SEQ ID NO: 3160403 - RNA, 16 nt, Reston Ebola virus [REBOV]
caccauugccccaagu

SEQ ID NO: 3160404 - RNA, 10 nt, Reston Ebola virus [REBOV]
ucacagguuu

SEQ ID NO: 3160405 - RNA, 18 nt, Reston Ebola virus [REBOV]
uagacuaaaaaucugauu

SEQ ID NO: 3160406 - RNA, 19 nt, Reston Ebola virus [REBOV]
cggaccaagucagcccgga

SEQ ID NO: 3160407 - RNA, 18 nt, Reston Ebola virus [REBOV]
acugagucccaccaggaa

SEQ ID NO: 3160408 - RNA, 14 nt, Reston Ebola virus [REBOV]
uaagaucaaaugca

SEQ ID NO: 3160409 - RNA, 23 nt, Reston Ebola virus [REBOV]
caucuuguugcauugagccacau

SEQ ID NO: 3160410 - RNA, 20 nt, Reston Ebola virus [REBOV]
caaucacagguuucaccgcg

SEQ ID NO: 3160411 - RNA, 21 nt, Reston Ebola virus [REBOV]
uguguugauuuauucugagau

SEQ ID NO: 3160412 - RNA, 20 nt, Reston Ebola virus [REBOV]
uucaacccagucaaaacuaa

SEQ ID NO: 3160413 - RNA, 18 nt, Reston Ebola virus [REBOV]
cccaaguccaaccaugac

SEQ ID NO: 3160414 - RNA, 20 nt, Reston Ebola virus [REBOV]
caugacuuuauugacaaucc

SEQ ID NO: 3160415 - RNA, 20 nt, Reston Ebola virus [REBOV]
cuccgcccagagcccacaga

SEQ ID NO: 3160416 - RNA, 14 nt, Reston Ebola virus [REBOV]
auaacaugucaaug

SEQ ID NO: 3160417 - RNA, 14 nt, Reston Ebola virus [REBOV]
ugacccaggacccg

SEQ ID NO: 3160418 - RNA, 23 nt, Reston Ebola virus [REBOV]
aaauuuacuugaaugcugaccac

SEQ ID NO: 3160419 - RNA, 23 nt, Reston Ebola virus [REBOV]
acugaggacuuacucacuucuua

SEQ ID NO: 3160420 - RNA, 16 nt, Reston Ebola virus [REBOV]
caggacccgcaagaga

SEQ ID NO: 3160421 - RNA, 16 nt, Reston Ebola virus [REBOV]
aagaccacgccagcac

SEQ ID NO: 3160422 - RNA, 13 nt, Reston Ebola virus [REBOV]
cagcacccacaac

SEQ ID NO: 3160423 - RNA, 15 nt, Reston Ebola virus [REBOV]
agaucauuccaaacu

SEQ ID NO: 3160424 - RNA, 19 nt, Reston Ebola virus [REBOV]
agguagcugauucacugag

SEQ ID NO: 3160425 - RNA, 18 nt, Reston Ebola virus [REBOV]
uaaucuauggacagguug

SEQ ID NO: 3160426 - RNA, 20 nt, Reston Ebola virus [REBOV]
guaauauacauauacacuua

SEQ ID NO: 3160427 - RNA, 19 nt, Reston Ebola virus [REBOV]
gaacccaaugacaaccacc

SEQ ID NO: 3160428 - RNA, 23 nt, Reston Ebola virus [REBOV]
uaaucuaaggccauuaagaguuu

SEQ ID NO: 3160429 - RNA, 19 nt, Reston Ebola virus [REBOV]
acuacccaggcucuucaau

SEQ ID NO: 3160430 - RNA, 16 nt, Reston Ebola virus [REBOV]
aucuauggacagguug

SEQ ID NO: 3160431 - RNA, 14 nt, Reston Ebola virus [REBOV]
uacugaugaaauua

SEQ ID NO: 3160432 - RNA, 19 nt, Reston Ebola virus [REBOV]
cugucgaauccuaggacca

SEQ ID NO: 3160433 - RNA, 17 nt, Reston Ebola virus [REBOV]
agaaaagcuauugauuu

SEQ ID NO: 3160434 - RNA, 16 nt, Reston Ebola virus [REBOV]
cagagcccacagacca

SEQ ID NO: 3160435 - RNA, 19 nt, Reston Ebola virus [REBOV]
cagaucuuuacuauuggac

SEQ ID NO: 3160436 - RNA, 16 nt, Reston Ebola virus [REBOV]
agacuauugaacuauu

SEQ ID NO: 3160437 - RNA, 15 nt, Reston Ebola virus [REBOV]
ccccgaugacccagg

SEQ ID NO: 3160438 - RNA, 17 nt, Reston Ebola virus [REBOV]
uggauccgauccaaggc

SEQ ID NO: 3160439 - RNA, 18 nt, Reston Ebola virus [REBOV]
gacccaggacccgcaaga

SEQ ID NO: 3160440 - RNA, 13 nt, Reston Ebola virus [REBOV]
aacagaaaagcua

SEQ ID NO: 3160441 - RNA, 14 nt, Reston Ebola virus [REBOV]
uacuauuggacagc

SEQ ID NO: 3160442 - RNA, 15 nt, Reston Ebola virus [REBOV]
auaagugauucuuaa

SEQ ID NO: 3160443 - RNA, 19 nt, Reston Ebola virus [REBOV]
uucaccgcgaacccaauga

SEQ ID NO: 3160444 - RNA, 14 nt, Reston Ebola virus [REBOV]
cagagcccacagac

SEQ ID NO: 3160445 - RNA, 18 nt, Reston Ebola virus [REBOV]
aacaacuccgcccagagc

SEQ ID NO: 3160446 - RNA, 22 nt, Reston Ebola virus [REBOV]
guaagguagcugauucacugag

SEQ ID NO: 3160447 - RNA, 15 nt, Reston Ebola virus [REBOV]
gaccaagucagcccg

SEQ ID NO: 3160448 - RNA, 20 nt, Reston Ebola virus [REBOV]
cuaaucagagguauaacaau

SEQ ID NO: 3160449 - RNA, 20 nt, Reston Ebola virus [REBOV]
caggaagcgcagccggacca

SEQ ID NO: 3160450 - RNA, 20 nt, Reston Ebola virus [REBOV]
cgaacaacuccgcccagagc

SEQ ID NO: 3160451 - RNA, 19 nt, Reston Ebola virus [REBOV]
ccagcccaggaagcgcagc

SEQ ID NO: 3160452 - RNA, 22 nt, Reston Ebola virus [REBOV]
aaaaucugauuguauagaauua

SEQ ID NO: 3160453 - RNA, 17 nt, Reston Ebola virus [REBOV]
uacauguguauauaacc

SEQ ID NO: 3160454 - RNA, 22 nt, Reston Ebola virus [REBOV]
agauuuagaguguaugaauugu

SEQ ID NO: 3160455 - RNA, 12 nt, Reston Ebola virus [REBOV]
guuauuacuuau

SEQ ID NO: 3160456 - RNA, 18 nt, Reston Ebola virus [REBOV]
accaggaaccagcccagg

SEQ ID NO: 3160457 - RNA, 15 nt, Reston Ebola virus [REBOV]
ggacagcuguugaug

SEQ ID NO: 3160458 - RNA, 22 nt, Reston Ebola virus [REBOV]
aacauccccgaugacccaggac

SEQ ID NO: 3160459 - RNA, 17 nt, Reston Ebola virus [REBOV]
guggucuuuuugaaaug

SEQ ID NO: 3160460 - RNA, 20 nt, Reston Ebola virus [REBOV]
acuucaaagugauuaaauga

SEQ ID NO: 3160461 - RNA, 11 nt, Reston Ebola virus [REBOV]
ugacccaggac

SEQ ID NO: 3160462 - RNA, 14 nt, Reston Ebola virus [REBOV]
cccaaguccaacca

SEQ ID NO: 3160463 - RNA, 17 nt, Reston Ebola virus [REBOV]
cacugagucccaccagg

SEQ ID NO: 3160464 - RNA, 12 nt, Reston Ebola virus [REBOV]
augacccaggac

SEQ ID NO: 3160465 - RNA, 15 nt, Reston Ebola virus [REBOV]
aguaugccaaucuua

SEQ ID NO: 3160466 - RNA, 16 nt, Reston Ebola virus [REBOV]
ugagucccaccaggaa

SEQ ID NO: 3160467 - RNA, 13 nt, Reston Ebola virus [REBOV]
cgaugacccagga

SEQ ID NO: 3160468 - RNA, 16 nt, Reston Ebola virus [REBOV]
guaccaagugaacagc

SEQ ID NO: 3160469 - RNA, 12 nt, Reston Ebola virus [REBOV]
aagcuaaauaca

SEQ ID NO: 3160470 - RNA, 19 nt, Reston Ebola virus [REBOV]
auauaauguaaauauaaca

SEQ ID NO: 3160471 - RNA, 16 nt, Reston Ebola virus [REBOV]
ugaauugugcagauuu

SEQ ID NO: 3160472 - RNA, 16 nt, Reston Ebola virus [REBOV]
aaugacaaccaccauu

SEQ ID NO: 3160473 - RNA, 21 nt, Reston Ebola virus [REBOV]
caaccaccauugccccaaguc

SEQ ID NO: 3160474 - RNA, 13 nt, Reston Ebola virus [REBOV]
uuguugaguuaac

SEQ ID NO: 3160475 - RNA, 14 nt, Reston Ebola virus [REBOV]
agcgcagccggacc

SEQ ID NO: 3160476 - RNA, 13 nt, Reston Ebola virus [REBOV]
ccauugccccaag

SEQ ID NO: 3160477 - RNA, 13 nt, Reston Ebola virus [REBOV]
aacauagacugaa

SEQ ID NO: 3160478 - RNA, 14 nt, Reston Ebola virus [REBOV]
cggccaacagcagc

SEQ ID NO: 3160479 - RNA, 19 nt, Reston Ebola virus [REBOV]
ccccgaugacccaggaccc

SEQ ID NO: 3160480 - RNA, 15 nt, Reston Ebola virus [REBOV]
ugauaacaauguacc

SEQ ID NO: 3160481 - RNA, 13 nt, Reston Ebola virus [REBOV]
uauuuuaauaaca

SEQ ID NO: 3160482 - RNA, 17 nt, Reston Ebola virus [REBOV]
ucgcauuuaaacaugcu

SEQ ID NO: 3160483 - RNA, 15 nt, Reston Ebola virus [REBOV]
cccacagaccaagac

SEQ ID NO: 3160484 - RNA, 16 nt, Reston Ebola virus [REBOV]
aacaaucgcuaguaau

SEQ ID NO: 3160485 - RNA, 19 nt, Reston Ebola virus [REBOV]
ucuauccaagauguggcuc

SEQ ID NO: 3160486 - RNA, 14 nt, Reston Ebola virus [REBOV]
gcuaaauacacuua

SEQ ID NO: 3160487 - RNA, 20 nt, Reston Ebola virus [REBOV]
acagcagcaaaccaggaacc

SEQ ID NO: 3160488 - RNA, 14 nt, Reston Ebola virus [REBOV]
cuaaucuauuuucg

SEQ ID NO: 3160489 - RNA, 15 nt, Reston Ebola virus [REBOV]
cgcaagagacggcca

SEQ ID NO: 3160490 - RNA, 21 nt, Reston Ebola virus [REBOV]
ugaucuuaaucuauggacagg

SEQ ID NO: 3160491 - RNA, 14 nt, Reston Ebola virus [REBOV]
acaacacagcaucc

SEQ ID NO: 3160492 - RNA, 14 nt, Reston Ebola virus [REBOV]
auugccccaagucc

SEQ ID NO: 3160493 - RNA, 17 nt, Reston Ebola virus [REBOV]
aggcucgaacaacuccg

SEQ ID NO: 3160494 - RNA, 23 nt, Reston Ebola virus [REBOV]
ccuaacuauugggcggcuuccau

SEQ ID NO: 3160495 - RNA, 15 nt, Reston Ebola virus [REBOV]
ucaaagugauuaaau

SEQ ID NO: 3160496 - RNA, 20 nt, Reston Ebola virus [REBOV]
ugauuguguguauuaaauua

SEQ ID NO: 3160497 - RNA, 23 nt, Reston Ebola virus [REBOV]
uaguuaagaucaaaugcaaacau

SEQ ID NO: 3160498 - RNA, 17 nt, Reston Ebola virus [REBOV]
cuaaccucauauuuuga

SEQ ID NO: 3160499 - RNA, 15 nt, Reston Ebola virus [REBOV]
acuuuauuuuaauaa

SEQ ID NO: 3160500 - RNA, 15 nt, Reston Ebola virus [REBOV]
uaagaauacacuuua

SEQ ID NO: 3160501 - RNA, 14 nt, Reston Ebola virus [REBOV]
cggaccaagucagc

SEQ ID NO: 3160502 - RNA, 17 nt, Reston Ebola virus [REBOV]
agcacccacaacauccc

SEQ ID NO: 3160503 - RNA, 20 nt, Reston Ebola virus [REBOV]
auccccgaugacccaggacc

SEQ ID NO: 3160504 - RNA, 20 nt, Reston Ebola virus [REBOV]
uaagaucaaaugcaaacauu

SEQ ID NO: 3160505 - RNA, 20 nt, Reston Ebola virus [REBOV]
caagucagcccggacucacu

SEQ ID NO: 3160506 - RNA, 13 nt, Reston Ebola virus [REBOV]
gucuuuuugaaau

SEQ ID NO: 3160507 - RNA, 14 nt, Reston Ebola virus [REBOV]
ccuaccagaccacg

SEQ ID NO: 3160508 - RNA, 16 nt, Reston Ebola virus [REBOV]
gaaccagcccaggaag

SEQ ID NO: 3160509 - RNA, 21 nt, Reston Ebola virus [REBOV]
uaaaaguauaaaauaaauuua

SEQ ID NO: 3160510 - RNA, 19 nt, Reston Ebola virus [REBOV]
cauccccgaugacccagga

SEQ ID NO: 3160511 - RNA, 16 nt, Reston Ebola virus [REBOV]
aucuucaguuaaguaa

SEQ ID NO: 3160512 - RNA, 21 nt, Reston Ebola virus [REBOV]
agcugauucacugagucccac

SEQ ID NO: 3160513 - RNA, 15 nt, Reston Ebola virus [REBOV]
ucuauggacagguug

SEQ ID NO: 3160514 - RNA, 23 nt, Reston Ebola virus [REBOV]
cacuuuaucauagcguaacacau

SEQ ID NO: 3160515 - RNA, 14 nt, Reston Ebola virus [REBOV]
ccaggaaacaaaag

SEQ ID NO: 3160516 - RNA, 23 nt, Reston Ebola virus [REBOV]
aaaagcuauugauuuucuucuuc

SEQ ID NO: 3160517 - RNA, 16 nt, Reston Ebola virus [REBOV]
cagcagcaaaccagga

SEQ ID NO: 3160518 - RNA, 20 nt, Reston Ebola virus [REBOV]
cagcagcaaaccaggaacca

SEQ ID NO: 3160519 - RNA, 23 nt, Reston Ebola virus [REBOV]
cuagccaaugaaacuacccaggc

SEQ ID NO: 3160520 - RNA, 21 nt, Reston Ebola virus [REBOV]
gcaaaccaggaaccagcccag

SEQ ID NO: 3160521 - RNA, 16 nt, Reston Ebola virus [REBOV]
gaacaacuccgcccag

SEQ ID NO: 3160522 - RNA, 15 nt, Reston Ebola virus [REBOV]
guaaucaugauuuua

SEQ ID NO: 3160523 - RNA, 19 nt, Reston Ebola virus [REBOV]
aacaacuccgcccagagcc

SEQ ID NO: 3160524 - RNA, 14 nt, Reston Ebola virus [REBOV]
cauuuaaacaugcu

SEQ ID NO: 3160525 - RNA, 18 nt, Reston Ebola virus [REBOV]
ugcuucuuugcuugauuu

SEQ ID NO: 3160526 - RNA, 14 nt, Reston Ebola virus [REBOV]
ugacgcuguugaug

SEQ ID NO: 3160527 - RNA, 15 nt, Reston Ebola virus [REBOV]
uagcaaucagaaauu

SEQ ID NO: 3160528 - RNA, 17 nt, Reston Ebola virus [REBOV]
auaugaccucaagucaa

SEQ ID NO: 3160529 - RNA, 16 nt, Reston Ebola virus [REBOV]
cuccgcccagagccca

SEQ ID NO: 3160530 - RNA, 17 nt, Reston Ebola virus [REBOV]
ucaaagugauuaaauga

SEQ ID NO: 3160531 - RNA, 17 nt, Reston Ebola virus [REBOV]
ccagagcccacagacca

SEQ ID NO: 3160532 - RNA, 17 nt, Reston Ebola virus [REBOV]
uguaucacguuaaagau

SEQ ID NO: 3160533 - RNA, 20 nt, Reston Ebola virus [REBOV]
cucaggguuacucuaaggag

SEQ ID NO: 3160534 - RNA, 20 nt, Reston Ebola virus [REBOV]
aggaccaucuuguugcauug

SEQ ID NO: 3160535 - RNA, 16 nt, Reston Ebola virus [REBOV]
caacagcagcaaacca

SEQ ID NO: 3160536 - RNA, 14 nt, Reston Ebola virus [REBOV]
uuacuugaaugcug

SEQ ID NO: 3160537 - RNA, 22 nt, Reston Ebola virus [REBOV]
uauauaaccaaucuuuuccuau

SEQ ID NO: 3160538 - RNA, 15 nt, Reston Ebola virus [REBOV]
cggaccugcagcaga

SEQ ID NO: 3160539 - RNA, 19 nt, Reston Ebola virus [REBOV]
uaauguaaauauaacaagu

SEQ ID NO: 3160540 - RNA, 17 nt, Reston Ebola virus [REBOV]
guacaugaaugagaauu

SEQ ID NO: 3160541 - RNA, 22 nt, Reston Ebola virus [REBOV]
auggucuuauuugaauaugaca

SEQ ID NO: 3160542 - RNA, 18 nt, Reston Ebola virus [REBOV]
auucugcuaguaauuccg

SEQ ID NO: 3160543 - RNA, 15 nt, Reston Ebola virus [REBOV]
aacacagcauccauu

SEQ ID NO: 3160544 - RNA, 18 nt, Reston Ebola virus [REBOV]
uccaaggcucgaacaacu

SEQ ID NO: 3160545 - RNA, 17 nt, Reston Ebola virus [REBOV]
ugcuaauagguuuguau

SEQ ID NO: 3160546 - RNA, 14 nt, Reston Ebola virus [REBOV]
ccgaugacccagga

SEQ ID NO: 3160547 - RNA, 16 nt, Reston Ebola virus [REBOV]
cgcccagagcccacag

SEQ ID NO: 3160548 - RNA, 16 nt, Reston Ebola virus [REBOV]
aacuccgcccagagcc

SEQ ID NO: 3160549 - RNA, 19 nt, Reston Ebola virus [REBOV]
accaggaaccagcccagga

SEQ ID NO: 3160550 - RNA, 12 nt, Reston Ebola virus [REBOV]
aucuuuaaauaa

SEQ ID NO: 3160551 - RNA, 13 nt, Reston Ebola virus [REBOV]
aacuacccaggcu

SEQ ID NO: 3160552 - RNA, 17 nt, Reston Ebola virus [REBOV]
gcucuauagucuauucu

SEQ ID NO: 3160553 - RNA, 18 nt, Reston Ebola virus [REBOV]
agcgcagccggaccaagu

SEQ ID NO: 3160554 - RNA, 21 nt, Reston Ebola virus [REBOV]
auaugaccucaagucaaaaau

SEQ ID NO: 3160555 - RNA, 16 nt, Reston Ebola virus [REBOV]
cccgaugacccaggac

SEQ ID NO: 3160556 - RNA, 13 nt, Reston Ebola virus [REBOV]
uauuaguaauuga

SEQ ID NO: 3160557 - RNA, 20 nt, Reston Ebola virus [REBOV]
agagacggccaacagcagca

SEQ ID NO: 3160558 - RNA, 20 nt, Reston Ebola virus [REBOV]
agaguguaugaauugugcag

SEQ ID NO: 3160559 - RNA, 17 nt, Reston Ebola virus [REBOV]
aagaccacgccagcacc

SEQ ID NO: 3160560 - RNA, 15 nt, Reston Ebola virus [REBOV]
cuuugcuuauauugg

SEQ ID NO: 3160561 - RNA, 13 nt, Reston Ebola virus [REBOV]
gagcuucuacuau

SEQ ID NO: 3160562 - RNA, 17 nt, Reston Ebola virus [REBOV]
aauugggauuauuggag

SEQ ID NO: 3160563 - RNA, 20 nt, Reston Ebola virus [REBOV]
gguguaaugcauaaucagaa

SEQ ID NO: 3160564 - RNA, 16 nt, Reston Ebola virus [REBOV]
gagagacaaucacagg

SEQ ID NO: 3160565 - RNA, 15 nt, Reston Ebola virus [REBOV]
gcagcaaaccaggaa

SEQ ID NO: 3160566 - RNA, 18 nt, Reston Ebola virus [REBOV]
caaugacucguuaacaau

SEQ ID NO: 3160567 - RNA, 18 nt, Reston Ebola virus [REBOV]
cuauuauucugcuaguaa

SEQ ID NO: 3160568 - RNA, 14 nt, Reston Ebola virus [REBOV]
auugcauugagcac

SEQ ID NO: 3160569 - RNA, 11 nt, Reston Ebola virus [REBOV]
acuugaaugcu

SEQ ID NO: 3160570 - RNA, 15 nt, Reston Ebola virus [REBOV]
uuaagaucaaaugca

SEQ ID NO: 3160571 - RNA, 14 nt, Reston Ebola virus [REBOV]
acaaucacagguuu

SEQ ID NO: 3160572 - RNA, 20 nt, Reston Ebola virus [REBOV]
uauuugaauaugacaacauc

SEQ ID NO: 3160573 - RNA, 15 nt, Reston Ebola virus [REBOV]
auuuauuuaacaagg

SEQ ID NO: 3160574 - RNA, 14 nt, Reston Ebola virus [REBOV]
agcauccauugaag

SEQ ID NO: 3160575 - RNA, 19 nt, Reston Ebola virus [REBOV]
cccacagaccaagaccacg

SEQ ID NO: 3160576 - RNA, 21 nt, Reston Ebola virus [REBOV]
agcuauuauucugcuaguaau

SEQ ID NO: 3160577 - RNA, 13 nt, Reston Ebola virus [REBOV]
ggccacaacagaa

SEQ ID NO: 3160578 - RNA, 15 nt, Reston Ebola virus [REBOV]
cagccggaccaaguc

SEQ ID NO: 3160579 - RNA, 16 nt, Reston Ebola virus [REBOV]
cuaaucuauuuucgcu

SEQ ID NO: 3160580 - RNA, 16 nt, Reston Ebola virus [REBOV]
accaagucagcccgga

SEQ ID NO: 3160581 - RNA, 22 nt, Reston Ebola virus [REBOV]
aggaccaucuuguugcauugag

SEQ ID NO: 3160582 - RNA, 22 nt, Reston Ebola virus [REBOV]
uuaagcgcacacaaaaacauua

SEQ ID NO: 3160583 - RNA, 18 nt, Reston Ebola virus [REBOV]
ccugcagcagaaggcauc

SEQ ID NO: 3160584 - RNA, 17 nt, Reston Ebola virus [REBOV]
aaguacaugaaugagaa

SEQ ID NO: 3160585 - RNA, 13 nt, Reston Ebola virus [REBOV]
accaggaaccagc

SEQ ID NO: 3160586 - RNA, 17 nt, Reston Ebola virus [REBOV]
acaauccccuaccagac

SEQ ID NO: 3160587 - RNA, 14 nt, Reston Ebola virus [REBOV]
auugaagacucccc

SEQ ID NO: 3160588 - RNA, 20 nt, Reston Ebola virus [REBOV]
uuuuuacauguguauauaac

SEQ ID NO: 3160589 - RNA, 16 nt, Reston Ebola virus [REBOV]
aacccaaugacaacca

SEQ ID NO: 3160590 - RNA, 13 nt, Reston Ebola virus [REBOV]
auuaagaguuuaa

SEQ ID NO: 3160591 - RNA, 15 nt, Reston Ebola virus [REBOV]
gcacaagauguuaug

SEQ ID NO: 3160592 - RNA, 19 nt, Reston Ebola virus [REBOV]
aacagcagcaaaccaggaa

SEQ ID NO: 3160593 - RNA, 14 nt, Reston Ebola virus [REBOV]
aaucuaacacugaa

SEQ ID NO: 3160594 - RNA, 16 nt, Reston Ebola virus [REBOV]
auuuauuagaauguac

SEQ ID NO: 3160595 - RNA, 22 nt, Reston Ebola virus [REBOV]
agguggucuuuuugaaauggag

SEQ ID NO: 3160596 - RNA, 17 nt, Reston Ebola virus [REBOV]
acggagaugaucuuaau

SEQ ID NO: 3160597 - RNA, 18 nt, Reston Ebola virus [REBOV]
auuggaguaaaaguauaa

SEQ ID NO: 3160598 - RNA, 16 nt, Reston Ebola virus [REBOV]
aacaaugccuaacuau

SEQ ID NO: 3160599 - RNA, 17 nt, Reston Ebola virus [REBOV]
caggacccgcaagagac

SEQ ID NO: 3160600 - RNA, 17 nt, Reston Ebola virus [REBOV]
auccccgaugacccagg

SEQ ID NO: 3160601 - RNA, 21 nt, Reston Ebola virus [REBOV]
cacugagucccaccaggaaac

SEQ ID NO: 3160602 - RNA, 13 nt, Reston Ebola virus [REBOV]
auuugaacauagu

SEQ ID NO: 3160603 - RNA, 24 nt, Reston Ebola virus [REBOV]
aaucgcuaguaauuuuaaucucca

SEQ ID NO: 3160604 - RNA, 18 nt, Reston Ebola virus [REBOV]
uuauuuuuaaaauuuacu

SEQ ID NO: 3160605 - RNA, 21 nt, Reston Ebola virus [REBOV]
acaacuccgcccagagcccac

SEQ ID NO: 3160606 - RNA, 13 nt, Reston Ebola virus [REBOV]
uuuuaaucuaauu

SEQ ID NO: 3160607 - RNA, 20 nt, Reston Ebola virus [REBOV]
gcuucauagguggucuuuuu

SEQ ID NO: 3160608 - RNA, 12 nt, Reston Ebola virus [REBOV]
ucugcuucuuug

SEQ ID NO: 3160609 - RNA, 15 nt, Reston Ebola virus [REBOV]
ugaugaaauuaacca

SEQ ID NO: 3160610 - RNA, 19 nt, Reston Ebola virus [REBOV]
gagcccacagaccaagacc

SEQ ID NO: 3160611 - RNA, 20 nt, Reston Ebola virus [REBOV]
gaucuuaaucuauggacagg

SEQ ID NO: 3160612 - RNA, 17 nt, Reston Ebola virus [REBOV]
uagaguauacucaaaau

SEQ ID NO: 3160613 - RNA, 14 nt, Reston Ebola virus [REBOV]
auucugcuaguaau

SEQ ID NO: 3160614 - RNA, 13 nt, Reston Ebola virus [REBOV]
uaaauaauacuuu

SEQ ID NO: 3160615 - RNA, 14 nt, Reston Ebola virus [REBOV]
cgaugacccaggac

SEQ ID NO: 3160616 - RNA, 17 nt, Reston Ebola virus [REBOV]
uugugggucuuaucuag

SEQ ID NO: 3160617 - RNA, 21 nt, Reston Ebola virus [REBOV]
uaagauuuuguguugauuuau

SEQ ID NO: 3160618 - RNA, 22 nt, Reston Ebola virus [REBOV]
auucacugagucccaccaggaa

SEQ ID NO: 3160619 - RNA, 21 nt, Reston Ebola virus [REBOV]
caugauuuuaugauaauucuu

SEQ ID NO: 3160620 - RNA, 13 nt, Reston Ebola virus [REBOV]
ccuuaugcuucau

SEQ ID NO: 3160621 - RNA, 16 nt, Reston Ebola virus [REBOV]
gaugacccaggacccg

SEQ ID NO: 3160622 - RNA, 15 nt, Reston Ebola virus [REBOV]
cuuugcuugauuuac

SEQ ID NO: 3160623 - RNA, 20 nt, Reston Ebola virus [REBOV]
cuugaguaauaaucauuucu

SEQ ID NO: 3160624 - RNA, 22 nt, Reston Ebola virus [REBOV]
caauagcaaaguuaaauucucc

SEQ ID NO: 3160625 - RNA, 22 nt, Reston Ebola virus [REBOV]
cagaacugaggacuuacucacu

SEQ ID NO: 3160626 - RNA, 16 nt, Reston Ebola virus [REBOV]
augugaucuaauagau

SEQ ID NO: 3160627 - RNA, 14 nt, Reston Ebola virus [REBOV]
auacuguuaagaga

SEQ ID NO: 3160628 - RNA, 14 nt, Reston Ebola virus [REBOV]
ucugauuguggauu

SEQ ID NO: 3160629 - RNA, 22 nt, Human
gaaccaccacacccagcccacu

SEQ ID NO: 3160630 - RNA, 21 nt, Human
gaaccaccacacccagcccac

SEQ ID NO: 3160631 - RNA, 20 nt, Human
gaaccaccacacccagccca

SEQ ID NO: 3160632 - RNA, 18 nt, Human
gaaccaccacacccagcc

SEQ ID NO: 3160633 - RNA, 14 nt, Human
gaacugagcuugga

SEQ ID NO: 3160634 - RNA, 19 nt, Human
gaacucuucucauuacuug

SEQ ID NO: 3160635 - RNA, 15 nt, Human
gaacucuugacagcu

SEQ ID NO: 3160636 - RNA, 22 nt, Human
gaacugaaaggcuuuucaacca

SEQ ID NO: 3160637 - RNA, 22 nt, Human
gaacugagcuuggaagcuucug

SEQ ID NO: 3160638 - RNA, 21 nt, Human
gaacugagcuuggaagcuucu

SEQ ID NO: 3160639 - RNA, 16 nt, Human
gaacugagcuuggaag

SEQ ID NO: 3160640 - RNA, 15 nt, Human
gaacugagcuuggaa

SEQ ID NO: 3160641 - RNA, 17 nt, Human
gaacccgggaggcagag

SEQ ID NO: 3160642 - RNA, 13 nt, Human
gaacuccuggccu

SEQ ID NO: 3160643 - RNA, 14 nt, Human
gaacuccugaccuc

SEQ ID NO: 3160644 - RNA, 14 nt, Human
gaacuccuggccuc

SEQ ID NO: 3160645 - RNA, 14 nt, Human
gaacucuucucauu

SEQ ID NO: 3160646 - RNA, 17 nt, Human
gaacucuucucauuacu

SEQ ID NO: 3160647 - RNA, 22 nt, Human
gaacucuuccuccaaggacaga

SEQ ID NO: 3160648 - RNA, 12 nt, Human
gaacucuuccuc

SEQ ID NO: 3160649 - RNA, 22 nt, Human
gaaccccuggcuccaggccagg

SEQ ID NO: 3160650 - RNA, 18 nt, Human
gaaccccuggcuccaggc

SEQ ID NO: 3160651 - RNA, 20 nt, Human
gaacccauggaaaaaugcca

SEQ ID NO: 3160652 - RNA, 17 nt, Human
gaacccaaguccaagca

SEQ ID NO: 3160653 - RNA, 16 nt, Human
gaacccaaguccaagc

SEQ ID NO: 3160654 - RNA, 22 nt, Human
gaaccauaguugacaguuccaa

SEQ ID NO: 3160655 - RNA, 20 nt, Human
gaaccauaguuacuguaaaa

SEQ ID NO: 3160656 - RNA, 23 nt, Human
gaaccauaguuacuguaaaaugc

SEQ ID NO: 3160657 - RNA, 21 nt, Human
gaaccauaguuacuguaaaau

SEQ ID NO: 3160658 - RNA, 18 nt, Human
gaaccauaaaauguccag

SEQ ID NO: 3160659 - RNA, 19 nt, Human
gaaccauaaaauguccagu

SEQ ID NO: 3160660 - RNA, 14 nt, Human
gaaccauaaaaugu

SEQ ID NO: 3160661 - RNA, 23 nt, Human
gaaccaccacacccagcccacuu

SEQ ID NO: 3160662 - RNA, 13 nt, Human
gaaccacuuguag

SEQ ID NO: 3160663 - RNA, 14 nt, Human
gaaccacuuguaga

SEQ ID NO: 3160664 - RNA, 13 nt, Human
gaaccaccuaccc

SEQ ID NO: 3160665 - RNA, 14 nt, Human
gaaccaccuacccc

SEQ ID NO: 3160666 - RNA, 20 nt, Human
gaaccacuuguagauuugau

SEQ ID NO: 3160667 - RNA, 15 nt, Human
gaaccacuuguagau

SEQ ID NO: 3160668 - RNA, 18 nt, Human
gaaccacuuguagauuug

SEQ ID NO: 3160669 - RNA, 16 nt, Human
gaagacucauucuucu

SEQ ID NO: 3160670 - RNA, 18 nt, Human
gaagacucauucuucugu

SEQ ID NO: 3160671 - RNA, 17 nt, Human
gaagacucauucuucug

SEQ ID NO: 3160672 - RNA, 22 nt, Human
gaagcacaugccucucucaggc

SEQ ID NO: 3160673 - RNA, 14 nt, Human
gaagcacagcuuca

SEQ ID NO: 3160674 - RNA, 13 nt, Human
gaagcacagcuuc

SEQ ID NO: 3160675 - RNA, 16 nt, Human
gaagcaccauaacuuu

SEQ ID NO: 3160676 - RNA, 21 nt, Human
gaagcacaugccucucucagg

SEQ ID NO: 3160677 - RNA, 23 nt, Human
gaagcacaccaaucuuacuuugu

SEQ ID NO: 3160678 - RNA, 17 nt, Human
gaagcaggguuucuuuu

SEQ ID NO: 3160679 - RNA, 19 nt, Human
gaagcaggugugagggcag

SEQ ID NO: 3160680 - RNA, 16 nt, Human
gaagcagguuaaaugu

SEQ ID NO: 3160681 - RNA, 15 nt, Human
gaagcagguuaaaug

SEQ ID NO: 3160682 - RNA, 13 nt, Human
gaagcaguauuuu

SEQ ID NO: 3160683 - RNA, 19 nt, Human
gaagcagguuaaauguuuu

SEQ ID NO: 3160684 - RNA, 18 nt, Human
gaagcagguuaaauguuu

SEQ ID NO: 3160685 - RNA, 17 nt, Human
gaagcagguuaaauguu

SEQ ID NO: 3160686 - RNA, 14 nt, Human
gaagacagcucuua

SEQ ID NO: 3160687 - RNA, 15 nt, Human
gaagacagcucuuau

SEQ ID NO: 3160688 - RNA, 18 nt, Human
gaagaccuaaccagggcc

SEQ ID NO: 3160689 - RNA, 13 nt, Human
gaagaccuaacca

SEQ ID NO: 3160690 - RNA, 23 nt, Human
gaagaccuaaccagggccagaag

SEQ ID NO: 3160691 - RNA, 20 nt, Human
gaagaccuaaccagggccag

SEQ ID NO: 3160692 - RNA, 13 nt, Human
gaagacagagcua

SEQ ID NO: 3160693 - RNA, 15 nt, Human
gaagacagagcuaca

SEQ ID NO: 3160694 - RNA, 12 nt, Human
gaagacagcucu

SEQ ID NO: 3160695 - RNA, 13 nt, Human
gaagacagcucuu

SEQ ID NO: 3160696 - RNA, 21 nt, Human
gaagacacugaugggcaaccc

SEQ ID NO: 3160697 - RNA, 16 nt, Human
gaagacacugaugggc

SEQ ID NO: 3160698 - RNA, 17 nt, Human
gaacugcagucacugca

SEQ ID NO: 3160699 - RNA, 22 nt, Human
gaaaaaaccguguuugucucuu

SEQ ID NO: 3160700 - RNA, 16 nt, Human
gaaaaaagagaaaaga

SEQ ID NO: 3160701 - RNA, 10 nt, Human
gaaaaaagag

SEQ ID NO: 3160702 - RNA, 22 nt, Human
gaaaaaaaugucaaaaguagaa

SEQ ID NO: 3160703 - RNA, 23 nt, Human
gaaaagaaaaaugagccuggcaa

SEQ ID NO: 3160704 - RNA, 15 nt, Human
gaaaagaaaacaaaa

SEQ ID NO: 3160705 - RNA, 16 nt, Human
gaaaagaaaacaaaaa

SEQ ID NO: 3160706 - RNA, 18 nt, Human
gaaaaaagagaaaagaaa

SEQ ID NO: 3160707 - RNA, 17 nt, Human
gaaaaaagagaaaagaa

SEQ ID NO: 3160708 - RNA, 16 nt, Human
gaaaaaauaauuauuu

SEQ ID NO: 3160709 - RNA, 23 nt, Human
gaaaaaaguuguaggcgaaucau

SEQ ID NO: 3160710 - RNA, 22 nt, Human
gaaaaaaguuguaggcgaauca

SEQ ID NO: 3160711 - RNA, 14 nt, Human
gaaaaaaguuguag

SEQ ID NO: 3160712 - RNA, 22 nt, Human
gaaaauuaggauuucaugauuu

SEQ ID NO: 3160713 - RNA, 15 nt, Human
gaaaauguucuucca

SEQ ID NO: 3160714 - RNA, 21 nt, Human
gaaaagauguagauuuauuuc

SEQ ID NO: 3160715 - RNA, 19 nt, Human
gaaaagauguagauuuauu

SEQ ID NO: 3160716 - RNA, 18 nt, Human
gaaaagauguagauuuau

SEQ ID NO: 3160717 - RNA, 17 nt, Human
gaaaagauguagauuua

SEQ ID NO: 3160718 - RNA, 14 nt, Human
gaaaagauguagau

SEQ ID NO: 3160719 - RNA, 12 nt, Human
gaaaaugugugu

SEQ ID NO: 3160720 - RNA, 15 nt, Human
gaaaaugugugugug

SEQ ID NO: 3160721 - RNA, 14 nt, Human
gaaaauguguguuu

SEQ ID NO: 3160722 - RNA, 15 nt, Human
gaaaauguguguuuu

SEQ ID NO: 3160723 - RNA, 22 nt, Human
gaaaagaaaucuaugauuccag

SEQ ID NO: 3160724 - RNA, 15 nt, Human
gaaaagaaggaaaga

SEQ ID NO: 3160725 - RNA, 15 nt, Human
gaaaagaaguagugu

SEQ ID NO: 3160726 - RNA, 24 nt, Human
gaaaagaaaucuauagaaaguguu

SEQ ID NO: 3160727 - RNA, 23 nt, Human
gaaaagaaaucuauagaaagugu

SEQ ID NO: 3160728 - RNA, 22 nt, Human
gaaaagaaaucuauagaaagug

SEQ ID NO: 3160729 - RNA, 21 nt, Human
gaaaagaaaucuauagaaagu

SEQ ID NO: 3160730 - RNA, 22 nt, Human
gaaaagaaacucuauggucuua

SEQ ID NO: 3160731 - RNA, 14 nt, Human
gaaaagaaacucua

SEQ ID NO: 3160732 - RNA, 13 nt, Human
gaaaagaaaucua

SEQ ID NO: 3160733 - RNA, 14 nt, Human
gaaaagacuccaaa

SEQ ID NO: 3160734 - RNA, 17 nt, Human
gaaaagacuaagaucgg

SEQ ID NO: 3160735 - RNA, 14 nt, Human
gaaaagaauagaag

SEQ ID NO: 3160736 - RNA, 11 nt, Human
gaaaagaauuu

SEQ ID NO: 3160737 - RNA, 14 nt, Human
gaaaagaauuuuuu

SEQ ID NO: 3160738 - RNA, 17 nt, Human
gaaaagacuccaaagaa

SEQ ID NO: 3160739 - RNA, 16 nt, Human
gaaaagacuccaaaga

SEQ ID NO: 3160740 - RNA, 19 nt, Human
gaaaagauaaagaccagaa

SEQ ID NO: 3160741 - RNA, 20 nt, Human
gaaaagauaaagaccagaaa

SEQ ID NO: 3160742 - RNA, 22 nt, Human
gaaaagauaaagaccagaaauu

SEQ ID NO: 3160743 - RNA, 24 nt, Human
gaaacaaagcauuugacuuucugu

SEQ ID NO: 3160744 - RNA, 16 nt, Human
gaaacaacauuuauau

SEQ ID NO: 3160745 - RNA, 18 nt, Human
gaaacaacauuuauaugu

SEQ ID NO: 3160746 - RNA, 20 nt, Human
gaacaaguugagcuaugacu

SEQ ID NO: 3160747 - RNA, 21 nt, Human
gaacaaguugagcuaugacuu

SEQ ID NO: 3160748 - RNA, 22 nt, Human
gaacaaguugagcuaugacuua

SEQ ID NO: 3160749 - RNA, 22 nt, Human
gaacaagucccuguaauuguug

SEQ ID NO: 3160750 - RNA, 13 nt, Human
gaacaaaucuucc

SEQ ID NO: 3160751 - RNA, 16 nt, Human
gaacaaagaccaauuu

SEQ ID NO: 3160752 - RNA, 14 nt, Human
gaacaaaucuuccu

SEQ ID NO: 3160753 - RNA, 17 nt, Human
gaacacauaauucagga

SEQ ID NO: 3160754 - RNA, 20 nt, Human
gaacacauaauucaggaagc

SEQ ID NO: 3160755 - RNA, 23 nt, Human
gaacacauuucuuuuuaaaaaaa

SEQ ID NO: 3160756 - RNA, 22 nt, Human
gaacacauuucuuuuuaaaaaa

SEQ ID NO: 3160757 - RNA, 18 nt, Human
gaaaucuaugauuccagg

SEQ ID NO: 3160758 - RNA, 14 nt, Human
gaaaucuauagaaa

SEQ ID NO: 3160759 - RNA, 20 nt, Human
gaaaucuaugauuccaggug

SEQ ID NO: 3160760 - RNA, 23 nt, Human
gaaaucuauagaaaguguucugu

SEQ ID NO: 3160761 - RNA, 19 nt, Human
gaaaucuauagaaaguguu

SEQ ID NO: 3160762 - RNA, 17 nt, Human
gaaaggggauuacaguu

SEQ ID NO: 3160763 - RNA, 14 nt, Human
gaaauccugguucc

SEQ ID NO: 3160764 - RNA, 15 nt, Human
gaaauccugguuccu

SEQ ID NO: 3160765 - RNA, 16 nt, Human
gaaagggcccagagag

SEQ ID NO: 3160766 - RNA, 15 nt, Human
gaaagggcccagaga

SEQ ID NO: 3160767 - RNA, 23 nt, Human
gaaaucugaggaauggacauuuc

SEQ ID NO: 3160768 - RNA, 15 nt, Human
gaaaucucuuugccc

SEQ ID NO: 3160769 - RNA, 14 nt, Human
gaaaucugaacauu

SEQ ID NO: 3160770 - RNA, 14 nt, Human
gaacaaaauuauuu

SEQ ID NO: 3160771 - RNA, 16 nt, Human
gaacaaaauaaauugg

SEQ ID NO: 3160772 - RNA, 15 nt, Human
gaacaaaauaaauug

SEQ ID NO: 3160773 - RNA, 14 nt, Human
gaacaaaauaaauu

SEQ ID NO: 3160774 - RNA, 13 nt, Human
gaaagggcccaga

SEQ ID NO: 3160775 - RNA, 12 nt, Human
gaaaggcuccag

SEQ ID NO: 3160776 - RNA, 20 nt, Human
gaaagaacgcugauuuaaag

SEQ ID NO: 3160777 - RNA, 14 nt, Human
gaaaggcuccagga

SEQ ID NO: 3160778 - RNA, 15 nt, Human
gaaaggcuccaggag

SEQ ID NO: 3160779 - RNA, 13 nt, Human
gaaaggcuccagg

SEQ ID NO: 3160780 - RNA, 15 nt, Human
gaaagaaagaggaaa

SEQ ID NO: 3160781 - RNA, 13 nt, Human
gaaagaaagagga

SEQ ID NO: 3160782 - RNA, 18 nt, Human
gaaagaaaaucaggcugg

SEQ ID NO: 3160783 - RNA, 22 nt, Human
gaaacuggaaauacuagauuug

SEQ ID NO: 3160784 - RNA, 22 nt, Human
cuuggggucagguugacaggag

SEQ ID NO: 3160785 - RNA, 13 nt, Human
cuuggggucaggu

SEQ ID NO: 3160786 - RNA, 17 nt, Human
cuuggucacagccaggc

SEQ ID NO: 3160787 - RNA, 19 nt, Human
cuuggucugugagaugcua

SEQ ID NO: 3160788 - RNA, 16 nt, Human
cuuggucugugagaug

SEQ ID NO: 3160789 - RNA, 14 nt, Human
cuugguccugcugc

SEQ ID NO: 3160790 - RNA, 22 nt, Human
cuugguagaagcccuucuaccu

SEQ ID NO: 3160791 - RNA, 16 nt, Human
cuuggucacagccagg

SEQ ID NO: 3160792 - RNA, 16 nt, Human
cuugguauuuggauau

SEQ ID NO: 3160793 - RNA, 21 nt, Human
cuugguauuuggauaucuguu

SEQ ID NO: 3160794 - RNA, 18 nt, Human
cuugugaaaauaauugac

SEQ ID NO: 3160795 - RNA, 18 nt, Human
cuugucuuuggacccuga

SEQ ID NO: 3160796 - RNA, 13 nt, Human
cuugucuuuggac

SEQ ID NO: 3160797 - RNA, 15 nt, Human
cuugucuuuggaccc

SEQ ID NO: 3160798 - RNA, 21 nt, Human
cuugugaaaauaauugacagg

SEQ ID NO: 3160799 - RNA, 16 nt, Human
cuugucuuucuggggu

SEQ ID NO: 3160800 - RNA, 15 nt, Human
cuugucuuucugggg

SEQ ID NO: 3160801 - RNA, 16 nt, Human
cuugucggcuccaguc

SEQ ID NO: 3160802 - RNA, 14 nt, Human
cuugucggcuccag

SEQ ID NO: 3160803 - RNA, 19 nt, Human
cuuggugucgggcaugaca

SEQ ID NO: 3160804 - RNA, 18 nt, Human
cuuggugcuuauugauau

SEQ ID NO: 3160805 - RNA, 17 nt, Human
cuuggugccucugcagu

SEQ ID NO: 3160806 - RNA, 19 nt, Human
cuuggugccuaauguucca

SEQ ID NO: 3160807 - RNA, 15 nt, Human
cuuucacuauaaugu

SEQ ID NO: 3160808 - RNA, 20 nt, Human
cuuucacuauaaugugaaau

SEQ ID NO: 3160809 - RNA, 20 nt, Human
cuuucacccuuuucuguuug

SEQ ID NO: 3160810 - RNA, 14 nt, Human
cuuucacccuuuuc

SEQ ID NO: 3160811 - RNA, 15 nt, Human
cuuucacccuuuucu

SEQ ID NO: 3160812 - RNA, 14 nt, Human
cuuuaccaugcuca

SEQ ID NO: 3160813 - RNA, 23 nt, Human
cuuuaaugucacaggcaggucca

SEQ ID NO: 3160814 - RNA, 22 nt, Human
cuuuaauuaaaaccugggauua

SEQ ID NO: 3160815 - RNA, 23 nt, Human
cuuuaauuccaugaauguuccug

SEQ ID NO: 3160816 - RNA, 16 nt, Human
cuuuaauuccaugaau

SEQ ID NO: 3160817 - RNA, 15 nt, Human
cuuuaauuccaugaa

SEQ ID NO: 3160818 - RNA, 18 nt, Human
cuuuacauacuuuaucaa

SEQ ID NO: 3160819 - RNA, 15 nt, Human
cuuucagcaggcagc

SEQ ID NO: 3160820 - RNA, 14 nt, Human
cuuucagcaggcag

SEQ ID NO: 3160821 - RNA, 18 nt, Human
cuuucagcaggcagccuu

SEQ ID NO: 3160822 - RNA, 16 nt, Human
cuuucagcaggcagcc

SEQ ID NO: 3160823 - RNA, 14 nt, Human
cuuugaccuguugg

SEQ ID NO: 3160824 - RNA, 16 nt, Human
cuuugacgccauccca

SEQ ID NO: 3160825 - RNA, 17 nt, Human
cuuugacgccaucccag

SEQ ID NO: 3160826 - RNA, 19 nt, Human
cuuugacucuauaagcaaa

SEQ ID NO: 3160827 - RNA, 20 nt, Human
cuuugacucuauaagcaaau

SEQ ID NO: 3160828 - RNA, 16 nt, Human
cuuucuacccagcgag

SEQ ID NO: 3160829 - RNA, 15 nt, Human
cuuucuacccagcga

SEQ ID NO: 3160830 - RNA, 17 nt, Human
cuuucuaaugugugaau

SEQ ID NO: 3160831 - RNA, 21 nt, Human
cuuugguucuggguuguuucc

SEQ ID NO: 3160832 - RNA, 20 nt, Human
cuuuguacacccaugaaaga

SEQ ID NO: 3160833 - RNA, 22 nt, Human
cuuuguacacccaugaaagaaa

SEQ ID NO: 3160834 - RNA, 12 nt, Human
cuuuguaugcac

SEQ ID NO: 3160835 - RNA, 16 nt, Human
cuuugcaaaggagcuc

SEQ ID NO: 3160836 - RNA, 15 nt, Human
cuuugcaaaggagcu

SEQ ID NO: 3160837 - RNA, 16 nt, Human
cuuuguauucugucuu

SEQ ID NO: 3160838 - RNA, 19 nt, Human
cuuuguauucugucuucau

SEQ ID NO: 3160839 - RNA, 20 nt, Human
cuugauuaagaucucagugg

SEQ ID NO: 3160840 - RNA, 13 nt, Human
cuugauuaaauca

SEQ ID NO: 3160841 - RNA, 14 nt, Human
cuugauuaaaucaa

SEQ ID NO: 3160842 - RNA, 15 nt, Human
cuugauuaaaucaac

SEQ ID NO: 3160843 - RNA, 15 nt, Human
cuugauguguuaucu

SEQ ID NO: 3160844 - RNA, 21 nt, Human
cuugaucaguaguuugcauuu

SEQ ID NO: 3160845 - RNA, 20 nt, Human
cuugaucaguaguuugcauu

SEQ ID NO: 3160846 - RNA, 22 nt, Human
cuugaucaguaguuugcauuuc

SEQ ID NO: 3160847 - RNA, 18 nt, Human
cuugauguguuaucucuu

SEQ ID NO: 3160848 - RNA, 22 nt, Human
cuugauauccucuuugagugaa

SEQ ID NO: 3160849 - RNA, 17 nt, Human
cuugauauccucuuuga

SEQ ID NO: 3160850 - RNA, 23 nt, Human
cuugauauuuguauuuauucuuu

SEQ ID NO: 3160851 - RNA, 18 nt, Human
cuugaucaguaguuugca

SEQ ID NO: 3160852 - RNA, 18 nt, Human
cuugauauuuguauuuau

SEQ ID NO: 3160853 - RNA, 16 nt, Human
cuugauauuuguauuu

SEQ ID NO: 3160854 - RNA, 14 nt, Human
cuugauauuuguau

SEQ ID NO: 3160855 - RNA, 13 nt, Human
cuugauauuugua

SEQ ID NO: 3160856 - RNA, 23 nt, Human
cuugaaugaugccaugaggaaca

SEQ ID NO: 3160857 - RNA, 23 nt, Human
cuugaauggcaauguuuugcuuu

SEQ ID NO: 3160858 - RNA, 21 nt, Human
cuugaauggcaauguuuugcu

SEQ ID NO: 3160859 - RNA, 16 nt, Human
cuugacaucaacugca

SEQ ID NO: 3160860 - RNA, 20 nt, Human
cuugacagggcacaccgggc

SEQ ID NO: 3160861 - RNA, 22 nt, Human
cuugcuaccacggccuccuuuc

SEQ ID NO: 3160862 - RNA, 17 nt, Human
cuugcaaaauuccugac

SEQ ID NO: 3160863 - RNA, 16 nt, Human
cuugauuugagauuuu

SEQ ID NO: 3160864 - RNA, 23 nt, Human
cuugauuuuccaucuaaaaauau

SEQ ID NO: 3160865 - RNA, 22 nt, Human
cuugauuuuccaucuaaaaaua

SEQ ID NO: 3160866 - RNA, 14 nt, Human
cuugauuuuccauc

SEQ ID NO: 3160867 - RNA, 13 nt, Human
cuugauuuuccau

SEQ ID NO: 3160868 - RNA, 16 nt, Human
cuugcaaaauuccuga

SEQ ID NO: 3160869 - RNA, 23 nt, Human
cuuggauuguccccgacccuugc

SEQ ID NO: 3160870 - RNA, 24 nt, Human
cuuggauuguccccgacccuugcc

SEQ ID NO: 3160871 - RNA, 22 nt, Human
cuuggauuguccccgacccuug

SEQ ID NO: 3160872 - RNA, 15 nt, Human
cuugcucccugacug

SEQ ID NO: 3160873 - RNA, 13 nt, Human
cuuggccucagag

SEQ ID NO: 3160874 - RNA, 17 nt, Human
cuugcucccugacuggg

SEQ ID NO: 3160875 - RNA, 21 nt, Human
cuuggcaauaaauuuugaaaa

SEQ ID NO: 3160876 - RNA, 20 nt, Human
cuuggccucacccucuggcu

SEQ ID NO: 3160877 - RNA, 20 nt, Human
cuuggcaauaaauuuugaaa

SEQ ID NO: 3160878 - RNA, 21 nt, Human
cuucucacauggaaugagggu

SEQ ID NO: 3160879 - RNA, 21 nt, Human
cuucuaaguaaaaccacagca

SEQ ID NO: 3160880 - RNA, 17 nt, Human
cuucuaaguaaaaccac

SEQ ID NO: 3160881 - RNA, 13 nt, Human
cuucuaaguaaaa

SEQ ID NO: 3160882 - RNA, 13 nt, Human
cuuccugagggga

SEQ ID NO: 3160883 - RNA, 22 nt, Human
cuuccugaggggagacagagca

SEQ ID NO: 3160884 - RNA, 21 nt, Human
cuuccugaggggagacagagc

SEQ ID NO: 3160885 - RNA, 21 nt, Human
cuuccucuuuccaucuacccu

SEQ ID NO: 3160886 - RNA, 16 nt, Human
cuuccucugaggcuga

SEQ ID NO: 3160887 - RNA, 22 nt, Human
cuuccucuuuccaucuacccuc

SEQ ID NO: 3160888 - RNA, 22 nt, Human
cuuccucugaggcugaaauuca

SEQ ID NO: 3160889 - RNA, 14 nt, Human
cuuccucuccacug

SEQ ID NO: 3160890 - RNA, 13 nt, Human
cuuccucuccacu

SEQ ID NO: 3160891 - RNA, 14 nt, Human
cuuccucugagccu

SEQ ID NO: 3160892 - RNA, 15 nt, Human
cuuccucugagccuu

SEQ ID NO: 3160893 - RNA, 13 nt, Human
cuuccuccuggug

SEQ ID NO: 3160894 - RNA, 23 nt, Human
cuucugaacuuggcgcugccccu

SEQ ID NO: 3160895 - RNA, 17 nt, Human
cuucucuuccaggcagc

SEQ ID NO: 3160896 - RNA, 16 nt, Human
cuucucuuccaggcag

SEQ ID NO: 3160897 - RNA, 19 nt, Human
cuucugacauaauccagua

SEQ ID NO: 3160898 - RNA, 13 nt, Human
cuucuucagagac

SEQ ID NO: 3160899 - RNA, 14 nt, Human
cuucuucagagacu

SEQ ID NO: 3160900 - RNA, 14 nt, Human
cugcuucaaauauu

SEQ ID NO: 3160901 - RNA, 20 nt, Human
cugcuucaaggauccugagc

SEQ ID NO: 3160902 - RNA, 20 nt, Human
cugcuuuugucuaugggacu

SEQ ID NO: 3160903 - RNA, 22 nt, Human
cugcuucaaggauccugagcca

SEQ ID NO: 3160904 - RNA, 23 nt, Human
cugcuucaaggauccugagccag

SEQ ID NO: 3160905 - RNA, 19 nt, Human
cugcuucaaauauuucccu

SEQ ID NO: 3160906 - RNA, 12 nt, Human
cugcuucaagga

SEQ ID NO: 3160907 - RNA, 21 nt, Human
cugcuucaaggauccugagcc

SEQ ID NO: 3160908 - RNA, 13 nt, Human
cuggacuuggagg

SEQ ID NO: 3160909 - RNA, 13 nt, Human
cuggagaaaaaua

SEQ ID NO: 3160910 - RNA, 14 nt, Human
cuggagaaaaauau

SEQ ID NO: 3160911 - RNA, 21 nt, Human
cugcuuuugucuaugggacuc

SEQ ID NO: 3160912 - RNA, 19 nt, Human
cugcuuuugucuaugggac

SEQ ID NO: 3160913 - RNA, 19 nt, Human
cuggaagagcuaggcaggg

SEQ ID NO: 3160914 - RNA, 17 nt, Human
cuggaagagcuaggcag

SEQ ID NO: 3160915 - RNA, 16 nt, Human
cuggaguuggggcaga

SEQ ID NO: 3160916 - RNA, 13 nt, Human
cuggauagugaag

SEQ ID NO: 3160917 - RNA, 16 nt, Human
cugccugguccucaca

SEQ ID NO: 3160918 - RNA, 23 nt, Human
cugccugguccucacacucaccc

SEQ ID NO: 3160919 - RNA, 19 nt, Human
cugccugguccucacacuc

SEQ ID NO: 3160920 - RNA, 17 nt, Human
cugccugguccucacac

SEQ ID NO: 3160921 - RNA, 20 nt, Human
cugccuguugggccaggagc

SEQ ID NO: 3160922 - RNA, 19 nt, Human
cugccuguucagcuccagc

SEQ ID NO: 3160923 - RNA, 18 nt, Human
cugccuguucagcuccag

SEQ ID NO: 3160924 - RNA, 17 nt, Human
cugccuguucagcucca

SEQ ID NO: 3160925 - RNA, 23 nt, Human
cugccucucccaucacuucccua

SEQ ID NO: 3160926 - RNA, 22 nt, Human
cugccucucccaucacuucccu

SEQ ID NO: 3160927 - RNA, 15 nt, Human
cugccucucccauca

SEQ ID NO: 3160928 - RNA, 15 nt, Human
cugccuccucuucaa

SEQ ID NO: 3160929 - RNA, 14 nt, Human
cugccuccucuuca

SEQ ID NO: 3160930 - RNA, 13 nt, Human
cugccuccucuuc

SEQ ID NO: 3160931 - RNA, 20 nt, Human
cugaucugaugcaagcaaga

SEQ ID NO: 3160932 - RNA, 14 nt, Human
cugaucuguuauag

SEQ ID NO: 3160933 - RNA, 13 nt, Human
cugaucuguuaua

SEQ ID NO: 3160934 - RNA, 15 nt, Human
cugccuguucagcuc

SEQ ID NO: 3160935 - RNA, 21 nt, Human
cugccuguugggccaggagcc

SEQ ID NO: 3160936 - RNA, 22 nt, Human
cugccuguugggccaggagccu

SEQ ID NO: 3160937 - RNA, 22 nt, Human
cugcuaguguucuuucucuuuc

SEQ ID NO: 3160938 - RNA, 18 nt, Human
cugcugacuguuuucucu

SEQ ID NO: 3160939 - RNA, 21 nt, Human
cugcugacuguuuucucuuga

SEQ ID NO: 3160940 - RNA, 20 nt, Human
cugggcaccggggccucgga

SEQ ID NO: 3160941 - RNA, 12 nt, Human
cugggcagaagg

SEQ ID NO: 3160942 - RNA, 17 nt, Human
cugggcacugcucucac

SEQ ID NO: 3160943 - RNA, 19 nt, Human
cugggcacugcucucaccu

SEQ ID NO: 3160944 - RNA, 18 nt, Human
cugggcacugcucucacc

SEQ ID NO: 3160945 - RNA, 15 nt, Human
cugggcagaaggaag

SEQ ID NO: 3160946 - RNA, 16 nt, Human
cuggggaugucucuca

SEQ ID NO: 3160947 - RNA, 19 nt, Human
cuggggcagccucugggcc

SEQ ID NO: 3160948 - RNA, 14 nt, Human
cuggggcagccucu

SEQ ID NO: 3160949 - RNA, 14 nt, Human
cuggggagaaagua

SEQ ID NO: 3160950 - RNA, 23 nt, Human
cuggggagaauggggcugggccc

SEQ ID NO: 3160951 - RNA, 20 nt, Human
cugggccaggggagguuaca

SEQ ID NO: 3160952 - RNA, 14 nt, Human
cugggccagaauuu

SEQ ID NO: 3160953 - RNA, 12 nt, Human
cugggccagaau

SEQ ID NO: 3160954 - RNA, 17 nt, Human
cuggggcauccaugggg

SEQ ID NO: 3160955 - RNA, 19 nt, Human
cuggggcauccaugggguc

SEQ ID NO: 3160956 - RNA, 15 nt, Human
cuggguucacugcaa

SEQ ID NO: 3160957 - RNA, 20 nt, Human
cuggguucacugcaaccucc

SEQ ID NO: 3160958 - RNA, 18 nt, Human
cuggguucacugcaaccu

SEQ ID NO: 3160959 - RNA, 23 nt, Human
cuggccccugagaucucugcagg

SEQ ID NO: 3160960 - RNA, 22 nt, Human
cuggccccugagaucucugcag

SEQ ID NO: 3160961 - RNA, 18 nt, Human
cuggccccugagaucucu

SEQ ID NO: 3160962 - RNA, 22 nt, Human
cuggccccucagggucccuggu

SEQ ID NO: 3160963 - RNA, 11 nt, Human
cuggcccugcc

SEQ ID NO: 3160964 - RNA, 13 nt, Human
cuggcccugcccu

SEQ ID NO: 3160965 - RNA, 14 nt, Human
cuggcccugcccug

SEQ ID NO: 3160966 - RNA, 21 nt, Human
cuggcccucucugaaggaggc

SEQ ID NO: 3160967 - RNA, 23 nt, Human
cuggcccucucugaaggaggcca

SEQ ID NO: 3160968 - RNA, 22 nt, Human
cuggcccucucugaaggaggcc

SEQ ID NO: 3160969 - RNA, 15 nt, Human
cuggcccugcccugg

SEQ ID NO: 3160970 - RNA, 16 nt, Human
cuggccgggagccuga

SEQ ID NO: 3160971 - RNA, 20 nt, Human
cuggccggugugggggcccc

SEQ ID NO: 3160972 - RNA, 18 nt, Human
cugggaauaagugccagg

SEQ ID NO: 3160973 - RNA, 14 nt, Human
cugggaauguauag

SEQ ID NO: 3160974 - RNA, 23 nt, Human
cugggaauguauaguauuugaaa

SEQ ID NO: 3160975 - RNA, 21 nt, Human
cugggaauguauaguauuuga

SEQ ID NO: 3160976 - RNA, 20 nt, Human
cugggaauguauaguauuug

SEQ ID NO: 3160977 - RNA, 19 nt, Human
cugggaauguauaguauuu

SEQ ID NO: 3160978 - RNA, 13 nt, Human
cugggacugggaa

SEQ ID NO: 3160979 - RNA, 17 nt, Human
cuggcagaguugaagac

SEQ ID NO: 3160980 - RNA, 18 nt, Human
cuggcagaguugaagaca

SEQ ID NO: 3160981 - RNA, 11 nt, Human
cuggcagccca

SEQ ID NO: 3160982 - RNA, 12 nt, Human
cuggcagccccu

SEQ ID NO: 3160983 - RNA, 14 nt, Human
cuggcagaggaggg

SEQ ID NO: 3160984 - RNA, 21 nt, Human
cuggcagcaccgccucuuccc

SEQ ID NO: 3160985 - RNA, 22 nt, Human
cuggcagccgugccuucagcuc

SEQ ID NO: 3160986 - RNA, 21 nt, Human
cuggcagccgugccuucagcu

SEQ ID NO: 3160987 - RNA, 20 nt, Human
cuggcagccgugccuucagc

SEQ ID NO: 3160988 - RNA, 19 nt, Human
cuggcagccgugccuucag

SEQ ID NO: 3160989 - RNA, 16 nt, Human
cugugccuuuugccau

SEQ ID NO: 3160990 - RNA, 18 nt, Human
cugugccucugggacugg

SEQ ID NO: 3160991 - RNA, 21 nt, Human
cugugcgcauaggccugcuuu

SEQ ID NO: 3160992 - RNA, 20 nt, Human
cugugcgcauaggccugcuu

SEQ ID NO: 3160993 - RNA, 20 nt, Human
cugugccuuuuuuauaucuu

SEQ ID NO: 3160994 - RNA, 12 nt, Human
cugugcugcccu

SEQ ID NO: 3160995 - RNA, 13 nt, Human
cugugcugcccug

SEQ ID NO: 3160996 - RNA, 14 nt, Human
cugugcugcccugc

SEQ ID NO: 3160997 - RNA, 17 nt, Human
cuguuagugcacugauu

SEQ ID NO: 3160998 - RNA, 15 nt, Human
cuguguccggcccag

SEQ ID NO: 3160999 - RNA, 15 nt, Human
cugugcugcccugcc

SEQ ID NO: 3161000 - RNA, 17 nt, Human
cugugcugcccugccca

SEQ ID NO: 3161001 - RNA, 18 nt, Human
cugugcugcccugcccac

SEQ ID NO: 3161002 - RNA, 19 nt, Human
cugugcugcccugcccacc

SEQ ID NO: 3161003 - RNA, 17 nt, Human
cugugucagcauagaag

SEQ ID NO: 3161004 - RNA, 19 nt, Human
cugugucagcauagaagua

SEQ ID NO: 3161005 - RNA, 16 nt, Human
cuguguauuuucaguc

SEQ ID NO: 3161006 - RNA, 19 nt, Human
cuggucuuugagcucccac

SEQ ID NO: 3161007 - RNA, 12 nt, Human
cuggucuuugag

SEQ ID NO: 3161008 - RNA, 18 nt, Human
cuggucuuugagcuccca

SEQ ID NO: 3161009 - RNA, 13 nt, Human
cugguuuccugcc

SEQ ID NO: 3161010 - RNA, 14 nt, Human
cugguuuccugccc

SEQ ID NO: 3161011 - RNA, 15 nt, Human
cuguaacgugugcug

SEQ ID NO: 3161012 - RNA, 16 nt, Human
cuguaacgugugcugu

SEQ ID NO: 3161013 - RNA, 12 nt, Human
cuguaacugucc

SEQ ID NO: 3161014 - RNA, 17 nt, Human
cuguaacuguuacagua

SEQ ID NO: 3161015 - RNA, 18 nt, Human
cuguaacaguucuuuuug

SEQ ID NO: 3161016 - RNA, 14 nt, Human
cuguaacaguucuu

SEQ ID NO: 3161017 - RNA, 14 nt, Human
cuguagaaucaauu

SEQ ID NO: 3161018 - RNA, 16 nt, Human
cuguagaaucaauuua

SEQ ID NO: 3161019 - RNA, 14 nt, Human
cuguagacaucugu

SEQ ID NO: 3161020 - RNA, 15 nt, Human
cuguagacaucuguc

SEQ ID NO: 3161021 - RNA, 17 nt, Human
cuguagacaucuguccu

SEQ ID NO: 3161022 - RNA, 13 nt, Human
cuguagaguggga

SEQ ID NO: 3161023 - RNA, 16 nt, Human
cugucgcccagucugg

SEQ ID NO: 3161024 - RNA, 15 nt, Human
cugucgcccagucug

SEQ ID NO: 3161025 - RNA, 14 nt, Human
cuguccuguaacug

SEQ ID NO: 3161026 - RNA, 17 nt, Human
cuguccuguaacuguua

SEQ ID NO: 3161027 - RNA, 15 nt, Human
cugucaucugagaau

SEQ ID NO: 3161028 - RNA, 17 nt, Human
cugucaucugagaauga

SEQ ID NO: 3161029 - RNA, 16 nt, Human
cugucaucugagaaug

SEQ ID NO: 3161030 - RNA, 19 nt, Human
cugucaucugagaaugaac

SEQ ID NO: 3161031 - RNA, 21 nt, Human
cuguccugggagugagcuggu

SEQ ID NO: 3161032 - RNA, 22 nt, Human
cugucaguuaugacauccacaa

SEQ ID NO: 3161033 - RNA, 23 nt, Human
cugucaauuacaggaaguacugg

SEQ ID NO: 3161034 - RNA, 19 nt, Human
cugucaauuacaggaagua

SEQ ID NO: 3161035 - RNA, 20 nt, Human
cugucaauuacaggaaguac

SEQ ID NO: 3161036 - RNA, 16 nt, Human
cuguuauuuucagcau

SEQ ID NO: 3161037 - RNA, 14 nt, Human
cuguuauucuuugc

SEQ ID NO: 3161038 - RNA, 16 nt, Human
cuguuauucuuugcac

SEQ ID NO: 3161039 - RNA, 15 nt, Human
cuguuauucuuugca

SEQ ID NO: 3161040 - RNA, 18 nt, Human
cuguuuaagacacuuccg

SEQ ID NO: 3161041 - RNA, 21 nt, Human
cuguuuaaauugcucacaguu

SEQ ID NO: 3161042 - RNA, 14 nt, Human
cuguuuaaauugcu

SEQ ID NO: 3161043 - RNA, 11 nt, Human
cuguuuaaauu

SEQ ID NO: 3161044 - RNA, 21 nt, Human
cuuaaaaaugguuuaaauggu

SEQ ID NO: 3161045 - RNA, 22 nt, Human
cuguuguauaaauuuauuuacu

SEQ ID NO: 3161046 - RNA, 22 nt, Human
cuguuggcugggggccucagug

SEQ ID NO: 3161047 - RNA, 19 nt, Human
cuguuggcugggggccuca

SEQ ID NO: 3161048 - RNA, 15 nt, Human
cuguuggccagugug

SEQ ID NO: 3161049 - RNA, 14 nt, Human
cuguuggcuggggg

SEQ ID NO: 3161050 - RNA, 20 nt, Human
cuuaaaguugguauuaauaa

SEQ ID NO: 3161051 - RNA, 22 nt, Human
cuuaaaguugguauuaauaaaa

SEQ ID NO: 3161052 - RNA, 19 nt, Human
cuuaaaacaucauuccuuu

SEQ ID NO: 3161053 - RNA, 20 nt, Human
cuuaaaacaucauuccuuuu

SEQ ID NO: 3161054 - RNA, 18 nt, Human
cuuacaaaugauugcuuu

SEQ ID NO: 3161055 - RNA, 16 nt, Human
cuuacaaaugauugcu

SEQ ID NO: 3161056 - RNA, 13 nt, Human
cuuaaaacaucau

SEQ ID NO: 3161057 - RNA, 15 nt, Human
cuuaaaaauuuauua

SEQ ID NO: 3161058 - RNA, 17 nt, Human
cuuaaaacaucauuccu

SEQ ID NO: 3161059 - RNA, 18 nt, Human
cuuaaaacaucauuccuu

SEQ ID NO: 3161060 - RNA, 14 nt, Human
cuuaaaacaacacu

SEQ ID NO: 3161061 - RNA, 15 nt, Human
cuuaccagcagagca

SEQ ID NO: 3161062 - RNA, 22 nt, Human
cuuacauuagcaguuugcuuug

SEQ ID NO: 3161063 - RNA, 21 nt, Human
cuuacauuagcaguuugcuuu

SEQ ID NO: 3161064 - RNA, 22 nt, Human
cuuacaaaugauugcuuuuaaa

SEQ ID NO: 3161065 - RNA, 21 nt, Human
cuuacaaaugauugcuuuuaa

SEQ ID NO: 3161066 - RNA, 20 nt, Human
cuuacaaaugauugcuuuua

SEQ ID NO: 3161067 - RNA, 15 nt, Human
cuuaggccagcacca

SEQ ID NO: 3161068 - RNA, 23 nt, Human
cuuaggcaauggugaacugucau

SEQ ID NO: 3161069 - RNA, 11 nt, Human
cuuagggucuc

SEQ ID NO: 3161070 - RNA, 13 nt, Human
cuuagggucucag

SEQ ID NO: 3161071 - RNA, 16 nt, Human
cuuagggucucagggu

SEQ ID NO: 3161072 - RNA, 17 nt, Human
cuuagggucucagggug

SEQ ID NO: 3161073 - RNA, 14 nt, Human
cuuagcuggagaug

SEQ ID NO: 3161074 - RNA, 13 nt, Human
cuuagcugggaga

SEQ ID NO: 3161075 - RNA, 14 nt, Human
cuuagccuuucuuu

SEQ ID NO: 3161076 - RNA, 16 nt, Human
cuuaccagcagagcac

SEQ ID NO: 3161077 - RNA, 21 nt, Human
cuuagcagggaaacagcuaau

SEQ ID NO: 3161078 - RNA, 12 nt, Human
gcaccuccugcc

SEQ ID NO: 3161079 - RNA, 21 nt, Human
gcaccuccucggcuggcuguc

SEQ ID NO: 3161080 - RNA, 20 nt, Human
gcaccuccucggcuggcugu

SEQ ID NO: 3161081 - RNA, 11 nt, Human
gcaccuccucg

SEQ ID NO: 3161082 - RNA, 20 nt, Human
gcacacaccagagcccaccu

SEQ ID NO: 3161083 - RNA, 23 nt, Human
gcacacagcacgggggccaagga

SEQ ID NO: 3161084 - RNA, 11 nt, Human
gcacacagcac

SEQ ID NO: 3161085 - RNA, 20 nt, Human
gcacacaucaucuguaagcu

SEQ ID NO: 3161086 - RNA, 17 nt, Human
gcacacaucaucuguaa

SEQ ID NO: 3161087 - RNA, 16 nt, Human
gcacacaucaucugua

SEQ ID NO: 3161088 - RNA, 15 nt, Human
gcacacaucaucugu

SEQ ID NO: 3161089 - RNA, 17 nt, Human
gcaccggcuggccuggc

SEQ ID NO: 3161090 - RNA, 15 nt, Human
gcaccggcuggccug

SEQ ID NO: 3161091 - RNA, 16 nt, Human
gcaccggcuggccugg

SEQ ID NO: 3161092 - RNA, 17 nt, Human
gcaccuaccaccacgcc

SEQ ID NO: 3161093 - RNA, 22 nt, Human
gcacuauagccuaggugacaga

SEQ ID NO: 3161094 - RNA, 22 nt, Human
gcacuauaauguaagcucuacu

SEQ ID NO: 3161095 - RNA, 17 nt, Human
gcacuccagccugggug

SEQ ID NO: 3161096 - RNA, 15 nt, Human
gcacuccagccuggg

SEQ ID NO: 3161097 - RNA, 21 nt, Human
gcacucaaaucuuaagaaaua

SEQ ID NO: 3161098 - RNA, 20 nt, Human
gcacucaaaucuuaagaaau

SEQ ID NO: 3161099 - RNA, 18 nt, Human
gcacuauauacaucacgu

SEQ ID NO: 3161100 - RNA, 15 nt, Human
gcacuauugagucuu

SEQ ID NO: 3161101 - RNA, 18 nt, Human
gcacucaaaucuuaagaa

SEQ ID NO: 3161102 - RNA, 18 nt, Human
gcaaccuccgccucuugg

SEQ ID NO: 3161103 - RNA, 22 nt, Human
gcaacccuggugaccagcacca

SEQ ID NO: 3161104 - RNA, 15 nt, Human
gcaaaagaugcuucu

SEQ ID NO: 3161105 - RNA, 21 nt, Human
gcaaaaccagguuuuguuccg

SEQ ID NO: 3161106 - RNA, 19 nt, Human
gcaaaacacaaaacaaauc

SEQ ID NO: 3161107 - RNA, 18 nt, Human
gcaacccccagccugcua

SEQ ID NO: 3161108 - RNA, 14 nt, Human
gcaaccccuggacc

SEQ ID NO: 3161109 - RNA, 13 nt, Human
gcaaccccuggac

SEQ ID NO: 3161110 - RNA, 21 nt, Human
gcaaaagaguguaaaauauuu

SEQ ID NO: 3161111 - RNA, 12 nt, Human
gcaaaagagugu

SEQ ID NO: 3161112 - RNA, 21 nt, Human
gcaaccccuggaccccagccu

SEQ ID NO: 3161113 - RNA, 19 nt, Human
gcaaccccuggaccccagc

SEQ ID NO: 3161114 - RNA, 22 nt, Human
gcaaccccuggaccccagccuc

SEQ ID NO: 3161115 - RNA, 16 nt, Human
gcaaaagaugcuucuc

SEQ ID NO: 3161116 - RNA, 17 nt, Human
gcaacccccagccugcu

SEQ ID NO: 3161117 - RNA, 19 nt, Human
gcaauaaaagcccaggagc

SEQ ID NO: 3161118 - RNA, 18 nt, Human
gcaauaaaagcccaggag

SEQ ID NO: 3161119 - RNA, 17 nt, Human
gcaauaaaagcccagga

SEQ ID NO: 3161120 - RNA, 16 nt, Human
gcaauaaaagcccagg

SEQ ID NO: 3161121 - RNA, 20 nt, Human
gcaaguuuucccugaaguua

SEQ ID NO: 3161122 - RNA, 19 nt, Human
gcaaguuuucccugaaguu

SEQ ID NO: 3161123 - RNA, 23 nt, Human
gcaauaaggggagaguaacccug

SEQ ID NO: 3161124 - RNA, 22 nt, Human
gcaauaaaagcccaggagccca

SEQ ID NO: 3161125 - RNA, 19 nt, Human
gcacacaccagagcccacc

SEQ ID NO: 3161126 - RNA, 18 nt, Human
gcacacaccagagcccac

SEQ ID NO: 3161127 - RNA, 17 nt, Human
gcacacaccagagccca

SEQ ID NO: 3161128 - RNA, 16 nt, Human
gcacacaccagagccc

SEQ ID NO: 3161129 - RNA, 15 nt, Human
gcacacaccagagcc

SEQ ID NO: 3161130 - RNA, 14 nt, Human
gcacacaccagagc

SEQ ID NO: 3161131 - RNA, 12 nt, Human
gcacacaccaga

SEQ ID NO: 3161132 - RNA, 21 nt, Human
gaugaugaaaugaggucagag

SEQ ID NO: 3161133 - RNA, 20 nt, Human
gaugcuugcggcaaaaggaa

SEQ ID NO: 3161134 - RNA, 23 nt, Human
gaugcuugcggcaaaaggaaagc

SEQ ID NO: 3161135 - RNA, 18 nt, Human
gaugcuguagacaucugu

SEQ ID NO: 3161136 - RNA, 14 nt, Human
gaugauugaagaaa

SEQ ID NO: 3161137 - RNA, 15 nt, Human
gaugagcuuucuuuu

SEQ ID NO: 3161138 - RNA, 16 nt, Human
gaugagcuuucuuuuu

SEQ ID NO: 3161139 - RNA, 22 nt, Human
gaugaggaguaaaauucaguuu

SEQ ID NO: 3161140 - RNA, 13 nt, Human
gaugaggcaaccc

SEQ ID NO: 3161141 - RNA, 23 nt, Human
gauggaggaaaaccaagccgugg

SEQ ID NO: 3161142 - RNA, 13 nt, Human
gauguaaagaugu

SEQ ID NO: 3161143 - RNA, 14 nt, Human
gauguaaagauguu

SEQ ID NO: 3161144 - RNA, 19 nt, Human
gauguaauuuuguguaaga

SEQ ID NO: 3161145 - RNA, 17 nt, Human
gaugucagcaguugcug

SEQ ID NO: 3161146 - RNA, 13 nt, Human
gauguaauuuugu

SEQ ID NO: 3161147 - RNA, 12 nt, Human
gauguaaauuuu

SEQ ID NO: 3161148 - RNA, 18 nt, Human
gaugucccaacuuguaaa

SEQ ID NO: 3161149 - RNA, 14 nt, Human
gauguccuguaaac

SEQ ID NO: 3161150 - RNA, 17 nt, Human
gaugucccaacuuguaa

SEQ ID NO: 3161151 - RNA, 19 nt, Human
gaugucagcaguugcuggu

SEQ ID NO: 3161152 - RNA, 18 nt, Human
gaucuggguucacugcaa

SEQ ID NO: 3161153 - RNA, 22 nt, Human
gaugugagaaaaccccuuccca

SEQ ID NO: 3161154 - RNA, 14 nt, Human
gaugugagaaaacc

SEQ ID NO: 3161155 - RNA, 21 nt, Human
gauucuccugccucagccucc

SEQ ID NO: 3161156 - RNA, 20 nt, Human
gauucuccugccucagccuc

SEQ ID NO: 3161157 - RNA, 19 nt, Human
gauucuccugccucagccu

SEQ ID NO: 3161158 - RNA, 20 nt, Human
gauucuucugcuucagccuc

SEQ ID NO: 3161159 - RNA, 21 nt, Human
gauucuucugcuucagccucc

SEQ ID NO: 3161160 - RNA, 23 nt, Human
gauucuuauggacaaugacccag

SEQ ID NO: 3161161 - RNA, 16 nt, Human
gauucuuguuuugcuu

SEQ ID NO: 3161162 - RNA, 15 nt, Human
gauucuuguuuugcu

SEQ ID NO: 3161163 - RNA, 15 nt, Human
gauucuuuagagaag

SEQ ID NO: 3161164 - RNA, 21 nt, Human
gauucuuguuuugcuuccccu

SEQ ID NO: 3161165 - RNA, 20 nt, Human
gauucuuguuuugcuucccc

SEQ ID NO: 3161166 - RNA, 19 nt, Human
gcaaaaaaaguuguaugau

SEQ ID NO: 3161167 - RNA, 12 nt, Human
gcaaaaaaaguu

SEQ ID NO: 3161168 - RNA, 18 nt, Human
gcaaaaaaaguuguauga

SEQ ID NO: 3161169 - RNA, 17 nt, Human
gcaaaaaaaguuguaug

SEQ ID NO: 3161170 - RNA, 23 nt, Human
gauuuuuuuuuccuucagugccu

SEQ ID NO: 3161171 - RNA, 22 nt, Human
gauuuuuuuuuccuucagugcc

SEQ ID NO: 3161172 - RNA, 12 nt, Human
gauuucagaaac

SEQ ID NO: 3161173 - RNA, 17 nt, Human
gauuucacucuccuugg

SEQ ID NO: 3161174 - RNA, 18 nt, Human
gauuucacucuccuuggu

SEQ ID NO: 3161175 - RNA, 17 nt, Human
gauuucagcucacugca

SEQ ID NO: 3161176 - RNA, 20 nt, Human
gauuucagcucacugcaacc

SEQ ID NO: 3161177 - RNA, 15 nt, Human
gauuucagcucacug

SEQ ID NO: 3161178 - RNA, 13 nt, Human
gauuucacucucc

SEQ ID NO: 3161179 - RNA, 16 nt, Human
gauuucacucuccuug

SEQ ID NO: 3161180 - RNA, 19 nt, Human
gcagcugcgguccacccag

SEQ ID NO: 3161181 - RNA, 20 nt, Human
gcagcugcuuuugucuaugg

SEQ ID NO: 3161182 - RNA, 13 nt, Human
gcagcugcuuuug

SEQ ID NO: 3161183 - RNA, 23 nt, Human
gcagcugcgguccacccaggagc

SEQ ID NO: 3161184 - RNA, 22 nt, Human
gcagcugcgguccacccaggag

SEQ ID NO: 3161185 - RNA, 15 nt, Human
gcagcuuauucacaa

SEQ ID NO: 3161186 - RNA, 16 nt, Human
gcagcuugaggguugg

SEQ ID NO: 3161187 - RNA, 20 nt, Human
gcagcuguugucucuucucc

SEQ ID NO: 3161188 - RNA, 10 nt, Human
gcagcuguug

SEQ ID NO: 3161189 - RNA, 16 nt, Human
gcagcuguugucucuu

SEQ ID NO: 3161190 - RNA, 19 nt, Human
gcagcuguugucucuucuc

SEQ ID NO: 3161191 - RNA, 18 nt, Human
gcagcuguugucucuucu

SEQ ID NO: 3161192 - RNA, 22 nt, Human
gcagggaaacagcuaaugggac

SEQ ID NO: 3161193 - RNA, 13 nt, Human
gcagggaaacagc

SEQ ID NO: 3161194 - RNA, 13 nt, Human
gcaggcuggcccu

SEQ ID NO: 3161195 - RNA, 17 nt, Human
gcaggcucucaggccag

SEQ ID NO: 3161196 - RNA, 13 nt, Human
gcaggcucucagg

SEQ ID NO: 3161197 - RNA, 14 nt, Human
gcaggcucucaggc

SEQ ID NO: 3161198 - RNA, 15 nt, Human
gcaggcucucaggcc

SEQ ID NO: 3161199 - RNA, 16 nt, Human
gcaggcucucaggcca

SEQ ID NO: 3161200 - RNA, 22 nt, Human
gcaggcucgggcuccccagccc

SEQ ID NO: 3161201 - RNA, 12 nt, Human
gcaggcucucag

SEQ ID NO: 3161202 - RNA, 21 nt, Human
gcagcuugaggguugggcugg

SEQ ID NO: 3161203 - RNA, 19 nt, Human
gcagcuugaggguugggcu

SEQ ID NO: 3161204 - RNA, 16 nt, Human
gcacuuuguucuggcu

SEQ ID NO: 3161205 - RNA, 23 nt, Human
gcacuuugacagcgcacagcugc

SEQ ID NO: 3161206 - RNA, 18 nt, Human
gcacuuucuucuucccau

SEQ ID NO: 3161207 - RNA, 9 nt, Human
gcacugaag

SEQ ID NO: 3161208 - RNA, 13 nt, Human
gcacucuggcagc

SEQ ID NO: 3161209 - RNA, 14 nt, Human
gcacucuggcagca

SEQ ID NO: 3161210 - RNA, 22 nt, Human
gcaguugaaaagacuccaaaga

SEQ ID NO: 3161211 - RNA, 21 nt, Human
gcaguugagaggacacucccg

SEQ ID NO: 3161212 - RNA, 18 nt, Human
gcaguugaauuuuuauau

SEQ ID NO: 3161213 - RNA, 13 nt, Human
gcagguucaguuu

SEQ ID NO: 3161214 - RNA, 23 nt, Human
gcagguuaaauguuuuguaaacu

SEQ ID NO: 3161215 - RNA, 19 nt, Human
gcagguuaaauguuuugua

SEQ ID NO: 3161216 - RNA, 18 nt, Human
gcagguuaaauguuuugu

SEQ ID NO: 3161217 - RNA, 15 nt, Human
gcagguuaaauguuu

SEQ ID NO: 3161218 - RNA, 14 nt, Human
gcagguuaaauguu

SEQ ID NO: 3161219 - RNA, 13 nt, Human
gcagguuaaaugu

SEQ ID NO: 3161220 - RNA, 18 nt, Human
gcaggugugagggcagug

SEQ ID NO: 3161221 - RNA, 15 nt, Human
gcagggacagggccg

SEQ ID NO: 3161222 - RNA, 18 nt, Human
gcauacaaacaagcauau

SEQ ID NO: 3161223 - RNA, 12 nt, Human
gcauacaaacaa

SEQ ID NO: 3161224 - RNA, 14 nt, Human
gcaguugccaguca

SEQ ID NO: 3161225 - RNA, 23 nt, Human
gcaguugccagucaccccggcca

SEQ ID NO: 3161226 - RNA, 15 nt, Human
gcauaaaaauuagcc

SEQ ID NO: 3161227 - RNA, 14 nt, Human
gcaguugcccagcc

SEQ ID NO: 3161228 - RNA, 19 nt, Human
gcauaaagcucaaaugaaa

SEQ ID NO: 3161229 - RNA, 21 nt, Human
gcauaaagcucaaaugaaaug

SEQ ID NO: 3161230 - RNA, 15 nt, Human
gcauuucccacccug

SEQ ID NO: 3161231 - RNA, 21 nt, Human
gcauuucagaaagccuuucau

SEQ ID NO: 3161232 - RNA, 23 nt, Human
gcauuuaugguaaucauauuaga

SEQ ID NO: 3161233 - RNA, 19 nt, Human
gcauuucacuugaguggag

SEQ ID NO: 3161234 - RNA, 12 nt, Human
gcauuucagaaa

SEQ ID NO: 3161235 - RNA, 22 nt, Human
gcauuuagggaguauucuaaua

SEQ ID NO: 3161236 - RNA, 23 nt, Human
gcauuuagggaguauucuaauaa

SEQ ID NO: 3161237 - RNA, 20 nt, Human
gcauuuaugguaaucauauu

SEQ ID NO: 3161238 - RNA, 18 nt, Human
gcauuuaugguaaucaua

SEQ ID NO: 3161239 - RNA, 19 nt, Human
gcauuuagggaguauucua

SEQ ID NO: 3161240 - RNA, 21 nt, Human
gccaacagguagcauagcucu

SEQ ID NO: 3161241 - RNA, 12 nt, Human
gccaagaggcug

SEQ ID NO: 3161242 - RNA, 14 nt, Human
gccaagaggcugca

SEQ ID NO: 3161243 - RNA, 13 nt, Human
gccaagaggcugc

SEQ ID NO: 3161244 - RNA, 15 nt, Human
gccaagaauuagauu

SEQ ID NO: 3161245 - RNA, 14 nt, Human
gccaagaauucuua

SEQ ID NO: 3161246 - RNA, 18 nt, Human
gccaagaauucuuaaaua

SEQ ID NO: 3161247 - RNA, 21 nt, Human
gccaacuuuccccacguuaaa

SEQ ID NO: 3161248 - RNA, 18 nt, Human
gccaagaaguuuaaggaa

SEQ ID NO: 3161249 - RNA, 18 nt, Human
gccaacggccccagcuuc

SEQ ID NO: 3161250 - RNA, 15 nt, Human
gccaaccucgcucca

SEQ ID NO: 3161251 - RNA, 14 nt, Human
gccaaccucgcucc

SEQ ID NO: 3161252 - RNA, 23 nt, Human
gccaaccucgcuccaacuccaac

SEQ ID NO: 3161253 - RNA, 17 nt, Human
gccaacugaucuguuau

SEQ ID NO: 3161254 - RNA, 14 nt, Human
gcauggcagcccuc

SEQ ID NO: 3161255 - RNA, 13 nt, Human
gcauggccaggug

SEQ ID NO: 3161256 - RNA, 17 nt, Human
gcauggccagguggcca

SEQ ID NO: 3161257 - RNA, 14 nt, Human
gcauggccaggugg

SEQ ID NO: 3161258 - RNA, 23 nt, Human
gcauccuggcacccggccccugc

SEQ ID NO: 3161259 - RNA, 22 nt, Human
gcauccuggcacccggccccug

SEQ ID NO: 3161260 - RNA, 14 nt, Human
gcauccuggcaccc

SEQ ID NO: 3161261 - RNA, 13 nt, Human
gcaucgcaaugua

SEQ ID NO: 3161262 - RNA, 21 nt, Human
gcauccuggcacccggccccu

SEQ ID NO: 3161263 - RNA, 17 nt, Human
gcauccuggcacccggc

SEQ ID NO: 3161264 - RNA, 16 nt, Human
gcauuguaaaugugcu

SEQ ID NO: 3161265 - RNA, 16 nt, Human
gcauugggugaucauu

SEQ ID NO: 3161266 - RNA, 19 nt, Human
gcauuggggauguuuuucu

SEQ ID NO: 3161267 - RNA, 12 nt, Human
gcauuguaagcg

SEQ ID NO: 3161268 - RNA, 21 nt, Human
gcauuguaagcguauggcuuu

SEQ ID NO: 3161269 - RNA, 20 nt, Human
gcauuguaaaagcauuuugu

SEQ ID NO: 3161270 - RNA, 22 nt, Human
gcauuguaagcguauggcuuua

SEQ ID NO: 3161271 - RNA, 20 nt, Human
gcauuguauagauauaauga

SEQ ID NO: 3161272 - RNA, 21 nt, Human
gcauuguauagauauaaugaa

SEQ ID NO: 3161273 - RNA, 17 nt, Human
gcaugugaugagaggaa

SEQ ID NO: 3161274 - RNA, 16 nt, Human
gcaugucuuauuuaaa

SEQ ID NO: 3161275 - RNA, 23 nt, Human
gcaugucccuaccgagucucuuc

SEQ ID NO: 3161276 - RNA, 22 nt, Human
gcaugucccaugugagcugcug

SEQ ID NO: 3161277 - RNA, 13 nt, Human
gcaugggaaugaa

SEQ ID NO: 3161278 - RNA, 16 nt, Human
gcaugggaaugaaugu

SEQ ID NO: 3161279 - RNA, 19 nt, Human
gcaugggaaugaaugucag

SEQ ID NO: 3161280 - RNA, 14 nt, Human
gcaugggccaccac

SEQ ID NO: 3161281 - RNA, 19 nt, Human
gcaugggcaguuucaguuu

SEQ ID NO: 3161282 - RNA, 17 nt, Human
gccaagaggcugcagcc

SEQ ID NO: 3161283 - RNA, 18 nt, Human
gccaagagcccgucugcu

SEQ ID NO: 3161284 - RNA, 22 nt, Human
gccaagagguuuggcuccugcc

SEQ ID NO: 3161285 - RNA, 21 nt, Human
gccaagagguuuggcuccugc

SEQ ID NO: 3161286 - RNA, 22 nt, Human
gccaagaguggccccaccuggc

SEQ ID NO: 3161287 - RNA, 21 nt, Human
gccaagaguggccccaccugg

SEQ ID NO: 3161288 - RNA, 20 nt, Human
gccaagaguggccccaccug

SEQ ID NO: 3161289 - RNA, 18 nt, Human
gccaagaguggccccacc

SEQ ID NO: 3161290 - RNA, 14 nt, Human
gccaagaguggccc

SEQ ID NO: 3161291 - RNA, 22 nt, Human
gccaagcaccuagccucgcucu

SEQ ID NO: 3161292 - RNA, 15 nt, Human
gccaagcuuuaaauu

SEQ ID NO: 3161293 - RNA, 16 nt, Human
gccaagcuuuaaauua

SEQ ID NO: 3161294 - RNA, 17 nt, Human
gccaaggccaaaggaag

SEQ ID NO: 3161295 - RNA, 11 nt, Human
gccaaggccaa

SEQ ID NO: 3161296 - RNA, 18 nt, Human
gagcagugggccuggcca

SEQ ID NO: 3161297 - RNA, 17 nt, Human
gagcagugggccuggcc

SEQ ID NO: 3161298 - RNA, 15 nt, Human
gagcagugggccugg

SEQ ID NO: 3161299 - RNA, 20 nt, Human
gagcaucaggccaggcccuc

SEQ ID NO: 3161300 - RNA, 22 nt, Human
gagcaucaggccaggcccucug

SEQ ID NO: 3161301 - RNA, 20 nt, Human
gagcagugauauucuuuguu

SEQ ID NO: 3161302 - RNA, 22 nt, Human
gagcugugggcaaaagagugua

SEQ ID NO: 3161303 - RNA, 20 nt, Human
gagcugugcaucagcuagaa

SEQ ID NO: 3161304 - RNA, 19 nt, Human
gagcugccuguucagcucc

SEQ ID NO: 3161305 - RNA, 16 nt, Human
gagcugccuguucagc

SEQ ID NO: 3161306 - RNA, 15 nt, Human
gagcugccuguucag

SEQ ID NO: 3161307 - RNA, 13 nt, Human
gagcgacagugag

SEQ ID NO: 3161308 - RNA, 15 nt, Human
gagcgacagugagac

SEQ ID NO: 3161309 - RNA, 12 nt, Human
gagccuuccagg

SEQ ID NO: 3161310 - RNA, 13 nt, Human
gagccuuccaggg

SEQ ID NO: 3161311 - RNA, 17 nt, Human
gagcaucaggccaggcc

SEQ ID NO: 3161312 - RNA, 14 nt, Human
gagccuuaaaacau

SEQ ID NO: 3161313 - RNA, 18 nt, Human
gagguggaauuauuuuaa

SEQ ID NO: 3161314 - RNA, 14 nt, Human
gagucacuggaaca

SEQ ID NO: 3161315 - RNA, 21 nt, Human
gagucacuggaacacuaauga

SEQ ID NO: 3161316 - RNA, 17 nt, Human
gaggugggauccuccag

SEQ ID NO: 3161317 - RNA, 15 nt, Human
gaggugggauccucc

SEQ ID NO: 3161318 - RNA, 16 nt, Human
gaggugggauccucca

SEQ ID NO: 3161319 - RNA, 13 nt, Human
gaggugggauccu

SEQ ID NO: 3161320 - RNA, 18 nt, Human
gagugagacucugucuca

SEQ ID NO: 3161321 - RNA, 14 nt, Human
gagugagacucugu

SEQ ID NO: 3161322 - RNA, 19 nt, Human
gaguccaaacuggaaugag

SEQ ID NO: 3161323 - RNA, 15 nt, Human
gagucauuucugauu

SEQ ID NO: 3161324 - RNA, 14 nt, Human
gagugagacagacu

SEQ ID NO: 3161325 - RNA, 18 nt, Human
gagucagaaguuucugcc

SEQ ID NO: 3161326 - RNA, 14 nt, Human
gagucauuucugau

SEQ ID NO: 3161327 - RNA, 16 nt, Human
gaguccaaacuggaau

SEQ ID NO: 3161328 - RNA, 21 nt, Human
gagucauuuuguguugaagag

SEQ ID NO: 3161329 - RNA, 18 nt, Human
gagugcagugagccgaga

SEQ ID NO: 3161330 - RNA, 13 nt, Human
gagugcagugagc

SEQ ID NO: 3161331 - RNA, 15 nt, Human
gagugagaggggagg

SEQ ID NO: 3161332 - RNA, 18 nt, Human
gagugccaacuucuuuca

SEQ ID NO: 3161333 - RNA, 20 nt, Human
gagugagaggggaggccaag

SEQ ID NO: 3161334 - RNA, 19 nt, Human
gagugagaggggaggccaa

SEQ ID NO: 3161335 - RNA, 18 nt, Human
gagugagaggggaggcca

SEQ ID NO: 3161336 - RNA, 21 nt, Human
gaguugauagcacagacccug

SEQ ID NO: 3161337 - RNA, 19 nt, Human
gagugccgcaucucacagc

SEQ ID NO: 3161338 - RNA, 15 nt, Human
gagucagucgccuuu

SEQ ID NO: 3161339 - RNA, 19 nt, Human
gaggcugcagccaggccac

SEQ ID NO: 3161340 - RNA, 16 nt, Human
gaggcuccaggcagca

SEQ ID NO: 3161341 - RNA, 20 nt, Human
gagggccugggccuggcucc

SEQ ID NO: 3161342 - RNA, 17 nt, Human
gagggccugggccuggc

SEQ ID NO: 3161343 - RNA, 15 nt, Human
gagggccugggccug

SEQ ID NO: 3161344 - RNA, 13 nt, Human
gagggccugggcc

SEQ ID NO: 3161345 - RNA, 12 nt, Human
gagggcuccaga

SEQ ID NO: 3161346 - RNA, 13 nt, Human
gagggcuccagac

SEQ ID NO: 3161347 - RNA, 14 nt, Human
gagggcuccagaca

SEQ ID NO: 3161348 - RNA, 15 nt, Human
gagggcuccagacac

SEQ ID NO: 3161349 - RNA, 12 nt, Human
gaggggaacaga

SEQ ID NO: 3161350 - RNA, 15 nt, Human
gaggcucugcccuug

SEQ ID NO: 3161351 - RNA, 17 nt, Human
gaggcucugcccuuggu

SEQ ID NO: 3161352 - RNA, 12 nt, Human
gaggcucugccc

SEQ ID NO: 3161353 - RNA, 15 nt, Human
gaggcuccaggcagc

SEQ ID NO: 3161354 - RNA, 14 nt, Human
gaggcuccaggcag

SEQ ID NO: 3161355 - RNA, 13 nt, Human
gaggcucugcccu

SEQ ID NO: 3161356 - RNA, 14 nt, Human
gaggcucugcccuu

SEQ ID NO: 3161357 - RNA, 20 nt, Human
gaggccagagacacaagccu

SEQ ID NO: 3161358 - RNA, 19 nt, Human
gaggccagagacacaagcc

SEQ ID NO: 3161359 - RNA, 20 nt, Human
gacaggggcaggaggaaggg

SEQ ID NO: 3161360 - RNA, 21 nt, Human
gacagggguuccuucugggca

SEQ ID NO: 3161361 - RNA, 20 nt, Human
gacagggguuccuucugggc

SEQ ID NO: 3161362 - RNA, 14 nt, Human
gacagggguuccuu

SEQ ID NO: 3161363 - RNA, 17 nt, Human
gacagggggccagaaca

SEQ ID NO: 3161364 - RNA, 18 nt, Human
gacaggggcaggaggaag

SEQ ID NO: 3161365 - RNA, 20 nt, Human
gacaggggagggggcaaagg

SEQ ID NO: 3161366 - RNA, 11 nt, Human
gacagcuccuu

SEQ ID NO: 3161367 - RNA, 15 nt, Human
gacagcuccuucugu

SEQ ID NO: 3161368 - RNA, 14 nt, Human
gacagcuccuucug

SEQ ID NO: 3161369 - RNA, 13 nt, Human
gacagcuccuucu

SEQ ID NO: 3161370 - RNA, 12 nt, Human
gacagccuggca

SEQ ID NO: 3161371 - RNA, 11 nt, Human
gacagccuggc

SEQ ID NO: 3161372 - RNA, 14 nt, Human
gacagaaagcagaa

SEQ ID NO: 3161373 - RNA, 20 nt, Human
gacagaaagcagaacaguga

SEQ ID NO: 3161374 - RNA, 13 nt, Human
gacagcccuccau

SEQ ID NO: 3161375 - RNA, 22 nt, Human
gacagaaaauauguauuaacac

SEQ ID NO: 3161376 - RNA, 17 nt, Human
gacagaaaauauguauu

SEQ ID NO: 3161377 - RNA, 13 nt, Human
gacagaaaauaug

SEQ ID NO: 3161378 - RNA, 14 nt, Human
gacacuuuuucuuu

SEQ ID NO: 3161379 - RNA, 18 nt, Human
gaagcaugaacagugcac

SEQ ID NO: 3161380 - RNA, 12 nt, Human
gaagcagugccc

SEQ ID NO: 3161381 - RNA, 16 nt, Human
gaagcagugcccaggu

SEQ ID NO: 3161382 - RNA, 15 nt, Human
gaagcagugcccagg

SEQ ID NO: 3161383 - RNA, 18 nt, Human
gaagcagugcccaggugg

SEQ ID NO: 3161384 - RNA, 19 nt, Human
gacagguuugggaccccug

SEQ ID NO: 3161385 - RNA, 17 nt, Human
gacaggguuucaccaug

SEQ ID NO: 3161386 - RNA, 22 nt, Human
gacagguuugggaccccuggug

SEQ ID NO: 3161387 - RNA, 20 nt, Human
gaccaggguuggcaccuucc

SEQ ID NO: 3161388 - RNA, 22 nt, Human
gaccagggcuggggcagccucu

SEQ ID NO: 3161389 - RNA, 19 nt, Human
gaccagggcuggggcagcc

SEQ ID NO: 3161390 - RNA, 18 nt, Human
gaccagggcuggggcagc

SEQ ID NO: 3161391 - RNA, 14 nt, Human
gaccaucccugaag

SEQ ID NO: 3161392 - RNA, 15 nt, Human
gaccaucccugaagg

SEQ ID NO: 3161393 - RNA, 16 nt, Human
gacccuauugcugcuu

SEQ ID NO: 3161394 - RNA, 13 nt, Human
gacccggcugcgu

SEQ ID NO: 3161395 - RNA, 12 nt, Human
gacccggcugcg

SEQ ID NO: 3161396 - RNA, 22 nt, Human
gaccccuggcuuuucacugcug

SEQ ID NO: 3161397 - RNA, 21 nt, Human
gaccccuggcuuuucacugcu

SEQ ID NO: 3161398 - RNA, 16 nt, Human
gaccaucccugaaggc

SEQ ID NO: 3161399 - RNA, 17 nt, Human
gaccaucccugaaggcc

SEQ ID NO: 3161400 - RNA, 22 nt, Human
gaccaugcugucuggcacagcc

SEQ ID NO: 3161401 - RNA, 20 nt, Human
gaccaugcugucuggcacag

SEQ ID NO: 3161402 - RNA, 19 nt, Human
gaccaugcugucuggcaca

SEQ ID NO: 3161403 - RNA, 15 nt, Human
gaccaugcugucugg

SEQ ID NO: 3161404 - RNA, 16 nt, Human
gaccauucuccaccug

SEQ ID NO: 3161405 - RNA, 23 nt, Human
gaccaugcugucuggcacagccu

SEQ ID NO: 3161406 - RNA, 13 nt, Human
gaccccuggcuuu

SEQ ID NO: 3161407 - RNA, 15 nt, Human
gacuauggagcugag

SEQ ID NO: 3161408 - RNA, 16 nt, Human
gacuauucaaacaguc

SEQ ID NO: 3161409 - RNA, 15 nt, Human
gacuauucaaacagu

SEQ ID NO: 3161410 - RNA, 18 nt, Human
gacuaugcuuuucucaaa

SEQ ID NO: 3161411 - RNA, 18 nt, Human
gacuaggguccuggggaa

SEQ ID NO: 3161412 - RNA, 17 nt, Human
gacuauagcuguucuaa

SEQ ID NO: 3161413 - RNA, 12 nt, Human
gacuauaaaugu

SEQ ID NO: 3161414 - RNA, 20 nt, Human
gacccuccaaggccaggccu

SEQ ID NO: 3161415 - RNA, 22 nt, Human
gacccuccaaggccaggccuug

SEQ ID NO: 3161416 - RNA, 12 nt, Human
gacgcugugcug

SEQ ID NO: 3161417 - RNA, 22 nt, Human
gacgcucugcugugggcacagg

SEQ ID NO: 3161418 - RNA, 13 nt, Human
gacgcucugcugu

SEQ ID NO: 3161419 - RNA, 13 nt, Human
gacgcugugcugc

SEQ ID NO: 3161420 - RNA, 17 nt, Human
gagaagcggcuggcagc

SEQ ID NO: 3161421 - RNA, 16 nt, Human
gagaagcggcuggcag

SEQ ID NO: 3161422 - RNA, 23 nt, Human
gacugucucaagagggcacuggu

SEQ ID NO: 3161423 - RNA, 22 nt, Human
gacugucucaagagggcacugg

SEQ ID NO: 3161424 - RNA, 21 nt, Human
gacugucucaagagggcacug

SEQ ID NO: 3161425 - RNA, 14 nt, Human
gacucaaugcacug

SEQ ID NO: 3161426 - RNA, 17 nt, Human
gacucaaugcacugaca

SEQ ID NO: 3161427 - RNA, 22 nt, Human
gacuguacaaaguagaagucuu

SEQ ID NO: 3161428 - RNA, 17 nt, Human
gacuguacuccucccag

SEQ ID NO: 3161429 - RNA, 16 nt, Human
gacuguacuccuccca

SEQ ID NO: 3161430 - RNA, 22 nt, Human
gacuuuguuaguuucuccaagc

SEQ ID NO: 3161431 - RNA, 20 nt, Human
gacuuuuccaacccucauca

SEQ ID NO: 3161432 - RNA, 12 nt, Human
gacuuuguuaca

SEQ ID NO: 3161433 - RNA, 15 nt, Human
gacuuuguuacacug

SEQ ID NO: 3161434 - RNA, 21 nt, Human
gacuuuucuguccgagcuuug

SEQ ID NO: 3161435 - RNA, 22 nt, Human
gacuuuuccaauaugugauuuu

SEQ ID NO: 3161436 - RNA, 17 nt, Human
gacuuuuccaauaugug

SEQ ID NO: 3161437 - RNA, 16 nt, Human
gacuguuuucucuuga

SEQ ID NO: 3161438 - RNA, 18 nt, Human
gacuguuuucucuugaga

SEQ ID NO: 3161439 - RNA, 14 nt, Human
gacuuuggaaagac

SEQ ID NO: 3161440 - RNA, 14 nt, Human
gacuuuggaaagag

SEQ ID NO: 3161441 - RNA, 22 nt, Human
gacuuugaugucagcaguugcu

SEQ ID NO: 3161442 - RNA, 18 nt, Human
gacuuugaugucagcagu

SEQ ID NO: 3161443 - RNA, 18 nt, Human
gacuuugaaaauauauac

SEQ ID NO: 3161444 - RNA, 14 nt, Human
ggcucagagugggg

SEQ ID NO: 3161445 - RNA, 18 nt, Human
ggcucagcggggacagcu

SEQ ID NO: 3161446 - RNA, 16 nt, Human
ggcucagauuguaaua

SEQ ID NO: 3161447 - RNA, 15 nt, Human
ggcucaggcugagcu

SEQ ID NO: 3161448 - RNA, 19 nt, Human
ggcucagcggggacagcuc

SEQ ID NO: 3161449 - RNA, 19 nt, Human
ggcucagguggggucacuc

SEQ ID NO: 3161450 - RNA, 20 nt, Human
ggcucagguggggucacucu

SEQ ID NO: 3161451 - RNA, 14 nt, Human
ggcuccacuugguc

SEQ ID NO: 3161452 - RNA, 22 nt, Human
ggcuccacacacacaaaaaaag

SEQ ID NO: 3161453 - RNA, 14 nt, Human
ggcuccacacacac

SEQ ID NO: 3161454 - RNA, 23 nt, Human
ggcuccacacacacaaaaaaaga

SEQ ID NO: 3161455 - RNA, 13 nt, Human
ggcugggagagcc

SEQ ID NO: 3161456 - RNA, 14 nt, Human
ggcugggagagccu

SEQ ID NO: 3161457 - RNA, 15 nt, Human
ggcugggagagccuu

SEQ ID NO: 3161458 - RNA, 16 nt, Human
ggcugggagagccuuc

SEQ ID NO: 3161459 - RNA, 17 nt, Human
ggcugcggggcgggcac

SEQ ID NO: 3161460 - RNA, 11 nt, Human
ggcucucaggc

SEQ ID NO: 3161461 - RNA, 22 nt, Human
ggcuccuuaggguuuucucucu

SEQ ID NO: 3161462 - RNA, 12 nt, Human
ggcucuuccagg

SEQ ID NO: 3161463 - RNA, 13 nt, Human
ggcucuucuccuu

SEQ ID NO: 3161464 - RNA, 12 nt, Human
ggcucuucuccu

SEQ ID NO: 3161465 - RNA, 13 nt, Human
ggcucucaggcca

SEQ ID NO: 3161466 - RNA, 17 nt, Human
ggcucucaaugcuguuu

SEQ ID NO: 3161467 - RNA, 22 nt, Human
ggcugcggaaugaaccacaucu

SEQ ID NO: 3161468 - RNA, 16 nt, Human
ggcugccuuagaaccu

SEQ ID NO: 3161469 - RNA, 12 nt, Human
ggcugcccuggu

SEQ ID NO: 3161470 - RNA, 13 nt, Human
ggcugcccuggug

SEQ ID NO: 3161471 - RNA, 19 nt, Human
ggcugcccuggugcugcca

SEQ ID NO: 3161472 - RNA, 16 nt, Human
ggcugcccuggugcug

SEQ ID NO: 3161473 - RNA, 15 nt, Human
ggcugcccuggugcu

SEQ ID NO: 3161474 - RNA, 14 nt, Human
ggcugcccuggugc

SEQ ID NO: 3161475 - RNA, 19 nt, Human
ggcugccaaugggagcuca

SEQ ID NO: 3161476 - RNA, 20 nt, Human
ggcugccaaugggagcucau

SEQ ID NO: 3161477 - RNA, 22 nt, Human
ggcugcaugcgggcuuccuccu

SEQ ID NO: 3161478 - RNA, 15 nt, Human
ggcucuucuccuuuc

SEQ ID NO: 3161479 - RNA, 14 nt, Human
ggcucuucuccuuu

SEQ ID NO: 3161480 - RNA, 22 nt, Human
ggcugacagacagcccuccauc

SEQ ID NO: 3161481 - RNA, 16 nt, Human
ggcucuucuccuuuca

SEQ ID NO: 3161482 - RNA, 16 nt, Human
ggcugaauguauguaa

SEQ ID NO: 3161483 - RNA, 19 nt, Human
ggcugaauguauguaaaua

SEQ ID NO: 3161484 - RNA, 13 nt, Human
gggacagcuccuu

SEQ ID NO: 3161485 - RNA, 12 nt, Human
gggacagcuccu

SEQ ID NO: 3161486 - RNA, 13 nt, Human
gggacagagcaga

SEQ ID NO: 3161487 - RNA, 18 nt, Human
gggacaggggcaggagga

SEQ ID NO: 3161488 - RNA, 17 nt, Human
gggacaggggcaggagg

SEQ ID NO: 3161489 - RNA, 15 nt, Human
gggacagcuccuucu

SEQ ID NO: 3161490 - RNA, 12 nt, Human
gggacagucuca

SEQ ID NO: 3161491 - RNA, 15 nt, Human
gggacagucucacca

SEQ ID NO: 3161492 - RNA, 22 nt, Human
gggacauccugucaucugagaa

SEQ ID NO: 3161493 - RNA, 20 nt, Human
gggaacccaaguccaagcau

SEQ ID NO: 3161494 - RNA, 13 nt, Human
gggaaccugaccc

SEQ ID NO: 3161495 - RNA, 18 nt, Human
gggaagaagcucucuccu

SEQ ID NO: 3161496 - RNA, 15 nt, Human
gggaacguucucuuu

SEQ ID NO: 3161497 - RNA, 20 nt, Human
gggaacgcccacuucccugg

SEQ ID NO: 3161498 - RNA, 19 nt, Human
gggaacgcccacuucccug

SEQ ID NO: 3161499 - RNA, 16 nt, Human
gggaacgcccacuucc

SEQ ID NO: 3161500 - RNA, 12 nt, Human
gggaacgcccac

SEQ ID NO: 3161501 - RNA, 16 nt, Human
ggcuucugugcccaga

SEQ ID NO: 3161502 - RNA, 19 nt, Human
ggcuucugugcaccugggc

SEQ ID NO: 3161503 - RNA, 22 nt, Human
ggcuucugugcaccugggcucu

SEQ ID NO: 3161504 - RNA, 21 nt, Human
ggcuuccuccugguguggaag

SEQ ID NO: 3161505 - RNA, 22 nt, Human
ggcuucccgcucagcccucccu

SEQ ID NO: 3161506 - RNA, 11 nt, Human
ggcuucauaca

SEQ ID NO: 3161507 - RNA, 9 nt, Human
ggcuucaua

SEQ ID NO: 3161508 - RNA, 18 nt, Human
ggcuucauccuccucaga

SEQ ID NO: 3161509 - RNA, 12 nt, Human
ggcuucauacac

SEQ ID NO: 3161510 - RNA, 14 nt, Human
ggcuucccgcucag

SEQ ID NO: 3161511 - RNA, 22 nt, Human
ggcuucauccuccucagaucuu

SEQ ID NO: 3161512 - RNA, 16 nt, Human
ggcuuccucauaguau

SEQ ID NO: 3161513 - RNA, 21 nt, Human
ggcuucccgcucagcccuccc

SEQ ID NO: 3161514 - RNA, 19 nt, Human
ggcuucccgcucagcccuc

SEQ ID NO: 3161515 - RNA, 18 nt, Human
ggcuucccgcucagcccu

SEQ ID NO: 3161516 - RNA, 17 nt, Human
ggcuucccgcucagccc

SEQ ID NO: 3161517 - RNA, 16 nt, Human
ggcuucccgcucagcc

SEQ ID NO: 3161518 - RNA, 15 nt, Human
ggcuucccgcucagc

SEQ ID NO: 3161519 - RNA, 18 nt, Human
ggcuguaucccaugagcc

SEQ ID NO: 3161520 - RNA, 20 nt, Human
ggcuucaguggcagcugcuu

SEQ ID NO: 3161521 - RNA, 19 nt, Human
ggcuucaguggcagcugcu

SEQ ID NO: 3161522 - RNA, 17 nt, Human
ggcuucaguggcagcug

SEQ ID NO: 3161523 - RNA, 18 nt, Human
ggcuucaguggcagcugc

SEQ ID NO: 3161524 - RNA, 19 nt, Human
ggcuggguucuacccaggu

SEQ ID NO: 3161525 - RNA, 21 nt, Human
ggcuggguucuacccaggugc

SEQ ID NO: 3161526 - RNA, 19 nt, Human
ggcuggguggcaccagcag

SEQ ID NO: 3161527 - RNA, 12 nt, Human
aaaaauaaagca

SEQ ID NO: 3161528 - RNA, 11 nt, Human
aaaaauaaagc

SEQ ID NO: 3161529 - RNA, 19 nt, Human
aaaaauaacuguaauuauu

SEQ ID NO: 3161530 - RNA, 18 nt, Human
aaaaauaacuguaauuau

SEQ ID NO: 3161531 - RNA, 19 nt, Human
ggcugggggccucagugcc

SEQ ID NO: 3161532 - RNA, 17 nt, Human
ggcugggggccucagug

SEQ ID NO: 3161533 - RNA, 16 nt, Human
ggcugggggccucagu

SEQ ID NO: 3161534 - RNA, 15 nt, Human
ggcugggggccucag

SEQ ID NO: 3161535 - RNA, 18 nt, Human
aaaagccaagaggcugca

SEQ ID NO: 3161536 - RNA, 16 nt, Human
aaaagcauuuuguaau

SEQ ID NO: 3161537 - RNA, 15 nt, Human
aaaagcauuuuguaa

SEQ ID NO: 3161538 - RNA, 14 nt, Human
aaaagcauuuugua

SEQ ID NO: 3161539 - RNA, 13 nt, Human
aaaagcccaaccu

SEQ ID NO: 3161540 - RNA, 20 nt, Human
aaaagcccaaccucuuccuc

SEQ ID NO: 3161541 - RNA, 15 nt, Human
aaaagcccaaccucu

SEQ ID NO: 3161542 - RNA, 17 nt, Human
aaaagcccaggagccca

SEQ ID NO: 3161543 - RNA, 14 nt, Human
aaaagcccaggagc

SEQ ID NO: 3161544 - RNA, 22 nt, Human
aaaagccagccaagcuuuaaau

SEQ ID NO: 3161545 - RNA, 23 nt, Human
aaaagccagguuccacagaggac

SEQ ID NO: 3161546 - RNA, 11 nt, Human
aaaaggaaagc

SEQ ID NO: 3161547 - RNA, 13 nt, Human
aaaaggaaagcug

SEQ ID NO: 3161548 - RNA, 19 nt, Human
aaaagcuuuguuuguucuu

SEQ ID NO: 3161549 - RNA, 17 nt, Human
aaaagcuucccucccug

SEQ ID NO: 3161550 - RNA, 13 nt, Human
aaaagcuuuguuu

SEQ ID NO: 3161551 - RNA, 13 nt, Human
aaaagcuuucaug

SEQ ID NO: 3161552 - RNA, 23 nt, Human
gggacuuggaagcuccgcuuucu

SEQ ID NO: 3161553 - RNA, 18 nt, Human
gggacuuggaagcuccgc

SEQ ID NO: 3161554 - RNA, 17 nt, Human
gggacuuggaagcuccg

SEQ ID NO: 3161555 - RNA, 15 nt, Human
gggacuuggaagcuc

SEQ ID NO: 3161556 - RNA, 21 nt, Human
gggagaaccaaaaagaggcua

SEQ ID NO: 3161557 - RNA, 18 nt, Human
gggaggucaaggcugcag

SEQ ID NO: 3161558 - RNA, 15 nt, Human
gggagggagggcucc

SEQ ID NO: 3161559 - RNA, 16 nt, Human
gggagggagggcucca

SEQ ID NO: 3161560 - RNA, 18 nt, Human
gggagggagcugagaaga

SEQ ID NO: 3161561 - RNA, 15 nt, Human
gggagagccuuccag

SEQ ID NO: 3161562 - RNA, 19 nt, Human
gggagagccuuccaggggu

SEQ ID NO: 3161563 - RNA, 23 nt, Human
gggagcaggcucgggcuccccag

SEQ ID NO: 3161564 - RNA, 12 nt, Human
gggagagcugaa

SEQ ID NO: 3161565 - RNA, 13 nt, Human
gggagccaggagg

SEQ ID NO: 3161566 - RNA, 13 nt, Human
gggaggcugacuc

SEQ ID NO: 3161567 - RNA, 20 nt, Human
gggaggcugacuccuggucc

SEQ ID NO: 3161568 - RNA, 23 nt, Human
aaaagauguagauuuauuucauc

SEQ ID NO: 3161569 - RNA, 17 nt, Human
aaaacuucauguaauuu

SEQ ID NO: 3161570 - RNA, 15 nt, Human
aaaacuucagacaua

SEQ ID NO: 3161571 - RNA, 22 nt, Human
aaaagauguagauuuauuucau

SEQ ID NO: 3161572 - RNA, 15 nt, Human
aaaacugaugugaaa

SEQ ID NO: 3161573 - RNA, 22 nt, Human
aaaacuguacuuugauucacau

SEQ ID NO: 3161574 - RNA, 17 nt, Human
aaaacugugaccaagua

SEQ ID NO: 3161575 - RNA, 19 nt, Human
aaaacugugaccaaguaua

SEQ ID NO: 3161576 - RNA, 21 nt, Human
aaaacugugaccaaguauaaa

SEQ ID NO: 3161577 - RNA, 17 nt, Human
aaaacuuaguuugugaa

SEQ ID NO: 3161578 - RNA, 18 nt, Human
aaaacucuccucugcugc

SEQ ID NO: 3161579 - RNA, 21 nt, Human
aaaacucuuuaacuuguaaua

SEQ ID NO: 3161580 - RNA, 12 nt, Human
aaaacucuuuaa

SEQ ID NO: 3161581 - RNA, 13 nt, Human
aaaacucuuuaac

SEQ ID NO: 3161582 - RNA, 16 nt, Human
aaaaccaggcuuucua

SEQ ID NO: 3161583 - RNA, 14 nt, Human
aaaaccaggcuuuc

SEQ ID NO: 3161584 - RNA, 18 nt, Human
aaaaccugggauuauaua

SEQ ID NO: 3161585 - RNA, 17 nt, Human
aaaacgauuuaauuuau

SEQ ID NO: 3161586 - RNA, 16 nt, Human
aaaacgauuuaauuua

SEQ ID NO: 3161587 - RNA, 15 nt, Human
aaaacgauuuaauuu

SEQ ID NO: 3161588 - RNA, 17 nt, Human
aaaaaugguuuaaaugg

SEQ ID NO: 3161589 - RNA, 19 nt, Human
aaaaaugguaucaaaauua

SEQ ID NO: 3161590 - RNA, 21 nt, Human
gggaccacaggugcccgccac

SEQ ID NO: 3161591 - RNA, 12 nt, Human
gggaccagcuug

SEQ ID NO: 3161592 - RNA, 14 nt, Human
gggaccagagcugc

SEQ ID NO: 3161593 - RNA, 20 nt, Human
gggaccagagcugccaccug

SEQ ID NO: 3161594 - RNA, 18 nt, Human
gggacaugggucgcccau

SEQ ID NO: 3161595 - RNA, 22 nt, Human
gggacaugggucgcccaugaga

SEQ ID NO: 3161596 - RNA, 14 nt, Human
aaaaccacagcagu

SEQ ID NO: 3161597 - RNA, 12 nt, Human
aaaacccaagug

SEQ ID NO: 3161598 - RNA, 13 nt, Human
aaaacaucucauc

SEQ ID NO: 3161599 - RNA, 22 nt, Human
aaaacaucauuccuuuuuauuu

SEQ ID NO: 3161600 - RNA, 21 nt, Human
aaaacaucauuccuuuuuauu

SEQ ID NO: 3161601 - RNA, 23 nt, Human
ggccccugcugguucaggguugg

SEQ ID NO: 3161602 - RNA, 13 nt, Human
ggcccggcuccag

SEQ ID NO: 3161603 - RNA, 14 nt, Human
ggccccugcugguu

SEQ ID NO: 3161604 - RNA, 13 nt, Human
ggccccugcuggu

SEQ ID NO: 3161605 - RNA, 19 nt, Human
ggcccuucucuccagcccc

SEQ ID NO: 3161606 - RNA, 20 nt, Human
ggcccuucucuccagccccu

SEQ ID NO: 3161607 - RNA, 21 nt, Human
ggcccuucucuccagccccug

SEQ ID NO: 3161608 - RNA, 15 nt, Human
ggcccggcuccaggc

SEQ ID NO: 3161609 - RNA, 14 nt, Human
ggccuccauccuga

SEQ ID NO: 3161610 - RNA, 15 nt, Human
ggccuccauccugag

SEQ ID NO: 3161611 - RNA, 13 nt, Human
ggccuccauccug

SEQ ID NO: 3161612 - RNA, 22 nt, Human
ggcccuucucuccagccccugg

SEQ ID NO: 3161613 - RNA, 23 nt, Human
ggcccuucucuccagccccugga

SEQ ID NO: 3161614 - RNA, 19 nt, Human
ggccucacuaggcuucugg

SEQ ID NO: 3161615 - RNA, 23 nt, Human
ggccucaagugauucuccugccu

SEQ ID NO: 3161616 - RNA, 23 nt, Human
ggccauaagcaacaauuuucaga

SEQ ID NO: 3161617 - RNA, 13 nt, Human
ggccauaagcaac

SEQ ID NO: 3161618 - RNA, 14 nt, Human
ggccaguugguccc

SEQ ID NO: 3161619 - RNA, 17 nt, Human
ggccaguuggucccccu

SEQ ID NO: 3161620 - RNA, 23 nt, Human
ggccagucccugaggcagguccc

SEQ ID NO: 3161621 - RNA, 17 nt, Human
ggccagucccugaggca

SEQ ID NO: 3161622 - RNA, 20 nt, Human
ggccagugugacaaggauug

SEQ ID NO: 3161623 - RNA, 16 nt, Human
ggcaguugcccagccu

SEQ ID NO: 3161624 - RNA, 15 nt, Human
ggcagggcugaggcc

SEQ ID NO: 3161625 - RNA, 17 nt, Human
ggcagcccgcaucagcu

SEQ ID NO: 3161626 - RNA, 22 nt, Human
ggcagccccuguucuggcagag

SEQ ID NO: 3161627 - RNA, 19 nt, Human
ggcagccgcggugcccaac

SEQ ID NO: 3161628 - RNA, 16 nt, Human
ggagagaagagaaugc

SEQ ID NO: 3161629 - RNA, 15 nt, Human
ggagagaaauauuuu

SEQ ID NO: 3161630 - RNA, 18 nt, Human
ggagagaaauauuuuaau

SEQ ID NO: 3161631 - RNA, 21 nt, Human
ggagacugcuccugagccccc

SEQ ID NO: 3161632 - RNA, 20 nt, Human
ggagacugcuccugagcccc

SEQ ID NO: 3161633 - RNA, 19 nt, Human
ggagacugcuccugagccc

SEQ ID NO: 3161634 - RNA, 18 nt, Human
ggagacugcuccugagcc

SEQ ID NO: 3161635 - RNA, 19 nt, Human
ggagacuuugaugucagca

SEQ ID NO: 3161636 - RNA, 21 nt, Human
ggagacuuugaugucagcagu

SEQ ID NO: 3161637 - RNA, 20 nt, Human
ggcacagaaaauggaagaca

SEQ ID NO: 3161638 - RNA, 21 nt, Human
ggcacagaaaauggaagacag

SEQ ID NO: 3161639 - RNA, 19 nt, Human
ggcacagaaaauggaagac

SEQ ID NO: 3161640 - RNA, 21 nt, Human
ggcacaguuuucugagaaaga

SEQ ID NO: 3161641 - RNA, 20 nt, Human
ggcacagggccuggcccaug

SEQ ID NO: 3161642 - RNA, 20 nt, Human
ggcacucagaagacacugau

SEQ ID NO: 3161643 - RNA, 23 nt, Human
ggcacucagaagacacugauggg

SEQ ID NO: 3161644 - RNA, 19 nt, Human
ggcacugagagagcgcagc

SEQ ID NO: 3161645 - RNA, 15 nt, Human
ggcacuucugccuga

SEQ ID NO: 3161646 - RNA, 13 nt, Human
ggcacuucugccu

SEQ ID NO: 3161647 - RNA, 15 nt, Human
ggcacugguggcccg

SEQ ID NO: 3161648 - RNA, 21 nt, Human
ggcacugccgccgcuagguag

SEQ ID NO: 3161649 - RNA, 21 nt, Human
ggcagacaugguggggucucc

SEQ ID NO: 3161650 - RNA, 16 nt, Human
ggcagacauggugggg

SEQ ID NO: 3161651 - RNA, 11 nt, Human
ggcagccccug

SEQ ID NO: 3161652 - RNA, 23 nt, Human
ggcagccccauucugccugccca

SEQ ID NO: 3161653 - RNA, 12 nt, Human
ggugcaggcagg

SEQ ID NO: 3161654 - RNA, 13 nt, Human
ggugcaggcgccu

SEQ ID NO: 3161655 - RNA, 15 nt, Human
gguggaauuauuuua

SEQ ID NO: 3161656 - RNA, 13 nt, Human
gguggaugccugg

SEQ ID NO: 3161657 - RNA, 10 nt, Human
ggugcuuucc

SEQ ID NO: 3161658 - RNA, 18 nt, Human
ggugcuuuuuauaaaaag

SEQ ID NO: 3161659 - RNA, 21 nt, Human
ggugcuuuuuauaaaaagaua

SEQ ID NO: 3161660 - RNA, 13 nt, Human
ggugaacagaaca

SEQ ID NO: 3161661 - RNA, 14 nt, Human
ggucgcccaugaga

SEQ ID NO: 3161662 - RNA, 18 nt, Human
ggucgcccaugagagcgc

SEQ ID NO: 3161663 - RNA, 13 nt, Human
gguccuuuagaaa

SEQ ID NO: 3161664 - RNA, 13 nt, Human
ggucgaggcagga

SEQ ID NO: 3161665 - RNA, 13 nt, Human
ggugcaaugaccu

SEQ ID NO: 3161666 - RNA, 12 nt, Human
ggugcaaugacc

SEQ ID NO: 3161667 - RNA, 18 nt, Human
ggugcaaaguucccuacu

SEQ ID NO: 3161668 - RNA, 24 nt, Human
ggugauccacccaccucagccucc

SEQ ID NO: 3161669 - RNA, 23 nt, Human
ggugauccacccaccucagccuc

SEQ ID NO: 3161670 - RNA, 18 nt, Human
ggugauccacccaccuca

SEQ ID NO: 3161671 - RNA, 16 nt, Human
aaaggagcaagaacuu

SEQ ID NO: 3161672 - RNA, 22 nt, Human
aaagggacuuggaagcuccgcu

SEQ ID NO: 3161673 - RNA, 22 nt, Human
aaagggucuccgaaaugcuguc

SEQ ID NO: 3161674 - RNA, 15 nt, Human
aaagggaguuuaaaa

SEQ ID NO: 3161675 - RNA, 14 nt, Human
aaagggaguuuuug

SEQ ID NO: 3161676 - RNA, 15 nt, Human
aaagggaguuuuuga

SEQ ID NO: 3161677 - RNA, 21 nt, Human
aaaggagagcuagcagcaggg

SEQ ID NO: 3161678 - RNA, 17 nt, Human
aaaggagagcuagcagc

SEQ ID NO: 3161679 - RNA, 17 nt, Human
aaaggagauuggaagga

SEQ ID NO: 3161680 - RNA, 14 nt, Human
aaaggagaguacuu

SEQ ID NO: 3161681 - RNA, 23 nt, Human
aaaggaagguaguucaagaaaug

SEQ ID NO: 3161682 - RNA, 22 nt, Human
aaaggaaagagggagguaagga

SEQ ID NO: 3161683 - RNA, 15 nt, Human
aaaggaaagcugugu

SEQ ID NO: 3161684 - RNA, 18 nt, Human
aaaggaaagcuguguuua

SEQ ID NO: 3161685 - RNA, 16 nt, Human
aaaggaagacaguucu

SEQ ID NO: 3161686 - RNA, 21 nt, Human
aaagcacugacuucuaaguaa

SEQ ID NO: 3161687 - RNA, 17 nt, Human
aaagcacugacuucuaa

SEQ ID NO: 3161688 - RNA, 23 nt, Human
aaagcaccaaaauaagaaaagau

SEQ ID NO: 3161689 - RNA, 14 nt, Human
aaagcucaaaugaa

SEQ ID NO: 3161690 - RNA, 18 nt, Human
aaagcucaaaugaaaugu

SEQ ID NO: 3161691 - RNA, 19 nt, Human
aaagcucaaaugaaaugua

SEQ ID NO: 3161692 - RNA, 22 nt, Human
aaagcugccagccgagauagcc

SEQ ID NO: 3161693 - RNA, 13 nt, Human
aaagcugcugaca

SEQ ID NO: 3161694 - RNA, 14 nt, Human
aaagcugcugugau

SEQ ID NO: 3161695 - RNA, 12 nt, Human
aaagcugaaaac

SEQ ID NO: 3161696 - RNA, 15 nt, Human
aaagcuuguuaagau

SEQ ID NO: 3161697 - RNA, 23 nt, Human
aaagcuuucaugucccagaacuu

SEQ ID NO: 3161698 - RNA, 20 nt, Human
aaagcuuuguuuguucuugu

SEQ ID NO: 3161699 - RNA, 14 nt, Human
aaagcuuuguuugu

SEQ ID NO: 3161700 - RNA, 19 nt, Human
aaacuuguaaauaaaggaa

SEQ ID NO: 3161701 - RNA, 20 nt, Human
aaacuuggugcuuauugaua

SEQ ID NO: 3161702 - RNA, 12 nt, Human
aaacuuugaaau

SEQ ID NO: 3161703 - RNA, 15 nt, Human
aaacuuucuuaauau

SEQ ID NO: 3161704 - RNA, 21 nt, Human
aaacuuucuacucauuuuaau

SEQ ID NO: 3161705 - RNA, 12 nt, Human
aaacuuuguagu

SEQ ID NO: 3161706 - RNA, 22 nt, Human
aaacuuugagaucuaaaaauaa

SEQ ID NO: 3161707 - RNA, 21 nt, Human
aaacuuugagaucuaaaaaua

SEQ ID NO: 3161708 - RNA, 15 nt, Human
aaacuuugaaauaua

SEQ ID NO: 3161709 - RNA, 13 nt, Human
aaacuuugaaaua

SEQ ID NO: 3161710 - RNA, 20 nt, Human
aaacuuugagaucuaaaaau

SEQ ID NO: 3161711 - RNA, 17 nt, Human
ggguggggggcuucaua

SEQ ID NO: 3161712 - RNA, 19 nt, Human
ggguggggggcuucauaca

SEQ ID NO: 3161713 - RNA, 19 nt, Human
aaacuucagacauagaauu

SEQ ID NO: 3161714 - RNA, 16 nt, Human
aaacuucauguaauuu

SEQ ID NO: 3161715 - RNA, 20 nt, Human
aaacuucauguaauuuuauu

SEQ ID NO: 3161716 - RNA, 21 nt, Human
aaacuucauguaauuuuauuu

SEQ ID NO: 3161717 - RNA, 17 nt, Human
aaacuuccaaagaaagu

SEQ ID NO: 3161718 - RNA, 18 nt, Human
aaacuuccaaagaaaguu

SEQ ID NO: 3161719 - RNA, 14 nt, Human
aaagacaugaaauu

SEQ ID NO: 3161720 - RNA, 14 nt, Human
aaagaccagaaauu

SEQ ID NO: 3161721 - RNA, 22 nt, Human
aaagaccuggggcugcugugaa

SEQ ID NO: 3161722 - RNA, 17 nt, Human
aaagacuauucaaacag

SEQ ID NO: 3161723 - RNA, 19 nt, Human
aaagacuauucaaacaguc

SEQ ID NO: 3161724 - RNA, 18 nt, Human
aaagacuauucaaacagu

SEQ ID NO: 3161725 - RNA, 14 nt, Human
aaagacuccaaaga

SEQ ID NO: 3161726 - RNA, 21 nt, Human
aaagacuccaaagaaauguaa

SEQ ID NO: 3161727 - RNA, 15 nt, Human
aaagacuccaaagaa

SEQ ID NO: 3161728 - RNA, 21 nt, Human
aaagacuauucaaacagucuc

SEQ ID NO: 3161729 - RNA, 22 nt, Human
aaagagaugaugaaaauauuua

SEQ ID NO: 3161730 - RNA, 15 nt, Human
aaagagauuuaaacu

SEQ ID NO: 3161731 - RNA, 20 nt, Human
aaagagaugaugaaaauauu

SEQ ID NO: 3161732 - RNA, 19 nt, Human
aaagagaugaugaaaauau

SEQ ID NO: 3161733 - RNA, 13 nt, Human
aaagacuguacaa

SEQ ID NO: 3161734 - RNA, 11 nt, Human
aaagacuggca

SEQ ID NO: 3161735 - RNA, 14 nt, Human
aaagacugaucuca

SEQ ID NO: 3161736 - RNA, 15 nt, Human
aaagaggaaugaagu

SEQ ID NO: 3161737 - RNA, 21 nt, Human
aaagagauuuaaacucugaau

SEQ ID NO: 3161738 - RNA, 17 nt, Human
aaagaugcuucucacug

SEQ ID NO: 3161739 - RNA, 14 nt, Human
aaagaugcuucuca

SEQ ID NO: 3161740 - RNA, 19 nt, Human
aaagaugcuucucacugcc

SEQ ID NO: 3161741 - RNA, 15 nt, Human
aaagaggcacagagc

SEQ ID NO: 3161742 - RNA, 13 nt, Human
gguccugcucagc

SEQ ID NO: 3161743 - RNA, 12 nt, Human
gguccugcugca

SEQ ID NO: 3161744 - RNA, 11 nt, Human
gguccugcugc

SEQ ID NO: 3161745 - RNA, 22 nt, Human
aaagauggcugugccucugccu

SEQ ID NO: 3161746 - RNA, 21 nt, Human
aaagauggcugugccucugcc

SEQ ID NO: 3161747 - RNA, 23 nt, Human
aaagauggcugugccucugccug

SEQ ID NO: 3161748 - RNA, 12 nt, Human
aaagcaauauug

SEQ ID NO: 3161749 - RNA, 14 nt, Human
aaagcaauauugua

SEQ ID NO: 3161750 - RNA, 20 nt, Human
ggguccaggccuacuccugu

SEQ ID NO: 3161751 - RNA, 22 nt, Human
gggggcuucauacacaugagau

SEQ ID NO: 3161752 - RNA, 11 nt, Human
ggggggcagag

SEQ ID NO: 3161753 - RNA, 10 nt, Human
ggggggaggc

SEQ ID NO: 3161754 - RNA, 13 nt, Human
ggggggcagagcc

SEQ ID NO: 3161755 - RNA, 13 nt, Human
gggucgcccauga

SEQ ID NO: 3161756 - RNA, 14 nt, Human
gggucgccuguccu

SEQ ID NO: 3161757 - RNA, 17 nt, Human
ggguccccuccaggagu

SEQ ID NO: 3161758 - RNA, 16 nt, Human
ggguccccuccaggag

SEQ ID NO: 3161759 - RNA, 16 nt, Human
ggguccccagcccuuc

SEQ ID NO: 3161760 - RNA, 15 nt, Human
aaacgggcucagcaa

SEQ ID NO: 3161761 - RNA, 19 nt, Human
aaaccuuuggcuacacaau

SEQ ID NO: 3161762 - RNA, 21 nt, Human
aaaccuuucuauaauuuuaca

SEQ ID NO: 3161763 - RNA, 18 nt, Human
aaaccuuucuauaauuuu

SEQ ID NO: 3161764 - RNA, 12 nt, Human
aaaccuuucccc

SEQ ID NO: 3161765 - RNA, 12 nt, Human
aaaccacagcag

SEQ ID NO: 3161766 - RNA, 23 nt, Human
aaaccaagucaagugaaaaagga

SEQ ID NO: 3161767 - RNA, 24 nt, Human
aaacauuaguacuuuauagaagaa

SEQ ID NO: 3161768 - RNA, 21 nt, Human
aaacauuaguacuuuauagaa

SEQ ID NO: 3161769 - RNA, 17 nt, Human
aaacauuaguacuuuau

SEQ ID NO: 3161770 - RNA, 15 nt, Human
aaacauuaugaugug

SEQ ID NO: 3161771 - RNA, 19 nt, Human
aaacauucuaucuacugau

SEQ ID NO: 3161772 - RNA, 21 nt, Human
aaacauucuaucuacugauuu

SEQ ID NO: 3161773 - RNA, 16 nt, Human
aaaccaagccguggcu

SEQ ID NO: 3161774 - RNA, 14 nt, Human
aaacauuaauguug

SEQ ID NO: 3161775 - RNA, 14 nt, Human
aaacauuaguacuu

SEQ ID NO: 3161776 - RNA, 24 nt, Human
aaacauuaauguugauuucuaguu

SEQ ID NO: 3161777 - RNA, 22 nt, Human
aaacauuaauguugauuucuag

SEQ ID NO: 3161778 - RNA, 20 nt, Human
aaacauuaauguugauuucu

SEQ ID NO: 3161779 - RNA, 19 nt, Human
aaacauuaauguugauuuc

SEQ ID NO: 3161780 - RNA, 16 nt, Human
aaacauuaauguugau

SEQ ID NO: 3161781 - RNA, 15 nt, Human
aaacauuaauguuga

SEQ ID NO: 3161782 - RNA, 14 nt, Human
aaacuaguuuuucc

SEQ ID NO: 3161783 - RNA, 15 nt, Human
aaacuaguuuuuccu

SEQ ID NO: 3161784 - RNA, 16 nt, Human
aaacuaguuuuuccua

SEQ ID NO: 3161785 - RNA, 15 nt, Human
aaacuaggcuccuuc

SEQ ID NO: 3161786 - RNA, 13 nt, Human
aaacuauguguuu

SEQ ID NO: 3161787 - RNA, 16 nt, Human
aaacuauguguuuuuc

SEQ ID NO: 3161788 - RNA, 17 nt, Human
aaacuauguguuuuucu

SEQ ID NO: 3161789 - RNA, 19 nt, Human
aaacuauguguuuuucuca

SEQ ID NO: 3161790 - RNA, 20 nt, Human
aaacuauguguuuuucucau

SEQ ID NO: 3161791 - RNA, 21 nt, Human
aaacuauguguuuuucucaua

SEQ ID NO: 3161792 - RNA, 17 nt, Human
aaacuaggcauuuguaa

SEQ ID NO: 3161793 - RNA, 19 nt, Human
aaacuaggcauuuguaaau

SEQ ID NO: 3161794 - RNA, 20 nt, Human
aaacuaggcauuuguaaaua

SEQ ID NO: 3161795 - RNA, 18 nt, Human
aaacguauaauauguaca

SEQ ID NO: 3161796 - RNA, 23 nt, Human
aaacggccucacuaggcuucugg

SEQ ID NO: 3161797 - RNA, 12 nt, Human
aaaccuuuuauu

SEQ ID NO: 3161798 - RNA, 15 nt, Human
aaaccuuuuauuaua

SEQ ID NO: 3161799 - RNA, 16 nt, Human
aaaccuuuucuuguau

SEQ ID NO: 3161800 - RNA, 13 nt, Human
aaacucaucugga

SEQ ID NO: 3161801 - RNA, 18 nt, Human
aaacuauuuaaagaaaua

SEQ ID NO: 3161802 - RNA, 22 nt, Human
aaacucaaccaaaugguacaaa

SEQ ID NO: 3161803 - RNA, 17 nt, Human
aaacucaaccaaauggu

SEQ ID NO: 3161804 - RNA, 20 nt, Human
aaacucaaccaaaugguaca

SEQ ID NO: 3161805 - RNA, 18 nt, Human
aaacucaaccaaauggua

SEQ ID NO: 3161806 - RNA, 19 nt, Human
ggguggcaccagcagccug

SEQ ID NO: 3161807 - RNA, 22 nt, Human
aaacuguuaacuuauucaaaga

SEQ ID NO: 3161808 - RNA, 20 nt, Human
ggguggcaucauuccaggcc

SEQ ID NO: 3161809 - RNA, 13 nt, Human
aaacuggaaugag

SEQ ID NO: 3161810 - RNA, 21 nt, Human
aaacugucgugucauacucga

SEQ ID NO: 3161811 - RNA, 14 nt, Human
aaacuggaaugagc

SEQ ID NO: 3161812 - RNA, 21 nt, Human
aaacuggaaauacuagauuug

SEQ ID NO: 3161813 - RNA, 14 nt, Human
aaacuggaaauacu

SEQ ID NO: 3161814 - RNA, 22 nt, Human
aaacugcccccucugcccugcg

SEQ ID NO: 3161815 - RNA, 17 nt, Human
aaacucuauggucuuau

SEQ ID NO: 3161816 - RNA, 13 nt, Human
aaacucuaugguc

SEQ ID NO: 3161817 - RNA, 21 nt, Human
aaacugcccccucugcccugc

SEQ ID NO: 3161818 - RNA, 18 nt, Human
aaacucuauuuagaugca

SEQ ID NO: 3161819 - RNA, 20 nt, Human
aaacugcuuccuuucuugau

SEQ ID NO: 3161820 - RNA, 19 nt, Human
aaacugcuuccuuucuuga

SEQ ID NO: 3161821 - RNA, 20 nt, Human
ggggccuaauaaaacugaug

SEQ ID NO: 3161822 - RNA, 23 nt, Human
ggggccuaauaaaacugauguga

SEQ ID NO: 3161823 - RNA, 18 nt, Human
gggggccucagugccacu

SEQ ID NO: 3161824 - RNA, 17 nt, Human
gggggccucagugccac

SEQ ID NO: 3161825 - RNA, 15 nt, Human
gggggccucagugcc

SEQ ID NO: 3161826 - RNA, 12 nt, Human
gggggccucagu

SEQ ID NO: 3161827 - RNA, 14 nt, Human
ggggacugccaccu

SEQ ID NO: 3161828 - RNA, 17 nt, Human
ggggacugccaccuccc

SEQ ID NO: 3161829 - RNA, 15 nt, Human
ggggacugccaccuc

SEQ ID NO: 3161830 - RNA, 20 nt, Human
ggggacaaccuuggcuuggc

SEQ ID NO: 3161831 - RNA, 12 nt, Human
ggggaaugaggg

SEQ ID NO: 3161832 - RNA, 14 nt, Human
ggggaaugaggggg

SEQ ID NO: 3161833 - RNA, 20 nt, Human
ggggaaugagggggcucagu

SEQ ID NO: 3161834 - RNA, 16 nt, Human
ggggaccagagcugcc

SEQ ID NO: 3161835 - RNA, 15 nt, Human
ggggaccagagcugc

SEQ ID NO: 3161836 - RNA, 15 nt, Human
ggggaccagcuuggc

SEQ ID NO: 3161837 - RNA, 22 nt, Human
ggggaauguuugccucugccuc

SEQ ID NO: 3161838 - RNA, 18 nt, Human
ggggaauguuugccucug

SEQ ID NO: 3161839 - RNA, 13 nt, Human
ggggaaggcaggg

SEQ ID NO: 3161840 - RNA, 14 nt, Human
aaacaguagugaua

SEQ ID NO: 3161841 - RNA, 15 nt, Human
aaacagucucaggaa

SEQ ID NO: 3161842 - RNA, 17 nt, Human
aaacaugguuugacucu

SEQ ID NO: 3161843 - RNA, 11 nt, Human
aaacacagcaa

SEQ ID NO: 3161844 - RNA, 13 nt, Human
aaacaauucaaag

SEQ ID NO: 3161845 - RNA, 18 nt, Human
aaacacaaaacaaauccu

SEQ ID NO: 3161846 - RNA, 15 nt, Human
aaacaaaguuucaga

SEQ ID NO: 3161847 - RNA, 19 nt, Human
aaacaaaguuucagaguau

SEQ ID NO: 3161848 - RNA, 23 nt, Human
aaacaaaguuucagaguauauug

SEQ ID NO: 3161849 - RNA, 17 nt, Human
aaacaaaucuuuccaua

SEQ ID NO: 3161850 - RNA, 14 nt, Human
aaacacagcaaggg

SEQ ID NO: 3161851 - RNA, 12 nt, Human
aaacacagcaag

SEQ ID NO: 3161852 - RNA, 19 nt, Human
aaacacauaauuaacacuu

SEQ ID NO: 3161853 - RNA, 18 nt, Human
aaacacauaauuaacacu

SEQ ID NO: 3161854 - RNA, 14 nt, Human
aaacacauaauuaa

SEQ ID NO: 3161855 - RNA, 13 nt, Human
gggaugagaaagg

SEQ ID NO: 3161856 - RNA, 17 nt, Human
gggaugauugaagaaac

SEQ ID NO: 3161857 - RNA, 16 nt, Human
gggaugauugaagaaa

SEQ ID NO: 3161858 - RNA, 15 nt, Human
gggaugauugaagaa

SEQ ID NO: 3161859 - RNA, 14 nt, Human
aaaauguuuucagc

SEQ ID NO: 3161860 - RNA, 12 nt, Human
aaaauguuuuca

SEQ ID NO: 3161861 - RNA, 19 nt, Human
aaaauuuagaaauauaauu

SEQ ID NO: 3161862 - RNA, 21 nt, Human
aaaauuuacuacaauauguac

SEQ ID NO: 3161863 - RNA, 19 nt, Human
aaaauuuacuacaauaugu

SEQ ID NO: 3161864 - RNA, 13 nt, Human
aaaauuuuaagcu

SEQ ID NO: 3161865 - RNA, 12 nt, Human
aaaauuuuaagc

SEQ ID NO: 3161866 - RNA, 19 nt, Human
aaaauuuuaggcaaguuuu

SEQ ID NO: 3161867 - RNA, 20 nt, Human
aaacaaaggccuaauucuau

SEQ ID NO: 3161868 - RNA, 15 nt, Human
guagagccagagguc

SEQ ID NO: 3161869 - RNA, 23 nt, Human
guagagacaggguuucaccaugu

SEQ ID NO: 3161870 - RNA, 11 nt, Human
guagagccagg

SEQ ID NO: 3161871 - RNA, 10 nt, Human
guagagccag

SEQ ID NO: 3161872 - RNA, 13 nt, Human
guagagacagggu

SEQ ID NO: 3161873 - RNA, 15 nt, Human
guagagccagggucu

SEQ ID NO: 3161874 - RNA, 20 nt, Human
guagccuauuuuuuuagauu

SEQ ID NO: 3161875 - RNA, 21 nt, Human
guagccucaaucgagugagac

SEQ ID NO: 3161876 - RNA, 18 nt, Human
guagacuggccugaacca

SEQ ID NO: 3161877 - RNA, 12 nt, Human
guagacuuuuau

SEQ ID NO: 3161878 - RNA, 14 nt, Human
guagacuacuguuc

SEQ ID NO: 3161879 - RNA, 12 nt, Human
guagagacaggg

SEQ ID NO: 3161880 - RNA, 11 nt, Human
guagagacagg

SEQ ID NO: 3161881 - RNA, 15 nt, Human
guagacaucuguccu

SEQ ID NO: 3161882 - RNA, 15 nt, Human
guagacauuuauaac

SEQ ID NO: 3161883 - RNA, 23 nt, Human
guagaaauaucugaaaauguaug

SEQ ID NO: 3161884 - RNA, 21 nt, Human
guagaaauaucugaaaaugua

SEQ ID NO: 3161885 - RNA, 20 nt, Human
guagaaauaucugaaaaugu

SEQ ID NO: 3161886 - RNA, 16 nt, Human
guagaacgccagggac

SEQ ID NO: 3161887 - RNA, 13 nt, Human
guagaacuuugua

SEQ ID NO: 3161888 - RNA, 22 nt, Human
guagaacgccagggaccccaga

SEQ ID NO: 3161889 - RNA, 14 nt, Human
guagaacuuuguau

SEQ ID NO: 3161890 - RNA, 15 nt, Human
guagaacuuuguaua

SEQ ID NO: 3161891 - RNA, 21 nt, Human
guagaagucuuagauguauau

SEQ ID NO: 3161892 - RNA, 18 nt, Human
guagaagcccuucuaccu

SEQ ID NO: 3161893 - RNA, 21 nt, Human
guagaacuuuguauaguuaug

SEQ ID NO: 3161894 - RNA, 23 nt, Human
guagaaugaccuuguaauguaac

SEQ ID NO: 3161895 - RNA, 18 nt, Human
guagaaugaccuuguaau

SEQ ID NO: 3161896 - RNA, 22 nt, Human
guagaaugaccuuguaauguaa

SEQ ID NO: 3161897 - RNA, 20 nt, Human
guagaaugaccuuguaaugu

SEQ ID NO: 3161898 - RNA, 11 nt, Human
guacugugaau

SEQ ID NO: 3161899 - RNA, 16 nt, Human
guacuggagaaaaugg

SEQ ID NO: 3161900 - RNA, 14 nt, Human
guacuggauuuaac

SEQ ID NO: 3161901 - RNA, 15 nt, Human
guacugguaagauug

SEQ ID NO: 3161902 - RNA, 19 nt, Human
guacugguaagauuguuau

SEQ ID NO: 3161903 - RNA, 14 nt, Human
guacugauuucagu

SEQ ID NO: 3161904 - RNA, 15 nt, Human
guacugauuucagua

SEQ ID NO: 3161905 - RNA, 20 nt, Human
guacugauuucaguaagucu

SEQ ID NO: 3161906 - RNA, 17 nt, Human
guacugagcagugauau

SEQ ID NO: 3161907 - RNA, 18 nt, Human
guacuacaguccucccau

SEQ ID NO: 3161908 - RNA, 19 nt, Human
guacuacaguccucccauc

SEQ ID NO: 3161909 - RNA, 14 nt, Human
guacccacugcucu

SEQ ID NO: 3161910 - RNA, 13 nt, Human
guacccacugcuc

SEQ ID NO: 3161911 - RNA, 13 nt, Human
guacuauguauca

SEQ ID NO: 3161912 - RNA, 19 nt, Human
guacuaucuuaucucagau

SEQ ID NO: 3161913 - RNA, 20 nt, Human
guacuaguggcauggagaau

SEQ ID NO: 3161914 - RNA, 17 nt, Human
guacuacaguccuccca

SEQ ID NO: 3161915 - RNA, 19 nt, Human
guacuaguggcauggagaa

SEQ ID NO: 3161916 - RNA, 14 nt, Human
guacuagagauauu

SEQ ID NO: 3161917 - RNA, 21 nt, Human
guacuagagauauuuuguaaa

SEQ ID NO: 3161918 - RNA, 17 nt, Human
guacuauguaucaauga

SEQ ID NO: 3161919 - RNA, 15 nt, Human
guacuauguaucaau

SEQ ID NO: 3161920 - RNA, 14 nt, Human
guacuccucccagg

SEQ ID NO: 3161921 - RNA, 19 nt, Human
guacuccacauauuucagu

SEQ ID NO: 3161922 - RNA, 13 nt, Human
aaauauuauuugu

SEQ ID NO: 3161923 - RNA, 16 nt, Human
aaauauuauuuguguu

SEQ ID NO: 3161924 - RNA, 21 nt, Human
aaauauuauuuguguuuccua

SEQ ID NO: 3161925 - RNA, 16 nt, Human
aaauauucacaucuuc

SEQ ID NO: 3161926 - RNA, 14 nt, Human
aaaucacuuucaua

SEQ ID NO: 3161927 - RNA, 14 nt, Human
aaauauuagcaaag

SEQ ID NO: 3161928 - RNA, 19 nt, Human
aaauauuaagaaagacuau

SEQ ID NO: 3161929 - RNA, 12 nt, Human
aaauauuaagac

SEQ ID NO: 3161930 - RNA, 21 nt, Human
aaauauacauguuuauguaaa

SEQ ID NO: 3161931 - RNA, 23 nt, Human
aaauauacauguuuauguaaaca

SEQ ID NO: 3161932 - RNA, 16 nt, Human
aaauauaccacucuuu

SEQ ID NO: 3161933 - RNA, 20 nt, Human
aaauauaccacucuuuaccu

SEQ ID NO: 3161934 - RNA, 20 nt, Human
aaauauacauguuuauguaa

SEQ ID NO: 3161935 - RNA, 19 nt, Human
aaauauacauguuuaugua

SEQ ID NO: 3161936 - RNA, 18 nt, Human
aaauauacauguuuaugu

SEQ ID NO: 3161937 - RNA, 17 nt, Human
aaauauacauguuuaug

SEQ ID NO: 3161938 - RNA, 18 nt, Human
aaauccaaauauuguuaa

SEQ ID NO: 3161939 - RNA, 17 nt, Human
aaauccaaauauuguua

SEQ ID NO: 3161940 - RNA, 16 nt, Human
aaauccaaauauuguu

SEQ ID NO: 3161941 - RNA, 14 nt, Human
aaauccaaauauug

SEQ ID NO: 3161942 - RNA, 15 nt, Human
aaauccaaauauugu

SEQ ID NO: 3161943 - RNA, 11 nt, Human
aaaucauuucu

SEQ ID NO: 3161944 - RNA, 22 nt, Human
aaaucauacuccuaugcuuuag

SEQ ID NO: 3161945 - RNA, 23 nt, Human
aaaucauuucugcaucagcugcu

SEQ ID NO: 3161946 - RNA, 22 nt, Human
aaaucauuucugcaucagcugc

SEQ ID NO: 3161947 - RNA, 21 nt, Human
aaaucauuucugcaucagcug

SEQ ID NO: 3161948 - RNA, 19 nt, Human
aaaucauuucugcaucagc

SEQ ID NO: 3161949 - RNA, 12 nt, Human
aaaucauuucug

SEQ ID NO: 3161950 - RNA, 13 nt, Human
aaaucauaaaguc

SEQ ID NO: 3161951 - RNA, 14 nt, Human
aaaucauaaaguca

SEQ ID NO: 3161952 - RNA, 16 nt, Human
aaaucauaaagucagu

SEQ ID NO: 3161953 - RNA, 15 nt, Human
aaaucaguaaacacu

SEQ ID NO: 3161954 - RNA, 19 nt, Human
aaaucagccguguaaccau

SEQ ID NO: 3161955 - RNA, 12 nt, Human
aaaucagccugc

SEQ ID NO: 3161956 - RNA, 18 nt, Human
aaaucagccugcuccagc

SEQ ID NO: 3161957 - RNA, 16 nt, Human
aaaucagcugcuacua

SEQ ID NO: 3161958 - RNA, 17 nt, Human
guaccacugaaucugua

SEQ ID NO: 3161959 - RNA, 22 nt, Human
guaccaaugcagaacucccaag

SEQ ID NO: 3161960 - RNA, 18 nt, Human
guacauuucuaagucaaa

SEQ ID NO: 3161961 - RNA, 15 nt, Human
guacauucucaguuu

SEQ ID NO: 3161962 - RNA, 19 nt, Human
guacauuuuuugaaaugcu

SEQ ID NO: 3161963 - RNA, 20 nt, Human
guacauuuuuugaaaugcug

SEQ ID NO: 3161964 - RNA, 16 nt, Human
guaccaaaauuuuaaa

SEQ ID NO: 3161965 - RNA, 19 nt, Human
guaccaaaauuuuaaaaaa

SEQ ID NO: 3161966 - RNA, 20 nt, Human
guaccaaaauuuuaaaaaag

SEQ ID NO: 3161967 - RNA, 14 nt, Human
guacauuuuuugaa

SEQ ID NO: 3161968 - RNA, 19 nt, Human
guaccacugaaucuguaca

SEQ ID NO: 3161969 - RNA, 18 nt, Human
guaccacugaaucuguac

SEQ ID NO: 3161970 - RNA, 16 nt, Human
guaccagccccacccu

SEQ ID NO: 3161971 - RNA, 13 nt, Human
guaccagccccac

SEQ ID NO: 3161972 - RNA, 21 nt, Human
guaccaguucuuuaagaagau

SEQ ID NO: 3161973 - RNA, 15 nt, Human
guaccauuaaaauau

SEQ ID NO: 3161974 - RNA, 14 nt, Human
guaccauuaaaaua

SEQ ID NO: 3161975 - RNA, 17 nt, Human
guaccauuaaaauaugc

SEQ ID NO: 3161976 - RNA, 16 nt, Human
guaccauuaaaauaug

SEQ ID NO: 3161977 - RNA, 22 nt, Human
guaccauuuaauggggaggaca

SEQ ID NO: 3161978 - RNA, 12 nt, Human
guacccacugcu

SEQ ID NO: 3161979 - RNA, 18 nt, Human
guaccauuaaaauaugca

SEQ ID NO: 3161980 - RNA, 23 nt, Human
guaccauuuaauggggaggacaa

SEQ ID NO: 3161981 - RNA, 23 nt, Human
aaauccagaaacuuguucuucca

SEQ ID NO: 3161982 - RNA, 22 nt, Human
aaauccagaaacuuguucuucc

SEQ ID NO: 3161983 - RNA, 11 nt, Human
aaauccagaaa

SEQ ID NO: 3161984 - RNA, 11 nt, Human
aaauccaggac

SEQ ID NO: 3161985 - RNA, 13 nt, Human
aaauccaggaccc

SEQ ID NO: 3161986 - RNA, 12 nt, Human
aaauccaggacc

SEQ ID NO: 3161987 - RNA, 21 nt, Human
aaauccaggacccugccaggc

SEQ ID NO: 3161988 - RNA, 19 nt, Human
aaauccaggacccugccag

SEQ ID NO: 3161989 - RNA, 19 nt, Human
guacauggaauaacaugua

SEQ ID NO: 3161990 - RNA, 12 nt, Human
guacaugggacu

SEQ ID NO: 3161991 - RNA, 16 nt, Human
guacauguauuaaauu

SEQ ID NO: 3161992 - RNA, 13 nt, Human
guacauguauuaa

SEQ ID NO: 3161993 - RNA, 22 nt, Human
guacaugggacuaugcuuuucu

SEQ ID NO: 3161994 - RNA, 13 nt, Human
guacauuuaaauu

SEQ ID NO: 3161995 - RNA, 14 nt, Human
guacauuuaaauuu

SEQ ID NO: 3161996 - RNA, 12 nt, Human
guaauauauuua

SEQ ID NO: 3161997 - RNA, 23 nt, Human
guaauuuaaaauugugauguguc

SEQ ID NO: 3161998 - RNA, 19 nt, Human
guaauuuaaaauugugaug

SEQ ID NO: 3161999 - RNA, 20 nt, Human
guaauuuaaaauugugaugu

SEQ ID NO: 3162000 - RNA, 23 nt, Human
guaauuguuguuuguauguauaa

SEQ ID NO: 3162001 - RNA, 21 nt, Human
guaauuguuguuuguauguau

SEQ ID NO: 3162002 - RNA, 19 nt, Human
guaauuguuguuuguaugu

SEQ ID NO: 3162003 - RNA, 17 nt, Human
guaauuguuguuuguau

SEQ ID NO: 3162004 - RNA, 21 nt, Human
guaauuguuccagagacaaau

SEQ ID NO: 3162005 - RNA, 12 nt, Human
guaauuguucca

SEQ ID NO: 3162006 - RNA, 20 nt, Human
guaacuguccguaguaucag

SEQ ID NO: 3162007 - RNA, 15 nt, Human
guaauaaagacucua

SEQ ID NO: 3162008 - RNA, 14 nt, Human
guaauauaauacac

SEQ ID NO: 3162009 - RNA, 22 nt, Human
guaauauaauacacaaaaucaa

SEQ ID NO: 3162010 - RNA, 21 nt, Human
guaauauaauacacaaaauca

SEQ ID NO: 3162011 - RNA, 15 nt, Human
guaauauagaaaaaa

SEQ ID NO: 3162012 - RNA, 21 nt, Human
guaaagaaaaauauuuaaugu

SEQ ID NO: 3162013 - RNA, 17 nt, Human
guaaagaaaaauauuua

SEQ ID NO: 3162014 - RNA, 15 nt, Human
guaaagaaaaauauu

SEQ ID NO: 3162015 - RNA, 14 nt, Human
guaaagaaaaauau

SEQ ID NO: 3162016 - RNA, 16 nt, Human
guaaacuuugaaauau

SEQ ID NO: 3162017 - RNA, 14 nt, Human
guaaacuuugaaau

SEQ ID NO: 3162018 - RNA, 22 nt, Human
guaacugcucuugggcaauauu

SEQ ID NO: 3162019 - RNA, 19 nt, Human
aaauacacacucaaaucaa

SEQ ID NO: 3162020 - RNA, 20 nt, Human
aaauacaauuuuuauuucuu

SEQ ID NO: 3162021 - RNA, 21 nt, Human
aaauacaauuuuuauuucuuu

SEQ ID NO: 3162022 - RNA, 17 nt, Human
aaauacagauagauaua

SEQ ID NO: 3162023 - RNA, 20 nt, Human
aaauacaugaugauuucaga

SEQ ID NO: 3162024 - RNA, 14 nt, Human
aaauacaugaugau

SEQ ID NO: 3162025 - RNA, 22 nt, Human
aaauacagauaaaugauucaaa

SEQ ID NO: 3162026 - RNA, 20 nt, Human
aaauacagauaaaugauuca

SEQ ID NO: 3162027 - RNA, 16 nt, Human
aaauacagauaaauga

SEQ ID NO: 3162028 - RNA, 15 nt, Human
aaauacagacuggau

SEQ ID NO: 3162029 - RNA, 18 nt, Human
aaauacauucuuuuugcu

SEQ ID NO: 3162030 - RNA, 13 nt, Human
aaauacauucuuu

SEQ ID NO: 3162031 - RNA, 19 nt, Human
aaauacauucuuuuugcuc

SEQ ID NO: 3162032 - RNA, 17 nt, Human
aaauacauuuaaaacau

SEQ ID NO: 3162033 - RNA, 20 nt, Human
aaauaccacaaucaccgaug

SEQ ID NO: 3162034 - RNA, 23 nt, Human
aaauaccaaaccuucugacuuug

SEQ ID NO: 3162035 - RNA, 14 nt, Human
aaauauaauugaca

SEQ ID NO: 3162036 - RNA, 14 nt, Human
aaauacuguacaau

SEQ ID NO: 3162037 - RNA, 15 nt, Human
aaauauacaaaacuu

SEQ ID NO: 3162038 - RNA, 16 nt, Human
aaauauacauguuuau

SEQ ID NO: 3162039 - RNA, 15 nt, Human
aaauauacauguuua

SEQ ID NO: 3162040 - RNA, 14 nt, Human
aaauauacauguuu

SEQ ID NO: 3162041 - RNA, 13 nt, Human
aaauauacauguu

SEQ ID NO: 3162042 - RNA, 18 nt, Human
guacacccaugaaagaaa

SEQ ID NO: 3162043 - RNA, 17 nt, Human
guacacccaugaaagaa

SEQ ID NO: 3162044 - RNA, 16 nt, Human
guacacccaugaaaga

SEQ ID NO: 3162045 - RNA, 16 nt, Human
guaauuuuauuuuaaa

SEQ ID NO: 3162046 - RNA, 19 nt, Human
guaauuuuauuuuaaaauu

SEQ ID NO: 3162047 - RNA, 20 nt, Human
guaauuuuauuuuaaaauuu

SEQ ID NO: 3162048 - RNA, 23 nt, Human
guaauuuucggaugggagaguuu

SEQ ID NO: 3162049 - RNA, 16 nt, Human
guaauuuuguguaaga

SEQ ID NO: 3162050 - RNA, 14 nt, Human
guaauuuuguguaa

SEQ ID NO: 3162051 - RNA, 21 nt, Human
guaauuuuucuguauagacag

SEQ ID NO: 3162052 - RNA, 13 nt, Human
guaauuuuucugu

SEQ ID NO: 3162053 - RNA, 20 nt, Human
guaauuuuguguaagaaaua

SEQ ID NO: 3162054 - RNA, 16 nt, Human
guaauuuuucuguaua

SEQ ID NO: 3162055 - RNA, 15 nt, Human
guaauuuuucuguau

SEQ ID NO: 3162056 - RNA, 15 nt, Human
aaauacacacucaaa

SEQ ID NO: 3162057 - RNA, 17 nt, Human
guacacugaauuuuuau

SEQ ID NO: 3162058 - RNA, 13 nt, Human
guacacugccugc

SEQ ID NO: 3162059 - RNA, 17 nt, Human
guacacugccugccuua

SEQ ID NO: 3162060 - RNA, 13 nt, Human
aaauacaaaguua

SEQ ID NO: 3162061 - RNA, 16 nt, Human
aaaguuauuaaaauug

SEQ ID NO: 3162062 - RNA, 15 nt, Human
aaaguuauuaaaauu

SEQ ID NO: 3162063 - RNA, 21 nt, Human
aaaguuaccuggaaucaaaua

SEQ ID NO: 3162064 - RNA, 19 nt, Human
aaaguauugccaaacauua

SEQ ID NO: 3162065 - RNA, 23 nt, Human
aaaguucugcagauaaacaguag

SEQ ID NO: 3162066 - RNA, 16 nt, Human
aaaguauguuuuacuu

SEQ ID NO: 3162067 - RNA, 14 nt, Human
aaaguauucucuuu

SEQ ID NO: 3162068 - RNA, 22 nt, Human
aaaguuaccagugccuuaaacu

SEQ ID NO: 3162069 - RNA, 16 nt, Human
aaaguuaccagugccu

SEQ ID NO: 3162070 - RNA, 20 nt, Human
aaaguauuguaaugagugaa

SEQ ID NO: 3162071 - RNA, 18 nt, Human
aaaguauugccaaacauu

SEQ ID NO: 3162072 - RNA, 15 nt, Human
aaaguauugccaaac

SEQ ID NO: 3162073 - RNA, 14 nt, Human
aaaguauugccaaa

SEQ ID NO: 3162074 - RNA, 13 nt, Human
aaaguauugccaa

SEQ ID NO: 3162075 - RNA, 15 nt, Human
aaaguauucuuuuuc

SEQ ID NO: 3162076 - RNA, 16 nt, Human
aaaguauucuuuuucu

SEQ ID NO: 3162077 - RNA, 18 nt, Human
aaaguauucuuuuucuuu

SEQ ID NO: 3162078 - RNA, 16 nt, Human
aaaguauucucuuuuc

SEQ ID NO: 3162079 - RNA, 20 nt, Human
aaagguauuuuaaucaccaa

SEQ ID NO: 3162080 - RNA, 15 nt, Human
aaagguagacuuuua

SEQ ID NO: 3162081 - RNA, 17 nt, Human
aaaggguucuguaaaau

SEQ ID NO: 3162082 - RNA, 24 nt, Human
aaaggucaccucacucagcaccac

SEQ ID NO: 3162083 - RNA, 20 nt, Human
aaaggucaccucacucagca

SEQ ID NO: 3162084 - RNA, 19 nt, Human
aaaggucaccucacucagc

SEQ ID NO: 3162085 - RNA, 16 nt, Human
aaaggucaccucacuc

SEQ ID NO: 3162086 - RNA, 19 nt, Human
aaaguacuucuccacccug

SEQ ID NO: 3162087 - RNA, 18 nt, Human
aaaguacugagcagugau

SEQ ID NO: 3162088 - RNA, 19 nt, Human
aaaguacauuuuuugaaau

SEQ ID NO: 3162089 - RNA, 18 nt, Human
aaaguacauuuuuugaaa

SEQ ID NO: 3162090 - RNA, 15 nt, Human
aaaguacauuuuuug

SEQ ID NO: 3162091 - RNA, 23 nt, Human
aaaggucuuggugccucugcagu

SEQ ID NO: 3162092 - RNA, 16 nt, Human
aaaguacagguacuuu

SEQ ID NO: 3162093 - RNA, 14 nt, Human
aaaguacagguacu

SEQ ID NO: 3162094 - RNA, 13 nt, Human
aaaguacagaauu

SEQ ID NO: 3162095 - RNA, 14 nt, Human
aaaguacagaauuu

SEQ ID NO: 3162096 - RNA, 15 nt, Human
aaaguacagaauuug

SEQ ID NO: 3162097 - RNA, 21 nt, Human
aaaguacagaauuugaauuau

SEQ ID NO: 3162098 - RNA, 22 nt, Human
aaaguacagguacuuugucuaa

SEQ ID NO: 3162099 - RNA, 20 nt, Human
aaaguacagguacuuugucu

SEQ ID NO: 3162100 - RNA, 18 nt, Human
aaaguacagguacuuugu

SEQ ID NO: 3162101 - RNA, 22 nt, Human
aaaguacauucuggggaaacaa

SEQ ID NO: 3162102 - RNA, 21 nt, Human
aaaguacuucuccacccugcu

SEQ ID NO: 3162103 - RNA, 20 nt, Human
aaaguacuucuccacccugc

SEQ ID NO: 3162104 - RNA, 23 nt, Human
aaaguacuucuccacccugcucu

SEQ ID NO: 3162105 - RNA, 18 nt, Human
aaaguauaaauuugugua

SEQ ID NO: 3162106 - RNA, 13 nt, Human
aaaguauaauguu

SEQ ID NO: 3162107 - RNA, 14 nt, Human
aaaguauaauguuu

SEQ ID NO: 3162108 - RNA, 16 nt, Human
aaaguauaauguuuau

SEQ ID NO: 3162109 - RNA, 20 nt, Human
aaaguauaauguuuauuaaa

SEQ ID NO: 3162110 - RNA, 22 nt, Human
aaaguauaauguuuauuaaaug

SEQ ID NO: 3162111 - RNA, 23 nt, Human
aaaguauaauguuuauuaaaugc

SEQ ID NO: 3162112 - RNA, 12 nt, Human
aaaguaguacuu

SEQ ID NO: 3162113 - RNA, 19 nt, Human
aaaguaguacuucuucugu

SEQ ID NO: 3162114 - RNA, 20 nt, Human
aaaguaguacuucuucugua

SEQ ID NO: 3162115 - RNA, 21 nt, Human
aaaguaguacuucuucuguaa

SEQ ID NO: 3162116 - RNA, 21 nt, Human
aaaguacugagcagugauauu

SEQ ID NO: 3162117 - RNA, 20 nt, Human
aaauaaccuaauuaauauau

SEQ ID NO: 3162118 - RNA, 14 nt, Human
aaauaacuaaaaug

SEQ ID NO: 3162119 - RNA, 15 nt, Human
aaauaacuaaaaugu

SEQ ID NO: 3162120 - RNA, 14 nt, Human
aaauaacugaauuu

SEQ ID NO: 3162121 - RNA, 15 nt, Human
aaauaacugaauuug

SEQ ID NO: 3162122 - RNA, 18 nt, Human
aaauaacugaauuuggag

SEQ ID NO: 3162123 - RNA, 22 nt, Human
aaauaacuguaauuauuugaau

SEQ ID NO: 3162124 - RNA, 21 nt, Human
aaauaacuguaauuauuugaa

SEQ ID NO: 3162125 - RNA, 13 nt, Human
aaauaacuguaau

SEQ ID NO: 3162126 - RNA, 16 nt, Human
aaauaacuguaauuau

SEQ ID NO: 3162127 - RNA, 15 nt, Human
aaauaacuguaauua

SEQ ID NO: 3162128 - RNA, 14 nt, Human
aaaguuguacuuua

SEQ ID NO: 3162129 - RNA, 17 nt, Human
aaaguugguauuaauaa

SEQ ID NO: 3162130 - RNA, 18 nt, Human
aaaguugguauuaauaaa

SEQ ID NO: 3162131 - RNA, 17 nt, Human
aaaguuguaugaucugu

SEQ ID NO: 3162132 - RNA, 19 nt, Human
aaaguuguacuuuaaaaau

SEQ ID NO: 3162133 - RNA, 16 nt, Human
aaaguuguacuuuaaa

SEQ ID NO: 3162134 - RNA, 15 nt, Human
aaaguuguacuuuaa

SEQ ID NO: 3162135 - RNA, 19 nt, Human
aaaguuguaugaucugugc

SEQ ID NO: 3162136 - RNA, 18 nt, Human
aaaguuguaugaucugug

SEQ ID NO: 3162137 - RNA, 13 nt, Human
aaauaauaauuuu

SEQ ID NO: 3162138 - RNA, 19 nt, Human
aaauaauaccuuagaaggu

SEQ ID NO: 3162139 - RNA, 18 nt, Human
aaauaauaucucuaauau

SEQ ID NO: 3162140 - RNA, 21 nt, Human
aaauaauucuuuuuuauuaau

SEQ ID NO: 3162141 - RNA, 12 nt, Human
aaauaagaaaag

SEQ ID NO: 3162142 - RNA, 22 nt, Human
aaauaagaaaagauguagauuu

SEQ ID NO: 3162143 - RNA, 13 nt, Human
aaauaagaaaaga

SEQ ID NO: 3162144 - RNA, 14 nt, Human
aaauaauuuuguaa

SEQ ID NO: 3162145 - RNA, 13 nt, Human
aaauaauuuugua

SEQ ID NO: 3162146 - RNA, 16 nt, Human
aaauaauuuacuguga

SEQ ID NO: 3162147 - RNA, 19 nt, Human
aaauaauuuuaucucuuuc

SEQ ID NO: 3162148 - RNA, 12 nt, Human
aaauaauuuugu

SEQ ID NO: 3162149 - RNA, 22 nt, Human
aaauaauucuuuuuuauuaauc

SEQ ID NO: 3162150 - RNA, 15 nt, Human
guaaacaucucagag

SEQ ID NO: 3162151 - RNA, 18 nt, Human
aaauaauuuuauuccaga

SEQ ID NO: 3162152 - RNA, 14 nt, Human
guaaaccugucuga

SEQ ID NO: 3162153 - RNA, 19 nt, Human
ggacaggagaugcugugcc

SEQ ID NO: 3162154 - RNA, 18 nt, Human
ggacaggagaugcugugc

SEQ ID NO: 3162155 - RNA, 11 nt, Human
ggacccugagg

SEQ ID NO: 3162156 - RNA, 17 nt, Human
ggacccuccaaggccag

SEQ ID NO: 3162157 - RNA, 21 nt, Human
ggacccuccaaggccaggccu

SEQ ID NO: 3162158 - RNA, 18 nt, Human
ggacccuccaaggccagg

SEQ ID NO: 3162159 - RNA, 12 nt, Human
ggacccccugaa

SEQ ID NO: 3162160 - RNA, 14 nt, Human
ggaccucaggccug

SEQ ID NO: 3162161 - RNA, 15 nt, Human
ggaccucaggccugg

SEQ ID NO: 3162162 - RNA, 20 nt, Human
ggacguguuaugacuccaga

SEQ ID NO: 3162163 - RNA, 13 nt, Human
ggacguccuccaa

SEQ ID NO: 3162164 - RNA, 13 nt, Human
ggaccucaggccu

SEQ ID NO: 3162165 - RNA, 12 nt, Human
ggaccucaggcc

SEQ ID NO: 3162166 - RNA, 12 nt, Human
ggacccugaggc

SEQ ID NO: 3162167 - RNA, 13 nt, Human
ggacccugaggcc

SEQ ID NO: 3162168 - RNA, 19 nt, Human
ggacccugaggcccagagg

SEQ ID NO: 3162169 - RNA, 17 nt, Human
ggacccugccaggcaca

SEQ ID NO: 3162170 - RNA, 16 nt, Human
ggacccugaaaugugu

SEQ ID NO: 3162171 - RNA, 14 nt, Human
ggacccugaaaugu

SEQ ID NO: 3162172 - RNA, 24 nt, Human
ggacccugccaggcacaggcaggg

SEQ ID NO: 3162173 - RNA, 22 nt, Human
ggacccugccaggcacaggcag

SEQ ID NO: 3162174 - RNA, 21 nt, Human
ggacccugccaggcacaggca

SEQ ID NO: 3162175 - RNA, 20 nt, Human
ggacccugccaggcacaggc

SEQ ID NO: 3162176 - RNA, 18 nt, Human
ggacccugccaggcacag

SEQ ID NO: 3162177 - RNA, 22 nt, Human
ggacucauuuuaaaaaauggaa

SEQ ID NO: 3162178 - RNA, 16 nt, Human
ggacucaaugcacuga

SEQ ID NO: 3162179 - RNA, 24 nt, Human
ggacuaacuugucuuuggacccug

SEQ ID NO: 3162180 - RNA, 14 nt, Human
ggacuacaggugug

SEQ ID NO: 3162181 - RNA, 15 nt, Human
ggacucaaugcacug

SEQ ID NO: 3162182 - RNA, 20 nt, Human
ggacuaacuugucuuuggac

SEQ ID NO: 3162183 - RNA, 10 nt, Human
ggacuaaauu

SEQ ID NO: 3162184 - RNA, 16 nt, Human
ggacguggcaccuccu

SEQ ID NO: 3162185 - RNA, 13 nt, Human
ggagaaacuggaa

SEQ ID NO: 3162186 - RNA, 16 nt, Human
ggagaaaggaagggcu

SEQ ID NO: 3162187 - RNA, 14 nt, Human
ggacuuggaagcuc

SEQ ID NO: 3162188 - RNA, 20 nt, Human
ggaacugcugggcuuggcag

SEQ ID NO: 3162189 - RNA, 15 nt, Human
ggaacacucugagac

SEQ ID NO: 3162190 - RNA, 16 nt, Human
ggaacacucugagacu

SEQ ID NO: 3162191 - RNA, 12 nt, Human
ggaacacucuga

SEQ ID NO: 3162192 - RNA, 14 nt, Human
ggaacacucugaga

SEQ ID NO: 3162193 - RNA, 19 nt, Human
ggaacacuccuucacagau

SEQ ID NO: 3162194 - RNA, 13 nt, Human
ggaagagagaaag

SEQ ID NO: 3162195 - RNA, 13 nt, Human
ggaagagaaaaaa

SEQ ID NO: 3162196 - RNA, 18 nt, Human
ggaagacuuuggaaagag

SEQ ID NO: 3162197 - RNA, 15 nt, Human
ggaagagaaaaaaua

SEQ ID NO: 3162198 - RNA, 13 nt, Human
ggaagacuuugga

SEQ ID NO: 3162199 - RNA, 17 nt, Human
ggaagacuuuggaaaga

SEQ ID NO: 3162200 - RNA, 12 nt, Human
ggaagacuuugg

SEQ ID NO: 3162201 - RNA, 23 nt, Human
ggaagacaguucuacagaaaaac

SEQ ID NO: 3162202 - RNA, 13 nt, Human
ggaagacagcucu

SEQ ID NO: 3162203 - RNA, 14 nt, Human
ggaagacagcucuu

SEQ ID NO: 3162204 - RNA, 22 nt, Human
ggaagacaaugugaaaagaaaa

SEQ ID NO: 3162205 - RNA, 21 nt, Human
ggaagugugggucugugugug

SEQ ID NO: 3162206 - RNA, 22 nt, Human
ggaagugugggucugugugugu

SEQ ID NO: 3162207 - RNA, 12 nt, Human
ggaagugugggu

SEQ ID NO: 3162208 - RNA, 22 nt, Human
ggaaguuaaagggaagaaaaca

SEQ ID NO: 3162209 - RNA, 17 nt, Human
ggaaguuaaagugaggc

SEQ ID NO: 3162210 - RNA, 16 nt, Human
ggaaguuaaaagcaca

SEQ ID NO: 3162211 - RNA, 19 nt, Human
ggaaggaaacccagcucug

SEQ ID NO: 3162212 - RNA, 20 nt, Human
ggaaggaaacccagcucugg

SEQ ID NO: 3162213 - RNA, 16 nt, Human
ggaaggaaacccagcu

SEQ ID NO: 3162214 - RNA, 13 nt, Human
ggaagcugcuacu

SEQ ID NO: 3162215 - RNA, 23 nt, Human
ggaagcucagggccuggcucagg

SEQ ID NO: 3162216 - RNA, 11 nt, Human
ggaagcuccgc

SEQ ID NO: 3162217 - RNA, 22 nt, Human
ggaagcucagggccuggcucag

SEQ ID NO: 3162218 - RNA, 22 nt, Human
ggacaaggaugaucuaggaaga

SEQ ID NO: 3162219 - RNA, 23 nt, Human
ggacaaggaugaucuaggaagac

SEQ ID NO: 3162220 - RNA, 13 nt, Human
ggacaagagcagg

SEQ ID NO: 3162221 - RNA, 13 nt, Human
ggacaagcagugg

SEQ ID NO: 3162222 - RNA, 21 nt, Human
ggaaucuuuguaccaaaauuu

SEQ ID NO: 3162223 - RNA, 22 nt, Human
ggaaucuagccagugaacauaa

SEQ ID NO: 3162224 - RNA, 21 nt, Human
ggaaucuagccagugaacaua

SEQ ID NO: 3162225 - RNA, 18 nt, Human
ggaauaacauguaauuaa

SEQ ID NO: 3162226 - RNA, 16 nt, Human
ggaauccagacccggc

SEQ ID NO: 3162227 - RNA, 20 nt, Human
ggaaucauuguccagagcug

SEQ ID NO: 3162228 - RNA, 17 nt, Human
ggaaucauuguccagag

SEQ ID NO: 3162229 - RNA, 18 nt, Human
ggacacagcucuucucca

SEQ ID NO: 3162230 - RNA, 15 nt, Human
ggacacagcucuucu

SEQ ID NO: 3162231 - RNA, 14 nt, Human
ggacacagcucuuc

SEQ ID NO: 3162232 - RNA, 18 nt, Human
ggacaaggugcaggcagg

SEQ ID NO: 3162233 - RNA, 17 nt, Human
ggacaaggugcaggcag

SEQ ID NO: 3162234 - RNA, 19 nt, Human
ggacaaggacuaggguccu

SEQ ID NO: 3162235 - RNA, 22 nt, Human
ggacaagggaaaauaaaaaaag

SEQ ID NO: 3162236 - RNA, 17 nt, Human
ggacagcuccuucuguc

SEQ ID NO: 3162237 - RNA, 20 nt, Human
ggacagcuccuucuguccua

SEQ ID NO: 3162238 - RNA, 19 nt, Human
ggacagcuccuucuguccu

SEQ ID NO: 3162239 - RNA, 17 nt, Human
ggacacuaaccacgcug

SEQ ID NO: 3162240 - RNA, 18 nt, Human
gcuucacggaagagccuu

SEQ ID NO: 3162241 - RNA, 12 nt, Human
gcuucagccucc

SEQ ID NO: 3162242 - RNA, 19 nt, Human
gcuucagccucccacagug

SEQ ID NO: 3162243 - RNA, 18 nt, Human
gcuucagccucccacagu

SEQ ID NO: 3162244 - RNA, 14 nt, Human
gcuucagccuccca

SEQ ID NO: 3162245 - RNA, 21 nt, Human
gcuucagccucccacagugcu

SEQ ID NO: 3162246 - RNA, 15 nt, Human
gcuuauuacauuuua

SEQ ID NO: 3162247 - RNA, 17 nt, Human
gcuucacggaagagccu

SEQ ID NO: 3162248 - RNA, 15 nt, Human
gcuucacggaagagc

SEQ ID NO: 3162249 - RNA, 20 nt, Human
gcuucaaggauccugagcca

SEQ ID NO: 3162250 - RNA, 21 nt, Human
gcuucaaggauccugagccag

SEQ ID NO: 3162251 - RNA, 19 nt, Human
gcuucaaggauccugagcc

SEQ ID NO: 3162252 - RNA, 18 nt, Human
gcuucaaggauccugagc

SEQ ID NO: 3162253 - RNA, 17 nt, Human
gcuuauuuaauaugcuu

SEQ ID NO: 3162254 - RNA, 19 nt, Human
gcuuugacucuauaagcaa

SEQ ID NO: 3162255 - RNA, 20 nt, Human
gcuuugacucuauaagcaaa

SEQ ID NO: 3162256 - RNA, 23 nt, Human
gcuucuucagagacuccugcagg

SEQ ID NO: 3162257 - RNA, 16 nt, Human
gcuucuucugaggccu

SEQ ID NO: 3162258 - RNA, 15 nt, Human
gcuucuagggaccag

SEQ ID NO: 3162259 - RNA, 22 nt, Human
gcuuccucauaguaugguggcu

SEQ ID NO: 3162260 - RNA, 18 nt, Human
gcuuccuauaauuuugau

SEQ ID NO: 3162261 - RNA, 17 nt, Human
gcuuccuauaauuuuga

SEQ ID NO: 3162262 - RNA, 23 nt, Human
gcuuccuauaauuuugauagugg

SEQ ID NO: 3162263 - RNA, 13 nt, Human
gcuuguaguucuu

SEQ ID NO: 3162264 - RNA, 17 nt, Human
gcuuguaguucuuuaaa

SEQ ID NO: 3162265 - RNA, 16 nt, Human
gcuuguaguucuuuaa

SEQ ID NO: 3162266 - RNA, 17 nt, Human
gcuugucauagccagug

SEQ ID NO: 3162267 - RNA, 16 nt, Human
gcuugucauagccagu

SEQ ID NO: 3162268 - RNA, 18 nt, Human
gcuuucuuuuuaaagcuu

SEQ ID NO: 3162269 - RNA, 22 nt, Human
gcuuucuuuuuaaagcuuuuga

SEQ ID NO: 3162270 - RNA, 21 nt, Human
gcuuucuuucguuuguuuguu

SEQ ID NO: 3162271 - RNA, 20 nt, Human
gcuuucuuucguuuguuugu

SEQ ID NO: 3162272 - RNA, 22 nt, Human
gcuugaccuuuaagagaaauga

SEQ ID NO: 3162273 - RNA, 17 nt, Human
gcuucuucugaggccug

SEQ ID NO: 3162274 - RNA, 14 nt, Human
gcuugagcucagga

SEQ ID NO: 3162275 - RNA, 20 nt, Human
gcuuguaaauagcucaggug

SEQ ID NO: 3162276 - RNA, 23 nt, Human
gcuuguaacuaaaauaauuuugu

SEQ ID NO: 3162277 - RNA, 22 nt, Human
gcuuguaacuaaaauaauuuug

SEQ ID NO: 3162278 - RNA, 17 nt, Human
gcuuguaacuaaaauaa

SEQ ID NO: 3162279 - RNA, 13 nt, Human
gcugcuggcuggu

SEQ ID NO: 3162280 - RNA, 15 nt, Human
gcucugguccauaga

SEQ ID NO: 3162281 - RNA, 16 nt, Human
gcucugguccauagag

SEQ ID NO: 3162282 - RNA, 12 nt, Human
gcugcugaaggc

SEQ ID NO: 3162283 - RNA, 13 nt, Human
gcugcugaaggcu

SEQ ID NO: 3162284 - RNA, 14 nt, Human
gcugcugaaggcuc

SEQ ID NO: 3162285 - RNA, 15 nt, Human
gcugcugaaggcucg

SEQ ID NO: 3162286 - RNA, 15 nt, Human
gcuggaguaaucaga

SEQ ID NO: 3162287 - RNA, 20 nt, Human
gcuggccuggccccucaggg

SEQ ID NO: 3162288 - RNA, 22 nt, Human
gcuggagugcagugagccgaga

SEQ ID NO: 3162289 - RNA, 17 nt, Human
gcuggagugcagugagc

SEQ ID NO: 3162290 - RNA, 18 nt, Human
gcuggagugcagugagcc

SEQ ID NO: 3162291 - RNA, 20 nt, Human
gcuggcgugcaguggugcga

SEQ ID NO: 3162292 - RNA, 18 nt, Human
gcuggccuugugguccaa

SEQ ID NO: 3162293 - RNA, 19 nt, Human
gcuggccuugugguccaaa

SEQ ID NO: 3162294 - RNA, 21 nt, Human
gcuggccuugugguccaaaua

SEQ ID NO: 3162295 - RNA, 20 nt, Human
gcuggccuggggucaggccg

SEQ ID NO: 3162296 - RNA, 16 nt, Human
gcuggcuguuggcugg

SEQ ID NO: 3162297 - RNA, 15 nt, Human
gcuggcuguuggcug

SEQ ID NO: 3162298 - RNA, 22 nt, Human
gcuggcuggccuugugguccaa

SEQ ID NO: 3162299 - RNA, 13 nt, Human
gcuggcuccccug

SEQ ID NO: 3162300 - RNA, 14 nt, Human
gcuggcuccccugc

SEQ ID NO: 3162301 - RNA, 16 nt, Human
gcuggcuccccugcag

SEQ ID NO: 3162302 - RNA, 17 nt, Human
gcuggcuccccugcagc

SEQ ID NO: 3162303 - RNA, 18 nt, Human
gcuggcuccccugcagcc

SEQ ID NO: 3162304 - RNA, 20 nt, Human
gcuggcuccccugcagcccu

SEQ ID NO: 3162305 - RNA, 21 nt, Human
gcuggcuccccugcagcccug

SEQ ID NO: 3162306 - RNA, 22 nt, Human
gcuggcuccccugcagcccugg

SEQ ID NO: 3162307 - RNA, 14 nt, Human
gcuggcuccagccu

SEQ ID NO: 3162308 - RNA, 15 nt, Human
gcuggcuccagccug

SEQ ID NO: 3162309 - RNA, 13 nt, Human
gcugggcucccgu

SEQ ID NO: 3162310 - RNA, 23 nt, Human
gcugggguggggaccucaggccu

SEQ ID NO: 3162311 - RNA, 21 nt, Human
gcuggguggcaccagcagccu

SEQ ID NO: 3162312 - RNA, 22 nt, Human
gcuggguggcaccagcagccug

SEQ ID NO: 3162313 - RNA, 23 nt, Human
gcuggguggcaccagcagccugg

SEQ ID NO: 3162314 - RNA, 18 nt, Human
gcccugcagagggcacag

SEQ ID NO: 3162315 - RNA, 16 nt, Human
gcccugcagagggcac

SEQ ID NO: 3162316 - RNA, 12 nt, Human
gcccugcagcuc

SEQ ID NO: 3162317 - RNA, 15 nt, Human
gcccugcauuuucau

SEQ ID NO: 3162318 - RNA, 19 nt, Human
gcccugcagcucucaugcu

SEQ ID NO: 3162319 - RNA, 13 nt, Human
gcccugcagcucu

SEQ ID NO: 3162320 - RNA, 15 nt, Human
gcccugcccaccugg

SEQ ID NO: 3162321 - RNA, 11 nt, Human
gcccugcccug

SEQ ID NO: 3162322 - RNA, 11 nt, Human
gcccugccucc

SEQ ID NO: 3162323 - RNA, 12 nt, Human
gcccugcccugg

SEQ ID NO: 3162324 - RNA, 16 nt, Human
gcccugcccugguuuc

SEQ ID NO: 3162325 - RNA, 17 nt, Human
gcccugcccaccuggcc

SEQ ID NO: 3162326 - RNA, 20 nt, Human
gcccugcccaccuggccucu

SEQ ID NO: 3162327 - RNA, 21 nt, Human
gcccugcccaccuggccucug

SEQ ID NO: 3162328 - RNA, 22 nt, Human
gcccugcccaccuggccucugc

SEQ ID NO: 3162329 - RNA, 20 nt, Human
gcccuuagcagggaaacagc

SEQ ID NO: 3162330 - RNA, 19 nt, Human
gcccuuagcagggaaacag

SEQ ID NO: 3162331 - RNA, 22 nt, Human
gcccuguccugccuaaggcuga

SEQ ID NO: 3162332 - RNA, 12 nt, Human
gcccugccuccu

SEQ ID NO: 3162333 - RNA, 13 nt, Human
gcccugccuccuu

SEQ ID NO: 3162334 - RNA, 18 nt, Human
gcccugcccugguuuccu

SEQ ID NO: 3162335 - RNA, 22 nt, Human
gcccuuagcagggaaacagcua

SEQ ID NO: 3162336 - RNA, 20 nt, Human
gccgcagcccugcagagggc

SEQ ID NO: 3162337 - RNA, 19 nt, Human
gccgcagcccugcagaggg

SEQ ID NO: 3162338 - RNA, 23 nt, Human
gccgcaucucacagcuaugcaaa

SEQ ID NO: 3162339 - RNA, 15 nt, Human
gccgcaucucacagc

SEQ ID NO: 3162340 - RNA, 18 nt, Human
gccgcaucucacagcuau

SEQ ID NO: 3162341 - RNA, 20 nt, Human
gccuaggugacagagugaga

SEQ ID NO: 3162342 - RNA, 23 nt, Human
gccgccgcuagguagagucugag

SEQ ID NO: 3162343 - RNA, 22 nt, Human
gccgccggcaauaaaagcccag

SEQ ID NO: 3162344 - RNA, 23 nt, Human
gccgccggcaauaaaagcccagg

SEQ ID NO: 3162345 - RNA, 20 nt, Human
gccgccgcuagguagagucu

SEQ ID NO: 3162346 - RNA, 23 nt, Human
gccuaggauucacaccccaccug

SEQ ID NO: 3162347 - RNA, 22 nt, Human
gccuaggauucacaccccaccu

SEQ ID NO: 3162348 - RNA, 21 nt, Human
gccuaggauucacaccccacc

SEQ ID NO: 3162349 - RNA, 18 nt, Human
gccuaggauucacacccc

SEQ ID NO: 3162350 - RNA, 15 nt, Human
gccuaggugacagag

SEQ ID NO: 3162351 - RNA, 14 nt, Human
gccuaggugacaga

SEQ ID NO: 3162352 - RNA, 13 nt, Human
gccuaggugacag

SEQ ID NO: 3162353 - RNA, 21 nt, Human
gccccugccuuggggucaggu

SEQ ID NO: 3162354 - RNA, 17 nt, Human
gccccugcuacugccaa

SEQ ID NO: 3162355 - RNA, 14 nt, Human
gccccugcuacugc

SEQ ID NO: 3162356 - RNA, 19 nt, Human
gcccggugggggggcagag

SEQ ID NO: 3162357 - RNA, 23 nt, Human
gcccgggcucugccucccaucac

SEQ ID NO: 3162358 - RNA, 21 nt, Human
gcccgggcucugccucccauc

SEQ ID NO: 3162359 - RNA, 16 nt, Human
gcccuaaugcgcaggc

SEQ ID NO: 3162360 - RNA, 17 nt, Human
gcccuaaugcgcaggcu

SEQ ID NO: 3162361 - RNA, 19 nt, Human
gcccuaaugcgcaggcugg

SEQ ID NO: 3162362 - RNA, 20 nt, Human
gcccuaaugcgcaggcuggc

SEQ ID NO: 3162363 - RNA, 16 nt, Human
gccccugccagacccc

SEQ ID NO: 3162364 - RNA, 11 nt, Human
gccccugccag

SEQ ID NO: 3162365 - RNA, 16 nt, Human
gccccugccacccugg

SEQ ID NO: 3162366 - RNA, 17 nt, Human
gccccugccacccuggg

SEQ ID NO: 3162367 - RNA, 20 nt, Human
gccugcccaggccccugcca

SEQ ID NO: 3162368 - RNA, 15 nt, Human
gccugcccaggcccc

SEQ ID NO: 3162369 - RNA, 12 nt, Human
gccugcccaggc

SEQ ID NO: 3162370 - RNA, 22 nt, Human
gccugcccaggccccugccacc

SEQ ID NO: 3162371 - RNA, 17 nt, Human
gccucccaaagugcugg

SEQ ID NO: 3162372 - RNA, 13 nt, Human
gccuccugugugu

SEQ ID NO: 3162373 - RNA, 16 nt, Human
gccucccaaagugcug

SEQ ID NO: 3162374 - RNA, 11 nt, Human
gccuccaugcu

SEQ ID NO: 3162375 - RNA, 23 nt, Human
gccuccugugugugcgccuacag

SEQ ID NO: 3162376 - RNA, 19 nt, Human
gccuccugugugugcgccu

SEQ ID NO: 3162377 - RNA, 17 nt, Human
gccucgaacuggcugca

SEQ ID NO: 3162378 - RNA, 22 nt, Human
gccucgaacuggcugcaaaggg

SEQ ID NO: 3162379 - RNA, 20 nt, Human
gccucgaacuggcugcaaag

SEQ ID NO: 3162380 - RNA, 16 nt, Human
gccucuuaugggcugg

SEQ ID NO: 3162381 - RNA, 17 nt, Human
gccucuuaugggcuggg

SEQ ID NO: 3162382 - RNA, 18 nt, Human
gccucuuaugggcugggu

SEQ ID NO: 3162383 - RNA, 21 nt, Human
gccucuuaugggcuggguucu

SEQ ID NO: 3162384 - RNA, 14 nt, Human
gccucuuggguuca

SEQ ID NO: 3162385 - RNA, 20 nt, Human
gccucuucccgccgcccagc

SEQ ID NO: 3162386 - RNA, 12 nt, Human
gccucuugucuu

SEQ ID NO: 3162387 - RNA, 14 nt, Human
gccugcccaggccc

SEQ ID NO: 3162388 - RNA, 13 nt, Human
gccugcccaggcc

SEQ ID NO: 3162389 - RNA, 17 nt, Human
gccucuuucccuuccag

SEQ ID NO: 3162390 - RNA, 14 nt, Human
gccucuuucccuuc

SEQ ID NO: 3162391 - RNA, 12 nt, Human
gccucuuucccu

SEQ ID NO: 3162392 - RNA, 23 nt, Human
gccucuugucuuccuauuucaga

SEQ ID NO: 3162393 - RNA, 16 nt, Human
gccucuugucuuccua

SEQ ID NO: 3162394 - RNA, 23 nt, Human
gccuggcucacacuuggcucuga

SEQ ID NO: 3162395 - RNA, 20 nt, Human
gccuggccugagcugggaug

SEQ ID NO: 3162396 - RNA, 14 nt, Human
gccuggccugagcu

SEQ ID NO: 3162397 - RNA, 18 nt, Human
gccuggccugagcuggga

SEQ ID NO: 3162398 - RNA, 13 nt, Human
gccuggccugagc

SEQ ID NO: 3162399 - RNA, 15 nt, Human
gccuguugggccagg

SEQ ID NO: 3162400 - RNA, 16 nt, Human
gccuguugggccagga

SEQ ID NO: 3162401 - RNA, 18 nt, Human
gccuguugggccaggagc

SEQ ID NO: 3162402 - RNA, 20 nt, Human
gccuguugggccaggagccu

SEQ ID NO: 3162403 - RNA, 14 nt, Human
gccuguugggccag

SEQ ID NO: 3162404 - RNA, 23 nt, Human
gccuguucccauucuugcauggc

SEQ ID NO: 3162405 - RNA, 19 nt, Human
gccuguucccauucuugca

SEQ ID NO: 3162406 - RNA, 17 nt, Human
gccugugccucugggac

SEQ ID NO: 3162407 - RNA, 16 nt, Human
gccugugccucuggga

SEQ ID NO: 3162408 - RNA, 13 nt, Human
gccuggcucaggu

SEQ ID NO: 3162409 - RNA, 18 nt, Human
gccugugccucugggacu

SEQ ID NO: 3162410 - RNA, 20 nt, Human
gccuucggccuccauccuga

SEQ ID NO: 3162411 - RNA, 19 nt, Human
gccuucggccuccauccug

SEQ ID NO: 3162412 - RNA, 21 nt, Human
gccuucggccuccauccugag

SEQ ID NO: 3162413 - RNA, 16 nt, Human
gccuugaccauucucc

SEQ ID NO: 3162414 - RNA, 17 nt, Human
gccuugaccauucucca

SEQ ID NO: 3162415 - RNA, 19 nt, Human
gccuugaccauucuccacc

SEQ ID NO: 3162416 - RNA, 20 nt, Human
gccuugaccauucuccaccu

SEQ ID NO: 3162417 - RNA, 15 nt, Human
gcgagcccugguggc

SEQ ID NO: 3162418 - RNA, 17 nt, Human
gcgagcccugguggcag

SEQ ID NO: 3162419 - RNA, 23 nt, Human
gccuugcccacuccugcucugcu

SEQ ID NO: 3162420 - RNA, 22 nt, Human
gccuugcccacuccugcucugc

SEQ ID NO: 3162421 - RNA, 18 nt, Human
gccuugcccacuccugcu

SEQ ID NO: 3162422 - RNA, 17 nt, Human
gccuugcccacuccugc

SEQ ID NO: 3162423 - RNA, 22 nt, Human
gcgaucuggguucacugcaacc

SEQ ID NO: 3162424 - RNA, 18 nt, Human
gcgcaagggaggcccagc

SEQ ID NO: 3162425 - RNA, 14 nt, Human
gcgcacagcugcuc

SEQ ID NO: 3162426 - RNA, 19 nt, Human
gcgcaagggaggcccagcg

SEQ ID NO: 3162427 - RNA, 23 nt, Human
gcucuaaaauauuuaugaagaaa

SEQ ID NO: 3162428 - RNA, 19 nt, Human
gcucuaaaauauuuaugaa

SEQ ID NO: 3162429 - RNA, 15 nt, Human
gcucuaaaauauuua

SEQ ID NO: 3162430 - RNA, 13 nt, Human
gcucuaaaauauu

SEQ ID NO: 3162431 - RNA, 11 nt, Human
gcucugcccuu

SEQ ID NO: 3162432 - RNA, 22 nt, Human
gcucugccccagcuugggcaga

SEQ ID NO: 3162433 - RNA, 13 nt, Human
gcucugccccagc

SEQ ID NO: 3162434 - RNA, 23 nt, Human
gcucugcaagaauugaagcagga

SEQ ID NO: 3162435 - RNA, 17 nt, Human
gcucugaucauccacug

SEQ ID NO: 3162436 - RNA, 23 nt, Human
gcucugaucauccacugugccau

SEQ ID NO: 3162437 - RNA, 17 nt, Human
gcucccccuccaccugc

SEQ ID NO: 3162438 - RNA, 18 nt, Human
gcuccccucggagaagag

SEQ ID NO: 3162439 - RNA, 21 nt, Human
gcuccccucggagaagagcug

SEQ ID NO: 3162440 - RNA, 15 nt, Human
gcuccccugcagccc

SEQ ID NO: 3162441 - RNA, 16 nt, Human
gcuccccugcagcccu

SEQ ID NO: 3162442 - RNA, 17 nt, Human
gcuccccugcagcccug

SEQ ID NO: 3162443 - RNA, 19 nt, Human
gcuccccugcagcccuggc

SEQ ID NO: 3162444 - RNA, 20 nt, Human
gcuccccuuccccuuccuuc

SEQ ID NO: 3162445 - RNA, 16 nt, Human
gcuccccuuccccuuc

SEQ ID NO: 3162446 - RNA, 13 nt, Human
gcuccccuucccc

SEQ ID NO: 3162447 - RNA, 19 nt, Human
gcucccgccuccaaccccu

SEQ ID NO: 3162448 - RNA, 13 nt, Human
gcucccgccucca

SEQ ID NO: 3162449 - RNA, 16 nt, Human
gcuccugagcccccag

SEQ ID NO: 3162450 - RNA, 12 nt, Human
gcuccugagccc

SEQ ID NO: 3162451 - RNA, 12 nt, Human
gcuccugccacc

SEQ ID NO: 3162452 - RNA, 18 nt, Human
gcuccugccaccacgccc

SEQ ID NO: 3162453 - RNA, 18 nt, Human
gcuccuggcccacugcau

SEQ ID NO: 3162454 - RNA, 19 nt, Human
gcuccuggcccacugcauc

SEQ ID NO: 3162455 - RNA, 20 nt, Human
gcuccuggcccacugcaucg

SEQ ID NO: 3162456 - RNA, 14 nt, Human
gcuccuggcccacu

SEQ ID NO: 3162457 - RNA, 15 nt, Human
gcuccuggcccacug

SEQ ID NO: 3162458 - RNA, 18 nt, Human
gcuccacuuggucuguga

SEQ ID NO: 3162459 - RNA, 18 nt, Human
gcuccagcucaccagccc

SEQ ID NO: 3162460 - RNA, 17 nt, Human
gcuccagcucaccagcc

SEQ ID NO: 3162461 - RNA, 21 nt, Human
gcuccagcucaccagccccag

SEQ ID NO: 3162462 - RNA, 15 nt, Human
gcucccacaggcccu

SEQ ID NO: 3162463 - RNA, 20 nt, Human
gcuccagcucaccagcccca

SEQ ID NO: 3162464 - RNA, 21 nt, Human
gcucccacaggcccuuccucu

SEQ ID NO: 3162465 - RNA, 20 nt, Human
gcucccacaggcccuuccuc

SEQ ID NO: 3162466 - RNA, 17 nt, Human
gcucccacaggcccuuc

SEQ ID NO: 3162467 - RNA, 16 nt, Human
gcucccacaggcccuu

SEQ ID NO: 3162468 - RNA, 13 nt, Human
gcucccaggagcc

SEQ ID NO: 3162469 - RNA, 17 nt, Human
gcucccacuucugccag

SEQ ID NO: 3162470 - RNA, 18 nt, Human
gcucccacuucugccaga

SEQ ID NO: 3162471 - RNA, 22 nt, Human
gcucccacaggcccuuccucuc

SEQ ID NO: 3162472 - RNA, 21 nt, Human
gcucccaggagccugcccagc

SEQ ID NO: 3162473 - RNA, 20 nt, Human
gcucccaggagccugcccag

SEQ ID NO: 3162474 - RNA, 13 nt, Human
gcucccccagcuc

SEQ ID NO: 3162475 - RNA, 20 nt, Human
gcucccccagcuccccccac

SEQ ID NO: 3162476 - RNA, 14 nt, Human
gcucccccagcucc

SEQ ID NO: 3162477 - RNA, 11 nt, Human
gcuccccccag

SEQ ID NO: 3162478 - RNA, 15 nt, Human
gcuccacuuggucug

SEQ ID NO: 3162479 - RNA, 23 nt, Human
gcuccaccccgcaagcaccaucc

SEQ ID NO: 3162480 - RNA, 16 nt, Human
gcuaggccuggccaga

SEQ ID NO: 3162481 - RNA, 23 nt, Human
gcuaggccuggccagaugcacca

SEQ ID NO: 3162482 - RNA, 17 nt, Human
gcuaggccuggccagau

SEQ ID NO: 3162483 - RNA, 16 nt, Human
gcuagucuuaagaacu

SEQ ID NO: 3162484 - RNA, 14 nt, Human
gcuaugagggccuu

SEQ ID NO: 3162485 - RNA, 21 nt, Human
gcuagugugguguuuccuggc

SEQ ID NO: 3162486 - RNA, 22 nt, Human
gcuagugugguguuuccuggca

SEQ ID NO: 3162487 - RNA, 19 nt, Human
gcuauucaguaauaacucu

SEQ ID NO: 3162488 - RNA, 18 nt, Human
gcuaugauguuaguuuuc

SEQ ID NO: 3162489 - RNA, 14 nt, Human
gcucagagagggug

SEQ ID NO: 3162490 - RNA, 13 nt, Human
gcucagagagggu

SEQ ID NO: 3162491 - RNA, 20 nt, Human
gcucacugcauccuccgccu

SEQ ID NO: 3162492 - RNA, 17 nt, Human
gcucacugcagccuccg

SEQ ID NO: 3162493 - RNA, 23 nt, Human
gcucagguggggucacucuggca

SEQ ID NO: 3162494 - RNA, 14 nt, Human
gcucaggugucccu

SEQ ID NO: 3162495 - RNA, 16 nt, Human
gcucaggugucccugc

SEQ ID NO: 3162496 - RNA, 20 nt, Human
gcuauucaguaauaacucua

SEQ ID NO: 3162497 - RNA, 18 nt, Human
gcuauucaguaauaacuc

SEQ ID NO: 3162498 - RNA, 15 nt, Human
gcuauggccugugcg

SEQ ID NO: 3162499 - RNA, 21 nt, Human
gcuauuuuaaaccaauugcag

SEQ ID NO: 3162500 - RNA, 14 nt, Human
gcucacugcagccu

SEQ ID NO: 3162501 - RNA, 13 nt, Human
gcucacugcagcc

SEQ ID NO: 3162502 - RNA, 12 nt, Human
gcucacugcagc

SEQ ID NO: 3162503 - RNA, 11 nt, Human
gcucacugcag

SEQ ID NO: 3162504 - RNA, 16 nt, Human
gcucacugcagccuca

SEQ ID NO: 3162505 - RNA, 15 nt, Human
gcucacugcagccuc

SEQ ID NO: 3162506 - RNA, 17 nt, Human
gcucacugcagccucaa

SEQ ID NO: 3162507 - RNA, 16 nt, Human
gcucacugcauccucc

SEQ ID NO: 3162508 - RNA, 22 nt, Human
gcuaauucuuugaccuguuggg

SEQ ID NO: 3162509 - RNA, 15 nt, Human
gcuaaugggacacua

SEQ ID NO: 3162510 - RNA, 13 nt, Human
gcuaaugggacac

SEQ ID NO: 3162511 - RNA, 17 nt, Human
gcuaaucuugugaaaau

SEQ ID NO: 3162512 - RNA, 19 nt, Human
gcuaaacguguauguuuuu

SEQ ID NO: 3162513 - RNA, 18 nt, Human
gcuaaacguguauguuuu

SEQ ID NO: 3162514 - RNA, 23 nt, Human
gcuaagugauccucccaccucag

SEQ ID NO: 3162515 - RNA, 17 nt, Human
gcuaaaauguuuucagc

SEQ ID NO: 3162516 - RNA, 16 nt, Human
gcuaaaauguuuucag

SEQ ID NO: 3162517 - RNA, 15 nt, Human
gcuaaaauguuuuca

SEQ ID NO: 3162518 - RNA, 14 nt, Human
gcuaaaauguuuuc

SEQ ID NO: 3162519 - RNA, 13 nt, Human
gcuaaaauguuuu

SEQ ID NO: 3162520 - RNA, 12 nt, Human
gcuaaaauguuu

SEQ ID NO: 3162521 - RNA, 14 nt, Human
gcuaagugcuuauu

SEQ ID NO: 3162522 - RNA, 14 nt, Human
gcuaaucagcauuc

SEQ ID NO: 3162523 - RNA, 22 nt, Human
gcuaaucagcauucucacuccu

SEQ ID NO: 3162524 - RNA, 17 nt, Human
gcuaaucagcauucuca

SEQ ID NO: 3162525 - RNA, 16 nt, Human
gcuaaucagcauucuc

SEQ ID NO: 3162526 - RNA, 23 nt, Human
gcgugcacacaccagagcccacc

SEQ ID NO: 3162527 - RNA, 19 nt, Human
gcgugcacacaccagagcc

SEQ ID NO: 3162528 - RNA, 18 nt, Human
gcuaaaaaagcugaauca

SEQ ID NO: 3162529 - RNA, 18 nt, Human
gcuaaaaaugagcuugau

SEQ ID NO: 3162530 - RNA, 22 nt, Human
gcuaaaaaugagcuugauuaaa

SEQ ID NO: 3162531 - RNA, 22 nt, Human
gcgggaggauguucugggacac

SEQ ID NO: 3162532 - RNA, 21 nt, Human
gcgggaggauguucugggaca

SEQ ID NO: 3162533 - RNA, 20 nt, Human
gcgugcacacaccagagccc

SEQ ID NO: 3162534 - RNA, 20 nt, Human
gcgggaggauguucugggac

SEQ ID NO: 3162535 - RNA, 16 nt, Human
gcuagaacucccuuuc

SEQ ID NO: 3162536 - RNA, 20 nt, Human
gcuacugccaaccucgcucc

SEQ ID NO: 3162537 - RNA, 12 nt, Human
gcuagaacuccc

SEQ ID NO: 3162538 - RNA, 13 nt, Human
gcuagaacucccu

SEQ ID NO: 3162539 - RNA, 14 nt, Human
gcuagaacucccuu

SEQ ID NO: 3162540 - RNA, 15 nt, Human
gcuagaacucccuuu

SEQ ID NO: 3162541 - RNA, 19 nt, Human
gcuacucgugagcgccagu

SEQ ID NO: 3162542 - RNA, 19 nt, Human
gcuacugaaaggcaguagu

SEQ ID NO: 3162543 - RNA, 19 nt, Human
cauccauggggcugauugu

SEQ ID NO: 3162544 - RNA, 21 nt, Human
cauccauggggucucucacag

SEQ ID NO: 3162545 - RNA, 20 nt, Human
cauccauggggucucucaca

SEQ ID NO: 3162546 - RNA, 19 nt, Human
cauccauggggucucucac

SEQ ID NO: 3162547 - RNA, 11 nt, Human
cauccaugggg

SEQ ID NO: 3162548 - RNA, 22 nt, Human
cauccauggggucucucacaga

SEQ ID NO: 3162549 - RNA, 17 nt, Human
caucccagccccaauga

SEQ ID NO: 3162550 - RNA, 14 nt, Human
caucaggccaggcc

SEQ ID NO: 3162551 - RNA, 16 nt, Human
caucaggccaggcccu

SEQ ID NO: 3162552 - RNA, 19 nt, Human
caucaggccaggcccucug

SEQ ID NO: 3162553 - RNA, 15 nt, Human
caucaggccaggccc

SEQ ID NO: 3162554 - RNA, 19 nt, Human
caucccauaugccugggca

SEQ ID NO: 3162555 - RNA, 14 nt, Human
cauccccuguagag

SEQ ID NO: 3162556 - RNA, 17 nt, Human
cauccuucccacucugu

SEQ ID NO: 3162557 - RNA, 16 nt, Human
cauccuucccacucug

SEQ ID NO: 3162558 - RNA, 15 nt, Human
cauccuucccacucu

SEQ ID NO: 3162559 - RNA, 20 nt, Human
caucuggguagcuguaaggc

SEQ ID NO: 3162560 - RNA, 18 nt, Human
caucuggguagcuguaag

SEQ ID NO: 3162561 - RNA, 16 nt, Human
caucuggguagcugua

SEQ ID NO: 3162562 - RNA, 20 nt, Human
cauauucaggaagcucaggg

SEQ ID NO: 3162563 - RNA, 14 nt, Human
cauauucaggaagc

SEQ ID NO: 3162564 - RNA, 15 nt, Human
cauauucaggaagcu

SEQ ID NO: 3162565 - RNA, 22 nt, Human
cauaugccugggcagaaggaag

SEQ ID NO: 3162566 - RNA, 13 nt, Human
cauaugccugggc

SEQ ID NO: 3162567 - RNA, 15 nt, Human
cauaugccugggcag

SEQ ID NO: 3162568 - RNA, 20 nt, Human
cauaugccugggcagaagga

SEQ ID NO: 3162569 - RNA, 19 nt, Human
cauaauugccaauugaaac

SEQ ID NO: 3162570 - RNA, 18 nt, Human
cauaauuuaguuguuucu

SEQ ID NO: 3162571 - RNA, 19 nt, Human
cauaauuuaguuguuucua

SEQ ID NO: 3162572 - RNA, 20 nt, Human
cauaauuuaguuguuucuag

SEQ ID NO: 3162573 - RNA, 14 nt, Human
cauaauucuuauua

SEQ ID NO: 3162574 - RNA, 13 nt, Human
cauaauucuuauu

SEQ ID NO: 3162575 - RNA, 22 nt, Human
cauaauucugaaguuauauuuc

SEQ ID NO: 3162576 - RNA, 18 nt, Human
cauaauucugaaguuaua

SEQ ID NO: 3162577 - RNA, 17 nt, Human
cauaauucugaaguuau

SEQ ID NO: 3162578 - RNA, 13 nt, Human
cauacacacgcug

SEQ ID NO: 3162579 - RNA, 19 nt, Human
cauacacacgcugccuucg

SEQ ID NO: 3162580 - RNA, 17 nt, Human
cauacacacgcugccuu

SEQ ID NO: 3162581 - RNA, 16 nt, Human
cauacacacgcugccu

SEQ ID NO: 3162582 - RNA, 14 nt, Human
cauaauuuguuucc

SEQ ID NO: 3162583 - RNA, 16 nt, Human
cauaauuuguuuccag

SEQ ID NO: 3162584 - RNA, 16 nt, Human
cauagcucuguacauc

SEQ ID NO: 3162585 - RNA, 16 nt, Human
cauagcuguacuucuu

SEQ ID NO: 3162586 - RNA, 21 nt, Human
cauagcuguacuucuugaaua

SEQ ID NO: 3162587 - RNA, 22 nt, Human
cauagcagagaaugaaagggcc

SEQ ID NO: 3162588 - RNA, 19 nt, Human
cauagcagagaaugaaagg

SEQ ID NO: 3162589 - RNA, 22 nt, Human
cauagcaccuaacaacauugua

SEQ ID NO: 3162590 - RNA, 22 nt, Human
caugcacacaauuagauuucuc

SEQ ID NO: 3162591 - RNA, 22 nt, Human
caugauguuuuuaaaaucuuau

SEQ ID NO: 3162592 - RNA, 21 nt, Human
caugauguuuuuaaaaucuua

SEQ ID NO: 3162593 - RNA, 20 nt, Human
caugauguuuuuaaaaucuu

SEQ ID NO: 3162594 - RNA, 19 nt, Human
caugauguuuuuaaaaucu

SEQ ID NO: 3162595 - RNA, 18 nt, Human
caugauguuuuuaaaauc

SEQ ID NO: 3162596 - RNA, 14 nt, Human
caugcacacucaug

SEQ ID NO: 3162597 - RNA, 19 nt, Human
caugcacacucaugugcaa

SEQ ID NO: 3162598 - RNA, 22 nt, Human
caugauuaaccacuucagcuga

SEQ ID NO: 3162599 - RNA, 23 nt, Human
caugauuaaccacuucagcugac

SEQ ID NO: 3162600 - RNA, 23 nt, Human
caugacaguucauucagggccga

SEQ ID NO: 3162601 - RNA, 17 nt, Human
caugauguuuuuaaaau

SEQ ID NO: 3162602 - RNA, 14 nt, Human
caugacagaaaaua

SEQ ID NO: 3162603 - RNA, 16 nt, Human
caugacagaaaauaug

SEQ ID NO: 3162604 - RNA, 15 nt, Human
caugacagaaaauau

SEQ ID NO: 3162605 - RNA, 21 nt, Human
caugacagaaaauauguauua

SEQ ID NO: 3162606 - RNA, 19 nt, Human
caugacagaaaauauguau

SEQ ID NO: 3162607 - RNA, 12 nt, Human
caugcugcccug

SEQ ID NO: 3162608 - RNA, 13 nt, Human
caugcugcccugu

SEQ ID NO: 3162609 - RNA, 13 nt, Human
caugcuccuggcc

SEQ ID NO: 3162610 - RNA, 19 nt, Human
caugcuccccugugccagc

SEQ ID NO: 3162611 - RNA, 18 nt, Human
caugcuccccugugccag

SEQ ID NO: 3162612 - RNA, 16 nt, Human
caugcacgugugugca

SEQ ID NO: 3162613 - RNA, 18 nt, Human
caugcuauucacaauuau

SEQ ID NO: 3162614 - RNA, 14 nt, Human
caugcucaaugaaa

SEQ ID NO: 3162615 - RNA, 16 nt, Human
caugcuccccugugcc

SEQ ID NO: 3162616 - RNA, 15 nt, Human
caugcuccccugugc

SEQ ID NO: 3162617 - RNA, 21 nt, Human
caugacacgaauauugcugau

SEQ ID NO: 3162618 - RNA, 23 nt, Human
caugacacgaauauugcugaugg

SEQ ID NO: 3162619 - RNA, 14 nt, Human
caugaaggagugaa

SEQ ID NO: 3162620 - RNA, 22 nt, Human
caugaaggaugccaagaaguuu

SEQ ID NO: 3162621 - RNA, 16 nt, Human
caugcugccccugccu

SEQ ID NO: 3162622 - RNA, 18 nt, Human
cauggcaugcuuaaauuu

SEQ ID NO: 3162623 - RNA, 19 nt, Human
cauggcaugcuuaaauuuu

SEQ ID NO: 3162624 - RNA, 14 nt, Human
caugcugcccugug

SEQ ID NO: 3162625 - RNA, 13 nt, Human
cauggccaggugg

SEQ ID NO: 3162626 - RNA, 13 nt, Human
cauuaucucaaaa

SEQ ID NO: 3162627 - RNA, 21 nt, Human
cauuagugagacauauuuaca

SEQ ID NO: 3162628 - RNA, 12 nt, Human
cauuaucucaaa

SEQ ID NO: 3162629 - RNA, 14 nt, Human
cauuaguacuuuau

SEQ ID NO: 3162630 - RNA, 15 nt, Human
cauuaguacuuuaua

SEQ ID NO: 3162631 - RNA, 22 nt, Human
cauuaguacuuuauagaagaau

SEQ ID NO: 3162632 - RNA, 20 nt, Human
cauuaguacuuuauagaaga

SEQ ID NO: 3162633 - RNA, 19 nt, Human
cauguccaagaagcccagg

SEQ ID NO: 3162634 - RNA, 20 nt, Human
cauguccaagaagcccagga

SEQ ID NO: 3162635 - RNA, 18 nt, Human
cauguccaagaagcccag

SEQ ID NO: 3162636 - RNA, 16 nt, Human
cauguccaagaagccc

SEQ ID NO: 3162637 - RNA, 12 nt, Human
cauguuggccag

SEQ ID NO: 3162638 - RNA, 17 nt, Human
cauguugccaaaauggu

SEQ ID NO: 3162639 - RNA, 12 nt, Human
cauuccuguucc

SEQ ID NO: 3162640 - RNA, 13 nt, Human
cauuagugggaaa

SEQ ID NO: 3162641 - RNA, 22 nt, Human
cauucgcuacuaugauuuaauu

SEQ ID NO: 3162642 - RNA, 18 nt, Human
cauuccuuuuuauuuaua

SEQ ID NO: 3162643 - RNA, 14 nt, Human
cauucuaucuacug

SEQ ID NO: 3162644 - RNA, 15 nt, Human
cauucuaucuacuga

SEQ ID NO: 3162645 - RNA, 18 nt, Human
cauucuaucuacugauuu

SEQ ID NO: 3162646 - RNA, 18 nt, Human
cauucuagguuugcaaga

SEQ ID NO: 3162647 - RNA, 21 nt, Human
cauucgggccccaccugcagc

SEQ ID NO: 3162648 - RNA, 13 nt, Human
cauucucacuccu

SEQ ID NO: 3162649 - RNA, 21 nt, Human
cauucucaagggacguccucc

SEQ ID NO: 3162650 - RNA, 16 nt, Human
cauucucaagggacgu

SEQ ID NO: 3162651 - RNA, 22 nt, Human
cauucucaagggacguccucca

SEQ ID NO: 3162652 - RNA, 14 nt, Human
cauucucaagggac

SEQ ID NO: 3162653 - RNA, 22 nt, Human
cauucgggccccaccugcagcu

SEQ ID NO: 3162654 - RNA, 23 nt, Human
cauuguaaaagcauuuuguaaua

SEQ ID NO: 3162655 - RNA, 22 nt, Human
cauuguaaaagcauuuuguaau

SEQ ID NO: 3162656 - RNA, 15 nt, Human
cauuguaaaagcauu

SEQ ID NO: 3162657 - RNA, 21 nt, Human
cauuguaaaagcauuuuguaa

SEQ ID NO: 3162658 - RNA, 20 nt, Human
cauuguaaaagcauuuugua

SEQ ID NO: 3162659 - RNA, 16 nt, Human
cauuggaaauuucacg

SEQ ID NO: 3162660 - RNA, 14 nt, Human
cauuggaaauuuca

SEQ ID NO: 3162661 - RNA, 19 nt, Human
cauuggaaauuucacguca

SEQ ID NO: 3162662 - RNA, 13 nt, Human
cauuggaaauuuc

SEQ ID NO: 3162663 - RNA, 16 nt, Human
cauugcuucuucugag

SEQ ID NO: 3162664 - RNA, 15 nt, Human
cauugcuucuucuga

SEQ ID NO: 3162665 - RNA, 13 nt, Human
cauugcuucuucu

SEQ ID NO: 3162666 - RNA, 17 nt, Human
cauugcuuuuaaaacua

SEQ ID NO: 3162667 - RNA, 21 nt, Human
cauugcuuuuaaaacuacuua

SEQ ID NO: 3162668 - RNA, 17 nt, Human
cauuuggagggccuggg

SEQ ID NO: 3162669 - RNA, 15 nt, Human
cauuuggauuggaug

SEQ ID NO: 3162670 - RNA, 18 nt, Human
cauuuggagggccugggc

SEQ ID NO: 3162671 - RNA, 17 nt, Human
cauuugucacacacuuu

SEQ ID NO: 3162672 - RNA, 20 nt, Human
cauuugucauuuucauuagc

SEQ ID NO: 3162673 - RNA, 18 nt, Human
cauuugucauuuucauua

SEQ ID NO: 3162674 - RNA, 17 nt, Human
cauuugucauuuucauu

SEQ ID NO: 3162675 - RNA, 15 nt, Human
cauuugucauuuuca

SEQ ID NO: 3162676 - RNA, 14 nt, Human
cauuugucauuuuc

SEQ ID NO: 3162677 - RNA, 12 nt, Human
cauuugucauuu

SEQ ID NO: 3162678 - RNA, 14 nt, Human
cauuugugaaauga

SEQ ID NO: 3162679 - RNA, 14 nt, Human
cauuuauucugcuc

SEQ ID NO: 3162680 - RNA, 19 nt, Human
cauuuaugguaaucauauu

SEQ ID NO: 3162681 - RNA, 16 nt, Human
cauuuaugguaaucau

SEQ ID NO: 3162682 - RNA, 22 nt, Human
cauuuaugguaaucauauuaga

SEQ ID NO: 3162683 - RNA, 20 nt, Human
cauuuaugguaaucauauua

SEQ ID NO: 3162684 - RNA, 22 nt, Human
cauuucauaauuuguuuccagc

SEQ ID NO: 3162685 - RNA, 21 nt, Human
cauuucaguaaaccugucuga

SEQ ID NO: 3162686 - RNA, 16 nt, Human
cauuucauguccugug

SEQ ID NO: 3162687 - RNA, 18 nt, Human
cauuucauguccauaaaa

SEQ ID NO: 3162688 - RNA, 17 nt, Human
cauuucauccuuucacu

SEQ ID NO: 3162689 - RNA, 14 nt, Human
cauuucauccuuuc

SEQ ID NO: 3162690 - RNA, 14 nt, Human
ccaaucuuacuuug

SEQ ID NO: 3162691 - RNA, 15 nt, Human
ccaaucccugauccc

SEQ ID NO: 3162692 - RNA, 20 nt, Human
ccaaucuuacuuuguaaauu

SEQ ID NO: 3162693 - RNA, 21 nt, Human
ccaaucuuacuuuguaaauuc

SEQ ID NO: 3162694 - RNA, 16 nt, Human
ccaaucuuacuuugua

SEQ ID NO: 3162695 - RNA, 17 nt, Human
ccaaucuuacuuuguaa

SEQ ID NO: 3162696 - RNA, 15 nt, Human
ccaaucuuacuuugu

SEQ ID NO: 3162697 - RNA, 13 nt, Human
ccaagaagcccag

SEQ ID NO: 3162698 - RNA, 18 nt, Human
ccaagaaaggaaaccuuu

SEQ ID NO: 3162699 - RNA, 15 nt, Human
ccaacggccccagcu

SEQ ID NO: 3162700 - RNA, 21 nt, Human
ccaaauggaaacagaggacca

SEQ ID NO: 3162701 - RNA, 13 nt, Human
ccaacgucugugc

SEQ ID NO: 3162702 - RNA, 15 nt, Human
ccaacgucugugcca

SEQ ID NO: 3162703 - RNA, 22 nt, Human
ccaaauggaaaugggcagagca

SEQ ID NO: 3162704 - RNA, 17 nt, Human
ccaaauggaaacagagg

SEQ ID NO: 3162705 - RNA, 15 nt, Human
ccaaggccaaaggaa

SEQ ID NO: 3162706 - RNA, 18 nt, Human
ccaaggaugccccguccc

SEQ ID NO: 3162707 - RNA, 14 nt, Human
ccaagaagcccagg

SEQ ID NO: 3162708 - RNA, 19 nt, Human
ccaagcuggucccacucag

SEQ ID NO: 3162709 - RNA, 12 nt, Human
ccaagcuggucc

SEQ ID NO: 3162710 - RNA, 13 nt, Human
ccaaaugcagcuu

SEQ ID NO: 3162711 - RNA, 15 nt, Human
ccaaaugcagcuuua

SEQ ID NO: 3162712 - RNA, 18 nt, Human
ccaaaugcagcuuuaaaa

SEQ ID NO: 3162713 - RNA, 18 nt, Human
ccaaauaucaccaggacu

SEQ ID NO: 3162714 - RNA, 12 nt, Human
ccaaaugcagcu

SEQ ID NO: 3162715 - RNA, 19 nt, Human
ccaaauagugugaaauaua

SEQ ID NO: 3162716 - RNA, 23 nt, Human
ccaaauaauauguuuccuucccu

SEQ ID NO: 3162717 - RNA, 21 nt, Human
ccaaauaauauguuuccuucc

SEQ ID NO: 3162718 - RNA, 18 nt, Human
ccaaauaaaguuaaaagu

SEQ ID NO: 3162719 - RNA, 17 nt, Human
ccaccgccuccuacagc

SEQ ID NO: 3162720 - RNA, 18 nt, Human
ccaccaucugcugucuuu

SEQ ID NO: 3162721 - RNA, 15 nt, Human
ccaccaucugcuguc

SEQ ID NO: 3162722 - RNA, 14 nt, Human
ccaccaucugcugu

SEQ ID NO: 3162723 - RNA, 13 nt, Human
ccaccaucugcug

SEQ ID NO: 3162724 - RNA, 11 nt, Human
ccaccaucugc

SEQ ID NO: 3162725 - RNA, 19 nt, Human
ccaccgggcugggagcucu

SEQ ID NO: 3162726 - RNA, 18 nt, Human
ccaccaucaugucuggcu

SEQ ID NO: 3162727 - RNA, 18 nt, Human
ccaccaucaccagacagg

SEQ ID NO: 3162728 - RNA, 19 nt, Human
ccaccaucaugucuggcua

SEQ ID NO: 3162729 - RNA, 16 nt, Human
ccaccuuggcugcagg

SEQ ID NO: 3162730 - RNA, 15 nt, Human
ccaccuuggcugcag

SEQ ID NO: 3162731 - RNA, 14 nt, Human
ccaccuuggcugca

SEQ ID NO: 3162732 - RNA, 12 nt, Human
ccaccuuggcug

SEQ ID NO: 3162733 - RNA, 19 nt, Human
ccaccuuggcugcagggag

SEQ ID NO: 3162734 - RNA, 18 nt, Human
ccaccuuggcugcaggga

SEQ ID NO: 3162735 - RNA, 15 nt, Human
ccacgagagcgcagc

SEQ ID NO: 3162736 - RNA, 16 nt, Human
ccacgagagcgcagca

SEQ ID NO: 3162737 - RNA, 18 nt, Human
ccacgcuggaccuugaac

SEQ ID NO: 3162738 - RNA, 20 nt, Human
ccacgcugacuacagggccg

SEQ ID NO: 3162739 - RNA, 19 nt, Human
ccacgcugacuacagggcc

SEQ ID NO: 3162740 - RNA, 15 nt, Human
ccacgccuagccuca

SEQ ID NO: 3162741 - RNA, 13 nt, Human
ccacgcugacuac

SEQ ID NO: 3162742 - RNA, 21 nt, Human
ccacacuucaggcucuucucc

SEQ ID NO: 3162743 - RNA, 20 nt, Human
ccacacuucaggcucuucuc

SEQ ID NO: 3162744 - RNA, 16 nt, Human
ccacacuucaggcucu

SEQ ID NO: 3162745 - RNA, 16 nt, Human
ccaccacgccuagccu

SEQ ID NO: 3162746 - RNA, 15 nt, Human
ccaccacgcccggcu

SEQ ID NO: 3162747 - RNA, 22 nt, Human
ccacagagaaaguacuucucca

SEQ ID NO: 3162748 - RNA, 13 nt, Human
ccacagaggacac

SEQ ID NO: 3162749 - RNA, 14 nt, Human
caggaccccugagu

SEQ ID NO: 3162750 - RNA, 12 nt, Human
caggaccccuga

SEQ ID NO: 3162751 - RNA, 20 nt, Human
caggaccccugcaguucccc

SEQ ID NO: 3162752 - RNA, 15 nt, Human
caggaccccugcagu

SEQ ID NO: 3162753 - RNA, 13 nt, Human
caggaggaagggg

SEQ ID NO: 3162754 - RNA, 14 nt, Human
caggaggccagccu

SEQ ID NO: 3162755 - RNA, 15 nt, Human
caggaggccagccuu

SEQ ID NO: 3162756 - RNA, 16 nt, Human
caggaggccagccuug

SEQ ID NO: 3162757 - RNA, 15 nt, Human
caggagguggucugg

SEQ ID NO: 3162758 - RNA, 18 nt, Human
caggcacccaccaucaug

SEQ ID NO: 3162759 - RNA, 23 nt, Human
caggcacccaccaucaugucugg

SEQ ID NO: 3162760 - RNA, 22 nt, Human
caggcacccaccaucaugucug

SEQ ID NO: 3162761 - RNA, 14 nt, Human
caggaguaaaagag

SEQ ID NO: 3162762 - RNA, 17 nt, Human
caggagguuggagggaa

SEQ ID NO: 3162763 - RNA, 17 nt, Human
caggaggccagccuuga

SEQ ID NO: 3162764 - RNA, 12 nt, Human
caggagggacag

SEQ ID NO: 3162765 - RNA, 15 nt, Human
caggagggaggggga

SEQ ID NO: 3162766 - RNA, 19 nt, Human
caggagggacagucucacc

SEQ ID NO: 3162767 - RNA, 17 nt, Human
caggagggacagucuca

SEQ ID NO: 3162768 - RNA, 16 nt, Human
caggagggacagucuc

SEQ ID NO: 3162769 - RNA, 15 nt, Human
caggagggagcagag

SEQ ID NO: 3162770 - RNA, 20 nt, Human
caggagggacagucucacca

SEQ ID NO: 3162771 - RNA, 23 nt, Human
caggagggagggggaaggcaggg

SEQ ID NO: 3162772 - RNA, 21 nt, Human
caggccagagggagugacaga

SEQ ID NO: 3162773 - RNA, 19 nt, Human
caggccagagggagugaca

SEQ ID NO: 3162774 - RNA, 16 nt, Human
caggccagagggagug

SEQ ID NO: 3162775 - RNA, 15 nt, Human
caggccugacucuca

SEQ ID NO: 3162776 - RNA, 18 nt, Human
caggccucccugccagua

SEQ ID NO: 3162777 - RNA, 17 nt, Human
caggccucccugccagu

SEQ ID NO: 3162778 - RNA, 16 nt, Human
caggccucccugccag

SEQ ID NO: 3162779 - RNA, 13 nt, Human
caggccucccugc

SEQ ID NO: 3162780 - RNA, 23 nt, Human
caggcgcaagggaggcccagcgc

SEQ ID NO: 3162781 - RNA, 22 nt, Human
caggcgcaagggaggcccagcg

SEQ ID NO: 3162782 - RNA, 15 nt, Human
caggcgccccuuccc

SEQ ID NO: 3162783 - RNA, 20 nt, Human
caggccugccuguucccauu

SEQ ID NO: 3162784 - RNA, 20 nt, Human
caggccuacuccugucuucu

SEQ ID NO: 3162785 - RNA, 16 nt, Human
caggcgcuagcacagc

SEQ ID NO: 3162786 - RNA, 17 nt, Human
caggcgccccuuccccc

SEQ ID NO: 3162787 - RNA, 22 nt, Human
caggcgcuagcacagcucccuu

SEQ ID NO: 3162788 - RNA, 20 nt, Human
caggcgcuagcacagcuccc

SEQ ID NO: 3162789 - RNA, 18 nt, Human
caggcuggcccugcccug

SEQ ID NO: 3162790 - RNA, 19 nt, Human
caggcuggcccugcccugg

SEQ ID NO: 3162791 - RNA, 17 nt, Human
caggcuggcccugcccu

SEQ ID NO: 3162792 - RNA, 15 nt, Human
caggcugggcuucag

SEQ ID NO: 3162793 - RNA, 16 nt, Human
caggcugggcuucagu

SEQ ID NO: 3162794 - RNA, 20 nt, Human
caggcuggcccugcccuggu

SEQ ID NO: 3162795 - RNA, 21 nt, Human
caggcuggccuggggucaggc

SEQ ID NO: 3162796 - RNA, 17 nt, Human
cagggaggacgcucucu

SEQ ID NO: 3162797 - RNA, 18 nt, Human
cagggaggacgcucucug

SEQ ID NO: 3162798 - RNA, 17 nt, Human
caggcugggcuucagug

SEQ ID NO: 3162799 - RNA, 12 nt, Human
cagggagggccu

SEQ ID NO: 3162800 - RNA, 13 nt, Human
cagggagggccug

SEQ ID NO: 3162801 - RNA, 18 nt, Human
cagggaggugaccccagg

SEQ ID NO: 3162802 - RNA, 14 nt, Human
cagggagggccugg

SEQ ID NO: 3162803 - RNA, 16 nt, Human
cagggagggccugggc

SEQ ID NO: 3162804 - RNA, 22 nt, Human
cagggaguccgaaagggacuug

SEQ ID NO: 3162805 - RNA, 23 nt, Human
cagggaggugugaggcaggagag

SEQ ID NO: 3162806 - RNA, 22 nt, Human
cagggaggugugaggcaggaga

SEQ ID NO: 3162807 - RNA, 20 nt, Human
cagggaggugugaggcagga

SEQ ID NO: 3162808 - RNA, 15 nt, Human
cagguuugggacccc

SEQ ID NO: 3162809 - RNA, 21 nt, Human
cagguuuaaguagauuucaug

SEQ ID NO: 3162810 - RNA, 18 nt, Human
cagguuuaagcuguuacu

SEQ ID NO: 3162811 - RNA, 16 nt, Human
cagguuuaagcuguua

SEQ ID NO: 3162812 - RNA, 18 nt, Human
cagguuugggaccccugg

SEQ ID NO: 3162813 - RNA, 13 nt, Human
caguauuuuuaaa

SEQ ID NO: 3162814 - RNA, 14 nt, Human
caguauuuuuaaag

SEQ ID NO: 3162815 - RNA, 15 nt, Human
caguauuuuuaaagg

SEQ ID NO: 3162816 - RNA, 17 nt, Human
caguauuuuuaaaggca

SEQ ID NO: 3162817 - RNA, 18 nt, Human
caguauuuuuaaaggcau

SEQ ID NO: 3162818 - RNA, 19 nt, Human
caguauuuuuaaaggcauu

SEQ ID NO: 3162819 - RNA, 22 nt, Human
cagucaccccggccaccugcgg

SEQ ID NO: 3162820 - RNA, 20 nt, Human
cagucaccccggccaccugc

SEQ ID NO: 3162821 - RNA, 19 nt, Human
cagucaccccggccaccug

SEQ ID NO: 3162822 - RNA, 22 nt, Human
caggugcacaagcuccaagcuc

SEQ ID NO: 3162823 - RNA, 17 nt, Human
caggugauccacccacc

SEQ ID NO: 3162824 - RNA, 16 nt, Human
caggugauccacccac

SEQ ID NO: 3162825 - RNA, 12 nt, Human
caggguuggccc

SEQ ID NO: 3162826 - RNA, 14 nt, Human
cagguugguggggg

SEQ ID NO: 3162827 - RNA, 18 nt, Human
caggugcuaggaacacuc

SEQ ID NO: 3162828 - RNA, 20 nt, Human
caggugcuaggaacacuccu

SEQ ID NO: 3162829 - RNA, 14 nt, Human
caggugcgaaagga

SEQ ID NO: 3162830 - RNA, 18 nt, Human
cagggucucacucugucg

SEQ ID NO: 3162831 - RNA, 17 nt, Human
cagggucucacucuguc

SEQ ID NO: 3162832 - RNA, 21 nt, Human
cagggucucacucugucgccc

SEQ ID NO: 3162833 - RNA, 23 nt, Human
cagggucucuagugcugugaaaa

SEQ ID NO: 3162834 - RNA, 20 nt, Human
caggguuggcaccuuccccc

SEQ ID NO: 3162835 - RNA, 13 nt, Human
caggguuggcacc

SEQ ID NO: 3162836 - RNA, 24 nt, Human
cagggugucugcccccuccugagu

SEQ ID NO: 3162837 - RNA, 23 nt, Human
cagggugucugcccccuccugag

SEQ ID NO: 3162838 - RNA, 16 nt, Human
cagggugucugccccc

SEQ ID NO: 3162839 - RNA, 19 nt, Human
cagucucccccacccuugu

SEQ ID NO: 3162840 - RNA, 14 nt, Human
cagucucccucccu

SEQ ID NO: 3162841 - RNA, 15 nt, Human
cagucucaggaaauc

SEQ ID NO: 3162842 - RNA, 21 nt, Human
cagucucaccauuuccccagg

SEQ ID NO: 3162843 - RNA, 20 nt, Human
cagucucaccauuuccccag

SEQ ID NO: 3162844 - RNA, 19 nt, Human
cagucgggggaacugaggc

SEQ ID NO: 3162845 - RNA, 23 nt, Human
cagucgccuuucagcaggcagcc

SEQ ID NO: 3162846 - RNA, 22 nt, Human
cagucgccuuucagcaggcagc

SEQ ID NO: 3162847 - RNA, 21 nt, Human
cagucgccuuucagcaggcag

SEQ ID NO: 3162848 - RNA, 19 nt, Human
cagucgccuuucagcaggc

SEQ ID NO: 3162849 - RNA, 22 nt, Human
cagugcaugcugucccuuacgu

SEQ ID NO: 3162850 - RNA, 23 nt, Human
cagugcaugcugucccuuacgug

SEQ ID NO: 3162851 - RNA, 19 nt, Human
cagugcaugcugucccuua

SEQ ID NO: 3162852 - RNA, 15 nt, Human
cagugcaccugggac

SEQ ID NO: 3162853 - RNA, 20 nt, Human
cagucugauucccaagcucu

SEQ ID NO: 3162854 - RNA, 19 nt, Human
cagucugauucccaagcuc

SEQ ID NO: 3162855 - RNA, 12 nt, Human
cagugcccacag

SEQ ID NO: 3162856 - RNA, 16 nt, Human
cagugggacagggcau

SEQ ID NO: 3162857 - RNA, 19 nt, Human
cagugggacagggcauggc

SEQ ID NO: 3162858 - RNA, 11 nt, Human
cagugggagcu

SEQ ID NO: 3162859 - RNA, 15 nt, Human
cagugccaaaaacaa

SEQ ID NO: 3162860 - RNA, 21 nt, Human
cagcagguccccagcuuuggc

SEQ ID NO: 3162861 - RNA, 19 nt, Human
cagcagucuuaugcuucca

SEQ ID NO: 3162862 - RNA, 17 nt, Human
cagcagucuuaugcuuc

SEQ ID NO: 3162863 - RNA, 13 nt, Human
cagcaccgccucu

SEQ ID NO: 3162864 - RNA, 15 nt, Human
cagcaccgccucuuc

SEQ ID NO: 3162865 - RNA, 14 nt, Human
cagcaccgccucuu

SEQ ID NO: 3162866 - RNA, 12 nt, Human
cagccaggccac

SEQ ID NO: 3162867 - RNA, 13 nt, Human
cagccaggccaca

SEQ ID NO: 3162868 - RNA, 17 nt, Human
cagcaguugaaaagacu

SEQ ID NO: 3162869 - RNA, 22 nt, Human
cagcagucuuaugcuuccagaa

SEQ ID NO: 3162870 - RNA, 21 nt, Human
cagcagucuuaugcuuccaga

SEQ ID NO: 3162871 - RNA, 20 nt, Human
cagcagucuuaugcuuccag

SEQ ID NO: 3162872 - RNA, 21 nt, Human
cagcaguugaaaagacuccaa

SEQ ID NO: 3162873 - RNA, 20 nt, Human
cagcaguugaaaagacucca

SEQ ID NO: 3162874 - RNA, 19 nt, Human
cagcauauucaggaagcuc

SEQ ID NO: 3162875 - RNA, 22 nt, Human
cagcauauucaggaagcucagg

SEQ ID NO: 3162876 - RNA, 23 nt, Human
cagcauauucaggaagcucaggg

SEQ ID NO: 3162877 - RNA, 13 nt, Human
cagagcugccagu

SEQ ID NO: 3162878 - RNA, 12 nt, Human
cagagcugccag

SEQ ID NO: 3162879 - RNA, 16 nt, Human
cagagcugccaccugc

SEQ ID NO: 3162880 - RNA, 18 nt, Human
cagagcugccaccugccu

SEQ ID NO: 3162881 - RNA, 20 nt, Human
cagaaguuugagaucagccu

SEQ ID NO: 3162882 - RNA, 23 nt, Human
cagaaguuucugccgcagcccug

SEQ ID NO: 3162883 - RNA, 22 nt, Human
cagaaguuugagaucagccugg

SEQ ID NO: 3162884 - RNA, 22 nt, Human
cagagggccugcaagggaguga

SEQ ID NO: 3162885 - RNA, 18 nt, Human
cagaggggguggccuccc

SEQ ID NO: 3162886 - RNA, 17 nt, Human
cagaggggguggccucc

SEQ ID NO: 3162887 - RNA, 19 nt, Human
cagaggggguggccuccca

SEQ ID NO: 3162888 - RNA, 20 nt, Human
cagaggggguggccucccaa

SEQ ID NO: 3162889 - RNA, 20 nt, Human
cagagucagaaguuucugcc

SEQ ID NO: 3162890 - RNA, 18 nt, Human
cagaguauuuuuguauuc

SEQ ID NO: 3162891 - RNA, 18 nt, Human
cagccugagcgacaguga

SEQ ID NO: 3162892 - RNA, 13 nt, Human
cagccugagaguc

SEQ ID NO: 3162893 - RNA, 20 nt, Human
cagccucuuucccuuccagu

SEQ ID NO: 3162894 - RNA, 19 nt, Human
cagccugagcgacagugag

SEQ ID NO: 3162895 - RNA, 17 nt, Human
cagcggggacagcuccu

SEQ ID NO: 3162896 - RNA, 16 nt, Human
cagcggggacagcucc

SEQ ID NO: 3162897 - RNA, 14 nt, Human
cagcggggacagcu

SEQ ID NO: 3162898 - RNA, 15 nt, Human
cagcggggacagcuc

SEQ ID NO: 3162899 - RNA, 13 nt, Human
cagcccuuccucu

SEQ ID NO: 3162900 - RNA, 16 nt, Human
cagcccuuccucugcu

SEQ ID NO: 3162901 - RNA, 18 nt, Human
cagcccuuccucugcucc

SEQ ID NO: 3162902 - RNA, 17 nt, Human
cagcccuuccucugcuc

SEQ ID NO: 3162903 - RNA, 20 nt, Human
cagccgagauagccaaggcc

SEQ ID NO: 3162904 - RNA, 23 nt, Human
cagcccuuccucugcucccccuu

SEQ ID NO: 3162905 - RNA, 19 nt, Human
cagcccuuccucugcuccc

SEQ ID NO: 3162906 - RNA, 21 nt, Human
cagccgagauagccaaggcca

SEQ ID NO: 3162907 - RNA, 21 nt, Human
cagccgagcuuuuacucccug

SEQ ID NO: 3162908 - RNA, 19 nt, Human
cagccucuuucccuuccag

SEQ ID NO: 3162909 - RNA, 18 nt, Human
cagccucuuucccuucca

SEQ ID NO: 3162910 - RNA, 16 nt, Human
cagccucuuucccuuc

SEQ ID NO: 3162911 - RNA, 15 nt, Human
cagccucuuucccuu

SEQ ID NO: 3162912 - RNA, 12 nt, Human
cagccccuggau

SEQ ID NO: 3162913 - RNA, 13 nt, Human
cagccccuggaug

SEQ ID NO: 3162914 - RNA, 14 nt, Human
cagccccuggaugc

SEQ ID NO: 3162915 - RNA, 17 nt, Human
cagccccuggaugcagc

SEQ ID NO: 3162916 - RNA, 18 nt, Human
cagccccuggaugcagcc

SEQ ID NO: 3162917 - RNA, 19 nt, Human
cagccccuggaugcagccu

SEQ ID NO: 3162918 - RNA, 21 nt, Human
cagccccuggaugcagccuca

SEQ ID NO: 3162919 - RNA, 21 nt, Human
cagcccuuagcagggaaacag

SEQ ID NO: 3162920 - RNA, 16 nt, Human
cagcccuuagcaggga

SEQ ID NO: 3162921 - RNA, 15 nt, Human
cagcccuuagcaggg

SEQ ID NO: 3162922 - RNA, 23 nt, Human
cagcugcaccccuuccugggcac

SEQ ID NO: 3162923 - RNA, 20 nt, Human
cagcugcaccccuuccuggg

SEQ ID NO: 3162924 - RNA, 17 nt, Human
cagcugcaccccuuccu

SEQ ID NO: 3162925 - RNA, 12 nt, Human
cagcugcacccc

SEQ ID NO: 3162926 - RNA, 16 nt, Human
cagcugcaccccuucc

SEQ ID NO: 3162927 - RNA, 14 nt, Human
cagcugcaccccuu

SEQ ID NO: 3162928 - RNA, 16 nt, Human
cagcuccccucggaga

SEQ ID NO: 3162929 - RNA, 18 nt, Human
cagcuccccucggagaag

SEQ ID NO: 3162930 - RNA, 17 nt, Human
cagcuccccucggagaa

SEQ ID NO: 3162931 - RNA, 18 nt, Human
cagcuucauuuccugugu

SEQ ID NO: 3162932 - RNA, 15 nt, Human
cagcuucauuuccug

SEQ ID NO: 3162933 - RNA, 22 nt, Human
cagcuucacuucugacucuucc

SEQ ID NO: 3162934 - RNA, 18 nt, Human
cagcugugcucuggacag

SEQ ID NO: 3162935 - RNA, 16 nt, Human
cagcuucacuucugac

SEQ ID NO: 3162936 - RNA, 23 nt, Human
caggaaaucaaauaugcaaagca

SEQ ID NO: 3162937 - RNA, 22 nt, Human
caggaaaucaaauaugcaaagc

SEQ ID NO: 3162938 - RNA, 23 nt, Human
caggaaaugcugacccaugggca

SEQ ID NO: 3162939 - RNA, 22 nt, Human
caggaaaugcugacccaugggc

SEQ ID NO: 3162940 - RNA, 21 nt, Human
caggaaaugcugacccauggg

SEQ ID NO: 3162941 - RNA, 20 nt, Human
caggaaaugcugacccaugg

SEQ ID NO: 3162942 - RNA, 16 nt, Human
caggaaaugcugaccc

SEQ ID NO: 3162943 - RNA, 14 nt, Human
caggaaaggcucca

SEQ ID NO: 3162944 - RNA, 15 nt, Human
caggaaaggcuccag

SEQ ID NO: 3162945 - RNA, 15 nt, Human
cagcuccagcucacc

SEQ ID NO: 3162946 - RNA, 14 nt, Human
cagcuccagcucac

SEQ ID NO: 3162947 - RNA, 13 nt, Human
cagcuccagcuca

SEQ ID NO: 3162948 - RNA, 20 nt, Human
cagcuccagcucaccagccc

SEQ ID NO: 3162949 - RNA, 18 nt, Human
cagcuccagcucaccagc

SEQ ID NO: 3162950 - RNA, 17 nt, Human
cagcuccagcucaccag

SEQ ID NO: 3162951 - RNA, 16 nt, Human
cagcuccagcucacca

SEQ ID NO: 3162952 - RNA, 22 nt, Human
cagcuccagcucaccagcccca

SEQ ID NO: 3162953 - RNA, 21 nt, Human
cagcucccaaggcucugagca

SEQ ID NO: 3162954 - RNA, 21 nt, Human
caaacauuuucucuuagaaaa

SEQ ID NO: 3162955 - RNA, 20 nt, Human
caaacauuuucucuuagaaa

SEQ ID NO: 3162956 - RNA, 19 nt, Human
caaacauuuucucuuagaa

SEQ ID NO: 3162957 - RNA, 14 nt, Human
caaacauuggaaga

SEQ ID NO: 3162958 - RNA, 19 nt, Human
caaacauuaguacuuuaua

SEQ ID NO: 3162959 - RNA, 18 nt, Human
caaacauuaguacuuuau

SEQ ID NO: 3162960 - RNA, 17 nt, Human
caaacauuaguacuuua

SEQ ID NO: 3162961 - RNA, 16 nt, Human
caaacauuaguacuuu

SEQ ID NO: 3162962 - RNA, 15 nt, Human
caaacauuaguacuu

SEQ ID NO: 3162963 - RNA, 22 nt, Human
caaacauuaauguugauuucua

SEQ ID NO: 3162964 - RNA, 21 nt, Human
caaacauuaauguugauuucu

SEQ ID NO: 3162965 - RNA, 20 nt, Human
caaacauuaauguugauuuc

SEQ ID NO: 3162966 - RNA, 19 nt, Human
caaacauuaauguugauuu

SEQ ID NO: 3162967 - RNA, 18 nt, Human
caaacauuaauguugauu

SEQ ID NO: 3162968 - RNA, 17 nt, Human
caaacauuaauguugau

SEQ ID NO: 3162969 - RNA, 14 nt, Human
caaacccccauucu

SEQ ID NO: 3162970 - RNA, 19 nt, Human
caaacccccauucuguccu

SEQ ID NO: 3162971 - RNA, 18 nt, Human
caaaccccgaccaccugc

SEQ ID NO: 3162972 - RNA, 17 nt, Human
caaacccugucaaacau

SEQ ID NO: 3162973 - RNA, 13 nt, Human
caaacccugucaa

SEQ ID NO: 3162974 - RNA, 21 nt, Human
caaacccugucaaacauuagu

SEQ ID NO: 3162975 - RNA, 18 nt, Human
caaacccugucaaacauu

SEQ ID NO: 3162976 - RNA, 21 nt, Human
caaaccccgaccaccugccca

SEQ ID NO: 3162977 - RNA, 13 nt, Human
caaaccccugacc

SEQ ID NO: 3162978 - RNA, 15 nt, Human
caaacagucucagga

SEQ ID NO: 3162979 - RNA, 11 nt, Human
caaaaggaaag

SEQ ID NO: 3162980 - RNA, 16 nt, Human
caaaaggaaagcugug

SEQ ID NO: 3162981 - RNA, 20 nt, Human
caaaaggaaagcuguguuua

SEQ ID NO: 3162982 - RNA, 20 nt, Human
caaaagcuucccucccugcu

SEQ ID NO: 3162983 - RNA, 13 nt, Human
caaaagcuucccu

SEQ ID NO: 3162984 - RNA, 17 nt, Human
caaacagucucaggaaa

SEQ ID NO: 3162985 - RNA, 16 nt, Human
caaacagucucaggaa

SEQ ID NO: 3162986 - RNA, 14 nt, Human
caaaaggaauagau

SEQ ID NO: 3162987 - RNA, 15 nt, Human
caaacauuaauguug

SEQ ID NO: 3162988 - RNA, 14 nt, Human
caaacauuaauguu

SEQ ID NO: 3162989 - RNA, 16 nt, Human
auuuuuauaccuguuu

SEQ ID NO: 3162990 - RNA, 13 nt, Human
auuuuuuuguaug

SEQ ID NO: 3162991 - RNA, 18 nt, Human
auuuuuuuuuccuucagu

SEQ ID NO: 3162992 - RNA, 16 nt, Human
auuuuuuugagacaga

SEQ ID NO: 3162993 - RNA, 22 nt, Human
auuuuuuugaacucuucucauu

SEQ ID NO: 3162994 - RNA, 23 nt, Human
auuuuuuugaacucuucucauua

SEQ ID NO: 3162995 - RNA, 21 nt, Human
auuuuuuugaacucuucucau

SEQ ID NO: 3162996 - RNA, 20 nt, Human
auuuuuuuuuccuucagugc

SEQ ID NO: 3162997 - RNA, 22 nt, Human
auuuuuuuuuccuucagugccu

SEQ ID NO: 3162998 - RNA, 17 nt, Human
auuuuuuuuuccuucag

SEQ ID NO: 3162999 - RNA, 14 nt, Human
auuuuuuuguauga

SEQ ID NO: 3163000 - RNA, 17 nt, Human
auuuuuuuguaugaaaa

SEQ ID NO: 3163001 - RNA, 19 nt, Human
caaaagcugggcagguugg

SEQ ID NO: 3163002 - RNA, 15 nt, Human
caaaagagaugaaag

SEQ ID NO: 3163003 - RNA, 22 nt, Human
auuuuauguugacauuuguuug

SEQ ID NO: 3163004 - RNA, 20 nt, Human
auuuuauguugacauuuguu

SEQ ID NO: 3163005 - RNA, 19 nt, Human
auuuuauguugacauuugu

SEQ ID NO: 3163006 - RNA, 18 nt, Human
auuuuauguugacauuug

SEQ ID NO: 3163007 - RNA, 17 nt, Human
auuuuauguugacauuu

SEQ ID NO: 3163008 - RNA, 15 nt, Human
auuuuauguugacau

SEQ ID NO: 3163009 - RNA, 14 nt, Human
auuuuauguugaca

SEQ ID NO: 3163010 - RNA, 13 nt, Human
auuuuauguugac

SEQ ID NO: 3163011 - RNA, 15 nt, Human
auuuuauauaaagua

SEQ ID NO: 3163012 - RNA, 16 nt, Human
auuuuauauaaaguau

SEQ ID NO: 3163013 - RNA, 21 nt, Human
auuuuauauaaaguauucuuu

SEQ ID NO: 3163014 - RNA, 21 nt, Human
auuuuauaucaauuuaaaaaa

SEQ ID NO: 3163015 - RNA, 15 nt, Human
auuuuaggcaaguuu

SEQ ID NO: 3163016 - RNA, 15 nt, Human
auuuuagcuaauuua

SEQ ID NO: 3163017 - RNA, 16 nt, Human
auuuuagcuaauuuag

SEQ ID NO: 3163018 - RNA, 11 nt, Human
auuuucugugu

SEQ ID NO: 3163019 - RNA, 12 nt, Human
auuuucugugug

SEQ ID NO: 3163020 - RNA, 13 nt, Human
auuuucugugugu

SEQ ID NO: 3163021 - RNA, 14 nt, Human
auuuucuguguguu

SEQ ID NO: 3163022 - RNA, 15 nt, Human
auuuucuguguguuc

SEQ ID NO: 3163023 - RNA, 16 nt, Human
auuuucuguguguucc

SEQ ID NO: 3163024 - RNA, 17 nt, Human
auuuucuguguguuccu

SEQ ID NO: 3163025 - RNA, 18 nt, Human
auuuucuguguguuccug

SEQ ID NO: 3163026 - RNA, 19 nt, Human
auuuucuguguguuccugg

SEQ ID NO: 3163027 - RNA, 20 nt, Human
auuuucuguguguuccuggc

SEQ ID NO: 3163028 - RNA, 20 nt, Human
auuuugaagugagaaaauga

SEQ ID NO: 3163029 - RNA, 14 nt, Human
auuuuuaagugguu

SEQ ID NO: 3163030 - RNA, 14 nt, Human
auuuuuagacagag

SEQ ID NO: 3163031 - RNA, 22 nt, Human
auuuuuagccugugucauugcc

SEQ ID NO: 3163032 - RNA, 16 nt, Human
auuuuuagccuguguc

SEQ ID NO: 3163033 - RNA, 17 nt, Human
auuuuuaggacaugaaa

SEQ ID NO: 3163034 - RNA, 14 nt, Human
auuuuuauaagaaa

SEQ ID NO: 3163035 - RNA, 18 nt, Human
auuuuuauaacaucuuua

SEQ ID NO: 3163036 - RNA, 16 nt, Human
caaagucaagccacau

SEQ ID NO: 3163037 - RNA, 20 nt, Human
caaagucagaacaaauucag

SEQ ID NO: 3163038 - RNA, 22 nt, Human
caaagucaugauguuuuuaaaa

SEQ ID NO: 3163039 - RNA, 19 nt, Human
caaagucaugauguuuuua

SEQ ID NO: 3163040 - RNA, 18 nt, Human
caaagucaugauguuuuu

SEQ ID NO: 3163041 - RNA, 17 nt, Human
caaagucaugauguuuu

SEQ ID NO: 3163042 - RNA, 15 nt, Human
caaagucaugauguu

SEQ ID NO: 3163043 - RNA, 22 nt, Human
caaaguagaagucuuagaugua

SEQ ID NO: 3163044 - RNA, 21 nt, Human
caaaguaguacuucuucugua

SEQ ID NO: 3163045 - RNA, 22 nt, Human
caaaguaguacuucuucuguaa

SEQ ID NO: 3163046 - RNA, 18 nt, Human
caaaguauaaauuugugu

SEQ ID NO: 3163047 - RNA, 19 nt, Human
caaaguauaaauuugugua

SEQ ID NO: 3163048 - RNA, 20 nt, Human
caaaguauaaauuuguguaa

SEQ ID NO: 3163049 - RNA, 21 nt, Human
caaaguauaaauuuguguaau

SEQ ID NO: 3163050 - RNA, 17 nt, Human
caaagcauggacauuua

SEQ ID NO: 3163051 - RNA, 24 nt, Human
caaagcauggacauuuagaagaaa

SEQ ID NO: 3163052 - RNA, 22 nt, Human
caaagcagugcaugcugucccu

SEQ ID NO: 3163053 - RNA, 15 nt, Human
caaagcaguggagcc

SEQ ID NO: 3163054 - RNA, 14 nt, Human
caaagcaguugaau

SEQ ID NO: 3163055 - RNA, 21 nt, Human
caaagcaguggagcccaggag

SEQ ID NO: 3163056 - RNA, 18 nt, Human
caaagcagugcaugcugu

SEQ ID NO: 3163057 - RNA, 21 nt, Human
caaagcagugcaugcuguccc

SEQ ID NO: 3163058 - RNA, 21 nt, Human
caaaucuuaacuugaaggagu

SEQ ID NO: 3163059 - RNA, 21 nt, Human
caaaucugcuuuuuaaagaau

SEQ ID NO: 3163060 - RNA, 13 nt, Human
caaaucugucugc

SEQ ID NO: 3163061 - RNA, 13 nt, Human
caaaucuuaagaa

SEQ ID NO: 3163062 - RNA, 14 nt, Human
caaaucugucugcu

SEQ ID NO: 3163063 - RNA, 13 nt, Human
caaaucuuccugg

SEQ ID NO: 3163064 - RNA, 14 nt, Human
caaaucuuaagaaa

SEQ ID NO: 3163065 - RNA, 20 nt, Human
caaaucuuuccauauccaua

SEQ ID NO: 3163066 - RNA, 22 nt, Human
caaaucuuccuggucgaaaguu

SEQ ID NO: 3163067 - RNA, 13 nt, Human
caaaugaaaugua

SEQ ID NO: 3163068 - RNA, 18 nt, Human
caaaugaaauguaugcau

SEQ ID NO: 3163069 - RNA, 18 nt, Human
caaaugaauaaugccuuu

SEQ ID NO: 3163070 - RNA, 22 nt, Human
caaaugaauaaugccuuuguaa

SEQ ID NO: 3163071 - RNA, 23 nt, Human
caaaugaauaaugccuuuguaac

SEQ ID NO: 3163072 - RNA, 13 nt, Human
caaaugacuuuau

SEQ ID NO: 3163073 - RNA, 21 nt, Human
caaaugcaucuuugauguguu

SEQ ID NO: 3163074 - RNA, 22 nt, Human
caaaugcaucuuugauguguug

SEQ ID NO: 3163075 - RNA, 16 nt, Human
caaaugcaucuuugau

SEQ ID NO: 3163076 - RNA, 17 nt, Human
caaaugcaucuuugaug

SEQ ID NO: 3163077 - RNA, 15 nt, Human
caaaugcaucuuuga

SEQ ID NO: 3163078 - RNA, 14 nt, Human
caaaugacuuuauu

SEQ ID NO: 3163079 - RNA, 15 nt, Human
caaaugacuuuauua

SEQ ID NO: 3163080 - RNA, 16 nt, Human
caaaugacuuuauuau

SEQ ID NO: 3163081 - RNA, 17 nt, Human
caaaugacuuuauuauu

SEQ ID NO: 3163082 - RNA, 18 nt, Human
caaaugacuuuauuauuu

SEQ ID NO: 3163083 - RNA, 20 nt, Human
caaaugacuuuauuauuuau

SEQ ID NO: 3163084 - RNA, 21 nt, Human
caaaugacuuuauuauuuauu

SEQ ID NO: 3163085 - RNA, 17 nt, Human
caaaugagacagcaguc

SEQ ID NO: 3163086 - RNA, 21 nt, Human
caaaugcuagaaaaauuguua

SEQ ID NO: 3163087 - RNA, 21 nt, Human
caacacacagauuugagcuca

SEQ ID NO: 3163088 - RNA, 22 nt, Human
caacacacagauuugagcucag

SEQ ID NO: 3163089 - RNA, 18 nt, Human
caacaagaauaaaggcag

SEQ ID NO: 3163090 - RNA, 12 nt, Human
caacaagaagaa

SEQ ID NO: 3163091 - RNA, 18 nt, Human
caacaagaagaauuugaa

SEQ ID NO: 3163092 - RNA, 15 nt, Human
caacaccaaaaaaua

SEQ ID NO: 3163093 - RNA, 23 nt, Human
caacaccaaaaaauaucuaguaa

SEQ ID NO: 3163094 - RNA, 17 nt, Human
caacaccaaaaaauauc

SEQ ID NO: 3163095 - RNA, 16 nt, Human
caagauggcacagggc

SEQ ID NO: 3163096 - RNA, 23 nt, Human
caagauggcacagggcaugaaau

SEQ ID NO: 3163097 - RNA, 20 nt, Human
caagauggcacagggcauga

SEQ ID NO: 3163098 - RNA, 13 nt, Human
caagauggcacag

SEQ ID NO: 3163099 - RNA, 19 nt, Human
caagacccaaaaggcagaa

SEQ ID NO: 3163100 - RNA, 14 nt, Human
caacucuccuccag

SEQ ID NO: 3163101 - RNA, 18 nt, Human
caacuccaacauccacuc

SEQ ID NO: 3163102 - RNA, 17 nt, Human
caacuccaacauccacu

SEQ ID NO: 3163103 - RNA, 14 nt, Human
caacucauugcauc

SEQ ID NO: 3163104 - RNA, 22 nt, Human
caagaauugaagcaggacuaaa

SEQ ID NO: 3163105 - RNA, 23 nt, Human
caacucuaaagugcuaauaauaa

SEQ ID NO: 3163106 - RNA, 22 nt, Human
caagaaugaagguuuuuguaaa

SEQ ID NO: 3163107 - RNA, 19 nt, Human
caacuacuaccuguaauga

SEQ ID NO: 3163108 - RNA, 15 nt, Human
caacuaauuuuugua

SEQ ID NO: 3163109 - RNA, 18 nt, Human
caacuaauuuuuguauuu

SEQ ID NO: 3163110 - RNA, 18 nt, Human
caacuacacaaagcaggc

SEQ ID NO: 3163111 - RNA, 22 nt, Human
caaccccuggaccccagccuca

SEQ ID NO: 3163112 - RNA, 18 nt, Human
caaccccuggaccccagc

SEQ ID NO: 3163113 - RNA, 17 nt, Human
caaccccuggaccccag

SEQ ID NO: 3163114 - RNA, 12 nt, Human
caaccccuggac

SEQ ID NO: 3163115 - RNA, 17 nt, Human
caacucaccccagcccc

SEQ ID NO: 3163116 - RNA, 18 nt, Human
caacucaccccagcccca

SEQ ID NO: 3163117 - RNA, 18 nt, Human
caacccccagcucccgcu

SEQ ID NO: 3163118 - RNA, 15 nt, Human
caaccccucgcccag

SEQ ID NO: 3163119 - RNA, 23 nt, Human
caaccccucgcccagucccagca

SEQ ID NO: 3163120 - RNA, 22 nt, Human
caaccccucgcccagucccagc

SEQ ID NO: 3163121 - RNA, 21 nt, Human
caaccccucgcccagucccag

SEQ ID NO: 3163122 - RNA, 17 nt, Human
caaccccucgcccaguc

SEQ ID NO: 3163123 - RNA, 20 nt, Human
auuucauaccuaucaucuua

SEQ ID NO: 3163124 - RNA, 16 nt, Human
auuucauaauuuguuu

SEQ ID NO: 3163125 - RNA, 20 nt, Human
auuucauaauuuguuuccag

SEQ ID NO: 3163126 - RNA, 23 nt, Human
auuucauaauuuguuuccagcau

SEQ ID NO: 3163127 - RNA, 22 nt, Human
auuucaguuauugucccuggcu

SEQ ID NO: 3163128 - RNA, 19 nt, Human
auuucagaaguuuaaauau

SEQ ID NO: 3163129 - RNA, 21 nt, Human
auuucaguuauugucccuggc

SEQ ID NO: 3163130 - RNA, 13 nt, Human
auuucagaaguuu

SEQ ID NO: 3163131 - RNA, 16 nt, Human
auuucagaaguuuaaa

SEQ ID NO: 3163132 - RNA, 15 nt, Human
auuucagaaguuuaa

SEQ ID NO: 3163133 - RNA, 15 nt, Human
auuucugccauuuca

SEQ ID NO: 3163134 - RNA, 16 nt, Human
auuucugccauuucau

SEQ ID NO: 3163135 - RNA, 17 nt, Human
auuucugccauuucaug

SEQ ID NO: 3163136 - RNA, 18 nt, Human
auuucugccauuucaugu

SEQ ID NO: 3163137 - RNA, 19 nt, Human
auuucugccauuucauguc

SEQ ID NO: 3163138 - RNA, 19 nt, Human
auuucugucacaguaaaaa

SEQ ID NO: 3163139 - RNA, 20 nt, Human
auuucugucacaguaaaaau

SEQ ID NO: 3163140 - RNA, 21 nt, Human
auuucugucacaguaaaaaua

SEQ ID NO: 3163141 - RNA, 23 nt, Human
auuucugucacaguaaaaauaaa

SEQ ID NO: 3163142 - RNA, 18 nt, Human
auuucuguguccuguuuu

SEQ ID NO: 3163143 - RNA, 16 nt, Human
auuuauggguggauuu

SEQ ID NO: 3163144 - RNA, 14 nt, Human
auuucacucuccuu

SEQ ID NO: 3163145 - RNA, 14 nt, Human
auuucacugucugu

SEQ ID NO: 3163146 - RNA, 23 nt, Human
auuucacuugaguggagguuuau

SEQ ID NO: 3163147 - RNA, 15 nt, Human
auuucacuugagugg

SEQ ID NO: 3163148 - RNA, 21 nt, Human
auuucagaaauacagauaaau

SEQ ID NO: 3163149 - RNA, 13 nt, Human
auuucagaaauac

SEQ ID NO: 3163150 - RNA, 21 nt, Human
auuucagaaagccuuucauuu

SEQ ID NO: 3163151 - RNA, 11 nt, Human
auuuauaugua

SEQ ID NO: 3163152 - RNA, 14 nt, Human
auuuauauguaugu

SEQ ID NO: 3163153 - RNA, 16 nt, Human
auuuauauguaugugu

SEQ ID NO: 3163154 - RNA, 13 nt, Human
auuuauauguaug

SEQ ID NO: 3163155 - RNA, 21 nt, Human
auuuauauguauguguuuaga

SEQ ID NO: 3163156 - RNA, 17 nt, Human
auuuauauguauguguu

SEQ ID NO: 3163157 - RNA, 18 nt, Human
auuuauauguauguguuu

SEQ ID NO: 3163158 - RNA, 19 nt, Human
auuuaugaagaaaauacuu

SEQ ID NO: 3163159 - RNA, 16 nt, Human
auuuaugaagaaaaua

SEQ ID NO: 3163160 - RNA, 13 nt, Human
auuuaucuuugau

SEQ ID NO: 3163161 - RNA, 23 nt, Human
auuuaucuugaaggaaaaauuca

SEQ ID NO: 3163162 - RNA, 15 nt, Human
auuuaugaagaaaau

SEQ ID NO: 3163163 - RNA, 16 nt, Human
auuuaucuuugauaac

SEQ ID NO: 3163164 - RNA, 14 nt, Human
auuuaucuuugaua

SEQ ID NO: 3163165 - RNA, 16 nt, Human
auuuaucuugaaggaa

SEQ ID NO: 3163166 - RNA, 12 nt, Human
auuuaucuugaa

SEQ ID NO: 3163167 - RNA, 20 nt, Human
auuuaucuugaaggaaaaau

SEQ ID NO: 3163168 - RNA, 19 nt, Human
auuuaucuugaaggaaaaa

SEQ ID NO: 3163169 - RNA, 16 nt, Human
auuuaauaaaugugcc

SEQ ID NO: 3163170 - RNA, 21 nt, Human
auuuaaugaaagacuguacaa

SEQ ID NO: 3163171 - RNA, 20 nt, Human
auuuaaugaaagacuguaca

SEQ ID NO: 3163172 - RNA, 15 nt, Human
auuuaaugaaagacu

SEQ ID NO: 3163173 - RNA, 16 nt, Human
auuuaaugaaagacug

SEQ ID NO: 3163174 - RNA, 15 nt, Human
auuuauaauacagaa

SEQ ID NO: 3163175 - RNA, 17 nt, Human
auuuauaauacagaauc

SEQ ID NO: 3163176 - RNA, 18 nt, Human
auuuauaauacagaaucu

SEQ ID NO: 3163177 - RNA, 19 nt, Human
auuuauaagaaaaauguga

SEQ ID NO: 3163178 - RNA, 12 nt, Human
auuguguuucua

SEQ ID NO: 3163179 - RNA, 22 nt, Human
auuguguuucuaccggagagag

SEQ ID NO: 3163180 - RNA, 15 nt, Human
auuguuaauugcuga

SEQ ID NO: 3163181 - RNA, 19 nt, Human
auuguuaauugcugaggca

SEQ ID NO: 3163182 - RNA, 16 nt, Human
auuguuaauugcugag

SEQ ID NO: 3163183 - RNA, 18 nt, Human
auuguguugacuuuauaa

SEQ ID NO: 3163184 - RNA, 19 nt, Human
auuguguugacuuuauaaa

SEQ ID NO: 3163185 - RNA, 22 nt, Human
auuguguugacuuuauaaauuu

SEQ ID NO: 3163186 - RNA, 21 nt, Human
auuguaagaaauacuguacaa

SEQ ID NO: 3163187 - RNA, 20 nt, Human
auuguaagaaauacuguaca

SEQ ID NO: 3163188 - RNA, 14 nt, Human
auuguaagaaauac

SEQ ID NO: 3163189 - RNA, 12 nt, Human
auuguaagaaau

SEQ ID NO: 3163190 - RNA, 18 nt, Human
auugcuugagcucaggag

SEQ ID NO: 3163191 - RNA, 14 nt, Human
auugcuuucuuuca

SEQ ID NO: 3163192 - RNA, 21 nt, Human
auuguuguuuguauguauaau

SEQ ID NO: 3163193 - RNA, 20 nt, Human
auuguuguuuguauguauaa

SEQ ID NO: 3163194 - RNA, 18 nt, Human
auuguuguuuguauguau

SEQ ID NO: 3163195 - RNA, 17 nt, Human
auuguuguuuguaugua

SEQ ID NO: 3163196 - RNA, 12 nt, Human
auuaguaagauc

SEQ ID NO: 3163197 - RNA, 21 nt, Human
auuaguaagaucucuuucuaa

SEQ ID NO: 3163198 - RNA, 18 nt, Human
auuaguaagcuagcaaau

SEQ ID NO: 3163199 - RNA, 17 nt, Human
auuaguacuggauuauu

SEQ ID NO: 3163200 - RNA, 15 nt, Human
auuaguacuuuauag

SEQ ID NO: 3163201 - RNA, 13 nt, Human
auuaguacuuuau

SEQ ID NO: 3163202 - RNA, 16 nt, Human
auuaggcaugguuuug

SEQ ID NO: 3163203 - RNA, 18 nt, Human
auuaaauuaguuugugaa

SEQ ID NO: 3163204 - RNA, 16 nt, Human
auuaggauuucaugau

SEQ ID NO: 3163205 - RNA, 14 nt, Human
auuaggauuucaug

SEQ ID NO: 3163206 - RNA, 18 nt, Human
auuaaauuacauuuguaa

SEQ ID NO: 3163207 - RNA, 22 nt, Human
auuaaauuacuauagcaaagua

SEQ ID NO: 3163208 - RNA, 17 nt, Human
auuaaaugcccagcccc

SEQ ID NO: 3163209 - RNA, 19 nt, Human
auuaaaugcccagccccuu

SEQ ID NO: 3163210 - RNA, 16 nt, Human
auuaaaugcuucauuu

SEQ ID NO: 3163211 - RNA, 14 nt, Human
auuaaauguagcuu

SEQ ID NO: 3163212 - RNA, 21 nt, Human
auuaaauguagcuucagucau

SEQ ID NO: 3163213 - RNA, 22 nt, Human
auuaaauguagcuucagucauu

SEQ ID NO: 3163214 - RNA, 24 nt, Human
auuaaauguagcuucagucauuaa

SEQ ID NO: 3163215 - RNA, 14 nt, Human
auuaaauuacauuu

SEQ ID NO: 3163216 - RNA, 17 nt, Human
auuaaauuacauuugua

SEQ ID NO: 3163217 - RNA, 15 nt, Human
auuaaauuacauuug

SEQ ID NO: 3163218 - RNA, 12 nt, Human
auuaaauuacau

SEQ ID NO: 3163219 - RNA, 18 nt, Human
auucaacagguuuuccug

SEQ ID NO: 3163220 - RNA, 12 nt, Human
auucaaauuuau

SEQ ID NO: 3163221 - RNA, 13 nt, Human
auucaaauuuauu

SEQ ID NO: 3163222 - RNA, 21 nt, Human
auucaaauuuauuuccaaugu

SEQ ID NO: 3163223 - RNA, 18 nt, Human
auucaacagcaaguguga

SEQ ID NO: 3163224 - RNA, 21 nt, Human
auucaacagcaagugugaaua

SEQ ID NO: 3163225 - RNA, 22 nt, Human
auucaacagcaagugugaauac

SEQ ID NO: 3163226 - RNA, 19 nt, Human
auuaugguaaaauuuugua

SEQ ID NO: 3163227 - RNA, 15 nt, Human
auuauggaaaaauaa

SEQ ID NO: 3163228 - RNA, 19 nt, Human
auuauggaaaaauaaaacu

SEQ ID NO: 3163229 - RNA, 20 nt, Human
auuauggaaaaauaaaacug

SEQ ID NO: 3163230 - RNA, 22 nt, Human
auuauggaaaaauaaaacuguc

SEQ ID NO: 3163231 - RNA, 16 nt, Human
auuaugcuaagaauuu

SEQ ID NO: 3163232 - RNA, 13 nt, Human
auuaugcuaagaa

SEQ ID NO: 3163233 - RNA, 11 nt, Human
auuaugcuaag

SEQ ID NO: 3163234 - RNA, 21 nt, Human
auucaauaguaauauaauaca

SEQ ID NO: 3163235 - RNA, 17 nt, Human
auucaauaguaauauaa

SEQ ID NO: 3163236 - RNA, 19 nt, Human
auuccugcccugcuguuua

SEQ ID NO: 3163237 - RNA, 15 nt, Human
auuccugcauuugug

SEQ ID NO: 3163238 - RNA, 18 nt, Human
auuccugcauuugugaaa

SEQ ID NO: 3163239 - RNA, 18 nt, Human
auuccugcccugcuguuu

SEQ ID NO: 3163240 - RNA, 21 nt, Human
auuccucaacaguguuuucag

SEQ ID NO: 3163241 - RNA, 22 nt, Human
auucuucuguacgucugacagg

SEQ ID NO: 3163242 - RNA, 20 nt, Human
auucuucugcuucagccucc

SEQ ID NO: 3163243 - RNA, 19 nt, Human
auucuucugcuucagccuc

SEQ ID NO: 3163244 - RNA, 17 nt, Human
auucucuguacauauua

SEQ ID NO: 3163245 - RNA, 14 nt, Human
auucucuguacaua

SEQ ID NO: 3163246 - RNA, 11 nt, Human
auucucuguac

SEQ ID NO: 3163247 - RNA, 14 nt, Human
auucuucugcuuca

SEQ ID NO: 3163248 - RNA, 15 nt, Human
cacuuaaaaaugguu

SEQ ID NO: 3163249 - RNA, 16 nt, Human
cacuuaaaacacguuu

SEQ ID NO: 3163250 - RNA, 22 nt, Human
cacuuaaaacacguuuuaagga

SEQ ID NO: 3163251 - RNA, 19 nt, Human
cacuguugcccaggcuggc

SEQ ID NO: 3163252 - RNA, 18 nt, Human
cacuguugcccaggcugg

SEQ ID NO: 3163253 - RNA, 23 nt, Human
cacuguugcccaggcuggcgugc

SEQ ID NO: 3163254 - RNA, 17 nt, Human
cacuguugcccaggcug

SEQ ID NO: 3163255 - RNA, 13 nt, Human
cacugggcuucua

SEQ ID NO: 3163256 - RNA, 14 nt, Human
cacugcagccucaa

SEQ ID NO: 3163257 - RNA, 19 nt, Human
cacugcagccucaaccucc

SEQ ID NO: 3163258 - RNA, 23 nt, Human
cacugcagccucaaccuccuggg

SEQ ID NO: 3163259 - RNA, 22 nt, Human
cacugcagccucaaccuccugg

SEQ ID NO: 3163260 - RNA, 21 nt, Human
cacugcagccucaaccuccug

SEQ ID NO: 3163261 - RNA, 20 nt, Human
cacugcagccucaaccuccu

SEQ ID NO: 3163262 - RNA, 17 nt, Human
cacugccaugccagcuu

SEQ ID NO: 3163263 - RNA, 23 nt, Human
cacugcagccuccgcuucccugg

SEQ ID NO: 3163264 - RNA, 22 nt, Human
cacugcagccuccgcuucccug

SEQ ID NO: 3163265 - RNA, 21 nt, Human
cacugcagccuccgcuucccu

SEQ ID NO: 3163266 - RNA, 19 nt, Human
cacugcagccuccgcuucc

SEQ ID NO: 3163267 - RNA, 22 nt, Human
cacuuaaguuaguuccacugag

SEQ ID NO: 3163268 - RNA, 20 nt, Human
cacuuaaguuaguuccacug

SEQ ID NO: 3163269 - RNA, 13 nt, Human
cacuuaauucugu

SEQ ID NO: 3163270 - RNA, 14 nt, Human
cacuuaauucuguu

SEQ ID NO: 3163271 - RNA, 15 nt, Human
cacuuaauucuguuc

SEQ ID NO: 3163272 - RNA, 18 nt, Human
cacuuguguuaugaagca

SEQ ID NO: 3163273 - RNA, 12 nt, Human
cacuuuaauggg

SEQ ID NO: 3163274 - RNA, 19 nt, Human
cacuuguugauuaauggaa

SEQ ID NO: 3163275 - RNA, 16 nt, Human
cacuuucuagccagag

SEQ ID NO: 3163276 - RNA, 17 nt, Human
cacuuucuagccagagg

SEQ ID NO: 3163277 - RNA, 13 nt, Human
cacuuucuagcca

SEQ ID NO: 3163278 - RNA, 15 nt, Human
cagaaauaauaaaaa

SEQ ID NO: 3163279 - RNA, 14 nt, Human
cagaaauagacaaa

SEQ ID NO: 3163280 - RNA, 16 nt, Human
cagaaauagacaaaaa

SEQ ID NO: 3163281 - RNA, 20 nt, Human
cagaaauagacaaaaaguau

SEQ ID NO: 3163282 - RNA, 21 nt, Human
cagaaauagacaaaaaguaua

SEQ ID NO: 3163283 - RNA, 19 nt, Human
cagaaauacagauaaauga

SEQ ID NO: 3163284 - RNA, 11 nt, Human
cagaaauacag

SEQ ID NO: 3163285 - RNA, 15 nt, Human
cagaaaucugaggaa

SEQ ID NO: 3163286 - RNA, 14 nt, Human
cagaaaucugagga

SEQ ID NO: 3163287 - RNA, 12 nt, Human
cagaacagcugu

SEQ ID NO: 3163288 - RNA, 20 nt, Human
cagaacagcuguugacucua

SEQ ID NO: 3163289 - RNA, 13 nt, Human
cagaacagcuguu

SEQ ID NO: 3163290 - RNA, 22 nt, Human
cagaaaugucccuuucuucucc

SEQ ID NO: 3163291 - RNA, 17 nt, Human
cagaaaugucccuuucu

SEQ ID NO: 3163292 - RNA, 16 nt, Human
cagaaaugucccuuuc

SEQ ID NO: 3163293 - RNA, 23 nt, Human
cagaaaugucaugagauugcugu

SEQ ID NO: 3163294 - RNA, 11 nt, Human
cagaacaguga

SEQ ID NO: 3163295 - RNA, 14 nt, Human
cagaacagcuucau

SEQ ID NO: 3163296 - RNA, 12 nt, Human
cagaacagugau

SEQ ID NO: 3163297 - RNA, 17 nt, Human
cagaacagugauuacca

SEQ ID NO: 3163298 - RNA, 14 nt, Human
cagaaguuucugcc

SEQ ID NO: 3163299 - RNA, 16 nt, Human
cagaaguuucugccgc

SEQ ID NO: 3163300 - RNA, 19 nt, Human
cagaaguuucucagcuccc

SEQ ID NO: 3163301 - RNA, 15 nt, Human
cagaaguuucucagc

SEQ ID NO: 3163302 - RNA, 23 nt, Human
cacuccagccugagcgacaguga

SEQ ID NO: 3163303 - RNA, 16 nt, Human
cacuaccccuugauuu

SEQ ID NO: 3163304 - RNA, 14 nt, Human
cacuccagccuggg

SEQ ID NO: 3163305 - RNA, 13 nt, Human
cacuccagccugg

SEQ ID NO: 3163306 - RNA, 20 nt, Human
cacucugucgcccagucugg

SEQ ID NO: 3163307 - RNA, 13 nt, Human
cacuccagccuga

SEQ ID NO: 3163308 - RNA, 12 nt, Human
cacuccagccug

SEQ ID NO: 3163309 - RNA, 17 nt, Human
cacuaccaaaggacacu

SEQ ID NO: 3163310 - RNA, 22 nt, Human
cacuaccaaaggacacuuaucc

SEQ ID NO: 3163311 - RNA, 15 nt, Human
cacuaccccuugauu

SEQ ID NO: 3163312 - RNA, 12 nt, Human
cacggccaggcc

SEQ ID NO: 3163313 - RNA, 17 nt, Human
cacggccaggccagagg

SEQ ID NO: 3163314 - RNA, 14 nt, Human
cacggcucacugca

SEQ ID NO: 3163315 - RNA, 14 nt, Human
cacggccuccuuuc

SEQ ID NO: 3163316 - RNA, 12 nt, Human
cacggccuccuu

SEQ ID NO: 3163317 - RNA, 22 nt, Human
cacucuuauugcccacgcugga

SEQ ID NO: 3163318 - RNA, 21 nt, Human
cacucuuauugcccacgcugg

SEQ ID NO: 3163319 - RNA, 20 nt, Human
cacucuuauugcccacgcug

SEQ ID NO: 3163320 - RNA, 19 nt, Human
cacucuuauugcccacgcu

SEQ ID NO: 3163321 - RNA, 16 nt, Human
caccuuggcugcaggg

SEQ ID NO: 3163322 - RNA, 15 nt, Human
caccuuggcugcagg

SEQ ID NO: 3163323 - RNA, 18 nt, Human
caccuuggcugcagggag

SEQ ID NO: 3163324 - RNA, 23 nt, Human
caccuuuauucuggcagaggagg

SEQ ID NO: 3163325 - RNA, 14 nt, Human
caccuuggcugcag

SEQ ID NO: 3163326 - RNA, 13 nt, Human
caccugcccaacc

SEQ ID NO: 3163327 - RNA, 19 nt, Human
caccugcccaaccugcucu

SEQ ID NO: 3163328 - RNA, 18 nt, Human
caccugcccaaccugcuc

SEQ ID NO: 3163329 - RNA, 17 nt, Human
caccuuuguccccaccg

SEQ ID NO: 3163330 - RNA, 14 nt, Human
caccuuucccaucu

SEQ ID NO: 3163331 - RNA, 14 nt, Human
caccuuuauucugg

SEQ ID NO: 3163332 - RNA, 16 nt, Human
caccucacucagcacc

SEQ ID NO: 3163333 - RNA, 15 nt, Human
caccucacucagcac

SEQ ID NO: 3163334 - RNA, 14 nt, Human
caccucacucagca

SEQ ID NO: 3163335 - RNA, 13 nt, Human
caccucacucagc

SEQ ID NO: 3163336 - RNA, 16 nt, Human
caccucacucugcuac

SEQ ID NO: 3163337 - RNA, 21 nt, Human
caccucacucagcaccacuca

SEQ ID NO: 3163338 - RNA, 20 nt, Human
caccucacucagcaccacuc

SEQ ID NO: 3163339 - RNA, 19 nt, Human
caccucacucagcaccacu

SEQ ID NO: 3163340 - RNA, 17 nt, Human
caccucacucagcacca

SEQ ID NO: 3163341 - RNA, 12 nt, Human
caccuacugagu

SEQ ID NO: 3163342 - RNA, 20 nt, Human
caauaaaaucuugaaaaugc

SEQ ID NO: 3163343 - RNA, 18 nt, Human
caaguuuucccugaaguu

SEQ ID NO: 3163344 - RNA, 16 nt, Human
caaguuuucccugaag

SEQ ID NO: 3163345 - RNA, 17 nt, Human
caaguuuuccauauuuu

SEQ ID NO: 3163346 - RNA, 13 nt, Human
caaguuuuaaagu

SEQ ID NO: 3163347 - RNA, 14 nt, Human
caaguuuuaaaguu

SEQ ID NO: 3163348 - RNA, 15 nt, Human
caaguuuuaaaguuc

SEQ ID NO: 3163349 - RNA, 14 nt, Human
caauaaaagcccag

SEQ ID NO: 3163350 - RNA, 16 nt, Human
caauaaaagcccagga

SEQ ID NO: 3163351 - RNA, 15 nt, Human
caauaaaagcccagg

SEQ ID NO: 3163352 - RNA, 22 nt, Human
caauaaaagcccaggagcccau

SEQ ID NO: 3163353 - RNA, 19 nt, Human
caauaaaagcccaggagcc

SEQ ID NO: 3163354 - RNA, 18 nt, Human
caauaaaagcccaggagc

SEQ ID NO: 3163355 - RNA, 17 nt, Human
caauaaaagcccaggag

SEQ ID NO: 3163356 - RNA, 15 nt, Human
caaggcgcuaacuug

SEQ ID NO: 3163357 - RNA, 15 nt, Human
caaggcucugagcaa

SEQ ID NO: 3163358 - RNA, 19 nt, Human
caaggccaaaggaagcaca

SEQ ID NO: 3163359 - RNA, 20 nt, Human
caaggccaaaggaagcacau

SEQ ID NO: 3163360 - RNA, 21 nt, Human
caaggccaaaggaagcacaug

SEQ ID NO: 3163361 - RNA, 12 nt, Human
caaggccaccuc

SEQ ID NO: 3163362 - RNA, 20 nt, Human
caaggccaccucuuccuggc

SEQ ID NO: 3163363 - RNA, 19 nt, Human
caaggccaccucuuccugg

SEQ ID NO: 3163364 - RNA, 14 nt, Human
caaggccaccucuu

SEQ ID NO: 3163365 - RNA, 13 nt, Human
caaggccaccucu

SEQ ID NO: 3163366 - RNA, 15 nt, Human
caaggcccccugccu

SEQ ID NO: 3163367 - RNA, 22 nt, Human
caaggccaccucuuccuggccg

SEQ ID NO: 3163368 - RNA, 21 nt, Human
caaggccaccucuuccuggcc

SEQ ID NO: 3163369 - RNA, 20 nt, Human
caaggcccccugccugcccu

SEQ ID NO: 3163370 - RNA, 17 nt, Human
caaggcccccugccugc

SEQ ID NO: 3163371 - RNA, 18 nt, Human
caaggcaaggcugucaau

SEQ ID NO: 3163372 - RNA, 21 nt, Human
caagaaugaagguuuuuguaa

SEQ ID NO: 3163373 - RNA, 17 nt, Human
caaggcaaggcugucaa

SEQ ID NO: 3163374 - RNA, 16 nt, Human
caaggcaaggcuguca

SEQ ID NO: 3163375 - RNA, 16 nt, Human
caagauugucauuagu

SEQ ID NO: 3163376 - RNA, 20 nt, Human
cacaagcuccaagcucccag

SEQ ID NO: 3163377 - RNA, 13 nt, Human
caaugcuggcugu

SEQ ID NO: 3163378 - RNA, 16 nt, Human
caaucccugaucccug

SEQ ID NO: 3163379 - RNA, 23 nt, Human
caaucccaccaacccucagagcc

SEQ ID NO: 3163380 - RNA, 21 nt, Human
caaugcuggcuguuggcuggg

SEQ ID NO: 3163381 - RNA, 20 nt, Human
caaugcuggcuguuggcugg

SEQ ID NO: 3163382 - RNA, 12 nt, Human
caaugcuggcug

SEQ ID NO: 3163383 - RNA, 16 nt, Human
caauggcagccuuggc

SEQ ID NO: 3163384 - RNA, 22 nt, Human
caaucaguagcuuaagaaaaaa

SEQ ID NO: 3163385 - RNA, 21 nt, Human
caaucaguagcuuaagaaaaa

SEQ ID NO: 3163386 - RNA, 17 nt, Human
caaucaguagcuuaaga

SEQ ID NO: 3163387 - RNA, 22 nt, Human
caaucccaccaacccucagagc

SEQ ID NO: 3163388 - RNA, 17 nt, Human
caaucccaccaacccuc

SEQ ID NO: 3163389 - RNA, 16 nt, Human
caaucccaccaacccu

SEQ ID NO: 3163390 - RNA, 16 nt, Human
caauccaucagugcca

SEQ ID NO: 3163391 - RNA, 17 nt, Human
cacaagagcccaggccu

SEQ ID NO: 3163392 - RNA, 20 nt, Human
cacaagagcccaggccuccu

SEQ ID NO: 3163393 - RNA, 18 nt, Human
cacaagcuccaagcuccc

SEQ ID NO: 3163394 - RNA, 19 nt, Human
cacaagcuccaagcuccca

SEQ ID NO: 3163395 - RNA, 18 nt, Human
cacaagagcccaggccuc

SEQ ID NO: 3163396 - RNA, 19 nt, Human
cacaagagcccaggccucc

SEQ ID NO: 3163397 - RNA, 17 nt, Human
caauggcuauuaacaau

SEQ ID NO: 3163398 - RNA, 20 nt, Human
caauggcuauuaacaauuaa

SEQ ID NO: 3163399 - RNA, 14 nt, Human
cacacauuucacug

SEQ ID NO: 3163400 - RNA, 16 nt, Human
cacacauuucacuguc

SEQ ID NO: 3163401 - RNA, 22 nt, Human
cacacauuucacugucugucug

SEQ ID NO: 3163402 - RNA, 19 nt, Human
cacacauuucacugucugu

SEQ ID NO: 3163403 - RNA, 21 nt, Human
cacaccaaucuuacuuuguaa

SEQ ID NO: 3163404 - RNA, 13 nt, Human
cacagaacccuug

SEQ ID NO: 3163405 - RNA, 10 nt, Human
cacagcucuu

SEQ ID NO: 3163406 - RNA, 18 nt, Human
cacagcucuguccuggga

SEQ ID NO: 3163407 - RNA, 16 nt, Human
cacagcucuguccugg

SEQ ID NO: 3163408 - RNA, 15 nt, Human
cacagcucuguccug

SEQ ID NO: 3163409 - RNA, 15 nt, Human
cacagcucuucucca

SEQ ID NO: 3163410 - RNA, 14 nt, Human
cacagcucuucucc

SEQ ID NO: 3163411 - RNA, 17 nt, Human
cacagcucuucuccagg

SEQ ID NO: 3163412 - RNA, 22 nt, Human
cacagcuccuuuuccagagcau

SEQ ID NO: 3163413 - RNA, 14 nt, Human
cacagcucuguccu

SEQ ID NO: 3163414 - RNA, 11 nt, Human
cacagcucugu

SEQ ID NO: 3163415 - RNA, 12 nt, Human
cacagcuccuuu

SEQ ID NO: 3163416 - RNA, 21 nt, Human
cacagcuccuuuuccagagca

SEQ ID NO: 3163417 - RNA, 13 nt, Human
cacagcuccuuuu

SEQ ID NO: 3163418 - RNA, 16 nt, Human
cacagacccugcccug

SEQ ID NO: 3163419 - RNA, 17 nt, Human
cacagacccugcccugu

SEQ ID NO: 3163420 - RNA, 14 nt, Human
cacagacccugccc

SEQ ID NO: 3163421 - RNA, 18 nt, Human
cacaggcugggcugggca

SEQ ID NO: 3163422 - RNA, 17 nt, Human
cacaggcugggcugggc

SEQ ID NO: 3163423 - RNA, 16 nt, Human
cacaggcugggcuggg

SEQ ID NO: 3163424 - RNA, 13 nt, Human
cacaggcugggcu

SEQ ID NO: 3163425 - RNA, 22 nt, Human
cacaggcugggcugggcacugc

SEQ ID NO: 3163426 - RNA, 19 nt, Human
cacaggcugggcugggcac

SEQ ID NO: 3163427 - RNA, 22 nt, Human
cacaggcugagugcaggcccac

SEQ ID NO: 3163428 - RNA, 21 nt, Human
cacaggcugagugcaggccca

SEQ ID NO: 3163429 - RNA, 20 nt, Human
cacaggcugagugcaggccc

SEQ ID NO: 3163430 - RNA, 18 nt, Human
cacaggcugagugcaggc

SEQ ID NO: 3163431 - RNA, 17 nt, Human
cacaggcugagugcagg

SEQ ID NO: 3163432 - RNA, 14 nt, Human
cacaggcugagugc

SEQ ID NO: 3163433 - RNA, 14 nt, Human
caccaacgucugug

SEQ ID NO: 3163434 - RNA, 13 nt, Human
caccaacccucag

SEQ ID NO: 3163435 - RNA, 19 nt, Human
caccaaaauaagaaaagau

SEQ ID NO: 3163436 - RNA, 18 nt, Human
caccaaaauaagaaaaga

SEQ ID NO: 3163437 - RNA, 17 nt, Human
caccaaaauaagaaaag

SEQ ID NO: 3163438 - RNA, 12 nt, Human
caccaaaauaag

SEQ ID NO: 3163439 - RNA, 17 nt, Human
cacccaccucagccucc

SEQ ID NO: 3163440 - RNA, 18 nt, Human
caccagggaaggggacaa

SEQ ID NO: 3163441 - RNA, 21 nt, Human
caccagggaaggggacaagga

SEQ ID NO: 3163442 - RNA, 13 nt, Human
caccagggaaggg

SEQ ID NO: 3163443 - RNA, 13 nt, Human
caccagccccagu

SEQ ID NO: 3163444 - RNA, 16 nt, Human
caccagccccaaucca

SEQ ID NO: 3163445 - RNA, 15 nt, Human
caccagcccagaagu

SEQ ID NO: 3163446 - RNA, 14 nt, Human
caccagcccagaag

SEQ ID NO: 3163447 - RNA, 18 nt, Human
cacccaccucagccuccc

SEQ ID NO: 3163448 - RNA, 16 nt, Human
cacccaggagccccga

SEQ ID NO: 3163449 - RNA, 11 nt, Human
cacccagccug

SEQ ID NO: 3163450 - RNA, 12 nt, Human
cacccagccugg

SEQ ID NO: 3163451 - RNA, 21 nt, Human
ccugccucuccgccccugagc

SEQ ID NO: 3163452 - RNA, 18 nt, Human
ccugccucuccgccccug

SEQ ID NO: 3163453 - RNA, 17 nt, Human
ccugccucuccgccccu

SEQ ID NO: 3163454 - RNA, 16 nt, Human
ccugccucuccgcccc

SEQ ID NO: 3163455 - RNA, 13 nt, Human
ccugccucuccgc

SEQ ID NO: 3163456 - RNA, 17 nt, Human
ccugcccacaccuccug

SEQ ID NO: 3163457 - RNA, 17 nt, Human
ccugccucagccucccg

SEQ ID NO: 3163458 - RNA, 18 nt, Human
ccugcugagucccaggcu

SEQ ID NO: 3163459 - RNA, 15 nt, Human
ccugcugagucccag

SEQ ID NO: 3163460 - RNA, 23 nt, Human
ccugccucuccgccccugagccc

SEQ ID NO: 3163461 - RNA, 22 nt, Human
ccugccucuccgccccugagcc

SEQ ID NO: 3163462 - RNA, 19 nt, Human
ccugcugagucccaggcug

SEQ ID NO: 3163463 - RNA, 20 nt, Human
ccugcugagucccaggcuga

SEQ ID NO: 3163464 - RNA, 18 nt, Human
ccugcccaccuggccucu

SEQ ID NO: 3163465 - RNA, 19 nt, Human
ccugcccaggccccugcca

SEQ ID NO: 3163466 - RNA, 18 nt, Human
ccugcccaggccccugcc

SEQ ID NO: 3163467 - RNA, 21 nt, Human
ccugcccaggccccugccacc

SEQ ID NO: 3163468 - RNA, 15 nt, Human
ccugccucagccucc

SEQ ID NO: 3163469 - RNA, 16 nt, Human
ccugccucagccuccc

SEQ ID NO: 3163470 - RNA, 18 nt, Human
ccugccaucauguuuaca

SEQ ID NO: 3163471 - RNA, 20 nt, Human
ccugccaucauguuuacaga

SEQ ID NO: 3163472 - RNA, 15 nt, Human
ccugcccaccuggcc

SEQ ID NO: 3163473 - RNA, 17 nt, Human
ccugcccaccuggccuc

SEQ ID NO: 3163474 - RNA, 21 nt, Human
ccugaguuccuagccaccgcc

SEQ ID NO: 3163475 - RNA, 20 nt, Human
ccugaguuccuagccaccgc

SEQ ID NO: 3163476 - RNA, 18 nt, Human
ccugaguuccuagccacc

SEQ ID NO: 3163477 - RNA, 14 nt, Human
ccugaguuccugag

SEQ ID NO: 3163478 - RNA, 13 nt, Human
ccugaguuccuga

SEQ ID NO: 3163479 - RNA, 18 nt, Human
ccugaguugaagagggga

SEQ ID NO: 3163480 - RNA, 15 nt, Human
ccugaguugaagagg

SEQ ID NO: 3163481 - RNA, 13 nt, Human
ccugaguugaaga

SEQ ID NO: 3163482 - RNA, 22 nt, Human
ccugaguuccugaggugaugaa

SEQ ID NO: 3163483 - RNA, 22 nt, Human
ccugauauugaaguaaaaaauu

SEQ ID NO: 3163484 - RNA, 12 nt, Human
ccugcaggcagc

SEQ ID NO: 3163485 - RNA, 13 nt, Human
ccugcaggcagcc

SEQ ID NO: 3163486 - RNA, 14 nt, Human
ccugcaggcagcca

SEQ ID NO: 3163487 - RNA, 19 nt, Human
ccugaguuccuagccaccg

SEQ ID NO: 3163488 - RNA, 23 nt, Human
ccugaggugaugaagacagcccg

SEQ ID NO: 3163489 - RNA, 18 nt, Human
ccugagaucucugcagga

SEQ ID NO: 3163490 - RNA, 22 nt, Human
ccugagaugguaugcacaauuc

SEQ ID NO: 3163491 - RNA, 17 nt, Human
ccugagaucucugcagg

SEQ ID NO: 3163492 - RNA, 18 nt, Human
ccugaccccucauagccc

SEQ ID NO: 3163493 - RNA, 16 nt, Human
ccucggauccccuucc

SEQ ID NO: 3163494 - RNA, 20 nt, Human
ccucggaucagcugagccuu

SEQ ID NO: 3163495 - RNA, 17 nt, Human
ccucggaucagcugagc

SEQ ID NO: 3163496 - RNA, 15 nt, Human
ccucggaucagcuga

SEQ ID NO: 3163497 - RNA, 17 nt, Human
ccucggauccccuuccu

SEQ ID NO: 3163498 - RNA, 15 nt, Human
ccucuuugagugaag

SEQ ID NO: 3163499 - RNA, 19 nt, Human
ccucuuucccucccuuccu

SEQ ID NO: 3163500 - RNA, 15 nt, Human
ccucuuucccuucca

SEQ ID NO: 3163501 - RNA, 18 nt, Human
ccucuuucccuuccaguu

SEQ ID NO: 3163502 - RNA, 16 nt, Human
ccucuuucccuuccag

SEQ ID NO: 3163503 - RNA, 16 nt, Human
ccucuuucccucccuu

SEQ ID NO: 3163504 - RNA, 14 nt, Human
ccucuugccacugc

SEQ ID NO: 3163505 - RNA, 22 nt, Human
ccucuugccacugccucuuccu

SEQ ID NO: 3163506 - RNA, 23 nt, Human
ccucuugccacugccucuuccuc

SEQ ID NO: 3163507 - RNA, 22 nt, Human
ccuggugguucacucuuggagc

SEQ ID NO: 3163508 - RNA, 13 nt, Human
ccuggugguucac

SEQ ID NO: 3163509 - RNA, 12 nt, Human
ccuggugguuca

SEQ ID NO: 3163510 - RNA, 13 nt, Human
ccugguguggaag

SEQ ID NO: 3163511 - RNA, 15 nt, Human
ccuggugguuucugu

SEQ ID NO: 3163512 - RNA, 16 nt, Human
ccugguuuccugcccu

SEQ ID NO: 3163513 - RNA, 23 nt, Human
ccugguucaagcgauucucuugc

SEQ ID NO: 3163514 - RNA, 18 nt, Human
ccugguuuccugcccugg

SEQ ID NO: 3163515 - RNA, 19 nt, Human
ccugguuuccugcccuggg

SEQ ID NO: 3163516 - RNA, 20 nt, Human
ccugguuuccugcccuggga

SEQ ID NO: 3163517 - RNA, 21 nt, Human
ccugguuuccugcccugggag

SEQ ID NO: 3163518 - RNA, 15 nt, Human
ccugguggcaguggg

SEQ ID NO: 3163519 - RNA, 19 nt, Human
ccugguggcagugggagcu

SEQ ID NO: 3163520 - RNA, 18 nt, Human
ccugguggcagugggagc

SEQ ID NO: 3163521 - RNA, 15 nt, Human
ccuggggagaaagua

SEQ ID NO: 3163522 - RNA, 22 nt, Human
ccugggcuuuuguuuugcuuuu

SEQ ID NO: 3163523 - RNA, 19 nt, Human
ccuggggcgcgugaggccc

SEQ ID NO: 3163524 - RNA, 22 nt, Human
ccuggggcgcgugaggcccgug

SEQ ID NO: 3163525 - RNA, 18 nt, Human
ccuggggaaccugacccc

SEQ ID NO: 3163526 - RNA, 19 nt, Human
ccugggcucucgcggccuc

SEQ ID NO: 3163527 - RNA, 22 nt, Human
ccuggccuugggauccaggccc

SEQ ID NO: 3163528 - RNA, 20 nt, Human
ccuggccuugggauccaggc

SEQ ID NO: 3163529 - RNA, 17 nt, Human
ccuggccugucucggaa

SEQ ID NO: 3163530 - RNA, 13 nt, Human
ccuggccugucuc

SEQ ID NO: 3163531 - RNA, 17 nt, Human
ccuggccugucugugaa

SEQ ID NO: 3163532 - RNA, 13 nt, Human
ccuggccugucug

SEQ ID NO: 3163533 - RNA, 15 nt, Human
ccuggauggggcugc

SEQ ID NO: 3163534 - RNA, 17 nt, Human
ccuggauggggcugcac

SEQ ID NO: 3163535 - RNA, 18 nt, Human
ccuggauggggcugcacc

SEQ ID NO: 3163536 - RNA, 16 nt, Human
ccuggccccucagggu

SEQ ID NO: 3163537 - RNA, 18 nt, Human
ccuggccccucagggucc

SEQ ID NO: 3163538 - RNA, 20 nt, Human
ccuggccccucagggucccu

SEQ ID NO: 3163539 - RNA, 21 nt, Human
ccuggccccucagggucccug

SEQ ID NO: 3163540 - RNA, 22 nt, Human
ccuggccucaagugauucuccu

SEQ ID NO: 3163541 - RNA, 20 nt, Human
ccuggccugagcugggauga

SEQ ID NO: 3163542 - RNA, 17 nt, Human
ccugucucuacuaaaaa

SEQ ID NO: 3163543 - RNA, 19 nt, Human
ccugguuuuuggauuaaau

SEQ ID NO: 3163544 - RNA, 22 nt, Human
ccugguuuuuggauuaaauuag

SEQ ID NO: 3163545 - RNA, 22 nt, Human
ccugguuuccugcccugggagg

SEQ ID NO: 3163546 - RNA, 13 nt, Human
ccuguaaacacuc

SEQ ID NO: 3163547 - RNA, 16 nt, Human
ccuguaaacacucagc

SEQ ID NO: 3163548 - RNA, 19 nt, Human
ccuguaaacacucagcugu

SEQ ID NO: 3163549 - RNA, 20 nt, Human
ccuguaaacacucagcuguu

SEQ ID NO: 3163550 - RNA, 12 nt, Human
ccuagccaccca

SEQ ID NO: 3163551 - RNA, 17 nt, Human
ccuaauuaauuucagua

SEQ ID NO: 3163552 - RNA, 16 nt, Human
ccuagccacccaccac

SEQ ID NO: 3163553 - RNA, 20 nt, Human
ccuagccugugccucuggga

SEQ ID NO: 3163554 - RNA, 14 nt, Human
ccuaauuaauuuca

SEQ ID NO: 3163555 - RNA, 21 nt, Human
ccuaauuaauauauuaaaauu

SEQ ID NO: 3163556 - RNA, 15 nt, Human
ccuaauggugaugca

SEQ ID NO: 3163557 - RNA, 21 nt, Human
ccuaaugcgcaggcuggcccu

SEQ ID NO: 3163558 - RNA, 20 nt, Human
ccuaaugcgcaggcuggccc

SEQ ID NO: 3163559 - RNA, 12 nt, Human
ccgugagcccuu

SEQ ID NO: 3163560 - RNA, 12 nt, Human
ccuaauaaaacu

SEQ ID NO: 3163561 - RNA, 14 nt, Human
ccuaauaaaacuga

SEQ ID NO: 3163562 - RNA, 15 nt, Human
ccuaauaaaacugau

SEQ ID NO: 3163563 - RNA, 16 nt, Human
ccuaauaaaacugaug

SEQ ID NO: 3163564 - RNA, 18 nt, Human
ccuaauaaaacugaugug

SEQ ID NO: 3163565 - RNA, 19 nt, Human
ccuaauaaaacugauguga

SEQ ID NO: 3163566 - RNA, 21 nt, Human
ccuaauaaaacugaugugaaa

SEQ ID NO: 3163567 - RNA, 22 nt, Human
ccuaauaaaacugaugugaaac

SEQ ID NO: 3163568 - RNA, 23 nt, Human
ccuaauaaaacugaugugaaacu

SEQ ID NO: 3163569 - RNA, 13 nt, Human
ccgucuuccucca

SEQ ID NO: 3163570 - RNA, 17 nt, Human
ccgugaagauacuuugu

SEQ ID NO: 3163571 - RNA, 18 nt, Human
ccgugaagauacuuugua

SEQ ID NO: 3163572 - RNA, 20 nt, Human
ccgugaagauacuuuguauu

SEQ ID NO: 3163573 - RNA, 23 nt, Human
ccuagccugugccucugggacug

SEQ ID NO: 3163574 - RNA, 19 nt, Human
ccuagccuuagaagucaca

SEQ ID NO: 3163575 - RNA, 22 nt, Human
ccuagccuuagaagucacacag

SEQ ID NO: 3163576 - RNA, 18 nt, Human
ccggccaccugcggugcu

SEQ ID NO: 3163577 - RNA, 14 nt, Human
ccggcccaguuuug

SEQ ID NO: 3163578 - RNA, 17 nt, Human
ccggccaggugccuccu

SEQ ID NO: 3163579 - RNA, 18 nt, Human
ccggccaggugccuccug

SEQ ID NO: 3163580 - RNA, 19 nt, Human
ccggccaggugccuccuga

SEQ ID NO: 3163581 - RNA, 20 nt, Human
ccggccaggugccuccugac

SEQ ID NO: 3163582 - RNA, 14 nt, Human
ccggccaguggcgg

SEQ ID NO: 3163583 - RNA, 20 nt, Human
ccggccaguggcggaaguga

SEQ ID NO: 3163584 - RNA, 17 nt, Human
ccggccaccugcggugc

SEQ ID NO: 3163585 - RNA, 23 nt, Human
ccguacgacucuuuuccaaacac

SEQ ID NO: 3163586 - RNA, 16 nt, Human
ccguaaaaacugaagu

SEQ ID NO: 3163587 - RNA, 12 nt, Human
ccguaaaaacug

SEQ ID NO: 3163588 - RNA, 20 nt, Human
ccguaaaaacugaaguucug

SEQ ID NO: 3163589 - RNA, 14 nt, Human
ccgucccccucugg

SEQ ID NO: 3163590 - RNA, 17 nt, Human
ccguccccucccaggga

SEQ ID NO: 3163591 - RNA, 16 nt, Human
ccguccccucccaggg

SEQ ID NO: 3163592 - RNA, 15 nt, Human
ccguccccucccagg

SEQ ID NO: 3163593 - RNA, 14 nt, Human
ccguccccucccag

SEQ ID NO: 3163594 - RNA, 11 nt, Human
ccguccccucc

SEQ ID NO: 3163595 - RNA, 23 nt, Human
ccggcaauaaaagcccaggagcc

SEQ ID NO: 3163596 - RNA, 20 nt, Human
ccggcaauaaaagcccagga

SEQ ID NO: 3163597 - RNA, 19 nt, Human
ccggcaauaaaagcccagg

SEQ ID NO: 3163598 - RNA, 23 nt, Human
ccgcagagaagugacgguuccua

SEQ ID NO: 3163599 - RNA, 17 nt, Human
ccgacagcuuuccagua

SEQ ID NO: 3163600 - RNA, 15 nt, Human
ccgacagcuuuccag

SEQ ID NO: 3163601 - RNA, 22 nt, Human
ccgacagccuggcacagggcag

SEQ ID NO: 3163602 - RNA, 15 nt, Human
ccgacagccuggcac

SEQ ID NO: 3163603 - RNA, 12 nt, Human
ccgacagccugg

SEQ ID NO: 3163604 - RNA, 14 nt, Human
ccgacagccuggca

SEQ ID NO: 3163605 - RNA, 13 nt, Human
ccgacagccuggc

SEQ ID NO: 3163606 - RNA, 23 nt, Human
ccgaaaggucaccucacucagca

SEQ ID NO: 3163607 - RNA, 15 nt, Human
ccgaaaugcugucuu

SEQ ID NO: 3163608 - RNA, 22 nt, Human
ccgaaaggucaccucacucagc

SEQ ID NO: 3163609 - RNA, 18 nt, Human
ccgaacugggcauauuuc

SEQ ID NO: 3163610 - RNA, 17 nt, Human
ccgaacuguuguauaaa

SEQ ID NO: 3163611 - RNA, 14 nt, Human
cccuucucuccagc

SEQ ID NO: 3163612 - RNA, 21 nt, Human
cccuuuuuuggcugcugaagg

SEQ ID NO: 3163613 - RNA, 22 nt, Human
cccuuuuuuggcugcugaaggc

SEQ ID NO: 3163614 - RNA, 23 nt, Human
cccuuuuuuggcugcugaaggcu

SEQ ID NO: 3163615 - RNA, 23 nt, Human
cccugugaguacuacaguccucc

SEQ ID NO: 3163616 - RNA, 15 nt, Human
cccugugauggggcc

SEQ ID NO: 3163617 - RNA, 21 nt, Human
cccugugaguacuacaguccu

SEQ ID NO: 3163618 - RNA, 14 nt, Human
cccuccuuucacca

SEQ ID NO: 3163619 - RNA, 19 nt, Human
cccuccuucccacucuucu

SEQ ID NO: 3163620 - RNA, 13 nt, Human
cccuccuucccac

SEQ ID NO: 3163621 - RNA, 14 nt, Human
ccgcagcccugcag

SEQ ID NO: 3163622 - RNA, 18 nt, Human
ccgcagcccugcagaggg

SEQ ID NO: 3163623 - RNA, 15 nt, Human
ccuccuagccaccca

SEQ ID NO: 3163624 - RNA, 14 nt, Human
ccuccgccucuugg

SEQ ID NO: 3163625 - RNA, 14 nt, Human
ccuccgcuucccug

SEQ ID NO: 3163626 - RNA, 19 nt, Human
ccuccggccaggugccucc

SEQ ID NO: 3163627 - RNA, 20 nt, Human
ccuccggccaggugccuccu

SEQ ID NO: 3163628 - RNA, 21 nt, Human
ccuccggccaggugccuccug

SEQ ID NO: 3163629 - RNA, 15 nt, Human
ccuccgcggcgggcc

SEQ ID NO: 3163630 - RNA, 18 nt, Human
ccuccgcggcgggcccug

SEQ ID NO: 3163631 - RNA, 13 nt, Human
ccuccgccucuug

SEQ ID NO: 3163632 - RNA, 16 nt, Human
ccucccuucucuucac

SEQ ID NO: 3163633 - RNA, 20 nt, Human
ccucccuuggggccuaugca

SEQ ID NO: 3163634 - RNA, 14 nt, Human
ccucggagaagagc

SEQ ID NO: 3163635 - RNA, 12 nt, Human
ccucggagaaga

SEQ ID NO: 3163636 - RNA, 14 nt, Human
ccucgcuucuuuca

SEQ ID NO: 3163637 - RNA, 19 nt, Human
ccucggacuuagcugggag

SEQ ID NO: 3163638 - RNA, 20 nt, Human
ccucggacuuagcugggaga

SEQ ID NO: 3163639 - RNA, 23 nt, Human
ccucgcccagucccagcagccag

SEQ ID NO: 3163640 - RNA, 20 nt, Human
ccucgcccagucccagcagc

SEQ ID NO: 3163641 - RNA, 23 nt, Human
ccucgcaggccucccugccagua

SEQ ID NO: 3163642 - RNA, 22 nt, Human
ccucgcaggccucccugccagu

SEQ ID NO: 3163643 - RNA, 21 nt, Human
ccucgcaggccucccugccag

SEQ ID NO: 3163644 - RNA, 19 nt, Human
ccucgcccagucccagcag

SEQ ID NO: 3163645 - RNA, 18 nt, Human
ccucgcccagucccagca

SEQ ID NO: 3163646 - RNA, 17 nt, Human
ccucgcccagucccagc

SEQ ID NO: 3163647 - RNA, 16 nt, Human
ccucgcccagucccag

SEQ ID NO: 3163648 - RNA, 15 nt, Human
ccucgcccaguccca

SEQ ID NO: 3163649 - RNA, 13 nt, Human
ccucgcccagucc

SEQ ID NO: 3163650 - RNA, 12 nt, Human
ccucgcccaguc

SEQ ID NO: 3163651 - RNA, 18 nt, Human
ccuccuuuucacaguucu

SEQ ID NO: 3163652 - RNA, 19 nt, Human
ccucgcaggccucccugcc

SEQ ID NO: 3163653 - RNA, 16 nt, Human
ccucgaacuccuggca

SEQ ID NO: 3163654 - RNA, 23 nt, Human
ccuccuuugugaggaagccgcug

SEQ ID NO: 3163655 - RNA, 20 nt, Human
ccuccuuugugaggaagccg

SEQ ID NO: 3163656 - RNA, 19 nt, Human
ccuccuaucagaaguuucu

SEQ ID NO: 3163657 - RNA, 16 nt, Human
ccucaacaccucugca

SEQ ID NO: 3163658 - RNA, 23 nt, Human
ccucaaaugaugugccugcuuca

SEQ ID NO: 3163659 - RNA, 17 nt, Human
ccucaacaguguuuuca

SEQ ID NO: 3163660 - RNA, 21 nt, Human
ccucaacucuccuccagaguc

SEQ ID NO: 3163661 - RNA, 23 nt, Human
ccucaacucuccuccagagucag

SEQ ID NO: 3163662 - RNA, 19 nt, Human
ccucaacucuccuccagag

SEQ ID NO: 3163663 - RNA, 15 nt, Human
ccucaaccuccuggg

SEQ ID NO: 3163664 - RNA, 23 nt, Human
ccucaaauccaggacccugccag

SEQ ID NO: 3163665 - RNA, 19 nt, Human
ccucaaauccaggacccug

SEQ ID NO: 3163666 - RNA, 18 nt, Human
ccucaaauccaggacccu

SEQ ID NO: 3163667 - RNA, 17 nt, Human
ccucaaauccaggaccc

SEQ ID NO: 3163668 - RNA, 16 nt, Human
ccucaaauccaggacc

SEQ ID NO: 3163669 - RNA, 19 nt, Human
ccucaaaugaugugccugc

SEQ ID NO: 3163670 - RNA, 24 nt, Human
ccucaaauccaggacccugccagg

SEQ ID NO: 3163671 - RNA, 14 nt, Human
ccucaaauccagga

SEQ ID NO: 3163672 - RNA, 18 nt, Human
ccucauuagcauuuugcu

SEQ ID NO: 3163673 - RNA, 21 nt, Human
ccucauuccaccuucccaugc

SEQ ID NO: 3163674 - RNA, 22 nt, Human
ccucauucccucgucuuuccca

SEQ ID NO: 3163675 - RNA, 21 nt, Human
ccucauucccucgucuuuccc

SEQ ID NO: 3163676 - RNA, 15 nt, Human
ccucauucccucguc

SEQ ID NO: 3163677 - RNA, 12 nt, Human
ccucaggcaggu

SEQ ID NO: 3163678 - RNA, 18 nt, Human
ccucaggcaggugggaug

SEQ ID NO: 3163679 - RNA, 20 nt, Human
ccucaagugauucuccugcc

SEQ ID NO: 3163680 - RNA, 14 nt, Human
ccucaacucugcug

SEQ ID NO: 3163681 - RNA, 15 nt, Human
ccucaacucugcuga

SEQ ID NO: 3163682 - RNA, 16 nt, Human
ccucaacucugcugag

SEQ ID NO: 3163683 - RNA, 18 nt, Human
ccucaacucugcugaggg

SEQ ID NO: 3163684 - RNA, 19 nt, Human
ccucaacucugcugagggu

SEQ ID NO: 3163685 - RNA, 20 nt, Human
ccucaacucugcugaggguc

SEQ ID NO: 3163686 - RNA, 17 nt, Human
ccucccaucacccgcua

SEQ ID NO: 3163687 - RNA, 17 nt, Human
ccuccaagaccuucucc

SEQ ID NO: 3163688 - RNA, 19 nt, Human
ccuccaagaccuucuccuu

SEQ ID NO: 3163689 - RNA, 16 nt, Human
ccuccaagaccuucuc

SEQ ID NO: 3163690 - RNA, 12 nt, Human
ccucccaucacc

SEQ ID NO: 3163691 - RNA, 21 nt, Human
ccucccagggagcaagggcag

SEQ ID NO: 3163692 - RNA, 18 nt, Human
ccucccagggagcaaggg

SEQ ID NO: 3163693 - RNA, 23 nt, Human
ccagggggccagucccugaggca

SEQ ID NO: 3163694 - RNA, 22 nt, Human
ccagggggcuuccugaggggag

SEQ ID NO: 3163695 - RNA, 13 nt, Human
ccagggggcuucc

SEQ ID NO: 3163696 - RNA, 23 nt, Human
ccagggggcuuccugaggggaga

SEQ ID NO: 3163697 - RNA, 22 nt, Human
ccaggggucuugcaaaauuccu

SEQ ID NO: 3163698 - RNA, 14 nt, Human
ccagucaggcucuc

SEQ ID NO: 3163699 - RNA, 15 nt, Human
ccagucccugaggca

SEQ ID NO: 3163700 - RNA, 14 nt, Human
ccaguccccuuccc

SEQ ID NO: 3163701 - RNA, 14 nt, Human
ccagucccccugcc

SEQ ID NO: 3163702 - RNA, 18 nt, Human
ccagucccccugccccag

SEQ ID NO: 3163703 - RNA, 18 nt, Human
ccaguccccuucccguga

SEQ ID NO: 3163704 - RNA, 14 nt, Human
ccaggcaggucuug

SEQ ID NO: 3163705 - RNA, 12 nt, Human
ccaggcaggucu

SEQ ID NO: 3163706 - RNA, 23 nt, Human
ccaggcaggucuugaacuccugg

SEQ ID NO: 3163707 - RNA, 14 nt, Human
ccaggcugcucuca

SEQ ID NO: 3163708 - RNA, 21 nt, Human
ccaggcugcucuugaacuccu

SEQ ID NO: 3163709 - RNA, 12 nt, Human
ccaggcuggcgu

SEQ ID NO: 3163710 - RNA, 23 nt, Human
ccaggcugcucucaaaccccuga

SEQ ID NO: 3163711 - RNA, 21 nt, Human
ccaggggaaaaucagccugcu

SEQ ID NO: 3163712 - RNA, 17 nt, Human
ccaggggaccuccuggg

SEQ ID NO: 3163713 - RNA, 23 nt, Human
ccaggauauauuuuauuuuuaga

SEQ ID NO: 3163714 - RNA, 16 nt, Human
ccaggauauauuuuau

SEQ ID NO: 3163715 - RNA, 23 nt, Human
ccagccccuucugacccaugcug

SEQ ID NO: 3163716 - RNA, 24 nt, Human
ccagccccuucugacccaugcugc

SEQ ID NO: 3163717 - RNA, 18 nt, Human
ccagccccuucugaccca

SEQ ID NO: 3163718 - RNA, 13 nt, Human
ccagcuccacccc

SEQ ID NO: 3163719 - RNA, 12 nt, Human
ccagcuccaccc

SEQ ID NO: 3163720 - RNA, 19 nt, Human
ccagcuccccccaccuccc

SEQ ID NO: 3163721 - RNA, 14 nt, Human
ccagcuccccccac

SEQ ID NO: 3163722 - RNA, 15 nt, Human
ccagcuccaccccgc

SEQ ID NO: 3163723 - RNA, 12 nt, Human
ccagcagagcac

SEQ ID NO: 3163724 - RNA, 13 nt, Human
ccagcagagcacc

SEQ ID NO: 3163725 - RNA, 14 nt, Human
ccagcagagcaccu

SEQ ID NO: 3163726 - RNA, 17 nt, Human
ccagccccagugcccac

SEQ ID NO: 3163727 - RNA, 15 nt, Human
ccagccccauccucu

SEQ ID NO: 3163728 - RNA, 17 nt, Human
ccagccccauccucugu

SEQ ID NO: 3163729 - RNA, 17 nt, Human
ccacuccugcucugcuc

SEQ ID NO: 3163730 - RNA, 16 nt, Human
ccacuccugcucugcu

SEQ ID NO: 3163731 - RNA, 13 nt, Human
ccacuccugcucu

SEQ ID NO: 3163732 - RNA, 17 nt, Human
ccagcacuucaggaggc

SEQ ID NO: 3163733 - RNA, 16 nt, Human
ccagcuuuucauugcu

SEQ ID NO: 3163734 - RNA, 19 nt, Human
ccauucuguccuaccuuua

SEQ ID NO: 3163735 - RNA, 15 nt, Human
cccaacucaccccag

SEQ ID NO: 3163736 - RNA, 16 nt, Human
cccaacucaccccagc

SEQ ID NO: 3163737 - RNA, 21 nt, Human
ccauuucauuugugccagaau

SEQ ID NO: 3163738 - RNA, 22 nt, Human
ccauuucauuugugccagaaug

SEQ ID NO: 3163739 - RNA, 15 nt, Human
ccauuucauguccau

SEQ ID NO: 3163740 - RNA, 15 nt, Human
ccauuuaucuugaag

SEQ ID NO: 3163741 - RNA, 22 nt, Human
ccauuucaguaaaccugucuga

SEQ ID NO: 3163742 - RNA, 21 nt, Human
ccauuucaguaaaccugucug

SEQ ID NO: 3163743 - RNA, 11 nt, Human
ccauuggaaau

SEQ ID NO: 3163744 - RNA, 15 nt, Human
ccauuggaaauuuca

SEQ ID NO: 3163745 - RNA, 14 nt, Human
ccauuggaaauuuc

SEQ ID NO: 3163746 - RNA, 20 nt, Human
cccaacuaauuuuuguauuu

SEQ ID NO: 3163747 - RNA, 17 nt, Human
cccaacucaccccagcc

SEQ ID NO: 3163748 - RNA, 20 nt, Human
cccaacucaccccagcccca

SEQ ID NO: 3163749 - RNA, 12 nt, Human
cccaagcucugc

SEQ ID NO: 3163750 - RNA, 14 nt, Human
cccaagcucugcuc

SEQ ID NO: 3163751 - RNA, 13 nt, Human
cccaagcucugcu

SEQ ID NO: 3163752 - RNA, 13 nt, Human
cccacccagccug

SEQ ID NO: 3163753 - RNA, 22 nt, Human
cccacugcuuuuggucugugug

SEQ ID NO: 3163754 - RNA, 23 nt, Human
cccacugcuuuuggucuguguga

SEQ ID NO: 3163755 - RNA, 14 nt, Human
cccacuccugcucu

SEQ ID NO: 3163756 - RNA, 21 nt, Human
cccacucgugauaagucaaca

SEQ ID NO: 3163757 - RNA, 18 nt, Human
cccacuccugcucugcuc

SEQ ID NO: 3163758 - RNA, 12 nt, Human
cccacuccugcu

SEQ ID NO: 3163759 - RNA, 17 nt, Human
cccacucucagaggccc

SEQ ID NO: 3163760 - RNA, 15 nt, Human
cccacucucagaggc

SEQ ID NO: 3163761 - RNA, 14 nt, Human
cccacucucagagg

SEQ ID NO: 3163762 - RNA, 11 nt, Human
cccacucucag

SEQ ID NO: 3163763 - RNA, 13 nt, Human
cccacucucagag

SEQ ID NO: 3163764 - RNA, 12 nt, Human
cccacucucaga

SEQ ID NO: 3163765 - RNA, 13 nt, Human
cccacucccugca

SEQ ID NO: 3163766 - RNA, 12 nt, Human
cccacucccugc

SEQ ID NO: 3163767 - RNA, 15 nt, Human
cccacccuccccuuc

SEQ ID NO: 3163768 - RNA, 13 nt, Human
cccaccccauccu

SEQ ID NO: 3163769 - RNA, 20 nt, Human
ccaugaggaacaaggcaagg

SEQ ID NO: 3163770 - RNA, 23 nt, Human
ccaugaggaacaaggcaaggcug

SEQ ID NO: 3163771 - RNA, 18 nt, Human
ccaugaguccccuguuug

SEQ ID NO: 3163772 - RNA, 17 nt, Human
ccaugucgccucugcau

SEQ ID NO: 3163773 - RNA, 16 nt, Human
ccaugucgccucugca

SEQ ID NO: 3163774 - RNA, 15 nt, Human
ccaugucgccucugc

SEQ ID NO: 3163775 - RNA, 12 nt, Human
ccaugucgccuc

SEQ ID NO: 3163776 - RNA, 22 nt, Human
ccauccccuguagagugggagc

SEQ ID NO: 3163777 - RNA, 21 nt, Human
ccaucccauaugccugggcag

SEQ ID NO: 3163778 - RNA, 19 nt, Human
ccaucccauaugccugggc

SEQ ID NO: 3163779 - RNA, 20 nt, Human
ccaucccauaugccugggca

SEQ ID NO: 3163780 - RNA, 19 nt, Human
ccauccagguucagcuugu

SEQ ID NO: 3163781 - RNA, 18 nt, Human
ccauccagguucagcuug

SEQ ID NO: 3163782 - RNA, 20 nt, Human
ccauaagcaacaauuuucag

SEQ ID NO: 3163783 - RNA, 16 nt, Human
ccauaauguucugcua

SEQ ID NO: 3163784 - RNA, 21 nt, Human
ccauaaucuggacuccucugu

SEQ ID NO: 3163785 - RNA, 14 nt, Human
ccauaaucuggacu

SEQ ID NO: 3163786 - RNA, 18 nt, Human
ccaguuggucccccuucc

SEQ ID NO: 3163787 - RNA, 20 nt, Human
ccaguuggucccccuuccau

SEQ ID NO: 3163788 - RNA, 13 nt, Human
ccaguuggucccc

SEQ ID NO: 3163789 - RNA, 23 nt, Human
ccaguuggguggaugccuggugg

SEQ ID NO: 3163790 - RNA, 10 nt, Human
ccccugccag

SEQ ID NO: 3163791 - RNA, 16 nt, Human
ccccugccacccuggg

SEQ ID NO: 3163792 - RNA, 14 nt, Human
ccccugccacccug

SEQ ID NO: 3163793 - RNA, 23 nt, Human
ccccugcccagaucagccagaag

SEQ ID NO: 3163794 - RNA, 21 nt, Human
ccccugcaaagcccagcuuga

SEQ ID NO: 3163795 - RNA, 17 nt, Human
ccccugcaaagcccagc

SEQ ID NO: 3163796 - RNA, 18 nt, Human
ccccugcaaagcccagcu

SEQ ID NO: 3163797 - RNA, 20 nt, Human
ccccugcaaagcccagcuug

SEQ ID NO: 3163798 - RNA, 15 nt, Human
ccccugacaacacuc

SEQ ID NO: 3163799 - RNA, 16 nt, Human
ccccucuggcuccagc

SEQ ID NO: 3163800 - RNA, 14 nt, Human
ccccucugcccugc

SEQ ID NO: 3163801 - RNA, 15 nt, Human
ccccucugcccugcg

SEQ ID NO: 3163802 - RNA, 20 nt, Human
ccccucugcccugcggguca

SEQ ID NO: 3163803 - RNA, 23 nt, Human
ccccucugcccugcgggucacag

SEQ ID NO: 3163804 - RNA, 18 nt, Human
cccgggaagggggcuggg

SEQ ID NO: 3163805 - RNA, 21 nt, Human
cccgggaagggggcugggaca

SEQ ID NO: 3163806 - RNA, 16 nt, Human
cccucaacaccucugc

SEQ ID NO: 3163807 - RNA, 15 nt, Human
cccucaaagaggcag

SEQ ID NO: 3163808 - RNA, 16 nt, Human
cccucaacucuccucc

SEQ ID NO: 3163809 - RNA, 16 nt, Human
cccucacccuggggcu

SEQ ID NO: 3163810 - RNA, 15 nt, Human
cccucacccuggggc

SEQ ID NO: 3163811 - RNA, 14 nt, Human
cccucacucucagg

SEQ ID NO: 3163812 - RNA, 13 nt, Human
cccucacucucag

SEQ ID NO: 3163813 - RNA, 15 nt, Human
cccucacucucagga

SEQ ID NO: 3163814 - RNA, 17 nt, Human
cccggccaccugcggug

SEQ ID NO: 3163815 - RNA, 18 nt, Human
cccgaauagcugggacua

SEQ ID NO: 3163816 - RNA, 17 nt, Human
cccgaauagcugggacu

SEQ ID NO: 3163817 - RNA, 16 nt, Human
cccgaauagcugggac

SEQ ID NO: 3163818 - RNA, 14 nt, Human
ccccuucugaccca

SEQ ID NO: 3163819 - RNA, 13 nt, Human
ccccuucugaccc

SEQ ID NO: 3163820 - RNA, 15 nt, Human
cccgggaagggggcu

SEQ ID NO: 3163821 - RNA, 12 nt, Human
cccgggaagggg

SEQ ID NO: 3163822 - RNA, 20 nt, Human
cccggcuaauuuuuguauuu

SEQ ID NO: 3163823 - RNA, 15 nt, Human
cccggccccugcugg

SEQ ID NO: 3163824 - RNA, 16 nt, Human
cccggccccugcuggu

SEQ ID NO: 3163825 - RNA, 16 nt, Human
cccggcccugccugcu

SEQ ID NO: 3163826 - RNA, 16 nt, Human
cccuccucccucccag

SEQ ID NO: 3163827 - RNA, 17 nt, Human
cccuccucugagaggcg

SEQ ID NO: 3163828 - RNA, 16 nt, Human
cccuccucucugcccu

SEQ ID NO: 3163829 - RNA, 15 nt, Human
cccuccucucugccc

SEQ ID NO: 3163830 - RNA, 23 nt, Human
ccccgaggccuucucugaaggac

SEQ ID NO: 3163831 - RNA, 16 nt, Human
cccccuuucuuccuca

SEQ ID NO: 3163832 - RNA, 15 nt, Human
cccccuuucuuccuc

SEQ ID NO: 3163833 - RNA, 14 nt, Human
ccccgcacugggcu

SEQ ID NO: 3163834 - RNA, 24 nt, Human
ccccauggccggcuuucaggagcu

SEQ ID NO: 3163835 - RNA, 19 nt, Human
ccccauggccggcuuucag

SEQ ID NO: 3163836 - RNA, 20 nt, Human
ccccagauugcaacaggcug

SEQ ID NO: 3163837 - RNA, 15 nt, Human
ccccagauugcaaca

SEQ ID NO: 3163838 - RNA, 17 nt, Human
ccccagaggcuggguga

SEQ ID NO: 3163839 - RNA, 15 nt, Human
cccauucugccugcc

SEQ ID NO: 3163840 - RNA, 14 nt, Human
cccauucugccugc

SEQ ID NO: 3163841 - RNA, 19 nt, Human
cccauucugccugcccagg

SEQ ID NO: 3163842 - RNA, 13 nt, Human
cccauucugccug

SEQ ID NO: 3163843 - RNA, 15 nt, Human
cccauuugcuccuuu

SEQ ID NO: 3163844 - RNA, 20 nt, Human
cccauuugggcagagaggcu

SEQ ID NO: 3163845 - RNA, 13 nt, Human
cccauuugggcag

SEQ ID NO: 3163846 - RNA, 19 nt, Human
cccauuuggagggccuggg

SEQ ID NO: 3163847 - RNA, 14 nt, Human
cccauuuggagggc

SEQ ID NO: 3163848 - RNA, 13 nt, Human
ccccagaggcugg

SEQ ID NO: 3163849 - RNA, 12 nt, Human
cccauuuuuccc

SEQ ID NO: 3163850 - RNA, 23 nt, Human
cccagcaagugagagcugggugu

SEQ ID NO: 3163851 - RNA, 16 nt, Human
cccacugguuagaugu

SEQ ID NO: 3163852 - RNA, 13 nt, Human
cccacuggccggc

SEQ ID NO: 3163853 - RNA, 16 nt, Human
cccacuggacucaccu

SEQ ID NO: 3163854 - RNA, 15 nt, Human
cccaggaaaggcucc

SEQ ID NO: 3163855 - RNA, 16 nt, Human
cccaggaaaggcucca

SEQ ID NO: 3163856 - RNA, 20 nt, Human
cccauauuuguacaccaaua

SEQ ID NO: 3163857 - RNA, 18 nt, Human
cccaucagcccaaucccu

SEQ ID NO: 3163858 - RNA, 12 nt, Human
cccaucagccca

SEQ ID NO: 3163859 - RNA, 17 nt, Human
cccaggaaaggcuccag

SEQ ID NO: 3163860 - RNA, 18 nt, Human
cccaggaaaggcuccagg

SEQ ID NO: 3163861 - RNA, 15 nt, Human
cccaggcugagccuc

SEQ ID NO: 3163862 - RNA, 16 nt, Human
cccaggcugagccuca

SEQ ID NO: 3163863 - RNA, 17 nt, Human
cccaggcugagccucag

SEQ ID NO: 3163864 - RNA, 20 nt, Human
cccaggcuuagucacugaga

SEQ ID NO: 3163865 - RNA, 22 nt, Human
cccaggcuuagucacugagaca

SEQ ID NO: 3163866 - RNA, 18 nt, Human
cccaggcugagccucagu

SEQ ID NO: 3163867 - RNA, 13 nt, Human
cccaggcuggagu

SEQ ID NO: 3163868 - RNA, 21 nt, Human
cccauccucuguacagagccc

SEQ ID NO: 3163869 - RNA, 22 nt, Human
cccauccucuguacagagccca

SEQ ID NO: 3163870 - RNA, 20 nt, Human
cccauccucuguacagagcc

SEQ ID NO: 3163871 - RNA, 19 nt, Human
cccauauuuuacuuggaaa

SEQ ID NO: 3163872 - RNA, 12 nt, Human
cuaggcuccuuc

SEQ ID NO: 3163873 - RNA, 14 nt, Human
cuagggaagauaau

SEQ ID NO: 3163874 - RNA, 13 nt, Human
cuaggcuccuuca

SEQ ID NO: 3163875 - RNA, 13 nt, Human
cuaggcuggaagg

SEQ ID NO: 3163876 - RNA, 14 nt, Human
cuaggcuggaagga

SEQ ID NO: 3163877 - RNA, 15 nt, Human
cuaggcuggaaggag

SEQ ID NO: 3163878 - RNA, 16 nt, Human
cuaggcuggaaggagg

SEQ ID NO: 3163879 - RNA, 17 nt, Human
cuaggcuggaaggagga

SEQ ID NO: 3163880 - RNA, 19 nt, Human
cuaggcuggaaggaggaag

SEQ ID NO: 3163881 - RNA, 13 nt, Human
cuaggguccuggg

SEQ ID NO: 3163882 - RNA, 14 nt, Human
cuaggguccugggg

SEQ ID NO: 3163883 - RNA, 15 nt, Human
cuaggguccugggga

SEQ ID NO: 3163884 - RNA, 16 nt, Human
cuauaaaauguaucaa

SEQ ID NO: 3163885 - RNA, 21 nt, Human
cuauaaacacuguuuguucca

SEQ ID NO: 3163886 - RNA, 14 nt, Human
cuauaaacacuguu

SEQ ID NO: 3163887 - RNA, 12 nt, Human
cuauaaacacug

SEQ ID NO: 3163888 - RNA, 19 nt, Human
cuagccagaggagagagga

SEQ ID NO: 3163889 - RNA, 17 nt, Human
cuagccagaggagagag

SEQ ID NO: 3163890 - RNA, 13 nt, Human
cuaggccuggcca

SEQ ID NO: 3163891 - RNA, 19 nt, Human
cuaggccuggccagaugca

SEQ ID NO: 3163892 - RNA, 18 nt, Human
cuaggccuggccagaugc

SEQ ID NO: 3163893 - RNA, 15 nt, Human
cuaggccuggccaga

SEQ ID NO: 3163894 - RNA, 14 nt, Human
cuaggccuggccag

SEQ ID NO: 3163895 - RNA, 12 nt, Human
cuaggccugggg

SEQ ID NO: 3163896 - RNA, 13 nt, Human
cuaggccugggga

SEQ ID NO: 3163897 - RNA, 17 nt, Human
cuagaauguuucauuug

SEQ ID NO: 3163898 - RNA, 16 nt, Human
cuacucaaagcaaaag

SEQ ID NO: 3163899 - RNA, 17 nt, Human
cuacuaccuguaaugac

SEQ ID NO: 3163900 - RNA, 16 nt, Human
cuacuaagaaaauaga

SEQ ID NO: 3163901 - RNA, 23 nt, Human
cuacuaagaaaauagagaugagc

SEQ ID NO: 3163902 - RNA, 22 nt, Human
cuaccuuuaaucagguccugcu

SEQ ID NO: 3163903 - RNA, 21 nt, Human
cuaccuuuggcuuaauuccaa

SEQ ID NO: 3163904 - RNA, 20 nt, Human
cuaccuuuggcuuaauucca

SEQ ID NO: 3163905 - RNA, 18 nt, Human
cuaccuuccaguuccuca

SEQ ID NO: 3163906 - RNA, 14 nt, Human
cuaccuugccccaa

SEQ ID NO: 3163907 - RNA, 16 nt, Human
cuaccuugccccaacc

SEQ ID NO: 3163908 - RNA, 21 nt, Human
cuaccuugccccaacccuucu

SEQ ID NO: 3163909 - RNA, 15 nt, Human
cuaccugaggggccu

SEQ ID NO: 3163910 - RNA, 16 nt, Human
cuaccugaggggccuc

SEQ ID NO: 3163911 - RNA, 19 nt, Human
cuaccugaggggccucuua

SEQ ID NO: 3163912 - RNA, 23 nt, Human
cuaccugaggggccucuuauggg

SEQ ID NO: 3163913 - RNA, 17 nt, Human
cucagaaggucuguuuu

SEQ ID NO: 3163914 - RNA, 18 nt, Human
cucagaaacuccaugaug

SEQ ID NO: 3163915 - RNA, 22 nt, Human
cucagaaaagacgcaccagccc

SEQ ID NO: 3163916 - RNA, 13 nt, Human
cucacuuuuucau

SEQ ID NO: 3163917 - RNA, 16 nt, Human
cucaccuugguuccug

SEQ ID NO: 3163918 - RNA, 18 nt, Human
cucaccugccccucaacu

SEQ ID NO: 3163919 - RNA, 14 nt, Human
cucaccugccccuc

SEQ ID NO: 3163920 - RNA, 16 nt, Human
cucaccugccccucaa

SEQ ID NO: 3163921 - RNA, 13 nt, Human
cucaccugccccu

SEQ ID NO: 3163922 - RNA, 14 nt, Human
cucaccucucccuu

SEQ ID NO: 3163923 - RNA, 15 nt, Human
cucaccucucccuug

SEQ ID NO: 3163924 - RNA, 16 nt, Human
cucaccucucccuugg

SEQ ID NO: 3163925 - RNA, 17 nt, Human
cucaccucucccuugga

SEQ ID NO: 3163926 - RNA, 13 nt, Human
cucaccucucccu

SEQ ID NO: 3163927 - RNA, 16 nt, Human
cucaccucccccaucu

SEQ ID NO: 3163928 - RNA, 14 nt, Human
cucacccuggggcu

SEQ ID NO: 3163929 - RNA, 17 nt, Human
cucaccccuugccauaa

SEQ ID NO: 3163930 - RNA, 15 nt, Human
cucaaagcaaaagug

SEQ ID NO: 3163931 - RNA, 12 nt, Human
cucaaagcaaaa

SEQ ID NO: 3163932 - RNA, 14 nt, Human
cucaaaaagaaauc

SEQ ID NO: 3163933 - RNA, 14 nt, Human
cucaaagaggcagu

SEQ ID NO: 3163934 - RNA, 22 nt, Human
cucaaagccccauuaacugcuu

SEQ ID NO: 3163935 - RNA, 19 nt, Human
cucaaagccccauuaacug

SEQ ID NO: 3163936 - RNA, 22 nt, Human
cucaaaggccagguugcuaaga

SEQ ID NO: 3163937 - RNA, 13 nt, Human
cucaaaacugcac

SEQ ID NO: 3163938 - RNA, 14 nt, Human
cucaaaacaaaggc

SEQ ID NO: 3163939 - RNA, 18 nt, Human
cucaaaaaaagaaaaaga

SEQ ID NO: 3163940 - RNA, 13 nt, Human
cucaaaacaaagg

SEQ ID NO: 3163941 - RNA, 17 nt, Human
cucaaaaaaagaaaaag

SEQ ID NO: 3163942 - RNA, 22 nt, Human
cuauuuuugacauggaaaugaa

SEQ ID NO: 3163943 - RNA, 16 nt, Human
cuauguugcccaggca

SEQ ID NO: 3163944 - RNA, 20 nt, Human
cuaucucccccagccccauc

SEQ ID NO: 3163945 - RNA, 19 nt, Human
cuauguaucaaugaguaac

SEQ ID NO: 3163946 - RNA, 18 nt, Human
cuaucucccccagcccca

SEQ ID NO: 3163947 - RNA, 19 nt, Human
cuaucucuauuauuggaaa

SEQ ID NO: 3163948 - RNA, 17 nt, Human
cuaugugagcacaaagg

SEQ ID NO: 3163949 - RNA, 16 nt, Human
cuauguaucaaugagu

SEQ ID NO: 3163950 - RNA, 13 nt, Human
cuaugucauuuca

SEQ ID NO: 3163951 - RNA, 16 nt, Human
cuaugucauuucaugu

SEQ ID NO: 3163952 - RNA, 14 nt, Human
cuaugucauuucau

SEQ ID NO: 3163953 - RNA, 22 nt, Human
cuauguguagggcgggaggaug

SEQ ID NO: 3163954 - RNA, 17 nt, Human
cuaugugccuuauguug

SEQ ID NO: 3163955 - RNA, 19 nt, Human
cuaugugccuuauguugaa

SEQ ID NO: 3163956 - RNA, 22 nt, Human
cuaugugccuuauguugaaaaa

SEQ ID NO: 3163957 - RNA, 15 nt, Human
cuauguugcccaggc

SEQ ID NO: 3163958 - RNA, 14 nt, Human
cuauguugcccagg

SEQ ID NO: 3163959 - RNA, 14 nt, Human
cuaugugugugcuu

SEQ ID NO: 3163960 - RNA, 14 nt, Human
cuauguguuuuucu

SEQ ID NO: 3163961 - RNA, 17 nt, Human
cuauguguuuuucucau

SEQ ID NO: 3163962 - RNA, 22 nt, Human
cuauguguuuuucucauauuug

SEQ ID NO: 3163963 - RNA, 14 nt, Human
cucacacaugagca

SEQ ID NO: 3163964 - RNA, 14 nt, Human
cucacaaaggaugc

SEQ ID NO: 3163965 - RNA, 21 nt, Human
cucaaauaauauuuuuuuccu

SEQ ID NO: 3163966 - RNA, 12 nt, Human
cucaaauaacua

SEQ ID NO: 3163967 - RNA, 18 nt, Human
cucacaaaugaaaccuga

SEQ ID NO: 3163968 - RNA, 17 nt, Human
cgguuccuacacaggac

SEQ ID NO: 3163969 - RNA, 16 nt, Human
cgguuccuacacagga

SEQ ID NO: 3163970 - RNA, 18 nt, Human
cgguucaaaccugugaag

SEQ ID NO: 3163971 - RNA, 19 nt, Human
cgguucaguguuucugggg

SEQ ID NO: 3163972 - RNA, 13 nt, Human
cgguucaguguuu

SEQ ID NO: 3163973 - RNA, 23 nt, Human
cguaauucuuauuccauauuaga

SEQ ID NO: 3163974 - RNA, 14 nt, Human
cguaauucuuauuc

SEQ ID NO: 3163975 - RNA, 24 nt, Human
cggagaagagcuguucacagccag

SEQ ID NO: 3163976 - RNA, 23 nt, Human
cggagaagagcuguucacagcca

SEQ ID NO: 3163977 - RNA, 14 nt, Human
cgguguccccacca

SEQ ID NO: 3163978 - RNA, 16 nt, Human
cggugggggggcagag

SEQ ID NO: 3163979 - RNA, 22 nt, Human
cgguguccccaccaucugcugu

SEQ ID NO: 3163980 - RNA, 19 nt, Human
cgguguccccaccaucugc

SEQ ID NO: 3163981 - RNA, 16 nt, Human
cgguguccccaccauc

SEQ ID NO: 3163982 - RNA, 15 nt, Human
cgguguccccaccau

SEQ ID NO: 3163983 - RNA, 21 nt, Human
cguacaaguaguucuguauuu

SEQ ID NO: 3163984 - RNA, 22 nt, Human
cguacaaguaguucuguauuug

SEQ ID NO: 3163985 - RNA, 18 nt, Human
cguacaaguaguucugua

SEQ ID NO: 3163986 - RNA, 19 nt, Human
cguacaaguaguucuguau

SEQ ID NO: 3163987 - RNA, 21 nt, Human
cuaaagaagguuucagaaaga

SEQ ID NO: 3163988 - RNA, 14 nt, Human
cuaaagcugccagc

SEQ ID NO: 3163989 - RNA, 15 nt, Human
cuaaagcugccagcc

SEQ ID NO: 3163990 - RNA, 15 nt, Human
cuaaaguuguacuuu

SEQ ID NO: 3163991 - RNA, 20 nt, Human
cuaaaguuguacuuuaaaaa

SEQ ID NO: 3163992 - RNA, 19 nt, Human
cuaaaguuguacuuuaaaa

SEQ ID NO: 3163993 - RNA, 14 nt, Human
cguuaccaggcagg

SEQ ID NO: 3163994 - RNA, 18 nt, Human
cguguuugucucuucugg

SEQ ID NO: 3163995 - RNA, 17 nt, Human
cguguuugucucuucug

SEQ ID NO: 3163996 - RNA, 21 nt, Human
cguuaaaaacagauuuggaaa

SEQ ID NO: 3163997 - RNA, 14 nt, Human
cguuaaaaacagau

SEQ ID NO: 3163998 - RNA, 15 nt, Human
cgugucaaugugugc

SEQ ID NO: 3163999 - RNA, 22 nt, Human
cguguccccuauccuacuuccc

SEQ ID NO: 3164000 - RNA, 16 nt, Human
cguguuugucucuucu

SEQ ID NO: 3164001 - RNA, 17 nt, Human
cguguaggaaccugcac

SEQ ID NO: 3164002 - RNA, 20 nt, Human
cgccuuccaccucugggagc

SEQ ID NO: 3164003 - RNA, 14 nt, Human
cgccuucacagcag

SEQ ID NO: 3164004 - RNA, 12 nt, Human
cgcugcucugcc

SEQ ID NO: 3164005 - RNA, 15 nt, Human
cgcugcucugcccca

SEQ ID NO: 3164006 - RNA, 18 nt, Human
cgcugccccuggcagccc

SEQ ID NO: 3164007 - RNA, 23 nt, Human
cgcuggaccuugaacuggguacu

SEQ ID NO: 3164008 - RNA, 19 nt, Human
cgcuggaccuugaacuggg

SEQ ID NO: 3164009 - RNA, 16 nt, Human
cgcugccccuggcagc

SEQ ID NO: 3164010 - RNA, 17 nt, Human
cgcugccccuggcagcc

SEQ ID NO: 3164011 - RNA, 13 nt, Human
cgcugccccuggc

SEQ ID NO: 3164012 - RNA, 13 nt, Human
cgccuucacagca

SEQ ID NO: 3164013 - RNA, 16 nt, Human
cgccuuaaggauguuc

SEQ ID NO: 3164014 - RNA, 13 nt, Human
cgcaucucacagc

SEQ ID NO: 3164015 - RNA, 16 nt, Human
cgcaucagcugcucag

SEQ ID NO: 3164016 - RNA, 15 nt, Human
cgcaucagcugcuca

SEQ ID NO: 3164017 - RNA, 16 nt, Human
cgcauaggccugcuuu

SEQ ID NO: 3164018 - RNA, 17 nt, Human
cgcuggggccaguuggu

SEQ ID NO: 3164019 - RNA, 20 nt, Human
cgcuggggccaguugguccc

SEQ ID NO: 3164020 - RNA, 17 nt, Human
cggagaaaggaagggcu

SEQ ID NO: 3164021 - RNA, 21 nt, Human
cgauacaccgggccuggagaa

SEQ ID NO: 3164022 - RNA, 20 nt, Human
cgauacaccgggccuggaga

SEQ ID NO: 3164023 - RNA, 18 nt, Human
cgauacaccgggccugga

SEQ ID NO: 3164024 - RNA, 19 nt, Human
cgaguagcugagauuauag

SEQ ID NO: 3164025 - RNA, 20 nt, Human
cgaguaauugcauuugcuuu

SEQ ID NO: 3164026 - RNA, 20 nt, Human
cucucuugauuaagaucuca

SEQ ID NO: 3164027 - RNA, 19 nt, Human
cucucuggccuucggccuc

SEQ ID NO: 3164028 - RNA, 17 nt, Human
cucucuggccuucggcc

SEQ ID NO: 3164029 - RNA, 10 nt, Human
cucuccucug

SEQ ID NO: 3164030 - RNA, 13 nt, Human
cucucccuuggau

SEQ ID NO: 3164031 - RNA, 13 nt, Human
cucuccuccuuuu

SEQ ID NO: 3164032 - RNA, 20 nt, Human
cucuccuccuuuucacaguu

SEQ ID NO: 3164033 - RNA, 16 nt, Human
cucuccgaccagacac

SEQ ID NO: 3164034 - RNA, 16 nt, Human
cucugcacaagcugca

SEQ ID NO: 3164035 - RNA, 16 nt, Human
cuccuagccacccacc

SEQ ID NO: 3164036 - RNA, 22 nt, Human
cuccuagccugugccucuggga

SEQ ID NO: 3164037 - RNA, 17 nt, Human
cuccuuuagcgcccagu

SEQ ID NO: 3164038 - RNA, 16 nt, Human
cuccuuuagcgcccag

SEQ ID NO: 3164039 - RNA, 22 nt, Human
cuccuuuagcgcccaguugggu

SEQ ID NO: 3164040 - RNA, 23 nt, Human
cuccuuugugaggaagccgcugg

SEQ ID NO: 3164041 - RNA, 24 nt, Human
cuccuuuucacaguucucuccuuc

SEQ ID NO: 3164042 - RNA, 17 nt, Human
cuccuuuuccagagcau

SEQ ID NO: 3164043 - RNA, 16 nt, Human
cuccuuuuccagagca

SEQ ID NO: 3164044 - RNA, 17 nt, Human
cuccuuuuguguuccaa

SEQ ID NO: 3164045 - RNA, 13 nt, Human
cuccuuuuguguu

SEQ ID NO: 3164046 - RNA, 19 nt, Human
cuccuuuuccagagcauuc

SEQ ID NO: 3164047 - RNA, 13 nt, Human
cucgaacuccuga

SEQ ID NO: 3164048 - RNA, 16 nt, Human
cucgaacuccugaccu

SEQ ID NO: 3164049 - RNA, 16 nt, Human
cucguauagaagucuu

SEQ ID NO: 3164050 - RNA, 18 nt, Human
cucguauaugucucaggu

SEQ ID NO: 3164051 - RNA, 11 nt, Human
cucggugccuu

SEQ ID NO: 3164052 - RNA, 23 nt, Human
cucgguguggagaagcggcuggc

SEQ ID NO: 3164053 - RNA, 20 nt, Human
cucguauaugucucaggucc

SEQ ID NO: 3164054 - RNA, 23 nt, Human
cucguauagaagucuucaugaaa

SEQ ID NO: 3164055 - RNA, 19 nt, Human
cucccagcaucgcacucug

SEQ ID NO: 3164056 - RNA, 13 nt, Human
cucccagcaucgc

SEQ ID NO: 3164057 - RNA, 13 nt, Human
cucccaccucagc

SEQ ID NO: 3164058 - RNA, 17 nt, Human
cucccaccucagccucc

SEQ ID NO: 3164059 - RNA, 16 nt, Human
cucccaccucagccuc

SEQ ID NO: 3164060 - RNA, 14 nt, Human
cucccaccucagcc

SEQ ID NO: 3164061 - RNA, 20 nt, Human
cuccauacacacgcugccuu

SEQ ID NO: 3164062 - RNA, 19 nt, Human
cuccauacacacgcugccu

SEQ ID NO: 3164063 - RNA, 17 nt, Human
cuccauacacacgcugc

SEQ ID NO: 3164064 - RNA, 21 nt, Human
cuccagugagacagcucugca

SEQ ID NO: 3164065 - RNA, 19 nt, Human
cuccaggugcacaagcucc

SEQ ID NO: 3164066 - RNA, 20 nt, Human
cuccaggugcacaagcucca

SEQ ID NO: 3164067 - RNA, 18 nt, Human
cuccaggugcacaagcuc

SEQ ID NO: 3164068 - RNA, 22 nt, Human
cuccaggcuguaucccaugagc

SEQ ID NO: 3164069 - RNA, 23 nt, Human
cuccaggcuguaucccaugagcc

SEQ ID NO: 3164070 - RNA, 22 nt, Human
cuccagaauuucccaaagcagu

SEQ ID NO: 3164071 - RNA, 11 nt, Human
cuccagacaca

SEQ ID NO: 3164072 - RNA, 17 nt, Human
cucagaaucucaaauaa

SEQ ID NO: 3164073 - RNA, 16 nt, Human
cucagaaucucaaaua

SEQ ID NO: 3164074 - RNA, 21 nt, Human
cuccagaauuucccaaagcag

SEQ ID NO: 3164075 - RNA, 15 nt, Human
cucccucuuucccuc

SEQ ID NO: 3164076 - RNA, 16 nt, Human
cucccucccucuuucc

SEQ ID NO: 3164077 - RNA, 18 nt, Human
cucccagcuccaccccgc

SEQ ID NO: 3164078 - RNA, 19 nt, Human
cucccucuuucccucccuu

SEQ ID NO: 3164079 - RNA, 20 nt, Human
cuccgcuuucuacccagcga

SEQ ID NO: 3164080 - RNA, 21 nt, Human
cuccgcuuucuacccagcgag

SEQ ID NO: 3164081 - RNA, 22 nt, Human
cuccgcuuucuacccagcgagc

SEQ ID NO: 3164082 - RNA, 15 nt, Human
cuccgggucuuccua

SEQ ID NO: 3164083 - RNA, 14 nt, Human
cuccgucacuaccu

SEQ ID NO: 3164084 - RNA, 19 nt, Human
cuccgucacuaccuggcug

SEQ ID NO: 3164085 - RNA, 17 nt, Human
cuccgucacuaccuggc

SEQ ID NO: 3164086 - RNA, 16 nt, Human
cuccgucacuaccugg

SEQ ID NO: 3164087 - RNA, 21 nt, Human
cugaguaaaaaagcugugugc

SEQ ID NO: 3164088 - RNA, 21 nt, Human
cugagguugggagaggugcac

SEQ ID NO: 3164089 - RNA, 20 nt, Human
cugagguugggagaggugca

SEQ ID NO: 3164090 - RNA, 21 nt, Human
cugaggugggagauguggaaa

SEQ ID NO: 3164091 - RNA, 22 nt, Human
cugaggugggaggaucucuuga

SEQ ID NO: 3164092 - RNA, 13 nt, Human
cugaggugggagg

SEQ ID NO: 3164093 - RNA, 12 nt, Human
cugaggugggag

SEQ ID NO: 3164094 - RNA, 14 nt, Human
cugaggguccagaa

SEQ ID NO: 3164095 - RNA, 17 nt, Human
cugaggguccagaagga

SEQ ID NO: 3164096 - RNA, 18 nt, Human
cugaggggagacagagca

SEQ ID NO: 3164097 - RNA, 17 nt, Human
cugaggggagacagagc

SEQ ID NO: 3164098 - RNA, 23 nt, Human
cugaggaauccagacccggcugc

SEQ ID NO: 3164099 - RNA, 14 nt, Human
cugaggggccucuu

SEQ ID NO: 3164100 - RNA, 23 nt, Human
cugaggggcagccugccuugccc

SEQ ID NO: 3164101 - RNA, 19 nt, Human
cugaggggcagccugccuu

SEQ ID NO: 3164102 - RNA, 18 nt, Human
cugaggggcagccugccu

SEQ ID NO: 3164103 - RNA, 17 nt, Human
cugaggggcagccugcc

SEQ ID NO: 3164104 - RNA, 19 nt, Human
cugaggggagacagagcaa

SEQ ID NO: 3164105 - RNA, 16 nt, Human
cugaggggcagccugc

SEQ ID NO: 3164106 - RNA, 15 nt, Human
cugaggggcagccug

SEQ ID NO: 3164107 - RNA, 12 nt, Human
cugagcuuggaa

SEQ ID NO: 3164108 - RNA, 22 nt, Human
cugagcuugcagagaugaggcc

SEQ ID NO: 3164109 - RNA, 21 nt, Human
cugagcuuggaagcuucuggu

SEQ ID NO: 3164110 - RNA, 20 nt, Human
cugagcuuggaagcuucugg

SEQ ID NO: 3164111 - RNA, 14 nt, Human
cugagcuuggaagc

SEQ ID NO: 3164112 - RNA, 18 nt, Human
cugaggaagagggacugu

SEQ ID NO: 3164113 - RNA, 23 nt, Human
cugaggaagagggacuguucuuu

SEQ ID NO: 3164114 - RNA, 21 nt, Human
cugaggaauccagacccggcu

SEQ ID NO: 3164115 - RNA, 19 nt, Human
cugacccugcuucaaauau

SEQ ID NO: 3164116 - RNA, 12 nt, Human
cugagcugggau

SEQ ID NO: 3164117 - RNA, 22 nt, Human
cugagcugggaugauuggaggg

SEQ ID NO: 3164118 - RNA, 16 nt, Human
cugagcuggccucuca

SEQ ID NO: 3164119 - RNA, 14 nt, Human
cugagcuggccucu

SEQ ID NO: 3164120 - RNA, 22 nt, Human
cugagcuggccucucacugccu

SEQ ID NO: 3164121 - RNA, 17 nt, Human
cugagcuggccucucac

SEQ ID NO: 3164122 - RNA, 17 nt, Human
cugaucucucgugauug

SEQ ID NO: 3164123 - RNA, 18 nt, Human
cugaucucucgugauuga

SEQ ID NO: 3164124 - RNA, 14 nt, Human
cugaucucucguga

SEQ ID NO: 3164125 - RNA, 15 nt, Human
cugacacaccugcag

SEQ ID NO: 3164126 - RNA, 16 nt, Human
cugacacaccugcagc

SEQ ID NO: 3164127 - RNA, 21 nt, Human
cugacacaccugcagccuccc

SEQ ID NO: 3164128 - RNA, 23 nt, Human
cugacacaccugcagccucccuc

SEQ ID NO: 3164129 - RNA, 14 nt, Human
cugacaccccacuu

SEQ ID NO: 3164130 - RNA, 18 nt, Human
cugacaccccacuuagcc

SEQ ID NO: 3164131 - RNA, 17 nt, Human
cugacaccccacuuagc

SEQ ID NO: 3164132 - RNA, 23 nt, Human
cugacacacagcucuguccuggg

SEQ ID NO: 3164133 - RNA, 22 nt, Human
cugacacacagcucuguccugg

SEQ ID NO: 3164134 - RNA, 21 nt, Human
cugacacacagcucuguccug

SEQ ID NO: 3164135 - RNA, 20 nt, Human
cugacacacagcucuguccu

SEQ ID NO: 3164136 - RNA, 19 nt, Human
cugacacacagcucugucc

SEQ ID NO: 3164137 - RNA, 18 nt, Human
cugacacacagcucuguc

SEQ ID NO: 3164138 - RNA, 17 nt, Human
cugacacacagcucugu

SEQ ID NO: 3164139 - RNA, 16 nt, Human
cugacacacagcucug

SEQ ID NO: 3164140 - RNA, 15 nt, Human
cugacacacagcucu

SEQ ID NO: 3164141 - RNA, 13 nt, Human
cugacacacagcu

SEQ ID NO: 3164142 - RNA, 18 nt, Human
cugaaagaggccaaacag

SEQ ID NO: 3164143 - RNA, 17 nt, Human
cugaaagagucuuucuu

SEQ ID NO: 3164144 - RNA, 17 nt, Human
cugaccccucauagccc

SEQ ID NO: 3164145 - RNA, 20 nt, Human
cugaccccucauagcccuca

SEQ ID NO: 3164146 - RNA, 21 nt, Human
cugaccccucauagcccucac

SEQ ID NO: 3164147 - RNA, 13 nt, Human
cugaaagaggaau

SEQ ID NO: 3164148 - RNA, 17 nt, Human
cugaaagaggaaugaag

SEQ ID NO: 3164149 - RNA, 15 nt, Human
cucuuuuuuacaaag

SEQ ID NO: 3164150 - RNA, 24 nt, Human
cucuugauucauaaugacuuaagc

SEQ ID NO: 3164151 - RNA, 22 nt, Human
cucuugccacugccucuuccuc

SEQ ID NO: 3164152 - RNA, 19 nt, Human
cucuugccucagcuucccc

SEQ ID NO: 3164153 - RNA, 21 nt, Human
cucuugccucagcuuccccag

SEQ ID NO: 3164154 - RNA, 14 nt, Human
cucuuuuuuacaaa

SEQ ID NO: 3164155 - RNA, 13 nt, Human
cucuuuuuuaagu

SEQ ID NO: 3164156 - RNA, 22 nt, Human
cucuugauucauaaugacuuaa

SEQ ID NO: 3164157 - RNA, 23 nt, Human
cucuugaguuguuuuuguauauu

SEQ ID NO: 3164158 - RNA, 13 nt, Human
cucuugaguuguu

SEQ ID NO: 3164159 - RNA, 16 nt, Human
cucuugaguuguuuuu

SEQ ID NO: 3164160 - RNA, 18 nt, Human
cucuugaguuguuuuugu

SEQ ID NO: 3164161 - RNA, 20 nt, Human
cucuugaguuguuuuuguau

SEQ ID NO: 3164162 - RNA, 21 nt, Human
cucuugaguuguuuuuguaua

SEQ ID NO: 3164163 - RNA, 22 nt, Human
cucuugaguuguuuuuguauau

SEQ ID NO: 3164164 - RNA, 15 nt, Human
cucuugagccuggga

SEQ ID NO: 3164165 - RNA, 13 nt, Human
cucuugagccugg

SEQ ID NO: 3164166 - RNA, 14 nt, Human
cucuugagccuggg

SEQ ID NO: 3164167 - RNA, 17 nt, Human
cucugcacaagcugcac

SEQ ID NO: 3164168 - RNA, 18 nt, Human
cucugcacaagcugcacc

SEQ ID NO: 3164169 - RNA, 15 nt, Human
augugaugagaggaa

SEQ ID NO: 3164170 - RNA, 16 nt, Human
augugaugagaggaaa

SEQ ID NO: 3164171 - RNA, 17 nt, Human
augugaugagaggaaau

SEQ ID NO: 3164172 - RNA, 19 nt, Human
augugaugagaggaaauca

SEQ ID NO: 3164173 - RNA, 15 nt, Human
augugaccauaaugu

SEQ ID NO: 3164174 - RNA, 16 nt, Human
augugaccauaaugua

SEQ ID NO: 3164175 - RNA, 23 nt, Human
augugacauuugucauuuucauu

SEQ ID NO: 3164176 - RNA, 23 nt, Human
augugcacaugcacgugugugca

SEQ ID NO: 3164177 - RNA, 19 nt, Human
uuuguaauaauaaagaaua

SEQ ID NO: 3164178 - RNA, 21 nt, Human
augugcaaacccacucagaga

SEQ ID NO: 3164179 - RNA, 14 nt, Human
augugaugcuggaa

SEQ ID NO: 3164180 - RNA, 23 nt, Human
uuugugaagugaaggauuugugu

SEQ ID NO: 3164181 - RNA, 21 nt, Human
uuugugaaauuuuucauauuu

SEQ ID NO: 3164182 - RNA, 22 nt, Human
uuugugaacaagucccuguaau

SEQ ID NO: 3164183 - RNA, 20 nt, Human
uuugugaaauuuuucauauu

SEQ ID NO: 3164184 - RNA, 18 nt, Human
uuugugaaauuuuucaua

SEQ ID NO: 3164185 - RNA, 17 nt, Human
uuugugaaauuuuucau

SEQ ID NO: 3164186 - RNA, 12 nt, Human
uuugugaaauuu

SEQ ID NO: 3164187 - RNA, 20 nt, Human
uuugugaaacagacuuguau

SEQ ID NO: 3164188 - RNA, 18 nt, Human
uuugugaaacagacuugu

SEQ ID NO: 3164189 - RNA, 22 nt, Human
uuugugaaaugauggugaaagu

SEQ ID NO: 3164190 - RNA, 21 nt, Human
uuuguaauaauaaagaauagc

SEQ ID NO: 3164191 - RNA, 14 nt, Human
auguaugcuucaua

SEQ ID NO: 3164192 - RNA, 17 nt, Human
auguaugcauaauaauc

SEQ ID NO: 3164193 - RNA, 13 nt, Human
auguaugcauaau

SEQ ID NO: 3164194 - RNA, 15 nt, Human
auguaugcuucauac

SEQ ID NO: 3164195 - RNA, 14 nt, Human
auguaugcauucac

SEQ ID NO: 3164196 - RNA, 15 nt, Human
auguauguguaagua

SEQ ID NO: 3164197 - RNA, 15 nt, Human
uuuggcacucugacu

SEQ ID NO: 3164198 - RNA, 18 nt, Human
auguaugagguacaaccu

SEQ ID NO: 3164199 - RNA, 16 nt, Human
augucaguauguggaa

SEQ ID NO: 3164200 - RNA, 12 nt, Human
auguauuauguc

SEQ ID NO: 3164201 - RNA, 20 nt, Human
auguauuauguccugugaga

SEQ ID NO: 3164202 - RNA, 21 nt, Human
auguauuaaauuacauuugua

SEQ ID NO: 3164203 - RNA, 23 nt, Human
auguauuaacacuacucaaagca

SEQ ID NO: 3164204 - RNA, 21 nt, Human
auguauuaagcccacaguaua

SEQ ID NO: 3164205 - RNA, 23 nt, Human
auguauuaagcccacaguauauu

SEQ ID NO: 3164206 - RNA, 16 nt, Human
auguauuaaauuacau

SEQ ID NO: 3164207 - RNA, 12 nt, Human
auguauuaaauu

SEQ ID NO: 3164208 - RNA, 18 nt, Human
auguauguguuuagaauu

SEQ ID NO: 3164209 - RNA, 20 nt, Human
auguauguguuuagaauuga

SEQ ID NO: 3164210 - RNA, 21 nt, Human
auguauguguuuagaauugaa

SEQ ID NO: 3164211 - RNA, 16 nt, Human
auguauguguaaguau

SEQ ID NO: 3164212 - RNA, 12 nt, Human
auguauguguuu

SEQ ID NO: 3164213 - RNA, 14 nt, Human
auguauguguuuag

SEQ ID NO: 3164214 - RNA, 15 nt, Human
auguauguguuuaga

SEQ ID NO: 3164215 - RNA, 16 nt, Human
auguauguguuuagaa

SEQ ID NO: 3164216 - RNA, 17 nt, Human
auguauguguuuagaau

SEQ ID NO: 3164217 - RNA, 16 nt, Human
auguccaguaagauca

SEQ ID NO: 3164218 - RNA, 18 nt, Human
auguccaguaagaucacu

SEQ ID NO: 3164219 - RNA, 19 nt, Human
auguccaguaagaucacug

SEQ ID NO: 3164220 - RNA, 20 nt, Human
auguccaguaagaucacugu

SEQ ID NO: 3164221 - RNA, 13 nt, Human
auguccuguaaac

SEQ ID NO: 3164222 - RNA, 22 nt, Human
auguccuguaaacacucagcug

SEQ ID NO: 3164223 - RNA, 23 nt, Human
auguccuguaaacacucagcugu

SEQ ID NO: 3164224 - RNA, 16 nt, Human
auguccacugguucuu

SEQ ID NO: 3164225 - RNA, 17 nt, Human
auguccacugguucuuc

SEQ ID NO: 3164226 - RNA, 12 nt, Human
augucaguguga

SEQ ID NO: 3164227 - RNA, 13 nt, Human
augucagugugac

SEQ ID NO: 3164228 - RNA, 22 nt, Human
augucucaggucccugcagggc

SEQ ID NO: 3164229 - RNA, 23 nt, Human
augucucagguuuguuuugugaa

SEQ ID NO: 3164230 - RNA, 17 nt, Human
augucucaggucccugc

SEQ ID NO: 3164231 - RNA, 14 nt, Human
augucgccucugca

SEQ ID NO: 3164232 - RNA, 13 nt, Human
augucgccucugc

SEQ ID NO: 3164233 - RNA, 19 nt, Human
auguccugugagaugugua

SEQ ID NO: 3164234 - RNA, 20 nt, Human
auguccugugagauguguau

SEQ ID NO: 3164235 - RNA, 13 nt, Human
auguccuguguca

SEQ ID NO: 3164236 - RNA, 11 nt, Human
auguccugugu

SEQ ID NO: 3164237 - RNA, 20 nt, Human
auguccugugucaguuuaug

SEQ ID NO: 3164238 - RNA, 18 nt, Human
auguccugugucaguuua

SEQ ID NO: 3164239 - RNA, 21 nt, Human
auguccugugucaguuuaugu

SEQ ID NO: 3164240 - RNA, 17 nt, Human
augucucugagcauuag

SEQ ID NO: 3164241 - RNA, 16 nt, Human
auguagccuuuacugu

SEQ ID NO: 3164242 - RNA, 22 nt, Human
auguagccuuuacuguuugaua

SEQ ID NO: 3164243 - RNA, 19 nt, Human
auguagcuucagucauuaa

SEQ ID NO: 3164244 - RNA, 20 nt, Human
auguagcuucagucauuaaa

SEQ ID NO: 3164245 - RNA, 17 nt, Human
auguagauuuauuucau

SEQ ID NO: 3164246 - RNA, 16 nt, Human
auguagauuuauuuca

SEQ ID NO: 3164247 - RNA, 20 nt, Human
auguagauuuauuucaucau

SEQ ID NO: 3164248 - RNA, 20 nt, Human
auguagcaaacccugucaaa

SEQ ID NO: 3164249 - RNA, 23 nt, Human
auguagcaaacccugucaaacau

SEQ ID NO: 3164250 - RNA, 18 nt, Human
uuugacagcgcacagcug

SEQ ID NO: 3164251 - RNA, 16 nt, Human
uuugacauggaaauga

SEQ ID NO: 3164252 - RNA, 19 nt, Human
uuugacagcgcacagcugc

SEQ ID NO: 3164253 - RNA, 19 nt, Human
auguagaggggaaaagaga

SEQ ID NO: 3164254 - RNA, 17 nt, Human
auguagaggagaaacug

SEQ ID NO: 3164255 - RNA, 19 nt, Human
auguagaggagaaacugga

SEQ ID NO: 3164256 - RNA, 12 nt, Human
auguagaggaga

SEQ ID NO: 3164257 - RNA, 13 nt, Human
auguagaggagaa

SEQ ID NO: 3164258 - RNA, 20 nt, Human
auguagagcacaauggaauu

SEQ ID NO: 3164259 - RNA, 16 nt, Human
auguacugauuucagu

SEQ ID NO: 3164260 - RNA, 17 nt, Human
auguacugauuucagua

SEQ ID NO: 3164261 - RNA, 18 nt, Human
auguacugauuucaguaa

SEQ ID NO: 3164262 - RNA, 19 nt, Human
auguacugauuucaguaag

SEQ ID NO: 3164263 - RNA, 17 nt, Human
auguacuauaacauaga

SEQ ID NO: 3164264 - RNA, 14 nt, Human
auguacuauaacau

SEQ ID NO: 3164265 - RNA, 17 nt, Human
auguacauguauuaaau

SEQ ID NO: 3164266 - RNA, 23 nt, Human
uuuggcaaacucuccaccacacg

SEQ ID NO: 3164267 - RNA, 14 nt, Human
uuuggcacucugac

SEQ ID NO: 3164268 - RNA, 14 nt, Human
uuugcugcugauaa

SEQ ID NO: 3164269 - RNA, 18 nt, Human
uuugcugaacauuggaga

SEQ ID NO: 3164270 - RNA, 23 nt, Human
uuugcugacaaccauuaaaguca

SEQ ID NO: 3164271 - RNA, 21 nt, Human
uuugcuccccuuccccuuccu

SEQ ID NO: 3164272 - RNA, 15 nt, Human
uuugcucuaaaauau

SEQ ID NO: 3164273 - RNA, 23 nt, Human
uuugcuccccuuccccuuccuuc

SEQ ID NO: 3164274 - RNA, 22 nt, Human
uuugcuccccuuccccuuccuu

SEQ ID NO: 3164275 - RNA, 19 nt, Human
uuugcucuaaaauauuuau

SEQ ID NO: 3164276 - RNA, 13 nt, Human
uuugccucugccu

SEQ ID NO: 3164277 - RNA, 22 nt, Human
uuugauucagacagcugccugg

SEQ ID NO: 3164278 - RNA, 13 nt, Human
uuugacgccaucc

SEQ ID NO: 3164279 - RNA, 14 nt, Human
uuugacgccauccc

SEQ ID NO: 3164280 - RNA, 16 nt, Human
uuugacgccaucccag

SEQ ID NO: 3164281 - RNA, 19 nt, Human
uuugacgccaucccagccc

SEQ ID NO: 3164282 - RNA, 20 nt, Human
uuugacgccaucccagcccc

SEQ ID NO: 3164283 - RNA, 20 nt, Human
uuugauguaaagauguucug

SEQ ID NO: 3164284 - RNA, 18 nt, Human
uuugauucagacagcugc

SEQ ID NO: 3164285 - RNA, 21 nt, Human
uuugauucagacagcugccug

SEQ ID NO: 3164286 - RNA, 22 nt, Human
uuugauguucuuucacccuuuu

SEQ ID NO: 3164287 - RNA, 20 nt, Human
uuugaugucagcaguugcug

SEQ ID NO: 3164288 - RNA, 21 nt, Human
uuugaugucagcaguugcugg

SEQ ID NO: 3164289 - RNA, 14 nt, Human
uuugaugucagcag

SEQ ID NO: 3164290 - RNA, 16 nt, Human
uuugaugucagcaguu

SEQ ID NO: 3164291 - RNA, 17 nt, Human
uuugaugucagcaguug

SEQ ID NO: 3164292 - RNA, 21 nt, Human
uuugauguguuguucuuggca

SEQ ID NO: 3164293 - RNA, 19 nt, Human
augguguucaaaaaacuug

SEQ ID NO: 3164294 - RNA, 24 nt, Human
auggugguugggacccaguggcag

SEQ ID NO: 3164295 - RNA, 21 nt, Human
augguuaccucugcauaaaua

SEQ ID NO: 3164296 - RNA, 13 nt, Human
augguuaaacauu

SEQ ID NO: 3164297 - RNA, 17 nt, Human
augguggcuggguugga

SEQ ID NO: 3164298 - RNA, 23 nt, Human
augguggggucuccucaggacca

SEQ ID NO: 3164299 - RNA, 16 nt, Human
augguggggucuccuc

SEQ ID NO: 3164300 - RNA, 15 nt, Human
augguggcuggguug

SEQ ID NO: 3164301 - RNA, 13 nt, Human
augguggcugggu

SEQ ID NO: 3164302 - RNA, 12 nt, Human
augguggcuggg

SEQ ID NO: 3164303 - RNA, 19 nt, Human
auggugcaaugaccuuuca

SEQ ID NO: 3164304 - RNA, 19 nt, Human
auggugauuuuaaaugugu

SEQ ID NO: 3164305 - RNA, 17 nt, Human
auggugauuuuaaaugu

SEQ ID NO: 3164306 - RNA, 16 nt, Human
auggugauuuuaaaug

SEQ ID NO: 3164307 - RNA, 15 nt, Human
auggugcauuguaua

SEQ ID NO: 3164308 - RNA, 18 nt, Human
auggugcauuguauagau

SEQ ID NO: 3164309 - RNA, 16 nt, Human
auggugcaaugaccuu

SEQ ID NO: 3164310 - RNA, 17 nt, Human
auggugcaaugaccuuu

SEQ ID NO: 3164311 - RNA, 12 nt, Human
auggugcaauga

SEQ ID NO: 3164312 - RNA, 20 nt, Human
auggugaugcagucuuagau

SEQ ID NO: 3164313 - RNA, 13 nt, Human
auggugauguuga

SEQ ID NO: 3164314 - RNA, 14 nt, Human
auggugauuuuaaa

SEQ ID NO: 3164315 - RNA, 12 nt, Human
auggugauuuua

SEQ ID NO: 3164316 - RNA, 19 nt, Human
auggugaugcagucuuaga

SEQ ID NO: 3164317 - RNA, 13 nt, Human
auggugcaaugac

SEQ ID NO: 3164318 - RNA, 15 nt, Human
auggugcaaugaccu

SEQ ID NO: 3164319 - RNA, 15 nt, Human
augggugcuuggagg

SEQ ID NO: 3164320 - RNA, 20 nt, Human
auggugagggauacccaucc

SEQ ID NO: 3164321 - RNA, 14 nt, Human
auggugaugaaaug

SEQ ID NO: 3164322 - RNA, 17 nt, Human
auggugaugaaauguaa

SEQ ID NO: 3164323 - RNA, 16 nt, Human
auggugaugaaaugua

SEQ ID NO: 3164324 - RNA, 17 nt, Human
auguaaauugacuguac

SEQ ID NO: 3164325 - RNA, 18 nt, Human
auguaaauugacuguacu

SEQ ID NO: 3164326 - RNA, 14 nt, Human
auguacauguauua

SEQ ID NO: 3164327 - RNA, 13 nt, Human
auguacauguauu

SEQ ID NO: 3164328 - RNA, 18 nt, Human
auguaaauagguuucuaa

SEQ ID NO: 3164329 - RNA, 16 nt, Human
auguaaauaauucuuu

SEQ ID NO: 3164330 - RNA, 14 nt, Human
auguaaauaauucu

SEQ ID NO: 3164331 - RNA, 13 nt, Human
auguaaauaauuc

SEQ ID NO: 3164332 - RNA, 21 nt, Human
auguaaagcaaccaaaaagaa

SEQ ID NO: 3164333 - RNA, 22 nt, Human
auguaaacaaaucuuuccauau

SEQ ID NO: 3164334 - RNA, 16 nt, Human
auguaaacaaaucuuu

SEQ ID NO: 3164335 - RNA, 15 nt, Human
auguaaacaaaucuu

SEQ ID NO: 3164336 - RNA, 13 nt, Human
auguaaacaaauc

SEQ ID NO: 3164337 - RNA, 13 nt, Human
auguaaaagccua

SEQ ID NO: 3164338 - RNA, 14 nt, Human
augguuuaaaagaa

SEQ ID NO: 3164339 - RNA, 16 nt, Human
augguucucaggccug

SEQ ID NO: 3164340 - RNA, 20 nt, Human
augguuccccuguucacucu

SEQ ID NO: 3164341 - RNA, 19 nt, Human
augguuccccuguucacuc

SEQ ID NO: 3164342 - RNA, 15 nt, Human
augguuuucaaaaua

SEQ ID NO: 3164343 - RNA, 14 nt, Human
augguuuucaaaau

SEQ ID NO: 3164344 - RNA, 22 nt, Human
augguuuggugcuuuuuauaaa

SEQ ID NO: 3164345 - RNA, 16 nt, Human
augguuuucaaaauaa

SEQ ID NO: 3164346 - RNA, 14 nt, Human
augguuuucuugug

SEQ ID NO: 3164347 - RNA, 11 nt, Human
auguaaaaagg

SEQ ID NO: 3164348 - RNA, 20 nt, Human
auggggauagauguguggac

SEQ ID NO: 3164349 - RNA, 14 nt, Human
auggggcagaaauc

SEQ ID NO: 3164350 - RNA, 20 nt, Human
augggcuggguucuacccag

SEQ ID NO: 3164351 - RNA, 15 nt, Human
augggcucaggaucu

SEQ ID NO: 3164352 - RNA, 12 nt, Human
augggccugagu

SEQ ID NO: 3164353 - RNA, 18 nt, Human
augggccuccugugugug

SEQ ID NO: 3164354 - RNA, 17 nt, Human
augggccuccugugugu

SEQ ID NO: 3164355 - RNA, 13 nt, Human
uuugaaauggaaa

SEQ ID NO: 3164356 - RNA, 20 nt, Human
uuugaaaugcugaaaauugc

SEQ ID NO: 3164357 - RNA, 16 nt, Human
uuugaaaacagaaauu

SEQ ID NO: 3164358 - RNA, 14 nt, Human
uuugaaaacagaaa

SEQ ID NO: 3164359 - RNA, 12 nt, Human
uuugaaaugcug

SEQ ID NO: 3164360 - RNA, 21 nt, Human
uuugaaaucaguaaacacugu

SEQ ID NO: 3164361 - RNA, 20 nt, Human
uuugaaaucaguaaacacug

SEQ ID NO: 3164362 - RNA, 15 nt, Human
uuugaaaucaguaaa

SEQ ID NO: 3164363 - RNA, 14 nt, Human
uuugaaaucaguaa

SEQ ID NO: 3164364 - RNA, 20 nt, Human
uuugaaaaccaacaccauca

SEQ ID NO: 3164365 - RNA, 22 nt, Human
uuugaaaaccaacaccaucaca

SEQ ID NO: 3164366 - RNA, 21 nt, Human
uuucuuuuguuuuuugaagug

SEQ ID NO: 3164367 - RNA, 15 nt, Human
uuucuuuuuaaagcu

SEQ ID NO: 3164368 - RNA, 20 nt, Human
uuucuuuuguuuuuugaagu

SEQ ID NO: 3164369 - RNA, 22 nt, Human
uuucuuugccaucucugcucca

SEQ ID NO: 3164370 - RNA, 16 nt, Human
uuucuuuuugaaucuu

SEQ ID NO: 3164371 - RNA, 19 nt, Human
uuucuuuuugaaucuuuaa

SEQ ID NO: 3164372 - RNA, 17 nt, Human
uuucuuuuugaaucuuu

SEQ ID NO: 3164373 - RNA, 16 nt, Human
uuucuuuuuuaaauua

SEQ ID NO: 3164374 - RNA, 18 nt, Human
uuucuuuuuuaaauuaau

SEQ ID NO: 3164375 - RNA, 20 nt, Human
uuucuuuuugaaucuuuaau

SEQ ID NO: 3164376 - RNA, 12 nt, Human
auggggcugcac

SEQ ID NO: 3164377 - RNA, 24 nt, Human
auggggcugcaccggcuggccugg

SEQ ID NO: 3164378 - RNA, 17 nt, Human
augggggcacugaggac

SEQ ID NO: 3164379 - RNA, 20 nt, Human
auggggggagcacccugagg

SEQ ID NO: 3164380 - RNA, 21 nt, Human
auggggggagcacccugaggg

SEQ ID NO: 3164381 - RNA, 22 nt, Human
auggggggagcacccugagggc

SEQ ID NO: 3164382 - RNA, 21 nt, Human
auggggucucucacagacagg

SEQ ID NO: 3164383 - RNA, 20 nt, Human
auggggucucucacagacag

SEQ ID NO: 3164384 - RNA, 19 nt, Human
auggggucucucacagaca

SEQ ID NO: 3164385 - RNA, 16 nt, Human
auggggucucucacag

SEQ ID NO: 3164386 - RNA, 23 nt, Human
auggguagggcucugacaaagcu

SEQ ID NO: 3164387 - RNA, 22 nt, Human
auggguagggcucugacaaagc

SEQ ID NO: 3164388 - RNA, 15 nt, Human
augggucgcccauga

SEQ ID NO: 3164389 - RNA, 17 nt, Human
augggucgcccaugaga

SEQ ID NO: 3164390 - RNA, 22 nt, Human
augggucgcccaugagagcgca

SEQ ID NO: 3164391 - RNA, 18 nt, Human
uuucucccagucauuuaa

SEQ ID NO: 3164392 - RNA, 17 nt, Human
uuucucccagucauuua

SEQ ID NO: 3164393 - RNA, 15 nt, Human
augggauccuggagu

SEQ ID NO: 3164394 - RNA, 16 nt, Human
augggaugauugaaga

SEQ ID NO: 3164395 - RNA, 18 nt, Human
augggaugauugaagaaa

SEQ ID NO: 3164396 - RNA, 17 nt, Human
augggaugauugaagaa

SEQ ID NO: 3164397 - RNA, 19 nt, Human
augggaugauugaagaaac

SEQ ID NO: 3164398 - RNA, 19 nt, Human
uuucugcagccacuauugu

SEQ ID NO: 3164399 - RNA, 10 nt, Human
uuucuccccc

SEQ ID NO: 3164400 - RNA, 12 nt, Human
uuucuguauaga

SEQ ID NO: 3164401 - RNA, 19 nt, Human
uuucugucacaguaaaaau

SEQ ID NO: 3164402 - RNA, 23 nt, Human
uuucugggcaccggggccucgga

SEQ ID NO: 3164403 - RNA, 19 nt, Human
uuucugggguuuuucuguu

SEQ ID NO: 3164404 - RNA, 22 nt, Human
uuucuggggccuaauaaaacug

SEQ ID NO: 3164405 - RNA, 16 nt, Human
uuucugggguuuuucu

SEQ ID NO: 3164406 - RNA, 11 nt, Human
uuucuuucagu

SEQ ID NO: 3164407 - RNA, 16 nt, Human
uuucuuugaucaugaa

SEQ ID NO: 3164408 - RNA, 19 nt, Human
uuucuuugccaucucugcu

SEQ ID NO: 3164409 - RNA, 15 nt, Human
uuucuuugccaucuc

SEQ ID NO: 3164410 - RNA, 12 nt, Human
uuucuuugauca

SEQ ID NO: 3164411 - RNA, 20 nt, Human
uuucuuugaauuuucauuuu

SEQ ID NO: 3164412 - RNA, 17 nt, Human
uuucuuugaauuuucau

SEQ ID NO: 3164413 - RNA, 16 nt, Human
uuucuuugaauuuuca

SEQ ID NO: 3164414 - RNA, 11 nt, Human
uuucugugugu

SEQ ID NO: 3164415 - RNA, 14 nt, Human
uuucuguuaaaaug

SEQ ID NO: 3164416 - RNA, 13 nt, Human
uuucuguguuuau

SEQ ID NO: 3164417 - RNA, 20 nt, Human
uuucuguucagcguuuugca

SEQ ID NO: 3164418 - RNA, 22 nt, Human
uuucuguucagcguuuugcaag

SEQ ID NO: 3164419 - RNA, 17 nt, Human
uuucuguuaaaaugcau

SEQ ID NO: 3164420 - RNA, 14 nt, Human
uuucuguccuguaa

SEQ ID NO: 3164421 - RNA, 18 nt, Human
uuucuguccuguaacugu

SEQ ID NO: 3164422 - RNA, 14 nt, Human
uuucuguauagaca

SEQ ID NO: 3164423 - RNA, 10 nt, Human
uuucugugug

SEQ ID NO: 3164424 - RNA, 13 nt, Human
uuucuguguguuc

SEQ ID NO: 3164425 - RNA, 14 nt, Human
uuucuguguguucc

SEQ ID NO: 3164426 - RNA, 15 nt, Human
uuucuguguguuccu

SEQ ID NO: 3164427 - RNA, 16 nt, Human
uuucuguguguuccug

SEQ ID NO: 3164428 - RNA, 17 nt, Human
uuucuguguguuccugg

SEQ ID NO: 3164429 - RNA, 18 nt, Human
uuucuguguguuccuggc

SEQ ID NO: 3164430 - RNA, 23 nt, Human
uuucauuagcaaaaaaaguugua

SEQ ID NO: 3164431 - RNA, 21 nt, Human
uuucauuagcaaaaaaaguug

SEQ ID NO: 3164432 - RNA, 19 nt, Human
uuucauuagcaaaaaaagu

SEQ ID NO: 3164433 - RNA, 16 nt, Human
uuucauuagcaaaaaa

SEQ ID NO: 3164434 - RNA, 15 nt, Human
uuucauuagcaaaaa

SEQ ID NO: 3164435 - RNA, 14 nt, Human
uuucauuagcaaaa

SEQ ID NO: 3164436 - RNA, 17 nt, Human
uuucaacaguuucaaaa

SEQ ID NO: 3164437 - RNA, 13 nt, Human
uuucauuagcaaa

SEQ ID NO: 3164438 - RNA, 12 nt, Human
uuucauuagcaa

SEQ ID NO: 3164439 - RNA, 21 nt, Human
uuuccauauuuuuuuccuuac

SEQ ID NO: 3164440 - RNA, 13 nt, Human
uuuccaucuaaaa

SEQ ID NO: 3164441 - RNA, 22 nt, Human
uuuccauauuuuuuuccuuaca

SEQ ID NO: 3164442 - RNA, 17 nt, Human
uuuccaugaguccccug

SEQ ID NO: 3164443 - RNA, 18 nt, Human
uuuccaugaguccccugu

SEQ ID NO: 3164444 - RNA, 17 nt, Human
uuucccccuuggcucuc

SEQ ID NO: 3164445 - RNA, 16 nt, Human
uuuccaucuaaaaaua

SEQ ID NO: 3164446 - RNA, 21 nt, Human
uuucccccuuucuuccucauu

SEQ ID NO: 3164447 - RNA, 18 nt, Human
uuucccccuuucuuccuc

SEQ ID NO: 3164448 - RNA, 17 nt, Human
uuucccccuuucuuccu

SEQ ID NO: 3164449 - RNA, 14 nt, Human
uuucccccuuucuu

SEQ ID NO: 3164450 - RNA, 13 nt, Human
uuucccccuuucu

SEQ ID NO: 3164451 - RNA, 15 nt, Human
auggaauuuuuuugu

SEQ ID NO: 3164452 - RNA, 16 nt, Human
auggaauuuuuuugua

SEQ ID NO: 3164453 - RNA, 17 nt, Human
auggaauuuuuuuguac

SEQ ID NO: 3164454 - RNA, 18 nt, Human
auggaauuuuuuuguacg

SEQ ID NO: 3164455 - RNA, 19 nt, Human
auggacuaacuugucuuug

SEQ ID NO: 3164456 - RNA, 18 nt, Human
auggacucagaaacucca

SEQ ID NO: 3164457 - RNA, 11 nt, Human
auggacuuugu

SEQ ID NO: 3164458 - RNA, 12 nt, Human
auggacuuuguu

SEQ ID NO: 3164459 - RNA, 15 nt, Human
auggagaaccaccua

SEQ ID NO: 3164460 - RNA, 19 nt, Human
auggcaggugauguccugu

SEQ ID NO: 3164461 - RNA, 18 nt, Human
auggagacugucucaaga

SEQ ID NO: 3164462 - RNA, 23 nt, Human
auggcuauaggugcuacaaaaac

SEQ ID NO: 3164463 - RNA, 14 nt, Human
auggcuauuaacaa

SEQ ID NO: 3164464 - RNA, 22 nt, Human
auggcuauuaacaauuaauugu

SEQ ID NO: 3164465 - RNA, 19 nt, Human
auggcuaagcaaaauguga

SEQ ID NO: 3164466 - RNA, 17 nt, Human
augggaggggaaauggg

SEQ ID NO: 3164467 - RNA, 15 nt, Human
augggaggcuggagu

SEQ ID NO: 3164468 - RNA, 13 nt, Human
augggagggagcu

SEQ ID NO: 3164469 - RNA, 19 nt, Human
augggagagaagagaaugc

SEQ ID NO: 3164470 - RNA, 15 nt, Human
augggagagaagaga

SEQ ID NO: 3164471 - RNA, 22 nt, Human
augggagaaauaguguggaaau

SEQ ID NO: 3164472 - RNA, 18 nt, Human
uuuauuuuuaaauuaugu

SEQ ID NO: 3164473 - RNA, 23 nt, Human
uuuauuuuuagaauuuugugaaa

SEQ ID NO: 3164474 - RNA, 19 nt, Human
uuuauuuuuagaauuuugu

SEQ ID NO: 3164475 - RNA, 16 nt, Human
uuuauuuuuagaauuu

SEQ ID NO: 3164476 - RNA, 17 nt, Human
uuuauuuuuaagaaaga

SEQ ID NO: 3164477 - RNA, 16 nt, Human
uuuauuuuuaagaaag

SEQ ID NO: 3164478 - RNA, 24 nt, Human
uuucaaaaaucugaagauuguuua

SEQ ID NO: 3164479 - RNA, 23 nt, Human
uuucaaaaaucugaagauuguuu

SEQ ID NO: 3164480 - RNA, 21 nt, Human
uuucaaaaaucugaagauugu

SEQ ID NO: 3164481 - RNA, 19 nt, Human
uuucaaaaaucugaagauu

SEQ ID NO: 3164482 - RNA, 13 nt, Human
uuuauuuuucugu

SEQ ID NO: 3164483 - RNA, 15 nt, Human
uuuauuuuucuguua

SEQ ID NO: 3164484 - RNA, 13 nt, Human
uuucaaaaaucug

SEQ ID NO: 3164485 - RNA, 18 nt, Human
uuucaaaauaaaauauca

SEQ ID NO: 3164486 - RNA, 14 nt, Human
augcuguguaagcu

SEQ ID NO: 3164487 - RNA, 17 nt, Human
augcuccccugugccag

SEQ ID NO: 3164488 - RNA, 16 nt, Human
augcuccccugugcca

SEQ ID NO: 3164489 - RNA, 13 nt, Human
augcuucucacug

SEQ ID NO: 3164490 - RNA, 13 nt, Human
augcuuccagaaa

SEQ ID NO: 3164491 - RNA, 16 nt, Human
augcuucauuuguaug

SEQ ID NO: 3164492 - RNA, 21 nt, Human
augcuucauuuguaugucaaa

SEQ ID NO: 3164493 - RNA, 22 nt, Human
augcuuccagaaacacccacag

SEQ ID NO: 3164494 - RNA, 14 nt, Human
augcuuccagaaac

SEQ ID NO: 3164495 - RNA, 14 nt, Human
uuuauauuuggaug

SEQ ID NO: 3164496 - RNA, 21 nt, Human
uuuauauuucaaguacacuga

SEQ ID NO: 3164497 - RNA, 20 nt, Human
uuuauauuucaaguacacug

SEQ ID NO: 3164498 - RNA, 18 nt, Human
uuuauauuucaaguacac

SEQ ID NO: 3164499 - RNA, 17 nt, Human
uuuaucaugaaugcuuu

SEQ ID NO: 3164500 - RNA, 19 nt, Human
uuuaucaugaaugcuuuua

SEQ ID NO: 3164501 - RNA, 16 nt, Human
uuuaucaaugugucuu

SEQ ID NO: 3164502 - RNA, 19 nt, Human
uuuaucaaugugucuuucu

SEQ ID NO: 3164503 - RNA, 20 nt, Human
uuuaucaaugugucuuucua

SEQ ID NO: 3164504 - RNA, 21 nt, Human
uuuauauuuauugacucuuga

SEQ ID NO: 3164505 - RNA, 13 nt, Human
uuuauauuucaag

SEQ ID NO: 3164506 - RNA, 15 nt, Human
uuuauauuucaagua

SEQ ID NO: 3164507 - RNA, 14 nt, Human
uuuauauuucaagu

SEQ ID NO: 3164508 - RNA, 16 nt, Human
augcuaagacucagug

SEQ ID NO: 3164509 - RNA, 13 nt, Human
augcuaagaauuu

SEQ ID NO: 3164510 - RNA, 16 nt, Human
augcuaagaauuuuuu

SEQ ID NO: 3164511 - RNA, 20 nt, Human
uuuauauguauguguuuaga

SEQ ID NO: 3164512 - RNA, 21 nt, Human
uuuauauguauguguuuagaa

SEQ ID NO: 3164513 - RNA, 15 nt, Human
uuuauauguaugugu

SEQ ID NO: 3164514 - RNA, 17 nt, Human
augcuaugucauuucau

SEQ ID NO: 3164515 - RNA, 14 nt, Human
augcuaugucauuu

SEQ ID NO: 3164516 - RNA, 19 nt, Human
augcuagaacucccuuuca

SEQ ID NO: 3164517 - RNA, 22 nt, Human
augcuagaacucccuuucaaca

SEQ ID NO: 3164518 - RNA, 20 nt, Human
augcuagaacucccuuucaa

SEQ ID NO: 3164519 - RNA, 21 nt, Human
augcuagaacucccuuucaac

SEQ ID NO: 3164520 - RNA, 19 nt, Human
uuuauuaaucacuguguau

SEQ ID NO: 3164521 - RNA, 21 nt, Human
uuuauuaaucacuguguauau

SEQ ID NO: 3164522 - RNA, 15 nt, Human
uuuauuaaucacugu

SEQ ID NO: 3164523 - RNA, 13 nt, Human
uuuauuaaucacu

SEQ ID NO: 3164524 - RNA, 20 nt, Human
uuuauuaagcacguauuuau

SEQ ID NO: 3164525 - RNA, 20 nt, Human
uuuauuaagcuuuuuggaau

SEQ ID NO: 3164526 - RNA, 22 nt, Human
augcagauuuugcccuugacaa

SEQ ID NO: 3164527 - RNA, 15 nt, Human
augcagaugccuggg

SEQ ID NO: 3164528 - RNA, 16 nt, Human
uuuacaaccuagaagu

SEQ ID NO: 3164529 - RNA, 17 nt, Human
augcagcaucuaaguaa

SEQ ID NO: 3164530 - RNA, 17 nt, Human
augcagccucacagucc

SEQ ID NO: 3164531 - RNA, 18 nt, Human
augcagccacuuaggaca

SEQ ID NO: 3164532 - RNA, 17 nt, Human
augcagccacuuaggac

SEQ ID NO: 3164533 - RNA, 15 nt, Human
augcagcucuuccug

SEQ ID NO: 3164534 - RNA, 16 nt, Human
augcagcucuuccugg

SEQ ID NO: 3164535 - RNA, 22 nt, Human
augcaggagcuucugggagauu

SEQ ID NO: 3164536 - RNA, 18 nt, Human
augcagccucacaguccu

SEQ ID NO: 3164537 - RNA, 14 nt, Human
augcagcucuuccu

SEQ ID NO: 3164538 - RNA, 19 nt, Human
uuuaauuuuuuugagacag

SEQ ID NO: 3164539 - RNA, 23 nt, Human
uuuaauuucaagcuuauuuugga

SEQ ID NO: 3164540 - RNA, 16 nt, Human
uuuaauuugaaauaug

SEQ ID NO: 3164541 - RNA, 20 nt, Human
uuuaauuucaagcuuauuuu

SEQ ID NO: 3164542 - RNA, 13 nt, Human
uuuaauuucaagc

SEQ ID NO: 3164543 - RNA, 23 nt, Human
uuuacaaaggcuguauucagcaa

SEQ ID NO: 3164544 - RNA, 13 nt, Human
uuuacaaaggcug

SEQ ID NO: 3164545 - RNA, 20 nt, Human
uuuacaacacuuuaaugggu

SEQ ID NO: 3164546 - RNA, 19 nt, Human
uuuacaacacuuuaauggg

SEQ ID NO: 3164547 - RNA, 14 nt, Human
uuuacaacacuuua

SEQ ID NO: 3164548 - RNA, 17 nt, Human
uuuacaaacaaaagcau

SEQ ID NO: 3164549 - RNA, 15 nt, Human
uuuaaggucuguuug

SEQ ID NO: 3164550 - RNA, 14 nt, Human
uuuaaguagauuuc

SEQ ID NO: 3164551 - RNA, 17 nt, Human
uuuaaggucuguuugcu

SEQ ID NO: 3164552 - RNA, 14 nt, Human
uuuaagugaaauuu

SEQ ID NO: 3164553 - RNA, 13 nt, Human
uuuaagugaaauu

SEQ ID NO: 3164554 - RNA, 13 nt, Human
uuuaauguugaac

SEQ ID NO: 3164555 - RNA, 23 nt, Human
uuuaauguugaacaaaauaaauu

SEQ ID NO: 3164556 - RNA, 18 nt, Human
uuuaauguugaacaaaau

SEQ ID NO: 3164557 - RNA, 14 nt, Human
uuuaauuaagcaaa

SEQ ID NO: 3164558 - RNA, 21 nt, Human
augcgguguuugguuuuuugu

SEQ ID NO: 3164559 - RNA, 12 nt, Human
augcccagcccc

SEQ ID NO: 3164560 - RNA, 13 nt, Human
augcccagccccu

SEQ ID NO: 3164561 - RNA, 14 nt, Human
augcccagccccuu

SEQ ID NO: 3164562 - RNA, 16 nt, Human
augccucagccuccug

SEQ ID NO: 3164563 - RNA, 14 nt, Human
augcccuggaucca

SEQ ID NO: 3164564 - RNA, 22 nt, Human
augcaguuacaaauuauaaugu

SEQ ID NO: 3164565 - RNA, 19 nt, Human
augcaguguagauuuuaua

SEQ ID NO: 3164566 - RNA, 23 nt, Human
augcaguguagauuuuauagugu

SEQ ID NO: 3164567 - RNA, 20 nt, Human
augcaguuacaaauuauaau

SEQ ID NO: 3164568 - RNA, 19 nt, Human
augcaguuacaaauuauaa

SEQ ID NO: 3164569 - RNA, 13 nt, Human
augcagugcuucc

SEQ ID NO: 3164570 - RNA, 23 nt, Human
augcagugguaugaucacggcuc

SEQ ID NO: 3164571 - RNA, 21 nt, Human
augccaaagaaugaauuucaa

SEQ ID NO: 3164572 - RNA, 13 nt, Human
augcauuuggaac

SEQ ID NO: 3164573 - RNA, 21 nt, Human
augccauuuaaagcuuauuaa

SEQ ID NO: 3164574 - RNA, 17 nt, Human
augccauuuaaagcuua

SEQ ID NO: 3164575 - RNA, 11 nt, Human
augcccagccc

SEQ ID NO: 3164576 - RNA, 13 nt, Human
augccaauuucuc

SEQ ID NO: 3164577 - RNA, 15 nt, Human
augauaguugaaugu

SEQ ID NO: 3164578 - RNA, 17 nt, Human
augauauaacuuuagaa

SEQ ID NO: 3164579 - RNA, 17 nt, Human
augauaugcuuguaacu

SEQ ID NO: 3164580 - RNA, 23 nt, Human
augauaugcuuguaacuaaaaua

SEQ ID NO: 3164581 - RNA, 15 nt, Human
augaucuaggaagac

SEQ ID NO: 3164582 - RNA, 17 nt, Human
augaucuaggaagacuu

SEQ ID NO: 3164583 - RNA, 20 nt, Human
augaucuaggaagacuuugg

SEQ ID NO: 3164584 - RNA, 17 nt, Human
uuggugcuuuuuauaaa

SEQ ID NO: 3164585 - RNA, 19 nt, Human
uuggugcuuuuuauaaaaa

SEQ ID NO: 3164586 - RNA, 21 nt, Human
uuggugcuuuuuauaaaaaga

SEQ ID NO: 3164587 - RNA, 21 nt, Human
uuguuccacaaguuaaauaaa

SEQ ID NO: 3164588 - RNA, 21 nt, Human
uuguucauuucauccuuucac

SEQ ID NO: 3164589 - RNA, 22 nt, Human
uuguugaacuguuagaauguaa

SEQ ID NO: 3164590 - RNA, 11 nt, Human
uuguuccaguu

SEQ ID NO: 3164591 - RNA, 12 nt, Human
uuguuccagaga

SEQ ID NO: 3164592 - RNA, 18 nt, Human
uuguugaacuguuagaau

SEQ ID NO: 3164593 - RNA, 15 nt, Human
uuguugaacuguuag

SEQ ID NO: 3164594 - RNA, 15 nt, Human
uuguugaaagaaagu

SEQ ID NO: 3164595 - RNA, 20 nt, Human
uuguucuuguuuuuaaguuu

SEQ ID NO: 3164596 - RNA, 15 nt, Human
uuguucuuguuuuua

SEQ ID NO: 3164597 - RNA, 19 nt, Human
augauugcagaauuguuua

SEQ ID NO: 3164598 - RNA, 12 nt, Human
augauugcagaa

SEQ ID NO: 3164599 - RNA, 15 nt, Human
augauugcuuuuaaa

SEQ ID NO: 3164600 - RNA, 14 nt, Human
augauugcuuuuaa

SEQ ID NO: 3164601 - RNA, 13 nt, Human
augauugcuuuua

SEQ ID NO: 3164602 - RNA, 21 nt, Human
augauugcagaauuguuuaga

SEQ ID NO: 3164603 - RNA, 13 nt, Human
augauugaagaaa

SEQ ID NO: 3164604 - RNA, 12 nt, Human
augauugaaaau

SEQ ID NO: 3164605 - RNA, 13 nt, Human
augcaagcaguuu

SEQ ID NO: 3164606 - RNA, 23 nt, Human
augcaagcaguuucaauaaaguu

SEQ ID NO: 3164607 - RNA, 22 nt, Human
augcaagcaguuucaauaaagu

SEQ ID NO: 3164608 - RNA, 16 nt, Human
augcaagcaguuucaa

SEQ ID NO: 3164609 - RNA, 15 nt, Human
augcaagcaguuuca

SEQ ID NO: 3164610 - RNA, 17 nt, Human
augauugcuuuuaaaau

SEQ ID NO: 3164611 - RNA, 15 nt, Human
augcaaccauuugaa

SEQ ID NO: 3164612 - RNA, 19 nt, Human
augcacuuuguucuggcuc

SEQ ID NO: 3164613 - RNA, 20 nt, Human
augcacuuuguucuggcucu

SEQ ID NO: 3164614 - RNA, 17 nt, Human
augcacuuuguucuggc

SEQ ID NO: 3164615 - RNA, 16 nt, Human
augcacuuuguucugg

SEQ ID NO: 3164616 - RNA, 14 nt, Human
augcaccagcccuu

SEQ ID NO: 3164617 - RNA, 22 nt, Human
augcaccagcccuuagcaggga

SEQ ID NO: 3164618 - RNA, 13 nt, Human
uuuaaagaaugcu

SEQ ID NO: 3164619 - RNA, 23 nt, Human
uuuaaauaaaaauuacuguguua

SEQ ID NO: 3164620 - RNA, 21 nt, Human
uuuaaagguuucuauuuucuc

SEQ ID NO: 3164621 - RNA, 15 nt, Human
uuuaaaguaugcauu

SEQ ID NO: 3164622 - RNA, 21 nt, Human
uuuaaaguaugcauuauuaaa

SEQ ID NO: 3164623 - RNA, 23 nt, Human
uuuaaaaauacagauagauauau

SEQ ID NO: 3164624 - RNA, 19 nt, Human
uuuaaaaaugguaucaaaa

SEQ ID NO: 3164625 - RNA, 20 nt, Human
uuuaaaaaugguaucaaaau

SEQ ID NO: 3164626 - RNA, 22 nt, Human
uuuaaaaaugguaucaaaauua

SEQ ID NO: 3164627 - RNA, 14 nt, Human
uuuaaaaauuuacu

SEQ ID NO: 3164628 - RNA, 12 nt, Human
uuuaaaaauuua

SEQ ID NO: 3164629 - RNA, 23 nt, Human
uuuaaaaauuagccuaagauaua

SEQ ID NO: 3164630 - RNA, 13 nt, Human
uuguuuugcuucc

SEQ ID NO: 3164631 - RNA, 16 nt, Human
uuguuuugcuuccccu

SEQ ID NO: 3164632 - RNA, 14 nt, Human
uuguuuugcuuccc

SEQ ID NO: 3164633 - RNA, 14 nt, Human
uuguuuugcuuuuu

SEQ ID NO: 3164634 - RNA, 14 nt, Human
uuguuuugaaaaua

SEQ ID NO: 3164635 - RNA, 15 nt, Human
uuguuuugaaaauaa

SEQ ID NO: 3164636 - RNA, 13 nt, Human
aucaggccauugu

SEQ ID NO: 3164637 - RNA, 16 nt, Human
aucaggccauuguccc

SEQ ID NO: 3164638 - RNA, 14 nt, Human
aucaggccaggccc

SEQ ID NO: 3164639 - RNA, 13 nt, Human
aucaggcucccag

SEQ ID NO: 3164640 - RNA, 14 nt, Human
aucaggcucccagg

SEQ ID NO: 3164641 - RNA, 21 nt, Human
aucagguccugcucagcagug

SEQ ID NO: 3164642 - RNA, 19 nt, Human
aucagguccugcucagcag

SEQ ID NO: 3164643 - RNA, 14 nt, Human
aucagguccugcuc

SEQ ID NO: 3164644 - RNA, 13 nt, Human
aucagguccugcu

SEQ ID NO: 3164645 - RNA, 18 nt, Human
aucagggaccaccagagg

SEQ ID NO: 3164646 - RNA, 15 nt, Human
aucaggccaggcccu

SEQ ID NO: 3164647 - RNA, 16 nt, Human
aucaggccaggcccuc

SEQ ID NO: 3164648 - RNA, 18 nt, Human
aucaggccaggcccucug

SEQ ID NO: 3164649 - RNA, 12 nt, Human
aucagaauucuc

SEQ ID NO: 3164650 - RNA, 20 nt, Human
aucagaauaaccuucaaaua

SEQ ID NO: 3164651 - RNA, 18 nt, Human
aucagaauggaagagaga

SEQ ID NO: 3164652 - RNA, 20 nt, Human
aucagaauggaagagagaaa

SEQ ID NO: 3164653 - RNA, 13 nt, Human
aucagcaaagaaa

SEQ ID NO: 3164654 - RNA, 14 nt, Human
aucagcaaagaaaa

SEQ ID NO: 3164655 - RNA, 23 nt, Human
aucagcaaagaaaaaaaaaaaag

SEQ ID NO: 3164656 - RNA, 13 nt, Human
aucagauugcuuu

SEQ ID NO: 3164657 - RNA, 14 nt, Human
aucagauugcuuuu

SEQ ID NO: 3164658 - RNA, 15 nt, Human
aucagauugcuuuug

SEQ ID NO: 3164659 - RNA, 18 nt, Human
aucagauugcuuuugugc

SEQ ID NO: 3164660 - RNA, 19 nt, Human
aucagauugcuuuugugca

SEQ ID NO: 3164661 - RNA, 12 nt, Human
aucacuuucaua

SEQ ID NO: 3164662 - RNA, 18 nt, Human
aucagaaguuucucagcu

SEQ ID NO: 3164663 - RNA, 11 nt, Human
aucagaauucu

SEQ ID NO: 3164664 - RNA, 20 nt, Human
uucucacauggaaugagggu

SEQ ID NO: 3164665 - RNA, 13 nt, Human
uucucaccagcug

SEQ ID NO: 3164666 - RNA, 18 nt, Human
uucucacuccuaccuggu

SEQ ID NO: 3164667 - RNA, 16 nt, Human
uucucacuccuaccug

SEQ ID NO: 3164668 - RNA, 16 nt, Human
uucuaggaccuguguc

SEQ ID NO: 3164669 - RNA, 14 nt, Human
uucucaccagcugu

SEQ ID NO: 3164670 - RNA, 23 nt, Human
uucuaagaagugaaaaucuacac

SEQ ID NO: 3164671 - RNA, 13 nt, Human
uucuaagaaguga

SEQ ID NO: 3164672 - RNA, 15 nt, Human
uucuaaguaaaacca

SEQ ID NO: 3164673 - RNA, 16 nt, Human
uucuaaguaaaaccac

SEQ ID NO: 3164674 - RNA, 16 nt, Human
uucuagcauggcugcc

SEQ ID NO: 3164675 - RNA, 15 nt, Human
uucuagauuaccaug

SEQ ID NO: 3164676 - RNA, 14 nt, Human
uucggccuccaucc

SEQ ID NO: 3164677 - RNA, 13 nt, Human
uucgcuccugugu

SEQ ID NO: 3164678 - RNA, 19 nt, Human
uucgcuccugugucuugca

SEQ ID NO: 3164679 - RNA, 15 nt, Human
uucgcuccugugucu

SEQ ID NO: 3164680 - RNA, 12 nt, Human
uucggcauuuga

SEQ ID NO: 3164681 - RNA, 13 nt, Human
uucccucccugcu

SEQ ID NO: 3164682 - RNA, 23 nt, Human
uucccucccugcugucauugcuu

SEQ ID NO: 3164683 - RNA, 16 nt, Human
uucccucccugcuguc

SEQ ID NO: 3164684 - RNA, 15 nt, Human
uucccucccugcugu

SEQ ID NO: 3164685 - RNA, 19 nt, Human
uuccgucacaucccacccc

SEQ ID NO: 3164686 - RNA, 14 nt, Human
uuccgucacauccc

SEQ ID NO: 3164687 - RNA, 15 nt, Human
uucccuauuagagaa

SEQ ID NO: 3164688 - RNA, 20 nt, Human
uucccucaccuuucccaucu

SEQ ID NO: 3164689 - RNA, 22 nt, Human
uucccgcucagcccucccugcc

SEQ ID NO: 3164690 - RNA, 21 nt, Human
uucccgcucagcccucccugc

SEQ ID NO: 3164691 - RNA, 18 nt, Human
uucccgcucagcccuccc

SEQ ID NO: 3164692 - RNA, 16 nt, Human
uucccgcucagcccuc

SEQ ID NO: 3164693 - RNA, 19 nt, Human
auagauugugaauaaugau

SEQ ID NO: 3164694 - RNA, 15 nt, Human
auagcaaaaucaaga

SEQ ID NO: 3164695 - RNA, 15 nt, Human
uucccgcucagcccu

SEQ ID NO: 3164696 - RNA, 13 nt, Human
uuccucuuuccau

SEQ ID NO: 3164697 - RNA, 19 nt, Human
uuccucugcuaaauugaug

SEQ ID NO: 3164698 - RNA, 16 nt, Human
uuccucugcuaaauug

SEQ ID NO: 3164699 - RNA, 14 nt, Human
uuccucugcuaaau

SEQ ID NO: 3164700 - RNA, 22 nt, Human
uuccucuuuccaucuacccucc

SEQ ID NO: 3164701 - RNA, 17 nt, Human
uuccucuuuccaucuac

SEQ ID NO: 3164702 - RNA, 14 nt, Human
uuccugaaccgaug

SEQ ID NO: 3164703 - RNA, 17 nt, Human
uuccucugcuaaauuga

SEQ ID NO: 3164704 - RNA, 17 nt, Human
uuccuaauccucuagga

SEQ ID NO: 3164705 - RNA, 12 nt, Human
uuccuaaaacag

SEQ ID NO: 3164706 - RNA, 22 nt, Human
uuccguuugauuugucacugcu

SEQ ID NO: 3164707 - RNA, 16 nt, Human
uuccuaauuccacagc

SEQ ID NO: 3164708 - RNA, 17 nt, Human
uuccuaauuccacagcu

SEQ ID NO: 3164709 - RNA, 18 nt, Human
uuccuaauuccacagcug

SEQ ID NO: 3164710 - RNA, 14 nt, Human
uuccucugagccuu

SEQ ID NO: 3164711 - RNA, 17 nt, Human
uuccucugagccuuggg

SEQ ID NO: 3164712 - RNA, 21 nt, Human
uuccucugaggcugaaauuca

SEQ ID NO: 3164713 - RNA, 15 nt, Human
uuccuacacaggaca

SEQ ID NO: 3164714 - RNA, 14 nt, Human
uuccuacacaggac

SEQ ID NO: 3164715 - RNA, 15 nt, Human
auauuuuuaucuaua

SEQ ID NO: 3164716 - RNA, 16 nt, Human
auauuuuuaucuauau

SEQ ID NO: 3164717 - RNA, 22 nt, Human
auauuuuuaucuauauaaaaua

SEQ ID NO: 3164718 - RNA, 16 nt, Human
uuccugugccagguga

SEQ ID NO: 3164719 - RNA, 16 nt, Human
uuccuguguccaugug

SEQ ID NO: 3164720 - RNA, 14 nt, Human
uuccugugccaggu

SEQ ID NO: 3164721 - RNA, 18 nt, Human
auauuuuuuguuaaauga

SEQ ID NO: 3164722 - RNA, 20 nt, Human
auauuuuuuguuaaaugauu

SEQ ID NO: 3164723 - RNA, 17 nt, Human
aucaaauuaauugugug

SEQ ID NO: 3164724 - RNA, 16 nt, Human
aucaaauuaauugugu

SEQ ID NO: 3164725 - RNA, 14 nt, Human
aucaacagauaaau

SEQ ID NO: 3164726 - RNA, 16 nt, Human
aucaacacacauuuua

SEQ ID NO: 3164727 - RNA, 21 nt, Human
aucaagaugugacauguuuua

SEQ ID NO: 3164728 - RNA, 21 nt, Human
aucaaucuuuagaaaaggcau

SEQ ID NO: 3164729 - RNA, 15 nt, Human
aucaaucuuuagaaa

SEQ ID NO: 3164730 - RNA, 14 nt, Human
aucaaugaguguga

SEQ ID NO: 3164731 - RNA, 14 nt, Human
aucaaugaguaaca

SEQ ID NO: 3164732 - RNA, 21 nt, Human
aucaaucuguaaaacuaagaa

SEQ ID NO: 3164733 - RNA, 21 nt, Human
aucaagggccuaucuuggaga

SEQ ID NO: 3164734 - RNA, 15 nt, Human
aucacggcucacugc

SEQ ID NO: 3164735 - RNA, 13 nt, Human
aucacgccacugc

SEQ ID NO: 3164736 - RNA, 18 nt, Human
aucacggcucacugcagc

SEQ ID NO: 3164737 - RNA, 21 nt, Human
auccuacgaguaauugcauuu

SEQ ID NO: 3164738 - RNA, 24 nt, Human
auccuacgaguaauugcauuugcu

SEQ ID NO: 3164739 - RNA, 16 nt, Human
auccuaggcauuugcu

SEQ ID NO: 3164740 - RNA, 16 nt, Human
auccuccucagaucuu

SEQ ID NO: 3164741 - RNA, 14 nt, Human
auccuccucagauc

SEQ ID NO: 3164742 - RNA, 17 nt, Human
auccggggccagcuccg

SEQ ID NO: 3164743 - RNA, 16 nt, Human
auccggggccagcucc

SEQ ID NO: 3164744 - RNA, 12 nt, Human
auccuaagcuau

SEQ ID NO: 3164745 - RNA, 18 nt, Human
auccuaagauguguucuu

SEQ ID NO: 3164746 - RNA, 21 nt, Human
auccuaagauguguucuuauu

SEQ ID NO: 3164747 - RNA, 18 nt, Human
auccuacaagacacagug

SEQ ID NO: 3164748 - RNA, 19 nt, Human
auccuacaagacacaguga

SEQ ID NO: 3164749 - RNA, 14 nt, Human
auccuacaagacac

SEQ ID NO: 3164750 - RNA, 18 nt, Human
uugaacccgggaggcaga

SEQ ID NO: 3164751 - RNA, 19 nt, Human
uugaacccgggaggcagag

SEQ ID NO: 3164752 - RNA, 13 nt, Human
uugaaauucuauu

SEQ ID NO: 3164753 - RNA, 14 nt, Human
uugaaauucuauuu

SEQ ID NO: 3164754 - RNA, 21 nt, Human
uugaaauucuauuuauaauac

SEQ ID NO: 3164755 - RNA, 15 nt, Human
uugaaagugccuuug

SEQ ID NO: 3164756 - RNA, 15 nt, Human
uugaaauggaaauua

SEQ ID NO: 3164757 - RNA, 17 nt, Human
uugaaaugcugaaaauu

SEQ ID NO: 3164758 - RNA, 13 nt, Human
uugaaaugcugaa

SEQ ID NO: 3164759 - RNA, 11 nt, Human
uugaaaugcug

SEQ ID NO: 3164760 - RNA, 21 nt, Human
uucuuuuugcucuaaaauauu

SEQ ID NO: 3164761 - RNA, 20 nt, Human
uucuuuuugcucuaaaauau

SEQ ID NO: 3164762 - RNA, 14 nt, Human
uucuuuuugcucua

SEQ ID NO: 3164763 - RNA, 13 nt, Human
uucuuuuugcucu

SEQ ID NO: 3164764 - RNA, 12 nt, Human
uucuuuuugcuc

SEQ ID NO: 3164765 - RNA, 17 nt, Human
uucuuuuugaucaucuu

SEQ ID NO: 3164766 - RNA, 18 nt, Human
uucuuuuugaaucuuuaa

SEQ ID NO: 3164767 - RNA, 12 nt, Human
uucuuuuugaau

SEQ ID NO: 3164768 - RNA, 17 nt, Human
uugaaagaauguaaagc

SEQ ID NO: 3164769 - RNA, 14 nt, Human
uucuuuuuuuguga

SEQ ID NO: 3164770 - RNA, 16 nt, Human
uugaaagaauguaaag

SEQ ID NO: 3164771 - RNA, 22 nt, Human
uucuuuuuuauuaaucacugug

SEQ ID NO: 3164772 - RNA, 20 nt, Human
uucuuuuuuauuaaucacug

SEQ ID NO: 3164773 - RNA, 21 nt, Human
uucuuuuuuauuaaucacugu

SEQ ID NO: 3164774 - RNA, 17 nt, Human
uucuuuuuuaaauuaau

SEQ ID NO: 3164775 - RNA, 15 nt, Human
uucuuuuuuauuaau

SEQ ID NO: 3164776 - RNA, 16 nt, Human
uucuuuuuuauuaauc

SEQ ID NO: 3164777 - RNA, 14 nt, Human
uucuuuuuuauuaa

SEQ ID NO: 3164778 - RNA, 20 nt, Human
uucuucugcuucagccuccc

SEQ ID NO: 3164779 - RNA, 19 nt, Human
uucuucugaucacugaaau

SEQ ID NO: 3164780 - RNA, 14 nt, Human
uucuucugaggccu

SEQ ID NO: 3164781 - RNA, 13 nt, Human
uucuucuguaaua

SEQ ID NO: 3164782 - RNA, 14 nt, Human
uucuucuguaauau

SEQ ID NO: 3164783 - RNA, 15 nt, Human
uucuucuguaauauu

SEQ ID NO: 3164784 - RNA, 23 nt, Human
uucuucuguaauauuuacaaugu

SEQ ID NO: 3164785 - RNA, 20 nt, Human
uucuucugaucacugaaaua

SEQ ID NO: 3164786 - RNA, 14 nt, Human
uucuuugcccuuua

SEQ ID NO: 3164787 - RNA, 21 nt, Human
uucuuugccaucucugcucca

SEQ ID NO: 3164788 - RNA, 16 nt, Human
uucuuuggaguuaaaa

SEQ ID NO: 3164789 - RNA, 20 nt, Human
uucuuuggaguuaaaaugca

SEQ ID NO: 3164790 - RNA, 16 nt, Human
uucuugaauauaaaaa

SEQ ID NO: 3164791 - RNA, 17 nt, Human
uucuugaauauaaaaaa

SEQ ID NO: 3164792 - RNA, 13 nt, Human
aucccucauccuc

SEQ ID NO: 3164793 - RNA, 21 nt, Human
aucccucauccucauacccac

SEQ ID NO: 3164794 - RNA, 23 nt, Human
aucccucauccucauacccaccc

SEQ ID NO: 3164795 - RNA, 14 nt, Human
aucccucauccuca

SEQ ID NO: 3164796 - RNA, 24 nt, Human
aucccauaugccugggcagaagga

SEQ ID NO: 3164797 - RNA, 17 nt, Human
aucccauaugccugggc

SEQ ID NO: 3164798 - RNA, 13 nt, Human
uucuucucccuca

SEQ ID NO: 3164799 - RNA, 11 nt, Human
uucuucucccu

SEQ ID NO: 3164800 - RNA, 14 nt, Human
uucuuaaucauuuu

SEQ ID NO: 3164801 - RNA, 18 nt, Human
uucuuaauauauagcauu

SEQ ID NO: 3164802 - RNA, 14 nt, Human
uucuucucccucag

SEQ ID NO: 3164803 - RNA, 15 nt, Human
uucuucugcuucagc

SEQ ID NO: 3164804 - RNA, 13 nt, Human
uucuucugcuuca

SEQ ID NO: 3164805 - RNA, 15 nt, Human
uucugccauauucug

SEQ ID NO: 3164806 - RNA, 16 nt, Human
uucugccauuucaugu

SEQ ID NO: 3164807 - RNA, 19 nt, Human
uucugaacuuggcgcugcc

SEQ ID NO: 3164808 - RNA, 22 nt, Human
uucugaacuuggcgcugccccu

SEQ ID NO: 3164809 - RNA, 18 nt, Human
uucugccugcccaggccc

SEQ ID NO: 3164810 - RNA, 17 nt, Human
uucugccugcccaggcc

SEQ ID NO: 3164811 - RNA, 15 nt, Human
uucuggcucuuccag

SEQ ID NO: 3164812 - RNA, 21 nt, Human
uucugccugcccaggccccug

SEQ ID NO: 3164813 - RNA, 16 nt, Human
uucuggcucuuccagg

SEQ ID NO: 3164814 - RNA, 17 nt, Human
uucuggcucuuccaggc

SEQ ID NO: 3164815 - RNA, 20 nt, Human
uucugggcaccacaaaauau

SEQ ID NO: 3164816 - RNA, 23 nt, Human
uucugggcaccacaaaauauaca

SEQ ID NO: 3164817 - RNA, 23 nt, Human
uucucuucuccccuuccauuucu

SEQ ID NO: 3164818 - RNA, 22 nt, Human
uucucuugccucagcuucccca

SEQ ID NO: 3164819 - RNA, 14 nt, Human
uucucuugccucag

SEQ ID NO: 3164820 - RNA, 12 nt, Human
uucucuugccuc

SEQ ID NO: 3164821 - RNA, 19 nt, Human
uucucuucauauucagcuu

SEQ ID NO: 3164822 - RNA, 15 nt, Human
uucucuuccaggcag

SEQ ID NO: 3164823 - RNA, 22 nt, Human
uucucuuccaaccauuuaucuu

SEQ ID NO: 3164824 - RNA, 16 nt, Human
uucucuuccaggcagc

SEQ ID NO: 3164825 - RNA, 19 nt, Human
uucucuucuccccuuccau

SEQ ID NO: 3164826 - RNA, 21 nt, Human
uucucuucuccccuuccauuu

SEQ ID NO: 3164827 - RNA, 20 nt, Human
uucucuucuccccuuccauu

SEQ ID NO: 3164828 - RNA, 20 nt, Human
uucuccuuaagagacaauuu

SEQ ID NO: 3164829 - RNA, 23 nt, Human
aucaguaguuugcauuucagaaa

SEQ ID NO: 3164830 - RNA, 21 nt, Human
aucaguaguuugcauuucaga

SEQ ID NO: 3164831 - RNA, 19 nt, Human
aucaguaguuugcauuuca

SEQ ID NO: 3164832 - RNA, 18 nt, Human
aucaguaguuugcauuuc

SEQ ID NO: 3164833 - RNA, 20 nt, Human
uucuccugcguguucucaga

SEQ ID NO: 3164834 - RNA, 19 nt, Human
aucaggugcugccauccag

SEQ ID NO: 3164835 - RNA, 17 nt, Human
aucagguuaggcaguau

SEQ ID NO: 3164836 - RNA, 13 nt, Human
aucaguaaaauua

SEQ ID NO: 3164837 - RNA, 17 nt, Human
aucaguaaaauuauacu

SEQ ID NO: 3164838 - RNA, 19 nt, Human
aucaguaaaauuauacugu

SEQ ID NO: 3164839 - RNA, 21 nt, Human
aucaguaaaauuauacugugu

SEQ ID NO: 3164840 - RNA, 15 nt, Human
aucaguaaacacugu

SEQ ID NO: 3164841 - RNA, 14 nt, Human
aucaguaaacacug

SEQ ID NO: 3164842 - RNA, 13 nt, Human
aucaguaaacacu

SEQ ID NO: 3164843 - RNA, 22 nt, Human
aucagguuaggcaguauaaaga

SEQ ID NO: 3164844 - RNA, 17 nt, Human
aucaguagcuuaagaaa

SEQ ID NO: 3164845 - RNA, 15 nt, Human
aucaguacuuguuuc

SEQ ID NO: 3164846 - RNA, 19 nt, Human
aucaguaaacacuguguau

SEQ ID NO: 3164847 - RNA, 21 nt, Human
uucuggggccuaauaaaacug

SEQ ID NO: 3164848 - RNA, 22 nt, Human
uucuggggccuaauaaaacuga

SEQ ID NO: 3164849 - RNA, 23 nt, Human
uucuggggccuaauaaaacugau

SEQ ID NO: 3164850 - RNA, 23 nt, Human
uucuggggagcuggacaguggag

SEQ ID NO: 3164851 - RNA, 15 nt, Human
auccaguaucuugaa

SEQ ID NO: 3164852 - RNA, 16 nt, Human
auccaguaucuugaag

SEQ ID NO: 3164853 - RNA, 15 nt, Human
auccacccaccucag

SEQ ID NO: 3164854 - RNA, 13 nt, Human
auccacccaccuc

SEQ ID NO: 3164855 - RNA, 18 nt, Human
auccaagcuggucccacu

SEQ ID NO: 3164856 - RNA, 19 nt, Human
auccauagcaccuccacau

SEQ ID NO: 3164857 - RNA, 21 nt, Human
auccaguaucuugaagacuuu

SEQ ID NO: 3164858 - RNA, 13 nt, Human
auccaucaggcca

SEQ ID NO: 3164859 - RNA, 14 nt, Human
auccaucagugcca

SEQ ID NO: 3164860 - RNA, 13 nt, Human
auccaucagugcc

SEQ ID NO: 3164861 - RNA, 21 nt, Human
auccauacuaacccuuuucca

SEQ ID NO: 3164862 - RNA, 14 nt, Human
auccauagugacuu

SEQ ID NO: 3164863 - RNA, 22 nt, Human
auccauagugacuuuucaagua

SEQ ID NO: 3164864 - RNA, 16 nt, Human
auccauagugacuuuu

SEQ ID NO: 3164865 - RNA, 15 nt, Human
auccauagugacuuu

SEQ ID NO: 3164866 - RNA, 21 nt, Human
auccauauuaaguaagucuca

SEQ ID NO: 3164867 - RNA, 19 nt, Human
auccauauuaaguaagucu

SEQ ID NO: 3164868 - RNA, 19 nt, Human
aucccaaacccuucagugc

SEQ ID NO: 3164869 - RNA, 20 nt, Human
aucccaaacccuucagugcc

SEQ ID NO: 3164870 - RNA, 12 nt, Human
aucccagcccca

SEQ ID NO: 3164871 - RNA, 22 nt, Human
auccauuuuuuauauuucaagu

SEQ ID NO: 3164872 - RNA, 15 nt, Human
auccaucagugccaa

SEQ ID NO: 3164873 - RNA, 18 nt, Human
aucccauaugccugggca

SEQ ID NO: 3164874 - RNA, 22 nt, Human
aucccagcuucggcauuugauc

SEQ ID NO: 3164875 - RNA, 20 nt, Human
aucccagcuucggcauuuga

SEQ ID NO: 3164876 - RNA, 18 nt, Human
uugacacuuuucauauca

SEQ ID NO: 3164877 - RNA, 19 nt, Human
uugacacuuuucauaucau

SEQ ID NO: 3164878 - RNA, 12 nt, Human
uugaauacuuga

SEQ ID NO: 3164879 - RNA, 14 nt, Human
uugaauacuugaac

SEQ ID NO: 3164880 - RNA, 16 nt, Human
uugaauacuugaacca

SEQ ID NO: 3164881 - RNA, 17 nt, Human
uugaauacuugaaccau

SEQ ID NO: 3164882 - RNA, 13 nt, Human
uugaaucacagua

SEQ ID NO: 3164883 - RNA, 15 nt, Human
uugaaggcagaaagc

SEQ ID NO: 3164884 - RNA, 17 nt, Human
uugaaggcagaaagcaa

SEQ ID NO: 3164885 - RNA, 13 nt, Human
uugaagccugcuc

SEQ ID NO: 3164886 - RNA, 16 nt, Human
uugaagccugcuccuu

SEQ ID NO: 3164887 - RNA, 15 nt, Human
uugaagccugcuccu

SEQ ID NO: 3164888 - RNA, 13 nt, Human
uugaagccuuugu

SEQ ID NO: 3164889 - RNA, 19 nt, Human
uugaagccugcuccuuccc

SEQ ID NO: 3164890 - RNA, 23 nt, Human
uugaauaaacaccacuggauuaa

SEQ ID NO: 3164891 - RNA, 21 nt, Human
uugaauaaacaccacuggauu

SEQ ID NO: 3164892 - RNA, 22 nt, Human
uugaauaaacaccacuggauua

SEQ ID NO: 3164893 - RNA, 12 nt, Human
uugaauaaacua

SEQ ID NO: 3164894 - RNA, 18 nt, Human
aucuaaaaauaacuguaa

SEQ ID NO: 3164895 - RNA, 16 nt, Human
aucuaaaaauaacugu

SEQ ID NO: 3164896 - RNA, 20 nt, Human
aucuaaaaauaacuguaauu

SEQ ID NO: 3164897 - RNA, 16 nt, Human
aucuaaaucuguccaa

SEQ ID NO: 3164898 - RNA, 20 nt, Human
aucguugcaaccacugcaau

SEQ ID NO: 3164899 - RNA, 16 nt, Human
auccucuguacagagc

SEQ ID NO: 3164900 - RNA, 17 nt, Human
auccucuguacagagcc

SEQ ID NO: 3164901 - RNA, 15 nt, Human
aucguuaucacugug

SEQ ID NO: 3164902 - RNA, 13 nt, Human
auccuccuccuuc

SEQ ID NO: 3164903 - RNA, 18 nt, Human
auccuccuccuuccuagu

SEQ ID NO: 3164904 - RNA, 17 nt, Human
auccuccuccuuccuag

SEQ ID NO: 3164905 - RNA, 14 nt, Human
auccuccuccuucc

SEQ ID NO: 3164906 - RNA, 23 nt, Human
uugacagagccugccccagcgcu

SEQ ID NO: 3164907 - RNA, 19 nt, Human
uugacagagccugccccag

SEQ ID NO: 3164908 - RNA, 17 nt, Human
uugacagagccugcccc

SEQ ID NO: 3164909 - RNA, 23 nt, Human
uugacagagagagauacucuggg

SEQ ID NO: 3164910 - RNA, 12 nt, Human
uugacagcucag

SEQ ID NO: 3164911 - RNA, 13 nt, Human
uugacuuuauaaa

SEQ ID NO: 3164912 - RNA, 12 nt, Human
uugagacagagu

SEQ ID NO: 3164913 - RNA, 18 nt, Human
uugaguauauuauaauag

SEQ ID NO: 3164914 - RNA, 13 nt, Human
uugagucauuuua

SEQ ID NO: 3164915 - RNA, 16 nt, Human
uugagaucagccuggg

SEQ ID NO: 3164916 - RNA, 15 nt, Human
uugagaucagccugg

SEQ ID NO: 3164917 - RNA, 16 nt, Human
uugagaccgugaagau

SEQ ID NO: 3164918 - RNA, 21 nt, Human
uugagaccgugaagauacuuu

SEQ ID NO: 3164919 - RNA, 22 nt, Human
uugagaccgugaagauacuuug

SEQ ID NO: 3164920 - RNA, 18 nt, Human
aucuacacuccagugaga

SEQ ID NO: 3164921 - RNA, 12 nt, Human
aucuaauuucaa

SEQ ID NO: 3164922 - RNA, 19 nt, Human
aucuacacuccagugagac

SEQ ID NO: 3164923 - RNA, 12 nt, Human
aucuacugcauu

SEQ ID NO: 3164924 - RNA, 13 nt, Human
aucuacugcauuu

SEQ ID NO: 3164925 - RNA, 14 nt, Human
aucuacugcauuua

SEQ ID NO: 3164926 - RNA, 18 nt, Human
aucuaauauguaacaagc

SEQ ID NO: 3164927 - RNA, 20 nt, Human
uugagugaagcugggagaac

SEQ ID NO: 3164928 - RNA, 21 nt, Human
uugagucuuuuuuuuuuaagu

SEQ ID NO: 3164929 - RNA, 11 nt, Human
uugagucuuuu

SEQ ID NO: 3164930 - RNA, 20 nt, Human
uugaguuaagucuaucuggu

SEQ ID NO: 3164931 - RNA, 20 nt, Human
uugaguugauucagcucugc

SEQ ID NO: 3164932 - RNA, 18 nt, Human
uugaguucuuccuguaau

SEQ ID NO: 3164933 - RNA, 23 nt, Human
uugaguucuuccuguaaucuugu

SEQ ID NO: 3164934 - RNA, 17 nt, Human
uugaguuguuuuuguau

SEQ ID NO: 3164935 - RNA, 18 nt, Human
uugaguuguuuuuguaua

SEQ ID NO: 3164936 - RNA, 19 nt, Human
uugaguuguuuuuguauau

SEQ ID NO: 3164937 - RNA, 16 nt, Human
uugauaauuuuccuuu

SEQ ID NO: 3164938 - RNA, 14 nt, Human
uugauaauuuuccu

SEQ ID NO: 3164939 - RNA, 18 nt, Human
uugauaauuuuccuuuaa

SEQ ID NO: 3164940 - RNA, 17 nt, Human
uugauaauuuuccuuua

SEQ ID NO: 3164941 - RNA, 19 nt, Human
aucuagaagagucuauugu

SEQ ID NO: 3164942 - RNA, 20 nt, Human
aucuagaagagucuauuguc

SEQ ID NO: 3164943 - RNA, 21 nt, Human
aucuagaagagucuauugucu

SEQ ID NO: 3164944 - RNA, 18 nt, Human
aucuacugcauuuaggga

SEQ ID NO: 3164945 - RNA, 14 nt, Human
aucucagggccugg

SEQ ID NO: 3164946 - RNA, 16 nt, Human
aucucagggccugguc

SEQ ID NO: 3164947 - RNA, 20 nt, Human
aucucauuguucaauuccca

SEQ ID NO: 3164948 - RNA, 16 nt, Human
aucucccccagcccca

SEQ ID NO: 3164949 - RNA, 17 nt, Human
aucucccccagccccau

SEQ ID NO: 3164950 - RNA, 14 nt, Human
aucucccccagccc

SEQ ID NO: 3164951 - RNA, 21 nt, Human
aucucuucuggguuccuuccu

SEQ ID NO: 3164952 - RNA, 13 nt, Human
aucucuucugugu

SEQ ID NO: 3164953 - RNA, 15 nt, Human
aucucccccagcccc

SEQ ID NO: 3164954 - RNA, 22 nt, Human
aucugaaaauguauguguaagu

SEQ ID NO: 3164955 - RNA, 20 nt, Human
aucugaaaauguauguguaa

SEQ ID NO: 3164956 - RNA, 19 nt, Human
aucugaaaauguaugugua

SEQ ID NO: 3164957 - RNA, 16 nt, Human
aucugaaaauguaugu

SEQ ID NO: 3164958 - RNA, 14 nt, Human
aucugaaaauguau

SEQ ID NO: 3164959 - RNA, 15 nt, Human
aucucuugagccugg

SEQ ID NO: 3164960 - RNA, 15 nt, Human
aucucuucuuauaca

SEQ ID NO: 3164961 - RNA, 17 nt, Human
aucucuucuuauacaga

SEQ ID NO: 3164962 - RNA, 22 nt, Human
uugauuaagaucucagugguua

SEQ ID NO: 3164963 - RNA, 14 nt, Human
uugauuaaagauga

SEQ ID NO: 3164964 - RNA, 13 nt, Human
uugauucacaugu

SEQ ID NO: 3164965 - RNA, 16 nt, Human
uugcaagccuccugau

SEQ ID NO: 3164966 - RNA, 13 nt, Human
uugauuaaagaug

SEQ ID NO: 3164967 - RNA, 23 nt, Human
aucugaaaauguauguguaagua

SEQ ID NO: 3164968 - RNA, 12 nt, Human
aucugaaaaugu

SEQ ID NO: 3164969 - RNA, 16 nt, Human
aucugaauuggaaugc

SEQ ID NO: 3164970 - RNA, 13 nt, Human
uugcaucaauuuu

SEQ ID NO: 3164971 - RNA, 23 nt, Human
uugcauauaacuuauauuguaag

SEQ ID NO: 3164972 - RNA, 14 nt, Human
uugcaauggcagcc

SEQ ID NO: 3164973 - RNA, 22 nt, Human
uugcauauaacuuauauuguaa

SEQ ID NO: 3164974 - RNA, 17 nt, Human
uugcauauaacuuauau

SEQ ID NO: 3164975 - RNA, 14 nt, Human
uugcauauaacuua

SEQ ID NO: 3164976 - RNA, 17 nt, Human
uugcauaguucuagugc

SEQ ID NO: 3164977 - RNA, 13 nt, Human
uugcauugucugu

SEQ ID NO: 3164978 - RNA, 15 nt, Human
uugcauugucugucu

SEQ ID NO: 3164979 - RNA, 22 nt, Human
uugcauauauuucaugaauaca

SEQ ID NO: 3164980 - RNA, 14 nt, Human
uugcaccacugcac

SEQ ID NO: 3164981 - RNA, 15 nt, Human
uugcaccacugcacu

SEQ ID NO: 3164982 - RNA, 16 nt, Human
uugcaccacugcacuc

SEQ ID NO: 3164983 - RNA, 19 nt, Human
uugcaauggcagccuuggc

SEQ ID NO: 3164984 - RNA, 17 nt, Human
uugcaauggcagccuug

SEQ ID NO: 3164985 - RNA, 16 nt, Human
uugcaauggcagccuu

SEQ ID NO: 3164986 - RNA, 18 nt, Human
uugcaagguaaaauuuua

SEQ ID NO: 3164987 - RNA, 23 nt, Human
uugcaagggcggccuuucccacu

SEQ ID NO: 3164988 - RNA, 22 nt, Human
uugcaagggcggccuuucccac

SEQ ID NO: 3164989 - RNA, 21 nt, Human
uugcaagggcggccuuuccca

SEQ ID NO: 3164990 - RNA, 18 nt, Human
aucuugugaaaauaauug

SEQ ID NO: 3164991 - RNA, 15 nt, Human
aucuugugaaaauaa

SEQ ID NO: 3164992 - RNA, 14 nt, Human
aucuugugaaaaua

SEQ ID NO: 3164993 - RNA, 19 nt, Human
aucuugugaaaauaauuga

SEQ ID NO: 3164994 - RNA, 13 nt, Human
uugcuucuucuga

SEQ ID NO: 3164995 - RNA, 21 nt, Human
uugcucucuuuuauucugugc

SEQ ID NO: 3164996 - RNA, 18 nt, Human
uugcucuaaaauauuuau

SEQ ID NO: 3164997 - RNA, 12 nt, Human
uugcuccuugac

SEQ ID NO: 3164998 - RNA, 22 nt, Human
uugcucuaaaauauuuaugaag

SEQ ID NO: 3164999 - RNA, 21 nt, Human
uugcucuaaaauauuuaugaa

SEQ ID NO: 3165000 - RNA, 20 nt, Human
uugcucuaaaauauuuauga

SEQ ID NO: 3165001 - RNA, 21 nt, Human
uugcuaugugccuuauguuga

SEQ ID NO: 3165002 - RNA, 19 nt, Human
uugcucacaguuauuacau

SEQ ID NO: 3165003 - RNA, 23 nt, Human
uugcucaucucaguccucaaagc

SEQ ID NO: 3165004 - RNA, 20 nt, Human
uugcucacaguuauuacaua

SEQ ID NO: 3165005 - RNA, 17 nt, Human
aucuugcucucuuuuau

SEQ ID NO: 3165006 - RNA, 20 nt, Human
aucuuggucagauuugaacu

SEQ ID NO: 3165007 - RNA, 17 nt, Human
aucuguuuacaguguuc

SEQ ID NO: 3165008 - RNA, 15 nt, Human
aucuguuuacagugu

SEQ ID NO: 3165009 - RNA, 12 nt, Human
aucuguuuacag

SEQ ID NO: 3165010 - RNA, 18 nt, Human
aucugugaaaggaaagag

SEQ ID NO: 3165011 - RNA, 21 nt, Human
aucuguuuuauaccuugcuua

SEQ ID NO: 3165012 - RNA, 21 nt, Human
aucuguuuugugguuuggaau

SEQ ID NO: 3165013 - RNA, 22 nt, Human
aucuguuuugugguuuggaaua

SEQ ID NO: 3165014 - RNA, 12 nt, Human
uugcauuuuugc

SEQ ID NO: 3165015 - RNA, 22 nt, Human
uugccaaaacccagcugcaccc

SEQ ID NO: 3165016 - RNA, 21 nt, Human
uugccaaaacccagcugcacc

SEQ ID NO: 3165017 - RNA, 19 nt, Human
uugccaaaacccagcugca

SEQ ID NO: 3165018 - RNA, 18 nt, Human
uugccaaaacccagcugc

SEQ ID NO: 3165019 - RNA, 17 nt, Human
uugccaaaacccagcug

SEQ ID NO: 3165020 - RNA, 13 nt, Human
uugcauuucagaa

SEQ ID NO: 3165021 - RNA, 14 nt, Human
uugcauuugcuuuu

SEQ ID NO: 3165022 - RNA, 20 nt, Human
uugcauuucagaaagccuuu

SEQ ID NO: 3165023 - RNA, 14 nt, Human
uugcauuucagaaa

SEQ ID NO: 3165024 - RNA, 20 nt, Human
uugccaaacauuaauguuga

SEQ ID NO: 3165025 - RNA, 19 nt, Human
uugccaaacauuaauguug

SEQ ID NO: 3165026 - RNA, 13 nt, Human
uugccaaacauua

SEQ ID NO: 3165027 - RNA, 15 nt, Human
uugccaaacauuaau

SEQ ID NO: 3165028 - RNA, 14 nt, Human
uugccaaacauuaa

SEQ ID NO: 3165029 - RNA, 13 nt, Human
uugccaaaauggu

SEQ ID NO: 3165030 - RNA, 23 nt, Human
uugccaaaacccagcugcacccc

SEQ ID NO: 3165031 - RNA, 14 nt, Human
aucuggugauuucu

SEQ ID NO: 3165032 - RNA, 15 nt, Human
aucuggugauuucua

SEQ ID NO: 3165033 - RNA, 17 nt, Human
aucuggugauuucuagc

SEQ ID NO: 3165034 - RNA, 15 nt, Human
aucugguuuucucuc

SEQ ID NO: 3165035 - RNA, 13 nt, Human
aucugguuuucuc

SEQ ID NO: 3165036 - RNA, 15 nt, Human
aucuguauaauacuu

SEQ ID NO: 3165037 - RNA, 16 nt, Human
aucuguauaauacuuu

SEQ ID NO: 3165038 - RNA, 18 nt, Human
aucuguauaauacuuugu

SEQ ID NO: 3165039 - RNA, 20 nt, Human
aucuguauaauacuuuguau

SEQ ID NO: 3165040 - RNA, 21 nt, Human
aucuguauaauacuuuguaua

SEQ ID NO: 3165041 - RNA, 24 nt, Human
aucuguauaauacuuuguauacaa

SEQ ID NO: 3165042 - RNA, 16 nt, Human
aucuggugacuuuccu

SEQ ID NO: 3165043 - RNA, 17 nt, Human
aucuggugacuuuccuc

SEQ ID NO: 3165044 - RNA, 10 nt, Human
aucuggugac

SEQ ID NO: 3165045 - RNA, 17 nt, Human
aucugugaaaggaaaga

SEQ ID NO: 3165046 - RNA, 23 nt, Human
aucugucugcuggucacuucuuc

SEQ ID NO: 3165047 - RNA, 14 nt, Human
aucugucugcuggu

SEQ ID NO: 3165048 - RNA, 11 nt, Human
aucugucugcu

SEQ ID NO: 3165049 - RNA, 22 nt, Human
aucugucauuugagcagggcuc

SEQ ID NO: 3165050 - RNA, 19 nt, Human
aucuguaugauucuaugga

SEQ ID NO: 3165051 - RNA, 15 nt, Human
aucuguaugauucua

SEQ ID NO: 3165052 - RNA, 14 nt, Human
aucuguaugauucu

SEQ ID NO: 3165053 - RNA, 11 nt, Human
uuggagacaga

SEQ ID NO: 3165054 - RNA, 21 nt, Human
uugcuugaagcaaacaguuga

SEQ ID NO: 3165055 - RNA, 14 nt, Human
uuggagggccuggg

SEQ ID NO: 3165056 - RNA, 15 nt, Human
uuggagggccugggc

SEQ ID NO: 3165057 - RNA, 13 nt, Human
uuggccucagagg

SEQ ID NO: 3165058 - RNA, 22 nt, Human
uuggccucugcaaaggaaauac

SEQ ID NO: 3165059 - RNA, 23 nt, Human
uuggcuauuagagaucaaccccu

SEQ ID NO: 3165060 - RNA, 23 nt, Human
uuggccugagaugccuggugagc

SEQ ID NO: 3165061 - RNA, 16 nt, Human
uuggagggugucccaa

SEQ ID NO: 3165062 - RNA, 17 nt, Human
uuggaguagaauguagu

SEQ ID NO: 3165063 - RNA, 14 nt, Human
uuggaguagaaugu

SEQ ID NO: 3165064 - RNA, 18 nt, Human
uuggccccugcccggcug

SEQ ID NO: 3165065 - RNA, 21 nt, Human
uuggcccagggggcuuccuga

SEQ ID NO: 3165066 - RNA, 22 nt, Human
aucuuuucauuuaggugaggaa

SEQ ID NO: 3165067 - RNA, 17 nt, Human
aucuuugcagacaggca

SEQ ID NO: 3165068 - RNA, 18 nt, Human
augaaagggcccagagag

SEQ ID NO: 3165069 - RNA, 15 nt, Human
augaaagggcccaga

SEQ ID NO: 3165070 - RNA, 21 nt, Human
aucuuugauguguuguucuug

SEQ ID NO: 3165071 - RNA, 18 nt, Human
aucuuuucugaaucuucu

SEQ ID NO: 3165072 - RNA, 13 nt, Human
aucuuuucuuauu

SEQ ID NO: 3165073 - RNA, 16 nt, Human
aucuuuucugaaucuu

SEQ ID NO: 3165074 - RNA, 12 nt, Human
aucuuugaugug

SEQ ID NO: 3165075 - RNA, 14 nt, Human
aucuuugauguguu

SEQ ID NO: 3165076 - RNA, 15 nt, Human
aucuuugauguguug

SEQ ID NO: 3165077 - RNA, 16 nt, Human
aucuuugauguguugu

SEQ ID NO: 3165078 - RNA, 17 nt, Human
aucuuugauguguuguu

SEQ ID NO: 3165079 - RNA, 19 nt, Human
aucuuugauguguuguucu

SEQ ID NO: 3165080 - RNA, 22 nt, Human
uuggcucccaucuuuuguuacu

SEQ ID NO: 3165081 - RNA, 17 nt, Human
uuggcucccaucuuuug

SEQ ID NO: 3165082 - RNA, 22 nt, Human
uuggcuccugcccacugauagc

SEQ ID NO: 3165083 - RNA, 16 nt, Human
augaagagcuguugau

SEQ ID NO: 3165084 - RNA, 17 nt, Human
augaagagcuagagaaa

SEQ ID NO: 3165085 - RNA, 18 nt, Human
augaagagcuagagaaau

SEQ ID NO: 3165086 - RNA, 11 nt, Human
augaagaggag

SEQ ID NO: 3165087 - RNA, 16 nt, Human
augaagaauuuaaaga

SEQ ID NO: 3165088 - RNA, 13 nt, Human
augaagaauuuaa

SEQ ID NO: 3165089 - RNA, 15 nt, Human
augaaauguuaacaa

SEQ ID NO: 3165090 - RNA, 19 nt, Human
augaaagggcccagagagg

SEQ ID NO: 3165091 - RNA, 14 nt, Human
augaaaugagguca

SEQ ID NO: 3165092 - RNA, 15 nt, Human
augaaagguauguag

SEQ ID NO: 3165093 - RNA, 16 nt, Human
augaaagucaguuuaa

SEQ ID NO: 3165094 - RNA, 14 nt, Human
augaaaugcuaugu

SEQ ID NO: 3165095 - RNA, 23 nt, Human
augaaaugcuaugucauuucaug

SEQ ID NO: 3165096 - RNA, 22 nt, Human
augaaaugcuaugucauuucau

SEQ ID NO: 3165097 - RNA, 23 nt, Human
uuggggacaggggcaggaggaag

SEQ ID NO: 3165098 - RNA, 18 nt, Human
uuggggaccagagcugcc

SEQ ID NO: 3165099 - RNA, 23 nt, Human
augaauggcuaagcaaaauguga

SEQ ID NO: 3165100 - RNA, 14 nt, Human
augaauaugaugac

SEQ ID NO: 3165101 - RNA, 16 nt, Human
augaaugcuuuuagug

SEQ ID NO: 3165102 - RNA, 13 nt, Human
auuugaaagugcc

SEQ ID NO: 3165103 - RNA, 14 nt, Human
auuugaaagugccu

SEQ ID NO: 3165104 - RNA, 20 nt, Human
auuugaaacauugcuuuuaa

SEQ ID NO: 3165105 - RNA, 19 nt, Human
auuugaaacauugcuuuua

SEQ ID NO: 3165106 - RNA, 17 nt, Human
auuugaaacauugcuuu

SEQ ID NO: 3165107 - RNA, 13 nt, Human
auuugaaacauug

SEQ ID NO: 3165108 - RNA, 16 nt, Human
auuucuuccacaagag

SEQ ID NO: 3165109 - RNA, 18 nt, Human
auuucuaguuauuuauuc

SEQ ID NO: 3165110 - RNA, 23 nt, Human
auuucccugaaggaaccaaagcg

SEQ ID NO: 3165111 - RNA, 17 nt, Human
auuucccugaaggaacc

SEQ ID NO: 3165112 - RNA, 20 nt, Human
auuucuuccacaagagccca

SEQ ID NO: 3165113 - RNA, 23 nt, Human
auuucuuccacaagagcccaggc

SEQ ID NO: 3165114 - RNA, 17 nt, Human
auuucuaguuauuuauu

SEQ ID NO: 3165115 - RNA, 16 nt, Human
auuucuaguuauuuau

SEQ ID NO: 3165116 - RNA, 15 nt, Human
auuucuaguuauuua

SEQ ID NO: 3165117 - RNA, 20 nt, Human
auuuauuucuuuuuugccaa

SEQ ID NO: 3165118 - RNA, 14 nt, Human
auuuauuucaucau

SEQ ID NO: 3165119 - RNA, 18 nt, Human
auuuauuuccaauguuuc

SEQ ID NO: 3165120 - RNA, 19 nt, Human
auuuauuuccaauguuuca

SEQ ID NO: 3165121 - RNA, 14 nt, Human
auuuauuuaaauuu

SEQ ID NO: 3165122 - RNA, 12 nt, Human
auuuauuuaaau

SEQ ID NO: 3165123 - RNA, 19 nt, Human
auuucccaaagcagugcau

SEQ ID NO: 3165124 - RNA, 14 nt, Human
auuuccaauguuuc

SEQ ID NO: 3165125 - RNA, 19 nt, Human
auuucccaacacaaagauu

SEQ ID NO: 3165126 - RNA, 18 nt, Human
auuucccaacacaaagau

SEQ ID NO: 3165127 - RNA, 23 nt, Human
auuucccagcccucuucuucuca

SEQ ID NO: 3165128 - RNA, 19 nt, Human
auuuguaaauuuaugugau

SEQ ID NO: 3165129 - RNA, 18 nt, Human
auuuguaaauuuauguga

SEQ ID NO: 3165130 - RNA, 14 nt, Human
auuugggcagagag

SEQ ID NO: 3165131 - RNA, 22 nt, Human
auuugggagaagggcagaguua

SEQ ID NO: 3165132 - RNA, 18 nt, Human
auuugggagaagggcaga

SEQ ID NO: 3165133 - RNA, 17 nt, Human
auuugggcugaauguau

SEQ ID NO: 3165134 - RNA, 18 nt, Human
auuugggcugaauguaug

SEQ ID NO: 3165135 - RNA, 19 nt, Human
auuugggcugaauguaugu

SEQ ID NO: 3165136 - RNA, 20 nt, Human
auuugggcugaauguaugua

SEQ ID NO: 3165137 - RNA, 21 nt, Human
auuugggcugaauguauguaa

SEQ ID NO: 3165138 - RNA, 22 nt, Human
auuugggcugaauguauguaaa

SEQ ID NO: 3165139 - RNA, 15 nt, Human
auuuguaaauauuaa

SEQ ID NO: 3165140 - RNA, 18 nt, Human
auuugacuuucugucugu

SEQ ID NO: 3165141 - RNA, 15 nt, Human
auuugacuguuauuu

SEQ ID NO: 3165142 - RNA, 13 nt, Human
auuuguaagauau

SEQ ID NO: 3165143 - RNA, 18 nt, Human
auuuguaagauauuugca

SEQ ID NO: 3165144 - RNA, 14 nt, Human
auuugucauuuuca

SEQ ID NO: 3165145 - RNA, 22 nt, Human
auuugucaguguagaucaacuc

SEQ ID NO: 3165146 - RNA, 16 nt, Human
auuugucacugcuuca

SEQ ID NO: 3165147 - RNA, 20 nt, Human
auuuguauuaauuuguaaga

SEQ ID NO: 3165148 - RNA, 17 nt, Human
auuuguauuuauucuuu

SEQ ID NO: 3165149 - RNA, 16 nt, Human
auuuguauuuauucuu

SEQ ID NO: 3165150 - RNA, 20 nt, Human
auuuuaaaagaugcaaugua

SEQ ID NO: 3165151 - RNA, 23 nt, Human
auuuuaaaacuucaucugucugu

SEQ ID NO: 3165152 - RNA, 13 nt, Human
auuuuaaaacaau

SEQ ID NO: 3165153 - RNA, 18 nt, Human
auuuuaaaacaauaggau

SEQ ID NO: 3165154 - RNA, 19 nt, Human
auuuuaaaauaaacuuucu

SEQ ID NO: 3165155 - RNA, 17 nt, Human
auuuuaaaauaaacuuu

SEQ ID NO: 3165156 - RNA, 16 nt, Human
auuuuaaaauaaacuu

SEQ ID NO: 3165157 - RNA, 14 nt, Human
auuuuaaaauaaac

SEQ ID NO: 3165158 - RNA, 20 nt, Human
auuuuaaaagauaaauauua

SEQ ID NO: 3165159 - RNA, 20 nt, Human
auuuuaaaaucuccuaaaug

SEQ ID NO: 3165160 - RNA, 12 nt, Human
auuuuaaaaugu

SEQ ID NO: 3165161 - RNA, 18 nt, Human
auuuuaaaauguacaugu

SEQ ID NO: 3165162 - RNA, 15 nt, Human
auuuuaaaauguaca

SEQ ID NO: 3165163 - RNA, 14 nt, Human
auuuuaaaauguac

SEQ ID NO: 3165164 - RNA, 13 nt, Human
auuuuaaaaugua

SEQ ID NO: 3165165 - RNA, 13 nt, Human
auuuuaacuuaga

SEQ ID NO: 3165166 - RNA, 16 nt, Human
auuuuaacuaaauuuu

SEQ ID NO: 3165167 - RNA, 18 nt, Human
auuuuaacuaaauuuuaa

SEQ ID NO: 3165168 - RNA, 21 nt, Human
auuuuaacuaaauuuuaaagc

SEQ ID NO: 3165169 - RNA, 21 nt, Human
auuugucauuuucauuagcaa

SEQ ID NO: 3165170 - RNA, 17 nt, Human
auuugucauuuucauua

SEQ ID NO: 3165171 - RNA, 15 nt, Human
auuugucauuuucau

SEQ ID NO: 3165172 - RNA, 21 nt, Human
auuugucugaaacauuucaua

SEQ ID NO: 3165173 - RNA, 22 nt, Human
auuuuaaaaauacagauagaua

SEQ ID NO: 3165174 - RNA, 23 nt, Human
auuugugaaaugauggugaaagu

SEQ ID NO: 3165175 - RNA, 22 nt, Human
auuggauucugagagcugugca

SEQ ID NO: 3165176 - RNA, 19 nt, Human
auuggauucugagagcugu

SEQ ID NO: 3165177 - RNA, 13 nt, Human
auuggauuuuaug

SEQ ID NO: 3165178 - RNA, 22 nt, Human
auuggauuuuauguugacauuu

SEQ ID NO: 3165179 - RNA, 21 nt, Human
auuggauuuuauguugacauu

SEQ ID NO: 3165180 - RNA, 18 nt, Human
auuggauuuuauguugac

SEQ ID NO: 3165181 - RNA, 17 nt, Human
auuggauuuuauguuga

SEQ ID NO: 3165182 - RNA, 22 nt, Human
auuggguggggggcuucauaca

SEQ ID NO: 3165183 - RNA, 23 nt, Human
auuggguggggggcuucauacac

SEQ ID NO: 3165184 - RNA, 18 nt, Human
auugguaaagaauggaag

SEQ ID NO: 3165185 - RNA, 17 nt, Human
auugguaccuugcacac

SEQ ID NO: 3165186 - RNA, 15 nt, Human
auugguaccuugcac

SEQ ID NO: 3165187 - RNA, 14 nt, Human
auugguuucucuuc

SEQ ID NO: 3165188 - RNA, 16 nt, Human
auugguuucucuucuc

SEQ ID NO: 3165189 - RNA, 15 nt, Human
auugguuucucuucu

SEQ ID NO: 3165190 - RNA, 14 nt, Human
auugguuuuaugau

SEQ ID NO: 3165191 - RNA, 15 nt, Human
auugguuuuaugaug

SEQ ID NO: 3165192 - RNA, 17 nt, Human
auugguuuuaugaugac

SEQ ID NO: 3165193 - RNA, 18 nt, Human
auugguuuuaugaugacg

SEQ ID NO: 3165194 - RNA, 19 nt, Human
auugguuucucuucucccc

SEQ ID NO: 3165195 - RNA, 18 nt, Human
auugguuucucuucuccc

SEQ ID NO: 3165196 - RNA, 17 nt, Human
auugguuucucuucucc

SEQ ID NO: 3165197 - RNA, 23 nt, Human
auugguacugccuuaaagauaca

SEQ ID NO: 3165198 - RNA, 14 nt, Human
auugguagaggaag

SEQ ID NO: 3165199 - RNA, 19 nt, Human
auugguaccuugcacacau

SEQ ID NO: 3165200 - RNA, 18 nt, Human
auugguaccuugcacaca

SEQ ID NO: 3165201 - RNA, 13 nt, Human
auugcuuuuaaaa

SEQ ID NO: 3165202 - RNA, 12 nt, Human
auugcuuuuaaa

SEQ ID NO: 3165203 - RNA, 14 nt, Human
auugcuuuugugca

SEQ ID NO: 3165204 - RNA, 15 nt, Human
auugcuuuugugcau

SEQ ID NO: 3165205 - RNA, 20 nt, Human
auugcuuuugugcauuggau

SEQ ID NO: 3165206 - RNA, 19 nt, Human
auugcuuuuaaaauuuuaa

SEQ ID NO: 3165207 - RNA, 17 nt, Human
auugcuuuuaaaauuuu

SEQ ID NO: 3165208 - RNA, 16 nt, Human
auugcuuuuaaaauuu

SEQ ID NO: 3165209 - RNA, 18 nt, Human
auugcuuuuaaaacuacu

SEQ ID NO: 3165210 - RNA, 16 nt, Human
auugcuuuuaaaacua

SEQ ID NO: 3165211 - RNA, 15 nt, Human
auugcuuuuaaaacu

SEQ ID NO: 3165212 - RNA, 15 nt, Human
auugauuguauauag

SEQ ID NO: 3165213 - RNA, 14 nt, Human
auugauugcuuuuu

SEQ ID NO: 3165214 - RNA, 21 nt, Human
auugcuuuuuuccaaaacaaa

SEQ ID NO: 3165215 - RNA, 23 nt, Human
auugcuuuuuuccaaaacaaaaa

SEQ ID NO: 3165216 - RNA, 21 nt, Human
auugcuuuuaaaauuuuaagc

SEQ ID NO: 3165217 - RNA, 15 nt, Human
auuggaaaagacuaa

SEQ ID NO: 3165218 - RNA, 20 nt, Human
auuggaguuggaguagaaug

SEQ ID NO: 3165219 - RNA, 15 nt, Human
auuggauaacaccac

SEQ ID NO: 3165220 - RNA, 21 nt, Human
auuggaguuggaguagaaugu

SEQ ID NO: 3165221 - RNA, 16 nt, Human
auuggaucaaguauua

SEQ ID NO: 3165222 - RNA, 19 nt, Human
auugucaaugcuggagaaa

SEQ ID NO: 3165223 - RNA, 16 nt, Human
auugucaccugcuucu

SEQ ID NO: 3165224 - RNA, 21 nt, Human
auugucaaugcuggagaaaaa

SEQ ID NO: 3165225 - RNA, 21 nt, Human
auugucaccugcuucucugcc

SEQ ID NO: 3165226 - RNA, 19 nt, Human
auugucaccugcuucucug

SEQ ID NO: 3165227 - RNA, 17 nt, Human
auugucaccugcuucuc

SEQ ID NO: 3165228 - RNA, 23 nt, Human
auugucaaaguggugagaggcau

SEQ ID NO: 3165229 - RNA, 16 nt, Human
auugucaaagugguga

SEQ ID NO: 3165230 - RNA, 14 nt, Human
auugucauuaguga

SEQ ID NO: 3165231 - RNA, 18 nt, Human
auuguccuauuaguguua

SEQ ID NO: 3165232 - RNA, 20 nt, Human
auuguccuauuaguguuaua

SEQ ID NO: 3165233 - RNA, 21 nt, Human
auuguccuauuaguguuauau

SEQ ID NO: 3165234 - RNA, 23 nt, Human
auuguccuauuaguguuauauga

SEQ ID NO: 3165235 - RNA, 14 nt, Human
auuguccuauuagu

SEQ ID NO: 3165236 - RNA, 18 nt, Human
auugucccuggcuuccuu

SEQ ID NO: 3165237 - RNA, 13 nt, Human
auugugggaaggg

SEQ ID NO: 3165238 - RNA, 14 nt, Human
auugugggaagggg

SEQ ID NO: 3165239 - RNA, 21 nt, Human
auuguuuggggaugagaaagg

SEQ ID NO: 3165240 - RNA, 23 nt, Human
auuuaaagaaauauguauucugu

SEQ ID NO: 3165241 - RNA, 18 nt, Human
auuuaaagaaauauguau

SEQ ID NO: 3165242 - RNA, 18 nt, Human
auuuaaacucugaauuua

SEQ ID NO: 3165243 - RNA, 15 nt, Human
auuuaaacucugaau

SEQ ID NO: 3165244 - RNA, 18 nt, Human
auuuaaagaaaaaaaugu

SEQ ID NO: 3165245 - RNA, 19 nt, Human
auuuaaagaaaaaaauguc

SEQ ID NO: 3165246 - RNA, 23 nt, Human
auuuaaacucugaauuuaucuuu

SEQ ID NO: 3165247 - RNA, 21 nt, Human
auuuaaacucugaauuuaucu

SEQ ID NO: 3165248 - RNA, 14 nt, Human
auuuaaaccuuuua

SEQ ID NO: 3165249 - RNA, 20 nt, Human
auuuaaaccuuuuauuauaa

SEQ ID NO: 3165250 - RNA, 12 nt, Human
auuuuucaauag

SEQ ID NO: 3165251 - RNA, 19 nt, Human
auuuuucaauagcgugugu

SEQ ID NO: 3165252 - RNA, 12 nt, Human
auuuuucucaug

SEQ ID NO: 3165253 - RNA, 19 nt, Human
auuuuucccaggcaaauaa

SEQ ID NO: 3165254 - RNA, 18 nt, Human
auuuuucuacugcucuuu

SEQ ID NO: 3165255 - RNA, 12 nt, Human
auuuuucauauu

SEQ ID NO: 3165256 - RNA, 18 nt, Human
auuuuugacauggaaaug

SEQ ID NO: 3165257 - RNA, 18 nt, Human
auuuuugagcccuuguuu

SEQ ID NO: 3165258 - RNA, 10 nt, Human
auuuuugcuu

SEQ ID NO: 3165259 - RNA, 14 nt, Human
auuuuugcaggagc

SEQ ID NO: 3165260 - RNA, 15 nt, Human
auuuuugcuuuuaga

SEQ ID NO: 3165261 - RNA, 18 nt, Human
auuuuugcuuuuagaaaa

SEQ ID NO: 3165262 - RNA, 20 nt, Human
auuuuugcuuuuagaaaagg

SEQ ID NO: 3165263 - RNA, 15 nt, Human
auuuuugcuuuugau

SEQ ID NO: 3165264 - RNA, 14 nt, Human
auuuuugcuuuuga

SEQ ID NO: 3165265 - RNA, 21 nt, Human
auuuuugcuuuugauaagaaa

SEQ ID NO: 3165266 - RNA, 19 nt, Human
auuuuugguugaauaaacu

SEQ ID NO: 3165267 - RNA, 17 nt, Human
auuuuugguugaauaaa

SEQ ID NO: 3165268 - RNA, 15 nt, Human
auuuuugguugaaua

SEQ ID NO: 3165269 - RNA, 22 nt, Human
auuuuuggugggugaaaggaau

SEQ ID NO: 3165270 - RNA, 19 nt, Human
auuuuuggugggaauccaa

SEQ ID NO: 3165271 - RNA, 20 nt, Human
auuuuucuuaaaaaguaacu

SEQ ID NO: 3165272 - RNA, 18 nt, Human
auuuuugaaacugcauuu

SEQ ID NO: 3165273 - RNA, 20 nt, Human
auuuuugaaacugcauuugu

SEQ ID NO: 3165274 - RNA, 20 nt, Human
auuuuucuuauuucauuucu

SEQ ID NO: 3165275 - RNA, 19 nt, Human
auuuuucuuauuucauuuc

SEQ ID NO: 3165276 - RNA, 15 nt, Human
auuuuucuuauuuca

SEQ ID NO: 3165277 - RNA, 19 nt, Human
auuuuuguagagccagggu

SEQ ID NO: 3165278 - RNA, 18 nt, Human
auuuuuguauucaauuaa

SEQ ID NO: 3165279 - RNA, 19 nt, Human
auuuuuguauucaauuaaa

SEQ ID NO: 3165280 - RNA, 16 nt, Human
auuuuuguuacucucu

SEQ ID NO: 3165281 - RNA, 20 nt, Human
auuuuuguuacucucuucca

SEQ ID NO: 3165282 - RNA, 12 nt, Human
auuuuuguuguu

SEQ ID NO: 3165283 - RNA, 21 nt, Human
auuuuuguuuucauuaucuca

SEQ ID NO: 3165284 - RNA, 18 nt, Human
auuuuuuaaauugaauuc

SEQ ID NO: 3165285 - RNA, 13 nt, Human
auuuuuugaaagu

SEQ ID NO: 3165286 - RNA, 14 nt, Human
auuuuuugaaaguu

SEQ ID NO: 3165287 - RNA, 16 nt, Human
auuuuuuggcacuugc

SEQ ID NO: 3165288 - RNA, 21 nt, Human
auuuuuugaaaugcugaaaau

SEQ ID NO: 3165289 - RNA, 19 nt, Human
auuuuuugaaaugcugaaa

SEQ ID NO: 3165290 - RNA, 16 nt, Human
auuuuuugaaaugcug

SEQ ID NO: 3165291 - RNA, 15 nt, Human
auuuuuugaaaugcu

SEQ ID NO: 3165292 - RNA, 14 nt, Human
auuuuuugaaaugc

SEQ ID NO: 3165293 - RNA, 13 nt, Human
auuuuuugaaaug

SEQ ID NO: 3165294 - RNA, 12 nt, Human
auuuuuugugug

SEQ ID NO: 3165295 - RNA, 15 nt, Human
auuuuuuuaacuuua

SEQ ID NO: 3165296 - RNA, 18 nt, Human
auuuuuugguauuggcca

SEQ ID NO: 3165297 - RNA, 18 nt, Human
auuuuuuguuaaaugauu

SEQ ID NO: 3165298 - RNA, 19 nt, Human
auuuuuuacagcugccugc

SEQ ID NO: 3165299 - RNA, 21 nt, Human
auuuuuuaagugaaaauauag

SEQ ID NO: 3165300 - RNA, 18 nt, Human
auuuuuuauauuucaagu

SEQ ID NO: 3165301 - RNA, 20 nt, Human
auuuuuuauauauaugcaua

SEQ ID NO: 3165302 - RNA, 14 nt, Human
auuuuuuccuguuu

SEQ ID NO: 3165303 - RNA, 18 nt, Human
auuuuguguuuauucuug

SEQ ID NO: 3165304 - RNA, 17 nt, Human
auuuuguguuuauucuu

SEQ ID NO: 3165305 - RNA, 17 nt, Human
auuuuguguugaagagc

SEQ ID NO: 3165306 - RNA, 20 nt, Human
auuuuguguuuauucuugau

SEQ ID NO: 3165307 - RNA, 19 nt, Human
auuuuguguuuauucuuga

SEQ ID NO: 3165308 - RNA, 23 nt, Human
auuuugucauauaagauucauau

SEQ ID NO: 3165309 - RNA, 20 nt, Human
auuuugucugccccaaguuu

SEQ ID NO: 3165310 - RNA, 24 nt, Human
auuuugugaaacagacuuguauau

SEQ ID NO: 3165311 - RNA, 22 nt, Human
auuuugugaaacagacuuguau

SEQ ID NO: 3165312 - RNA, 18 nt, Human
auuuugugaagugaagga

SEQ ID NO: 3165313 - RNA, 19 nt, Human
auuuugugaaacagacuug

SEQ ID NO: 3165314 - RNA, 21 nt, Human
auuuugugaaacagacuugua

SEQ ID NO: 3165315 - RNA, 20 nt, Human
auuuugugaaacagacuugu

SEQ ID NO: 3165316 - RNA, 19 nt, Human
auuuugugcccccauguaa

SEQ ID NO: 3165317 - RNA, 23 nt, Human
auuuugugaguuuguuucuuuga

SEQ ID NO: 3165318 - RNA, 19 nt, Human
auuuugugaguuuguuucu

SEQ ID NO: 3165319 - RNA, 18 nt, Human
auuuugugaguuuguuuc

SEQ ID NO: 3165320 - RNA, 15 nt, Human
auuuugugaguuugu

SEQ ID NO: 3165321 - RNA, 20 nt, Human
auuuuguguaagaaauacag

SEQ ID NO: 3165322 - RNA, 18 nt, Human
auuuuguguaagaaauac

SEQ ID NO: 3165323 - RNA, 17 nt, Human
auuuuguguaagaaaua

SEQ ID NO: 3165324 - RNA, 16 nt, Human
auuuuguguaagaaau

SEQ ID NO: 3165325 - RNA, 16 nt, Human
auuuugcuuuaauuuu

SEQ ID NO: 3165326 - RNA, 12 nt, Human
auuuugcuuuaa

SEQ ID NO: 3165327 - RNA, 20 nt, Human
auuuuggaaaauaaauuauu

SEQ ID NO: 3165328 - RNA, 19 nt, Human
auuuuggaaaauaaauuau

SEQ ID NO: 3165329 - RNA, 14 nt, Human
auuuuggaaaauaa

SEQ ID NO: 3165330 - RNA, 11 nt, Human
auuuugcuuua

SEQ ID NO: 3165331 - RNA, 23 nt, Human
auuuuguaauguaucaaauacau

SEQ ID NO: 3165332 - RNA, 20 nt, Human
auuuuguaauguaucaaaua

SEQ ID NO: 3165333 - RNA, 14 nt, Human
auuuuguaauaaua

SEQ ID NO: 3165334 - RNA, 22 nt, Human
auuuuguaauaauaaagaauag

SEQ ID NO: 3165335 - RNA, 19 nt, Human
auuuuguaauaauaaagaa

SEQ ID NO: 3165336 - RNA, 14 nt, Human
auuuuguaugaaau

SEQ ID NO: 3165337 - RNA, 16 nt, Human
auuuuguaugaaauau

SEQ ID NO: 3165338 - RNA, 21 nt, Human
auuuuguaugaaauauaugug

SEQ ID NO: 3165339 - RNA, 13 nt, Human
auuuuguaugcaa

SEQ ID NO: 3165340 - RNA, 12 nt, Human
auuuuguaugca

SEQ ID NO: 3165341 - RNA, 23 nt, Human
auuuuguaugcaagcaguuucaa

SEQ ID NO: 3165342 - RNA, 20 nt, Human
auuuuguaugcaagcaguuu

SEQ ID NO: 3165343 - RNA, 23 nt, Human
auuuugcccuugacaaagucaag

SEQ ID NO: 3165344 - RNA, 15 nt, Human
auuuugcccuugaca

SEQ ID NO: 3165345 - RNA, 18 nt, Human
auuuugccagugggaacu

SEQ ID NO: 3165346 - RNA, 22 nt, Human
auuuugcagaggcuaugggaag

SEQ ID NO: 3165347 - RNA, 20 nt, Human
auuuugcauauccuuuuagu

SEQ ID NO: 3165348 - RNA, 21 nt, Human
auuuugcugucccuuuuccuu

SEQ ID NO: 3165349 - RNA, 23 nt, Human
auuuugcuaaguaaaucucuucu

SEQ ID NO: 3165350 - RNA, 18 nt, Human
auuuugcgucagagaaau

SEQ ID NO: 3165351 - RNA, 20 nt, Human
auuuugcuaaaugugaauga

SEQ ID NO: 3165352 - RNA, 17 nt, Human
auuuugcgucagagaaa

SEQ ID NO: 3165353 - RNA, 18 nt, Human
auuuugauguaaagaugu

SEQ ID NO: 3165354 - RNA, 17 nt, Human
auuuugauguaaagaug

SEQ ID NO: 3165355 - RNA, 19 nt, Human
auuuugauccaagcugguc

SEQ ID NO: 3165356 - RNA, 20 nt, Human
auuuugaucucacauuuuua

SEQ ID NO: 3165357 - RNA, 18 nt, Human
auuuugauccaagcuggu

SEQ ID NO: 3165358 - RNA, 19 nt, Human
auuuuccuguugucaagaa

SEQ ID NO: 3165359 - RNA, 19 nt, Human
auuuucccccuuggcucuc

SEQ ID NO: 3165360 - RNA, 20 nt, Human
auuuuccaucuaaaaauaua

SEQ ID NO: 3165361 - RNA, 19 nt, Human
auuuuccaucuaaaaauau

SEQ ID NO: 3165362 - RNA, 20 nt, Human
auuuucccacucauucugaa

SEQ ID NO: 3165363 - RNA, 22 nt, Human
auuuucccacucauucugaauu

SEQ ID NO: 3165364 - RNA, 19 nt, Human
auuuucccuauuagagaag

SEQ ID NO: 3165365 - RNA, 16 nt, Human
auuuuccugccaggca

SEQ ID NO: 3165366 - RNA, 22 nt, Human
auuuucccucagaaaaugagua

SEQ ID NO: 3165367 - RNA, 12 nt, Human
auuuuccugaua

SEQ ID NO: 3165368 - RNA, 11 nt, Human
auucagacagc

SEQ ID NO: 3165369 - RNA, 12 nt, Human
auucagacagcu

SEQ ID NO: 3165370 - RNA, 13 nt, Human
auucagacagcug

SEQ ID NO: 3165371 - RNA, 16 nt, Human
auucaccaguacauuc

SEQ ID NO: 3165372 - RNA, 14 nt, Human
auucacauuuagaa

SEQ ID NO: 3165373 - RNA, 15 nt, Human
auucacauuuagaaa

SEQ ID NO: 3165374 - RNA, 21 nt, Human
auucacauguuuucaaaugga

SEQ ID NO: 3165375 - RNA, 14 nt, Human
auucagacagcugc

SEQ ID NO: 3165376 - RNA, 15 nt, Human
auucagacagcugcc

SEQ ID NO: 3165377 - RNA, 16 nt, Human
auucagacagcugccu

SEQ ID NO: 3165378 - RNA, 17 nt, Human
auucagacagcugccug

SEQ ID NO: 3165379 - RNA, 18 nt, Human
auucagacagcugccugg

SEQ ID NO: 3165380 - RNA, 12 nt, Human
auucaggaagcu

SEQ ID NO: 3165381 - RNA, 22 nt, Human
auucaggaagcagcuuucccca

SEQ ID NO: 3165382 - RNA, 12 nt, Human
auuccagaggaa

SEQ ID NO: 3165383 - RNA, 17 nt, Human
auuccagagcugccagu

SEQ ID NO: 3165384 - RNA, 20 nt, Human
auuccagcacuucaggaggc

SEQ ID NO: 3165385 - RNA, 13 nt, Human
auucaggaagcuc

SEQ ID NO: 3165386 - RNA, 19 nt, Human
auuccagagaguggcuccu

SEQ ID NO: 3165387 - RNA, 21 nt, Human
auuccagagaguggcuccucc

SEQ ID NO: 3165388 - RNA, 16 nt, Human
auuccccacccucccc

SEQ ID NO: 3165389 - RNA, 14 nt, Human
auuccccuuccugu

SEQ ID NO: 3165390 - RNA, 18 nt, Human
auucuaagaaauaucugu

SEQ ID NO: 3165391 - RNA, 20 nt, Human
auucuaagaaauaucuguga

SEQ ID NO: 3165392 - RNA, 21 nt, Human
auucuaagaaauaucugugaa

SEQ ID NO: 3165393 - RNA, 23 nt, Human
auucuaagaaauaucugugaaau

SEQ ID NO: 3165394 - RNA, 24 nt, Human
auucuaagaaauaucugugaaaua

SEQ ID NO: 3165395 - RNA, 20 nt, Human
auucuaauaagcuaguugaa

SEQ ID NO: 3165396 - RNA, 14 nt, Human
auucuaauaagcua

SEQ ID NO: 3165397 - RNA, 16 nt, Human
auucuaauaagcuagu

SEQ ID NO: 3165398 - RNA, 19 nt, Human
auucuaauaagcuaguuga

SEQ ID NO: 3165399 - RNA, 20 nt, Human
auucccgggugcagaauugu

SEQ ID NO: 3165400 - RNA, 23 nt, Human
auuccccgucucugguuccuccc

SEQ ID NO: 3165401 - RNA, 15 nt, Human
auuauuuguaagaua

SEQ ID NO: 3165402 - RNA, 17 nt, Human
auuauuuguaagauauu

SEQ ID NO: 3165403 - RNA, 13 nt, Human
auuauuugcaguc

SEQ ID NO: 3165404 - RNA, 16 nt, Human
auuauuugaaugacua

SEQ ID NO: 3165405 - RNA, 15 nt, Human
auuauuauuugcagu

SEQ ID NO: 3165406 - RNA, 15 nt, Human
auuauuucugucaca

SEQ ID NO: 3165407 - RNA, 22 nt, Human
auuauuucugucacaguaaaaa

SEQ ID NO: 3165408 - RNA, 18 nt, Human
auucaaacagucucagga

SEQ ID NO: 3165409 - RNA, 16 nt, Human
auucaaacagucucag

SEQ ID NO: 3165410 - RNA, 19 nt, Human
auucaaacagucucaggaa

SEQ ID NO: 3165411 - RNA, 19 nt, Human
auucacauguuuucaaaug

SEQ ID NO: 3165412 - RNA, 18 nt, Human
auucacauguuuucaaau

SEQ ID NO: 3165413 - RNA, 17 nt, Human
auucacauguuuucaaa

SEQ ID NO: 3165414 - RNA, 16 nt, Human
auucacauguuuucaa

SEQ ID NO: 3165415 - RNA, 15 nt, Human
auucacauguuuuca

SEQ ID NO: 3165416 - RNA, 14 nt, Human
auuauuauucagaa

SEQ ID NO: 3165417 - RNA, 15 nt, Human
auuauuauauacaua

SEQ ID NO: 3165418 - RNA, 12 nt, Human
auuauuacuuuu

SEQ ID NO: 3165419 - RNA, 22 nt, Human
auuauuacuuuuccucuuagaa

SEQ ID NO: 3165420 - RNA, 13 nt, Human
auuauuauaaaaa

SEQ ID NO: 3165421 - RNA, 14 nt, Human
auuauuauaaaaau

SEQ ID NO: 3165422 - RNA, 16 nt, Human
auuauuauaaaaauau

SEQ ID NO: 3165423 - RNA, 20 nt, Human
auuauuaccuuacagaaguu

SEQ ID NO: 3165424 - RNA, 17 nt, Human
auuauauuuggaugcag

SEQ ID NO: 3165425 - RNA, 16 nt, Human
auuauauuuggaugca

SEQ ID NO: 3165426 - RNA, 15 nt, Human
auuauauuuggaugc

SEQ ID NO: 3165427 - RNA, 12 nt, Human
auuauauuugga

SEQ ID NO: 3165428 - RNA, 20 nt, Human
auuauauuccucuugcauuu

SEQ ID NO: 3165429 - RNA, 13 nt, Human
auuauacugugug

SEQ ID NO: 3165430 - RNA, 15 nt, Human
auuauacugugugug

SEQ ID NO: 3165431 - RNA, 16 nt, Human
auuauacuguguguga

SEQ ID NO: 3165432 - RNA, 19 nt, Human
auuauacccccugcaaagc

SEQ ID NO: 3165433 - RNA, 15 nt, Human
auuauaccuguugcu

SEQ ID NO: 3165434 - RNA, 17 nt, Human
auuauacaugaaauuca

SEQ ID NO: 3165435 - RNA, 22 nt, Human
auuauacagaccgaacuguugu

SEQ ID NO: 3165436 - RNA, 11 nt, Human
uuuguggaaaa

SEQ ID NO: 3165437 - RNA, 21 nt, Human
auuaguuuagaacagguuuuu

SEQ ID NO: 3165438 - RNA, 15 nt, Human
auuaguuuagaacag

SEQ ID NO: 3165439 - RNA, 17 nt, Human
auuaguuuagaacaggu

SEQ ID NO: 3165440 - RNA, 12 nt, Human
auuaguuuagaa

SEQ ID NO: 3165441 - RNA, 13 nt, Human
auuaguuuagaac

SEQ ID NO: 3165442 - RNA, 19 nt, Human
auuaguguuauaugaacau

SEQ ID NO: 3165443 - RNA, 21 nt, Human
auuaguguuauaugaacauac

SEQ ID NO: 3165444 - RNA, 18 nt, Human
auuaguuccccaaauaca

SEQ ID NO: 3165445 - RNA, 19 nt, Human
auuaguuccccaaauacaa

SEQ ID NO: 3165446 - RNA, 20 nt, Human
auuaguuccccaaauacaaa

SEQ ID NO: 3165447 - RNA, 16 nt, Human
auuaguguuauaugaa

SEQ ID NO: 3165448 - RNA, 17 nt, Human
auuaguguuauaugaac

SEQ ID NO: 3165449 - RNA, 15 nt, Human
auuaguguuauauga

SEQ ID NO: 3165450 - RNA, 16 nt, Human
auucuaggaccugugu

SEQ ID NO: 3165451 - RNA, 15 nt, Human
auucuagcuuugagc

SEQ ID NO: 3165452 - RNA, 21 nt, Human
auucucaugccucagccuccu

SEQ ID NO: 3165453 - RNA, 17 nt, Human
auucuaggaccuguguc

SEQ ID NO: 3165454 - RNA, 17 nt, Human
auucucauuugucacac

SEQ ID NO: 3165455 - RNA, 22 nt, Human
auucucaugccucagccuccug

SEQ ID NO: 3165456 - RNA, 12 nt, Human
auucucauucuu

SEQ ID NO: 3165457 - RNA, 19 nt, Human
auucugccugcccaggccc

SEQ ID NO: 3165458 - RNA, 18 nt, Human
auucugccugcccaggcc

SEQ ID NO: 3165459 - RNA, 17 nt, Human
auucugccugcccaggc

SEQ ID NO: 3165460 - RNA, 16 nt, Human
auucugccugcccagg

SEQ ID NO: 3165461 - RNA, 15 nt, Human
auucugccugcccag

SEQ ID NO: 3165462 - RNA, 14 nt, Human
auucugccugccca

SEQ ID NO: 3165463 - RNA, 13 nt, Human
auucugccugccc

SEQ ID NO: 3165464 - RNA, 11 nt, Human
auucugccugc

SEQ ID NO: 3165465 - RNA, 17 nt, Human
auucuguaaaagaaaaa

SEQ ID NO: 3165466 - RNA, 15 nt, Human
auucuguaaaagaaa

SEQ ID NO: 3165467 - RNA, 19 nt, Human
auucuguuggccaguguga

SEQ ID NO: 3165468 - RNA, 13 nt, Human
auucuguucugau

SEQ ID NO: 3165469 - RNA, 19 nt, Human
auucuguucugauauuaau

SEQ ID NO: 3165470 - RNA, 14 nt, Human
auucuguuggccag

SEQ ID NO: 3165471 - RNA, 22 nt, Human
auucugcucacauaucugucau

SEQ ID NO: 3165472 - RNA, 21 nt, Human
auucugcucacauaucuguca

SEQ ID NO: 3165473 - RNA, 20 nt, Human
auucugcucacauaucuguc

SEQ ID NO: 3165474 - RNA, 19 nt, Human
auucugcucacauaucugu

SEQ ID NO: 3165475 - RNA, 21 nt, Human
auucugccugcccaggccccu

SEQ ID NO: 3165476 - RNA, 20 nt, Human
auucugccugcccaggcccc

SEQ ID NO: 3165477 - RNA, 18 nt, Human
auucugcucacauaucug

SEQ ID NO: 3165478 - RNA, 15 nt, Human
auugacacuuaaaaa

SEQ ID NO: 3165479 - RNA, 17 nt, Human
auugacacuuaaaaaug

SEQ ID NO: 3165480 - RNA, 12 nt, Human
auugacaaguuu

SEQ ID NO: 3165481 - RNA, 15 nt, Human
auugaacucugagag

SEQ ID NO: 3165482 - RNA, 13 nt, Human
auugacucuugag

SEQ ID NO: 3165483 - RNA, 14 nt, Human
auugacucuugagu

SEQ ID NO: 3165484 - RNA, 15 nt, Human
auugacucuugaguu

SEQ ID NO: 3165485 - RNA, 11 nt, Human
auugacuucuu

SEQ ID NO: 3165486 - RNA, 22 nt, Human
auugacucuugaguuguuuuug

SEQ ID NO: 3165487 - RNA, 16 nt, Human
auugacucuugaguug

SEQ ID NO: 3165488 - RNA, 19 nt, Human
auugacucuugaguuguuu

SEQ ID NO: 3165489 - RNA, 19 nt, Human
auugacacuuaaaaauggu

SEQ ID NO: 3165490 - RNA, 17 nt, Human
auugaccugaggcccuu

SEQ ID NO: 3165491 - RNA, 18 nt, Human
auugacacaguaccauuu

SEQ ID NO: 3165492 - RNA, 14 nt, Human
auugacaaguuuaa

SEQ ID NO: 3165493 - RNA, 15 nt, Human
auugacgucuagcua

SEQ ID NO: 3165494 - RNA, 23 nt, Human
auugacgucuagcuaugcuguau

SEQ ID NO: 3165495 - RNA, 20 nt, Human
auugaccuuuagguauuaca

SEQ ID NO: 3165496 - RNA, 14 nt, Human
auucuuaaauaugu

SEQ ID NO: 3165497 - RNA, 21 nt, Human
auucuucccaacuugccuuug

SEQ ID NO: 3165498 - RNA, 20 nt, Human
auucuucccaacuugccuuu

SEQ ID NO: 3165499 - RNA, 23 nt, Human
auucuucccaacuugccuuugaa

SEQ ID NO: 3165500 - RNA, 17 nt, Human
auugaaaucuuuuugcu

SEQ ID NO: 3165501 - RNA, 18 nt, Human
auugaaaucuuuuugcuu

SEQ ID NO: 3165502 - RNA, 20 nt, Human
auugaaaucuuuuugcuuug

SEQ ID NO: 3165503 - RNA, 12 nt, Human
auugaaaucuuu

SEQ ID NO: 3165504 - RNA, 22 nt, Human
auucuuuuuuauuaaucacugu

SEQ ID NO: 3165505 - RNA, 18 nt, Human
auucuuuuuuucucuaga

SEQ ID NO: 3165506 - RNA, 17 nt, Human
auucuuuuuuauuaauc

SEQ ID NO: 3165507 - RNA, 19 nt, Human
auucuuuuuuauuaaucac

SEQ ID NO: 3165508 - RNA, 20 nt, Human
auucuuuuuuauuaaucacu

SEQ ID NO: 3165509 - RNA, 21 nt, Human
auucuuuuuuauuaaucacug

SEQ ID NO: 3165510 - RNA, 15 nt, Human
auucuuuuuuauuaa

SEQ ID NO: 3165511 - RNA, 16 nt, Human
auucuuuuuuauuaau

SEQ ID NO: 3165512 - RNA, 14 nt, Human
auucuuuuuuauua

SEQ ID NO: 3165513 - RNA, 13 nt, Human
auucuuuuugcuc

SEQ ID NO: 3165514 - RNA, 15 nt, Human
auucuuuuugcucua

SEQ ID NO: 3165515 - RNA, 14 nt, Human
auucuuuuugcucu

SEQ ID NO: 3165516 - RNA, 22 nt, Human
auucuuuuugcucuaaaauauu

SEQ ID NO: 3165517 - RNA, 21 nt, Human
auucuuuuugcucuaaaauau

SEQ ID NO: 3165518 - RNA, 20 nt, Human
auucuuuuugcucuaaaaua

SEQ ID NO: 3165519 - RNA, 19 nt, Human
auucuuuuugcucuaaaau

SEQ ID NO: 3165520 - RNA, 18 nt, Human
agccugccacucaggccc

SEQ ID NO: 3165521 - RNA, 12 nt, Human
agccugcccucc

SEQ ID NO: 3165522 - RNA, 12 nt, Human
agccugcccagc

SEQ ID NO: 3165523 - RNA, 23 nt, Human
agccugcccagcccccuggucuu

SEQ ID NO: 3165524 - RNA, 16 nt, Human
agccugccccagcgcu

SEQ ID NO: 3165525 - RNA, 14 nt, Human
agccugccccagcg

SEQ ID NO: 3165526 - RNA, 16 nt, Human
agccugccucuucucu

SEQ ID NO: 3165527 - RNA, 19 nt, Human
agccugccucuucucuacu

SEQ ID NO: 3165528 - RNA, 23 nt, Human
agccugcaguuauuaacacuaac

SEQ ID NO: 3165529 - RNA, 23 nt, Human
agccugcacuugggggcucagca

SEQ ID NO: 3165530 - RNA, 15 nt, Human
agccugcagagcugc

SEQ ID NO: 3165531 - RNA, 14 nt, Human
agccugcagagcug

SEQ ID NO: 3165532 - RNA, 13 nt, Human
agccugcagagcu

SEQ ID NO: 3165533 - RNA, 12 nt, Human
agccugcagagc

SEQ ID NO: 3165534 - RNA, 20 nt, Human
agccugcacuugggggcuca

SEQ ID NO: 3165535 - RNA, 19 nt, Human
agccugaucaccugcccug

SEQ ID NO: 3165536 - RNA, 16 nt, Human
ugcaugcugucccuua

SEQ ID NO: 3165537 - RNA, 18 nt, Human
agccugaucaccugcccu

SEQ ID NO: 3165538 - RNA, 23 nt, Human
ugcauacaaacaagcauauaaaa

SEQ ID NO: 3165539 - RNA, 22 nt, Human
ugcauacaaacaagcauauaaa

SEQ ID NO: 3165540 - RNA, 12 nt, Human
ugcauacaaaca

SEQ ID NO: 3165541 - RNA, 20 nt, Human
ugcauacaaacaagcauaua

SEQ ID NO: 3165542 - RNA, 13 nt, Human
ugcauacaaacaa

SEQ ID NO: 3165543 - RNA, 15 nt, Human
ugcaucucagcccac

SEQ ID NO: 3165544 - RNA, 19 nt, Human
ugcaucuggguagcuguaa

SEQ ID NO: 3165545 - RNA, 18 nt, Human
ugcaucuggguagcugua

SEQ ID NO: 3165546 - RNA, 21 nt, Human
ugcaucuggguagcuguaagg

SEQ ID NO: 3165547 - RNA, 20 nt, Human
ugcaucuggguagcuguaag

SEQ ID NO: 3165548 - RNA, 21 nt, Human
ugcaugaggcuaguguggugu

SEQ ID NO: 3165549 - RNA, 14 nt, Human
ugcaugcugucccu

SEQ ID NO: 3165550 - RNA, 15 nt, Human
ugcaugcugucccuu

SEQ ID NO: 3165551 - RNA, 13 nt, Human
ugcaugcuguccc

SEQ ID NO: 3165552 - RNA, 15 nt, Human
agccucagcauccug

SEQ ID NO: 3165553 - RNA, 18 nt, Human
agccugagcgacagugag

SEQ ID NO: 3165554 - RNA, 14 nt, Human
agccucagcauccu

SEQ ID NO: 3165555 - RNA, 13 nt, Human
agccucagcaucc

SEQ ID NO: 3165556 - RNA, 18 nt, Human
agccucaaccuccugggc

SEQ ID NO: 3165557 - RNA, 17 nt, Human
agccucaaccuccuggg

SEQ ID NO: 3165558 - RNA, 19 nt, Human
ugcagccucaaccuccugg

SEQ ID NO: 3165559 - RNA, 18 nt, Human
ugcagccucaaccuccug

SEQ ID NO: 3165560 - RNA, 13 nt, Human
agccugagagucu

SEQ ID NO: 3165561 - RNA, 13 nt, Human
ugcagcccuggcc

SEQ ID NO: 3165562 - RNA, 23 nt, Human
ugcauaauucugaaguuauauuu

SEQ ID NO: 3165563 - RNA, 19 nt, Human
ugcauaauucugaaguuau

SEQ ID NO: 3165564 - RNA, 23 nt, Human
ugcauaauaauccugcaaaguac

SEQ ID NO: 3165565 - RNA, 17 nt, Human
ugcauaauagcuacagu

SEQ ID NO: 3165566 - RNA, 11 nt, Human
ugcauaauaau

SEQ ID NO: 3165567 - RNA, 17 nt, Human
ugcauaaguuaacuucc

SEQ ID NO: 3165568 - RNA, 11 nt, Human
ugcauaaaaug

SEQ ID NO: 3165569 - RNA, 15 nt, Human
ugcaguuuuucauuu

SEQ ID NO: 3165570 - RNA, 18 nt, Human
ugcaguuuuucauuuuaa

SEQ ID NO: 3165571 - RNA, 22 nt, Human
ugcagucuuagaucauaguuuu

SEQ ID NO: 3165572 - RNA, 14 nt, Human
ugcagugagccgag

SEQ ID NO: 3165573 - RNA, 23 nt, Human
agccguuuguuccccaagacauu

SEQ ID NO: 3165574 - RNA, 17 nt, Human
agccuaaaaauaaagca

SEQ ID NO: 3165575 - RNA, 16 nt, Human
agccuaaaaauaaagc

SEQ ID NO: 3165576 - RNA, 14 nt, Human
agccuaaaaauaaa

SEQ ID NO: 3165577 - RNA, 13 nt, Human
agccuaaaaauaa

SEQ ID NO: 3165578 - RNA, 19 nt, Human
agccguuuguuccccaaga

SEQ ID NO: 3165579 - RNA, 21 nt, Human
agccuaagauauacuuguuuu

SEQ ID NO: 3165580 - RNA, 18 nt, Human
agccuaagauauacuugu

SEQ ID NO: 3165581 - RNA, 17 nt, Human
agccuaagauauacuug

SEQ ID NO: 3165582 - RNA, 20 nt, Human
agccuaaagauuuugaucuc

SEQ ID NO: 3165583 - RNA, 16 nt, Human
agccuaaagauuuuga

SEQ ID NO: 3165584 - RNA, 12 nt, Human
agccuaaagauu

SEQ ID NO: 3165585 - RNA, 23 nt, Human
agccuaaaaauaaagcacaaacc

SEQ ID NO: 3165586 - RNA, 18 nt, Human
agccuaaaaauaaagcac

SEQ ID NO: 3165587 - RNA, 17 nt, Human
agccuaggugacagagu

SEQ ID NO: 3165588 - RNA, 15 nt, Human
agccuaggugacaga

SEQ ID NO: 3165589 - RNA, 15 nt, Human
agccucaaccuccug

SEQ ID NO: 3165590 - RNA, 22 nt, Human
agccucaaauccaggacccugc

SEQ ID NO: 3165591 - RNA, 21 nt, Human
agccucaaauccaggacccug

SEQ ID NO: 3165592 - RNA, 20 nt, Human
agccucaaauccaggacccu

SEQ ID NO: 3165593 - RNA, 19 nt, Human
agccucaaauccaggaccc

SEQ ID NO: 3165594 - RNA, 18 nt, Human
agccucaaauccaggacc

SEQ ID NO: 3165595 - RNA, 16 nt, Human
agccucaaauccagga

SEQ ID NO: 3165596 - RNA, 20 nt, Human
agccucaaaacaaaggccua

SEQ ID NO: 3165597 - RNA, 17 nt, Human
agccuauuuuuuuagau

SEQ ID NO: 3165598 - RNA, 18 nt, Human
agccucaaaacaaaggcc

SEQ ID NO: 3165599 - RNA, 20 nt, Human
ugcacuuuguucuggcucuu

SEQ ID NO: 3165600 - RNA, 21 nt, Human
ugcacuuuucuaaacuaggcu

SEQ ID NO: 3165601 - RNA, 20 nt, Human
ugcacuuuuucuuaaucauu

SEQ ID NO: 3165602 - RNA, 18 nt, Human
ugcacuuuuuuucuauau

SEQ ID NO: 3165603 - RNA, 14 nt, Human
ugcacuuuuucuua

SEQ ID NO: 3165604 - RNA, 18 nt, Human
ugcagacucuacagaggc

SEQ ID NO: 3165605 - RNA, 16 nt, Human
ugcagaaauagacaaa

SEQ ID NO: 3165606 - RNA, 17 nt, Human
ugcagaaauagacaaaa

SEQ ID NO: 3165607 - RNA, 19 nt, Human
ugcagaaauagacaaaaag

SEQ ID NO: 3165608 - RNA, 20 nt, Human
ugcagaaauagacaaaaagu

SEQ ID NO: 3165609 - RNA, 21 nt, Human
ugcagaaauagacaaaaagua

SEQ ID NO: 3165610 - RNA, 20 nt, Human
ugcagacucuacagaggcca

SEQ ID NO: 3165611 - RNA, 19 nt, Human
ugcagacucuacagaggcc

SEQ ID NO: 3165612 - RNA, 14 nt, Human
agcccuucauuugg

SEQ ID NO: 3165613 - RNA, 13 nt, Human
agcccuucauuug

SEQ ID NO: 3165614 - RNA, 23 nt, Human
agcccuuccaugucgccucugca

SEQ ID NO: 3165615 - RNA, 22 nt, Human
agcccuuccaugucgccucugc

SEQ ID NO: 3165616 - RNA, 19 nt, Human
agcccuuccaugucgccuc

SEQ ID NO: 3165617 - RNA, 22 nt, Human
ugcagacucuacagaggccaug

SEQ ID NO: 3165618 - RNA, 12 nt, Human
ugcacuccccug

SEQ ID NO: 3165619 - RNA, 13 nt, Human
ugcacuccccugc

SEQ ID NO: 3165620 - RNA, 16 nt, Human
ugcacguuuucaucuc

SEQ ID NO: 3165621 - RNA, 16 nt, Human
ugcacuaagucucuuu

SEQ ID NO: 3165622 - RNA, 23 nt, Human
ugcacuaagucucuuuuuuacaa

SEQ ID NO: 3165623 - RNA, 19 nt, Human
ugcacguacacacacauac

SEQ ID NO: 3165624 - RNA, 14 nt, Human
ugcaccacugcacu

SEQ ID NO: 3165625 - RNA, 18 nt, Human
ugcacaagcuccaagcuc

SEQ ID NO: 3165626 - RNA, 20 nt, Human
ugcacaagcuccaagcuccc

SEQ ID NO: 3165627 - RNA, 22 nt, Human
ugcacaagcuccaagcucccag

SEQ ID NO: 3165628 - RNA, 23 nt, Human
ugcacaagcuccaagcucccagg

SEQ ID NO: 3165629 - RNA, 15 nt, Human
ugcacaagcuccaag

SEQ ID NO: 3165630 - RNA, 16 nt, Human
ugcacaagcuccaagc

SEQ ID NO: 3165631 - RNA, 18 nt, Human
agcagcaaggucuugcuc

SEQ ID NO: 3165632 - RNA, 14 nt, Human
agcagcaaggucuu

SEQ ID NO: 3165633 - RNA, 13 nt, Human
agcagcacccauc

SEQ ID NO: 3165634 - RNA, 23 nt, Human
agcagcaaggucuugcucuccua

SEQ ID NO: 3165635 - RNA, 15 nt, Human
ugcacacaccagagc

SEQ ID NO: 3165636 - RNA, 21 nt, Human
ugcacaauuccaugacaauau

SEQ ID NO: 3165637 - RNA, 13 nt, Human
ugcacaauuccau

SEQ ID NO: 3165638 - RNA, 13 nt, Human
ugcacaaguaggg

SEQ ID NO: 3165639 - RNA, 15 nt, Human
ugcacacaauuagau

SEQ ID NO: 3165640 - RNA, 17 nt, Human
ugcacacaauuagauuu

SEQ ID NO: 3165641 - RNA, 14 nt, Human
ugcacacaaauauu

SEQ ID NO: 3165642 - RNA, 18 nt, Human
ugcacacaaauauuauuu

SEQ ID NO: 3165643 - RNA, 12 nt, Human
ugcacaugauuu

SEQ ID NO: 3165644 - RNA, 17 nt, Human
ugcacaugauuucacaa

SEQ ID NO: 3165645 - RNA, 16 nt, Human
ugcacaugauuucaca

SEQ ID NO: 3165646 - RNA, 15 nt, Human
ugcacaugauuucac

SEQ ID NO: 3165647 - RNA, 14 nt, Human
ugcacaugauuuca

SEQ ID NO: 3165648 - RNA, 23 nt, Human
ugcacaugauuucacaaauauua

SEQ ID NO: 3165649 - RNA, 17 nt, Human
ugcacauggauucaguu

SEQ ID NO: 3165650 - RNA, 22 nt, Human
ugcacaugauuucacaaauauu

SEQ ID NO: 3165651 - RNA, 21 nt, Human
ugcacaugauuucacaaauau

SEQ ID NO: 3165652 - RNA, 20 nt, Human
ugcacaugauuucacaaaua

SEQ ID NO: 3165653 - RNA, 19 nt, Human
ugcacaugauuucacaaau

SEQ ID NO: 3165654 - RNA, 18 nt, Human
ugcacaugauuucacaaa

SEQ ID NO: 3165655 - RNA, 23 nt, Human
agcgugguggacaugcacagcua

SEQ ID NO: 3165656 - RNA, 20 nt, Human
agcgugguggacaugcacag

SEQ ID NO: 3165657 - RNA, 15 nt, Human
agcgugcauaaguua

SEQ ID NO: 3165658 - RNA, 16 nt, Human
agcgugagccacugca

SEQ ID NO: 3165659 - RNA, 21 nt, Human
ugccauauucuguuggccagu

SEQ ID NO: 3165660 - RNA, 20 nt, Human
ugccauauucuguuggccag

SEQ ID NO: 3165661 - RNA, 15 nt, Human
agcggggacagcucc

SEQ ID NO: 3165662 - RNA, 17 nt, Human
agcggggacagcuccuu

SEQ ID NO: 3165663 - RNA, 16 nt, Human
agcggggacagcuccu

SEQ ID NO: 3165664 - RNA, 15 nt, Human
agcgugagccacugc

SEQ ID NO: 3165665 - RNA, 13 nt, Human
agcgugagccacu

SEQ ID NO: 3165666 - RNA, 12 nt, Human
ugccacacuuca

SEQ ID NO: 3165667 - RNA, 23 nt, Human
ugccacugccucuuccucccuca

SEQ ID NO: 3165668 - RNA, 15 nt, Human
ugccagucaccccgg

SEQ ID NO: 3165669 - RNA, 16 nt, Human
ugccagucaccccggc

SEQ ID NO: 3165670 - RNA, 18 nt, Human
ugccagucaccccggcca

SEQ ID NO: 3165671 - RNA, 20 nt, Human
ugccagucaccccggccacc

SEQ ID NO: 3165672 - RNA, 15 nt, Human
ugccauauucuguug

SEQ ID NO: 3165673 - RNA, 17 nt, Human
ugccauauucuguuggc

SEQ ID NO: 3165674 - RNA, 16 nt, Human
ugccauauucuguugg

SEQ ID NO: 3165675 - RNA, 22 nt, Human
ugccagucaccccggccaccug

SEQ ID NO: 3165676 - RNA, 23 nt, Human
ugccagucaccccggccaccugc

SEQ ID NO: 3165677 - RNA, 17 nt, Human
ugccagucccccugccc

SEQ ID NO: 3165678 - RNA, 19 nt, Human
ugccagucccccugcccca

SEQ ID NO: 3165679 - RNA, 20 nt, Human
agcggcuggaauuggguggg

SEQ ID NO: 3165680 - RNA, 15 nt, Human
ugcauucuucugauc

SEQ ID NO: 3165681 - RNA, 14 nt, Human
ugcauuuccugaca

SEQ ID NO: 3165682 - RNA, 13 nt, Human
ugcauuuccugac

SEQ ID NO: 3165683 - RNA, 14 nt, Human
agcgcccaguuggg

SEQ ID NO: 3165684 - RNA, 20 nt, Human
agcgcccacuagacccacug

SEQ ID NO: 3165685 - RNA, 19 nt, Human
agccugccccagcgcugac

SEQ ID NO: 3165686 - RNA, 18 nt, Human
agccugccccagcgcuga

SEQ ID NO: 3165687 - RNA, 23 nt, Human
agccugccuugcccacuccugcu

SEQ ID NO: 3165688 - RNA, 15 nt, Human
agccugccuugccca

SEQ ID NO: 3165689 - RNA, 17 nt, Human
agcggcucaagcccagg

SEQ ID NO: 3165690 - RNA, 19 nt, Human
agcggcucaagcccaggag

SEQ ID NO: 3165691 - RNA, 18 nt, Human
agcggcucaagcccagga

SEQ ID NO: 3165692 - RNA, 22 nt, Human
agcgcugacgugucaggaaaac

SEQ ID NO: 3165693 - RNA, 14 nt, Human
agcgcucuggugcu

SEQ ID NO: 3165694 - RNA, 16 nt, Human
agcggauugcaaagca

SEQ ID NO: 3165695 - RNA, 11 nt, Human
agcgcucccuu

SEQ ID NO: 3165696 - RNA, 19 nt, Human
agcgcggacauccccugcu

SEQ ID NO: 3165697 - RNA, 17 nt, Human
agcgcggacauccccug

SEQ ID NO: 3165698 - RNA, 16 nt, Human
ugccccgucccccucu

SEQ ID NO: 3165699 - RNA, 18 nt, Human
ugccccgucccccucugg

SEQ ID NO: 3165700 - RNA, 20 nt, Human
ugccccgucuacagcucccc

SEQ ID NO: 3165701 - RNA, 19 nt, Human
ugccccgucuacagcuccc

SEQ ID NO: 3165702 - RNA, 12 nt, Human
ugccccccagcc

SEQ ID NO: 3165703 - RNA, 15 nt, Human
ugcccaggcaggucu

SEQ ID NO: 3165704 - RNA, 14 nt, Human
ugcccacaggauca

SEQ ID NO: 3165705 - RNA, 15 nt, Human
ugcccacaccuccug

SEQ ID NO: 3165706 - RNA, 16 nt, Human
ugcccacaccuccugg

SEQ ID NO: 3165707 - RNA, 17 nt, Human
ugcccacaccuccuggg

SEQ ID NO: 3165708 - RNA, 15 nt, Human
ugcccaaugaauaau

SEQ ID NO: 3165709 - RNA, 20 nt, Human
ugcccaaugaauaauggaaa

SEQ ID NO: 3165710 - RNA, 11 nt, Human
ugcccaggccc

SEQ ID NO: 3165711 - RNA, 20 nt, Human
ugcccaggcaggucuugaac

SEQ ID NO: 3165712 - RNA, 17 nt, Human
ugcccaggcaggucuug

SEQ ID NO: 3165713 - RNA, 16 nt, Human
ugcccaggcaggucuu

SEQ ID NO: 3165714 - RNA, 22 nt, Human
ugcccaggccccugccacccug

SEQ ID NO: 3165715 - RNA, 20 nt, Human
ugcccaggccccugccaccc

SEQ ID NO: 3165716 - RNA, 12 nt, Human
ugcccaggcccc

SEQ ID NO: 3165717 - RNA, 15 nt, Human
ugcccaggccugccu

SEQ ID NO: 3165718 - RNA, 14 nt, Human
agcucagggccugg

SEQ ID NO: 3165719 - RNA, 15 nt, Human
agcucagggccuggc

SEQ ID NO: 3165720 - RNA, 16 nt, Human
agcucagggccuggcu

SEQ ID NO: 3165721 - RNA, 19 nt, Human
ugccauguuggccaggcug

SEQ ID NO: 3165722 - RNA, 18 nt, Human
ugccauguuggccaggcu

SEQ ID NO: 3165723 - RNA, 17 nt, Human
agcucagggccuggcuc

SEQ ID NO: 3165724 - RNA, 17 nt, Human
ugccauguuggccaggc

SEQ ID NO: 3165725 - RNA, 20 nt, Human
ugccauguuggccaggcugg

SEQ ID NO: 3165726 - RNA, 21 nt, Human
ugccauguuggccaggcuggu

SEQ ID NO: 3165727 - RNA, 20 nt, Human
ugccauuccaaaauauuaug

SEQ ID NO: 3165728 - RNA, 16 nt, Human
ugccauguuggccagg

SEQ ID NO: 3165729 - RNA, 22 nt, Human
ugcccaaccugcucuccucuug

SEQ ID NO: 3165730 - RNA, 18 nt, Human
ugcccaaccugcucuccu

SEQ ID NO: 3165731 - RNA, 24 nt, Human
ugcccaaccugcucuccucuugcc

SEQ ID NO: 3165732 - RNA, 23 nt, Human
ugcccaaccugcucuccucuugc

SEQ ID NO: 3165733 - RNA, 19 nt, Human
agcuaguugaauacuugaa

SEQ ID NO: 3165734 - RNA, 20 nt, Human
agcuaguugaauacuugaac

SEQ ID NO: 3165735 - RNA, 18 nt, Human
agcuaguugaauacuuga

SEQ ID NO: 3165736 - RNA, 16 nt, Human
agcuauaaauuauauu

SEQ ID NO: 3165737 - RNA, 18 nt, Human
agcuauaauuauuauuca

SEQ ID NO: 3165738 - RNA, 22 nt, Human
agcuaguugaauacuugaacca

SEQ ID NO: 3165739 - RNA, 23 nt, Human
agcuaguugaauacuugaaccau

SEQ ID NO: 3165740 - RNA, 24 nt, Human
agcuaguugaauacuugaaccaua

SEQ ID NO: 3165741 - RNA, 18 nt, Human
agcuacuggauucuuauu

SEQ ID NO: 3165742 - RNA, 13 nt, Human
agcuauaggaaau

SEQ ID NO: 3165743 - RNA, 21 nt, Human
agcuaugaagagcuagagaaa

SEQ ID NO: 3165744 - RNA, 12 nt, Human
agcuaugacuua

SEQ ID NO: 3165745 - RNA, 15 nt, Human
agcuaucuucaugua

SEQ ID NO: 3165746 - RNA, 16 nt, Human
agcuaucuucauguaa

SEQ ID NO: 3165747 - RNA, 17 nt, Human
agcuaucuucauguaaa

SEQ ID NO: 3165748 - RNA, 18 nt, Human
agcuaucuucauguaaau

SEQ ID NO: 3165749 - RNA, 20 nt, Human
agcuaucuucauguaaauug

SEQ ID NO: 3165750 - RNA, 20 nt, Human
agcuauggacagcauugcca

SEQ ID NO: 3165751 - RNA, 15 nt, Human
agcuaugcuguaucu

SEQ ID NO: 3165752 - RNA, 17 nt, Human
agcuaugcuguaucugu

SEQ ID NO: 3165753 - RNA, 20 nt, Human
agcuaugcuguaucugugcu

SEQ ID NO: 3165754 - RNA, 22 nt, Human
agcuaugcuguaucugugcuuu

SEQ ID NO: 3165755 - RNA, 16 nt, Human
agcuaugacuuaacau

SEQ ID NO: 3165756 - RNA, 13 nt, Human
agcuaugagagga

SEQ ID NO: 3165757 - RNA, 13 nt, Human
agcuaugcaaaaa

SEQ ID NO: 3165758 - RNA, 17 nt, Human
agcuaugcaaaaagcua

SEQ ID NO: 3165759 - RNA, 19 nt, Human
ugccuugugaaggaauuau

SEQ ID NO: 3165760 - RNA, 21 nt, Human
ugccuuagaaccuuucuuaca

SEQ ID NO: 3165761 - RNA, 17 nt, Human
ugccuuagaaccuuucu

SEQ ID NO: 3165762 - RNA, 14 nt, Human
ugccuuagaaccuu

SEQ ID NO: 3165763 - RNA, 16 nt, Human
ugccuguucagcucca

SEQ ID NO: 3165764 - RNA, 15 nt, Human
ugccuguucagcucc

SEQ ID NO: 3165765 - RNA, 15 nt, Human
agcuggggaugucuc

SEQ ID NO: 3165766 - RNA, 13 nt, Human
ugcgaaaggauga

SEQ ID NO: 3165767 - RNA, 17 nt, Human
ugcggacagccacggcc

SEQ ID NO: 3165768 - RNA, 15 nt, Human
ugcgaggcuaugagu

SEQ ID NO: 3165769 - RNA, 18 nt, Human
ugcggacagccacggcca

SEQ ID NO: 3165770 - RNA, 19 nt, Human
ugcgaaaggaugaaaguga

SEQ ID NO: 3165771 - RNA, 14 nt, Human
agcugggcagguug

SEQ ID NO: 3165772 - RNA, 22 nt, Human
agcugggauuacaggcuccugc

SEQ ID NO: 3165773 - RNA, 23 nt, Human
agcugggauuacaggcuccugcc

SEQ ID NO: 3165774 - RNA, 19 nt, Human
agcugggacuacaggugug

SEQ ID NO: 3165775 - RNA, 17 nt, Human
agcugggacuacaggug

SEQ ID NO: 3165776 - RNA, 16 nt, Human
agcuggagaggagccc

SEQ ID NO: 3165777 - RNA, 15 nt, Human
agcuggagaggagcc

SEQ ID NO: 3165778 - RNA, 19 nt, Human
agcuggagaggagcccugc

SEQ ID NO: 3165779 - RNA, 18 nt, Human
agcuggagaggagcccug

SEQ ID NO: 3165780 - RNA, 17 nt, Human
agcuggagaggagcccu

SEQ ID NO: 3165781 - RNA, 23 nt, Human
agcugggaugauuggagggggga

SEQ ID NO: 3165782 - RNA, 18 nt, Human
agcugggauuacaggcuc

SEQ ID NO: 3165783 - RNA, 21 nt, Human
agcugggauuacaggcuccug

SEQ ID NO: 3165784 - RNA, 22 nt, Human
agcugggaucacauguggacuu

SEQ ID NO: 3165785 - RNA, 19 nt, Human
agcugccugaaaaucaaga

SEQ ID NO: 3165786 - RNA, 17 nt, Human
agcugccugaaaaucaa

SEQ ID NO: 3165787 - RNA, 22 nt, Human
ugccucugacacacagcucugu

SEQ ID NO: 3165788 - RNA, 21 nt, Human
agcugccugggaucccucauc

SEQ ID NO: 3165789 - RNA, 13 nt, Human
agcugccugggau

SEQ ID NO: 3165790 - RNA, 19 nt, Human
agcugccugggaucccuca

SEQ ID NO: 3165791 - RNA, 15 nt, Human
ugccucucucaggcc

SEQ ID NO: 3165792 - RNA, 21 nt, Human
ugccucugacacacagcucug

SEQ ID NO: 3165793 - RNA, 20 nt, Human
ugccucugacacacagcucu

SEQ ID NO: 3165794 - RNA, 13 nt, Human
ugccucccaucac

SEQ ID NO: 3165795 - RNA, 14 nt, Human
ugccucccaucacc

SEQ ID NO: 3165796 - RNA, 13 nt, Human
ugccucucucagg

SEQ ID NO: 3165797 - RNA, 14 nt, Human
ugccucucucaggc

SEQ ID NO: 3165798 - RNA, 17 nt, Human
agcugcaccccuuccug

SEQ ID NO: 3165799 - RNA, 17 nt, Human
agcugcauaucuucauc

SEQ ID NO: 3165800 - RNA, 21 nt, Human
agcugcaccccuuccugggca

SEQ ID NO: 3165801 - RNA, 13 nt, Human
agcugccaccugc

SEQ ID NO: 3165802 - RNA, 15 nt, Human
ugcccuuucugggca

SEQ ID NO: 3165803 - RNA, 21 nt, Human
ugcccuuuacuugucuuucug

SEQ ID NO: 3165804 - RNA, 20 nt, Human
ugcccuuuguccuccugcug

SEQ ID NO: 3165805 - RNA, 19 nt, Human
ugcccuuuguccuccugcu

SEQ ID NO: 3165806 - RNA, 17 nt, Human
ugcccuuuguccuccug

SEQ ID NO: 3165807 - RNA, 15 nt, Human
ugcccuuuguccucc

SEQ ID NO: 3165808 - RNA, 22 nt, Human
ugccuccaagaggaaccucuga

SEQ ID NO: 3165809 - RNA, 18 nt, Human
ugccgggugcagcaucug

SEQ ID NO: 3165810 - RNA, 22 nt, Human
ugccgcugauguuuggccguga

SEQ ID NO: 3165811 - RNA, 13 nt, Human
ugccgcugauguu

SEQ ID NO: 3165812 - RNA, 22 nt, Human
agcucucaugcugccccugccu

SEQ ID NO: 3165813 - RNA, 22 nt, Human
agcucuaucaccaaggagccaa

SEQ ID NO: 3165814 - RNA, 17 nt, Human
agcucuaucaccaagga

SEQ ID NO: 3165815 - RNA, 19 nt, Human
ugcccuccaagaccuucuc

SEQ ID NO: 3165816 - RNA, 20 nt, Human
ugcccuccaagaccuucucc

SEQ ID NO: 3165817 - RNA, 22 nt, Human
ugcccuccaagaccuucuccuu

SEQ ID NO: 3165818 - RNA, 20 nt, Human
agcucugguccauagagagc

SEQ ID NO: 3165819 - RNA, 22 nt, Human
agcucugcuccucuccccagca

SEQ ID NO: 3165820 - RNA, 12 nt, Human
agcucugcuccu

SEQ ID NO: 3165821 - RNA, 11 nt, Human
agcucugccuu

SEQ ID NO: 3165822 - RNA, 12 nt, Human
agcucuguccug

SEQ ID NO: 3165823 - RNA, 17 nt, Human
agcucuucuccaggcug

SEQ ID NO: 3165824 - RNA, 18 nt, Human
agcucuucuccaggcugu

SEQ ID NO: 3165825 - RNA, 18 nt, Human
agcugcacccucaggcag

SEQ ID NO: 3165826 - RNA, 19 nt, Human
agcugcacccucaggcagg

SEQ ID NO: 3165827 - RNA, 20 nt, Human
agcugcacccucaggcaggu

SEQ ID NO: 3165828 - RNA, 22 nt, Human
agcugcacccucaggcaggugg

SEQ ID NO: 3165829 - RNA, 13 nt, Human
agcugcacccuca

SEQ ID NO: 3165830 - RNA, 17 nt, Human
agcugcacccucaggca

SEQ ID NO: 3165831 - RNA, 20 nt, Human
agcugauguguugccacuuu

SEQ ID NO: 3165832 - RNA, 16 nt, Human
aggaaaccuuuucuug

SEQ ID NO: 3165833 - RNA, 17 nt, Human
aggaaaccuuuucuugu

SEQ ID NO: 3165834 - RNA, 21 nt, Human
aggaaacccagcucuggucca

SEQ ID NO: 3165835 - RNA, 18 nt, Human
aggaaacccagcucuggu

SEQ ID NO: 3165836 - RNA, 20 nt, Human
aggaaacccagcucuggucc

SEQ ID NO: 3165837 - RNA, 16 nt, Human
aggaaacccagcucug

SEQ ID NO: 3165838 - RNA, 17 nt, Human
aggaaacccagcucugg

SEQ ID NO: 3165839 - RNA, 15 nt, Human
aggaaacccagcucu

SEQ ID NO: 3165840 - RNA, 17 nt, Human
aggaaaagguugaauaa

SEQ ID NO: 3165841 - RNA, 22 nt, Human
aggaaaagguugaauaauauau

SEQ ID NO: 3165842 - RNA, 16 nt, Human
aggaaaagcugcugac

SEQ ID NO: 3165843 - RNA, 19 nt, Human
agcuuugacucuauaagca

SEQ ID NO: 3165844 - RNA, 12 nt, Human
agcuuugaaaau

SEQ ID NO: 3165845 - RNA, 16 nt, Human
agcuuugaaaauucag

SEQ ID NO: 3165846 - RNA, 18 nt, Human
agcuuugaaaauucagug

SEQ ID NO: 3165847 - RNA, 19 nt, Human
agcuuugaaaauucagugg

SEQ ID NO: 3165848 - RNA, 12 nt, Human
aggaaagaggcu

SEQ ID NO: 3165849 - RNA, 13 nt, Human
aggaaagaggcuc

SEQ ID NO: 3165850 - RNA, 16 nt, Human
ugcuagucuuaagaac

SEQ ID NO: 3165851 - RNA, 21 nt, Human
ugcuauaacuauguugauaaa

SEQ ID NO: 3165852 - RNA, 13 nt, Human
ugcuauaaucugu

SEQ ID NO: 3165853 - RNA, 17 nt, Human
ugcuauaaucuguuuuu

SEQ ID NO: 3165854 - RNA, 18 nt, Human
ugcuauaaucuguuuuua

SEQ ID NO: 3165855 - RNA, 21 nt, Human
ugcuauaaucuguuuuuacgu

SEQ ID NO: 3165856 - RNA, 16 nt, Human
aggaaagaagcauuuc

SEQ ID NO: 3165857 - RNA, 16 nt, Human
aggaaagaggcucugg

SEQ ID NO: 3165858 - RNA, 17 nt, Human
aggaaagcaaaggagau

SEQ ID NO: 3165859 - RNA, 15 nt, Human
agcuuauuaaaacuc

SEQ ID NO: 3165860 - RNA, 20 nt, Human
agcuuauuaaaacucauuuu

SEQ ID NO: 3165861 - RNA, 20 nt, Human
agcuuguaaauagcucaggu

SEQ ID NO: 3165862 - RNA, 19 nt, Human
agcuuguaaauagcucagg

SEQ ID NO: 3165863 - RNA, 16 nt, Human
agcuuggcucaggcug

SEQ ID NO: 3165864 - RNA, 18 nt, Human
agcuuguaaauagcucag

SEQ ID NO: 3165865 - RNA, 22 nt, Human
agcuuucugagcaagaggauuu

SEQ ID NO: 3165866 - RNA, 14 nt, Human
agcuuucugagcaa

SEQ ID NO: 3165867 - RNA, 12 nt, Human
agcuuucuuuuu

SEQ ID NO: 3165868 - RNA, 22 nt, Human
agcuuucuuuuuaaagcuuuug

SEQ ID NO: 3165869 - RNA, 23 nt, Human
agcuuucugagcaagaggauuuu

SEQ ID NO: 3165870 - RNA, 20 nt, Human
ugcggacagccacggccagg

SEQ ID NO: 3165871 - RNA, 14 nt, Human
ugcuaccuugcccc

SEQ ID NO: 3165872 - RNA, 15 nt, Human
ugcuaccuugcccca

SEQ ID NO: 3165873 - RNA, 24 nt, Human
agcuguuugguuuuaaaauacugu

SEQ ID NO: 3165874 - RNA, 23 nt, Human
agcuguuugguuuuaaaauacug

SEQ ID NO: 3165875 - RNA, 20 nt, Human
agcuguuugguuuuaaaaua

SEQ ID NO: 3165876 - RNA, 13 nt, Human
agcuguuuggaaa

SEQ ID NO: 3165877 - RNA, 16 nt, Human
agcuguuuggaaaaga

SEQ ID NO: 3165878 - RNA, 19 nt, Human
agcuguuugguuuuaaaau

SEQ ID NO: 3165879 - RNA, 17 nt, Human
agcuguuugguuuuaaa

SEQ ID NO: 3165880 - RNA, 14 nt, Human
agcuuagggucuca

SEQ ID NO: 3165881 - RNA, 16 nt, Human
agcuuagggucucagg

SEQ ID NO: 3165882 - RNA, 17 nt, Human
agcuuagggucucaggg

SEQ ID NO: 3165883 - RNA, 18 nt, Human
agcuuagggucucagggu

SEQ ID NO: 3165884 - RNA, 12 nt, Human
agcuuaucucag

SEQ ID NO: 3165885 - RNA, 14 nt, Human
agcuuaucucaggg

SEQ ID NO: 3165886 - RNA, 15 nt, Human
agcuuaucucagggg

SEQ ID NO: 3165887 - RNA, 19 nt, Human
aggaauugacccacaagaa

SEQ ID NO: 3165888 - RNA, 15 nt, Human
aggaaugauauugcu

SEQ ID NO: 3165889 - RNA, 16 nt, Human
aggaaugauauugcug

SEQ ID NO: 3165890 - RNA, 16 nt, Human
aggaagcucagggccu

SEQ ID NO: 3165891 - RNA, 20 nt, Human
aggaauccagacccggcugc

SEQ ID NO: 3165892 - RNA, 23 nt, Human
aggaauccagacccggcugcgug

SEQ ID NO: 3165893 - RNA, 15 nt, Human
aggaagacuuuggaa

SEQ ID NO: 3165894 - RNA, 13 nt, Human
aggaaaucaaagu

SEQ ID NO: 3165895 - RNA, 14 nt, Human
aggaagagaaaaaa

SEQ ID NO: 3165896 - RNA, 14 nt, Human
aggaaaucaaagug

SEQ ID NO: 3165897 - RNA, 19 nt, Human
aggaaaucaaagugcuauu

SEQ ID NO: 3165898 - RNA, 18 nt, Human
aggaagcucagggccugg

SEQ ID NO: 3165899 - RNA, 22 nt, Human
aggaagcucagggccuggcuca

SEQ ID NO: 3165900 - RNA, 17 nt, Human
aggaagcucagggccug

SEQ ID NO: 3165901 - RNA, 13 nt, Human
aggaauuuugcua

SEQ ID NO: 3165902 - RNA, 15 nt, Human
ugcugccacacuuca

SEQ ID NO: 3165903 - RNA, 19 nt, Human
ugcugccacacuucaggcu

SEQ ID NO: 3165904 - RNA, 16 nt, Human
ugcugccacacuucag

SEQ ID NO: 3165905 - RNA, 11 nt, Human
ugcugccaucc

SEQ ID NO: 3165906 - RNA, 21 nt, Human
aggacaaaucugcaaagcaug

SEQ ID NO: 3165907 - RNA, 20 nt, Human
aggacaaaucugcaaagcau

SEQ ID NO: 3165908 - RNA, 22 nt, Human
ugcugccacacuucaggcucuu

SEQ ID NO: 3165909 - RNA, 15 nt, Human
ugcugccauccaggu

SEQ ID NO: 3165910 - RNA, 14 nt, Human
ugcugccauccagg

SEQ ID NO: 3165911 - RNA, 13 nt, Human
ugcugccauccag

SEQ ID NO: 3165912 - RNA, 12 nt, Human
ugcugccaucca

SEQ ID NO: 3165913 - RNA, 22 nt, Human
ugcugccauccagguucagcuu

SEQ ID NO: 3165914 - RNA, 21 nt, Human
ugcugccauccagguucagcu

SEQ ID NO: 3165915 - RNA, 17 nt, Human
ugcugccaguaccagcc

SEQ ID NO: 3165916 - RNA, 20 nt, Human
ugcugccaguaccagcccca

SEQ ID NO: 3165917 - RNA, 19 nt, Human
ugcugccaguaccagcccc

SEQ ID NO: 3165918 - RNA, 14 nt, Human
ugcugcccagccuc

SEQ ID NO: 3165919 - RNA, 16 nt, Human
ugcugcccagccucca

SEQ ID NO: 3165920 - RNA, 19 nt, Human
ugcucugugcccacccucc

SEQ ID NO: 3165921 - RNA, 17 nt, Human
ugcugacuguuuucucu

SEQ ID NO: 3165922 - RNA, 18 nt, Human
ugcucugcauguuacaua

SEQ ID NO: 3165923 - RNA, 15 nt, Human
ugcucugcauguuac

SEQ ID NO: 3165924 - RNA, 17 nt, Human
ugcucuggacaggcaug

SEQ ID NO: 3165925 - RNA, 14 nt, Human
ugcucugccccagc

SEQ ID NO: 3165926 - RNA, 15 nt, Human
ugcucugccccagcu

SEQ ID NO: 3165927 - RNA, 22 nt, Human
ugcucugaucauccacugugcc

SEQ ID NO: 3165928 - RNA, 18 nt, Human
ugcucugaugaagaggag

SEQ ID NO: 3165929 - RNA, 19 nt, Human
ugcucugaugaagaggagu

SEQ ID NO: 3165930 - RNA, 19 nt, Human
ugcucugaucauccacugu

SEQ ID NO: 3165931 - RNA, 18 nt, Human
ugcuaucaguuuuauagc

SEQ ID NO: 3165932 - RNA, 15 nt, Human
ugcuaucaguuuuau

SEQ ID NO: 3165933 - RNA, 22 nt, Human
aggaaaggcuccaggagcagcc

SEQ ID NO: 3165934 - RNA, 16 nt, Human
aggaaaggcuccagga

SEQ ID NO: 3165935 - RNA, 20 nt, Human
aggaaaggagaguacuuugg

SEQ ID NO: 3165936 - RNA, 18 nt, Human
aggaaaggcuccaggagc

SEQ ID NO: 3165937 - RNA, 20 nt, Human
aggaaaggcuccaggagcag

SEQ ID NO: 3165938 - RNA, 21 nt, Human
ugcugacuguuuucucuugag

SEQ ID NO: 3165939 - RNA, 24 nt, Human
ugcugacuguuuucucuugagagg

SEQ ID NO: 3165940 - RNA, 16 nt, Human
ugcugacuguuuucuc

SEQ ID NO: 3165941 - RNA, 11 nt, Human
ugcugaggguc

SEQ ID NO: 3165942 - RNA, 12 nt, Human
ugcugagggucc

SEQ ID NO: 3165943 - RNA, 13 nt, Human
ugcugagggucca

SEQ ID NO: 3165944 - RNA, 19 nt, Human
aggaaagcaaaggagauug

SEQ ID NO: 3165945 - RNA, 13 nt, Human
aggaaagcacaga

SEQ ID NO: 3165946 - RNA, 15 nt, Human
ugcugagucccaggc

SEQ ID NO: 3165947 - RNA, 18 nt, Human
ugcugagucccaggcuga

SEQ ID NO: 3165948 - RNA, 22 nt, Human
ugcugagucccaggcugagccu

SEQ ID NO: 3165949 - RNA, 20 nt, Human
ugcugaguccgaccuggccu

SEQ ID NO: 3165950 - RNA, 16 nt, Human
aggccugacucucagc

SEQ ID NO: 3165951 - RNA, 20 nt, Human
aggccugaauccaaaagaaa

SEQ ID NO: 3165952 - RNA, 23 nt, Human
aggccugaauccaaaagaaaaac

SEQ ID NO: 3165953 - RNA, 12 nt, Human
aggccuggccag

SEQ ID NO: 3165954 - RNA, 13 nt, Human
aggccuggccaga

SEQ ID NO: 3165955 - RNA, 21 nt, Human
aggccguugccgcugauguuu

SEQ ID NO: 3165956 - RNA, 18 nt, Human
aggccguugcugacuuag

SEQ ID NO: 3165957 - RNA, 21 nt, Human
aggccguugcugacuuagaau

SEQ ID NO: 3165958 - RNA, 23 nt, Human
aggccguugcugacuuagaaucc

SEQ ID NO: 3165959 - RNA, 19 nt, Human
aggccuaauucuaugccug

SEQ ID NO: 3165960 - RNA, 22 nt, Human
aggccuacaugcuuugugaaca

SEQ ID NO: 3165961 - RNA, 22 nt, Human
aggccuaauucuaugccugucu

SEQ ID NO: 3165962 - RNA, 23 nt, Human
aggccuacaugcuuugugaacaa

SEQ ID NO: 3165963 - RNA, 13 nt, Human
aggccuacuccug

SEQ ID NO: 3165964 - RNA, 15 nt, Human
aggccuacuccuguc

SEQ ID NO: 3165965 - RNA, 14 nt, Human
aggccuacuccugu

SEQ ID NO: 3165966 - RNA, 17 nt, Human
aggccuacuccugucuu

SEQ ID NO: 3165967 - RNA, 17 nt, Human
aggccugaaauccuggu

SEQ ID NO: 3165968 - RNA, 18 nt, Human
aggccugaaauccugguu

SEQ ID NO: 3165969 - RNA, 16 nt, Human
aggcccggcuccaggc

SEQ ID NO: 3165970 - RNA, 15 nt, Human
aggcccggcuccagg

SEQ ID NO: 3165971 - RNA, 14 nt, Human
aggcccggcuccag

SEQ ID NO: 3165972 - RNA, 19 nt, Human
aggccgggcagagcacagc

SEQ ID NO: 3165973 - RNA, 16 nt, Human
aggccgggcagagcac

SEQ ID NO: 3165974 - RNA, 14 nt, Human
aggccgggcagagc

SEQ ID NO: 3165975 - RNA, 13 nt, Human
aggccgggcagag

SEQ ID NO: 3165976 - RNA, 21 nt, Human
aggccccugccacccugggga

SEQ ID NO: 3165977 - RNA, 12 nt, Human
aggccccugcca

SEQ ID NO: 3165978 - RNA, 18 nt, Human
aggccccugccacccugg

SEQ ID NO: 3165979 - RNA, 17 nt, Human
aggccccugccacccug

SEQ ID NO: 3165980 - RNA, 19 nt, Human
aggcccagagggccugcaa

SEQ ID NO: 3165981 - RNA, 20 nt, Human
aggcccagagggccugcaag

SEQ ID NO: 3165982 - RNA, 15 nt, Human
aggccccugccaccc

SEQ ID NO: 3165983 - RNA, 13 nt, Human
aggccccugccac

SEQ ID NO: 3165984 - RNA, 14 nt, Human
uggcacagccugca

SEQ ID NO: 3165985 - RNA, 17 nt, Human
uggcacagccugcacuu

SEQ ID NO: 3165986 - RNA, 15 nt, Human
uggcacagggcagug

SEQ ID NO: 3165987 - RNA, 12 nt, Human
aggcauauuuua

SEQ ID NO: 3165988 - RNA, 19 nt, Human
aggcauaugcuucuuuaaa

SEQ ID NO: 3165989 - RNA, 18 nt, Human
aggcauaugcuucuuuaa

SEQ ID NO: 3165990 - RNA, 17 nt, Human
aggcauaugcuucuuua

SEQ ID NO: 3165991 - RNA, 16 nt, Human
uggcaccagcagccug

SEQ ID NO: 3165992 - RNA, 17 nt, Human
uggcaccagcagccugg

SEQ ID NO: 3165993 - RNA, 13 nt, Human
uggcagaugcagc

SEQ ID NO: 3165994 - RNA, 21 nt, Human
uggcagaugcagcucuuccug

SEQ ID NO: 3165995 - RNA, 17 nt, Human
uggcagaugcagcucuu

SEQ ID NO: 3165996 - RNA, 16 nt, Human
uggcagaugcagcucu

SEQ ID NO: 3165997 - RNA, 15 nt, Human
uggcagaugcagcuc

SEQ ID NO: 3165998 - RNA, 17 nt, Human
uggcagccgugccuuca

SEQ ID NO: 3165999 - RNA, 23 nt, Human
uggcagcaccgccucuucccgcc

SEQ ID NO: 3166000 - RNA, 20 nt, Human
uggcagcaccgccucuuccc

SEQ ID NO: 3166001 - RNA, 20 nt, Human
aggccauuccccgucucugg

SEQ ID NO: 3166002 - RNA, 15 nt, Human
aggcccagagggccu

SEQ ID NO: 3166003 - RNA, 16 nt, Human
aggcccagagggccug

SEQ ID NO: 3166004 - RNA, 13 nt, Human
uggcagcucagag

SEQ ID NO: 3166005 - RNA, 16 nt, Human
uggcagccgugccuuc

SEQ ID NO: 3166006 - RNA, 23 nt, Human
aggccagagacacaagccuucgg

SEQ ID NO: 3166007 - RNA, 18 nt, Human
aggccaugggccuccugu

SEQ ID NO: 3166008 - RNA, 17 nt, Human
aggccaugggccuccug

SEQ ID NO: 3166009 - RNA, 12 nt, Human
aggccagagaca

SEQ ID NO: 3166010 - RNA, 16 nt, Human
uggcagcucagagagg

SEQ ID NO: 3166011 - RNA, 13 nt, Human
aggccagagacac

SEQ ID NO: 3166012 - RNA, 18 nt, Human
aggccagagacacaagcc

SEQ ID NO: 3166013 - RNA, 14 nt, Human
uggcagcucagaga

SEQ ID NO: 3166014 - RNA, 15 nt, Human
uggcagcucagagag

SEQ ID NO: 3166015 - RNA, 21 nt, Human
uggcagccgugccuucagcuc

SEQ ID NO: 3166016 - RNA, 20 nt, Human
uggcagccgugccuucagcu

SEQ ID NO: 3166017 - RNA, 19 nt, Human
uggcagccgugccuucagc

SEQ ID NO: 3166018 - RNA, 18 nt, Human
uggcagccgugccuucag

SEQ ID NO: 3166019 - RNA, 21 nt, Human
aggcgaaagaaaacucuauuu

SEQ ID NO: 3166020 - RNA, 22 nt, Human
aggcgaggaggccguugccgcu

SEQ ID NO: 3166021 - RNA, 23 nt, Human
aggccuuuaguuauaaaggaauc

SEQ ID NO: 3166022 - RNA, 19 nt, Human
aggccuugggcucugcuga

SEQ ID NO: 3166023 - RNA, 18 nt, Human
aggccuugggcucugcug

SEQ ID NO: 3166024 - RNA, 18 nt, Human
aggccuucucugaaggac

SEQ ID NO: 3166025 - RNA, 17 nt, Human
aggccuucucugaagga

SEQ ID NO: 3166026 - RNA, 17 nt, Human
aggccuugggcucugcu

SEQ ID NO: 3166027 - RNA, 14 nt, Human
aggcucaaauuuug

SEQ ID NO: 3166028 - RNA, 15 nt, Human
aggcuauuaaaaaag

SEQ ID NO: 3166029 - RNA, 19 nt, Human
aggcgcaagggaggcccag

SEQ ID NO: 3166030 - RNA, 20 nt, Human
aggcgcaagggaggcccagc

SEQ ID NO: 3166031 - RNA, 14 nt, Human
aggcgccccuuccc

SEQ ID NO: 3166032 - RNA, 19 nt, Human
aggcgcuagcacagcuccc

SEQ ID NO: 3166033 - RNA, 15 nt, Human
aggcgcuagcacagc

SEQ ID NO: 3166034 - RNA, 23 nt, Human
aggcgcuaacuugcuuaaaugug

SEQ ID NO: 3166035 - RNA, 23 nt, Human
aggcgccucaacucugcugaggg

SEQ ID NO: 3166036 - RNA, 15 nt, Human
aggcgcuaacuugcu

SEQ ID NO: 3166037 - RNA, 13 nt, Human
aggcgcuaacuug

SEQ ID NO: 3166038 - RNA, 11 nt, Human
aggcuccacuu

SEQ ID NO: 3166039 - RNA, 17 nt, Human
aggcuccacuuggucug

SEQ ID NO: 3166040 - RNA, 21 nt, Human
aggcuccacuuggucugugag

SEQ ID NO: 3166041 - RNA, 22 nt, Human
aggcuccacuuggucugugaga

SEQ ID NO: 3166042 - RNA, 14 nt, Human
aggcuccaggagca

SEQ ID NO: 3166043 - RNA, 16 nt, Human
aggcuccaggagcagc

SEQ ID NO: 3166044 - RNA, 13 nt, Human
aggcuccaggagc

SEQ ID NO: 3166045 - RNA, 12 nt, Human
uggcccugcccu

SEQ ID NO: 3166046 - RNA, 24 nt, Human
uggcccucucugaaggaggccacc

SEQ ID NO: 3166047 - RNA, 13 nt, Human
uggcccacugcau

SEQ ID NO: 3166048 - RNA, 14 nt, Human
uggcccacugcauc

SEQ ID NO: 3166049 - RNA, 13 nt, Human
uggcccacgcacu

SEQ ID NO: 3166050 - RNA, 19 nt, Human
uggcccacgcacuucggga

SEQ ID NO: 3166051 - RNA, 22 nt, Human
uggcaugggaaugaaugucagu

SEQ ID NO: 3166052 - RNA, 22 nt, Human
uggcauggugguugggacccag

SEQ ID NO: 3166053 - RNA, 21 nt, Human
uggcauggugguugggaccca

SEQ ID NO: 3166054 - RNA, 19 nt, Human
uggccucugcacuccccug

SEQ ID NO: 3166055 - RNA, 18 nt, Human
uggccucugcacuccccu

SEQ ID NO: 3166056 - RNA, 20 nt, Human
uggccucugcacuccccugc

SEQ ID NO: 3166057 - RNA, 21 nt, Human
uggccucugcugauccuccca

SEQ ID NO: 3166058 - RNA, 18 nt, Human
uggccugagcugggauga

SEQ ID NO: 3166059 - RNA, 21 nt, Human
uggccugaugaccaauuuuaa

SEQ ID NO: 3166060 - RNA, 22 nt, Human
uggccugugcgaucccacccgu

SEQ ID NO: 3166061 - RNA, 21 nt, Human
uggccugugcgaucccacccg

SEQ ID NO: 3166062 - RNA, 13 nt, Human
aggaggccaccuc

SEQ ID NO: 3166063 - RNA, 14 nt, Human
aggaggccaccucc

SEQ ID NO: 3166064 - RNA, 15 nt, Human
aggaggccagccuug

SEQ ID NO: 3166065 - RNA, 13 nt, Human
uggaagugugggu

SEQ ID NO: 3166066 - RNA, 14 nt, Human
uggaaguguggguc

SEQ ID NO: 3166067 - RNA, 19 nt, Human
uggaagugaaaacuuugua

SEQ ID NO: 3166068 - RNA, 18 nt, Human
uggaagugaaaacuuugu

SEQ ID NO: 3166069 - RNA, 22 nt, Human
aggaguuucuuuagcugacaga

SEQ ID NO: 3166070 - RNA, 21 nt, Human
aggaguuugagaccaaccugg

SEQ ID NO: 3166071 - RNA, 14 nt, Human
aggauaugccugcu

SEQ ID NO: 3166072 - RNA, 18 nt, Human
aggauauggacacuggug

SEQ ID NO: 3166073 - RNA, 16 nt, Human
aggauauggacacugg

SEQ ID NO: 3166074 - RNA, 17 nt, Human
aggauaugccugcucuu

SEQ ID NO: 3166075 - RNA, 15 nt, Human
ugcugccccugccuu

SEQ ID NO: 3166076 - RNA, 10 nt, Human
ugcugcccug

SEQ ID NO: 3166077 - RNA, 12 nt, Human
uggaacacucug

SEQ ID NO: 3166078 - RNA, 13 nt, Human
uggaagcuccgcu

SEQ ID NO: 3166079 - RNA, 20 nt, Human
uggaaguacuauaauuuacc

SEQ ID NO: 3166080 - RNA, 18 nt, Human
uggaaguacuauaauuua

SEQ ID NO: 3166081 - RNA, 17 nt, Human
uggaagcuguuuggaaa

SEQ ID NO: 3166082 - RNA, 22 nt, Human
uggaauuucucccagucauuua

SEQ ID NO: 3166083 - RNA, 19 nt, Human
aggcaacugcauuggcuuu

SEQ ID NO: 3166084 - RNA, 16 nt, Human
aggcaacuugggaacu

SEQ ID NO: 3166085 - RNA, 14 nt, Human
aggcaagcaccucc

SEQ ID NO: 3166086 - RNA, 16 nt, Human
aggcaagauugauguu

SEQ ID NO: 3166087 - RNA, 16 nt, Human
aggcaagauggcacag

SEQ ID NO: 3166088 - RNA, 13 nt, Human
uggacaagaaagu

SEQ ID NO: 3166089 - RNA, 18 nt, Human
uggaauuuuuuuguacga

SEQ ID NO: 3166090 - RNA, 21 nt, Human
aggauccugagccagauuuca

SEQ ID NO: 3166091 - RNA, 18 nt, Human
aggauccugagccagauu

SEQ ID NO: 3166092 - RNA, 22 nt, Human
aggauugcuacuguccuaccca

SEQ ID NO: 3166093 - RNA, 12 nt, Human
aggcaggauggc

SEQ ID NO: 3166094 - RNA, 15 nt, Human
aggcaggagagacag

SEQ ID NO: 3166095 - RNA, 17 nt, Human
aggcagggcaggaccag

SEQ ID NO: 3166096 - RNA, 16 nt, Human
aggcagggcaggacca

SEQ ID NO: 3166097 - RNA, 15 nt, Human
aggcagggcaggacc

SEQ ID NO: 3166098 - RNA, 12 nt, Human
aggcagggcagg

SEQ ID NO: 3166099 - RNA, 16 nt, Human
aggcagggagggccug

SEQ ID NO: 3166100 - RNA, 21 nt, Human
aggcagccccauucugccugc

SEQ ID NO: 3166101 - RNA, 20 nt, Human
aggcagccccauucugccug

SEQ ID NO: 3166102 - RNA, 19 nt, Human
aggcagccccauucugccu

SEQ ID NO: 3166103 - RNA, 22 nt, Human
aggcagccccauucugccugcc

SEQ ID NO: 3166104 - RNA, 17 nt, Human
aggcagccugagagucu

SEQ ID NO: 3166105 - RNA, 11 nt, Human
aggcagguccc

SEQ ID NO: 3166106 - RNA, 19 nt, Human
aggcagggugucugccccc

SEQ ID NO: 3166107 - RNA, 14 nt, Human
aggcagguccaggg

SEQ ID NO: 3166108 - RNA, 22 nt, Human
aggcagggucucacucugucgc

SEQ ID NO: 3166109 - RNA, 15 nt, Human
aggcagggugucugc

SEQ ID NO: 3166110 - RNA, 22 nt, Human
aggcagggcaggaccagcccac

SEQ ID NO: 3166111 - RNA, 21 nt, Human
aggcagggcaggaccagccca

SEQ ID NO: 3166112 - RNA, 20 nt, Human
aggcagggcaggaccagccc

SEQ ID NO: 3166113 - RNA, 21 nt, Human
aggcagggucucacucugucg

SEQ ID NO: 3166114 - RNA, 20 nt, Human
aggcagggucucacucuguc

SEQ ID NO: 3166115 - RNA, 18 nt, Human
aggcagggucucacucug

SEQ ID NO: 3166116 - RNA, 19 nt, Human
aggcagggucucacucugu

SEQ ID NO: 3166117 - RNA, 15 nt, Human
aggcagguccccaga

SEQ ID NO: 3166118 - RNA, 14 nt, Human
aggcagguccccag

SEQ ID NO: 3166119 - RNA, 13 nt, Human
aggcaggucccca

SEQ ID NO: 3166120 - RNA, 12 nt, Human
aggcaggucccc

SEQ ID NO: 3166121 - RNA, 16 nt, Human
aggcagguccccagac

SEQ ID NO: 3166122 - RNA, 23 nt, Human
aggcaguaggacaaggugcaggc

SEQ ID NO: 3166123 - RNA, 21 nt, Human
aggcaggucuugaacuccugg

SEQ ID NO: 3166124 - RNA, 19 nt, Human
aggcaguugcccagccucu

SEQ ID NO: 3166125 - RNA, 17 nt, Human
aggcaguugcccagccu

SEQ ID NO: 3166126 - RNA, 20 nt, Human
aggcaguugcccagccucuu

SEQ ID NO: 3166127 - RNA, 15 nt, Human
aggcaguuugaggau

SEQ ID NO: 3166128 - RNA, 16 nt, Human
aggcaguauaaagaau

SEQ ID NO: 3166129 - RNA, 11 nt, Human
uggagccugca

SEQ ID NO: 3166130 - RNA, 13 nt, Human
uggagccugacag

SEQ ID NO: 3166131 - RNA, 14 nt, Human
uggagcccaggagu

SEQ ID NO: 3166132 - RNA, 16 nt, Human
uggagccugcagagcu

SEQ ID NO: 3166133 - RNA, 18 nt, Human
uggagccugacagccaga

SEQ ID NO: 3166134 - RNA, 17 nt, Human
uggagccugacagccag

SEQ ID NO: 3166135 - RNA, 21 nt, Human
uggagcugaggacucucacga

SEQ ID NO: 3166136 - RNA, 18 nt, Human
aggcacaggcagggcagg

SEQ ID NO: 3166137 - RNA, 17 nt, Human
aggcacaggcagggcag

SEQ ID NO: 3166138 - RNA, 16 nt, Human
aggcacaggcagggca

SEQ ID NO: 3166139 - RNA, 15 nt, Human
aggcacaggcagggc

SEQ ID NO: 3166140 - RNA, 21 nt, Human
aggcacauggaauauauuuua

SEQ ID NO: 3166141 - RNA, 18 nt, Human
aggcacauggaauauauu

SEQ ID NO: 3166142 - RNA, 16 nt, Human
aggcaaugcuggcugu

SEQ ID NO: 3166143 - RNA, 15 nt, Human
aggcaaugcuggcug

SEQ ID NO: 3166144 - RNA, 23 nt, Human
uggaggaaaaccaagccguggcu

SEQ ID NO: 3166145 - RNA, 21 nt, Human
uggaggaaaaccaagccgugg

SEQ ID NO: 3166146 - RNA, 23 nt, Human
uggagaaaaauaucuguaagagu

SEQ ID NO: 3166147 - RNA, 17 nt, Human
uggagaaaaauaucugu

SEQ ID NO: 3166148 - RNA, 24 nt, Human
uggacuuuguuaguuucuccaagc

SEQ ID NO: 3166149 - RNA, 11 nt, Human
uggacuuuguu

SEQ ID NO: 3166150 - RNA, 22 nt, Human
uggacuuuguuaguuucuccaa

SEQ ID NO: 3166151 - RNA, 16 nt, Human
uggacccugaaaugug

SEQ ID NO: 3166152 - RNA, 12 nt, Human
uggacuuuguua

SEQ ID NO: 3166153 - RNA, 14 nt, Human
uggacuuuguuaca

SEQ ID NO: 3166154 - RNA, 15 nt, Human
uggacuuuguuacac

SEQ ID NO: 3166155 - RNA, 22 nt, Human
uggacuuuguuacacuguuauu

SEQ ID NO: 3166156 - RNA, 15 nt, Human
uggacccugaaaugu

SEQ ID NO: 3166157 - RNA, 14 nt, Human
uggacccugaaaug

SEQ ID NO: 3166158 - RNA, 21 nt, Human
uggaccccaucugugaauaag

SEQ ID NO: 3166159 - RNA, 20 nt, Human
uggaccccaucugugaauaa

SEQ ID NO: 3166160 - RNA, 18 nt, Human
uggaccccaucugugaau

SEQ ID NO: 3166161 - RNA, 16 nt, Human
uggaccccaucuguga

SEQ ID NO: 3166162 - RNA, 15 nt, Human
uggaccccagccuca

SEQ ID NO: 3166163 - RNA, 14 nt, Human
uggaccccagccuc

SEQ ID NO: 3166164 - RNA, 13 nt, Human
uggaccccagccu

SEQ ID NO: 3166165 - RNA, 22 nt, Human
uggcugcagagcagugggccug

SEQ ID NO: 3166166 - RNA, 18 nt, Human
uggcugcagagcaguggg

SEQ ID NO: 3166167 - RNA, 15 nt, Human
uggcugcagagcagu

SEQ ID NO: 3166168 - RNA, 23 nt, Human
uggcugcaaaggguaucaggugc

SEQ ID NO: 3166169 - RNA, 17 nt, Human
uggcugugccucugccu

SEQ ID NO: 3166170 - RNA, 16 nt, Human
uggcugugccucugcc

SEQ ID NO: 3166171 - RNA, 15 nt, Human
uggcugugccucugc

SEQ ID NO: 3166172 - RNA, 14 nt, Human
uggcugugccucug

SEQ ID NO: 3166173 - RNA, 16 nt, Human
uggcuguggagugugg

SEQ ID NO: 3166174 - RNA, 22 nt, Human
uggcugugccucugccugucuc

SEQ ID NO: 3166175 - RNA, 19 nt, Human
uggcugugccucugccugu

SEQ ID NO: 3166176 - RNA, 18 nt, Human
uggcugugccucugccug

SEQ ID NO: 3166177 - RNA, 21 nt, Human
uggcuguggaauaggaacgcu

SEQ ID NO: 3166178 - RNA, 18 nt, Human
uggcuguuggcugggggc

SEQ ID NO: 3166179 - RNA, 16 nt, Human
uggcuguuggcugggg

SEQ ID NO: 3166180 - RNA, 14 nt, Human
uggcuucacggaag

SEQ ID NO: 3166181 - RNA, 23 nt, Human
uggcuguuggcugggggccucag

SEQ ID NO: 3166182 - RNA, 17 nt, Human
uggcuucacggaagagc

SEQ ID NO: 3166183 - RNA, 20 nt, Human
uggcuucacggaagagccuu

SEQ ID NO: 3166184 - RNA, 16 nt, Human
ugggaaagcauuguaa

SEQ ID NO: 3166185 - RNA, 14 nt, Human
ugggaaagcauugu

SEQ ID NO: 3166186 - RNA, 18 nt, Human
ugggaaagcauuguaaau

SEQ ID NO: 3166187 - RNA, 17 nt, Human
ugggaaagcauuguaaa

SEQ ID NO: 3166188 - RNA, 20 nt, Human
ugggaacaccauaggucacc

SEQ ID NO: 3166189 - RNA, 23 nt, Human
ugggaaaugcugauuuaaacuuc

SEQ ID NO: 3166190 - RNA, 17 nt, Human
ugggaaagagauuuaaa

SEQ ID NO: 3166191 - RNA, 15 nt, Human
ugggaaagcauaaag

SEQ ID NO: 3166192 - RNA, 19 nt, Human
uggcuauaggugcuacaaa

SEQ ID NO: 3166193 - RNA, 15 nt, Human
uggcuauaggugcua

SEQ ID NO: 3166194 - RNA, 19 nt, Human
uggcuaauguacugcauau

SEQ ID NO: 3166195 - RNA, 17 nt, Human
uggcuaauguacugcau

SEQ ID NO: 3166196 - RNA, 18 nt, Human
uggcuaagcaaaauguga

SEQ ID NO: 3166197 - RNA, 14 nt, Human
uggcuaaauucaug

SEQ ID NO: 3166198 - RNA, 13 nt, Human
aggcuccaggcag

SEQ ID NO: 3166199 - RNA, 15 nt, Human
aggcuccaggcagca

SEQ ID NO: 3166200 - RNA, 14 nt, Human
aggcuccaggcagc

SEQ ID NO: 3166201 - RNA, 17 nt, Human
aggcuccaggagcagcc

SEQ ID NO: 3166202 - RNA, 18 nt, Human
aggcuccaggagcagcca

SEQ ID NO: 3166203 - RNA, 19 nt, Human
aggcuccaggagcagccac

SEQ ID NO: 3166204 - RNA, 23 nt, Human
aggcuccaggagcagccacauuc

SEQ ID NO: 3166205 - RNA, 23 nt, Human
uggcuauaggugcuacaaaaaca

SEQ ID NO: 3166206 - RNA, 17 nt, Human
uggcucaagucuggccc

SEQ ID NO: 3166207 - RNA, 13 nt, Human
uggcucacgccug

SEQ ID NO: 3166208 - RNA, 23 nt, Human
agggaaaaaucaaguauuauaaa

SEQ ID NO: 3166209 - RNA, 22 nt, Human
agggaaaagauaaagaccagaa

SEQ ID NO: 3166210 - RNA, 15 nt, Human
agggaaacugccagc

SEQ ID NO: 3166211 - RNA, 14 nt, Human
agggaaacugccag

SEQ ID NO: 3166212 - RNA, 23 nt, Human
agggaaaauaaaaaaagaaaaaa

SEQ ID NO: 3166213 - RNA, 22 nt, Human
agggaaaauaaaaaaagaaaaa

SEQ ID NO: 3166214 - RNA, 15 nt, Human
agggaaacuaagauu

SEQ ID NO: 3166215 - RNA, 19 nt, Human
agggaaacuaagauucuuu

SEQ ID NO: 3166216 - RNA, 22 nt, Human
agggaaacuaagauucuuuuaa

SEQ ID NO: 3166217 - RNA, 11 nt, Human
agggaaaccuu

SEQ ID NO: 3166218 - RNA, 12 nt, Human
agggaaaccuuu

SEQ ID NO: 3166219 - RNA, 23 nt, Human
agggaaacugccagcaacgcagg

SEQ ID NO: 3166220 - RNA, 21 nt, Human
agggaaacugccagcaacgca

SEQ ID NO: 3166221 - RNA, 19 nt, Human
agggaaacugccagcaacg

SEQ ID NO: 3166222 - RNA, 16 nt, Human
agggaaacugccagca

SEQ ID NO: 3166223 - RNA, 21 nt, Human
aggcuuagucacugagacagc

SEQ ID NO: 3166224 - RNA, 22 nt, Human
aggcuuagucacugagacagcc

SEQ ID NO: 3166225 - RNA, 23 nt, Human
aggcuuagucacugagacagccc

SEQ ID NO: 3166226 - RNA, 22 nt, Human
aggcuuauauuuguguaauuuu

SEQ ID NO: 3166227 - RNA, 14 nt, Human
aggcuuauauuugu

SEQ ID NO: 3166228 - RNA, 16 nt, Human
aggcuuauaaaacaga

SEQ ID NO: 3166229 - RNA, 14 nt, Human
aggcuuauaaaaca

SEQ ID NO: 3166230 - RNA, 12 nt, Human
aggcuugcagaa

SEQ ID NO: 3166231 - RNA, 15 nt, Human
aggcuugcugcagau

SEQ ID NO: 3166232 - RNA, 21 nt, Human
aggcuugcccaguacauuuaa

SEQ ID NO: 3166233 - RNA, 23 nt, Human
aggcuucugguugaugccuguga

SEQ ID NO: 3166234 - RNA, 22 nt, Human
aggcugggggaagaagcucucu

SEQ ID NO: 3166235 - RNA, 14 nt, Human
aggcuggguucuga

SEQ ID NO: 3166236 - RNA, 17 nt, Human
aggcuggguucugaucc

SEQ ID NO: 3166237 - RNA, 21 nt, Human
aggcugggcuucaguggcagc

SEQ ID NO: 3166238 - RNA, 20 nt, Human
aggcugggcuucaguggcag

SEQ ID NO: 3166239 - RNA, 19 nt, Human
aggcugggcuucaguggca

SEQ ID NO: 3166240 - RNA, 18 nt, Human
aggcugggcuucaguggc

SEQ ID NO: 3166241 - RNA, 23 nt, Human
aggcugggcuucaguggcagcug

SEQ ID NO: 3166242 - RNA, 22 nt, Human
aggcugggcuucaguggcagcu

SEQ ID NO: 3166243 - RNA, 17 nt, Human
aggcugggggaagaagc

SEQ ID NO: 3166244 - RNA, 22 nt, Human
aggcugggcugggcacugcucu

SEQ ID NO: 3166245 - RNA, 21 nt, Human
aggcugggcugggcacugcuc

SEQ ID NO: 3166246 - RNA, 19 nt, Human
aggcugggcugggcacugc

SEQ ID NO: 3166247 - RNA, 20 nt, Human
ugggaacccaaguccaagca

SEQ ID NO: 3166248 - RNA, 19 nt, Human
aggcugggagagccuucca

SEQ ID NO: 3166249 - RNA, 16 nt, Human
aggcugggagagccuu

SEQ ID NO: 3166250 - RNA, 20 nt, Human
aggcugggagagccuuccag

SEQ ID NO: 3166251 - RNA, 21 nt, Human
aggcugggagagccuuccagg

SEQ ID NO: 3166252 - RNA, 22 nt, Human
aggcugggagagccuuccaggg

SEQ ID NO: 3166253 - RNA, 21 nt, Human
aggcugggcucccuucccacc

SEQ ID NO: 3166254 - RNA, 23 nt, Human
aggcugggcucccuucccaccuc

SEQ ID NO: 3166255 - RNA, 14 nt, Human
aggcugggcuucag

SEQ ID NO: 3166256 - RNA, 15 nt, Human
aggcugggcugggca

SEQ ID NO: 3166257 - RNA, 18 nt, Human
aggcugggcugggcacug

SEQ ID NO: 3166258 - RNA, 16 nt, Human
aggcugggcugggcac

SEQ ID NO: 3166259 - RNA, 14 nt, Human
aggcugggcucccu

SEQ ID NO: 3166260 - RNA, 18 nt, Human
aggcugggcucccuuccc

SEQ ID NO: 3166261 - RNA, 13 nt, Human
aggcugggcuccc

SEQ ID NO: 3166262 - RNA, 21 nt, Human
ugggcaacccccagccugcua

SEQ ID NO: 3166263 - RNA, 15 nt, Human
ugggcaaaagagugu

SEQ ID NO: 3166264 - RNA, 16 nt, Human
ugggcagaaggaagac

SEQ ID NO: 3166265 - RNA, 20 nt, Human
ugggcagaaggaagacuuca

SEQ ID NO: 3166266 - RNA, 13 nt, Human
ugggcagaaggaa

SEQ ID NO: 3166267 - RNA, 21 nt, Human
ugggcaauauucucuguacau

SEQ ID NO: 3166268 - RNA, 20 nt, Human
ugggcaauauucucuguaca

SEQ ID NO: 3166269 - RNA, 19 nt, Human
ugggcaauauucucuguac

SEQ ID NO: 3166270 - RNA, 18 nt, Human
ugggcaauauucucugua

SEQ ID NO: 3166271 - RNA, 17 nt, Human
ugggcaauauucucugu

SEQ ID NO: 3166272 - RNA, 13 nt, Human
ugggcaauauucu

SEQ ID NO: 3166273 - RNA, 21 nt, Human
ugggagaaccaaaaagaggcu

SEQ ID NO: 3166274 - RNA, 22 nt, Human
ugggaggaucucuugagccugg

SEQ ID NO: 3166275 - RNA, 18 nt, Human
ugggaggauugcuugagc

SEQ ID NO: 3166276 - RNA, 21 nt, Human
ugggaggauugcuugagcuca

SEQ ID NO: 3166277 - RNA, 19 nt, Human
ugggaggcugagaugggag

SEQ ID NO: 3166278 - RNA, 12 nt, Human
ugggagggagcu

SEQ ID NO: 3166279 - RNA, 19 nt, Human
ugggagggagcugagaaga

SEQ ID NO: 3166280 - RNA, 15 nt, Human
ugggaggcuggaguu

SEQ ID NO: 3166281 - RNA, 14 nt, Human
ugggacuggccucu

SEQ ID NO: 3166282 - RNA, 16 nt, Human
ugggacuggccucugc

SEQ ID NO: 3166283 - RNA, 20 nt, Human
ugggacugggaacagaacuc

SEQ ID NO: 3166284 - RNA, 16 nt, Human
ugggacuacaggugug

SEQ ID NO: 3166285 - RNA, 16 nt, Human
ugggacuacaggcacc

SEQ ID NO: 3166286 - RNA, 13 nt, Human
ugggacuggccuc

SEQ ID NO: 3166287 - RNA, 20 nt, Human
ugggacuaugcuuuucucaa

SEQ ID NO: 3166288 - RNA, 19 nt, Human
ugggacuaugcuuuucuca

SEQ ID NO: 3166289 - RNA, 18 nt, Human
ugggacuacaggcaccca

SEQ ID NO: 3166290 - RNA, 18 nt, Human
agggagcaucagugcccu

SEQ ID NO: 3166291 - RNA, 14 nt, Human
agggagcaguggcu

SEQ ID NO: 3166292 - RNA, 23 nt, Human
agggacuucugucuucacaacag

SEQ ID NO: 3166293 - RNA, 15 nt, Human
agggacuuggaagcu

SEQ ID NO: 3166294 - RNA, 19 nt, Human
agggacuuggaagcuccgc

SEQ ID NO: 3166295 - RNA, 18 nt, Human
agggacuuggaagcuccg

SEQ ID NO: 3166296 - RNA, 12 nt, Human
agggaaagacug

SEQ ID NO: 3166297 - RNA, 16 nt, Human
agggaaagacuggcaa

SEQ ID NO: 3166298 - RNA, 14 nt, Human
agggagagaagaua

SEQ ID NO: 3166299 - RNA, 13 nt, Human
agggagagaagau

SEQ ID NO: 3166300 - RNA, 23 nt, Human
agggagcagacuuuuaaagacuu

SEQ ID NO: 3166301 - RNA, 20 nt, Human
agggacuuggaagcuccgcu

SEQ ID NO: 3166302 - RNA, 19 nt, Human
agggcuguggccucccugc

SEQ ID NO: 3166303 - RNA, 18 nt, Human
agggcuggggcagccucu

SEQ ID NO: 3166304 - RNA, 14 nt, Human
ugggcucccuuccc

SEQ ID NO: 3166305 - RNA, 10 nt, Human
ugggcucagc

SEQ ID NO: 3166306 - RNA, 14 nt, Human
ugggcucagcacau

SEQ ID NO: 3166307 - RNA, 21 nt, Human
ugggcucccuucccaccucuc

SEQ ID NO: 3166308 - RNA, 15 nt, Human
ugggcucucgcggcc

SEQ ID NO: 3166309 - RNA, 16 nt, Human
agggcccaugggaggg

SEQ ID NO: 3166310 - RNA, 17 nt, Human
agggcccaugggaggga

SEQ ID NO: 3166311 - RNA, 18 nt, Human
agggcccaugggagggag

SEQ ID NO: 3166312 - RNA, 19 nt, Human
agggcccaugggagggagc

SEQ ID NO: 3166313 - RNA, 20 nt, Human
agggcuccagacacaugucc

SEQ ID NO: 3166314 - RNA, 15 nt, Human
agggcuccagacaca

SEQ ID NO: 3166315 - RNA, 14 nt, Human
agggcccagagagg

SEQ ID NO: 3166316 - RNA, 17 nt, Human
agggagggcuccagaca

SEQ ID NO: 3166317 - RNA, 19 nt, Human
agggagggcuccagacaca

SEQ ID NO: 3166318 - RNA, 12 nt, Human
agggagggcucc

SEQ ID NO: 3166319 - RNA, 13 nt, Human
agggagggccugg

SEQ ID NO: 3166320 - RNA, 15 nt, Human
agggagggccugggc

SEQ ID NO: 3166321 - RNA, 17 nt, Human
agggagggagggcucca

SEQ ID NO: 3166322 - RNA, 14 nt, Human
ugggcauucucucu

SEQ ID NO: 3166323 - RNA, 22 nt, Human
agggagggcuccagacacaugu

SEQ ID NO: 3166324 - RNA, 20 nt, Human
agggaguccgaaagggacuu

SEQ ID NO: 3166325 - RNA, 19 nt, Human
agggaggugugaggcagga

SEQ ID NO: 3166326 - RNA, 20 nt, Human
agggagugaguugauagcac

SEQ ID NO: 3166327 - RNA, 20 nt, Human
agggagugacagaggcagcc

SEQ ID NO: 3166328 - RNA, 23 nt, Human
agggaguccgaaagggacuugga

SEQ ID NO: 3166329 - RNA, 15 nt, Human
agggaguauucuaau

SEQ ID NO: 3166330 - RNA, 14 nt, Human
agggagucagcugu

SEQ ID NO: 3166331 - RNA, 13 nt, Human
agggcccagagag

SEQ ID NO: 3166332 - RNA, 12 nt, Human
agggcccagaga

SEQ ID NO: 3166333 - RNA, 17 nt, Human
agggcauggccaggugg

SEQ ID NO: 3166334 - RNA, 21 nt, Human
agggccaaaagcuucccuccc

SEQ ID NO: 3166335 - RNA, 19 nt, Human
agggccaaaagcuucccuc

SEQ ID NO: 3166336 - RNA, 18 nt, Human
agggccaaaagcuucccu

SEQ ID NO: 3166337 - RNA, 14 nt, Human
agggccaaaagcuu

SEQ ID NO: 3166338 - RNA, 19 nt, Human
agggcagugcaaggaggga

SEQ ID NO: 3166339 - RNA, 16 nt, Human
agggcagugcaaggag

SEQ ID NO: 3166340 - RNA, 13 nt, Human
agggaguuuuuga

SEQ ID NO: 3166341 - RNA, 17 nt, Human
agggcacugguggcccg

SEQ ID NO: 3166342 - RNA, 12 nt, Human
uguuaauaucac

SEQ ID NO: 3166343 - RNA, 13 nt, Human
uguuaauaucacu

SEQ ID NO: 3166344 - RNA, 17 nt, Human
uguuaauaucacucauu

SEQ ID NO: 3166345 - RNA, 18 nt, Human
uguuaauaucacucauua

SEQ ID NO: 3166346 - RNA, 19 nt, Human
uguuaauaucacucauuaa

SEQ ID NO: 3166347 - RNA, 21 nt, Human
uguuaauaucacucauuaauu

SEQ ID NO: 3166348 - RNA, 22 nt, Human
uguuaauaucacucauuaauua

SEQ ID NO: 3166349 - RNA, 13 nt, Human
uguuaagcaucua

SEQ ID NO: 3166350 - RNA, 22 nt, Human
uguuaaguugauggugaugaaa

SEQ ID NO: 3166351 - RNA, 15 nt, Human
uguuacaauguaacu

SEQ ID NO: 3166352 - RNA, 18 nt, Human
uguuacacuuuuuggaag

SEQ ID NO: 3166353 - RNA, 19 nt, Human
uguguuaaucuuaauguau

SEQ ID NO: 3166354 - RNA, 22 nt, Human
uguuaauaaagugcacugccac

SEQ ID NO: 3166355 - RNA, 14 nt, Human
uguuaacuuauuca

SEQ ID NO: 3166356 - RNA, 15 nt, Human
uguuaacuuauucaa

SEQ ID NO: 3166357 - RNA, 17 nt, Human
uguuaacuuauucaaag

SEQ ID NO: 3166358 - RNA, 18 nt, Human
uguuaacuuauucaaaga

SEQ ID NO: 3166359 - RNA, 23 nt, Human
uguuaacuuauucaaagagaaaa

SEQ ID NO: 3166360 - RNA, 16 nt, Human
uguuaacugagugccu

SEQ ID NO: 3166361 - RNA, 22 nt, Human
uguuaacugagugccuuuuggu

SEQ ID NO: 3166362 - RNA, 14 nt, Human
uguguuaauuuaag

SEQ ID NO: 3166363 - RNA, 18 nt, Human
uguguuaauuuaaguuuu

SEQ ID NO: 3166364 - RNA, 13 nt, Human
uguguuaauuuaa

SEQ ID NO: 3166365 - RNA, 20 nt, Human
aguggacuggaggagcuggg

SEQ ID NO: 3166366 - RNA, 14 nt, Human
uguuacaguaaugu

SEQ ID NO: 3166367 - RNA, 17 nt, Human
uguuacaguaaugucau

SEQ ID NO: 3166368 - RNA, 21 nt, Human
uguuacaguaaugucauaaag

SEQ ID NO: 3166369 - RNA, 21 nt, Human
aguggacccugaaaugugugu

SEQ ID NO: 3166370 - RNA, 19 nt, Human
aguggacccugaaaugugu

SEQ ID NO: 3166371 - RNA, 17 nt, Human
aguggauggaaggggcu

SEQ ID NO: 3166372 - RNA, 19 nt, Human
aguggauugcucaucucag

SEQ ID NO: 3166373 - RNA, 22 nt, Human
aguggcaaagcuguucuuccug

SEQ ID NO: 3166374 - RNA, 21 nt, Human
aguggcaccugucugcuccag

SEQ ID NO: 3166375 - RNA, 17 nt, Human
aguggcaccugucugcu

SEQ ID NO: 3166376 - RNA, 16 nt, Human
aguggcaccugucugc

SEQ ID NO: 3166377 - RNA, 13 nt, Human
aguggcaccuguc

SEQ ID NO: 3166378 - RNA, 22 nt, Human
aguggcaccugucugcuccagc

SEQ ID NO: 3166379 - RNA, 16 nt, Human
agugggguagguuggg

SEQ ID NO: 3166380 - RNA, 22 nt, Human
aguggggggaacgcccacuucc

SEQ ID NO: 3166381 - RNA, 19 nt, Human
aguggggggaacgcccacu

SEQ ID NO: 3166382 - RNA, 18 nt, Human
agugggggaucacagccu

SEQ ID NO: 3166383 - RNA, 18 nt, Human
aguggggggaacgcccac

SEQ ID NO: 3166384 - RNA, 17 nt, Human
aguggggggaacgccca

SEQ ID NO: 3166385 - RNA, 22 nt, Human
agugggcccaaugcacuuuguu

SEQ ID NO: 3166386 - RNA, 14 nt, Human
aguggggaggggcu

SEQ ID NO: 3166387 - RNA, 15 nt, Human
aguggggacagagca

SEQ ID NO: 3166388 - RNA, 15 nt, Human
ugugguuuucuguuu

SEQ ID NO: 3166389 - RNA, 18 nt, Human
ugugguuuucuguuucua

SEQ ID NO: 3166390 - RNA, 12 nt, Human
ugugguuucauu

SEQ ID NO: 3166391 - RNA, 12 nt, Human
ugugguuucuuu

SEQ ID NO: 3166392 - RNA, 16 nt, Human
ugugguuucuuuuuga

SEQ ID NO: 3166393 - RNA, 13 nt, Human
ugugguuuggaau

SEQ ID NO: 3166394 - RNA, 18 nt, Human
ugugguuuggaauauuaa

SEQ ID NO: 3166395 - RNA, 20 nt, Human
ugugucagguggggcagcuu

SEQ ID NO: 3166396 - RNA, 15 nt, Human
ugugucaguuuaugu

SEQ ID NO: 3166397 - RNA, 13 nt, Human
ugugucaguuuau

SEQ ID NO: 3166398 - RNA, 15 nt, Human
uguguaaauuauuga

SEQ ID NO: 3166399 - RNA, 20 nt, Human
ugugucaguuuauguuuugg

SEQ ID NO: 3166400 - RNA, 19 nt, Human
ugugucaguuuauguuuug

SEQ ID NO: 3166401 - RNA, 18 nt, Human
ugugucaguuuauguuuu

SEQ ID NO: 3166402 - RNA, 22 nt, Human
ugugucaucuagcauuagguau

SEQ ID NO: 3166403 - RNA, 23 nt, Human
agugccccgucuacagcuccccc

SEQ ID NO: 3166404 - RNA, 21 nt, Human
agugccccgucuacagcuccc

SEQ ID NO: 3166405 - RNA, 16 nt, Human
agugcccuccaggaua

SEQ ID NO: 3166406 - RNA, 22 nt, Human
ugugucucuugguccugcugca

SEQ ID NO: 3166407 - RNA, 16 nt, Human
ugugucugccacauua

SEQ ID NO: 3166408 - RNA, 18 nt, Human
uguguguuguguguggga

SEQ ID NO: 3166409 - RNA, 18 nt, Human
uguguguugcuuauguug

SEQ ID NO: 3166410 - RNA, 12 nt, Human
uguguguugcuu

SEQ ID NO: 3166411 - RNA, 15 nt, Human
uguguccggcccagu

SEQ ID NO: 3166412 - RNA, 14 nt, Human
uguguccuaguucu

SEQ ID NO: 3166413 - RNA, 15 nt, Human
uguguccaccguugu

SEQ ID NO: 3166414 - RNA, 17 nt, Human
aguguggcaguuuggca

SEQ ID NO: 3166415 - RNA, 16 nt, Human
aguguggcaguuuggc

SEQ ID NO: 3166416 - RNA, 20 nt, Human
agugugguguuuccuggcac

SEQ ID NO: 3166417 - RNA, 18 nt, Human
aguguggccucuucugag

SEQ ID NO: 3166418 - RNA, 21 nt, Human
agugugccugaagucccagau

SEQ ID NO: 3166419 - RNA, 14 nt, Human
agugugcuaaaaau

SEQ ID NO: 3166420 - RNA, 16 nt, Human
agugugcuaaaaauga

SEQ ID NO: 3166421 - RNA, 19 nt, Human
aguguggaaauuaagaaga

SEQ ID NO: 3166422 - RNA, 17 nt, Human
aguguggaaauuaagaa

SEQ ID NO: 3166423 - RNA, 20 nt, Human
agugugccugaagucccaga

SEQ ID NO: 3166424 - RNA, 20 nt, Human
agugugacugaucucucgug

SEQ ID NO: 3166425 - RNA, 9 nt, Human
aguguguaa

SEQ ID NO: 3166426 - RNA, 13 nt, Human
agugugguuucuu

SEQ ID NO: 3166427 - RNA, 21 nt, Human
agugugguuucuuuuugaauc

SEQ ID NO: 3166428 - RNA, 14 nt, Human
agugugguuucuuu

SEQ ID NO: 3166429 - RNA, 22 nt, Human
agugugguguuuccuggcacug

SEQ ID NO: 3166430 - RNA, 22 nt, Human
agugugguuucuuuuugaaucu

SEQ ID NO: 3166431 - RNA, 12 nt, Human
agugugguuuuc

SEQ ID NO: 3166432 - RNA, 16 nt, Human
agugugguuuucuguu

SEQ ID NO: 3166433 - RNA, 17 nt, Human
agugugguuuucuguuu

SEQ ID NO: 3166434 - RNA, 17 nt, Human
uguuaugacuccagaau

SEQ ID NO: 3166435 - RNA, 13 nt, Human
uguuaugacucca

SEQ ID NO: 3166436 - RNA, 18 nt, Human
uguuccuagugaaagagg

SEQ ID NO: 3166437 - RNA, 21 nt, Human
uguuccuauauuccagguuua

SEQ ID NO: 3166438 - RNA, 21 nt, Human
uguuccugccuccuugauauu

SEQ ID NO: 3166439 - RNA, 10 nt, Human
uguuccuggc

SEQ ID NO: 3166440 - RNA, 21 nt, Human
uguucgauuacgucaucaaaa

SEQ ID NO: 3166441 - RNA, 18 nt, Human
uguugcauagguuagaua

SEQ ID NO: 3166442 - RNA, 23 nt, Human
uguugcacugaaguuugauaaau

SEQ ID NO: 3166443 - RNA, 22 nt, Human
uguugcacugaaguuugauaaa

SEQ ID NO: 3166444 - RNA, 19 nt, Human
uguugcacugaaguuugau

SEQ ID NO: 3166445 - RNA, 16 nt, Human
uguugccaagagcccg

SEQ ID NO: 3166446 - RNA, 21 nt, Human
uguugccaaaaugguggccug

SEQ ID NO: 3166447 - RNA, 15 nt, Human
uguucuaagaaguga

SEQ ID NO: 3166448 - RNA, 15 nt, Human
uguugcacugaaguu

SEQ ID NO: 3166449 - RNA, 13 nt, Human
uguugcacugaag

SEQ ID NO: 3166450 - RNA, 18 nt, Human
uguugccacuuuccaagu

SEQ ID NO: 3166451 - RNA, 16 nt, Human
uguugccacuuuccaa

SEQ ID NO: 3166452 - RNA, 20 nt, Human
uguugcccaggcuggcgugc

SEQ ID NO: 3166453 - RNA, 23 nt, Human
uguugcccaggcuggcgugcagu

SEQ ID NO: 3166454 - RNA, 23 nt, Human
uguugccuauaagccaaaauuaa

SEQ ID NO: 3166455 - RNA, 19 nt, Human
agugugugcauaauagcua

SEQ ID NO: 3166456 - RNA, 17 nt, Human
uguugccuauaagccaa

SEQ ID NO: 3166457 - RNA, 18 nt, Human
uguugccuauaagccaaa

SEQ ID NO: 3166458 - RNA, 22 nt, Human
uguugccuauaagccaaaauua

SEQ ID NO: 3166459 - RNA, 21 nt, Human
aguguuccgugguuaaacucg

SEQ ID NO: 3166460 - RNA, 16 nt, Human
aguguucuuucucuuu

SEQ ID NO: 3166461 - RNA, 16 nt, Human
aguguucuguuacaaa

SEQ ID NO: 3166462 - RNA, 18 nt, Human
aguguucuguuacaaaau

SEQ ID NO: 3166463 - RNA, 17 nt, Human
aguguucuguuacaaaa

SEQ ID NO: 3166464 - RNA, 23 nt, Human
aguguucuguuacaaaauguaac

SEQ ID NO: 3166465 - RNA, 22 nt, Human
aguguucuguuacaaaauguaa

SEQ ID NO: 3166466 - RNA, 21 nt, Human
aguguucuguuacaaaaugua

SEQ ID NO: 3166467 - RNA, 20 nt, Human
aguguucuguuacaaaaugu

SEQ ID NO: 3166468 - RNA, 15 nt, Human
aguguucuguuacaa

SEQ ID NO: 3166469 - RNA, 22 nt, Human
aguguugggguuugguuuuguu

SEQ ID NO: 3166470 - RNA, 23 nt, Human
aguuacuaucaugucaaacguga

SEQ ID NO: 3166471 - RNA, 21 nt, Human
aguuagagaacuaaacuaguu

SEQ ID NO: 3166472 - RNA, 17 nt, Human
aguuagauucacuuuga

SEQ ID NO: 3166473 - RNA, 14 nt, Human
aguuagagaaucug

SEQ ID NO: 3166474 - RNA, 23 nt, Human
aguuagccuuuaucuaccaacuu

SEQ ID NO: 3166475 - RNA, 16 nt, Human
aguuagccuuuaucua

SEQ ID NO: 3166476 - RNA, 18 nt, Human
agugccaggauggaauga

SEQ ID NO: 3166477 - RNA, 18 nt, Human
agugcauguacuaucuua

SEQ ID NO: 3166478 - RNA, 14 nt, Human
agugcaugcugucc

SEQ ID NO: 3166479 - RNA, 16 nt, Human
agugcaugcugucccu

SEQ ID NO: 3166480 - RNA, 17 nt, Human
agugcagugagccgaga

SEQ ID NO: 3166481 - RNA, 16 nt, Human
agugcagcagggcagu

SEQ ID NO: 3166482 - RNA, 15 nt, Human
agugcagcagggcag

SEQ ID NO: 3166483 - RNA, 19 nt, Human
agugcaguggcacaaucuu

SEQ ID NO: 3166484 - RNA, 21 nt, Human
agugcaguggcacaaucuugg

SEQ ID NO: 3166485 - RNA, 22 nt, Human
agugcaguggcgaaaucccugc

SEQ ID NO: 3166486 - RNA, 21 nt, Human
agugcauaguuguagacaaag

SEQ ID NO: 3166487 - RNA, 22 nt, Human
agugcauaguuguagacaaagu

SEQ ID NO: 3166488 - RNA, 12 nt, Human
agugcagaacug

SEQ ID NO: 3166489 - RNA, 12 nt, Human
agugcacugauu

SEQ ID NO: 3166490 - RNA, 14 nt, Human
agugaggaugucug

SEQ ID NO: 3166491 - RNA, 12 nt, Human
agugaggccacu

SEQ ID NO: 3166492 - RNA, 16 nt, Human
agugaggccacugaag

SEQ ID NO: 3166493 - RNA, 17 nt, Human
agugaggccacugaaga

SEQ ID NO: 3166494 - RNA, 18 nt, Human
agugaggccacugaagag

SEQ ID NO: 3166495 - RNA, 12 nt, Human
agugaggcucug

SEQ ID NO: 3166496 - RNA, 13 nt, Human
agugaggcucugc

SEQ ID NO: 3166497 - RNA, 16 nt, Human
agugaggaugaaaaaa

SEQ ID NO: 3166498 - RNA, 20 nt, Human
agugaggaaaucaaagugcu

SEQ ID NO: 3166499 - RNA, 17 nt, Human
agugaggaauggcagug

SEQ ID NO: 3166500 - RNA, 15 nt, Human
agugaggaaaucaaa

SEQ ID NO: 3166501 - RNA, 17 nt, Human
agugaggaaaucaaagu

SEQ ID NO: 3166502 - RNA, 14 nt, Human
agugaggaaaucaa

SEQ ID NO: 3166503 - RNA, 12 nt, Human
agugcaaaaggc

SEQ ID NO: 3166504 - RNA, 23 nt, Human
agugcaaaaggcuugcagaacuu

SEQ ID NO: 3166505 - RNA, 14 nt, Human
uguggaugauaaaa

SEQ ID NO: 3166506 - RNA, 15 nt, Human
ugugcuguguuugcu

SEQ ID NO: 3166507 - RNA, 23 nt, Human
agugagcugguuuuuagcggaga

SEQ ID NO: 3166508 - RNA, 18 nt, Human
ugugcugcccugcccacc

SEQ ID NO: 3166509 - RNA, 19 nt, Human
ugugcugcccugcccaccu

SEQ ID NO: 3166510 - RNA, 20 nt, Human
ugugcugcccugcccaccug

SEQ ID NO: 3166511 - RNA, 14 nt, Human
ugugccgagcccuu

SEQ ID NO: 3166512 - RNA, 23 nt, Human
ugugccuaaauaaguuauaaaga

SEQ ID NO: 3166513 - RNA, 16 nt, Human
ugugauucaaugccuc

SEQ ID NO: 3166514 - RNA, 14 nt, Human
ugugauucaaugcc

SEQ ID NO: 3166515 - RNA, 14 nt, Human
ugugcucuccaagc

SEQ ID NO: 3166516 - RNA, 19 nt, Human
ugugcucuccaagcccagu

SEQ ID NO: 3166517 - RNA, 19 nt, Human
ugugcucuggacaggcaug

SEQ ID NO: 3166518 - RNA, 16 nt, Human
ugugcucaucagaaac

SEQ ID NO: 3166519 - RNA, 13 nt, Human
ugugcugcagugc

SEQ ID NO: 3166520 - RNA, 19 nt, Human
ugugcugagucugaaggcu

SEQ ID NO: 3166521 - RNA, 18 nt, Human
ugugcugagucugaaggc

SEQ ID NO: 3166522 - RNA, 20 nt, Human
agugaacaaauuuacagaga

SEQ ID NO: 3166523 - RNA, 21 nt, Human
agugaacaaauuuacagagac

SEQ ID NO: 3166524 - RNA, 18 nt, Human
agucuuuagcuauuacug

SEQ ID NO: 3166525 - RNA, 22 nt, Human
agugaacaaauuuacagagaca

SEQ ID NO: 3166526 - RNA, 23 nt, Human
agugaacaaauuuacagagacag

SEQ ID NO: 3166527 - RNA, 16 nt, Human
agugaacuugggccac

SEQ ID NO: 3166528 - RNA, 20 nt, Human
agugaacauaauucuuauua

SEQ ID NO: 3166529 - RNA, 21 nt, Human
agugacugauggcuaauguac

SEQ ID NO: 3166530 - RNA, 14 nt, Human
agugagcacuaagg

SEQ ID NO: 3166531 - RNA, 14 nt, Human
agugagagcugggu

SEQ ID NO: 3166532 - RNA, 16 nt, Human
agugagaaaaugaaca

SEQ ID NO: 3166533 - RNA, 17 nt, Human
agugagaggggaggcca

SEQ ID NO: 3166534 - RNA, 17 nt, Human
agugagaaaacugugac

SEQ ID NO: 3166535 - RNA, 20 nt, Human
agugacuuuucaaguauuua

SEQ ID NO: 3166536 - RNA, 19 nt, Human
agugacugaacgauccuuc

SEQ ID NO: 3166537 - RNA, 12 nt, Human
agugagcugguu

SEQ ID NO: 3166538 - RNA, 19 nt, Human
agugagaggggaggccaag

SEQ ID NO: 3166539 - RNA, 22 nt, Human
ugugaugaugaaaugaggucag

SEQ ID NO: 3166540 - RNA, 19 nt, Human
ugugaugagaggaaaucac

SEQ ID NO: 3166541 - RNA, 18 nt, Human
ugugaugagaggaaauca

SEQ ID NO: 3166542 - RNA, 16 nt, Human
ugugacugaucucucg

SEQ ID NO: 3166543 - RNA, 19 nt, Human
ugugacuucagcucuguuu

SEQ ID NO: 3166544 - RNA, 18 nt, Human
ugugacuucagcucuguu

SEQ ID NO: 3166545 - RNA, 15 nt, Human
ugucuccuacugagg

SEQ ID NO: 3166546 - RNA, 20 nt, Human
ugugacuuugaaaauauaua

SEQ ID NO: 3166547 - RNA, 14 nt, Human
ugugacuuugaaaa

SEQ ID NO: 3166548 - RNA, 13 nt, Human
ugugacuuugaaa

SEQ ID NO: 3166549 - RNA, 18 nt, Human
ugugacuuccuuggaaau

SEQ ID NO: 3166550 - RNA, 20 nt, Human
ugugagaaaaccccuuccca

SEQ ID NO: 3166551 - RNA, 23 nt, Human
ugugacuuuugcuuuaauuccau

SEQ ID NO: 3166552 - RNA, 17 nt, Human
ugugacuuuugcuuuaa

SEQ ID NO: 3166553 - RNA, 16 nt, Human
ugugacuuuugcuuua

SEQ ID NO: 3166554 - RNA, 14 nt, Human
ugugacuuuugcuu

SEQ ID NO: 3166555 - RNA, 11 nt, Human
ugugaggaagc

SEQ ID NO: 3166556 - RNA, 16 nt, Human
ugugagcugcugccau

SEQ ID NO: 3166557 - RNA, 18 nt, Human
agucucccucccuugggg

SEQ ID NO: 3166558 - RNA, 12 nt, Human
ugugagcugcac

SEQ ID NO: 3166559 - RNA, 20 nt, Human
ugugagcugcaccagguaga

SEQ ID NO: 3166560 - RNA, 15 nt, Human
ugugagcugcaccag

SEQ ID NO: 3166561 - RNA, 22 nt, Human
ugugagaaaaccccuucccauu

SEQ ID NO: 3166562 - RNA, 16 nt, Human
agucuuagauguauau

SEQ ID NO: 3166563 - RNA, 14 nt, Human
agucuuagauguau

SEQ ID NO: 3166564 - RNA, 13 nt, Human
agucuuagaugua

SEQ ID NO: 3166565 - RNA, 21 nt, Human
agucuuagaucauaguuuuau

SEQ ID NO: 3166566 - RNA, 16 nt, Human
agucucuuuuuuacaa

SEQ ID NO: 3166567 - RNA, 18 nt, Human
agucucuuuuuuacaaag

SEQ ID NO: 3166568 - RNA, 17 nt, Human
agucucuuuuuuacaaa

SEQ ID NO: 3166569 - RNA, 22 nt, Human
agucucuuuuuuacaaaggcug

SEQ ID NO: 3166570 - RNA, 21 nt, Human
agucucuuuuuuacaaaggcu

SEQ ID NO: 3166571 - RNA, 20 nt, Human
agucucuuuuuuacaaaggc

SEQ ID NO: 3166572 - RNA, 19 nt, Human
agucucuuuuuuacaaagg

SEQ ID NO: 3166573 - RNA, 16 nt, Human
agucucuugauucaua

SEQ ID NO: 3166574 - RNA, 17 nt, Human
agucucuugauucauaa

SEQ ID NO: 3166575 - RNA, 21 nt, Human
agucucuucuccacuggaugg

SEQ ID NO: 3166576 - RNA, 18 nt, Human
agucucuucuccacugga

SEQ ID NO: 3166577 - RNA, 19 nt, Human
agucucgcucuguugccca

SEQ ID NO: 3166578 - RNA, 23 nt, Human
agucucgcucuguugcccaggcu

SEQ ID NO: 3166579 - RNA, 21 nt, Human
agucucgcucuguugcccagg

SEQ ID NO: 3166580 - RNA, 19 nt, Human
agucucuucuccacuggau

SEQ ID NO: 3166581 - RNA, 15 nt, Human
aguacauuuuuugaa

SEQ ID NO: 3166582 - RNA, 13 nt, Human
aguacauuuuuug

SEQ ID NO: 3166583 - RNA, 22 nt, Human
aguacauuuuuugaaaugcuga

SEQ ID NO: 3166584 - RNA, 21 nt, Human
aguacauuuuuugaaaugcug

SEQ ID NO: 3166585 - RNA, 20 nt, Human
aguacauuuuuugaaaugcu

SEQ ID NO: 3166586 - RNA, 18 nt, Human
aguacauuuuuugaaaug

SEQ ID NO: 3166587 - RNA, 16 nt, Human
aguaccagccccaccc

SEQ ID NO: 3166588 - RNA, 13 nt, Human
aguagauuucaug

SEQ ID NO: 3166589 - RNA, 20 nt, Human
aguagcaaaugagacagcag

SEQ ID NO: 3166590 - RNA, 15 nt, Human
aguagcacaggcuga

SEQ ID NO: 3166591 - RNA, 14 nt, Human
aguagcacaggcug

SEQ ID NO: 3166592 - RNA, 13 nt, Human
aguagcaggcccg

SEQ ID NO: 3166593 - RNA, 22 nt, Human
aguagcacaggcugagugcagg

SEQ ID NO: 3166594 - RNA, 21 nt, Human
aguagcacaggcugagugcag

SEQ ID NO: 3166595 - RNA, 16 nt, Human
aguagcacaggcugag

SEQ ID NO: 3166596 - RNA, 20 nt, Human
uguaguccuagcuacucagg

SEQ ID NO: 3166597 - RNA, 17 nt, Human
uguaggguuauaauaau

SEQ ID NO: 3166598 - RNA, 16 nt, Human
uguaggguuauaauaa

SEQ ID NO: 3166599 - RNA, 13 nt, Human
uguauaucguuau

SEQ ID NO: 3166600 - RNA, 19 nt, Human
uguauaucguuaucacugu

SEQ ID NO: 3166601 - RNA, 18 nt, Human
uguauaugaacuuaacau

SEQ ID NO: 3166602 - RNA, 22 nt, Human
uguauauauuuccuauauuguu

SEQ ID NO: 3166603 - RNA, 18 nt, Human
uguauauauuuccuauau

SEQ ID NO: 3166604 - RNA, 20 nt, Human
uguauauauaccugcgcuug

SEQ ID NO: 3166605 - RNA, 21 nt, Human
uguauaguauuugaaaacaga

SEQ ID NO: 3166606 - RNA, 20 nt, Human
uguauaguauuugaaaacag

SEQ ID NO: 3166607 - RNA, 19 nt, Human
uguauaguauuugaaaaca

SEQ ID NO: 3166608 - RNA, 17 nt, Human
uguauaguauuugaaaa

SEQ ID NO: 3166609 - RNA, 16 nt, Human
uguauaguauuugaaa

SEQ ID NO: 3166610 - RNA, 15 nt, Human
uguauaguauuugaa

SEQ ID NO: 3166611 - RNA, 12 nt, Human
uguauauaaaaa

SEQ ID NO: 3166612 - RNA, 14 nt, Human
uguauauaaaaaug

SEQ ID NO: 3166613 - RNA, 16 nt, Human
uguauauaaaaauggc

SEQ ID NO: 3166614 - RNA, 13 nt, Human
uguauaguuaugu

SEQ ID NO: 3166615 - RNA, 14 nt, Human
uguauaguuaugua

SEQ ID NO: 3166616 - RNA, 15 nt, Human
uguauaguuauguaa

SEQ ID NO: 3166617 - RNA, 16 nt, Human
uguauaguuauguaaa

SEQ ID NO: 3166618 - RNA, 17 nt, Human
uguauaguuauguaaau

SEQ ID NO: 3166619 - RNA, 18 nt, Human
uguauaguuauguaaaua

SEQ ID NO: 3166620 - RNA, 19 nt, Human
uguauaguuauguaaauaa

SEQ ID NO: 3166621 - RNA, 22 nt, Human
aguaauugcauuugcuuuugua

SEQ ID NO: 3166622 - RNA, 18 nt, Human
aguaauugcauuugcuuu

SEQ ID NO: 3166623 - RNA, 17 nt, Human
aguaauugcauuugcuu

SEQ ID NO: 3166624 - RNA, 16 nt, Human
aguaauugcauuugcu

SEQ ID NO: 3166625 - RNA, 13 nt, Human
aguaaucuguaua

SEQ ID NO: 3166626 - RNA, 14 nt, Human
aguaaucuguauaa

SEQ ID NO: 3166627 - RNA, 15 nt, Human
aguaaucuguauaau

SEQ ID NO: 3166628 - RNA, 19 nt, Human
aguaaucuguauaauacuu

SEQ ID NO: 3166629 - RNA, 22 nt, Human
aguaaucuguauaauacuuugu

SEQ ID NO: 3166630 - RNA, 23 nt, Human
aguaaucuguauaauacuuugua

SEQ ID NO: 3166631 - RNA, 12 nt, Human
aguacagaauuu

SEQ ID NO: 3166632 - RNA, 14 nt, Human
aguacagaauuuga

SEQ ID NO: 3166633 - RNA, 16 nt, Human
aguacagaauuugaau

SEQ ID NO: 3166634 - RNA, 17 nt, Human
aguacagaauuugaauu

SEQ ID NO: 3166635 - RNA, 18 nt, Human
aguaauuguuccagagac

SEQ ID NO: 3166636 - RNA, 16 nt, Human
aguaauuguuccagag

SEQ ID NO: 3166637 - RNA, 23 nt, Human
aguaauugguuaucaugggaaag

SEQ ID NO: 3166638 - RNA, 21 nt, Human
uguacauggaauaacauguaa

SEQ ID NO: 3166639 - RNA, 14 nt, Human
agguuuuuuuaaug

SEQ ID NO: 3166640 - RNA, 21 nt, Human
uguacauguauuaaauuacau

SEQ ID NO: 3166641 - RNA, 20 nt, Human
uguacauguauuaaauuaca

SEQ ID NO: 3166642 - RNA, 19 nt, Human
uguacaugggacuaugcuu

SEQ ID NO: 3166643 - RNA, 14 nt, Human
uguacaugggacua

SEQ ID NO: 3166644 - RNA, 14 nt, Human
uguacauguauuaa

SEQ ID NO: 3166645 - RNA, 13 nt, Human
uguacauguauua

SEQ ID NO: 3166646 - RNA, 23 nt, Human
uguacaugggacuaugcuuuucu

SEQ ID NO: 3166647 - RNA, 20 nt, Human
uguacaugggacuaugcuuu

SEQ ID NO: 3166648 - RNA, 14 nt, Human
aguaauaaagacuc

SEQ ID NO: 3166649 - RNA, 15 nt, Human
aguaaguuaauguau

SEQ ID NO: 3166650 - RNA, 19 nt, Human
aguaaguuaauguauauaa

SEQ ID NO: 3166651 - RNA, 15 nt, Human
aguaagucucaaggu

SEQ ID NO: 3166652 - RNA, 23 nt, Human
aguaagucuugccuauauuuucc

SEQ ID NO: 3166653 - RNA, 16 nt, Human
aguaagucucaaggua

SEQ ID NO: 3166654 - RNA, 19 nt, Human
aguaaaaccacagcaguug

SEQ ID NO: 3166655 - RNA, 19 nt, Human
aguaaaaagaaaacaaaac

SEQ ID NO: 3166656 - RNA, 17 nt, Human
aguaaaaccacagcagu

SEQ ID NO: 3166657 - RNA, 16 nt, Human
aguaaaaccacagcag

SEQ ID NO: 3166658 - RNA, 14 nt, Human
aggugugcaagaga

SEQ ID NO: 3166659 - RNA, 13 nt, Human
agguucuuugugu

SEQ ID NO: 3166660 - RNA, 20 nt, Human
agguugaagaccuaaccagg

SEQ ID NO: 3166661 - RNA, 23 nt, Human
agguugaagaccuaaccagggcc

SEQ ID NO: 3166662 - RNA, 22 nt, Human
agguugaagaccuaaccagggc

SEQ ID NO: 3166663 - RNA, 14 nt, Human
agguugcagugagc

SEQ ID NO: 3166664 - RNA, 14 nt, Human
agguugaagcacca

SEQ ID NO: 3166665 - RNA, 15 nt, Human
agguugaauaauaua

SEQ ID NO: 3166666 - RNA, 22 nt, Human
aggugugagucaccaagcccag

SEQ ID NO: 3166667 - RNA, 21 nt, Human
aggugugagucaccaagccca

SEQ ID NO: 3166668 - RNA, 16 nt, Human
aggugucccugcacuu

SEQ ID NO: 3166669 - RNA, 20 nt, Human
aggugugagucaccaagccc

SEQ ID NO: 3166670 - RNA, 12 nt, Human
aggugggaggau

SEQ ID NO: 3166671 - RNA, 15 nt, Human
ugggcugcccuggug

SEQ ID NO: 3166672 - RNA, 14 nt, Human
ugggcugcccuggu

SEQ ID NO: 3166673 - RNA, 13 nt, Human
ugggcugcccugg

SEQ ID NO: 3166674 - RNA, 13 nt, Human
ugggcucugcuga

SEQ ID NO: 3166675 - RNA, 12 nt, Human
ugggcucugcug

SEQ ID NO: 3166676 - RNA, 15 nt, Human
ugggcucugcugagu

SEQ ID NO: 3166677 - RNA, 18 nt, Human
uguaagggaaacugccag

SEQ ID NO: 3166678 - RNA, 13 nt, Human
uguaagggaaacu

SEQ ID NO: 3166679 - RNA, 22 nt, Human
uguaaggccaaguacacugaga

SEQ ID NO: 3166680 - RNA, 14 nt, Human
agguuucuauuuuc

SEQ ID NO: 3166681 - RNA, 20 nt, Human
agguuggcaaaaaggcagga

SEQ ID NO: 3166682 - RNA, 17 nt, Human
agguuuauuuuucuguu

SEQ ID NO: 3166683 - RNA, 19 nt, Human
uguaagggaaacugccagc

SEQ ID NO: 3166684 - RNA, 18 nt, Human
uguaauuaaguacuaugu

SEQ ID NO: 3166685 - RNA, 21 nt, Human
uguaauuaaguacuauguauc

SEQ ID NO: 3166686 - RNA, 19 nt, Human
uguaauuaaguacuaugua

SEQ ID NO: 3166687 - RNA, 17 nt, Human
uguaauuaaguacuaug

SEQ ID NO: 3166688 - RNA, 16 nt, Human
uguaauuauuugaaug

SEQ ID NO: 3166689 - RNA, 15 nt, Human
uguaauuauuugaau

SEQ ID NO: 3166690 - RNA, 13 nt, Human
uguaauugauugu

SEQ ID NO: 3166691 - RNA, 20 nt, Human
uguaauuuuucuguauagac

SEQ ID NO: 3166692 - RNA, 19 nt, Human
uguaauuuuucuguauaga

SEQ ID NO: 3166693 - RNA, 15 nt, Human
uguaauuuuucugua

SEQ ID NO: 3166694 - RNA, 17 nt, Human
uguaauuuuucuguaua

SEQ ID NO: 3166695 - RNA, 16 nt, Human
uguaauuuuucuguau

SEQ ID NO: 3166696 - RNA, 20 nt, Human
uguaauuuuguguaagaaau

SEQ ID NO: 3166697 - RNA, 16 nt, Human
uguaauuuuguguaag

SEQ ID NO: 3166698 - RNA, 15 nt, Human
uguaauuuuguguaa

SEQ ID NO: 3166699 - RNA, 21 nt, Human
agucaguugcucaaaaagaaa

SEQ ID NO: 3166700 - RNA, 23 nt, Human
agucaguugcucaaaaagaaauc

SEQ ID NO: 3166701 - RNA, 16 nt, Human
agucccaccuuggcug

SEQ ID NO: 3166702 - RNA, 15 nt, Human
agucccaccuuggcu

SEQ ID NO: 3166703 - RNA, 19 nt, Human
agucccaccuuggcugcag

SEQ ID NO: 3166704 - RNA, 18 nt, Human
agucccaccuuggcugca

SEQ ID NO: 3166705 - RNA, 16 nt, Human
agucccagcagccagc

SEQ ID NO: 3166706 - RNA, 15 nt, Human
agucccagcagccag

SEQ ID NO: 3166707 - RNA, 14 nt, Human
agucccagcagcca

SEQ ID NO: 3166708 - RNA, 12 nt, Human
agucccagcagc

SEQ ID NO: 3166709 - RNA, 19 nt, Human
agucccagcagccagccaa

SEQ ID NO: 3166710 - RNA, 18 nt, Human
agucccagcagccagcca

SEQ ID NO: 3166711 - RNA, 17 nt, Human
agucccagcagccagcc

SEQ ID NO: 3166712 - RNA, 17 nt, Human
agucccaggcugagccu

SEQ ID NO: 3166713 - RNA, 18 nt, Human
agucccaggcugagccuc

SEQ ID NO: 3166714 - RNA, 14 nt, Human
aguccccccacucc

SEQ ID NO: 3166715 - RNA, 19 nt, Human
agucccaggcugagccuca

SEQ ID NO: 3166716 - RNA, 23 nt, Human
agucagccucgcaggccucccug

SEQ ID NO: 3166717 - RNA, 16 nt, Human
agucagccucgcaggc

SEQ ID NO: 3166718 - RNA, 17 nt, Human
agucagaaacuguuucu

SEQ ID NO: 3166719 - RNA, 19 nt, Human
ugucccuuacgugaguccu

SEQ ID NO: 3166720 - RNA, 23 nt, Human
ugucccuuacgugaguccuggca

SEQ ID NO: 3166721 - RNA, 14 nt, Human
ugucccugcacuug

SEQ ID NO: 3166722 - RNA, 15 nt, Human
ugucccuggcuuccu

SEQ ID NO: 3166723 - RNA, 17 nt, Human
ugucccuggcuuccuua

SEQ ID NO: 3166724 - RNA, 16 nt, Human
ugucccuggcuuccuu

SEQ ID NO: 3166725 - RNA, 13 nt, Human
ugucgccucugca

SEQ ID NO: 3166726 - RNA, 14 nt, Human
ugucgccucugcau

SEQ ID NO: 3166727 - RNA, 22 nt, Human
ugucucaguccaugaagaugua

SEQ ID NO: 3166728 - RNA, 13 nt, Human
agucucaggaaau

SEQ ID NO: 3166729 - RNA, 21 nt, Human
agucucacuguugcccaggcu

SEQ ID NO: 3166730 - RNA, 23 nt, Human
agucucacuguugcccaggcugg

SEQ ID NO: 3166731 - RNA, 13 nt, Human
agucuauugucuc

SEQ ID NO: 3166732 - RNA, 19 nt, Human
agucuaucugguauuaaau

SEQ ID NO: 3166733 - RNA, 23 nt, Human
agucuaucugguauuaaaugcca

SEQ ID NO: 3166734 - RNA, 14 nt, Human
agucuaucauuguu

SEQ ID NO: 3166735 - RNA, 23 nt, Human
agucuaacaacugcccaguuucc

SEQ ID NO: 3166736 - RNA, 20 nt, Human
agucuaaauuuauuauuuaa

SEQ ID NO: 3166737 - RNA, 21 nt, Human
agucuaagaacccauggaaaa

SEQ ID NO: 3166738 - RNA, 14 nt, Human
aguccucccaucuc

SEQ ID NO: 3166739 - RNA, 16 nt, Human
aguccucccaucucac

SEQ ID NO: 3166740 - RNA, 22 nt, Human
aguccuccagaacucuuccucc

SEQ ID NO: 3166741 - RNA, 21 nt, Human
agucgccuuucagcaggcagc

SEQ ID NO: 3166742 - RNA, 22 nt, Human
agucgccuuucagcaggcagcc

SEQ ID NO: 3166743 - RNA, 16 nt, Human
agucggcacagccugg

SEQ ID NO: 3166744 - RNA, 16 nt, Human
aguccuagaauguuuc

SEQ ID NO: 3166745 - RNA, 19 nt, Human
aguccuagaauguuucauu

SEQ ID NO: 3166746 - RNA, 16 nt, Human
aguccccgucugccug

SEQ ID NO: 3166747 - RNA, 17 nt, Human
aguccccgucugccugg

SEQ ID NO: 3166748 - RNA, 16 nt, Human
agucccccugccccag

SEQ ID NO: 3166749 - RNA, 15 nt, Human
aguccucaaagcuuu

SEQ ID NO: 3166750 - RNA, 17 nt, Human
aguccucaaagcuuuuu

SEQ ID NO: 3166751 - RNA, 19 nt, Human
aguccucaaagcuuuuuga

SEQ ID NO: 3166752 - RNA, 20 nt, Human
aguccucaaagcuuuuugaa

SEQ ID NO: 3166753 - RNA, 23 nt, Human
aguccucaaagcuuuuugaaaac

SEQ ID NO: 3166754 - RNA, 12 nt, Human
aguccuccagaa

SEQ ID NO: 3166755 - RNA, 21 nt, Human
aguccuccagaacucuuccuc

SEQ ID NO: 3166756 - RNA, 20 nt, Human
aguccuccagaacucuuccu

SEQ ID NO: 3166757 - RNA, 19 nt, Human
aguccuccagaacucuucc

SEQ ID NO: 3166758 - RNA, 14 nt, Human
aguccuccagaacu

SEQ ID NO: 3166759 - RNA, 14 nt, Human
aguauuugugggga

SEQ ID NO: 3166760 - RNA, 13 nt, Human
aguauuuaugggu

SEQ ID NO: 3166761 - RNA, 19 nt, Human
aguauucuuauuuaaugaa

SEQ ID NO: 3166762 - RNA, 16 nt, Human
aguauucucuuuucaa

SEQ ID NO: 3166763 - RNA, 16 nt, Human
aguauucucauucuuc

SEQ ID NO: 3166764 - RNA, 15 nt, Human
aguauucucauucuu

SEQ ID NO: 3166765 - RNA, 16 nt, Human
aguauucuaauaagcu

SEQ ID NO: 3166766 - RNA, 17 nt, Human
aguauucuaauaagcua

SEQ ID NO: 3166767 - RNA, 21 nt, Human
aguauucuaauaagcuaguug

SEQ ID NO: 3166768 - RNA, 23 nt, Human
aguauucuaauaagcuaguugaa

SEQ ID NO: 3166769 - RNA, 17 nt, Human
agucaccccggccaccu

SEQ ID NO: 3166770 - RNA, 15 nt, Human
agucaccaagcccag

SEQ ID NO: 3166771 - RNA, 14 nt, Human
agucaccaagccca

SEQ ID NO: 3166772 - RNA, 21 nt, Human
aguauuuuccuguugucaaga

SEQ ID NO: 3166773 - RNA, 12 nt, Human
aguauuuuagug

SEQ ID NO: 3166774 - RNA, 21 nt, Human
aguauuuuaguggacccugaa

SEQ ID NO: 3166775 - RNA, 15 nt, Human
uguauauuuguauga

SEQ ID NO: 3166776 - RNA, 16 nt, Human
uguauauuuguaugau

SEQ ID NO: 3166777 - RNA, 17 nt, Human
uguauauuuguaugaua

SEQ ID NO: 3166778 - RNA, 18 nt, Human
uguauauuuguaugauau

SEQ ID NO: 3166779 - RNA, 19 nt, Human
uguauauuuguaugauauu

SEQ ID NO: 3166780 - RNA, 12 nt, Human
uguauauuugau

SEQ ID NO: 3166781 - RNA, 14 nt, Human
uguauauuugauuu

SEQ ID NO: 3166782 - RNA, 16 nt, Human
uguauauuugauuuau

SEQ ID NO: 3166783 - RNA, 17 nt, Human
uguauauuugauuuauu

SEQ ID NO: 3166784 - RNA, 22 nt, Human
uguauauuugauuuauuaacuu

SEQ ID NO: 3166785 - RNA, 12 nt, Human
uguauauuugua

SEQ ID NO: 3166786 - RNA, 19 nt, Human
uguauauuugauuuauuaa

SEQ ID NO: 3166787 - RNA, 21 nt, Human
uguauauugguuuuaugauga

SEQ ID NO: 3166788 - RNA, 13 nt, Human
uguauauugguuu

SEQ ID NO: 3166789 - RNA, 18 nt, Human
uguauauucuauuuuaca

SEQ ID NO: 3166790 - RNA, 14 nt, Human
uguauauugguuuu

SEQ ID NO: 3166791 - RNA, 20 nt, Human
uguauauugguuuuaugaug

SEQ ID NO: 3166792 - RNA, 23 nt, Human
aguauuaucuuguucaggaaaag

SEQ ID NO: 3166793 - RNA, 16 nt, Human
aguauuaauucucuuu

SEQ ID NO: 3166794 - RNA, 17 nt, Human
aguauuacuaaauugac

SEQ ID NO: 3166795 - RNA, 21 nt, Human
aguauuacuaaauugaccuuu

SEQ ID NO: 3166796 - RNA, 17 nt, Human
aguauacucuuaggcca

SEQ ID NO: 3166797 - RNA, 13 nt, Human
uguauauuuguau

SEQ ID NO: 3166798 - RNA, 18 nt, Human
aguauaauguuuauuaaa

SEQ ID NO: 3166799 - RNA, 14 nt, Human
aguauguuuuacuu

SEQ ID NO: 3166800 - RNA, 20 nt, Human
uguccagagcugcuuccccg

SEQ ID NO: 3166801 - RNA, 16 nt, Human
uguccaagaagcccag

SEQ ID NO: 3166802 - RNA, 17 nt, Human
uguccaagaagcccagg

SEQ ID NO: 3166803 - RNA, 18 nt, Human
uguccaagaagcccagga

SEQ ID NO: 3166804 - RNA, 22 nt, Human
uguccaagaagcccaggaaagg

SEQ ID NO: 3166805 - RNA, 23 nt, Human
ugucccugcacuugcagacucua

SEQ ID NO: 3166806 - RNA, 22 nt, Human
ugucccugcacuugcagacucu

SEQ ID NO: 3166807 - RNA, 20 nt, Human
ugucccugcacuugcagacu

SEQ ID NO: 3166808 - RNA, 22 nt, Human
ugucauuugagcagggcucagc

SEQ ID NO: 3166809 - RNA, 21 nt, Human
ugucauuugagcagggcucag

SEQ ID NO: 3166810 - RNA, 20 nt, Human
ugucauuugagcagggcuca

SEQ ID NO: 3166811 - RNA, 20 nt, Human
ugucagguggggcagcuuga

SEQ ID NO: 3166812 - RNA, 18 nt, Human
ugucagguggggcagcuu

SEQ ID NO: 3166813 - RNA, 17 nt, Human
ugucagguggggcagcu

SEQ ID NO: 3166814 - RNA, 14 nt, Human
uguccaagaagccc

SEQ ID NO: 3166815 - RNA, 15 nt, Human
uguccaagaagccca

SEQ ID NO: 3166816 - RNA, 23 nt, Human
uguccaacugagaaguaccuuau

SEQ ID NO: 3166817 - RNA, 16 nt, Human
ugucagguggggcagc

SEQ ID NO: 3166818 - RNA, 20 nt, Human
ugucagcaguugcugguaaa

SEQ ID NO: 3166819 - RNA, 19 nt, Human
ugucauuugagcagggcuc

SEQ ID NO: 3166820 - RNA, 14 nt, Human
auagauguguggac

SEQ ID NO: 3166821 - RNA, 14 nt, Human
auagauuaaaucau

SEQ ID NO: 3166822 - RNA, 12 nt, Human
auagauuaaauc

SEQ ID NO: 3166823 - RNA, 20 nt, Human
auagauuaaaucauacuccu

SEQ ID NO: 3166824 - RNA, 18 nt, Human
auagauugugaauaauga

SEQ ID NO: 3166825 - RNA, 15 nt, Human
auagauugugaauaa

SEQ ID NO: 3166826 - RNA, 13 nt, Human
auagauugugaau

SEQ ID NO: 3166827 - RNA, 12 nt, Human
auagaugugugg

SEQ ID NO: 3166828 - RNA, 13 nt, Human
auagaugugugga

SEQ ID NO: 3166829 - RNA, 11 nt, Human
auagaugugug

SEQ ID NO: 3166830 - RNA, 13 nt, Human
auagauauaauga

SEQ ID NO: 3166831 - RNA, 14 nt, Human
auagauauaaugaa

SEQ ID NO: 3166832 - RNA, 20 nt, Human
auagauauaaugaacaaaau

SEQ ID NO: 3166833 - RNA, 23 nt, Human
auagauauaaugaacaaaauuau

SEQ ID NO: 3166834 - RNA, 15 nt, Human
auagagcagaaauuc

SEQ ID NO: 3166835 - RNA, 14 nt, Human
auagagcagaaauu

SEQ ID NO: 3166836 - RNA, 19 nt, Human
auagagcagaaauucuguu

SEQ ID NO: 3166837 - RNA, 16 nt, Human
auagagcagaaauucu

SEQ ID NO: 3166838 - RNA, 14 nt, Human
auagagagagacca

SEQ ID NO: 3166839 - RNA, 17 nt, Human
auagagaugagcuuucu

SEQ ID NO: 3166840 - RNA, 19 nt, Human
auagagaugagcuuucuuu

SEQ ID NO: 3166841 - RNA, 18 nt, Human
auagacccacaagaggca

SEQ ID NO: 3166842 - RNA, 17 nt, Human
auagaguacacugccug

SEQ ID NO: 3166843 - RNA, 14 nt, Human
auagaguacacugc

SEQ ID NO: 3166844 - RNA, 23 nt, Human
auagaguaaaaagaaaacaaaac

SEQ ID NO: 3166845 - RNA, 19 nt, Human
auagaaggcuauggggaua

SEQ ID NO: 3166846 - RNA, 23 nt, Human
auagaagaaugcaugcuuuccau

SEQ ID NO: 3166847 - RNA, 18 nt, Human
auagaagaaugcaugcuu

SEQ ID NO: 3166848 - RNA, 17 nt, Human
auagaagaaugcaugcu

SEQ ID NO: 3166849 - RNA, 16 nt, Human
auagaagaaugcaugc

SEQ ID NO: 3166850 - RNA, 13 nt, Human
auagaagaaugca

SEQ ID NO: 3166851 - RNA, 12 nt, Human
auagaagaaugc

SEQ ID NO: 3166852 - RNA, 21 nt, Human
auagaagucuucaugaaaugc

SEQ ID NO: 3166853 - RNA, 20 nt, Human
auagaagucuucaugaaaug

SEQ ID NO: 3166854 - RNA, 19 nt, Human
auagaagucuucaugaaau

SEQ ID NO: 3166855 - RNA, 18 nt, Human
auagaagucuucaugaaa

SEQ ID NO: 3166856 - RNA, 13 nt, Human
auagaagucuuca

SEQ ID NO: 3166857 - RNA, 14 nt, Human
auagaagucuucau

SEQ ID NO: 3166858 - RNA, 17 nt, Human
auagaagucuucaugaa

SEQ ID NO: 3166859 - RNA, 15 nt, Human
auagaagucuucaug

SEQ ID NO: 3166860 - RNA, 18 nt, Human
auagaacaacauauacaa

SEQ ID NO: 3166861 - RNA, 14 nt, Human
auagaacaacauau

SEQ ID NO: 3166862 - RNA, 17 nt, Human
auagaaauguuugcuga

SEQ ID NO: 3166863 - RNA, 20 nt, Human
auacuguacaaugacuuuau

SEQ ID NO: 3166864 - RNA, 18 nt, Human
auacuguagauaauuaac

SEQ ID NO: 3166865 - RNA, 13 nt, Human
auagaauagcaug

SEQ ID NO: 3166866 - RNA, 23 nt, Human
auagaagucuucaugaaaugcua

SEQ ID NO: 3166867 - RNA, 17 nt, Human
auagaauuaacacauga

SEQ ID NO: 3166868 - RNA, 18 nt, Human
auagaauugcaaucuaua

SEQ ID NO: 3166869 - RNA, 15 nt, Human
auagacaaaaaguau

SEQ ID NO: 3166870 - RNA, 16 nt, Human
auagacaaaaaguaua

SEQ ID NO: 3166871 - RNA, 22 nt, Human
auagacaggagaagaaagaacu

SEQ ID NO: 3166872 - RNA, 15 nt, Human
auagacagcaugaga

SEQ ID NO: 3166873 - RNA, 20 nt, Human
uuauucacuuuuauuuagca

SEQ ID NO: 3166874 - RNA, 22 nt, Human
uuauucaacagcaagugugaau

SEQ ID NO: 3166875 - RNA, 13 nt, Human
uuauucaaagaga

SEQ ID NO: 3166876 - RNA, 14 nt, Human
uuauucaaagagaa

SEQ ID NO: 3166877 - RNA, 15 nt, Human
uuauucaaagagaaa

SEQ ID NO: 3166878 - RNA, 19 nt, Human
uuauucaaagagaaaacau

SEQ ID NO: 3166879 - RNA, 20 nt, Human
uuauucaaagagaaaacauc

SEQ ID NO: 3166880 - RNA, 23 nt, Human
uuauucaaagagaaaacaucuca

SEQ ID NO: 3166881 - RNA, 12 nt, Human
uuauuauuuauu

SEQ ID NO: 3166882 - RNA, 20 nt, Human
uuauuauuugcagucaugga

SEQ ID NO: 3166883 - RNA, 13 nt, Human
uuauucaacagca

SEQ ID NO: 3166884 - RNA, 14 nt, Human
uuauucaacagcaa

SEQ ID NO: 3166885 - RNA, 17 nt, Human
uuauuaucaaguagacu

SEQ ID NO: 3166886 - RNA, 13 nt, Human
uuauuauaaaaau

SEQ ID NO: 3166887 - RNA, 22 nt, Human
uuauuaucauuguucuuuucaa

SEQ ID NO: 3166888 - RNA, 22 nt, Human
uuauuaguuccccaaauacaaa

SEQ ID NO: 3166889 - RNA, 17 nt, Human
uuauguugacauuuguu

SEQ ID NO: 3166890 - RNA, 16 nt, Human
uuauguugacauuugu

SEQ ID NO: 3166891 - RNA, 15 nt, Human
uuauguugacauuug

SEQ ID NO: 3166892 - RNA, 14 nt, Human
uuauguugacauuu

SEQ ID NO: 3166893 - RNA, 13 nt, Human
uuauguugacauu

SEQ ID NO: 3166894 - RNA, 10 nt, Human
uuauguugac

SEQ ID NO: 3166895 - RNA, 15 nt, Human
uuauguugaaaaaau

SEQ ID NO: 3166896 - RNA, 18 nt, Human
uuauguugaaaaaauuua

SEQ ID NO: 3166897 - RNA, 16 nt, Human
auacucauuaggaugg

SEQ ID NO: 3166898 - RNA, 11 nt, Human
auacucccauc

SEQ ID NO: 3166899 - RNA, 13 nt, Human
auacucauuagaa

SEQ ID NO: 3166900 - RNA, 23 nt, Human
auacucauuagaauuaccauuug

SEQ ID NO: 3166901 - RNA, 20 nt, Human
uuauuccaaaccaaauuuua

SEQ ID NO: 3166902 - RNA, 17 nt, Human
uuauuccauauuagaaa

SEQ ID NO: 3166903 - RNA, 12 nt, Human
uuauuccauauu

SEQ ID NO: 3166904 - RNA, 23 nt, Human
uuauuccauauuagaaaacuuug

SEQ ID NO: 3166905 - RNA, 20 nt, Human
uuauuccauauuagaaaacu

SEQ ID NO: 3166906 - RNA, 19 nt, Human
uuauuccauauuagaaaac

SEQ ID NO: 3166907 - RNA, 14 nt, Human
auacucccaucugu

SEQ ID NO: 3166908 - RNA, 17 nt, Human
auacuccuaugcuuuag

SEQ ID NO: 3166909 - RNA, 16 nt, Human
auacuccuaugcuuua

SEQ ID NO: 3166910 - RNA, 16 nt, Human
auacucugcuuagaau

SEQ ID NO: 3166911 - RNA, 18 nt, Human
auacucuuauagacaaca

SEQ ID NO: 3166912 - RNA, 23 nt, Human
auacugggacaccauuaccaaaa

SEQ ID NO: 3166913 - RNA, 15 nt, Human
auacugccuccccca

SEQ ID NO: 3166914 - RNA, 13 nt, Human
auacugccucccc

SEQ ID NO: 3166915 - RNA, 19 nt, Human
auacugcuugaauaaacac

SEQ ID NO: 3166916 - RNA, 12 nt, Human
auacugaaccac

SEQ ID NO: 3166917 - RNA, 18 nt, Human
auacugaaccacuuguag

SEQ ID NO: 3166918 - RNA, 19 nt, Human
auacugaaccacuuguaga

SEQ ID NO: 3166919 - RNA, 23 nt, Human
auacugaaccacuuguagauuug

SEQ ID NO: 3166920 - RNA, 22 nt, Human
auacugacuccaaccauucaaa

SEQ ID NO: 3166921 - RNA, 13 nt, Human
auacugauggaau

SEQ ID NO: 3166922 - RNA, 14 nt, Human
auacugauggaauu

SEQ ID NO: 3166923 - RNA, 21 nt, Human
auacugcaaacuauuuaaaga

SEQ ID NO: 3166924 - RNA, 22 nt, Human
auacugauggaauuuuuuugua

SEQ ID NO: 3166925 - RNA, 13 nt, Human
auacugauguguu

SEQ ID NO: 3166926 - RNA, 20 nt, Human
uuaugucauucucuuucuca

SEQ ID NO: 3166927 - RNA, 17 nt, Human
uuauguccugugagaug

SEQ ID NO: 3166928 - RNA, 20 nt, Human
uuauguccugugagaugugu

SEQ ID NO: 3166929 - RNA, 22 nt, Human
uuauguccugugagauguguau

SEQ ID NO: 3166930 - RNA, 13 nt, Human
uuauguauauggu

SEQ ID NO: 3166931 - RNA, 15 nt, Human
uuauguaaauaauuc

SEQ ID NO: 3166932 - RNA, 16 nt, Human
uuauguaaauaauucu

SEQ ID NO: 3166933 - RNA, 15 nt, Human
uuaugugcuauuaau

SEQ ID NO: 3166934 - RNA, 21 nt, Human
uuaugugcuauuaauauuugu

SEQ ID NO: 3166935 - RNA, 12 nt, Human
uuaugugugugu

SEQ ID NO: 3166936 - RNA, 14 nt, Human
uuaugugugugugu

SEQ ID NO: 3166937 - RNA, 10 nt, Human
uuaugugugu

SEQ ID NO: 3166938 - RNA, 13 nt, Human
uuauguguaugug

SEQ ID NO: 3166939 - RNA, 20 nt, Human
uuauguguaugugaguauuc

SEQ ID NO: 3166940 - RNA, 22 nt, Human
uuaugaugacguacaaguaguu

SEQ ID NO: 3166941 - RNA, 23 nt, Human
uuaugaugacguacaaguaguuc

SEQ ID NO: 3166942 - RNA, 15 nt, Human
uuaugaugacguaca

SEQ ID NO: 3166943 - RNA, 13 nt, Human
uuaugggcugggu

SEQ ID NO: 3166944 - RNA, 12 nt, Human
uuauguaaauaa

SEQ ID NO: 3166945 - RNA, 13 nt, Human
uuauguaaauaau

SEQ ID NO: 3166946 - RNA, 23 nt, Human
uuauguaaacaaaucuuuccaua

SEQ ID NO: 3166947 - RNA, 22 nt, Human
uuauguaaacaaaucuuuccau

SEQ ID NO: 3166948 - RNA, 22 nt, Human
uuaugggcuggguucuacccag

SEQ ID NO: 3166949 - RNA, 16 nt, Human
uuaugguaaucauauu

SEQ ID NO: 3166950 - RNA, 17 nt, Human
uuauguaaacaaaucuu

SEQ ID NO: 3166951 - RNA, 15 nt, Human
uuauguaaacaaauc

SEQ ID NO: 3166952 - RNA, 18 nt, Human
uuaugguaaucauauuag

SEQ ID NO: 3166953 - RNA, 13 nt, Human
uuaugguagaaaa

SEQ ID NO: 3166954 - RNA, 19 nt, Human
uuaugguagaaaaauuuca

SEQ ID NO: 3166955 - RNA, 23 nt, Human
uuaugaagaugggggccucuuuc

SEQ ID NO: 3166956 - RNA, 22 nt, Human
uuaugaagaaaauacuuaaaug

SEQ ID NO: 3166957 - RNA, 20 nt, Human
uuaugaagaaaauacuuaaa

SEQ ID NO: 3166958 - RNA, 13 nt, Human
uuaugaagaaaau

SEQ ID NO: 3166959 - RNA, 21 nt, Human
uuaugaagaaaaauuugaaaa

SEQ ID NO: 3166960 - RNA, 12 nt, Human
uuaugaagaaaa

SEQ ID NO: 3166961 - RNA, 19 nt, Human
uuaucauuuuuuccuguuu

SEQ ID NO: 3166962 - RNA, 22 nt, Human
uuaugauagcaaauggccucau

SEQ ID NO: 3166963 - RNA, 16 nt, Human
uuaugagauacuuugc

SEQ ID NO: 3166964 - RNA, 13 nt, Human
uuaugagccaggc

SEQ ID NO: 3166965 - RNA, 23 nt, Human
uuaugaagaaaauacuuaaaugu

SEQ ID NO: 3166966 - RNA, 11 nt, Human
uuaugacucca

SEQ ID NO: 3166967 - RNA, 12 nt, Human
uuauaaaggaau

SEQ ID NO: 3166968 - RNA, 17 nt, Human
auacaacaccaaaaaau

SEQ ID NO: 3166969 - RNA, 21 nt, Human
auacaacaccaaaaaauaucu

SEQ ID NO: 3166970 - RNA, 20 nt, Human
auacaacaccaaaaaauauc

SEQ ID NO: 3166971 - RNA, 16 nt, Human
auacagaggcaacugc

SEQ ID NO: 3166972 - RNA, 17 nt, Human
auacagaggcaacugca

SEQ ID NO: 3166973 - RNA, 20 nt, Human
auacagaccgaacuguugua

SEQ ID NO: 3166974 - RNA, 18 nt, Human
auacagaccgaacuguug

SEQ ID NO: 3166975 - RNA, 21 nt, Human
auacagaccgaacuguuguau

SEQ ID NO: 3166976 - RNA, 16 nt, Human
auacaaccuucauuua

SEQ ID NO: 3166977 - RNA, 18 nt, Human
auacaaccuucauuuaaa

SEQ ID NO: 3166978 - RNA, 19 nt, Human
auacaaccuucauuuaaaa

SEQ ID NO: 3166979 - RNA, 18 nt, Human
auacagaaucuuguuuug

SEQ ID NO: 3166980 - RNA, 20 nt, Human
auacagaaucuuguuuugaa

SEQ ID NO: 3166981 - RNA, 20 nt, Human
auacagucucugagaacugg

SEQ ID NO: 3166982 - RNA, 20 nt, Human
auacaggcuggaaaguaagg

SEQ ID NO: 3166983 - RNA, 23 nt, Human
auacaggaaaagcugcugacagu

SEQ ID NO: 3166984 - RNA, 22 nt, Human
auacaggaaaagcugcugacag

SEQ ID NO: 3166985 - RNA, 23 nt, Human
auacagauagauauaugcucugc

SEQ ID NO: 3166986 - RNA, 17 nt, Human
auacagauaaaugauuc

SEQ ID NO: 3166987 - RNA, 13 nt, Human
auacagauaaaug

SEQ ID NO: 3166988 - RNA, 18 nt, Human
auacagauaaaugauuca

SEQ ID NO: 3166989 - RNA, 15 nt, Human
auacaguuauaaaau

SEQ ID NO: 3166990 - RNA, 17 nt, Human
auacaguuauaaaauua

SEQ ID NO: 3166991 - RNA, 18 nt, Human
auacaguuauaaaauuaa

SEQ ID NO: 3166992 - RNA, 19 nt, Human
auacaugaugauuucagaa

SEQ ID NO: 3166993 - RNA, 16 nt, Human
auacaugaugauuuca

SEQ ID NO: 3166994 - RNA, 21 nt, Human
auacauguuuauguaaacaaa

SEQ ID NO: 3166995 - RNA, 19 nt, Human
auacauguuuauguaaaca

SEQ ID NO: 3166996 - RNA, 22 nt, Human
auacauguuuauguaaacaaau

SEQ ID NO: 3166997 - RNA, 16 nt, Human
auacauguuuauguaa

SEQ ID NO: 3166998 - RNA, 14 nt, Human
auacauguuuaugu

SEQ ID NO: 3166999 - RNA, 17 nt, Human
auaccacucuuuaccuu

SEQ ID NO: 3167000 - RNA, 21 nt, Human
auaccacucuuuaccuuuauu

SEQ ID NO: 3167001 - RNA, 20 nt, Human
uuauauuuggaugcagaguu

SEQ ID NO: 3167002 - RNA, 15 nt, Human
uuauauuuggaugca

SEQ ID NO: 3167003 - RNA, 22 nt, Human
uuauauuuggaugcagaguuca

SEQ ID NO: 3167004 - RNA, 14 nt, Human
uuauauuuuucuua

SEQ ID NO: 3167005 - RNA, 16 nt, Human
uuauauuuuucuuaaa

SEQ ID NO: 3167006 - RNA, 15 nt, Human
uuauauuuuucuuaa

SEQ ID NO: 3167007 - RNA, 16 nt, Human
uuaucaauagcccagg

SEQ ID NO: 3167008 - RNA, 21 nt, Human
uuauauuuuucuuaaaaagua

SEQ ID NO: 3167009 - RNA, 20 nt, Human
uuauauuuuucuuaaaaagu

SEQ ID NO: 3167010 - RNA, 17 nt, Human
uuauauuuuucuuaaaa

SEQ ID NO: 3167011 - RNA, 17 nt, Human
uuaucaauagcccagga

SEQ ID NO: 3167012 - RNA, 20 nt, Human
uuaucaaugugucuuucuaa

SEQ ID NO: 3167013 - RNA, 23 nt, Human
uuaucaaugugucuuucuaagaa

SEQ ID NO: 3167014 - RNA, 17 nt, Human
auacuauggaauuucuc

SEQ ID NO: 3167015 - RNA, 18 nt, Human
auacgugucaaugugugc

SEQ ID NO: 3167016 - RNA, 18 nt, Human
auacguuuuucaguuuca

SEQ ID NO: 3167017 - RNA, 21 nt, Human
auacguuucaaaaacaccccc

SEQ ID NO: 3167018 - RNA, 18 nt, Human
auaaucacaacccuucag

SEQ ID NO: 3167019 - RNA, 22 nt, Human
auaaucuggacuccucugucca

SEQ ID NO: 3167020 - RNA, 16 nt, Human
auaaucaagagccuua

SEQ ID NO: 3167021 - RNA, 17 nt, Human
auaaucaagagccuuaa

SEQ ID NO: 3167022 - RNA, 20 nt, Human
auaauauguuuccuucccuc

SEQ ID NO: 3167023 - RNA, 20 nt, Human
auaaucuguuuuuacguaug

SEQ ID NO: 3167024 - RNA, 20 nt, Human
auaaucaagagccuuaaaac

SEQ ID NO: 3167025 - RNA, 21 nt, Human
auaaucaagagccuuaaaaca

SEQ ID NO: 3167026 - RNA, 22 nt, Human
auaaucaagagccuuaaaacau

SEQ ID NO: 3167027 - RNA, 16 nt, Human
auaauaucucuaauau

SEQ ID NO: 3167028 - RNA, 12 nt, Human
auaauauugaaa

SEQ ID NO: 3167029 - RNA, 14 nt, Human
auaauauugaaaau

SEQ ID NO: 3167030 - RNA, 16 nt, Human
auaauauugaaaauug

SEQ ID NO: 3167031 - RNA, 18 nt, Human
auaauauugaaaauugaa

SEQ ID NO: 3167032 - RNA, 19 nt, Human
auaauauugaaaauugaaa

SEQ ID NO: 3167033 - RNA, 21 nt, Human
auaauauugaaaauugaaaag

SEQ ID NO: 3167034 - RNA, 19 nt, Human
auaauauguuuccuucccu

SEQ ID NO: 3167035 - RNA, 18 nt, Human
auaauauguuuccuuccc

SEQ ID NO: 3167036 - RNA, 21 nt, Human
auaagauucauauuuacuucu

SEQ ID NO: 3167037 - RNA, 15 nt, Human
auaagcaguuaugug

SEQ ID NO: 3167038 - RNA, 22 nt, Human
auaagccaaaaaaugcuugcuu

SEQ ID NO: 3167039 - RNA, 15 nt, Human
auaauauauuguguu

SEQ ID NO: 3167040 - RNA, 17 nt, Human
auaauauauuguguuga

SEQ ID NO: 3167041 - RNA, 14 nt, Human
auaagccaaaauua

SEQ ID NO: 3167042 - RNA, 13 nt, Human
auaauuuguuucc

SEQ ID NO: 3167043 - RNA, 14 nt, Human
auaauuuguuucca

SEQ ID NO: 3167044 - RNA, 16 nt, Human
auaauuuguuuccagc

SEQ ID NO: 3167045 - RNA, 18 nt, Human
uuagaugugcugcuuuga

SEQ ID NO: 3167046 - RNA, 18 nt, Human
auaauuugguauccuuau

SEQ ID NO: 3167047 - RNA, 21 nt, Human
auaauuuacugugacuuuauu

SEQ ID NO: 3167048 - RNA, 13 nt, Human
auaauuuacugug

SEQ ID NO: 3167049 - RNA, 18 nt, Human
auaauuuaccugaagucu

SEQ ID NO: 3167050 - RNA, 15 nt, Human
auaauuuaguuguuu

SEQ ID NO: 3167051 - RNA, 18 nt, Human
auaauuuaguuguuucua

SEQ ID NO: 3167052 - RNA, 20 nt, Human
auaauuuaguuguuucuaga

SEQ ID NO: 3167053 - RNA, 19 nt, Human
auaauuauuugucucagau

SEQ ID NO: 3167054 - RNA, 22 nt, Human
auaauuauuuauuacauaauuu

SEQ ID NO: 3167055 - RNA, 13 nt, Human
uuaguagagacag

SEQ ID NO: 3167056 - RNA, 12 nt, Human
uuaguacuuuau

SEQ ID NO: 3167057 - RNA, 19 nt, Human
uuaguacuuuauagaagaa

SEQ ID NO: 3167058 - RNA, 17 nt, Human
uuaguacuuuauagaag

SEQ ID NO: 3167059 - RNA, 16 nt, Human
uuaguacuuuauagaa

SEQ ID NO: 3167060 - RNA, 13 nt, Human
uuaguacuuuaua

SEQ ID NO: 3167061 - RNA, 21 nt, Human
uuaguacuuuauagaagaaug

SEQ ID NO: 3167062 - RNA, 14 nt, Human
uuaguagagacagg

SEQ ID NO: 3167063 - RNA, 22 nt, Human
uuauaaaacguguuuguauugu

SEQ ID NO: 3167064 - RNA, 19 nt, Human
uuauaaaacagaguaaucu

SEQ ID NO: 3167065 - RNA, 22 nt, Human
uuauaaaacagaguaaucuugu

SEQ ID NO: 3167066 - RNA, 13 nt, Human
uuauaaaaauauu

SEQ ID NO: 3167067 - RNA, 16 nt, Human
uuauaaaaauauuaag

SEQ ID NO: 3167068 - RNA, 21 nt, Human
uuauaaaaauauuaagacaau

SEQ ID NO: 3167069 - RNA, 12 nt, Human
uuauaaaaagau

SEQ ID NO: 3167070 - RNA, 14 nt, Human
uuauaaaaagauaa

SEQ ID NO: 3167071 - RNA, 21 nt, Human
uuauaaacaagaaugaagguu

SEQ ID NO: 3167072 - RNA, 20 nt, Human
uuauaaacaagaaugaaggu

SEQ ID NO: 3167073 - RNA, 18 nt, Human
uuauaaacucauuuugcu

SEQ ID NO: 3167074 - RNA, 13 nt, Human
uuauaaacaagaa

SEQ ID NO: 3167075 - RNA, 14 nt, Human
uuauaaaauuaaaa

SEQ ID NO: 3167076 - RNA, 13 nt, Human
uuaguaagucuug

SEQ ID NO: 3167077 - RNA, 14 nt, Human
uuaguaaucuguau

SEQ ID NO: 3167078 - RNA, 15 nt, Human
uuaguaaucuguaua

SEQ ID NO: 3167079 - RNA, 17 nt, Human
uuaguaaucuguauaau

SEQ ID NO: 3167080 - RNA, 19 nt, Human
uuaggugugggggaagcac

SEQ ID NO: 3167081 - RNA, 15 nt, Human
uuaggguuucugauu

SEQ ID NO: 3167082 - RNA, 15 nt, Human
uuagauuaagaaaua

SEQ ID NO: 3167083 - RNA, 15 nt, Human
uuagggagagaagau

SEQ ID NO: 3167084 - RNA, 14 nt, Human
uuagggagagaaga

SEQ ID NO: 3167085 - RNA, 20 nt, Human
uuagaugugcugcuuugaua

SEQ ID NO: 3167086 - RNA, 15 nt, Human
uuagggcucuaauuu

SEQ ID NO: 3167087 - RNA, 18 nt, Human
uuagggaguauucuaaua

SEQ ID NO: 3167088 - RNA, 14 nt, Human
uuagggaguauucu

SEQ ID NO: 3167089 - RNA, 17 nt, Human
uuagggaguauucuaau

SEQ ID NO: 3167090 - RNA, 13 nt, Human
uuacaguguuccg

SEQ ID NO: 3167091 - RNA, 18 nt, Human
uuacagugccuaaaauaa

SEQ ID NO: 3167092 - RNA, 17 nt, Human
uuacaguggauugcuca

SEQ ID NO: 3167093 - RNA, 13 nt, Human
uuacaguuacuuu

SEQ ID NO: 3167094 - RNA, 19 nt, Human
uuacaguuacuuuuccuug

SEQ ID NO: 3167095 - RNA, 18 nt, Human
uuacaguuacuuuuccuu

SEQ ID NO: 3167096 - RNA, 16 nt, Human
uuacaguuacuuuucc

SEQ ID NO: 3167097 - RNA, 14 nt, Human
uuacaguuacuuuu

SEQ ID NO: 3167098 - RNA, 14 nt, Human
uuacagugaagaaa

SEQ ID NO: 3167099 - RNA, 17 nt, Human
uuacagugccuaaaaua

SEQ ID NO: 3167100 - RNA, 20 nt, Human
uuacaggugauuaacuugga

SEQ ID NO: 3167101 - RNA, 14 nt, Human
uuacaguaauguca

SEQ ID NO: 3167102 - RNA, 17 nt, Human
uuacaguaaugucauaa

SEQ ID NO: 3167103 - RNA, 18 nt, Human
uuacaguaaugucauaaa

SEQ ID NO: 3167104 - RNA, 22 nt, Human
uuacaguaaugucauaaaguga

SEQ ID NO: 3167105 - RNA, 16 nt, Human
uuacaguuauagaaag

SEQ ID NO: 3167106 - RNA, 14 nt, Human
uuaccagcagagca

SEQ ID NO: 3167107 - RNA, 18 nt, Human
uuacauaaacaucagguu

SEQ ID NO: 3167108 - RNA, 14 nt, Human
uuacauaaacauca

SEQ ID NO: 3167109 - RNA, 19 nt, Human
uuaccagcagagcaccuua

SEQ ID NO: 3167110 - RNA, 14 nt, Human
uuacaggugugaac

SEQ ID NO: 3167111 - RNA, 15 nt, Human
uuacaggugauuaac

SEQ ID NO: 3167112 - RNA, 13 nt, Human
uuacaggugauua

SEQ ID NO: 3167113 - RNA, 17 nt, Human
uuacagguaccaguucu

SEQ ID NO: 3167114 - RNA, 15 nt, Human
auaacuauguugaua

SEQ ID NO: 3167115 - RNA, 18 nt, Human
auaaauugcuccuugaca

SEQ ID NO: 3167116 - RNA, 15 nt, Human
uuaauuuuugcuuuu

SEQ ID NO: 3167117 - RNA, 22 nt, Human
uuaauuuuugcuuuuagaaaag

SEQ ID NO: 3167118 - RNA, 16 nt, Human
uuacaaaauguaacug

SEQ ID NO: 3167119 - RNA, 17 nt, Human
uuacaaaauguaacugu

SEQ ID NO: 3167120 - RNA, 19 nt, Human
uuacaaaauguaacuguua

SEQ ID NO: 3167121 - RNA, 18 nt, Human
uuacaaaauguaacuguu

SEQ ID NO: 3167122 - RNA, 18 nt, Human
uuacaaaggcuguauuca

SEQ ID NO: 3167123 - RNA, 12 nt, Human
uuacaaaugauu

SEQ ID NO: 3167124 - RNA, 23 nt, Human
uuacaaaugauugcuuuuaaaau

SEQ ID NO: 3167125 - RNA, 21 nt, Human
uuacaaaugauugcuuuuaaa

SEQ ID NO: 3167126 - RNA, 20 nt, Human
uuacaaaugauugcuuuuaa

SEQ ID NO: 3167127 - RNA, 19 nt, Human
uuacaaaugauugcuuuua

SEQ ID NO: 3167128 - RNA, 17 nt, Human
uuacaaaugauugcuuu

SEQ ID NO: 3167129 - RNA, 14 nt, Human
uuacaaaugauugc

SEQ ID NO: 3167130 - RNA, 18 nt, Human
auaaaugauucaaaaagu

SEQ ID NO: 3167131 - RNA, 16 nt, Human
auaaauugcuccuuga

SEQ ID NO: 3167132 - RNA, 13 nt, Human
auaaauugcuccu

SEQ ID NO: 3167133 - RNA, 16 nt, Human
uuacuggauaaauugu

SEQ ID NO: 3167134 - RNA, 22 nt, Human
uuacuggaucucuuaagacagc

SEQ ID NO: 3167135 - RNA, 20 nt, Human
uuacugcuuaauucaaauaa

SEQ ID NO: 3167136 - RNA, 17 nt, Human
uuacugcuuuaaucaga

SEQ ID NO: 3167137 - RNA, 19 nt, Human
uuacugcuuuaaucagaaa

SEQ ID NO: 3167138 - RNA, 15 nt, Human
uuacugcagcuuugu

SEQ ID NO: 3167139 - RNA, 23 nt, Human
uuacuccauauauauauaugugu

SEQ ID NO: 3167140 - RNA, 17 nt, Human
uuaccauaguuuucuca

SEQ ID NO: 3167141 - RNA, 18 nt, Human
uuaccagugccuuaaacu

SEQ ID NO: 3167142 - RNA, 22 nt, Human
uuacuccagguuauugcaauaa

SEQ ID NO: 3167143 - RNA, 21 nt, Human
auaagaaaagauguagauuua

SEQ ID NO: 3167144 - RNA, 18 nt, Human
auaagaaaagauguagau

SEQ ID NO: 3167145 - RNA, 12 nt, Human
auaagaaaagau

SEQ ID NO: 3167146 - RNA, 11 nt, Human
auaagaaaaga

SEQ ID NO: 3167147 - RNA, 14 nt, Human
auaagauucauauu

SEQ ID NO: 3167148 - RNA, 22 nt, Human
auaagaaaagauguagauuuau

SEQ ID NO: 3167149 - RNA, 16 nt, Human
uuagaagucacacagu

SEQ ID NO: 3167150 - RNA, 20 nt, Human
uuacuguccuguugauuaau

SEQ ID NO: 3167151 - RNA, 13 nt, Human
uuagaagguauua

SEQ ID NO: 3167152 - RNA, 18 nt, Human
uuagaagguauuaagauu

SEQ ID NO: 3167153 - RNA, 17 nt, Human
uuagaauuaccauuugu

SEQ ID NO: 3167154 - RNA, 13 nt, Human
uuagaauguugaa

SEQ ID NO: 3167155 - RNA, 18 nt, Human
uuagaauggugauuuuaa

SEQ ID NO: 3167156 - RNA, 21 nt, Human
uuagaauggugauuuuaaaug

SEQ ID NO: 3167157 - RNA, 19 nt, Human
uuagaauggugauuuuaaa

SEQ ID NO: 3167158 - RNA, 23 nt, Human
uuagaaucccuguguuaauuuaa

SEQ ID NO: 3167159 - RNA, 17 nt, Human
uuagaaucccuguguua

SEQ ID NO: 3167160 - RNA, 20 nt, Human
uuagaaucccuguguuaauu

SEQ ID NO: 3167161 - RNA, 22 nt, Human
uuaagacacuuccgucacaucc

SEQ ID NO: 3167162 - RNA, 18 nt, Human
uuaagacauuuuuggaag

SEQ ID NO: 3167163 - RNA, 23 nt, Human
uuaagacauuuuuggaaggggac

SEQ ID NO: 3167164 - RNA, 23 nt, Human
uuaagaaugaguuucuuagacuu

SEQ ID NO: 3167165 - RNA, 22 nt, Human
uuaagaaugaguuucuuagacu

SEQ ID NO: 3167166 - RNA, 20 nt, Human
uuaagaaugaguuucuuaga

SEQ ID NO: 3167167 - RNA, 18 nt, Human
uuaagaaugaguuucuua

SEQ ID NO: 3167168 - RNA, 11 nt, Human
uuaagaaaaaa

SEQ ID NO: 3167169 - RNA, 12 nt, Human
aguuuuucuuaa

SEQ ID NO: 3167170 - RNA, 11 nt, Human
aguuuuucugu

SEQ ID NO: 3167171 - RNA, 13 nt, Human
aguuuuucugucc

SEQ ID NO: 3167172 - RNA, 13 nt, Human
aguuuuugauagu

SEQ ID NO: 3167173 - RNA, 20 nt, Human
aguuuuucauaagauauuuu

SEQ ID NO: 3167174 - RNA, 15 nt, Human
aguuuuucauuuuaa

SEQ ID NO: 3167175 - RNA, 19 nt, Human
aguuuuaggguacaugugc

SEQ ID NO: 3167176 - RNA, 18 nt, Human
aguuuuaggguacaugug

SEQ ID NO: 3167177 - RNA, 19 nt, Human
aguuuuacccuauaucuau

SEQ ID NO: 3167178 - RNA, 17 nt, Human
aguuuuacccuauaucu

SEQ ID NO: 3167179 - RNA, 16 nt, Human
aguuuugugaaauuuu

SEQ ID NO: 3167180 - RNA, 15 nt, Human
aguuuugugaaauuu

SEQ ID NO: 3167181 - RNA, 21 nt, Human
aguuuugugaaauuuuucaua

SEQ ID NO: 3167182 - RNA, 20 nt, Human
aguuuugugaaauuuuucau

SEQ ID NO: 3167183 - RNA, 19 nt, Human
aguuuugugaaauuuuuca

SEQ ID NO: 3167184 - RNA, 18 nt, Human
aguuuugugaaauuuuuc

SEQ ID NO: 3167185 - RNA, 13 nt, Human
uuaaguuugcacu

SEQ ID NO: 3167186 - RNA, 20 nt, Human
uuaaguuuugacaagcuggc

SEQ ID NO: 3167187 - RNA, 13 nt, Human
uuaauaaaaagac

SEQ ID NO: 3167188 - RNA, 14 nt, Human
uuaaucuacugcau

SEQ ID NO: 3167189 - RNA, 15 nt, Human
uuaaucuacugcauu

SEQ ID NO: 3167190 - RNA, 16 nt, Human
uuaaucuacugcauuu

SEQ ID NO: 3167191 - RNA, 12 nt, Human
uuaaucauuuuu

SEQ ID NO: 3167192 - RNA, 15 nt, Human
uuaaucagaagaaaa

SEQ ID NO: 3167193 - RNA, 20 nt, Human
uuaaucacuguguauauuug

SEQ ID NO: 3167194 - RNA, 15 nt, Human
uuaaucacuguguau

SEQ ID NO: 3167195 - RNA, 17 nt, Human
uuaaucacuguguauau

SEQ ID NO: 3167196 - RNA, 13 nt, Human
uuaaucacugugu

SEQ ID NO: 3167197 - RNA, 14 nt, Human
uuaaucacugugua

SEQ ID NO: 3167198 - RNA, 11 nt, Human
uuaaucacugu

SEQ ID NO: 3167199 - RNA, 13 nt, Human
uuaauuuaucaga

SEQ ID NO: 3167200 - RNA, 14 nt, Human
uuaauuuaucagau

SEQ ID NO: 3167201 - RNA, 14 nt, Human
uuaauuucaguaag

SEQ ID NO: 3167202 - RNA, 14 nt, Human
uuaauuucaagcuu

SEQ ID NO: 3167203 - RNA, 15 nt, Human
uuaauuugaaauaug

SEQ ID NO: 3167204 - RNA, 13 nt, Human
uuaauuugaaaua

SEQ ID NO: 3167205 - RNA, 13 nt, Human
uuaauuucugcca

SEQ ID NO: 3167206 - RNA, 20 nt, Human
uuaauuucugccauuucaug

SEQ ID NO: 3167207 - RNA, 21 nt, Human
uuaauuucugccauuucaugu

SEQ ID NO: 3167208 - RNA, 13 nt, Human
uuaauuugugugu

SEQ ID NO: 3167209 - RNA, 21 nt, Human
uuaauuuggaccauuuuccug

SEQ ID NO: 3167210 - RNA, 22 nt, Human
uuaauuuggagcacaaaauuca

SEQ ID NO: 3167211 - RNA, 19 nt, Human
uuaauuuggaccauuuucc

SEQ ID NO: 3167212 - RNA, 11 nt, Human
uuaauuuggaa

SEQ ID NO: 3167213 - RNA, 14 nt, Human
uuaauuuggaaacu

SEQ ID NO: 3167214 - RNA, 16 nt, Human
uuaauuuggaaacuaa

SEQ ID NO: 3167215 - RNA, 20 nt, Human
uuaauuuggaaacuaauaaa

SEQ ID NO: 3167216 - RNA, 18 nt, Human
uuaauuuggaccauuuuc

SEQ ID NO: 3167217 - RNA, 13 nt, Human
uuaauuuggacca

SEQ ID NO: 3167218 - RNA, 16 nt, Human
uuaauuuuuaaaugca

SEQ ID NO: 3167219 - RNA, 15 nt, Human
uuaauuuuuaaaugc

SEQ ID NO: 3167220 - RNA, 12 nt, Human
uuaauuuugucu

SEQ ID NO: 3167221 - RNA, 14 nt, Human
uuaauuuuuaaaug

SEQ ID NO: 3167222 - RNA, 23 nt, Human
uuaauuuugucugccccaaguuu

SEQ ID NO: 3167223 - RNA, 19 nt, Human
uuaauuuugacacugaaau

SEQ ID NO: 3167224 - RNA, 20 nt, Human
uuaauuuugacacugaaaua

SEQ ID NO: 3167225 - RNA, 21 nt, Human
uuaaaguuucaaaaaucugaa

SEQ ID NO: 3167226 - RNA, 20 nt, Human
uuaaaguuucaaaaaucuga

SEQ ID NO: 3167227 - RNA, 19 nt, Human
uuaaaguuucaaaaaucug

SEQ ID NO: 3167228 - RNA, 18 nt, Human
uuaaaguuucaaaaaucu

SEQ ID NO: 3167229 - RNA, 16 nt, Human
uuaaaguuucaaaaau

SEQ ID NO: 3167230 - RNA, 21 nt, Human
uuaaaguugguauuaauaaaa

SEQ ID NO: 3167231 - RNA, 14 nt, Human
uuaaaguucauugc

SEQ ID NO: 3167232 - RNA, 14 nt, Human
uuaaaguuucaaaa

SEQ ID NO: 3167233 - RNA, 13 nt, Human
uuaaaguuucaaa

SEQ ID NO: 3167234 - RNA, 12 nt, Human
uuaaaguuucaa

SEQ ID NO: 3167235 - RNA, 14 nt, Human
uuaaauuuuuuggc

SEQ ID NO: 3167236 - RNA, 17 nt, Human
uuaaauuuuuuuguaug

SEQ ID NO: 3167237 - RNA, 20 nt, Human
uuaaauuuuuuuguaugaaa

SEQ ID NO: 3167238 - RNA, 21 nt, Human
uuaaauuuuuuuguaugaaaa

SEQ ID NO: 3167239 - RNA, 22 nt, Human
uuaaauuuuuuuguaugaaaac

SEQ ID NO: 3167240 - RNA, 18 nt, Human
aguuuaugcagugcugcu

SEQ ID NO: 3167241 - RNA, 19 nt, Human
aguuuaugcagugcugcuu

SEQ ID NO: 3167242 - RNA, 17 nt, Human
aguuuaugucucaguuu

SEQ ID NO: 3167243 - RNA, 23 nt, Human
uuaaauuuuuuuguaugaaaaca

SEQ ID NO: 3167244 - RNA, 20 nt, Human
aguuuguuucuuugaauuuu

SEQ ID NO: 3167245 - RNA, 18 nt, Human
aguuuguuucuuugaauu

SEQ ID NO: 3167246 - RNA, 17 nt, Human
aguuuguuucuuugaau

SEQ ID NO: 3167247 - RNA, 16 nt, Human
aguuuguuucuuugaa

SEQ ID NO: 3167248 - RNA, 11 nt, Human
aguuuuaaagu

SEQ ID NO: 3167249 - RNA, 23 nt, Human
aguuuguuucuuugaauuuucau

SEQ ID NO: 3167250 - RNA, 22 nt, Human
aguuuguuucuuugaauuuuca

SEQ ID NO: 3167251 - RNA, 19 nt, Human
aguuucugccgcagcccug

SEQ ID NO: 3167252 - RNA, 15 nt, Human
aguuucugccgcagc

SEQ ID NO: 3167253 - RNA, 21 nt, Human
aguuucuccaagcaggacaug

SEQ ID NO: 3167254 - RNA, 13 nt, Human
aguuucucagcuc

SEQ ID NO: 3167255 - RNA, 14 nt, Human
aguuucucuuuuca

SEQ ID NO: 3167256 - RNA, 22 nt, Human
aguuuauuccagagcugccagu

SEQ ID NO: 3167257 - RNA, 21 nt, Human
aguuuauuccagagcugccag

SEQ ID NO: 3167258 - RNA, 16 nt, Human
aguuuauuccagagcu

SEQ ID NO: 3167259 - RNA, 16 nt, Human
aguuuauguuuugguc

SEQ ID NO: 3167260 - RNA, 14 nt, Human
aguuuauguuuugg

SEQ ID NO: 3167261 - RNA, 12 nt, Human
aguuuauguuuu

SEQ ID NO: 3167262 - RNA, 21 nt, Human
uuaaaaugcaugauugcagaa

SEQ ID NO: 3167263 - RNA, 19 nt, Human
uuaaaaugauugaaaauaa

SEQ ID NO: 3167264 - RNA, 20 nt, Human
uuaaaaucuuauuaaaguuu

SEQ ID NO: 3167265 - RNA, 19 nt, Human
uuaaaaucuuauuaaaguu

SEQ ID NO: 3167266 - RNA, 16 nt, Human
uuaaaaucuuauuaaa

SEQ ID NO: 3167267 - RNA, 15 nt, Human
uuaaaaucuuauuaa

SEQ ID NO: 3167268 - RNA, 13 nt, Human
uuaaaaucuuauu

SEQ ID NO: 3167269 - RNA, 14 nt, Human
uuaaaauguacaug

SEQ ID NO: 3167270 - RNA, 21 nt, Human
uuaaaauguacauguauuaaa

SEQ ID NO: 3167271 - RNA, 19 nt, Human
uuaaaauguacauguauua

SEQ ID NO: 3167272 - RNA, 17 nt, Human
uuaaaauguacauguau

SEQ ID NO: 3167273 - RNA, 15 nt, Human
uuaaaauguacaugu

SEQ ID NO: 3167274 - RNA, 14 nt, Human
uuaaaaucauuucu

SEQ ID NO: 3167275 - RNA, 22 nt, Human
uuaaaaucauuucugcaucagc

SEQ ID NO: 3167276 - RNA, 17 nt, Human
uuaaaaaugguaucaaa

SEQ ID NO: 3167277 - RNA, 19 nt, Human
uuaaaaaugguaucaaaau

SEQ ID NO: 3167278 - RNA, 20 nt, Human
uuaaaaaugguaucaaaauu

SEQ ID NO: 3167279 - RNA, 22 nt, Human
uuaaaaaugguaucaaaauuac

SEQ ID NO: 3167280 - RNA, 23 nt, Human
uuaaaaaugguaucaaaauuaca

SEQ ID NO: 3167281 - RNA, 24 nt, Human
uuaaaaaugguaucaaaauuacau

SEQ ID NO: 3167282 - RNA, 16 nt, Human
uuaaaaaauggaacau

SEQ ID NO: 3167283 - RNA, 12 nt, Human
aguuuagaacag

SEQ ID NO: 3167284 - RNA, 16 nt, Human
aguuuagaacagguuu

SEQ ID NO: 3167285 - RNA, 17 nt, Human
aguuuagaacagguuuu

SEQ ID NO: 3167286 - RNA, 15 nt, Human
aguuuacugagaaug

SEQ ID NO: 3167287 - RNA, 18 nt, Human
aguuuaccuggcuuauuu

SEQ ID NO: 3167288 - RNA, 19 nt, Human
agcagauggagaccccuug

SEQ ID NO: 3167289 - RNA, 17 nt, Human
agcagaggaaggagagg

SEQ ID NO: 3167290 - RNA, 18 nt, Human
agcagaucuguuuugugg

SEQ ID NO: 3167291 - RNA, 12 nt, Human
agcagaguuaaa

SEQ ID NO: 3167292 - RNA, 14 nt, Human
agcagaguuaaauc

SEQ ID NO: 3167293 - RNA, 18 nt, Human
agcagaguuaaaucucaa

SEQ ID NO: 3167294 - RNA, 22 nt, Human
ugagggugacuauggagcugag

SEQ ID NO: 3167295 - RNA, 20 nt, Human
ugaggguugggcugguguca

SEQ ID NO: 3167296 - RNA, 17 nt, Human
ugagguacugagaguga

SEQ ID NO: 3167297 - RNA, 16 nt, Human
ugaggguuugagagag

SEQ ID NO: 3167298 - RNA, 18 nt, Human
ugaggguuucagagagcc

SEQ ID NO: 3167299 - RNA, 22 nt, Human
ugagguacugagagugaacaaa

SEQ ID NO: 3167300 - RNA, 13 nt, Human
ugaggucagagcc

SEQ ID NO: 3167301 - RNA, 16 nt, Human
ugaggucagagccugc

SEQ ID NO: 3167302 - RNA, 14 nt, Human
ugaggucagagccu

SEQ ID NO: 3167303 - RNA, 18 nt, Human
agcagagaccaucccuga

SEQ ID NO: 3167304 - RNA, 19 nt, Human
agcagagaccaucccugaa

SEQ ID NO: 3167305 - RNA, 17 nt, Human
agcagagaccaucccug

SEQ ID NO: 3167306 - RNA, 17 nt, Human
ugaggucagagccugca

SEQ ID NO: 3167307 - RNA, 20 nt, Human
agcagagcaccuuagacagu

SEQ ID NO: 3167308 - RNA, 20 nt, Human
agcagagaccaucccugaag

SEQ ID NO: 3167309 - RNA, 19 nt, Human
ugagguacaaccuguucug

SEQ ID NO: 3167310 - RNA, 19 nt, Human
agcagagagcauuauaauc

SEQ ID NO: 3167311 - RNA, 13 nt, Human
ugaggggccucuu

SEQ ID NO: 3167312 - RNA, 13 nt, Human
ugagggggcucag

SEQ ID NO: 3167313 - RNA, 14 nt, Human
ugagggggcucagu

SEQ ID NO: 3167314 - RNA, 19 nt, Human
ugagggggcucaguucugg

SEQ ID NO: 3167315 - RNA, 14 nt, Human
ugaggguaaguauu

SEQ ID NO: 3167316 - RNA, 12 nt, Human
ugaggggccucu

SEQ ID NO: 3167317 - RNA, 18 nt, Human
ugaggggcagccugccuu

SEQ ID NO: 3167318 - RNA, 18 nt, Human
ugaggggagccaggaggg

SEQ ID NO: 3167319 - RNA, 15 nt, Human
ugaggggagccagga

SEQ ID NO: 3167320 - RNA, 14 nt, Human
ugaggggagccagg

SEQ ID NO: 3167321 - RNA, 23 nt, Human
ugaggggagacagagcaaccccu

SEQ ID NO: 3167322 - RNA, 13 nt, Human
ugagggcuuguag

SEQ ID NO: 3167323 - RNA, 16 nt, Human
ugagggcggggugucu

SEQ ID NO: 3167324 - RNA, 15 nt, Human
ugagggcagugcaag

SEQ ID NO: 3167325 - RNA, 14 nt, Human
ugagggcagugcaa

SEQ ID NO: 3167326 - RNA, 20 nt, Human
ugaggcccuucucuccagcc

SEQ ID NO: 3167327 - RNA, 22 nt, Human
ugaggcccuucucuccagcccc

SEQ ID NO: 3167328 - RNA, 23 nt, Human
ugaggcccuucucuccagccccu

SEQ ID NO: 3167329 - RNA, 24 nt, Human
ugaggcccuucucuccagccccug

SEQ ID NO: 3167330 - RNA, 18 nt, Human
ugaggcccuucucuccag

SEQ ID NO: 3167331 - RNA, 19 nt, Human
ugaggcccuucucuccagc

SEQ ID NO: 3167332 - RNA, 16 nt, Human
ugaggcccuucucucc

SEQ ID NO: 3167333 - RNA, 19 nt, Human
ugagggauacccaucccau

SEQ ID NO: 3167334 - RNA, 15 nt, Human
ugagggauuaucuuu

SEQ ID NO: 3167335 - RNA, 17 nt, Human
ugaggccguugcugacu

SEQ ID NO: 3167336 - RNA, 19 nt, Human
ugaggccguugcugacuua

SEQ ID NO: 3167337 - RNA, 14 nt, Human
ugaggccguugcug

SEQ ID NO: 3167338 - RNA, 20 nt, Human
ugaggccguugcugacuuag

SEQ ID NO: 3167339 - RNA, 21 nt, Human
ugaggccguugcugacuuaga

SEQ ID NO: 3167340 - RNA, 22 nt, Human
ugaggccguugcugacuuagaa

SEQ ID NO: 3167341 - RNA, 17 nt, Human
ugaggaagagggacugu

SEQ ID NO: 3167342 - RNA, 19 nt, Human
ugaggaagccgcuggggcc

SEQ ID NO: 3167343 - RNA, 21 nt, Human
ugaggaagccgcuggggccag

SEQ ID NO: 3167344 - RNA, 22 nt, Human
ugaggaagcaaaagcaucuaug

SEQ ID NO: 3167345 - RNA, 14 nt, Human
ugaggaagccgcug

SEQ ID NO: 3167346 - RNA, 17 nt, Human
ugaggaagccgcugggg

SEQ ID NO: 3167347 - RNA, 18 nt, Human
ugaggaagccgcuggggc

SEQ ID NO: 3167348 - RNA, 15 nt, Human
ugaggaagcaaaagc

SEQ ID NO: 3167349 - RNA, 22 nt, Human
ugaggaaaucaaagugcuauua

SEQ ID NO: 3167350 - RNA, 14 nt, Human
ugaggaaauuugca

SEQ ID NO: 3167351 - RNA, 16 nt, Human
ugaggaaauuugcagc

SEQ ID NO: 3167352 - RNA, 15 nt, Human
ugaggaaauuugcag

SEQ ID NO: 3167353 - RNA, 16 nt, Human
ugaggaaaucaaagug

SEQ ID NO: 3167354 - RNA, 18 nt, Human
ugaggaaaucaaagugcu

SEQ ID NO: 3167355 - RNA, 15 nt, Human
ugaggaaaucaaagu

SEQ ID NO: 3167356 - RNA, 19 nt, Human
ugaggaaaaauaugugaag

SEQ ID NO: 3167357 - RNA, 18 nt, Human
ugaggaaaaauaugugaa

SEQ ID NO: 3167358 - RNA, 16 nt, Human
ugaggaaaaauaugug

SEQ ID NO: 3167359 - RNA, 15 nt, Human
ugaggaaaaauaugu

SEQ ID NO: 3167360 - RNA, 22 nt, Human
ugagcgacaucucugacuuucu

SEQ ID NO: 3167361 - RNA, 14 nt, Human
ugagccuucugagc

SEQ ID NO: 3167362 - RNA, 14 nt, Human
ugagcuaugacuua

SEQ ID NO: 3167363 - RNA, 15 nt, Human
ugagcuaugacuuaa

SEQ ID NO: 3167364 - RNA, 19 nt, Human
ugagcuaugacuuaacaua

SEQ ID NO: 3167365 - RNA, 19 nt, Human
ugagcuuucuuuuuaaagc

SEQ ID NO: 3167366 - RNA, 18 nt, Human
ugagcuacuggauucuua

SEQ ID NO: 3167367 - RNA, 19 nt, Human
ugagcuacuggauucuuau

SEQ ID NO: 3167368 - RNA, 21 nt, Human
ugaggacacuaaccacgcugg

SEQ ID NO: 3167369 - RNA, 17 nt, Human
ugaggacauaaaucuuc

SEQ ID NO: 3167370 - RNA, 12 nt, Human
ugaggccagaga

SEQ ID NO: 3167371 - RNA, 14 nt, Human
ugaggccacugaag

SEQ ID NO: 3167372 - RNA, 15 nt, Human
ugaggccacugaaga

SEQ ID NO: 3167373 - RNA, 16 nt, Human
ugaggccacugaagag

SEQ ID NO: 3167374 - RNA, 18 nt, Human
ugaggccacugaagagga

SEQ ID NO: 3167375 - RNA, 22 nt, Human
ugaggccacugaagaggaggag

SEQ ID NO: 3167376 - RNA, 22 nt, Human
ugaggacaagagaaaaaagcca

SEQ ID NO: 3167377 - RNA, 13 nt, Human
ugaggacaagaga

SEQ ID NO: 3167378 - RNA, 18 nt, Human
ugaggaauggacauuucu

SEQ ID NO: 3167379 - RNA, 22 nt, Human
ugaggaauccagacccggcugc

SEQ ID NO: 3167380 - RNA, 21 nt, Human
ugaggaauccagacccggcug

SEQ ID NO: 3167381 - RNA, 23 nt, Human
ugaggcccagagggccugcaagg

SEQ ID NO: 3167382 - RNA, 21 nt, Human
ugaggcccagagggccugcaa

SEQ ID NO: 3167383 - RNA, 22 nt, Human
ugaggcccagagggccugcaag

SEQ ID NO: 3167384 - RNA, 15 nt, Human
ugaggcccagagggc

SEQ ID NO: 3167385 - RNA, 17 nt, Human
ugaggcccagagggccu

SEQ ID NO: 3167386 - RNA, 18 nt, Human
ugaggcccagagggccug

SEQ ID NO: 3167387 - RNA, 20 nt, Human
ugaggcccagagggccugca

SEQ ID NO: 3167388 - RNA, 20 nt, Human
ugaggccagagacacaagcc

SEQ ID NO: 3167389 - RNA, 14 nt, Human
ugaggccagagaca

SEQ ID NO: 3167390 - RNA, 16 nt, Human
ugaggccagagacaca

SEQ ID NO: 3167391 - RNA, 12 nt, Human
ugaggcccagag

SEQ ID NO: 3167392 - RNA, 13 nt, Human
ugaggcccagagg

SEQ ID NO: 3167393 - RNA, 20 nt, Human
agcagaaauucuguuuuuaa

SEQ ID NO: 3167394 - RNA, 16 nt, Human
agcagaaauucuguuu

SEQ ID NO: 3167395 - RNA, 14 nt, Human
agcagaaauucugu

SEQ ID NO: 3167396 - RNA, 14 nt, Human
agcagaacagugau

SEQ ID NO: 3167397 - RNA, 21 nt, Human
agcagaaauucuguuuuuaaa

SEQ ID NO: 3167398 - RNA, 13 nt, Human
agcagaaggaagg

SEQ ID NO: 3167399 - RNA, 23 nt, Human
agcacuuugggaggccaaggugg

SEQ ID NO: 3167400 - RNA, 14 nt, Human
agcacuuuuuaaaa

SEQ ID NO: 3167401 - RNA, 22 nt, Human
agcacuuugggaggccaaggug

SEQ ID NO: 3167402 - RNA, 23 nt, Human
agcaccuuagacagucccugcca

SEQ ID NO: 3167403 - RNA, 19 nt, Human
agcaccuuagacagucccu

SEQ ID NO: 3167404 - RNA, 20 nt, Human
agcaccuuagacagucccug

SEQ ID NO: 3167405 - RNA, 21 nt, Human
agcaccuuagacagucccugc

SEQ ID NO: 3167406 - RNA, 22 nt, Human
agcaccuuagacagucccugcc

SEQ ID NO: 3167407 - RNA, 15 nt, Human
agcaccacccuccuu

SEQ ID NO: 3167408 - RNA, 18 nt, Human
agcaccacccuccuuccc

SEQ ID NO: 3167409 - RNA, 16 nt, Human
agcaccacccuccuuc

SEQ ID NO: 3167410 - RNA, 18 nt, Human
agcaccacucaagaccaa

SEQ ID NO: 3167411 - RNA, 10 nt, Human
agcaccaggg

SEQ ID NO: 3167412 - RNA, 12 nt, Human
agcaccagggaa

SEQ ID NO: 3167413 - RNA, 13 nt, Human
agcaccagggaag

SEQ ID NO: 3167414 - RNA, 13 nt, Human
ugagcgacaguga

SEQ ID NO: 3167415 - RNA, 14 nt, Human
ugagcgacagugag

SEQ ID NO: 3167416 - RNA, 16 nt, Human
ugagcgacagugagac

SEQ ID NO: 3167417 - RNA, 20 nt, Human
ugagcgacagugagacucug

SEQ ID NO: 3167418 - RNA, 19 nt, Human
ugagccugggaggucaagg

SEQ ID NO: 3167419 - RNA, 22 nt, Human
ugagccugggaggucaaggcug

SEQ ID NO: 3167420 - RNA, 11 nt, Human
ugagccuggca

SEQ ID NO: 3167421 - RNA, 16 nt, Human
ugagccuggcaagaau

SEQ ID NO: 3167422 - RNA, 14 nt, Human
ugagccugggaggu

SEQ ID NO: 3167423 - RNA, 21 nt, Human
agcagagaaugaaagggccca

SEQ ID NO: 3167424 - RNA, 14 nt, Human
agcagaauucauuc

SEQ ID NO: 3167425 - RNA, 15 nt, Human
agcagaauucauuca

SEQ ID NO: 3167426 - RNA, 16 nt, Human
agcagaauucauucau

SEQ ID NO: 3167427 - RNA, 18 nt, Human
agcagaauugaccgacag

SEQ ID NO: 3167428 - RNA, 19 nt, Human
agcagaauuggaaaagacu

SEQ ID NO: 3167429 - RNA, 17 nt, Human
agcagaauuggaaaaga

SEQ ID NO: 3167430 - RNA, 14 nt, Human
agcagaauuggaaa

SEQ ID NO: 3167431 - RNA, 13 nt, Human
agcagaauuggaa

SEQ ID NO: 3167432 - RNA, 17 nt, Human
agcagacacccuuggag

SEQ ID NO: 3167433 - RNA, 21 nt, Human
agcagagaauucucuuaucca

SEQ ID NO: 3167434 - RNA, 14 nt, Human
agcagagaauucuc

SEQ ID NO: 3167435 - RNA, 23 nt, Human
agcagagaaugaaagggcccaga

SEQ ID NO: 3167436 - RNA, 22 nt, Human
agcagagaaugaaagggcccag

SEQ ID NO: 3167437 - RNA, 15 nt, Human
agcagagaccauccc

SEQ ID NO: 3167438 - RNA, 16 nt, Human
agcagagaccaucccu

SEQ ID NO: 3167439 - RNA, 10 nt, Human
ugagccuggc

SEQ ID NO: 3167440 - RNA, 18 nt, Human
agcagacuuuuaaagacu

SEQ ID NO: 3167441 - RNA, 18 nt, Human
agcaacgaucacaaauga

SEQ ID NO: 3167442 - RNA, 24 nt, Human
agcaaccccuggaccccagccuca

SEQ ID NO: 3167443 - RNA, 23 nt, Human
agcaaccccuggaccccagccuc

SEQ ID NO: 3167444 - RNA, 21 nt, Human
agcaaccccuggaccccagcc

SEQ ID NO: 3167445 - RNA, 15 nt, Human
ugagcaauccugcaa

SEQ ID NO: 3167446 - RNA, 15 nt, Human
ugagcaaauguggcu

SEQ ID NO: 3167447 - RNA, 15 nt, Human
ugagcaacaagaauc

SEQ ID NO: 3167448 - RNA, 19 nt, Human
ugagcaaauguggcuccug

SEQ ID NO: 3167449 - RNA, 18 nt, Human
ugagcaaauguggcuccu

SEQ ID NO: 3167450 - RNA, 16 nt, Human
ugagcaaauguggcuc

SEQ ID NO: 3167451 - RNA, 19 nt, Human
agcaacgaucacaaaugac

SEQ ID NO: 3167452 - RNA, 20 nt, Human
agcaacgaucacaaaugacu

SEQ ID NO: 3167453 - RNA, 21 nt, Human
agcaacgaucacaaaugacuu

SEQ ID NO: 3167454 - RNA, 22 nt, Human
agcaacgaucacaaaugacuuu

SEQ ID NO: 3167455 - RNA, 23 nt, Human
ugagcacuaaggugugcucugau

SEQ ID NO: 3167456 - RNA, 22 nt, Human
ugagcacuaaggugugcucuga

SEQ ID NO: 3167457 - RNA, 21 nt, Human
ugagcacuaaggugugcucug

SEQ ID NO: 3167458 - RNA, 20 nt, Human
ugagcacuaaggugugcucu

SEQ ID NO: 3167459 - RNA, 15 nt, Human
ugagcaagcccagga

SEQ ID NO: 3167460 - RNA, 14 nt, Human
ugagcaagcccagg

SEQ ID NO: 3167461 - RNA, 14 nt, Human
ugagccagauuuca

SEQ ID NO: 3167462 - RNA, 16 nt, Human
ugagccagauuucacu

SEQ ID NO: 3167463 - RNA, 13 nt, Human
ugagccagauuuc

SEQ ID NO: 3167464 - RNA, 23 nt, Human
ugagccacugcaccgggccacag

SEQ ID NO: 3167465 - RNA, 18 nt, Human
ugagccacugcaccgggc

SEQ ID NO: 3167466 - RNA, 21 nt, Human
ugagccacugcaccgggccac

SEQ ID NO: 3167467 - RNA, 18 nt, Human
ugagccaccgugccuggc

SEQ ID NO: 3167468 - RNA, 19 nt, Human
ugagccaccgugccuggcc

SEQ ID NO: 3167469 - RNA, 20 nt, Human
ugagccaccgugccuggcca

SEQ ID NO: 3167470 - RNA, 21 nt, Human
ugagcaucaggccaggcccuc

SEQ ID NO: 3167471 - RNA, 15 nt, Human
ugagcagaauucauu

SEQ ID NO: 3167472 - RNA, 22 nt, Human
ugagcaucaggccaggcccucu

SEQ ID NO: 3167473 - RNA, 24 nt, Human
ugagcaucaggccaggcccucugc

SEQ ID NO: 3167474 - RNA, 15 nt, Human
ugagccaccacgccc

SEQ ID NO: 3167475 - RNA, 14 nt, Human
ugagccaccgugcc

SEQ ID NO: 3167476 - RNA, 14 nt, Human
agcacagcucccuu

SEQ ID NO: 3167477 - RNA, 12 nt, Human
agcacagcuccc

SEQ ID NO: 3167478 - RNA, 18 nt, Human
agcacagucagguugaag

SEQ ID NO: 3167479 - RNA, 16 nt, Human
agcacagcucccuucu

SEQ ID NO: 3167480 - RNA, 15 nt, Human
agcacagcucccuuc

SEQ ID NO: 3167481 - RNA, 17 nt, Human
agcaccaaaauaagaaa

SEQ ID NO: 3167482 - RNA, 16 nt, Human
agcaccaaaauaagaa

SEQ ID NO: 3167483 - RNA, 21 nt, Human
agcaccaaaauaagaaaagau

SEQ ID NO: 3167484 - RNA, 20 nt, Human
agcaccaaaauaagaaaaga

SEQ ID NO: 3167485 - RNA, 19 nt, Human
agcaccaaaauaagaaaag

SEQ ID NO: 3167486 - RNA, 18 nt, Human
agcaccaaaauaagaaaa

SEQ ID NO: 3167487 - RNA, 13 nt, Human
agcacaugccucu

SEQ ID NO: 3167488 - RNA, 14 nt, Human
agcacaugccucuc

SEQ ID NO: 3167489 - RNA, 22 nt, Human
agcaccaaaagcuuaccaaggg

SEQ ID NO: 3167490 - RNA, 17 nt, Human
ugagccagauuucacuc

SEQ ID NO: 3167491 - RNA, 22 nt, Human
ugagccagauuucacucuccuu

SEQ ID NO: 3167492 - RNA, 21 nt, Human
ugagccagauuucacucuccu

SEQ ID NO: 3167493 - RNA, 13 nt, Human
agcaagugagagc

SEQ ID NO: 3167494 - RNA, 16 nt, Human
agcaagugagacccug

SEQ ID NO: 3167495 - RNA, 20 nt, Human
agcaagugagacccugucuc

SEQ ID NO: 3167496 - RNA, 14 nt, Human
agcaagugagagcu

SEQ ID NO: 3167497 - RNA, 18 nt, Human
agcaagugagagcugggu

SEQ ID NO: 3167498 - RNA, 22 nt, Human
agcaagugagagcuggguguca

SEQ ID NO: 3167499 - RNA, 15 nt, Human
agcaagugugaauac

SEQ ID NO: 3167500 - RNA, 21 nt, Human
agcaagugugaauacugcuug

SEQ ID NO: 3167501 - RNA, 23 nt, Human
agcaagugugaauacugcuugaa

SEQ ID NO: 3167502 - RNA, 21 nt, Human
agcacagcagccccugcacaa

SEQ ID NO: 3167503 - RNA, 17 nt, Human
ugacagguuugggaccc

SEQ ID NO: 3167504 - RNA, 16 nt, Human
ugaauuuaucuuugau

SEQ ID NO: 3167505 - RNA, 15 nt, Human
ugaauuuaucuuuga

SEQ ID NO: 3167506 - RNA, 13 nt, Human
ugaauuuaucuuu

SEQ ID NO: 3167507 - RNA, 12 nt, Human
agaucagccaga

SEQ ID NO: 3167508 - RNA, 20 nt, Human
agaucacuguuuagauuugc

SEQ ID NO: 3167509 - RNA, 24 nt, Human
ugacauuuguuugguuauagugca

SEQ ID NO: 3167510 - RNA, 18 nt, Human
ugacauuguagagcuucu

SEQ ID NO: 3167511 - RNA, 17 nt, Human
agaucauuugaguucag

SEQ ID NO: 3167512 - RNA, 12 nt, Human
ugaccacacucc

SEQ ID NO: 3167513 - RNA, 17 nt, Human
ugaccacacuccagcug

SEQ ID NO: 3167514 - RNA, 19 nt, Human
ugaccacacuccagcuggg

SEQ ID NO: 3167515 - RNA, 20 nt, Human
ugaccacacuccagcuggga

SEQ ID NO: 3167516 - RNA, 22 nt, Human
ugaccaaauaucaccaggacug

SEQ ID NO: 3167517 - RNA, 21 nt, Human
ugaccaaauaucaccaggacu

SEQ ID NO: 3167518 - RNA, 19 nt, Human
ugaccaaauaucaccagga

SEQ ID NO: 3167519 - RNA, 16 nt, Human
ugaccaauuuuaacuu

SEQ ID NO: 3167520 - RNA, 13 nt, Human
ugaccaauuuuaa

SEQ ID NO: 3167521 - RNA, 19 nt, Human
agaugaugaugaucuuuaa

SEQ ID NO: 3167522 - RNA, 18 nt, Human
agaucgguuaacaaauaa

SEQ ID NO: 3167523 - RNA, 17 nt, Human
agaucgguuaacaaaua

SEQ ID NO: 3167524 - RNA, 15 nt, Human
agaucgguuaacaaa

SEQ ID NO: 3167525 - RNA, 14 nt, Human
agaucgguuaacaa

SEQ ID NO: 3167526 - RNA, 15 nt, Human
agaugauuuuuugaa

SEQ ID NO: 3167527 - RNA, 17 nt, Human
agaugauuuuuugaaag

SEQ ID NO: 3167528 - RNA, 20 nt, Human
agaugauuuuuugaaaguua

SEQ ID NO: 3167529 - RNA, 21 nt, Human
agauguguaauuuuucuguau

SEQ ID NO: 3167530 - RNA, 22 nt, Human
agauguguaucaguguuuaugu

SEQ ID NO: 3167531 - RNA, 17 nt, Human
agauguguaauuuuucu

SEQ ID NO: 3167532 - RNA, 20 nt, Human
agaugugguuaauuuugcau

SEQ ID NO: 3167533 - RNA, 16 nt, Human
agauguguaauuuuuc

SEQ ID NO: 3167534 - RNA, 15 nt, Human
agauguguucuuauu

SEQ ID NO: 3167535 - RNA, 16 nt, Human
agauguguucuuauuu

SEQ ID NO: 3167536 - RNA, 13 nt, Human
ugaccucugccug

SEQ ID NO: 3167537 - RNA, 19 nt, Human
ugaccccucauagcccuca

SEQ ID NO: 3167538 - RNA, 20 nt, Human
ugaccccucauagcccucac

SEQ ID NO: 3167539 - RNA, 17 nt, Human
ugaccccucauagcccu

SEQ ID NO: 3167540 - RNA, 19 nt, Human
ugacccccccagcuucacu

SEQ ID NO: 3167541 - RNA, 15 nt, Human
ugacccccccagcuu

SEQ ID NO: 3167542 - RNA, 22 nt, Human
ugacccccaaccaaguggcucc

SEQ ID NO: 3167543 - RNA, 14 nt, Human
ugaccucugccuga

SEQ ID NO: 3167544 - RNA, 12 nt, Human
ugaccugaggcc

SEQ ID NO: 3167545 - RNA, 23 nt, Human
agaugcuagaacucccuuucaac

SEQ ID NO: 3167546 - RNA, 22 nt, Human
agaugcuagaacucccuuucaa

SEQ ID NO: 3167547 - RNA, 22 nt, Human
agaugcuugcggcaaaaggaaa

SEQ ID NO: 3167548 - RNA, 18 nt, Human
agaugcuucucacugcca

SEQ ID NO: 3167549 - RNA, 16 nt, Human
agaugcuucucacugc

SEQ ID NO: 3167550 - RNA, 17 nt, Human
agauggauaugaccagu

SEQ ID NO: 3167551 - RNA, 23 nt, Human
agauggcacagggcaugaaauga

SEQ ID NO: 3167552 - RNA, 22 nt, Human
agauggcacagggcaugaaaug

SEQ ID NO: 3167553 - RNA, 16 nt, Human
agauggcacagggcau

SEQ ID NO: 3167554 - RNA, 13 nt, Human
agaugucuuccua

SEQ ID NO: 3167555 - RNA, 14 nt, Human
agaugucucuaaaa

SEQ ID NO: 3167556 - RNA, 20 nt, Human
agaugugggccaccauugca

SEQ ID NO: 3167557 - RNA, 21 nt, Human
agauguccauuuuuacaaguu

SEQ ID NO: 3167558 - RNA, 17 nt, Human
agauguccuaaugguga

SEQ ID NO: 3167559 - RNA, 14 nt, Human
ugaccugaggcccu

SEQ ID NO: 3167560 - RNA, 15 nt, Human
ugaccugaggcccuu

SEQ ID NO: 3167561 - RNA, 17 nt, Human
ugacuccagaauuuccc

SEQ ID NO: 3167562 - RNA, 19 nt, Human
ugacuccagaauuucccaa

SEQ ID NO: 3167563 - RNA, 15 nt, Human
ugacuccaaccauuc

SEQ ID NO: 3167564 - RNA, 16 nt, Human
ugacuccaaccauuca

SEQ ID NO: 3167565 - RNA, 22 nt, Human
ugacuccaaccauucaaaaauu

SEQ ID NO: 3167566 - RNA, 21 nt, Human
ugacugugguagccagcaucg

SEQ ID NO: 3167567 - RNA, 20 nt, Human
ugacuccagaauuucccaaa

SEQ ID NO: 3167568 - RNA, 23 nt, Human
ugacuccagaauuucccaaagca

SEQ ID NO: 3167569 - RNA, 24 nt, Human
ugacuucuaaguaaaaccacagca

SEQ ID NO: 3167570 - RNA, 21 nt, Human
ugacuuccccaauaucuugcu

SEQ ID NO: 3167571 - RNA, 20 nt, Human
ugacuuccccaauaucuugc

SEQ ID NO: 3167572 - RNA, 12 nt, Human
agauuauuuaca

SEQ ID NO: 3167573 - RNA, 14 nt, Human
agauuauuuacaag

SEQ ID NO: 3167574 - RNA, 19 nt, Human
agauuauuuacaagaagaa

SEQ ID NO: 3167575 - RNA, 16 nt, Human
agauucaaucccagga

SEQ ID NO: 3167576 - RNA, 20 nt, Human
agauuauaggcaccuaccac

SEQ ID NO: 3167577 - RNA, 21 nt, Human
ugacuuucaggaauugcccau

SEQ ID NO: 3167578 - RNA, 15 nt, Human
ugacuuucaggaauu

SEQ ID NO: 3167579 - RNA, 16 nt, Human
ugacuuuauuauuuau

SEQ ID NO: 3167580 - RNA, 17 nt, Human
ugacuuuauuauuuauu

SEQ ID NO: 3167581 - RNA, 20 nt, Human
ugacuuuauuauuuauuuuu

SEQ ID NO: 3167582 - RNA, 22 nt, Human
ugacuuucaaaguggaugcaau

SEQ ID NO: 3167583 - RNA, 15 nt, Human
ugacuuuauuauuua

SEQ ID NO: 3167584 - RNA, 12 nt, Human
ugacuuuauaaa

SEQ ID NO: 3167585 - RNA, 14 nt, Human
ugacuuuauaaauu

SEQ ID NO: 3167586 - RNA, 15 nt, Human
ugacuuuauaaauuu

SEQ ID NO: 3167587 - RNA, 17 nt, Human
agcaacaauuuucagau

SEQ ID NO: 3167588 - RNA, 16 nt, Human
agcaacaauuuucaga

SEQ ID NO: 3167589 - RNA, 15 nt, Human
agcaacaauuuucag

SEQ ID NO: 3167590 - RNA, 14 nt, Human
agcaacaauuuuca

SEQ ID NO: 3167591 - RNA, 15 nt, Human
agcaacaucagcuug

SEQ ID NO: 3167592 - RNA, 16 nt, Human
agcaacaucagcuuga

SEQ ID NO: 3167593 - RNA, 14 nt, Human
agcaaccaaaaaga

SEQ ID NO: 3167594 - RNA, 20 nt, Human
agcaaccccuggaccccagc

SEQ ID NO: 3167595 - RNA, 19 nt, Human
agcaaccccuggaccccag

SEQ ID NO: 3167596 - RNA, 18 nt, Human
agcaaccccuggacccca

SEQ ID NO: 3167597 - RNA, 22 nt, Human
agcaaccauauagaaagcuuug

SEQ ID NO: 3167598 - RNA, 14 nt, Human
agauugugaauaau

SEQ ID NO: 3167599 - RNA, 13 nt, Human
agauugugaauaa

SEQ ID NO: 3167600 - RNA, 18 nt, Human
agauugugaauaaugauu

SEQ ID NO: 3167601 - RNA, 16 nt, Human
agauugugccccugca

SEQ ID NO: 3167602 - RNA, 15 nt, Human
agauucacuuugaca

SEQ ID NO: 3167603 - RNA, 17 nt, Human
agauucacuuugacacu

SEQ ID NO: 3167604 - RNA, 17 nt, Human
agauuugaacucuucaa

SEQ ID NO: 3167605 - RNA, 14 nt, Human
agauuugcacaaaa

SEQ ID NO: 3167606 - RNA, 12 nt, Human
agauuugcacaa

SEQ ID NO: 3167607 - RNA, 18 nt, Human
agauuugccauagaguac

SEQ ID NO: 3167608 - RNA, 19 nt, Human
agauuugccauagaguaca

SEQ ID NO: 3167609 - RNA, 17 nt, Human
agauuugcacaaaaaga

SEQ ID NO: 3167610 - RNA, 15 nt, Human
agauuugcacaaaaa

SEQ ID NO: 3167611 - RNA, 12 nt, Human
agauuugggaga

SEQ ID NO: 3167612 - RNA, 21 nt, Human
agauuugccauagaguacacu

SEQ ID NO: 3167613 - RNA, 13 nt, Human
agauuucacucuc

SEQ ID NO: 3167614 - RNA, 14 nt, Human
agauuucacucucc

SEQ ID NO: 3167615 - RNA, 16 nt, Human
agaggcaagcugaaau

SEQ ID NO: 3167616 - RNA, 18 nt, Human
agaggcaagcugaaauuu

SEQ ID NO: 3167617 - RNA, 22 nt, Human
agaggcaagcugaaauuuuaga

SEQ ID NO: 3167618 - RNA, 17 nt, Human
agaggcuaaaauguuuu

SEQ ID NO: 3167619 - RNA, 21 nt, Human
agaggccuuuaguuauaaagg

SEQ ID NO: 3167620 - RNA, 14 nt, Human
agaggcuaaaaugu

SEQ ID NO: 3167621 - RNA, 16 nt, Human
agaggcuaaaauguuu

SEQ ID NO: 3167622 - RNA, 15 nt, Human
agaggcuaaaauguu

SEQ ID NO: 3167623 - RNA, 22 nt, Human
agagggagggagggcuccagac

SEQ ID NO: 3167624 - RNA, 16 nt, Human
agaggugcacuugggg

SEQ ID NO: 3167625 - RNA, 21 nt, Human
agagggagggagggcuccaga

SEQ ID NO: 3167626 - RNA, 20 nt, Human
agagggagggagggcuccag

SEQ ID NO: 3167627 - RNA, 18 nt, Human
ugaagauguagaggagaa

SEQ ID NO: 3167628 - RNA, 17 nt, Human
ugaagauguagaggaga

SEQ ID NO: 3167629 - RNA, 22 nt, Human
agaggugcacuuggggcacagg

SEQ ID NO: 3167630 - RNA, 14 nt, Human
ugaagcaguauuuu

SEQ ID NO: 3167631 - RNA, 15 nt, Human
ugaagcaguauuuug

SEQ ID NO: 3167632 - RNA, 17 nt, Human
ugaagcaggguuucuuu

SEQ ID NO: 3167633 - RNA, 21 nt, Human
ugaagcaggguuucuuuucuu

SEQ ID NO: 3167634 - RNA, 13 nt, Human
ugaagccugcucc

SEQ ID NO: 3167635 - RNA, 17 nt, Human
ugaagccugcuccuucc

SEQ ID NO: 3167636 - RNA, 15 nt, Human
ugaagccugcuccuu

SEQ ID NO: 3167637 - RNA, 18 nt, Human
ugaagccugcuccuuccc

SEQ ID NO: 3167638 - RNA, 14 nt, Human
ucuuuggucuacac

SEQ ID NO: 3167639 - RNA, 21 nt, Human
ucuuuggucuacacugugcug

SEQ ID NO: 3167640 - RNA, 16 nt, Human
ugaagaauuuaaagaa

SEQ ID NO: 3167641 - RNA, 18 nt, Human
agaggcaacugcauuggc

SEQ ID NO: 3167642 - RNA, 17 nt, Human
agaggaaaguacauuuu

SEQ ID NO: 3167643 - RNA, 11 nt, Human
agaggaaauca

SEQ ID NO: 3167644 - RNA, 12 nt, Human
agaggaaaucac

SEQ ID NO: 3167645 - RNA, 12 nt, Human
agaggaaagcaa

SEQ ID NO: 3167646 - RNA, 16 nt, Human
agaggaaagcaaagga

SEQ ID NO: 3167647 - RNA, 18 nt, Human
agaggaaagcaaaggaga

SEQ ID NO: 3167648 - RNA, 19 nt, Human
agaggaaagcaaaggagau

SEQ ID NO: 3167649 - RNA, 19 nt, Human
agagcugggugucaagagg

SEQ ID NO: 3167650 - RNA, 19 nt, Human
agagcuucuguugcugccu

SEQ ID NO: 3167651 - RNA, 20 nt, Human
agagcuucuguugcugccuc

SEQ ID NO: 3167652 - RNA, 21 nt, Human
agagcuucuguugcugccuca

SEQ ID NO: 3167653 - RNA, 15 nt, Human
agagcuucuggcacu

SEQ ID NO: 3167654 - RNA, 15 nt, Human
agaucaacucauguu

SEQ ID NO: 3167655 - RNA, 21 nt, Human
agaucaaccccuucgcuccug

SEQ ID NO: 3167656 - RNA, 15 nt, Human
agaucacuguuuaga

SEQ ID NO: 3167657 - RNA, 16 nt, Human
agaucacuguuuagau

SEQ ID NO: 3167658 - RNA, 17 nt, Human
agaucacuguuuagauu

SEQ ID NO: 3167659 - RNA, 18 nt, Human
agaucacuguuuagauuu

SEQ ID NO: 3167660 - RNA, 19 nt, Human
agaucacuguuuagauuug

SEQ ID NO: 3167661 - RNA, 19 nt, Human
agaucaaccccuucgcucc

SEQ ID NO: 3167662 - RNA, 14 nt, Human
agaucaaccccuuc

SEQ ID NO: 3167663 - RNA, 19 nt, Human
agauacaggaaaagcugcu

SEQ ID NO: 3167664 - RNA, 15 nt, Human
agauacaaucagcug

SEQ ID NO: 3167665 - RNA, 16 nt, Human
agauacaaucagcugc

SEQ ID NO: 3167666 - RNA, 17 nt, Human
agauacaaucagcugcu

SEQ ID NO: 3167667 - RNA, 18 nt, Human
agauacaaucagcugcuu

SEQ ID NO: 3167668 - RNA, 21 nt, Human
agauacaaucagcugcuuugu

SEQ ID NO: 3167669 - RNA, 15 nt, Human
agauaccaagcaugu

SEQ ID NO: 3167670 - RNA, 13 nt, Human
agauauuuuguaa

SEQ ID NO: 3167671 - RNA, 15 nt, Human
agauauuuuguaaaa

SEQ ID NO: 3167672 - RNA, 20 nt, Human
agauauuuuguaaaauguau

SEQ ID NO: 3167673 - RNA, 21 nt, Human
agauauuuuguaaaauguauu

SEQ ID NO: 3167674 - RNA, 22 nt, Human
agauauuuuguaaaauguauua

SEQ ID NO: 3167675 - RNA, 18 nt, Human
agauaccuuaaaauuuga

SEQ ID NO: 3167676 - RNA, 22 nt, Human
agauaccuuaaaauuugaaaca

SEQ ID NO: 3167677 - RNA, 20 nt, Human
agauaccuuaaaauuugaaa

SEQ ID NO: 3167678 - RNA, 22 nt, Human
agauaaguuggaaacacuaaau

SEQ ID NO: 3167679 - RNA, 21 nt, Human
agauaaguuggaaacacuaaa

SEQ ID NO: 3167680 - RNA, 20 nt, Human
agauaaguuggaaacacuaa

SEQ ID NO: 3167681 - RNA, 19 nt, Human
agauaaguuggaaacacua

SEQ ID NO: 3167682 - RNA, 18 nt, Human
agauaaguuggaaacacu

SEQ ID NO: 3167683 - RNA, 16 nt, Human
agauaaguuggaaaca

SEQ ID NO: 3167684 - RNA, 15 nt, Human
agauaaguuggaaac

SEQ ID NO: 3167685 - RNA, 14 nt, Human
agauaaguuggaaa

SEQ ID NO: 3167686 - RNA, 23 nt, Human
agauaaguggccuugacacauua

SEQ ID NO: 3167687 - RNA, 16 nt, Human
agauaaagauugugug

SEQ ID NO: 3167688 - RNA, 15 nt, Human
agauaaguggccuug

SEQ ID NO: 3167689 - RNA, 16 nt, Human
agauaaucucagugcu

SEQ ID NO: 3167690 - RNA, 19 nt, Human
agauaaucucagugcuuuc

SEQ ID NO: 3167691 - RNA, 18 nt, Human
agauaauucuagcuuuga

SEQ ID NO: 3167692 - RNA, 19 nt, Human
agagugagacucugucuca

SEQ ID NO: 3167693 - RNA, 17 nt, Human
agauaaaaaaacagcuu

SEQ ID NO: 3167694 - RNA, 19 nt, Human
agauaaggguaucugguga

SEQ ID NO: 3167695 - RNA, 17 nt, Human
agauaaggguaucuggu

SEQ ID NO: 3167696 - RNA, 17 nt, Human
agauaaagaccagaaau

SEQ ID NO: 3167697 - RNA, 18 nt, Human
agauaaagaccagaaauu

SEQ ID NO: 3167698 - RNA, 19 nt, Human
agauaaagaccagaaauuc

SEQ ID NO: 3167699 - RNA, 21 nt, Human
agauaaacacagcugcuuucu

SEQ ID NO: 3167700 - RNA, 13 nt, Human
agauaaagauugu

SEQ ID NO: 3167701 - RNA, 18 nt, Human
agauaaaaaaacagcuuu

SEQ ID NO: 3167702 - RNA, 19 nt, Human
agauaaaccuagauaaaga

SEQ ID NO: 3167703 - RNA, 18 nt, Human
ugaaggugauaagggaaa

SEQ ID NO: 3167704 - RNA, 19 nt, Human
ugaaggugauaagggaaaa

SEQ ID NO: 3167705 - RNA, 13 nt, Human
ugaauauaaaugu

SEQ ID NO: 3167706 - RNA, 14 nt, Human
ugaauauaaaugug

SEQ ID NO: 3167707 - RNA, 17 nt, Human
ugaauauaaaugugugu

SEQ ID NO: 3167708 - RNA, 18 nt, Human
ugaauauaaaugugugua

SEQ ID NO: 3167709 - RNA, 19 nt, Human
ugaauauaaauguguguau

SEQ ID NO: 3167710 - RNA, 21 nt, Human
ugaauauaaauguguguaugu

SEQ ID NO: 3167711 - RNA, 22 nt, Human
ugaauauaaauguguguaugug

SEQ ID NO: 3167712 - RNA, 15 nt, Human
ugaauauacucauua

SEQ ID NO: 3167713 - RNA, 19 nt, Human
ugaauauacucauuagaau

SEQ ID NO: 3167714 - RNA, 14 nt, Human
ugaaugcauaaaau

SEQ ID NO: 3167715 - RNA, 14 nt, Human
ugaaugcuuuuagu

SEQ ID NO: 3167716 - RNA, 23 nt, Human
ugaaugcuuuuagugugugcaua

SEQ ID NO: 3167717 - RNA, 22 nt, Human
ugaauggacgguuuaggugaaa

SEQ ID NO: 3167718 - RNA, 16 nt, Human
ugaaugcauaaaaugu

SEQ ID NO: 3167719 - RNA, 15 nt, Human
ugaaugcauaaaaug

SEQ ID NO: 3167720 - RNA, 14 nt, Human
agagugaacaaauu

SEQ ID NO: 3167721 - RNA, 20 nt, Human
agagucucacuguugcccag

SEQ ID NO: 3167722 - RNA, 17 nt, Human
agagucuauugucuccu

SEQ ID NO: 3167723 - RNA, 22 nt, Human
agagugaacaaauuuacagaga

SEQ ID NO: 3167724 - RNA, 16 nt, Human
agagugagacucuguc

SEQ ID NO: 3167725 - RNA, 15 nt, Human
agagugagacucugu

SEQ ID NO: 3167726 - RNA, 15 nt, Human
ugaaugucaguguga

SEQ ID NO: 3167727 - RNA, 18 nt, Human
ugaaugucagugugacug

SEQ ID NO: 3167728 - RNA, 14 nt, Human
ugaaugucagugug

SEQ ID NO: 3167729 - RNA, 19 nt, Human
ugaauggcaauguuuugcu

SEQ ID NO: 3167730 - RNA, 14 nt, Human
agacuuaucaacau

SEQ ID NO: 3167731 - RNA, 23 nt, Human
agacuguguuugguccuguagga

SEQ ID NO: 3167732 - RNA, 21 nt, Human
agacuguguuugguccuguag

SEQ ID NO: 3167733 - RNA, 17 nt, Human
agacuguguuugguccu

SEQ ID NO: 3167734 - RNA, 20 nt, Human
agacuguggagacugcuccu

SEQ ID NO: 3167735 - RNA, 19 nt, Human
agacuguggagacugcucc

SEQ ID NO: 3167736 - RNA, 14 nt, Human
agacugucucaaga

SEQ ID NO: 3167737 - RNA, 18 nt, Human
agacuguggagacugcuc

SEQ ID NO: 3167738 - RNA, 15 nt, Human
agacuggcacaguuu

SEQ ID NO: 3167739 - RNA, 14 nt, Human
agacuggcacaguu

SEQ ID NO: 3167740 - RNA, 14 nt, Human
agacuucaucccuc

SEQ ID NO: 3167741 - RNA, 14 nt, Human
agacuucagggagu

SEQ ID NO: 3167742 - RNA, 17 nt, Human
agacuuauuuucacaug

SEQ ID NO: 3167743 - RNA, 17 nt, Human
agacuucaaaauauuga

SEQ ID NO: 3167744 - RNA, 18 nt, Human
agacuucaaaauauugag

SEQ ID NO: 3167745 - RNA, 20 nt, Human
agacuucaaaauauugagca

SEQ ID NO: 3167746 - RNA, 17 nt, Human
agacuucaucccucugg

SEQ ID NO: 3167747 - RNA, 13 nt, Human
agacuucuguuuu

SEQ ID NO: 3167748 - RNA, 22 nt, Human
agacuucagggagucagcuguu

SEQ ID NO: 3167749 - RNA, 11 nt, Human
agacuuugaug

SEQ ID NO: 3167750 - RNA, 13 nt, Human
agacuuugauguc

SEQ ID NO: 3167751 - RNA, 12 nt, Human
agacuugaaaag

SEQ ID NO: 3167752 - RNA, 18 nt, Human
agacuucuguuuucaauc

SEQ ID NO: 3167753 - RNA, 17 nt, Human
agacuucuguuuucaau

SEQ ID NO: 3167754 - RNA, 15 nt, Human
agacuucuguuuuca

SEQ ID NO: 3167755 - RNA, 15 nt, Human
agacuugaaaagaga

SEQ ID NO: 3167756 - RNA, 17 nt, Human
agacuugaaaagagaca

SEQ ID NO: 3167757 - RNA, 18 nt, Human
agacuugaaaagagacag

SEQ ID NO: 3167758 - RNA, 19 nt, Human
agacuugaaaagagacagg

SEQ ID NO: 3167759 - RNA, 22 nt, Human
agacuugaaaagagacaggcag

SEQ ID NO: 3167760 - RNA, 20 nt, Human
agacuugaaaagagacaggc

SEQ ID NO: 3167761 - RNA, 21 nt, Human
agacuugaaaagagacaggca

SEQ ID NO: 3167762 - RNA, 12 nt, Human
agacuuuggaaa

SEQ ID NO: 3167763 - RNA, 18 nt, Human
agacuuugaugucagcag

SEQ ID NO: 3167764 - RNA, 14 nt, Human
agacuuugauguca

SEQ ID NO: 3167765 - RNA, 17 nt, Human
agacuuugaugucagca

SEQ ID NO: 3167766 - RNA, 14 nt, Human
agacuuuggaaaga

SEQ ID NO: 3167767 - RNA, 18 nt, Human
agagaaugaaagggccca

SEQ ID NO: 3167768 - RNA, 13 nt, Human
agagaccaucccu

SEQ ID NO: 3167769 - RNA, 14 nt, Human
agagaccaucccug

SEQ ID NO: 3167770 - RNA, 15 nt, Human
agagaccaucccuga

SEQ ID NO: 3167771 - RNA, 19 nt, Human
ucuuggagccugcagagcu

SEQ ID NO: 3167772 - RNA, 18 nt, Human
ucuuggagccugcagagc

SEQ ID NO: 3167773 - RNA, 15 nt, Human
ucuuggagccugcag

SEQ ID NO: 3167774 - RNA, 16 nt, Human
ucuuggcaauaaauuu

SEQ ID NO: 3167775 - RNA, 24 nt, Human
ucuuggcaauaaauuuugaaaagu

SEQ ID NO: 3167776 - RNA, 17 nt, Human
ucuuggcaauaaauuuu

SEQ ID NO: 3167777 - RNA, 19 nt, Human
ucuuggcaauaaauuuuga

SEQ ID NO: 3167778 - RNA, 20 nt, Human
ucuuggcaauaaauuuugaa

SEQ ID NO: 3167779 - RNA, 22 nt, Human
ucuuggcaauaaauuuugaaaa

SEQ ID NO: 3167780 - RNA, 17 nt, Human
ucuuuaaaauacacacu

SEQ ID NO: 3167781 - RNA, 15 nt, Human
ucuuuaaacugucgu

SEQ ID NO: 3167782 - RNA, 20 nt, Human
ucuuuaaaauuacaacuaag

SEQ ID NO: 3167783 - RNA, 15 nt, Human
ucuuuaaaauuacaa

SEQ ID NO: 3167784 - RNA, 21 nt, Human
ucuuuaaagggauggcaagau

SEQ ID NO: 3167785 - RNA, 15 nt, Human
ucuuuacuucaugga

SEQ ID NO: 3167786 - RNA, 16 nt, Human
ucuuuagaaaaggcau

SEQ ID NO: 3167787 - RNA, 15 nt, Human
ucuuuagaaaaggca

SEQ ID NO: 3167788 - RNA, 18 nt, Human
ucuuuaccuuuauugaua

SEQ ID NO: 3167789 - RNA, 19 nt, Human
agacucuacagaggccaug

SEQ ID NO: 3167790 - RNA, 21 nt, Human
agacucgcgacaaugcaaacc

SEQ ID NO: 3167791 - RNA, 17 nt, Human
agacucuacagaggcca

SEQ ID NO: 3167792 - RNA, 18 nt, Human
agacuccugcaggcagcc

SEQ ID NO: 3167793 - RNA, 19 nt, Human
agacuccugcaggcagcca

SEQ ID NO: 3167794 - RNA, 20 nt, Human
agacuccugcaggcagccag

SEQ ID NO: 3167795 - RNA, 13 nt, Human
ucuuuccugaggc

SEQ ID NO: 3167796 - RNA, 14 nt, Human
ucuuuccugaggcu

SEQ ID NO: 3167797 - RNA, 15 nt, Human
ucuuuccugaggcug

SEQ ID NO: 3167798 - RNA, 12 nt, Human
ucuuuccugagg

SEQ ID NO: 3167799 - RNA, 14 nt, Human
agacuccugcaggc

SEQ ID NO: 3167800 - RNA, 15 nt, Human
agacuccugcaggca

SEQ ID NO: 3167801 - RNA, 16 nt, Human
agacuccugcaggcag

SEQ ID NO: 3167802 - RNA, 17 nt, Human
agacuccugcaggcagc

SEQ ID NO: 3167803 - RNA, 12 nt, Human
ucuuggagccug

SEQ ID NO: 3167804 - RNA, 14 nt, Human
ucuuggagccugca

SEQ ID NO: 3167805 - RNA, 13 nt, Human
ucuuggagccugc

SEQ ID NO: 3167806 - RNA, 18 nt, Human
ucuuggacacuuaauucu

SEQ ID NO: 3167807 - RNA, 19 nt, Human
ucuuggacacuuaauucug

SEQ ID NO: 3167808 - RNA, 21 nt, Human
ucuuggacacuuaauucuguu

SEQ ID NO: 3167809 - RNA, 19 nt, Human
ucuuggaagcuguuuggaa

SEQ ID NO: 3167810 - RNA, 20 nt, Human
ucuuggaagcuguuuggaaa

SEQ ID NO: 3167811 - RNA, 16 nt, Human
ucuugcaauggcagcc

SEQ ID NO: 3167812 - RNA, 13 nt, Human
ucuugcaauggca

SEQ ID NO: 3167813 - RNA, 17 nt, Human
ucuugcaauggcagccu

SEQ ID NO: 3167814 - RNA, 17 nt, Human
ucuugcaaaauuccuga

SEQ ID NO: 3167815 - RNA, 22 nt, Human
ucuugaugaaaagcuuuguuug

SEQ ID NO: 3167816 - RNA, 16 nt, Human
ucuugaugaaaagcuu

SEQ ID NO: 3167817 - RNA, 19 nt, Human
agacuccaaagaaauguaa

SEQ ID NO: 3167818 - RNA, 16 nt, Human
agacuccaaagaaaug

SEQ ID NO: 3167819 - RNA, 15 nt, Human
agacucauucuucug

SEQ ID NO: 3167820 - RNA, 16 nt, Human
agacuauucaaacagu

SEQ ID NO: 3167821 - RNA, 12 nt, Human
agaccugccccu

SEQ ID NO: 3167822 - RNA, 19 nt, Human
agacuaucuaaauguugaa

SEQ ID NO: 3167823 - RNA, 18 nt, Human
agacuaucuaaauguuga

SEQ ID NO: 3167824 - RNA, 17 nt, Human
agacuaucuaaauguug

SEQ ID NO: 3167825 - RNA, 15 nt, Human
agacuaucuaaaugu

SEQ ID NO: 3167826 - RNA, 14 nt, Human
agacuccaaagaaa

SEQ ID NO: 3167827 - RNA, 13 nt, Human
agacuccaaagaa

SEQ ID NO: 3167828 - RNA, 12 nt, Human
agacuccaaaga

SEQ ID NO: 3167829 - RNA, 18 nt, Human
agacucauucuucuguac

SEQ ID NO: 3167830 - RNA, 20 nt, Human
agacuauucaaacagucuca

SEQ ID NO: 3167831 - RNA, 18 nt, Human
agacuauucaaacagucu

SEQ ID NO: 3167832 - RNA, 21 nt, Human
agacuauucaaacagucucag

SEQ ID NO: 3167833 - RNA, 17 nt, Human
agacucauucuucugua

SEQ ID NO: 3167834 - RNA, 13 nt, Human
agacccugcccug

SEQ ID NO: 3167835 - RNA, 14 nt, Human
agacccugcccugu

SEQ ID NO: 3167836 - RNA, 12 nt, Human
agacccugcccu

SEQ ID NO: 3167837 - RNA, 21 nt, Human
agacauguaauuuguguaaau

SEQ ID NO: 3167838 - RNA, 18 nt, Human
agacauguaauuugugua

SEQ ID NO: 3167839 - RNA, 17 nt, Human
agacauguaauuugugu

SEQ ID NO: 3167840 - RNA, 18 nt, Human
agacaugguggggucucc

SEQ ID NO: 3167841 - RNA, 22 nt, Human
ucuuccuacucuucucucugcu

SEQ ID NO: 3167842 - RNA, 16 nt, Human
ucuuccuacucuucuc

SEQ ID NO: 3167843 - RNA, 20 nt, Human
ucuuccuauuucagaaguuu

SEQ ID NO: 3167844 - RNA, 17 nt, Human
ucuuccuauuucagaag

SEQ ID NO: 3167845 - RNA, 16 nt, Human
ucuuccuauuucagaa

SEQ ID NO: 3167846 - RNA, 15 nt, Human
ucuuccuauuucaga

SEQ ID NO: 3167847 - RNA, 14 nt, Human
ucuuccuauuucag

SEQ ID NO: 3167848 - RNA, 22 nt, Human
ucuuccuaucaaaaagauauca

SEQ ID NO: 3167849 - RNA, 17 nt, Human
agaccuaaccagggcca

SEQ ID NO: 3167850 - RNA, 21 nt, Human
agaccgugaagauacuuugua

SEQ ID NO: 3167851 - RNA, 16 nt, Human
agaccuaaccagggcc

SEQ ID NO: 3167852 - RNA, 12 nt, Human
agaccuaaccag

SEQ ID NO: 3167853 - RNA, 19 nt, Human
agaccgugaagauacuuug

SEQ ID NO: 3167854 - RNA, 20 nt, Human
agaccgugaagauacuuugu

SEQ ID NO: 3167855 - RNA, 19 nt, Human
agacccuuguggucccacc

SEQ ID NO: 3167856 - RNA, 20 nt, Human
agacccuuguggucccaccc

SEQ ID NO: 3167857 - RNA, 22 nt, Human
agacccuuguggucccacccca

SEQ ID NO: 3167858 - RNA, 23 nt, Human
agacccuuguggucccaccccac

SEQ ID NO: 3167859 - RNA, 16 nt, Human
agacccugcccugugg

SEQ ID NO: 3167860 - RNA, 19 nt, Human
agacccugcccugugggcc

SEQ ID NO: 3167861 - RNA, 21 nt, Human
agacccugcccugugggcccc

SEQ ID NO: 3167862 - RNA, 23 nt, Human
agacccugcccugugggccccca

SEQ ID NO: 3167863 - RNA, 13 nt, Human
agacccuuguggu

SEQ ID NO: 3167864 - RNA, 15 nt, Human
agacccuuguggucc

SEQ ID NO: 3167865 - RNA, 13 nt, Human
agacccuggagga

SEQ ID NO: 3167866 - RNA, 20 nt, Human
agaauugucuuucugucucu

SEQ ID NO: 3167867 - RNA, 18 nt, Human
agaauuggaaaagacuaa

SEQ ID NO: 3167868 - RNA, 12 nt, Human
agaauuggaaaa

SEQ ID NO: 3167869 - RNA, 14 nt, Human
agaauuguuuagau

SEQ ID NO: 3167870 - RNA, 14 nt, Human
ucuguuugcuguug

SEQ ID NO: 3167871 - RNA, 23 nt, Human
ucuguuggguggcaucauuccag

SEQ ID NO: 3167872 - RNA, 12 nt, Human
ucuguucugaua

SEQ ID NO: 3167873 - RNA, 23 nt, Human
agaauuucccaaagcagugcaug

SEQ ID NO: 3167874 - RNA, 17 nt, Human
agaauuucccaaagcag

SEQ ID NO: 3167875 - RNA, 18 nt, Human
agaauuucccaaagcagu

SEQ ID NO: 3167876 - RNA, 12 nt, Human
agaauuuaaaga

SEQ ID NO: 3167877 - RNA, 13 nt, Human
agaauuuaaagaa

SEQ ID NO: 3167878 - RNA, 15 nt, Human
agaauuguuuagauu

SEQ ID NO: 3167879 - RNA, 21 nt, Human
agaauuuaaagaaaaaaaugu

SEQ ID NO: 3167880 - RNA, 20 nt, Human
ucuguuggccagugugacaa

SEQ ID NO: 3167881 - RNA, 19 nt, Human
ucuguuggccagugugaca

SEQ ID NO: 3167882 - RNA, 18 nt, Human
ucuguuggccagugugac

SEQ ID NO: 3167883 - RNA, 24 nt, Human
ucuguuccauaguuaaagaagaca

SEQ ID NO: 3167884 - RNA, 17 nt, Human
ucuguuccauaguuaaa

SEQ ID NO: 3167885 - RNA, 15 nt, Human
ucugugaaaggaaag

SEQ ID NO: 3167886 - RNA, 21 nt, Human
ucugugaaaggaaagagggag

SEQ ID NO: 3167887 - RNA, 19 nt, Human
ucuguccaacugagaagua

SEQ ID NO: 3167888 - RNA, 20 nt, Human
ucugugccuuuuuuauaucu

SEQ ID NO: 3167889 - RNA, 23 nt, Human
ucuguauagacaggagaagaaag

SEQ ID NO: 3167890 - RNA, 20 nt, Human
ucuguauagacaggagaaga

SEQ ID NO: 3167891 - RNA, 15 nt, Human
ucugucauuugagca

SEQ ID NO: 3167892 - RNA, 23 nt, Human
ucugucauuugagcagggcucag

SEQ ID NO: 3167893 - RNA, 20 nt, Human
ucugucauuugagcagggcu

SEQ ID NO: 3167894 - RNA, 18 nt, Human
ucuguccaacugagaagu

SEQ ID NO: 3167895 - RNA, 16 nt, Human
ucuguauaauacuuug

SEQ ID NO: 3167896 - RNA, 19 nt, Human
ucuguauaauacuuuguau

SEQ ID NO: 3167897 - RNA, 22 nt, Human
ucuguauaauacuuuguauaca

SEQ ID NO: 3167898 - RNA, 20 nt, Human
ucuggucuauaccuuaagaa

SEQ ID NO: 3167899 - RNA, 18 nt, Human
ucugguccauagagagca

SEQ ID NO: 3167900 - RNA, 14 nt, Human
ucugguauuaaaug

SEQ ID NO: 3167901 - RNA, 15 nt, Human
ucugguauuaaaugc

SEQ ID NO: 3167902 - RNA, 17 nt, Human
ucugguauuaaaugcca

SEQ ID NO: 3167903 - RNA, 16 nt, Human
ucuggguucacugcaa

SEQ ID NO: 3167904 - RNA, 14 nt, Human
ucuggguucacugc

SEQ ID NO: 3167905 - RNA, 11 nt, Human
ucuggggcugu

SEQ ID NO: 3167906 - RNA, 22 nt, Human
ucugggugcaggagcgcucccu

SEQ ID NO: 3167907 - RNA, 15 nt, Human
agaaggaaagauggu

SEQ ID NO: 3167908 - RNA, 19 nt, Human
agaaggaaagaugguuaaa

SEQ ID NO: 3167909 - RNA, 14 nt, Human
agaaggaagcaggu

SEQ ID NO: 3167910 - RNA, 15 nt, Human
agaagcuuuauuucu

SEQ ID NO: 3167911 - RNA, 16 nt, Human
agaagcuuuauuucua

SEQ ID NO: 3167912 - RNA, 15 nt, Human
ucuggggaccagcuu

SEQ ID NO: 3167913 - RNA, 17 nt, Human
ucuggggagcuggacag

SEQ ID NO: 3167914 - RNA, 23 nt, Human
ucuggggaccagcuuggcucagg

SEQ ID NO: 3167915 - RNA, 19 nt, Human
ucuggggccuaauaaaacu

SEQ ID NO: 3167916 - RNA, 20 nt, Human
ucuggggccuaauaaaacug

SEQ ID NO: 3167917 - RNA, 21 nt, Human
ucuggggccuaauaaaacuga

SEQ ID NO: 3167918 - RNA, 23 nt, Human
ucuggggccuaauaaaacugaug

SEQ ID NO: 3167919 - RNA, 14 nt, Human
ucuuaauuaaaaga

SEQ ID NO: 3167920 - RNA, 22 nt, Human
ucuuaauauuuuuacaugcaga

SEQ ID NO: 3167921 - RNA, 14 nt, Human
ucuuaauccagucu

SEQ ID NO: 3167922 - RNA, 22 nt, Human
ucuuaaucauuuuuuauauaua

SEQ ID NO: 3167923 - RNA, 20 nt, Human
ucuuaaucauuuuuuauaua

SEQ ID NO: 3167924 - RNA, 14 nt, Human
ucuuaaucauuuuu

SEQ ID NO: 3167925 - RNA, 21 nt, Human
ucuuaauuaaaagaauauuuu

SEQ ID NO: 3167926 - RNA, 18 nt, Human
ucuuaauuaaaagaauau

SEQ ID NO: 3167927 - RNA, 14 nt, Human
ucuuaauuauuaua

SEQ ID NO: 3167928 - RNA, 17 nt, Human
ucuuaauuauuauaaaa

SEQ ID NO: 3167929 - RNA, 18 nt, Human
ucuuaauuauuauaaaaa

SEQ ID NO: 3167930 - RNA, 19 nt, Human
ucuuaauuauuauaaaaau

SEQ ID NO: 3167931 - RNA, 20 nt, Human
ucuuaauuauuauaaaaaua

SEQ ID NO: 3167932 - RNA, 22 nt, Human
ucuuaauuauuauaaaaauauu

SEQ ID NO: 3167933 - RNA, 21 nt, Human
ucuuagaacaguggaaacuau

SEQ ID NO: 3167934 - RNA, 13 nt, Human
ucuuagaagaaua

SEQ ID NO: 3167935 - RNA, 15 nt, Human
ucuuagaagaauauu

SEQ ID NO: 3167936 - RNA, 17 nt, Human
ucuuagaagaauauugu

SEQ ID NO: 3167937 - RNA, 18 nt, Human
ucuuagaagaauauugua

SEQ ID NO: 3167938 - RNA, 19 nt, Human
ucuuagaagaauauuguau

SEQ ID NO: 3167939 - RNA, 20 nt, Human
ucuuagaagaauauuguauu

SEQ ID NO: 3167940 - RNA, 15 nt, Human
ucuuaugggcugggu

SEQ ID NO: 3167941 - RNA, 16 nt, Human
ucuuaugggcuggguu

SEQ ID NO: 3167942 - RNA, 13 nt, Human
ucuuaugggcugg

SEQ ID NO: 3167943 - RNA, 14 nt, Human
ucuuaugggcuggg

SEQ ID NO: 3167944 - RNA, 22 nt, Human
ucuuauugcccacgcuggagug

SEQ ID NO: 3167945 - RNA, 18 nt, Human
ucuuauugcccacgcugg

SEQ ID NO: 3167946 - RNA, 14 nt, Human
ucuuauugcccacg

SEQ ID NO: 3167947 - RNA, 17 nt, Human
ucuuagacuuuuccaau

SEQ ID NO: 3167948 - RNA, 16 nt, Human
ucuuagacuuuuccaa

SEQ ID NO: 3167949 - RNA, 15 nt, Human
ucuucacaacagauu

SEQ ID NO: 3167950 - RNA, 16 nt, Human
ucuucacucaaauuuu

SEQ ID NO: 3167951 - RNA, 22 nt, Human
ucuucaaaauauaaaaugccaa

SEQ ID NO: 3167952 - RNA, 15 nt, Human
ucuucaaauaucucu

SEQ ID NO: 3167953 - RNA, 17 nt, Human
ucuucaaaaugagcccu

SEQ ID NO: 3167954 - RNA, 17 nt, Human
ucuuagaucauaguuuu

SEQ ID NO: 3167955 - RNA, 16 nt, Human
ucuuagaucauaguuu

SEQ ID NO: 3167956 - RNA, 23 nt, Human
ucuuagacuuuuccaauauguga

SEQ ID NO: 3167957 - RNA, 22 nt, Human
ucuuccaggcugggagagccuu

SEQ ID NO: 3167958 - RNA, 21 nt, Human
ucuuccaggcugggagagccu

SEQ ID NO: 3167959 - RNA, 18 nt, Human
ucuuccaguuacuuucca

SEQ ID NO: 3167960 - RNA, 19 nt, Human
ucuuccaguuacuuuccaa

SEQ ID NO: 3167961 - RNA, 22 nt, Human
ucuucccuacaguugaaaaaca

SEQ ID NO: 3167962 - RNA, 18 nt, Human
ucuucccugguaagaaaa

SEQ ID NO: 3167963 - RNA, 20 nt, Human
ucuucccugguaagaaaaag

SEQ ID NO: 3167964 - RNA, 19 nt, Human
ucuucccugguaagaaaaa

SEQ ID NO: 3167965 - RNA, 14 nt, Human
agacagucccugcc

SEQ ID NO: 3167966 - RNA, 14 nt, Human
ucuuaauacuguua

SEQ ID NO: 3167967 - RNA, 18 nt, Human
ucuuaauacuguuauucu

SEQ ID NO: 3167968 - RNA, 15 nt, Human
ucuuaauacuguuau

SEQ ID NO: 3167969 - RNA, 22 nt, Human
ucuuaauacuguuauucuuugc

SEQ ID NO: 3167970 - RNA, 19 nt, Human
ucuuaauacuguuauucuu

SEQ ID NO: 3167971 - RNA, 16 nt, Human
agacagucccugccaa

SEQ ID NO: 3167972 - RNA, 17 nt, Human
agacagucccugccaau

SEQ ID NO: 3167973 - RNA, 15 nt, Human
agacagucccugcca

SEQ ID NO: 3167974 - RNA, 21 nt, Human
agacaggguuuugccauguug

SEQ ID NO: 3167975 - RNA, 15 nt, Human
agacaggaccaggga

SEQ ID NO: 3167976 - RNA, 22 nt, Human
agacaggcaagcaccuccugcc

SEQ ID NO: 3167977 - RNA, 23 nt, Human
agacaggcaagcaccuccugccu

SEQ ID NO: 3167978 - RNA, 20 nt, Human
agacaggcaggugaucugcu

SEQ ID NO: 3167979 - RNA, 19 nt, Human
agaauuugaagacuucaaa

SEQ ID NO: 3167980 - RNA, 21 nt, Human
agaauuugaagacuucaaaau

SEQ ID NO: 3167981 - RNA, 22 nt, Human
agaauuugaagacuucaaaaua

SEQ ID NO: 3167982 - RNA, 14 nt, Human
agaauuugaauuau

SEQ ID NO: 3167983 - RNA, 18 nt, Human
agacacccuuggagcucu

SEQ ID NO: 3167984 - RNA, 17 nt, Human
agacacccuuggagcuc

SEQ ID NO: 3167985 - RNA, 18 nt, Human
agacagaaucucgcucug

SEQ ID NO: 3167986 - RNA, 22 nt, Human
agacagaaucucgcucugucgc

SEQ ID NO: 3167987 - RNA, 14 nt, Human
agacagagacaagu

SEQ ID NO: 3167988 - RNA, 15 nt, Human
agacagagacaagua

SEQ ID NO: 3167989 - RNA, 17 nt, Human
agacagagacaaguaau

SEQ ID NO: 3167990 - RNA, 14 nt, Human
agacagacuagaag

SEQ ID NO: 3167991 - RNA, 16 nt, Human
agacagcugccuggga

SEQ ID NO: 3167992 - RNA, 11 nt, Human
ucuggcccuau

SEQ ID NO: 3167993 - RNA, 21 nt, Human
ucuggccccacaccagcccca

SEQ ID NO: 3167994 - RNA, 15 nt, Human
agaagcggcuggcag

SEQ ID NO: 3167995 - RNA, 16 nt, Human
agaagcggcuggcagc

SEQ ID NO: 3167996 - RNA, 18 nt, Human
agaagcuaagguuuagau

SEQ ID NO: 3167997 - RNA, 13 nt, Human
ucuggaucaguaa

SEQ ID NO: 3167998 - RNA, 15 nt, Human
ucuggaucaguaaaa

SEQ ID NO: 3167999 - RNA, 14 nt, Human
ucuggcagcucaga

SEQ ID NO: 3168000 - RNA, 15 nt, Human
ucuggcagcucagag

SEQ ID NO: 3168001 - RNA, 22 nt, Human
ucuggcagcaccgccucuuccc

SEQ ID NO: 3168002 - RNA, 13 nt, Human
ucuggauucaaau

SEQ ID NO: 3168003 - RNA, 23 nt, Human
ucugcuuuuuaaagaaugcucuu

SEQ ID NO: 3168004 - RNA, 18 nt, Human
ucuggagguacgaaaaga

SEQ ID NO: 3168005 - RNA, 23 nt, Human
ucugcugugggcacaggucaggc

SEQ ID NO: 3168006 - RNA, 13 nt, Human
ucugcuguuaacu

SEQ ID NO: 3168007 - RNA, 22 nt, Human
ucugcugugggcacaggucagg

SEQ ID NO: 3168008 - RNA, 14 nt, Human
ucugcuaccuugcc

SEQ ID NO: 3168009 - RNA, 15 nt, Human
ucugcuaccuugccc

SEQ ID NO: 3168010 - RNA, 17 nt, Human
ucugcuaccuugcccca

SEQ ID NO: 3168011 - RNA, 21 nt, Human
ucugcuaccuugccccaaccc

SEQ ID NO: 3168012 - RNA, 16 nt, Human
ucugcucacauaucug

SEQ ID NO: 3168013 - RNA, 13 nt, Human
ucugccuuugcuc

SEQ ID NO: 3168014 - RNA, 21 nt, Human
ucugccuuuuguucauuucau

SEQ ID NO: 3168015 - RNA, 13 nt, Human
ucugcuagagagu

SEQ ID NO: 3168016 - RNA, 13 nt, Human
agaagaaacuagg

SEQ ID NO: 3168017 - RNA, 15 nt, Human
agaagaaagaacuau

SEQ ID NO: 3168018 - RNA, 13 nt, Human
agaagaaagaacu

SEQ ID NO: 3168019 - RNA, 14 nt, Human
ucugcccuccaaga

SEQ ID NO: 3168020 - RNA, 23 nt, Human
ucugccgcagcccugcagagggc

SEQ ID NO: 3168021 - RNA, 14 nt, Human
agaacucccuuuca

SEQ ID NO: 3168022 - RNA, 19 nt, Human
agaacucgguguccccacc

SEQ ID NO: 3168023 - RNA, 18 nt, Human
agaacucgguguccccac

SEQ ID NO: 3168024 - RNA, 12 nt, Human
agaacucugccu

SEQ ID NO: 3168025 - RNA, 20 nt, Human
agaacucgguguccccacca

SEQ ID NO: 3168026 - RNA, 23 nt, Human
agaacucugccugcccuuugucc

SEQ ID NO: 3168027 - RNA, 17 nt, Human
agaacucugccugcccu

SEQ ID NO: 3168028 - RNA, 14 nt, Human
agaacucugccugc

SEQ ID NO: 3168029 - RNA, 13 nt, Human
agaacucugccug

SEQ ID NO: 3168030 - RNA, 22 nt, Human
agaacucuuccuccaaggacag

SEQ ID NO: 3168031 - RNA, 13 nt, Human
agaacucuuccuc

SEQ ID NO: 3168032 - RNA, 12 nt, Human
agaacucuuccu

SEQ ID NO: 3168033 - RNA, 16 nt, Human
agaacugaaaggcuuu

SEQ ID NO: 3168034 - RNA, 20 nt, Human
agaacugaaaggcuuuucaa

SEQ ID NO: 3168035 - RNA, 18 nt, Human
agaacucaugugauuuac

SEQ ID NO: 3168036 - RNA, 15 nt, Human
agaacucaugugauu

SEQ ID NO: 3168037 - RNA, 19 nt, Human
agaacuaaacuaguuuuuc

SEQ ID NO: 3168038 - RNA, 12 nt, Human
ucugcagagcag

SEQ ID NO: 3168039 - RNA, 14 nt, Human
agaaauugguaccu

SEQ ID NO: 3168040 - RNA, 12 nt, Human
agaaauuaacuu

SEQ ID NO: 3168041 - RNA, 21 nt, Human
agaaauguguagcugcaaaaa

SEQ ID NO: 3168042 - RNA, 19 nt, Human
agaaaugucccuuucuucu

SEQ ID NO: 3168043 - RNA, 23 nt, Human
agaaauugguaccuugcacacau

SEQ ID NO: 3168044 - RNA, 22 nt, Human
agaaauugguaccuugcacaca

SEQ ID NO: 3168045 - RNA, 21 nt, Human
agaaauugguaccuugcacac

SEQ ID NO: 3168046 - RNA, 20 nt, Human
agaaauugguaccuugcaca

SEQ ID NO: 3168047 - RNA, 19 nt, Human
agaaauugguaccuugcac

SEQ ID NO: 3168048 - RNA, 18 nt, Human
agaaauugguaccuugca

SEQ ID NO: 3168049 - RNA, 16 nt, Human
agaaauugguaccuug

SEQ ID NO: 3168050 - RNA, 19 nt, Human
ucugacuuuagccuaccua

SEQ ID NO: 3168051 - RNA, 20 nt, Human
ucugagaaagacuauucaaa

SEQ ID NO: 3168052 - RNA, 19 nt, Human
ucugagaaagacuauucaa

SEQ ID NO: 3168053 - RNA, 15 nt, Human
ucugagaaagacuau

SEQ ID NO: 3168054 - RNA, 14 nt, Human
ucugagaaagacua

SEQ ID NO: 3168055 - RNA, 20 nt, Human
agaaagacuauucaaacagu

SEQ ID NO: 3168056 - RNA, 18 nt, Human
agaaagacuauucaaaca

SEQ ID NO: 3168057 - RNA, 19 nt, Human
agaaagacuauucaaacag

SEQ ID NO: 3168058 - RNA, 19 nt, Human
ucugacccugcuucaaaua

SEQ ID NO: 3168059 - RNA, 23 nt, Human
ucugagaaagacuauucaaacag

SEQ ID NO: 3168060 - RNA, 22 nt, Human
ucugagaaagacuauucaaaca

SEQ ID NO: 3168061 - RNA, 21 nt, Human
ucugagaaagacuauucaaac

SEQ ID NO: 3168062 - RNA, 17 nt, Human
ucugagggcuuguaguu

SEQ ID NO: 3168063 - RNA, 19 nt, Human
ucugagggcuuguaguucu

SEQ ID NO: 3168064 - RNA, 20 nt, Human
ucugagggcuuguaguucuu

SEQ ID NO: 3168065 - RNA, 22 nt, Human
ucugcacuccccugcugggugu

SEQ ID NO: 3168066 - RNA, 18 nt, Human
ucugaucacugaaauaaa

SEQ ID NO: 3168067 - RNA, 21 nt, Human
ucugauucccaagcucugcuc

SEQ ID NO: 3168068 - RNA, 20 nt, Human
ucugauucccaagcucugcu

SEQ ID NO: 3168069 - RNA, 19 nt, Human
ucugauucccaagcucugc

SEQ ID NO: 3168070 - RNA, 18 nt, Human
ucugauucccaagcucug

SEQ ID NO: 3168071 - RNA, 16 nt, Human
ucugaucacugaaaua

SEQ ID NO: 3168072 - RNA, 14 nt, Human
ucugauauguuugu

SEQ ID NO: 3168073 - RNA, 22 nt, Human
ucugauauuaauuuaucagauu

SEQ ID NO: 3168074 - RNA, 19 nt, Human
ucugauacuuuuuugaaau

SEQ ID NO: 3168075 - RNA, 17 nt, Human
ucugauacuuuuuugaa

SEQ ID NO: 3168076 - RNA, 13 nt, Human
ucugauacuuuuu

SEQ ID NO: 3168077 - RNA, 21 nt, Human
agaaaacacuguuaucauuuu

SEQ ID NO: 3168078 - RNA, 18 nt, Human
agaaaacacuguuaucau

SEQ ID NO: 3168079 - RNA, 14 nt, Human
agaaaacacuguua

SEQ ID NO: 3168080 - RNA, 13 nt, Human
agaaaacacuguu

SEQ ID NO: 3168081 - RNA, 19 nt, Human
agaaaaauaugaccacacu

SEQ ID NO: 3168082 - RNA, 13 nt, Human
agaaaaauauuua

SEQ ID NO: 3168083 - RNA, 12 nt, Human
agaaaaauauuu

SEQ ID NO: 3168084 - RNA, 18 nt, Human
agaaaaauaucuguaaga

SEQ ID NO: 3168085 - RNA, 15 nt, Human
agaaaaauaucugua

SEQ ID NO: 3168086 - RNA, 11 nt, Human
agaaaaauauu

SEQ ID NO: 3168087 - RNA, 22 nt, Human
ucucuuuaaugucacaggcagg

SEQ ID NO: 3168088 - RNA, 13 nt, Human
ucucuugagccug

SEQ ID NO: 3168089 - RNA, 14 nt, Human
ucucuugagccugg

SEQ ID NO: 3168090 - RNA, 15 nt, Human
ucucuugagccuggg

SEQ ID NO: 3168091 - RNA, 21 nt, Human
ucucuuuaaugucacaggcag

SEQ ID NO: 3168092 - RNA, 19 nt, Human
agaaaccaggaguaaaaga

SEQ ID NO: 3168093 - RNA, 22 nt, Human
agaaaaccaaacaaaaauguua

SEQ ID NO: 3168094 - RNA, 14 nt, Human
agaaagaaaaucag

SEQ ID NO: 3168095 - RNA, 17 nt, Human
agaaacuggaaauacua

SEQ ID NO: 3168096 - RNA, 14 nt, Human
agaaagaacuaucu

SEQ ID NO: 3168097 - RNA, 16 nt, Human
agaaagaacuaucuuc

SEQ ID NO: 3168098 - RNA, 12 nt, Human
agaaagaaauua

SEQ ID NO: 3168099 - RNA, 13 nt, Human
agaaacuggaacu

SEQ ID NO: 3168100 - RNA, 19 nt, Human
agaaacucuauggucuuau

SEQ ID NO: 3168101 - RNA, 21 nt, Human
agaaacccucauuguguuucu

SEQ ID NO: 3168102 - RNA, 13 nt, Human
ucucuggccuucg

SEQ ID NO: 3168103 - RNA, 16 nt, Human
ucucuggccuucggcc

SEQ ID NO: 3168104 - RNA, 17 nt, Human
ucucuggccuucggccu

SEQ ID NO: 3168105 - RNA, 22 nt, Human
ucucugcccuaaugcgcaggcu

SEQ ID NO: 3168106 - RNA, 11 nt, Human
ucucugcccua

SEQ ID NO: 3168107 - RNA, 19 nt, Human
ucucugcccagcuuuucau

SEQ ID NO: 3168108 - RNA, 15 nt, Human
ucucugcccagcuuu

SEQ ID NO: 3168109 - RNA, 12 nt, Human
ucucuucuuuaa

SEQ ID NO: 3168110 - RNA, 21 nt, Human
ucucuucuggguuccuuccuc

SEQ ID NO: 3168111 - RNA, 14 nt, Human
ucucuucuguguuu

SEQ ID NO: 3168112 - RNA, 13 nt, Human
ucucuucuguguu

SEQ ID NO: 3168113 - RNA, 13 nt, Human
ucucuucuuuaaa

SEQ ID NO: 3168114 - RNA, 14 nt, Human
ucucuugagagggu

SEQ ID NO: 3168115 - RNA, 19 nt, Human
ucucuucuggguuccuucc

SEQ ID NO: 3168116 - RNA, 20 nt, Human
ucucuucuggguuccuuccu

SEQ ID NO: 3168117 - RNA, 18 nt, Human
ucucuucuggguuccuuc

SEQ ID NO: 3168118 - RNA, 13 nt, Human
ucucuccagcccc

SEQ ID NO: 3168119 - RNA, 14 nt, Human
ucucuccagccccu

SEQ ID NO: 3168120 - RNA, 20 nt, Human
ucuccuucaccuuugucccc

SEQ ID NO: 3168121 - RNA, 18 nt, Human
ucuccuucaccuuugucc

SEQ ID NO: 3168122 - RNA, 12 nt, Human
acuuuuuuuagu

SEQ ID NO: 3168123 - RNA, 13 nt, Human
acuuuuuuuagua

SEQ ID NO: 3168124 - RNA, 15 nt, Human
agaaaaaaaaagaaa

SEQ ID NO: 3168125 - RNA, 14 nt, Human
agaaaaaaaaagaa

SEQ ID NO: 3168126 - RNA, 18 nt, Human
acuuuuuuuuuauuuuau

SEQ ID NO: 3168127 - RNA, 15 nt, Human
ucucuccagccccug

SEQ ID NO: 3168128 - RNA, 19 nt, Human
acuuuuucuuaaucauuuu

SEQ ID NO: 3168129 - RNA, 19 nt, Human
acuuuuuuucuauauuauu

SEQ ID NO: 3168130 - RNA, 16 nt, Human
acuuuuuugaaaucag

SEQ ID NO: 3168131 - RNA, 18 nt, Human
acuuuuuugaaaucagua

SEQ ID NO: 3168132 - RNA, 17 nt, Human
acuuuggaaagacuuuu

SEQ ID NO: 3168133 - RNA, 13 nt, Human
acuuuggaaagac

SEQ ID NO: 3168134 - RNA, 14 nt, Human
acuuuggaaagacu

SEQ ID NO: 3168135 - RNA, 12 nt, Human
acuuuggaaaga

SEQ ID NO: 3168136 - RNA, 21 nt, Human
acuuugagaucuaaaaauaac

SEQ ID NO: 3168137 - RNA, 19 nt, Human
acuuugagaucuaaaaaua

SEQ ID NO: 3168138 - RNA, 18 nt, Human
acuuugagaucuaaaaau

SEQ ID NO: 3168139 - RNA, 17 nt, Human
acuuugagaucuaaaaa

SEQ ID NO: 3168140 - RNA, 16 nt, Human
acuuugagaucuaaaa

SEQ ID NO: 3168141 - RNA, 16 nt, Human
acuuguugccuauaag

SEQ ID NO: 3168142 - RNA, 21 nt, Human
acuuguugccuauaagccaaa

SEQ ID NO: 3168143 - RNA, 13 nt, Human
acuuguuuaauaa

SEQ ID NO: 3168144 - RNA, 12 nt, Human
acuuguuucuau

SEQ ID NO: 3168145 - RNA, 14 nt, Human
acuuguuuaauaaa

SEQ ID NO: 3168146 - RNA, 15 nt, Human
ucucccagucauuua

SEQ ID NO: 3168147 - RNA, 11 nt, Human
ucucccuugga

SEQ ID NO: 3168148 - RNA, 18 nt, Human
ucucccuuggauuguccc

SEQ ID NO: 3168149 - RNA, 22 nt, Human
ucuccauuuuggugucuuucuc

SEQ ID NO: 3168150 - RNA, 18 nt, Human
ucucccaaagugcuggga

SEQ ID NO: 3168151 - RNA, 19 nt, Human
ucuccauuuuggugucuuu

SEQ ID NO: 3168152 - RNA, 17 nt, Human
ucuccauuucacuggcu

SEQ ID NO: 3168153 - RNA, 20 nt, Human
acuguauagcucuuuuccua

SEQ ID NO: 3168154 - RNA, 23 nt, Human
acuguagauaauuaaccaaggua

SEQ ID NO: 3168155 - RNA, 12 nt, Human
ucuccucugcug

SEQ ID NO: 3168156 - RNA, 21 nt, Human
ucuccgccccugagcccacug

SEQ ID NO: 3168157 - RNA, 19 nt, Human
ucucccuuggauugucccc

SEQ ID NO: 3168158 - RNA, 23 nt, Human
ucuccgaccagacaccuugacag

SEQ ID NO: 3168159 - RNA, 20 nt, Human
ucuccgccccugagcccacu

SEQ ID NO: 3168160 - RNA, 19 nt, Human
ucuccgccccugagcccac

SEQ ID NO: 3168161 - RNA, 18 nt, Human
ucuccgccccugagccca

SEQ ID NO: 3168162 - RNA, 17 nt, Human
ucuccgccccugagccc

SEQ ID NO: 3168163 - RNA, 16 nt, Human
ucuccgccccugagcc

SEQ ID NO: 3168164 - RNA, 15 nt, Human
ucuccgccccugagc

SEQ ID NO: 3168165 - RNA, 13 nt, Human
ucuccucugcugc

SEQ ID NO: 3168166 - RNA, 14 nt, Human
ucuccucugcugcu

SEQ ID NO: 3168167 - RNA, 15 nt, Human
acuuguugccuauaa

SEQ ID NO: 3168168 - RNA, 14 nt, Human
acuuguugaauuua

SEQ ID NO: 3168169 - RNA, 21 nt, Human
acuuguugauuaauggaaaug

SEQ ID NO: 3168170 - RNA, 19 nt, Human
acuuguugauuaauggaaa

SEQ ID NO: 3168171 - RNA, 21 nt, Human
acuuguucuuccaaagcagag

SEQ ID NO: 3168172 - RNA, 19 nt, Human
acuuguucuuccaaagcag

SEQ ID NO: 3168173 - RNA, 13 nt, Human
acuuguucuucca

SEQ ID NO: 3168174 - RNA, 12 nt, Human
acuuguucuucc

SEQ ID NO: 3168175 - RNA, 13 nt, Human
ucauuuuuuuuaa

SEQ ID NO: 3168176 - RNA, 23 nt, Human
ucauuuuuuccuguuugggaaga

SEQ ID NO: 3168177 - RNA, 17 nt, Human
ucauuuuuuccuguuug

SEQ ID NO: 3168178 - RNA, 13 nt, Human
ucauuuuuuccug

SEQ ID NO: 3168179 - RNA, 12 nt, Human
ucauuuuuuccu

SEQ ID NO: 3168180 - RNA, 23 nt, Human
ucauuuuuuauggcugcauagua

SEQ ID NO: 3168181 - RNA, 22 nt, Human
ucauuuuuuauauauaugcaua

SEQ ID NO: 3168182 - RNA, 21 nt, Human
ucauuuuuuauauauaugcau

SEQ ID NO: 3168183 - RNA, 17 nt, Human
ucauuuucauuagcaaa

SEQ ID NO: 3168184 - RNA, 12 nt, Human
ucauuuucauua

SEQ ID NO: 3168185 - RNA, 11 nt, Human
ucauuuucauu

SEQ ID NO: 3168186 - RNA, 22 nt, Human
ucauuuucaagacugaauucca

SEQ ID NO: 3168187 - RNA, 21 nt, Human
ucauuugagcagggcucagcg

SEQ ID NO: 3168188 - RNA, 14 nt, Human
ucauuugcuuugga

SEQ ID NO: 3168189 - RNA, 18 nt, Human
ucauuugugccagaaugc

SEQ ID NO: 3168190 - RNA, 22 nt, Human
ucauuuuauauaugaaaacuaa

SEQ ID NO: 3168191 - RNA, 22 nt, Human
ucauuuuacaguuacuuuuccu

SEQ ID NO: 3168192 - RNA, 19 nt, Human
ucauuuuacaguuacuuuu

SEQ ID NO: 3168193 - RNA, 14 nt, Human
ucauuuuacaguua

SEQ ID NO: 3168194 - RNA, 13 nt, Human
ucauuuuaaaaag

SEQ ID NO: 3168195 - RNA, 18 nt, Human
accugcggugcuaucucc

SEQ ID NO: 3168196 - RNA, 15 nt, Human
accugaagucuuugu

SEQ ID NO: 3168197 - RNA, 22 nt, Human
accugaagucuuuguacagaca

SEQ ID NO: 3168198 - RNA, 19 nt, Human
accugcggugcuaucuccc

SEQ ID NO: 3168199 - RNA, 22 nt, Human
accugcggugcuaucuccccca

SEQ ID NO: 3168200 - RNA, 23 nt, Human
accugcggugcuaucucccccag

SEQ ID NO: 3168201 - RNA, 17 nt, Human
accugcucuccucuugc

SEQ ID NO: 3168202 - RNA, 18 nt, Human
accugcucuccucuugcc

SEQ ID NO: 3168203 - RNA, 19 nt, Human
ucauuugagcagggcucag

SEQ ID NO: 3168204 - RNA, 19 nt, Human
accuggaaggcccagcacc

SEQ ID NO: 3168205 - RNA, 18 nt, Human
accuggaaggcccagcac

SEQ ID NO: 3168206 - RNA, 14 nt, Human
accugcucugcuga

SEQ ID NO: 3168207 - RNA, 13 nt, Human
accugcucugcug

SEQ ID NO: 3168208 - RNA, 19 nt, Human
accugcucuccucuugcca

SEQ ID NO: 3168209 - RNA, 12 nt, Human
accugcucugcu

SEQ ID NO: 3168210 - RNA, 18 nt, Human
uccaccaagccuggucag

SEQ ID NO: 3168211 - RNA, 23 nt, Human
uccaccaagccuggucagcccaa

SEQ ID NO: 3168212 - RNA, 22 nt, Human
uccaccaagccuggucagccca

SEQ ID NO: 3168213 - RNA, 11 nt, Human
uccaagcuggu

SEQ ID NO: 3168214 - RNA, 22 nt, Human
uccaaguggccuccgucacuac

SEQ ID NO: 3168215 - RNA, 17 nt, Human
uccaauaugugauuuuu

SEQ ID NO: 3168216 - RNA, 16 nt, Human
uccaauaugugauuuu

SEQ ID NO: 3168217 - RNA, 14 nt, Human
uccaauaugugauu

SEQ ID NO: 3168218 - RNA, 12 nt, Human
uccaagcuccca

SEQ ID NO: 3168219 - RNA, 13 nt, Human
uccaagcucccag

SEQ ID NO: 3168220 - RNA, 14 nt, Human
uccaagcucccagg

SEQ ID NO: 3168221 - RNA, 15 nt, Human
uccaagcucccaggc

SEQ ID NO: 3168222 - RNA, 16 nt, Human
uccaagcucccaggca

SEQ ID NO: 3168223 - RNA, 18 nt, Human
uccaagcuccaucuccac

SEQ ID NO: 3168224 - RNA, 22 nt, Human
uccaacgaggcuaaguuaaugc

SEQ ID NO: 3168225 - RNA, 18 nt, Human
uccaaccauucaaaaauu

SEQ ID NO: 3168226 - RNA, 16 nt, Human
uccaaccauuuucauu

SEQ ID NO: 3168227 - RNA, 15 nt, Human
uccaacauccacucu

SEQ ID NO: 3168228 - RNA, 14 nt, Human
uccaaaugcagcuu

SEQ ID NO: 3168229 - RNA, 20 nt, Human
uccaaauaauauguuuccuu

SEQ ID NO: 3168230 - RNA, 17 nt, Human
accuuccaagagccuga

SEQ ID NO: 3168231 - RNA, 12 nt, Human
accuucuccuuc

SEQ ID NO: 3168232 - RNA, 17 nt, Human
accuucuauagcaucac

SEQ ID NO: 3168233 - RNA, 18 nt, Human
accuucuauagcaucacu

SEQ ID NO: 3168234 - RNA, 20 nt, Human
accuucuauagcaucacuua

SEQ ID NO: 3168235 - RNA, 23 nt, Human
accuucucacauggaaugagggu

SEQ ID NO: 3168236 - RNA, 13 nt, Human
accuucuccuuca

SEQ ID NO: 3168237 - RNA, 12 nt, Human
accuucuguggc

SEQ ID NO: 3168238 - RNA, 16 nt, Human
accuucuguggcucac

SEQ ID NO: 3168239 - RNA, 15 nt, Human
accuucuguggcuca

SEQ ID NO: 3168240 - RNA, 13 nt, Human
accuucuguggcu

SEQ ID NO: 3168241 - RNA, 15 nt, Human
accuugaaugaugcc

SEQ ID NO: 3168242 - RNA, 14 nt, Human
accuugacagggca

SEQ ID NO: 3168243 - RNA, 15 nt, Human
accuugacagggcac

SEQ ID NO: 3168244 - RNA, 18 nt, Human
accuucuuauuuaaucuu

SEQ ID NO: 3168245 - RNA, 17 nt, Human
accuuagacagucccug

SEQ ID NO: 3168246 - RNA, 14 nt, Human
accuuagccugccc

SEQ ID NO: 3168247 - RNA, 21 nt, Human
accuuagaagguauuaagauu

SEQ ID NO: 3168248 - RNA, 15 nt, Human
uccaccaucaagcca

SEQ ID NO: 3168249 - RNA, 23 nt, Human
accuggucacaggacucugccuc

SEQ ID NO: 3168250 - RNA, 22 nt, Human
accuggucacaggacucugccu

SEQ ID NO: 3168251 - RNA, 14 nt, Human
accuuaauauuucu

SEQ ID NO: 3168252 - RNA, 15 nt, Human
accuuaauauuucuu

SEQ ID NO: 3168253 - RNA, 21 nt, Human
uccagccugagcgacagugag

SEQ ID NO: 3168254 - RNA, 11 nt, Human
uccagccuggg

SEQ ID NO: 3168255 - RNA, 20 nt, Human
uccagccugagcgacaguga

SEQ ID NO: 3168256 - RNA, 22 nt, Human
uccagccccuggaugcagccuc

SEQ ID NO: 3168257 - RNA, 23 nt, Human
uccagaccccuggcuuuucacug

SEQ ID NO: 3168258 - RNA, 16 nt, Human
uccagccccuggaugc

SEQ ID NO: 3168259 - RNA, 17 nt, Human
uccagccccuggaugca

SEQ ID NO: 3168260 - RNA, 19 nt, Human
uccagccccuggaugcagc

SEQ ID NO: 3168261 - RNA, 21 nt, Human
uccagccccuggaugcagccu

SEQ ID NO: 3168262 - RNA, 15 nt, Human
uccagccccuggaug

SEQ ID NO: 3168263 - RNA, 14 nt, Human
uccagccccuggau

SEQ ID NO: 3168264 - RNA, 18 nt, Human
uccagaccccuggcuuuu

SEQ ID NO: 3168265 - RNA, 17 nt, Human
uccagaccccuggcuuu

SEQ ID NO: 3168266 - RNA, 16 nt, Human
uccagaccccuggcuu

SEQ ID NO: 3168267 - RNA, 15 nt, Human
uccagaccccuggcu

SEQ ID NO: 3168268 - RNA, 18 nt, Human
accuuuggcuuaauucca

SEQ ID NO: 3168269 - RNA, 15 nt, Human
accuuuggcuuaauu

SEQ ID NO: 3168270 - RNA, 22 nt, Human
uccagaaguuugagaucagccu

SEQ ID NO: 3168271 - RNA, 13 nt, Human
uccagaccccugg

SEQ ID NO: 3168272 - RNA, 19 nt, Human
uccagaaugaagaauucag

SEQ ID NO: 3168273 - RNA, 12 nt, Human
uccagaaugaag

SEQ ID NO: 3168274 - RNA, 22 nt, Human
uccacucucucuuguucuuacu

SEQ ID NO: 3168275 - RNA, 22 nt, Human
ucaugauagaaggcuaugggga

SEQ ID NO: 3168276 - RNA, 15 nt, Human
ucaugccaguauuuu

SEQ ID NO: 3168277 - RNA, 12 nt, Human
ucaugaauuuua

SEQ ID NO: 3168278 - RNA, 15 nt, Human
ucaugaauuuuaaag

SEQ ID NO: 3168279 - RNA, 16 nt, Human
ucaugaauuuuaaagu

SEQ ID NO: 3168280 - RNA, 18 nt, Human
ucaugaauuuuaaaguau

SEQ ID NO: 3168281 - RNA, 22 nt, Human
accuccucggcuggcuguccac

SEQ ID NO: 3168282 - RNA, 23 nt, Human
ucauccacugugccaugugccag

SEQ ID NO: 3168283 - RNA, 21 nt, Human
ucauccacugugccaugugcc

SEQ ID NO: 3168284 - RNA, 19 nt, Human
ucauccacugugccaugug

SEQ ID NO: 3168285 - RNA, 13 nt, Human
ucaugucuggcua

SEQ ID NO: 3168286 - RNA, 19 nt, Human
ucauguccugugucaguuu

SEQ ID NO: 3168287 - RNA, 18 nt, Human
ucauguccugugucaguu

SEQ ID NO: 3168288 - RNA, 16 nt, Human
ucauguccugugucag

SEQ ID NO: 3168289 - RNA, 15 nt, Human
ucauguccuguguca

SEQ ID NO: 3168290 - RNA, 20 nt, Human
ucauguccugugucaguuua

SEQ ID NO: 3168291 - RNA, 13 nt, Human
ucaugucuauugu

SEQ ID NO: 3168292 - RNA, 20 nt, Human
ucaugucuauuguccaaagu

SEQ ID NO: 3168293 - RNA, 22 nt, Human
ucauguucaauuauuuccccca

SEQ ID NO: 3168294 - RNA, 19 nt, Human
ucauguucccacuucaaaa

SEQ ID NO: 3168295 - RNA, 23 nt, Human
ucauguucccacuucaaaacaaa

SEQ ID NO: 3168296 - RNA, 22 nt, Human
ucauguucccacuucaaaacaa

SEQ ID NO: 3168297 - RNA, 15 nt, Human
ucauguuaaccucug

SEQ ID NO: 3168298 - RNA, 20 nt, Human
ucauguuaaccucugcuuuu

SEQ ID NO: 3168299 - RNA, 21 nt, Human
ucauguuaaccucugcuuuua

SEQ ID NO: 3168300 - RNA, 18 nt, Human
ucauguuaauugauagaa

SEQ ID NO: 3168301 - RNA, 13 nt, Human
ucauuaaauuacu

SEQ ID NO: 3168302 - RNA, 15 nt, Human
ucauuaaauuacuau

SEQ ID NO: 3168303 - RNA, 22 nt, Human
ucauuaaccuuaucauaaauuc

SEQ ID NO: 3168304 - RNA, 23 nt, Human
accugaagggguuuucuugauaa

SEQ ID NO: 3168305 - RNA, 21 nt, Human
accugaagggguuuucuugau

SEQ ID NO: 3168306 - RNA, 17 nt, Human
accucugauuuauuuug

SEQ ID NO: 3168307 - RNA, 18 nt, Human
accucugauuuauuuugu

SEQ ID NO: 3168308 - RNA, 23 nt, Human
accucugauuuauuuuguaugaa

SEQ ID NO: 3168309 - RNA, 12 nt, Human
accucugcacaa

SEQ ID NO: 3168310 - RNA, 23 nt, Human
accucucccuuggauuguccccg

SEQ ID NO: 3168311 - RNA, 14 nt, Human
accucucucacucc

SEQ ID NO: 3168312 - RNA, 19 nt, Human
accucucucacuccuugaa

SEQ ID NO: 3168313 - RNA, 14 nt, Human
accucucugucaug

SEQ ID NO: 3168314 - RNA, 16 nt, Human
accucucugucaugug

SEQ ID NO: 3168315 - RNA, 13 nt, Human
accucucccuugg

SEQ ID NO: 3168316 - RNA, 14 nt, Human
accucucccuugga

SEQ ID NO: 3168317 - RNA, 15 nt, Human
accucucccuuggau

SEQ ID NO: 3168318 - RNA, 15 nt, Human
accucuagcccugcc

SEQ ID NO: 3168319 - RNA, 19 nt, Human
accucuagaauuuuaagcc

SEQ ID NO: 3168320 - RNA, 13 nt, Human
accucuagaauuu

SEQ ID NO: 3168321 - RNA, 12 nt, Human
accucuagaauu

SEQ ID NO: 3168322 - RNA, 18 nt, Human
accucuagcccugcccgg

SEQ ID NO: 3168323 - RNA, 16 nt, Human
accucuagcccugccc

SEQ ID NO: 3168324 - RNA, 21 nt, Human
ucauuggauucugagagcugu

SEQ ID NO: 3168325 - RNA, 22 nt, Human
ucauugggccauguuuaagugu

SEQ ID NO: 3168326 - RNA, 13 nt, Human
ucauuguaauguu

SEQ ID NO: 3168327 - RNA, 17 nt, Human
accucggugccuuccuc

SEQ ID NO: 3168328 - RNA, 19 nt, Human
accucgcuccaacuccaac

SEQ ID NO: 3168329 - RNA, 18 nt, Human
accucgcuccaacuccaa

SEQ ID NO: 3168330 - RNA, 22 nt, Human
ucauugaccugaggcccuucuc

SEQ ID NO: 3168331 - RNA, 14 nt, Human
ucauugcuucuucu

SEQ ID NO: 3168332 - RNA, 12 nt, Human
ucauugcuucuu

SEQ ID NO: 3168333 - RNA, 17 nt, Human
ucauugcuucuucugag

SEQ ID NO: 3168334 - RNA, 16 nt, Human
ucauugcuucuucuga

SEQ ID NO: 3168335 - RNA, 19 nt, Human
ucauugaccugaggcccuu

SEQ ID NO: 3168336 - RNA, 22 nt, Human
ucauucuaaagauagaguaaaa

SEQ ID NO: 3168337 - RNA, 13 nt, Human
ucauucuaaagau

SEQ ID NO: 3168338 - RNA, 12 nt, Human
ucauucuaaaga

SEQ ID NO: 3168339 - RNA, 20 nt, Human
ucauuccuuuuuauuuauau

SEQ ID NO: 3168340 - RNA, 21 nt, Human
ucauucgggccccaccugcag

SEQ ID NO: 3168341 - RNA, 18 nt, Human
ucauucgggccccaccug

SEQ ID NO: 3168342 - RNA, 18 nt, Human
ucauuccuuuuuauuuau

SEQ ID NO: 3168343 - RNA, 23 nt, Human
ucauucgcuacuaugauuuaauu

SEQ ID NO: 3168344 - RNA, 16 nt, Human
accgccuccuacagcc

SEQ ID NO: 3168345 - RNA, 13 nt, Human
accgccucuuccc

SEQ ID NO: 3168346 - RNA, 14 nt, Human
accgccucuucccg

SEQ ID NO: 3168347 - RNA, 13 nt, Human
accggagagagaa

SEQ ID NO: 3168348 - RNA, 20 nt, Human
accgcagacaggaccaggga

SEQ ID NO: 3168349 - RNA, 20 nt, Human
accgaugcaaacauuggaag

SEQ ID NO: 3168350 - RNA, 24 nt, Human
accgagucucuucuccacuggaug

SEQ ID NO: 3168351 - RNA, 21 nt, Human
accgagucucuucuccacugg

SEQ ID NO: 3168352 - RNA, 20 nt, Human
accgagucucuucuccacug

SEQ ID NO: 3168353 - RNA, 17 nt, Human
accgccaaggcuggggg

SEQ ID NO: 3168354 - RNA, 17 nt, Human
accgcagacaggaccag

SEQ ID NO: 3168355 - RNA, 21 nt, Human
ucauauucaugcaaguauucu

SEQ ID NO: 3168356 - RNA, 14 nt, Human
ucauauucaugcaa

SEQ ID NO: 3168357 - RNA, 15 nt, Human
ucauauucagcuugc

SEQ ID NO: 3168358 - RNA, 22 nt, Human
ucauauuagacuucuguuuuca

SEQ ID NO: 3168359 - RNA, 12 nt, Human
ucauauuauaca

SEQ ID NO: 3168360 - RNA, 20 nt, Human
ucauauuagacuucuguuuu

SEQ ID NO: 3168361 - RNA, 18 nt, Human
ucauauuagacuucuguu

SEQ ID NO: 3168362 - RNA, 13 nt, Human
ucauauuagacuu

SEQ ID NO: 3168363 - RNA, 15 nt, Human
ucauauuacaauauu

SEQ ID NO: 3168364 - RNA, 14 nt, Human
ucauauuacaauau

SEQ ID NO: 3168365 - RNA, 13 nt, Human
ucauauuacaaua

SEQ ID NO: 3168366 - RNA, 10 nt, Human
acccuuuucu

SEQ ID NO: 3168367 - RNA, 15 nt, Human
acccuuuuccauuuu

SEQ ID NO: 3168368 - RNA, 16 nt, Human
ucauauuuacuucuua

SEQ ID NO: 3168369 - RNA, 21 nt, Human
accgaacugggcauauuucua

SEQ ID NO: 3168370 - RNA, 22 nt, Human
ucauauuuacuucuuauacauu

SEQ ID NO: 3168371 - RNA, 21 nt, Human
ucauauuuacuucuuauacau

SEQ ID NO: 3168372 - RNA, 20 nt, Human
ucauauuuacuucuuauaca

SEQ ID NO: 3168373 - RNA, 22 nt, Human
accgacuagacacacaaagcag

SEQ ID NO: 3168374 - RNA, 15 nt, Human
accgacuagacacac

SEQ ID NO: 3168375 - RNA, 18 nt, Human
accgagucucuucuccac

SEQ ID NO: 3168376 - RNA, 11 nt, Human
accgacaagca

SEQ ID NO: 3168377 - RNA, 12 nt, Human
accgaauauuga

SEQ ID NO: 3168378 - RNA, 19 nt, Human
accguguuugucucuucug

SEQ ID NO: 3168379 - RNA, 18 nt, Human
accguguuugucucuucu

SEQ ID NO: 3168380 - RNA, 15 nt, Human
accguguuugucucu

SEQ ID NO: 3168381 - RNA, 13 nt, Human
accuagccuuaga

SEQ ID NO: 3168382 - RNA, 17 nt, Human
accuaugagugagaaua

SEQ ID NO: 3168383 - RNA, 16 nt, Human
accucacacuccuuua

SEQ ID NO: 3168384 - RNA, 20 nt, Human
accuccgccucuuggguuca

SEQ ID NO: 3168385 - RNA, 16 nt, Human
accucccccacuccca

SEQ ID NO: 3168386 - RNA, 11 nt, Human
accucccccac

SEQ ID NO: 3168387 - RNA, 18 nt, Human
ucauccacugugccaugu

SEQ ID NO: 3168388 - RNA, 19 nt, Human
accuccucccacugcccac

SEQ ID NO: 3168389 - RNA, 18 nt, Human
accuccucccacugccca

SEQ ID NO: 3168390 - RNA, 16 nt, Human
accuccucccacugcc

SEQ ID NO: 3168391 - RNA, 15 nt, Human
accuccucccacugc

SEQ ID NO: 3168392 - RNA, 14 nt, Human
accuccucccacug

SEQ ID NO: 3168393 - RNA, 18 nt, Human
accuccuaaaaggcccag

SEQ ID NO: 3168394 - RNA, 17 nt, Human
accuccuaaaaggccca

SEQ ID NO: 3168395 - RNA, 20 nt, Human
accuccggccaggugccucc

SEQ ID NO: 3168396 - RNA, 21 nt, Human
accuccggccaggugccuccu

SEQ ID NO: 3168397 - RNA, 22 nt, Human
accuccggccaggugccuccug

SEQ ID NO: 3168398 - RNA, 23 nt, Human
accuccggccaggugccuccuga

SEQ ID NO: 3168399 - RNA, 21 nt, Human
accuccuaaaaggcccagaga

SEQ ID NO: 3168400 - RNA, 19 nt, Human
accuccuaaaaggcccaga

SEQ ID NO: 3168401 - RNA, 22 nt, Human
accuccuaaaaggcccagagag

SEQ ID NO: 3168402 - RNA, 13 nt, Human
accuccucacauu

SEQ ID NO: 3168403 - RNA, 23 nt, Human
accagacaccuugacagggcaca

SEQ ID NO: 3168404 - RNA, 22 nt, Human
accagacaccuugacagggcac

SEQ ID NO: 3168405 - RNA, 17 nt, Human
accagacaccuugacag

SEQ ID NO: 3168406 - RNA, 17 nt, Human
accagagcccaccuugg

SEQ ID NO: 3168407 - RNA, 22 nt, Human
accagagcccaccuuggcucaa

SEQ ID NO: 3168408 - RNA, 19 nt, Human
accagagcccaccuuggcu

SEQ ID NO: 3168409 - RNA, 23 nt, Human
accagcgcacugauggucacugg

SEQ ID NO: 3168410 - RNA, 19 nt, Human
accaggcaacuugggaacu

SEQ ID NO: 3168411 - RNA, 23 nt, Human
accaggcaccuccccucccgccc

SEQ ID NO: 3168412 - RNA, 15 nt, Human
accaggcaccucccc

SEQ ID NO: 3168413 - RNA, 19 nt, Human
accaggcaccuccccuccc

SEQ ID NO: 3168414 - RNA, 15 nt, Human
accaggccccccugu

SEQ ID NO: 3168415 - RNA, 13 nt, Human
ucaccucccccau

SEQ ID NO: 3168416 - RNA, 15 nt, Human
ucaccucccccaucu

SEQ ID NO: 3168417 - RNA, 19 nt, Human
ucaccugaagacucauucu

SEQ ID NO: 3168418 - RNA, 16 nt, Human
ucaccugaagacucau

SEQ ID NO: 3168419 - RNA, 23 nt, Human
ucaccugaagacucauucuucug

SEQ ID NO: 3168420 - RNA, 13 nt, Human
accacugcagaag

SEQ ID NO: 3168421 - RNA, 14 nt, Human
accacugaaucugu

SEQ ID NO: 3168422 - RNA, 14 nt, Human
accacugcagaaga

SEQ ID NO: 3168423 - RNA, 19 nt, Human
accacugcagaagacagua

SEQ ID NO: 3168424 - RNA, 15 nt, Human
accacuucagcugac

SEQ ID NO: 3168425 - RNA, 13 nt, Human
accacuucagcug

SEQ ID NO: 3168426 - RNA, 14 nt, Human
accacuucagcuga

SEQ ID NO: 3168427 - RNA, 24 nt, Human
accacaucuugcucugcugacaga

SEQ ID NO: 3168428 - RNA, 21 nt, Human
accacaucuugcucugcugac

SEQ ID NO: 3168429 - RNA, 20 nt, Human
accacaucuugcucugcuga

SEQ ID NO: 3168430 - RNA, 16 nt, Human
accacucaagaccaaa

SEQ ID NO: 3168431 - RNA, 12 nt, Human
uauuucauuucu

SEQ ID NO: 3168432 - RNA, 20 nt, Human
uauuucaugaauacauugua

SEQ ID NO: 3168433 - RNA, 22 nt, Human
uauuucauucgggccccaccug

SEQ ID NO: 3168434 - RNA, 20 nt, Human
accacacuugucggcuccag

SEQ ID NO: 3168435 - RNA, 14 nt, Human
uauuucagaaauac

SEQ ID NO: 3168436 - RNA, 13 nt, Human
uauuucagaaaua

SEQ ID NO: 3168437 - RNA, 12 nt, Human
uauuucagaaau

SEQ ID NO: 3168438 - RNA, 20 nt, Human
uauuucacuuuaguuuuuga

SEQ ID NO: 3168439 - RNA, 16 nt, Human
uauuucagcaaacuug

SEQ ID NO: 3168440 - RNA, 23 nt, Human
uauuucagaaguuuaaauauuaa

SEQ ID NO: 3168441 - RNA, 16 nt, Human
uauuucagaaguuuaa

SEQ ID NO: 3168442 - RNA, 14 nt, Human
uauuucagaaguuu

SEQ ID NO: 3168443 - RNA, 19 nt, Human
uauuucaucagaacagcug

SEQ ID NO: 3168444 - RNA, 23 nt, Human
uauuucaguuauugucccuggcu

SEQ ID NO: 3168445 - RNA, 18 nt, Human
uauuucagcaaacuuguu

SEQ ID NO: 3168446 - RNA, 22 nt, Human
uauuucaguuauugucccuggc

SEQ ID NO: 3168447 - RNA, 21 nt, Human
uauuucaucauauuauacaga

SEQ ID NO: 3168448 - RNA, 20 nt, Human
uauuucaucauauuauacag

SEQ ID NO: 3168449 - RNA, 20 nt, Human
uauuucaucagaacagcugu

SEQ ID NO: 3168450 - RNA, 11 nt, Human
accacagcagu

SEQ ID NO: 3168451 - RNA, 22 nt, Human
accacaguguaccauuaaaaua

SEQ ID NO: 3168452 - RNA, 21 nt, Human
accacaguguaccauuaaaau

SEQ ID NO: 3168453 - RNA, 14 nt, Human
accacaucuugcuc

SEQ ID NO: 3168454 - RNA, 18 nt, Human
accacauacguaaaaauc

SEQ ID NO: 3168455 - RNA, 12 nt, Human
accacagacuuu

SEQ ID NO: 3168456 - RNA, 23 nt, Human
accacagcaacgaucacaaauga

SEQ ID NO: 3168457 - RNA, 23 nt, Human
accacagacuuuagcuuucugag

SEQ ID NO: 3168458 - RNA, 21 nt, Human
acccaaauguucaucaaugaa

SEQ ID NO: 3168459 - RNA, 18 nt, Human
acccaaaaggcagaagca

SEQ ID NO: 3168460 - RNA, 20 nt, Human
acccaaauguucaucaauga

SEQ ID NO: 3168461 - RNA, 18 nt, Human
acccagcccacuucugcc

SEQ ID NO: 3168462 - RNA, 15 nt, Human
acccagcccacuucu

SEQ ID NO: 3168463 - RNA, 14 nt, Human
ucagaacaaauuca

SEQ ID NO: 3168464 - RNA, 16 nt, Human
ucagaacagcuguuga

SEQ ID NO: 3168465 - RNA, 14 nt, Human
ucagaacagcuguu

SEQ ID NO: 3168466 - RNA, 16 nt, Human
ucagaacaaauucagg

SEQ ID NO: 3168467 - RNA, 12 nt, Human
ucagaacagcug

SEQ ID NO: 3168468 - RNA, 17 nt, Human
acccagcccacuucugc

SEQ ID NO: 3168469 - RNA, 16 nt, Human
acccagcccacuucug

SEQ ID NO: 3168470 - RNA, 21 nt, Human
acccagaaaaucugaauugga

SEQ ID NO: 3168471 - RNA, 21 nt, Human
acccagaaacgccacaucccc

SEQ ID NO: 3168472 - RNA, 20 nt, Human
acccagaaacgccacauccc

SEQ ID NO: 3168473 - RNA, 13 nt, Human
acccaaaaggcag

SEQ ID NO: 3168474 - RNA, 15 nt, Human
acccaaaaggcagaa

SEQ ID NO: 3168475 - RNA, 23 nt, Human
accauuuugggguacccacugcu

SEQ ID NO: 3168476 - RNA, 15 nt, Human
accauuuuuguuacu

SEQ ID NO: 3168477 - RNA, 16 nt, Human
accauuuuuguuacuc

SEQ ID NO: 3168478 - RNA, 22 nt, Human
accauuuugggguacccacugc

SEQ ID NO: 3168479 - RNA, 16 nt, Human
accauuuccccagggc

SEQ ID NO: 3168480 - RNA, 23 nt, Human
accauuucaguaaaccugucuga

SEQ ID NO: 3168481 - RNA, 19 nt, Human
accauuuccguaauucuua

SEQ ID NO: 3168482 - RNA, 19 nt, Human
accauuuccccagggcacg

SEQ ID NO: 3168483 - RNA, 18 nt, Human
accauuuccccagggcac

SEQ ID NO: 3168484 - RNA, 17 nt, Human
accauuuccccagggca

SEQ ID NO: 3168485 - RNA, 13 nt, Human
accauuuaucuug

SEQ ID NO: 3168486 - RNA, 16 nt, Human
accauuuaucuugaag

SEQ ID NO: 3168487 - RNA, 15 nt, Human
accauuuaucuugaa

SEQ ID NO: 3168488 - RNA, 13 nt, Human
accauucuccacc

SEQ ID NO: 3168489 - RNA, 16 nt, Human
accauucuccaccugc

SEQ ID NO: 3168490 - RNA, 20 nt, Human
accaugaucacuuaucaguu

SEQ ID NO: 3168491 - RNA, 22 nt, Human
accaugauuaaccacuucagcu

SEQ ID NO: 3168492 - RNA, 23 nt, Human
accaugauuaaccacuucagcug

SEQ ID NO: 3168493 - RNA, 12 nt, Human
accauuccccau

SEQ ID NO: 3168494 - RNA, 15 nt, Human
accauuccccauggg

SEQ ID NO: 3168495 - RNA, 23 nt, Human
ucaccugcuucucugcccagcuu

SEQ ID NO: 3168496 - RNA, 22 nt, Human
ucaccugcuucucugcccagcu

SEQ ID NO: 3168497 - RNA, 17 nt, Human
ucaccugcuucucugcc

SEQ ID NO: 3168498 - RNA, 15 nt, Human
ucaccugcuucucug

SEQ ID NO: 3168499 - RNA, 13 nt, Human
ucaccugcuucuc

SEQ ID NO: 3168500 - RNA, 16 nt, Human
ucaccugccccucaac

SEQ ID NO: 3168501 - RNA, 14 nt, Human
ucacugagacagcc

SEQ ID NO: 3168502 - RNA, 15 nt, Human
ucacugagacagccc

SEQ ID NO: 3168503 - RNA, 13 nt, Human
ucacugagacagc

SEQ ID NO: 3168504 - RNA, 16 nt, Human
ucacuguugcccaggc

SEQ ID NO: 3168505 - RNA, 14 nt, Human
ucacugucugucug

SEQ ID NO: 3168506 - RNA, 12 nt, Human
ucacugcagccu

SEQ ID NO: 3168507 - RNA, 15 nt, Human
ucacugcacagugca

SEQ ID NO: 3168508 - RNA, 20 nt, Human
ucacugcacagugcaucuca

SEQ ID NO: 3168509 - RNA, 24 nt, Human
ucacugcacagugcaucucagccc

SEQ ID NO: 3168510 - RNA, 22 nt, Human
ucacugcacagugcaucucagc

SEQ ID NO: 3168511 - RNA, 15 nt, Human
accaguucugggcaa

SEQ ID NO: 3168512 - RNA, 12 nt, Human
accagugccuua

SEQ ID NO: 3168513 - RNA, 14 nt, Human
accagggacugagg

SEQ ID NO: 3168514 - RNA, 18 nt, Human
ucacuguugcccaggcug

SEQ ID NO: 3168515 - RNA, 17 nt, Human
ucacuguugcccaggcu

SEQ ID NO: 3168516 - RNA, 22 nt, Human
accagggccagaaguagcuuug

SEQ ID NO: 3168517 - RNA, 15 nt, Human
accagggccagaagu

SEQ ID NO: 3168518 - RNA, 23 nt, Human
acccucccucuacugggagccua

SEQ ID NO: 3168519 - RNA, 15 nt, Human
acccuccacucuccu

SEQ ID NO: 3168520 - RNA, 20 nt, Human
accccuucgcuccugugucu

SEQ ID NO: 3168521 - RNA, 23 nt, Human
ucaggguuggccccugcccggcu

SEQ ID NO: 3168522 - RNA, 14 nt, Human
accccuugauuuuc

SEQ ID NO: 3168523 - RNA, 14 nt, Human
acccuccaaggcca

SEQ ID NO: 3168524 - RNA, 11 nt, Human
acccuccaagg

SEQ ID NO: 3168525 - RNA, 12 nt, Human
acccuccaaggc

SEQ ID NO: 3168526 - RNA, 15 nt, Human
acccgacuccagucc

SEQ ID NO: 3168527 - RNA, 15 nt, Human
acccgagcugggacc

SEQ ID NO: 3168528 - RNA, 16 nt, Human
acccuuguggucccac

SEQ ID NO: 3168529 - RNA, 17 nt, Human
acccuuguggucccacc

SEQ ID NO: 3168530 - RNA, 19 nt, Human
acccuuguggucccacccc

SEQ ID NO: 3168531 - RNA, 15 nt, Human
acccuugugguccca

SEQ ID NO: 3168532 - RNA, 23 nt, Human
acccuuccaucugauuccagcac

SEQ ID NO: 3168533 - RNA, 11 nt, Human
acccugcccug

SEQ ID NO: 3168534 - RNA, 12 nt, Human
acccugcccugu

SEQ ID NO: 3168535 - RNA, 13 nt, Human
acccugcccugug

SEQ ID NO: 3168536 - RNA, 14 nt, Human
acccucuuagaaaa

SEQ ID NO: 3168537 - RNA, 14 nt, Human
ucaggcccaaagcc

SEQ ID NO: 3168538 - RNA, 22 nt, Human
ucaggcauuuucccccuuggcu

SEQ ID NO: 3168539 - RNA, 15 nt, Human
ucaggccgaaggagg

SEQ ID NO: 3168540 - RNA, 15 nt, Human
ucaggccagcugcuu

SEQ ID NO: 3168541 - RNA, 20 nt, Human
ucaggccagcugcuugggcu

SEQ ID NO: 3168542 - RNA, 11 nt, Human
ucaggccaggc

SEQ ID NO: 3168543 - RNA, 14 nt, Human
ucaggccagcugcu

SEQ ID NO: 3168544 - RNA, 19 nt, Human
accccuucgcuccuguguc

SEQ ID NO: 3168545 - RNA, 16 nt, Human
ucagguaacaggcaga

SEQ ID NO: 3168546 - RNA, 15 nt, Human
ucagguaacaggcag

SEQ ID NO: 3168547 - RNA, 13 nt, Human
ucagguaacaggc

SEQ ID NO: 3168548 - RNA, 14 nt, Human
ucagggucccuggu

SEQ ID NO: 3168549 - RNA, 18 nt, Human
ucagggucccugguggca

SEQ ID NO: 3168550 - RNA, 23 nt, Human
ucaggggugugcggccuuuggcu

SEQ ID NO: 3168551 - RNA, 13 nt, Human
ucagggucccugg

SEQ ID NO: 3168552 - RNA, 17 nt, Human
ucagcggggacagcucc

SEQ ID NO: 3168553 - RNA, 16 nt, Human
ucagcggggacagcuc

SEQ ID NO: 3168554 - RNA, 15 nt, Human
ucagcggggacagcu

SEQ ID NO: 3168555 - RNA, 20 nt, Human
ucaggccaaacucaccugcc

SEQ ID NO: 3168556 - RNA, 23 nt, Human
ucaggccaaacucaccugccccu

SEQ ID NO: 3168557 - RNA, 17 nt, Human
ucaggcauuuucccccu

SEQ ID NO: 3168558 - RNA, 16 nt, Human
ucaggaagcucagggc

SEQ ID NO: 3168559 - RNA, 17 nt, Human
ucaggaagcucagggcc

SEQ ID NO: 3168560 - RNA, 19 nt, Human
ucaggaagcucagggccug

SEQ ID NO: 3168561 - RNA, 20 nt, Human
ucaggaagcucagggccugg

SEQ ID NO: 3168562 - RNA, 18 nt, Human
ucagcccucccugccccu

SEQ ID NO: 3168563 - RNA, 19 nt, Human
ucagcccucccugccccuc

SEQ ID NO: 3168564 - RNA, 17 nt, Human
ucagcccucccugcccc

SEQ ID NO: 3168565 - RNA, 22 nt, Human
acccagcuaugguucucucgca

SEQ ID NO: 3168566 - RNA, 13 nt, Human
acccagcucuggu

SEQ ID NO: 3168567 - RNA, 15 nt, Human
acccagcucuggucc

SEQ ID NO: 3168568 - RNA, 20 nt, Human
acccagguuuugcacucuug

SEQ ID NO: 3168569 - RNA, 20 nt, Human
acccagcugcaccccuuccu

SEQ ID NO: 3168570 - RNA, 14 nt, Human
acccagcugcaccc

SEQ ID NO: 3168571 - RNA, 13 nt, Human
acccagcugcacc

SEQ ID NO: 3168572 - RNA, 16 nt, Human
acccagguguggccua

SEQ ID NO: 3168573 - RNA, 23 nt, Human
acccaggugcuaggaacacuccu

SEQ ID NO: 3168574 - RNA, 22 nt, Human
ucagauuugccuuauuggcagc

SEQ ID NO: 3168575 - RNA, 16 nt, Human
ucagauguuuaaaaca

SEQ ID NO: 3168576 - RNA, 16 nt, Human
ucagauucaggcauuu

SEQ ID NO: 3168577 - RNA, 13 nt, Human
ucagauucaggca

SEQ ID NO: 3168578 - RNA, 15 nt, Human
ucagauguuaaaaua

SEQ ID NO: 3168579 - RNA, 16 nt, Human
ucagauguuaaaauaa

SEQ ID NO: 3168580 - RNA, 17 nt, Human
ucagauguuaaaauaaa

SEQ ID NO: 3168581 - RNA, 18 nt, Human
ucagauguuaaaauaaau

SEQ ID NO: 3168582 - RNA, 20 nt, Human
ucagauguuaaaauaaaugg

SEQ ID NO: 3168583 - RNA, 13 nt, Human
ucagauguuuaaa

SEQ ID NO: 3168584 - RNA, 15 nt, Human
ucagauguuuaaaac

SEQ ID NO: 3168585 - RNA, 17 nt, Human
ucagauguuuaaaacac

SEQ ID NO: 3168586 - RNA, 12 nt, Human
ucagauguuuga

SEQ ID NO: 3168587 - RNA, 14 nt, Human
ucagaagaaauaaa

SEQ ID NO: 3168588 - RNA, 16 nt, Human
ucagaagaaauaaaua

SEQ ID NO: 3168589 - RNA, 14 nt, Human
ucagaagaaaauua

SEQ ID NO: 3168590 - RNA, 13 nt, Human
ucagaagacacug

SEQ ID NO: 3168591 - RNA, 13 nt, Human
ucagaucuucugu

SEQ ID NO: 3168592 - RNA, 15 nt, Human
ucagaacuguuuuug

SEQ ID NO: 3168593 - RNA, 22 nt, Human
accccuggcuccaggccagggg

SEQ ID NO: 3168594 - RNA, 12 nt, Human
accccuggcuuu

SEQ ID NO: 3168595 - RNA, 20 nt, Human
accccuggcuccaggccagg

SEQ ID NO: 3168596 - RNA, 19 nt, Human
accccuggcuccaggccag

SEQ ID NO: 3168597 - RNA, 17 nt, Human
accccuggaccccagcc

SEQ ID NO: 3168598 - RNA, 20 nt, Human
accccuggaccccagccuca

SEQ ID NO: 3168599 - RNA, 18 nt, Human
accccuggaccccagccu

SEQ ID NO: 3168600 - RNA, 23 nt, Human
accccuggaccccagccucaaau

SEQ ID NO: 3168601 - RNA, 17 nt, Human
accccuucccauuccau

SEQ ID NO: 3168602 - RNA, 10 nt, Human
ucagccuggg

SEQ ID NO: 3168603 - RNA, 12 nt, Human
ucagccugggca

SEQ ID NO: 3168604 - RNA, 15 nt, Human
accccuggcuuuuca

SEQ ID NO: 3168605 - RNA, 16 nt, Human
acccccaggaccccug

SEQ ID NO: 3168606 - RNA, 16 nt, Human
acccccauucuguccu

SEQ ID NO: 3168607 - RNA, 15 nt, Human
acccccauucugucc

SEQ ID NO: 3168608 - RNA, 13 nt, Human
acccccagcuccc

SEQ ID NO: 3168609 - RNA, 12 nt, Human
acccccagcucc

SEQ ID NO: 3168610 - RNA, 20 nt, Human
accccauggccggcuuucag

SEQ ID NO: 3168611 - RNA, 14 nt, Human
accccauggccggc

SEQ ID NO: 3168612 - RNA, 18 nt, Human
accccaucugugaauaag

SEQ ID NO: 3168613 - RNA, 16 nt, Human
accccaucugugaaua

SEQ ID NO: 3168614 - RNA, 15 nt, Human
accccaucugugaau

SEQ ID NO: 3168615 - RNA, 14 nt, Human
acccccagccugcu

SEQ ID NO: 3168616 - RNA, 15 nt, Human
acccccagccugcua

SEQ ID NO: 3168617 - RNA, 22 nt, Human
ucccucauccucauacccaccc

SEQ ID NO: 3168618 - RNA, 21 nt, Human
ucccucagucuggcccuuccu

SEQ ID NO: 3168619 - RNA, 20 nt, Human
ucccucagucuggcccuucc

SEQ ID NO: 3168620 - RNA, 22 nt, Human
acucauugaccugaggcccuuc

SEQ ID NO: 3168621 - RNA, 20 nt, Human
acucauugcaucauuuacaa

SEQ ID NO: 3168622 - RNA, 17 nt, Human
acucaugcaugcaaauu

SEQ ID NO: 3168623 - RNA, 21 nt, Human
acuccaaagaaauguaaggga

SEQ ID NO: 3168624 - RNA, 18 nt, Human
acuccaacauccacucuc

SEQ ID NO: 3168625 - RNA, 17 nt, Human
acuccaacauccacucu

SEQ ID NO: 3168626 - RNA, 16 nt, Human
acuccaacauccacuc

SEQ ID NO: 3168627 - RNA, 15 nt, Human
acuccaacauccacu

SEQ ID NO: 3168628 - RNA, 19 nt, Human
acuccaacauccacucucu

SEQ ID NO: 3168629 - RNA, 20 nt, Human
acuccagcuggguuggaaaa

SEQ ID NO: 3168630 - RNA, 14 nt, Human
acuccuaccuggua

SEQ ID NO: 3168631 - RNA, 23 nt, Human
acuccaguagcgagagacggcac

SEQ ID NO: 3168632 - RNA, 14 nt, Human
uccgucacuaccug

SEQ ID NO: 3168633 - RNA, 18 nt, Human
uccgucacuaccuggcug

SEQ ID NO: 3168634 - RNA, 17 nt, Human
uccgucacuaccuggcu

SEQ ID NO: 3168635 - RNA, 16 nt, Human
uccgucacuaccuggc

SEQ ID NO: 3168636 - RNA, 15 nt, Human
uccgucacuaccugg

SEQ ID NO: 3168637 - RNA, 22 nt, Human
ucccuuugacgccaucccagcc

SEQ ID NO: 3168638 - RNA, 23 nt, Human
ucccuuugacgccaucccagccc

SEQ ID NO: 3168639 - RNA, 21 nt, Human
ucccuuugacgccaucccagc

SEQ ID NO: 3168640 - RNA, 14 nt, Human
uccuaggcauuugc

SEQ ID NO: 3168641 - RNA, 21 nt, Human
uccuaaaaggcccagagagaa

SEQ ID NO: 3168642 - RNA, 18 nt, Human
uccuaaaaggcccagaga

SEQ ID NO: 3168643 - RNA, 16 nt, Human
uccuaaaaggcccaga

SEQ ID NO: 3168644 - RNA, 15 nt, Human
uccuaaaaggcccag

SEQ ID NO: 3168645 - RNA, 13 nt, Human
uccuaaaaggccc

SEQ ID NO: 3168646 - RNA, 21 nt, Human
uccguuugauuugucacugcu

SEQ ID NO: 3168647 - RNA, 20 nt, Human
uccguuugauuugucacugc

SEQ ID NO: 3168648 - RNA, 22 nt, Human
ucccuuuccaaaugcccagcuu

SEQ ID NO: 3168649 - RNA, 17 nt, Human
ucccuuucauuugcuau

SEQ ID NO: 3168650 - RNA, 20 nt, Human
ucccuuuagcuguguuauua

SEQ ID NO: 3168651 - RNA, 18 nt, Human
ucccuuuagcuguguuau

SEQ ID NO: 3168652 - RNA, 17 nt, Human
ucccuuuagcuguguua

SEQ ID NO: 3168653 - RNA, 18 nt, Human
ucccuuacgugaguccug

SEQ ID NO: 3168654 - RNA, 22 nt, Human
ucccuuacgugaguccuggcau

SEQ ID NO: 3168655 - RNA, 21 nt, Human
ucccuucaaccauuccccaug

SEQ ID NO: 3168656 - RNA, 11 nt, Human
ucccuucaacc

SEQ ID NO: 3168657 - RNA, 21 nt, Human
ucccuuacuuuaccucucugu

SEQ ID NO: 3168658 - RNA, 17 nt, Human
ucccuuacgugaguccu

SEQ ID NO: 3168659 - RNA, 23 nt, Human
ucccugguggcagcucaccucuc

SEQ ID NO: 3168660 - RNA, 23 nt, Human
acuccugcacacgcuccuuccuc

SEQ ID NO: 3168661 - RNA, 18 nt, Human
ucccugguucaagcgauu

SEQ ID NO: 3168662 - RNA, 14 nt, Human
ucccugguucaagc

SEQ ID NO: 3168663 - RNA, 21 nt, Human
ucccuguaauuguuguuugua

SEQ ID NO: 3168664 - RNA, 20 nt, Human
ucccuguaauuguuguuugu

SEQ ID NO: 3168665 - RNA, 20 nt, Human
ucccuguguuaauuuaaguu

SEQ ID NO: 3168666 - RNA, 17 nt, Human
acucuggaaaaggcaua

SEQ ID NO: 3168667 - RNA, 12 nt, Human
acucuggaaaag

SEQ ID NO: 3168668 - RNA, 13 nt, Human
acucugcagacug

SEQ ID NO: 3168669 - RNA, 18 nt, Human
acucuccucugcugcugg

SEQ ID NO: 3168670 - RNA, 19 nt, Human
acucuccucugcugcuggc

SEQ ID NO: 3168671 - RNA, 16 nt, Human
acucuccucugcugcu

SEQ ID NO: 3168672 - RNA, 19 nt, Human
acucugaauuuaucuuuga

SEQ ID NO: 3168673 - RNA, 18 nt, Human
acucugaauuuaucuuug

SEQ ID NO: 3168674 - RNA, 17 nt, Human
acucugaauuuaucuuu

SEQ ID NO: 3168675 - RNA, 15 nt, Human
acucugaauuuaucu

SEQ ID NO: 3168676 - RNA, 23 nt, Human
acucugaauaagcacuuuuuaaa

SEQ ID NO: 3168677 - RNA, 22 nt, Human
acucugaauaagcacuuuuuaa

SEQ ID NO: 3168678 - RNA, 20 nt, Human
acucugaauaagcacuuuuu

SEQ ID NO: 3168679 - RNA, 17 nt, Human
acucuccucugcugcug

SEQ ID NO: 3168680 - RNA, 18 nt, Human
acucgguguccccaccau

SEQ ID NO: 3168681 - RNA, 14 nt, Human
acucggugucccca

SEQ ID NO: 3168682 - RNA, 23 nt, Human
acucgguguccccaccaucugcu

SEQ ID NO: 3168683 - RNA, 22 nt, Human
acucgguguccccaccaucugc

SEQ ID NO: 3168684 - RNA, 18 nt, Human
acucgcgacaaugcaaac

SEQ ID NO: 3168685 - RNA, 15 nt, Human
uccuaggcuggaagg

SEQ ID NO: 3168686 - RNA, 20 nt, Human
uccuaggcuggaaggaggaa

SEQ ID NO: 3168687 - RNA, 18 nt, Human
uccuaggggaaugagggg

SEQ ID NO: 3168688 - RNA, 19 nt, Human
uccuaggcauuugcugaau

SEQ ID NO: 3168689 - RNA, 20 nt, Human
acucgcgacaaugcaaacca

SEQ ID NO: 3168690 - RNA, 23 nt, Human
acucgcgacaaugcaaaccauca

SEQ ID NO: 3168691 - RNA, 17 nt, Human
acucgcgacaaugcaaa

SEQ ID NO: 3168692 - RNA, 20 nt, Human
uccucagaucuucugugggu

SEQ ID NO: 3168693 - RNA, 15 nt, Human
uccucaacaguguuu

SEQ ID NO: 3168694 - RNA, 20 nt, Human
uccucacaggugucuccaua

SEQ ID NO: 3168695 - RNA, 20 nt, Human
uccucaaaacuucagacaua

SEQ ID NO: 3168696 - RNA, 17 nt, Human
uccucaaaaugggagau

SEQ ID NO: 3168697 - RNA, 16 nt, Human
acucuuauugcccacg

SEQ ID NO: 3168698 - RNA, 14 nt, Human
uccucauacccacc

SEQ ID NO: 3168699 - RNA, 18 nt, Human
uccucauacccaccccca

SEQ ID NO: 3168700 - RNA, 16 nt, Human
uccuccccuccuccug

SEQ ID NO: 3168701 - RNA, 18 nt, Human
uccuccccuccuccugga

SEQ ID NO: 3168702 - RNA, 20 nt, Human
uccuccccuccuccuggacu

SEQ ID NO: 3168703 - RNA, 22 nt, Human
uccuccccuccuccuggacucc

SEQ ID NO: 3168704 - RNA, 15 nt, Human
uccuccccuggacuc

SEQ ID NO: 3168705 - RNA, 14 nt, Human
uccuccccuggacu

SEQ ID NO: 3168706 - RNA, 15 nt, Human
uccucccucccucuu

SEQ ID NO: 3168707 - RNA, 17 nt, Human
uccucccucccucuuuc

SEQ ID NO: 3168708 - RNA, 19 nt, Human
uccucccucccucuuuccc

SEQ ID NO: 3168709 - RNA, 12 nt, Human
uccucuccccag

SEQ ID NO: 3168710 - RNA, 15 nt, Human
uccucuccacugccu

SEQ ID NO: 3168711 - RNA, 14 nt, Human
uccucuccacugcc

SEQ ID NO: 3168712 - RNA, 13 nt, Human
uccucuccacugc

SEQ ID NO: 3168713 - RNA, 12 nt, Human
uccucuccacug

SEQ ID NO: 3168714 - RNA, 13 nt, Human
acuaucuucaucu

SEQ ID NO: 3168715 - RNA, 18 nt, Human
acuauguugcccaggcag

SEQ ID NO: 3168716 - RNA, 17 nt, Human
acuauguugcccaggca

SEQ ID NO: 3168717 - RNA, 18 nt, Human
acuaucccggcugcccuu

SEQ ID NO: 3168718 - RNA, 22 nt, Human
acuaucuuaucucagauauuug

SEQ ID NO: 3168719 - RNA, 16 nt, Human
acuaucccggcugccc

SEQ ID NO: 3168720 - RNA, 17 nt, Human
acuaucccggcugcccu

SEQ ID NO: 3168721 - RNA, 22 nt, Human
acuaucaugucaaacgugaaaa

SEQ ID NO: 3168722 - RNA, 20 nt, Human
acuauguugcccaggcaggu

SEQ ID NO: 3168723 - RNA, 19 nt, Human
acuauguugcccaggcagg

SEQ ID NO: 3168724 - RNA, 23 nt, Human
acuauguugcccaggcaggucuu

SEQ ID NO: 3168725 - RNA, 22 nt, Human
acuauguuuuaucguccaguga

SEQ ID NO: 3168726 - RNA, 14 nt, Human
acucaaauuuuggc

SEQ ID NO: 3168727 - RNA, 23 nt, Human
acucaaauuuuggcgaaucucaa

SEQ ID NO: 3168728 - RNA, 15 nt, Human
acucaaccaaauggu

SEQ ID NO: 3168729 - RNA, 21 nt, Human
acucaaccaaaugguacaaaa

SEQ ID NO: 3168730 - RNA, 16 nt, Human
acucaaccaaauggua

SEQ ID NO: 3168731 - RNA, 23 nt, Human
uccccaggaggccagccuugacc

SEQ ID NO: 3168732 - RNA, 24 nt, Human
uccccaccgcagacaggaccaggg

SEQ ID NO: 3168733 - RNA, 23 nt, Human
uccccaauaucuugcuugaacuu

SEQ ID NO: 3168734 - RNA, 23 nt, Human
acuauaauuuaccugaagucuuu

SEQ ID NO: 3168735 - RNA, 21 nt, Human
acuauaauguaagcucuacug

SEQ ID NO: 3168736 - RNA, 17 nt, Human
acuauagccuaggugac

SEQ ID NO: 3168737 - RNA, 16 nt, Human
acuauagcaaaguagu

SEQ ID NO: 3168738 - RNA, 20 nt, Human
acuauagcaaaguaguacuu

SEQ ID NO: 3168739 - RNA, 22 nt, Human
acuauauacaucacguuaaagu

SEQ ID NO: 3168740 - RNA, 15 nt, Human
acuauaaugugaaau

SEQ ID NO: 3168741 - RNA, 19 nt, Human
acuauaaugugaaauguaa

SEQ ID NO: 3168742 - RNA, 21 nt, Human
acuauaaugugaaauguaacu

SEQ ID NO: 3168743 - RNA, 14 nt, Human
uccccuugcagccg

SEQ ID NO: 3168744 - RNA, 14 nt, Human
uccccuugccagcu

SEQ ID NO: 3168745 - RNA, 22 nt, Human
uccccuugccagcugcugagcc

SEQ ID NO: 3168746 - RNA, 17 nt, Human
uccccuugccagcugcu

SEQ ID NO: 3168747 - RNA, 16 nt, Human
uccccuugccagcugc

SEQ ID NO: 3168748 - RNA, 15 nt, Human
uccccuugccagcug

SEQ ID NO: 3168749 - RNA, 16 nt, Human
ucccgaauagcuggga

SEQ ID NO: 3168750 - RNA, 15 nt, Human
ucccgaauagcuggg

SEQ ID NO: 3168751 - RNA, 18 nt, Human
uccccucagaaggucugu

SEQ ID NO: 3168752 - RNA, 20 nt, Human
ucccgcccaaaccuuucccc

SEQ ID NO: 3168753 - RNA, 19 nt, Human
ucccgcccaaaccuuuccc

SEQ ID NO: 3168754 - RNA, 21 nt, Human
ucccgccuccaaccccucgcc

SEQ ID NO: 3168755 - RNA, 15 nt, Human
ucccgccuccaaccc

SEQ ID NO: 3168756 - RNA, 13 nt, Human
ucccgcucagccc

SEQ ID NO: 3168757 - RNA, 20 nt, Human
ucccgcucagcccucccugc

SEQ ID NO: 3168758 - RNA, 16 nt, Human
ucccgcucagcccucc

SEQ ID NO: 3168759 - RNA, 15 nt, Human
ucccgcucagcccuc

SEQ ID NO: 3168760 - RNA, 14 nt, Human
ucccgcucagcccu

SEQ ID NO: 3168761 - RNA, 20 nt, Human
ucccgaguagcugggacuac

SEQ ID NO: 3168762 - RNA, 18 nt, Human
ucccgcccaaaccuuucc

SEQ ID NO: 3168763 - RNA, 18 nt, Human
ucccuauuagagaagaga

SEQ ID NO: 3168764 - RNA, 16 nt, Human
ucccuauuagagaaga

SEQ ID NO: 3168765 - RNA, 19 nt, Human
ucccagugccgagaaggaa

SEQ ID NO: 3168766 - RNA, 22 nt, Human
ucccagugccgagaaggaagcc

SEQ ID NO: 3168767 - RNA, 16 nt, Human
acuacaguccucccau

SEQ ID NO: 3168768 - RNA, 16 nt, Human
acuacauauugaauag

SEQ ID NO: 3168769 - RNA, 14 nt, Human
ucccaucucacaca

SEQ ID NO: 3168770 - RNA, 19 nt, Human
ucccaucucacacaugagc

SEQ ID NO: 3168771 - RNA, 13 nt, Human
ucccaucucacac

SEQ ID NO: 3168772 - RNA, 15 nt, Human
ucccauaugccuggg

SEQ ID NO: 3168773 - RNA, 20 nt, Human
ucccauaucaaaagacacag

SEQ ID NO: 3168774 - RNA, 22 nt, Human
uccccaccgcagacaggaccag

SEQ ID NO: 3168775 - RNA, 23 nt, Human
uccccaaggcccccugccugccc

SEQ ID NO: 3168776 - RNA, 21 nt, Human
uccccaaggcccccugccugc

SEQ ID NO: 3168777 - RNA, 20 nt, Human
uccccaaggcccccugccug

SEQ ID NO: 3168778 - RNA, 19 nt, Human
uccccaaggcccccugccu

SEQ ID NO: 3168779 - RNA, 15 nt, Human
uccccaagccuggca

SEQ ID NO: 3168780 - RNA, 14 nt, Human
acuaaaauaauuuu

SEQ ID NO: 3168781 - RNA, 16 nt, Human
acuaaaauguaucuaa

SEQ ID NO: 3168782 - RNA, 20 nt, Human
acuaaaauaauuuuguaaug

SEQ ID NO: 3168783 - RNA, 19 nt, Human
acuaaaauaauuuuguaau

SEQ ID NO: 3168784 - RNA, 17 nt, Human
acuaaaauaauuuugua

SEQ ID NO: 3168785 - RNA, 16 nt, Human
acuaaaauaauuuugu

SEQ ID NO: 3168786 - RNA, 15 nt, Human
acuaaaauaauuuug

SEQ ID NO: 3168787 - RNA, 20 nt, Human
acuaaaguuguacuuuaaaa

SEQ ID NO: 3168788 - RNA, 15 nt, Human
acuaaaguuguacuu

SEQ ID NO: 3168789 - RNA, 22 nt, Human
acuaaacucugaauaagcacuu

SEQ ID NO: 3168790 - RNA, 21 nt, Human
acuaaacucugaauaagcacu

SEQ ID NO: 3168791 - RNA, 12 nt, Human
acuaaccacgcu

SEQ ID NO: 3168792 - RNA, 22 nt, Human
acuaaaguuguacuuuaaaaau

SEQ ID NO: 3168793 - RNA, 13 nt, Human
acuaaccacgcug

SEQ ID NO: 3168794 - RNA, 23 nt, Human
acuacaggugugagucaccaagc

SEQ ID NO: 3168795 - RNA, 15 nt, Human
acuacaguccuccca

SEQ ID NO: 3168796 - RNA, 20 nt, Human
acuacagucaagauagaaag

SEQ ID NO: 3168797 - RNA, 13 nt, Human
acuaaaaauacaa

SEQ ID NO: 3168798 - RNA, 18 nt, Human
acguuuuaaggacugacu

SEQ ID NO: 3168799 - RNA, 19 nt, Human
acguuuuaaggacugacug

SEQ ID NO: 3168800 - RNA, 14 nt, Human
uccagcucaccagc

SEQ ID NO: 3168801 - RNA, 24 nt, Human
uccagccugggugacagagcaagu

SEQ ID NO: 3168802 - RNA, 13 nt, Human
uccagccugggug

SEQ ID NO: 3168803 - RNA, 12 nt, Human
ucgacacagagu

SEQ ID NO: 3168804 - RNA, 13 nt, Human
ucgaccugccucg

SEQ ID NO: 3168805 - RNA, 22 nt, Human
ucgacgcccgaguuagccucac

SEQ ID NO: 3168806 - RNA, 14 nt, Human
ucgagcaugccugg

SEQ ID NO: 3168807 - RNA, 13 nt, Human
ucgaggacaggga

SEQ ID NO: 3168808 - RNA, 16 nt, Human
ucgccuuucagcaggc

SEQ ID NO: 3168809 - RNA, 14 nt, Human
ucgccuuucagcag

SEQ ID NO: 3168810 - RNA, 19 nt, Human
ucgccuuccaccucuggga

SEQ ID NO: 3168811 - RNA, 15 nt, Human
ucgccuuccaccucu

SEQ ID NO: 3168812 - RNA, 22 nt, Human
ucgccuuucagcaggcagccuu

SEQ ID NO: 3168813 - RNA, 20 nt, Human
ucgccuuucagcaggcagcc

SEQ ID NO: 3168814 - RNA, 19 nt, Human
ucgccuuucagcaggcagc

SEQ ID NO: 3168815 - RNA, 13 nt, Human
ucgcgacaaugca

SEQ ID NO: 3168816 - RNA, 17 nt, Human
ucgaggacagggaggug

SEQ ID NO: 3168817 - RNA, 14 nt, Human
ucgaggacagggag

SEQ ID NO: 3168818 - RNA, 13 nt, Human
ucgaacuggcugc

SEQ ID NO: 3168819 - RNA, 14 nt, Human
ucgaacuggcugca

SEQ ID NO: 3168820 - RNA, 15 nt, Human
ucgaacuggcugcaa

SEQ ID NO: 3168821 - RNA, 13 nt, Human
uccuuuccaccuu

SEQ ID NO: 3168822 - RNA, 14 nt, Human
uccuuuccaccuuc

SEQ ID NO: 3168823 - RNA, 19 nt, Human
uccuuuccaccuucucaca

SEQ ID NO: 3168824 - RNA, 23 nt, Human
uccuuuagcgcccaguugggugg

SEQ ID NO: 3168825 - RNA, 19 nt, Human
uccuuucacaaccuucugu

SEQ ID NO: 3168826 - RNA, 18 nt, Human
uccuuucacaaccuucug

SEQ ID NO: 3168827 - RNA, 16 nt, Human
uccuuucacaaccuuc

SEQ ID NO: 3168828 - RNA, 15 nt, Human
uccuuucaccacaug

SEQ ID NO: 3168829 - RNA, 20 nt, Human
uccuuucacaaccuucugug

SEQ ID NO: 3168830 - RNA, 16 nt, Human
uccuuucacuucuuuc

SEQ ID NO: 3168831 - RNA, 13 nt, Human
uccuuucacuucu

SEQ ID NO: 3168832 - RNA, 20 nt, Human
uccuuucaguggcuuggacu

SEQ ID NO: 3168833 - RNA, 18 nt, Human
uccuuucacuucuuuccc

SEQ ID NO: 3168834 - RNA, 15 nt, Human
acuguacaaaguaga

SEQ ID NO: 3168835 - RNA, 14 nt, Human
acuguacaaaguag

SEQ ID NO: 3168836 - RNA, 13 nt, Human
acuguacaaagua

SEQ ID NO: 3168837 - RNA, 16 nt, Human
acuguaauuauuugaa

SEQ ID NO: 3168838 - RNA, 20 nt, Human
acuguaauuauuugaaugac

SEQ ID NO: 3168839 - RNA, 18 nt, Human
acuguaauuauuugaaug

SEQ ID NO: 3168840 - RNA, 17 nt, Human
acuguaauuauuugaau

SEQ ID NO: 3168841 - RNA, 14 nt, Human
acuguacuccuccc

SEQ ID NO: 3168842 - RNA, 13 nt, Human
acuguacuccucc

SEQ ID NO: 3168843 - RNA, 21 nt, Human
acuguacaugggacuaugcuu

SEQ ID NO: 3168844 - RNA, 23 nt, Human
acugggagccuacccacccccag

SEQ ID NO: 3168845 - RNA, 12 nt, Human
acugggagccua

SEQ ID NO: 3168846 - RNA, 22 nt, Human
acugggcuuggggaccagagcu

SEQ ID NO: 3168847 - RNA, 13 nt, Human
ucgcuccuguguc

SEQ ID NO: 3168848 - RNA, 12 nt, Human
ucgcuccugugu

SEQ ID NO: 3168849 - RNA, 18 nt, Human
acuggguacuuguggaca

SEQ ID NO: 3168850 - RNA, 23 nt, Human
acuggguacuuguggacacagcu

SEQ ID NO: 3168851 - RNA, 20 nt, Human
acuggguacuuguggacaca

SEQ ID NO: 3168852 - RNA, 19 nt, Human
acuggguacuuguggacac

SEQ ID NO: 3168853 - RNA, 13 nt, Human
uccuucagccuga

SEQ ID NO: 3168854 - RNA, 11 nt, Human
uccuucagugc

SEQ ID NO: 3168855 - RNA, 12 nt, Human
uccuucagugcc

SEQ ID NO: 3168856 - RNA, 13 nt, Human
uccuucagugccu

SEQ ID NO: 3168857 - RNA, 20 nt, Human
uccuucagugccuuauggaa

SEQ ID NO: 3168858 - RNA, 22 nt, Human
uccuucagugccuuauggaaca

SEQ ID NO: 3168859 - RNA, 17 nt, Human
uccuucccuugcuacca

SEQ ID NO: 3168860 - RNA, 16 nt, Human
uccuuccucugagccu

SEQ ID NO: 3168861 - RNA, 17 nt, Human
uccuuccucugagccuu

SEQ ID NO: 3168862 - RNA, 16 nt, Human
uccuuccucugaggcu

SEQ ID NO: 3168863 - RNA, 22 nt, Human
uccuuccuaguucaucccuucu

SEQ ID NO: 3168864 - RNA, 22 nt, Human
acuggcacaguuuucugagaaa

SEQ ID NO: 3168865 - RNA, 21 nt, Human
acuggcacaguuuucugagaa

SEQ ID NO: 3168866 - RNA, 14 nt, Human
acuggcaagaaaag

SEQ ID NO: 3168867 - RNA, 18 nt, Human
acuggcagggauaacaaa

SEQ ID NO: 3168868 - RNA, 16 nt, Human
acuggccucugcugau

SEQ ID NO: 3168869 - RNA, 23 nt, Human
acuggccucugcugauccuccca

SEQ ID NO: 3168870 - RNA, 19 nt, Human
acuggccuucugaugaaau

SEQ ID NO: 3168871 - RNA, 23 nt, Human
acuggccuucugaugaaauguua

SEQ ID NO: 3168872 - RNA, 22 nt, Human
acuggcugcaaaggguaucagg

SEQ ID NO: 3168873 - RNA, 14 nt, Human
uccuucagauauuu

SEQ ID NO: 3168874 - RNA, 17 nt, Human
uccuucagauauuuuua

SEQ ID NO: 3168875 - RNA, 15 nt, Human
uccuucagauauuuu

SEQ ID NO: 3168876 - RNA, 13 nt, Human
acugcagucacug

SEQ ID NO: 3168877 - RNA, 22 nt, Human
acugcucuugggcaauauucuc

SEQ ID NO: 3168878 - RNA, 19 nt, Human
acugcucuugggcaauauu

SEQ ID NO: 3168879 - RNA, 12 nt, Human
acugcucugaug

SEQ ID NO: 3168880 - RNA, 19 nt, Human
acugcuauuuuccuguucu

SEQ ID NO: 3168881 - RNA, 19 nt, Human
acugcuagucuuaagaacu

SEQ ID NO: 3168882 - RNA, 15 nt, Human
acuggauuauucagg

SEQ ID NO: 3168883 - RNA, 14 nt, Human
acuggauucuuauu

SEQ ID NO: 3168884 - RNA, 17 nt, Human
acugcuuccagugaggc

SEQ ID NO: 3168885 - RNA, 13 nt, Human
acugcuggcugcc

SEQ ID NO: 3168886 - RNA, 22 nt, Human
acugcuuccuauaauuuugaua

SEQ ID NO: 3168887 - RNA, 21 nt, Human
acugcuuccuauaauuuugau

SEQ ID NO: 3168888 - RNA, 18 nt, Human
acugcuuccuauaauuuu

SEQ ID NO: 3168889 - RNA, 17 nt, Human
acugcuuccuauaauuu

SEQ ID NO: 3168890 - RNA, 13 nt, Human
acugcuugaauaa

SEQ ID NO: 3168891 - RNA, 18 nt, Human
acugcuuccuuucuugau

SEQ ID NO: 3168892 - RNA, 17 nt, Human
acugcuuccuuucuuga

SEQ ID NO: 3168893 - RNA, 18 nt, Human
acugcuuccagugaggcu

SEQ ID NO: 3168894 - RNA, 21 nt, Human
acugcuuccagugaggcucug

SEQ ID NO: 3168895 - RNA, 22 nt, Human
acugcuuccagugaggcucugc

SEQ ID NO: 3168896 - RNA, 23 nt, Human
acugcuuccagugaggcucugcc

SEQ ID NO: 3168897 - RNA, 20 nt, Human
acugcugcuucauguuugcc

SEQ ID NO: 3168898 - RNA, 12 nt, Human
acugcuggcugc

SEQ ID NO: 3168899 - RNA, 18 nt, Human
acugcugcccagccucca

SEQ ID NO: 3168900 - RNA, 16 nt, Human
acugcugcccagccuc

SEQ ID NO: 3168901 - RNA, 21 nt, Human
acugcugcccagccuccaagc

SEQ ID NO: 3168902 - RNA, 16 nt, Human
uccugcacugacucug

SEQ ID NO: 3168903 - RNA, 21 nt, Human
uccugcacugacucuggaaaa

SEQ ID NO: 3168904 - RNA, 17 nt, Human
uccugcacugacucugg

SEQ ID NO: 3168905 - RNA, 15 nt, Human
uccugcaggcagcca

SEQ ID NO: 3168906 - RNA, 20 nt, Human
uccugauugguuucucuucu

SEQ ID NO: 3168907 - RNA, 23 nt, Human
uccugauugguuucucuucuccc

SEQ ID NO: 3168908 - RNA, 21 nt, Human
uccugauugguuucucuucuc

SEQ ID NO: 3168909 - RNA, 23 nt, Human
uccugcaaccaaacucccaucag

SEQ ID NO: 3168910 - RNA, 20 nt, Human
uccugcaaccaaacucccau

SEQ ID NO: 3168911 - RNA, 18 nt, Human
acugcacagugcaucuca

SEQ ID NO: 3168912 - RNA, 16 nt, Human
acugcacagugcaucu

SEQ ID NO: 3168913 - RNA, 23 nt, Human
uccugaggugaugaagacagccc

SEQ ID NO: 3168914 - RNA, 23 nt, Human
uccugauagcauaugacaaaugu

SEQ ID NO: 3168915 - RNA, 20 nt, Human
uccugaguagcugggauuac

SEQ ID NO: 3168916 - RNA, 16 nt, Human
uccugcaggcagccag

SEQ ID NO: 3168917 - RNA, 17 nt, Human
uccugcaggcagccagg

SEQ ID NO: 3168918 - RNA, 19 nt, Human
uccugcaggcagccaggcc

SEQ ID NO: 3168919 - RNA, 20 nt, Human
uccugcaggcagccaggcca

SEQ ID NO: 3168920 - RNA, 19 nt, Human
uccugccucagccucccaa

SEQ ID NO: 3168921 - RNA, 23 nt, Human
uccugcauugggugaucauucac

SEQ ID NO: 3168922 - RNA, 22 nt, Human
uccugcaggcagccaggccaca

SEQ ID NO: 3168923 - RNA, 20 nt, Human
uccugccucgaacuggcugc

SEQ ID NO: 3168924 - RNA, 17 nt, Human
uccugccucagccuccc

SEQ ID NO: 3168925 - RNA, 21 nt, Human
uccugccuccuugauauuugu

SEQ ID NO: 3168926 - RNA, 15 nt, Human
uccugcguguucuca

SEQ ID NO: 3168927 - RNA, 13 nt, Human
uccugcucugcuc

SEQ ID NO: 3168928 - RNA, 12 nt, Human
uccugcucugcu

SEQ ID NO: 3168929 - RNA, 11 nt, Human
uccugcucugc

SEQ ID NO: 3168930 - RNA, 13 nt, Human
uccugcucagcag

SEQ ID NO: 3168931 - RNA, 17 nt, Human
acugagcuuggaagcuu

SEQ ID NO: 3168932 - RNA, 12 nt, Human
acugagcuugga

SEQ ID NO: 3168933 - RNA, 16 nt, Human
acugagcuuggaagcu

SEQ ID NO: 3168934 - RNA, 13 nt, Human
acugagcuuggaa

SEQ ID NO: 3168935 - RNA, 15 nt, Human
uccucuccccagcaa

SEQ ID NO: 3168936 - RNA, 15 nt, Human
acugaggaccagcca

SEQ ID NO: 3168937 - RNA, 20 nt, Human
acugaggcaguuugaggauu

SEQ ID NO: 3168938 - RNA, 18 nt, Human
acugaggcaguuugagga

SEQ ID NO: 3168939 - RNA, 17 nt, Human
acugaggggaggggagc

SEQ ID NO: 3168940 - RNA, 22 nt, Human
acugaggggaggggagcauggg

SEQ ID NO: 3168941 - RNA, 22 nt, Human
acugcaaccuccgccucuuggg

SEQ ID NO: 3168942 - RNA, 16 nt, Human
acugcaaccuccgccu

SEQ ID NO: 3168943 - RNA, 20 nt, Human
acugcaaccuucgccaccug

SEQ ID NO: 3168944 - RNA, 14 nt, Human
acugcaaccuccgc

SEQ ID NO: 3168945 - RNA, 13 nt, Human
acugcaaccuccg

SEQ ID NO: 3168946 - RNA, 19 nt, Human
acugaguuagaauguugaa

SEQ ID NO: 3168947 - RNA, 16 nt, Human
acugagugccuuuugg

SEQ ID NO: 3168948 - RNA, 15 nt, Human
uccugucuucugcuu

SEQ ID NO: 3168949 - RNA, 14 nt, Human
uccugucuucugcu

SEQ ID NO: 3168950 - RNA, 13 nt, Human
uccugucuucugc

SEQ ID NO: 3168951 - RNA, 12 nt, Human
uccugucuucug

SEQ ID NO: 3168952 - RNA, 19 nt, Human
uccugucuucugcuuuguu

SEQ ID NO: 3168953 - RNA, 17 nt, Human
uccugucuucugcuuug

SEQ ID NO: 3168954 - RNA, 16 nt, Human
uccugucuucugcuuu

SEQ ID NO: 3168955 - RNA, 18 nt, Human
uccuggguucaagugauu

SEQ ID NO: 3168956 - RNA, 21 nt, Human
uccuguggaaggcagagaaau

SEQ ID NO: 3168957 - RNA, 22 nt, Human
uccuguggaaggcagagaaauc

SEQ ID NO: 3168958 - RNA, 23 nt, Human
uccuguggaaggcagagaaaucu

SEQ ID NO: 3168959 - RNA, 13 nt, Human
uccugugccaggu

SEQ ID NO: 3168960 - RNA, 18 nt, Human
uccugugacuucagcucu

SEQ ID NO: 3168961 - RNA, 15 nt, Human
uccugugagaugugu

SEQ ID NO: 3168962 - RNA, 17 nt, Human
uccugugagauguguau

SEQ ID NO: 3168963 - RNA, 22 nt, Human
uccugugagauguguaucagug

SEQ ID NO: 3168964 - RNA, 19 nt, Human
uccuguggccugccaguca

SEQ ID NO: 3168965 - RNA, 17 nt, Human
uccuguggccugccagu

SEQ ID NO: 3168966 - RNA, 22 nt, Human
uccuggggcccaaaugcuggcu

SEQ ID NO: 3168967 - RNA, 20 nt, Human
uccugggcuuuuguuuugcu

SEQ ID NO: 3168968 - RNA, 19 nt, Human
uccuggggcauccaugggg

SEQ ID NO: 3168969 - RNA, 23 nt, Human
uccugggcuuuuguuuugcuuuu

SEQ ID NO: 3168970 - RNA, 18 nt, Human
uccuggggaaccugaccc

SEQ ID NO: 3168971 - RNA, 19 nt, Human
uccuggggaaccugacccc

SEQ ID NO: 3168972 - RNA, 17 nt, Human
uccuggggcgcgugagg

SEQ ID NO: 3168973 - RNA, 23 nt, Human
uccuggggguucuuucuuccucu

SEQ ID NO: 3168974 - RNA, 22 nt, Human
uccuggggguucuuucuuccuc

SEQ ID NO: 3168975 - RNA, 21 nt, Human
uccuggggguucuuucuuccu

SEQ ID NO: 3168976 - RNA, 13 nt, Human
uccugcugcaguu

SEQ ID NO: 3168977 - RNA, 22 nt, Human
acugcagccuccgcuucccugg

SEQ ID NO: 3168978 - RNA, 23 nt, Human
acugcagccucaaccuccugggc

SEQ ID NO: 3168979 - RNA, 18 nt, Human
acugcagggacugccagu

SEQ ID NO: 3168980 - RNA, 17 nt, Human
acugcagggacugccag

SEQ ID NO: 3168981 - RNA, 16 nt, Human
acugcagggacugcca

SEQ ID NO: 3168982 - RNA, 13 nt, Human
acugcacuguuuu

SEQ ID NO: 3168983 - RNA, 22 nt, Human
acugcagccucaaccuccuggg

SEQ ID NO: 3168984 - RNA, 21 nt, Human
acugcagccucaaccuccugg

SEQ ID NO: 3168985 - RNA, 19 nt, Human
acugcagccucaaccuccu

SEQ ID NO: 3168986 - RNA, 16 nt, Human
uccuuaagagacaauu

SEQ ID NO: 3168987 - RNA, 13 nt, Human
uccuuaagagauu

SEQ ID NO: 3168988 - RNA, 12 nt, Human
acugcagaacag

SEQ ID NO: 3168989 - RNA, 24 nt, Human
uccugugucuugcaauggcagccu

SEQ ID NO: 3168990 - RNA, 23 nt, Human
uccugugucuugcaauggcagcc

SEQ ID NO: 3168991 - RNA, 16 nt, Human
uccugugucaguuuau

SEQ ID NO: 3168992 - RNA, 14 nt, Human
uccugugucaguuu

SEQ ID NO: 3168993 - RNA, 14 nt, Human
uccugugugugcgc

SEQ ID NO: 3168994 - RNA, 13 nt, Human
uccugugugugcg

SEQ ID NO: 3168995 - RNA, 18 nt, Human
uccugugugugcgccuac

SEQ ID NO: 3168996 - RNA, 19 nt, Human
uccuguucccaugagauga

SEQ ID NO: 3168997 - RNA, 17 nt, Human
uccuguugucaagaaua

SEQ ID NO: 3168998 - RNA, 23 nt, Human
uccuguuugggaagagcuuagaa

SEQ ID NO: 3168999 - RNA, 20 nt, Human
uccuguuucucagucucaca

SEQ ID NO: 3169000 - RNA, 16 nt, Human
uccuguuucaaguuca

SEQ ID NO: 3169001 - RNA, 14 nt, Human
aaggagacuguguu

SEQ ID NO: 3169002 - RNA, 22 nt, Human
aaggagaaucauguuucuuuga

SEQ ID NO: 3169003 - RNA, 20 nt, Human
aaggagaaucauguuucuuu

SEQ ID NO: 3169004 - RNA, 19 nt, Human
aaggagaaucauguuucuu

SEQ ID NO: 3169005 - RNA, 18 nt, Human
aaggagaaucauguuucu

SEQ ID NO: 3169006 - RNA, 15 nt, Human
aaggaaacccagcuc

SEQ ID NO: 3169007 - RNA, 16 nt, Human
aaggaagguaaaaagu

SEQ ID NO: 3169008 - RNA, 17 nt, Human
aaggaagguaguucaag

SEQ ID NO: 3169009 - RNA, 18 nt, Human
aaggaagguaaaaaguua

SEQ ID NO: 3169010 - RNA, 20 nt, Human
aaggaggaagagaaaaaaua

SEQ ID NO: 3169011 - RNA, 18 nt, Human
aaggaggaagagaaaaaa

SEQ ID NO: 3169012 - RNA, 15 nt, Human
aaggauaaaucauaa

SEQ ID NO: 3169013 - RNA, 19 nt, Human
aaggauaaaucauaaaguc

SEQ ID NO: 3169014 - RNA, 20 nt, Human
aaggauaaaucauaaaguca

SEQ ID NO: 3169015 - RNA, 22 nt, Human
aaggauaaaucauaaagucagu

SEQ ID NO: 3169016 - RNA, 11 nt, Human
aaggauccuga

SEQ ID NO: 3169017 - RNA, 12 nt, Human
aaggauccugag

SEQ ID NO: 3169018 - RNA, 20 nt, Human
aaggauccugagccagauuu

SEQ ID NO: 3169019 - RNA, 22 nt, Human
aaggauccugagccagauuuca

SEQ ID NO: 3169020 - RNA, 14 nt, Human
guugggagaauguc

SEQ ID NO: 3169021 - RNA, 21 nt, Human
guugggagaaugucaguaugu

SEQ ID NO: 3169022 - RNA, 17 nt, Human
guugggcuggugucacc

SEQ ID NO: 3169023 - RNA, 20 nt, Human
guugggacccaguggcaggg

SEQ ID NO: 3169024 - RNA, 16 nt, Human
guugggacccaguggc

SEQ ID NO: 3169025 - RNA, 22 nt, Human
guugggacccaguggcagggca

SEQ ID NO: 3169026 - RNA, 21 nt, Human
guugggacccaguggcagggc

SEQ ID NO: 3169027 - RNA, 23 nt, Human
guugggacccaguggcagggcac

SEQ ID NO: 3169028 - RNA, 21 nt, Human
guugggggaggggagacuuug

SEQ ID NO: 3169029 - RNA, 15 nt, Human
guugggcugguguca

SEQ ID NO: 3169030 - RNA, 22 nt, Human
guugguuccaagucuuugcuau

SEQ ID NO: 3169031 - RNA, 23 nt, Human
guuggcugggggccucagugcca

SEQ ID NO: 3169032 - RNA, 15 nt, Human
guugcugacuuagaa

SEQ ID NO: 3169033 - RNA, 20 nt, Human
guugcugauuuuauucuuga

SEQ ID NO: 3169034 - RNA, 18 nt, Human
guugcugauuuuauucuu

SEQ ID NO: 3169035 - RNA, 14 nt, Human
guugcugauuuuau

SEQ ID NO: 3169036 - RNA, 13 nt, Human
guugcugauuuua

SEQ ID NO: 3169037 - RNA, 15 nt, Human
guugcccaggcuggc

SEQ ID NO: 3169038 - RNA, 20 nt, Human
guugcccaggcuggagugca

SEQ ID NO: 3169039 - RNA, 16 nt, Human
guugcccaggcuggcg

SEQ ID NO: 3169040 - RNA, 14 nt, Human
aaggaugcccaaag

SEQ ID NO: 3169041 - RNA, 22 nt, Human
aaggaugccaagaaguuuaagg

SEQ ID NO: 3169042 - RNA, 20 nt, Human
aaggaugccaagaaguuuaa

SEQ ID NO: 3169043 - RNA, 14 nt, Human
aaggccccgcccag

SEQ ID NO: 3169044 - RNA, 16 nt, Human
aaggccccgcccaggc

SEQ ID NO: 3169045 - RNA, 19 nt, Human
aaggccccgcccaggcuua

SEQ ID NO: 3169046 - RNA, 15 nt, Human
aaggcccccugccug

SEQ ID NO: 3169047 - RNA, 14 nt, Human
aaggcccccugccu

SEQ ID NO: 3169048 - RNA, 19 nt, Human
aaggcccccugccugcccu

SEQ ID NO: 3169049 - RNA, 14 nt, Human
guugcccaggcugg

SEQ ID NO: 3169050 - RNA, 23 nt, Human
aaggcgcuaacuugcuuaaaugu

SEQ ID NO: 3169051 - RNA, 22 nt, Human
aaggcgcuaacuugcuuaaaug

SEQ ID NO: 3169052 - RNA, 18 nt, Human
aaggcgcuaacuugcuua

SEQ ID NO: 3169053 - RNA, 16 nt, Human
guguuuaugugugugu

SEQ ID NO: 3169054 - RNA, 14 nt, Human
guguuuauucuuga

SEQ ID NO: 3169055 - RNA, 16 nt, Human
guguuuaugugcuauu

SEQ ID NO: 3169056 - RNA, 18 nt, Human
guguuuaugugcuauuaa

SEQ ID NO: 3169057 - RNA, 12 nt, Human
guguuuaugugu

SEQ ID NO: 3169058 - RNA, 17 nt, Human
guguuuaucagaaaggg

SEQ ID NO: 3169059 - RNA, 18 nt, Human
guguuuauaucuccuuug

SEQ ID NO: 3169060 - RNA, 22 nt, Human
guguuuaagacauuuuuggaag

SEQ ID NO: 3169061 - RNA, 12 nt, Human
guguuuaacuga

SEQ ID NO: 3169062 - RNA, 15 nt, Human
guguuuagaauugaa

SEQ ID NO: 3169063 - RNA, 18 nt, Human
guguuuagaauugaaggu

SEQ ID NO: 3169064 - RNA, 14 nt, Human
guguuuacagagau

SEQ ID NO: 3169065 - RNA, 15 nt, Human
guguuuauucuugau

SEQ ID NO: 3169066 - RNA, 20 nt, Human
aagcuccaucuccacuccag

SEQ ID NO: 3169067 - RNA, 13 nt, Human
guguuuauuguca

SEQ ID NO: 3169068 - RNA, 11 nt, Human
aagcucccagg

SEQ ID NO: 3169069 - RNA, 16 nt, Human
aagcuccaucuuauuu

SEQ ID NO: 3169070 - RNA, 12 nt, Human
aagcucccaggc

SEQ ID NO: 3169071 - RNA, 22 nt, Human
aagcucccaggcauuccccagg

SEQ ID NO: 3169072 - RNA, 23 nt, Human
aagcucccaggcauuccccagga

SEQ ID NO: 3169073 - RNA, 21 nt, Human
aagcucuacugaggugcuaug

SEQ ID NO: 3169074 - RNA, 13 nt, Human
aagcuuuuuggaa

SEQ ID NO: 3169075 - RNA, 14 nt, Human
aagcuuuuuggaau

SEQ ID NO: 3169076 - RNA, 18 nt, Human
aagcuuuuuggaaucuuu

SEQ ID NO: 3169077 - RNA, 21 nt, Human
guuccccuggaagcagugccc

SEQ ID NO: 3169078 - RNA, 12 nt, Human
guuccccuggaa

SEQ ID NO: 3169079 - RNA, 17 nt, Human
guuccccuguucacucu

SEQ ID NO: 3169080 - RNA, 15 nt, Human
guuccccuguucacu

SEQ ID NO: 3169081 - RNA, 18 nt, Human
aagcuguuacugucuuca

SEQ ID NO: 3169082 - RNA, 13 nt, Human
aagcucugcuccu

SEQ ID NO: 3169083 - RNA, 19 nt, Human
aagcuguuggccucugcaa

SEQ ID NO: 3169084 - RNA, 18 nt, Human
aagcuguugaccaggcac

SEQ ID NO: 3169085 - RNA, 16 nt, Human
aagcuguucuuccugg

SEQ ID NO: 3169086 - RNA, 15 nt, Human
aagcuguucuuccug

SEQ ID NO: 3169087 - RNA, 14 nt, Human
aagcuguucuuccu

SEQ ID NO: 3169088 - RNA, 14 nt, Human
aagcuguuuggaaa

SEQ ID NO: 3169089 - RNA, 17 nt, Human
aagcuguuuggaaaaga

SEQ ID NO: 3169090 - RNA, 21 nt, Human
aagcuguuuggaaaagacagu

SEQ ID NO: 3169091 - RNA, 20 nt, Human
aagcuuugacucuauaagca

SEQ ID NO: 3169092 - RNA, 16 nt, Human
aagcuuuguuuguucu

SEQ ID NO: 3169093 - RNA, 20 nt, Human
aagcuuuguugaaagaaagu

SEQ ID NO: 3169094 - RNA, 18 nt, Human
guuccccuguucacucua

SEQ ID NO: 3169095 - RNA, 24 nt, Human
guuccccuggaagcagugcccagg

SEQ ID NO: 3169096 - RNA, 12 nt, Human
guucucugcccu

SEQ ID NO: 3169097 - RNA, 15 nt, Human
guucuguauuugaaa

SEQ ID NO: 3169098 - RNA, 20 nt, Human
guucuguauuugaaagugcc

SEQ ID NO: 3169099 - RNA, 16 nt, Human
guucugugacuaggaa

SEQ ID NO: 3169100 - RNA, 11 nt, Human
guucucugccc

SEQ ID NO: 3169101 - RNA, 16 nt, Human
guucucugaggacacu

SEQ ID NO: 3169102 - RNA, 14 nt, Human
guucucugaggaca

SEQ ID NO: 3169103 - RNA, 18 nt, Human
guucuguguauuuucagu

SEQ ID NO: 3169104 - RNA, 20 nt, Human
guucuguuacaaaauguaac

SEQ ID NO: 3169105 - RNA, 19 nt, Human
guucuguuacaaaauguaa

SEQ ID NO: 3169106 - RNA, 18 nt, Human
guucuguuacaaaaugua

SEQ ID NO: 3169107 - RNA, 14 nt, Human
guucuguuacaaaa

SEQ ID NO: 3169108 - RNA, 13 nt, Human
guucuguuacaaa

SEQ ID NO: 3169109 - RNA, 22 nt, Human
guucuguuacaaaauguaacug

SEQ ID NO: 3169110 - RNA, 21 nt, Human
guucuguuacaaaauguaacu

SEQ ID NO: 3169111 - RNA, 23 nt, Human
guugauagcacagacccugcccu

SEQ ID NO: 3169112 - RNA, 22 nt, Human
guugauagcacagacccugccc

SEQ ID NO: 3169113 - RNA, 15 nt, Human
guugagcuaugacuu

SEQ ID NO: 3169114 - RNA, 16 nt, Human
guugagcuaugacuua

SEQ ID NO: 3169115 - RNA, 12 nt, Human
guugagcuauga

SEQ ID NO: 3169116 - RNA, 19 nt, Human
guugacaucacuggcaugg

SEQ ID NO: 3169117 - RNA, 14 nt, Human
guugagaggacacu

SEQ ID NO: 3169118 - RNA, 18 nt, Human
guugagaggacacucccg

SEQ ID NO: 3169119 - RNA, 12 nt, Human
aaguaaaauguc

SEQ ID NO: 3169120 - RNA, 14 nt, Human
aaguaaaaugucuu

SEQ ID NO: 3169121 - RNA, 18 nt, Human
aaguaaaaccacagcagu

SEQ ID NO: 3169122 - RNA, 17 nt, Human
aaguaaaaccacagcag

SEQ ID NO: 3169123 - RNA, 16 nt, Human
guuucuagacuauaaa

SEQ ID NO: 3169124 - RNA, 21 nt, Human
guuucuaagguaacaagauga

SEQ ID NO: 3169125 - RNA, 17 nt, Human
guuucuaauuugcugcu

SEQ ID NO: 3169126 - RNA, 18 nt, Human
guuucuaauuugcugcug

SEQ ID NO: 3169127 - RNA, 23 nt, Human
guuucuaccggagagagaaugua

SEQ ID NO: 3169128 - RNA, 16 nt, Human
aaguaaaucucuucug

SEQ ID NO: 3169129 - RNA, 15 nt, Human
aaguaaaucucuucu

SEQ ID NO: 3169130 - RNA, 17 nt, Human
aaguaaaucucuucugu

SEQ ID NO: 3169131 - RNA, 14 nt, Human
aaguaaaaccacag

SEQ ID NO: 3169132 - RNA, 16 nt, Human
aaggguucuguaaaau

SEQ ID NO: 3169133 - RNA, 16 nt, Human
aaguaaaaccacagca

SEQ ID NO: 3169134 - RNA, 15 nt, Human
aaguaaaaccacagc

SEQ ID NO: 3169135 - RNA, 19 nt, Human
aagggugaugggaaagcau

SEQ ID NO: 3169136 - RNA, 21 nt, Human
aagggugaugggaaagcauug

SEQ ID NO: 3169137 - RNA, 13 nt, Human
aagggcccagaga

SEQ ID NO: 3169138 - RNA, 15 nt, Human
aagggcccagagagg

SEQ ID NO: 3169139 - RNA, 19 nt, Human
aaggcugagaggagagaga

SEQ ID NO: 3169140 - RNA, 22 nt, Human
aaggcugagacagugaauuugg

SEQ ID NO: 3169141 - RNA, 23 nt, Human
aaggcugagacagugaauuuggg

SEQ ID NO: 3169142 - RNA, 16 nt, Human
aaggguaucuggugac

SEQ ID NO: 3169143 - RNA, 19 nt, Human
aaggguaucaggugcugcc

SEQ ID NO: 3169144 - RNA, 17 nt, Human
aaggguaucaggugcug

SEQ ID NO: 3169145 - RNA, 14 nt, Human
guuugcuccccuuc

SEQ ID NO: 3169146 - RNA, 16 nt, Human
guuuuaagaggcaggg

SEQ ID NO: 3169147 - RNA, 14 nt, Human
guuuuaagaggcag

SEQ ID NO: 3169148 - RNA, 15 nt, Human
guuuucugagaaaga

SEQ ID NO: 3169149 - RNA, 16 nt, Human
guuuuacugcagcuuu

SEQ ID NO: 3169150 - RNA, 18 nt, Human
guuuuacugcagcuuugu

SEQ ID NO: 3169151 - RNA, 15 nt, Human
guuuuacugcagcuu

SEQ ID NO: 3169152 - RNA, 18 nt, Human
guuuuaaggacugacuga

SEQ ID NO: 3169153 - RNA, 19 nt, Human
guuuuaaggacugacugag

SEQ ID NO: 3169154 - RNA, 21 nt, Human
guuuuauaaggucugacauca

SEQ ID NO: 3169155 - RNA, 18 nt, Human
guuucugccgcagcccug

SEQ ID NO: 3169156 - RNA, 22 nt, Human
guuucugccgcagcccugcaga

SEQ ID NO: 3169157 - RNA, 15 nt, Human
guuucucccgugcuu

SEQ ID NO: 3169158 - RNA, 14 nt, Human
guuucucagcuccc

SEQ ID NO: 3169159 - RNA, 13 nt, Human
guuugcuaaguga

SEQ ID NO: 3169160 - RNA, 13 nt, Human
guuugcuaauguu

SEQ ID NO: 3169161 - RNA, 20 nt, Human
guuugcuaauguuuccauag

SEQ ID NO: 3169162 - RNA, 17 nt, Human
guuugccucugccucug

SEQ ID NO: 3169163 - RNA, 16 nt, Human
guuugccucugccucu

SEQ ID NO: 3169164 - RNA, 23 nt, Human
guuugcacucaaaucuuaagaaa

SEQ ID NO: 3169165 - RNA, 22 nt, Human
guuugcacucaaaucuuaagaa

SEQ ID NO: 3169166 - RNA, 21 nt, Human
guuugcacucaaaucuuaaga

SEQ ID NO: 3169167 - RNA, 19 nt, Human
guuugcacucaaaucuuaa

SEQ ID NO: 3169168 - RNA, 17 nt, Human
guuugcacucaaaucuu

SEQ ID NO: 3169169 - RNA, 13 nt, Human
aaguauucucuuu

SEQ ID NO: 3169170 - RNA, 20 nt, Human
aaguacugguaagauuguua

SEQ ID NO: 3169171 - RNA, 21 nt, Human
aaguacugguaagauuguuau

SEQ ID NO: 3169172 - RNA, 23 nt, Human
aaguacugguaagauuguuauua

SEQ ID NO: 3169173 - RNA, 20 nt, Human
aaguacuucuccacccugcu

SEQ ID NO: 3169174 - RNA, 15 nt, Human
aaguauguuuuacuu

SEQ ID NO: 3169175 - RNA, 23 nt, Human
aaguacuucuccacccugcucuc

SEQ ID NO: 3169176 - RNA, 22 nt, Human
aaguacuucuccacccugcucu

SEQ ID NO: 3169177 - RNA, 17 nt, Human
guuuucugagaaagacu

SEQ ID NO: 3169178 - RNA, 16 nt, Human
guuuucugagaaagac

SEQ ID NO: 3169179 - RNA, 22 nt, Human
guuuucugagaaagacuauuca

SEQ ID NO: 3169180 - RNA, 15 nt, Human
aaguacuauguauca

SEQ ID NO: 3169181 - RNA, 16 nt, Human
aaguacuauguaucaa

SEQ ID NO: 3169182 - RNA, 16 nt, Human
aaguacugagcaguga

SEQ ID NO: 3169183 - RNA, 15 nt, Human
guuuuauauccauuu

SEQ ID NO: 3169184 - RNA, 23 nt, Human
aaguacugagcagugauauucuu

SEQ ID NO: 3169185 - RNA, 15 nt, Human
aaguacuggagaaaa

SEQ ID NO: 3169186 - RNA, 21 nt, Human
aaguacuucuccacccugcuc

SEQ ID NO: 3169187 - RNA, 21 nt, Human
aagucaagugaaaaaggagga

SEQ ID NO: 3169188 - RNA, 24 nt, Human
aagucacacaguauuacuucugcu

SEQ ID NO: 3169189 - RNA, 19 nt, Human
aagucaaggguaggguggg

SEQ ID NO: 3169190 - RNA, 18 nt, Human
aaguauucuuauuuaaug

SEQ ID NO: 3169191 - RNA, 18 nt, Human
aaguauucucuuuucaag

SEQ ID NO: 3169192 - RNA, 13 nt, Human
aagucacacagug

SEQ ID NO: 3169193 - RNA, 13 nt, Human
aagucacaguuaa

SEQ ID NO: 3169194 - RNA, 16 nt, Human
aagucaccaaauagug

SEQ ID NO: 3169195 - RNA, 16 nt, Human
aagucacaguuaagga

SEQ ID NO: 3169196 - RNA, 20 nt, Human
aagucaguugcucaaaaaga

SEQ ID NO: 3169197 - RNA, 22 nt, Human
aagucaguugcucaaaaagaaa

SEQ ID NO: 3169198 - RNA, 19 nt, Human
aagucacaguuaaggagaa

SEQ ID NO: 3169199 - RNA, 12 nt, Human
aagucacugcac

SEQ ID NO: 3169200 - RNA, 22 nt, Human
aagucacugcaaaaccagguuu

SEQ ID NO: 3169201 - RNA, 19 nt, Human
aagucacugcaaaaccagg

SEQ ID NO: 3169202 - RNA, 13 nt, Human
guuuuuuuccagu

SEQ ID NO: 3169203 - RNA, 18 nt, Human
guuuuuuguuuuucugcu

SEQ ID NO: 3169204 - RNA, 13 nt, Human
guuuuuuuaauga

SEQ ID NO: 3169205 - RNA, 20 nt, Human
guuuuuuuaggguuucugau

SEQ ID NO: 3169206 - RNA, 9 nt, Human
guuuuuuga

SEQ ID NO: 3169207 - RNA, 16 nt, Human
guuuuuugaaguguug

SEQ ID NO: 3169208 - RNA, 9 nt, Human
guuuuuugu

SEQ ID NO: 3169209 - RNA, 18 nt, Human
guuuuuuguucuugcgau

SEQ ID NO: 3169210 - RNA, 17 nt, Human
guuuuuugaaguguugg

SEQ ID NO: 3169211 - RNA, 16 nt, Human
guuuuugucuuaaaaa

SEQ ID NO: 3169212 - RNA, 15 nt, Human
guuuuuguaaagauu

SEQ ID NO: 3169213 - RNA, 21 nt, Human
guuuuuguaaagaaaaauauu

SEQ ID NO: 3169214 - RNA, 20 nt, Human
guuuuuguaaagaaaaauau

SEQ ID NO: 3169215 - RNA, 19 nt, Human
guuuuuguaaagaaaaaua

SEQ ID NO: 3169216 - RNA, 15 nt, Human
guuuuuguaaagaaa

SEQ ID NO: 3169217 - RNA, 13 nt, Human
guuuuuguaaaga

SEQ ID NO: 3169218 - RNA, 12 nt, Human
guuuuuguaaag

SEQ ID NO: 3169219 - RNA, 18 nt, Human
guuuuuuaaaaaucugug

SEQ ID NO: 3169220 - RNA, 19 nt, Human
guuuuuguuuuuguuuugu

SEQ ID NO: 3169221 - RNA, 17 nt, Human
guuuuuguuuuguugca

SEQ ID NO: 3169222 - RNA, 14 nt, Human
guuuuuguuuuguu

SEQ ID NO: 3169223 - RNA, 14 nt, Human
guuuuuguauauug

SEQ ID NO: 3169224 - RNA, 22 nt, Human
guuuuuguaaagauuucuguuc

SEQ ID NO: 3169225 - RNA, 16 nt, Human
guuuuucugcuuuaga

SEQ ID NO: 3169226 - RNA, 18 nt, Human
guuuuucugcuuuagacu

SEQ ID NO: 3169227 - RNA, 19 nt, Human
guuuuucugcuuuagacuu

SEQ ID NO: 3169228 - RNA, 22 nt, Human
guuuuucugcuuuagacuugaa

SEQ ID NO: 3169229 - RNA, 14 nt, Human
guuuuucugcuuua

SEQ ID NO: 3169230 - RNA, 15 nt, Human
guuuuucugauaugu

SEQ ID NO: 3169231 - RNA, 17 nt, Human
aagucuuagauguauau

SEQ ID NO: 3169232 - RNA, 23 nt, Human
aagucaugauguuuuuaaaaucu

SEQ ID NO: 3169233 - RNA, 22 nt, Human
aagucaugauguuuuuaaaauc

SEQ ID NO: 3169234 - RNA, 21 nt, Human
aagucaugauguuuuuaaaau

SEQ ID NO: 3169235 - RNA, 19 nt, Human
aagucaugauguuuuuaaa

SEQ ID NO: 3169236 - RNA, 18 nt, Human
aagucaugauguuuuuaa

SEQ ID NO: 3169237 - RNA, 17 nt, Human
aagucaugauguuuuua

SEQ ID NO: 3169238 - RNA, 13 nt, Human
aagucaugauguu

SEQ ID NO: 3169239 - RNA, 19 nt, Human
aagucuuagauguauauau

SEQ ID NO: 3169240 - RNA, 18 nt, Human
aagucuuagauguauaua

SEQ ID NO: 3169241 - RNA, 14 nt, Human
aagugaauugaagu

SEQ ID NO: 3169242 - RNA, 15 nt, Human
aagugaauugaaguu

SEQ ID NO: 3169243 - RNA, 16 nt, Human
aagugaauugaaguuu

SEQ ID NO: 3169244 - RNA, 21 nt, Human
aagugaauugaaguuucaagu

SEQ ID NO: 3169245 - RNA, 18 nt, Human
guuuuucuaggccugggg

SEQ ID NO: 3169246 - RNA, 17 nt, Human
aagugacgguuccuaca

SEQ ID NO: 3169247 - RNA, 15 nt, Human
aagugacgguuccua

SEQ ID NO: 3169248 - RNA, 14 nt, Human
aagugacgguuccu

SEQ ID NO: 3169249 - RNA, 14 nt, Human
aagugagaaaacug

SEQ ID NO: 3169250 - RNA, 18 nt, Human
aagugaccaucauuucac

SEQ ID NO: 3169251 - RNA, 20 nt, Human
aagugaccgcaccucacacu

SEQ ID NO: 3169252 - RNA, 14 nt, Human
uaaauuuugaaaag

SEQ ID NO: 3169253 - RNA, 15 nt, Human
uaaauuuugaaaagu

SEQ ID NO: 3169254 - RNA, 22 nt, Human
uaaauuuugaaaaguaauauuu

SEQ ID NO: 3169255 - RNA, 15 nt, Human
uaaauuuuuuuguau

SEQ ID NO: 3169256 - RNA, 16 nt, Human
uaaauuuuuuuguaug

SEQ ID NO: 3169257 - RNA, 17 nt, Human
uaaauuuuuuuguauga

SEQ ID NO: 3169258 - RNA, 18 nt, Human
uaaauuuuuuuguaugaa

SEQ ID NO: 3169259 - RNA, 17 nt, Human
uaacaaauaacaacuuu

SEQ ID NO: 3169260 - RNA, 21 nt, Human
uaaauuuuuuuguaugaaaac

SEQ ID NO: 3169261 - RNA, 22 nt, Human
uaaauuuuuuuguaugaaaaca

SEQ ID NO: 3169262 - RNA, 18 nt, Human
uaacaaauaacaacuuuu

SEQ ID NO: 3169263 - RNA, 13 nt, Human
uaacaagccaccc

SEQ ID NO: 3169264 - RNA, 15 nt, Human
uaacaacugcccagu

SEQ ID NO: 3169265 - RNA, 22 nt, Human
uaacaacuaugauuuggaaaau

SEQ ID NO: 3169266 - RNA, 21 nt, Human
uaacaacuaugauuuggaaaa

SEQ ID NO: 3169267 - RNA, 16 nt, Human
uaacaacuaugauuug

SEQ ID NO: 3169268 - RNA, 20 nt, Human
uaacaacuuuuuuuucuuuu

SEQ ID NO: 3169269 - RNA, 14 nt, Human
uaacaagaaaauga

SEQ ID NO: 3169270 - RNA, 13 nt, Human
uaacaagaagcaa

SEQ ID NO: 3169271 - RNA, 22 nt, Human
uaaauguuuuguaaacuuugaa

SEQ ID NO: 3169272 - RNA, 21 nt, Human
uaaauguuuuguaaacuuuga

SEQ ID NO: 3169273 - RNA, 19 nt, Human
uaaauguuuuguaaacuuu

SEQ ID NO: 3169274 - RNA, 18 nt, Human
uaaauguuuuguaaacuu

SEQ ID NO: 3169275 - RNA, 16 nt, Human
uaaauguuuuguaaac

SEQ ID NO: 3169276 - RNA, 15 nt, Human
uaaauguuuuguaaa

SEQ ID NO: 3169277 - RNA, 14 nt, Human
uaaauguuuuguaa

SEQ ID NO: 3169278 - RNA, 12 nt, Human
uaaauguuuugu

SEQ ID NO: 3169279 - RNA, 11 nt, Human
uaaauuaauau

SEQ ID NO: 3169280 - RNA, 12 nt, Human
uaaauuaauauc

SEQ ID NO: 3169281 - RNA, 14 nt, Human
uaaauuaauaucuu

SEQ ID NO: 3169282 - RNA, 15 nt, Human
uaaauuaauaucuuu

SEQ ID NO: 3169283 - RNA, 17 nt, Human
uaaauuaauaucuuucu

SEQ ID NO: 3169284 - RNA, 23 nt, Human
uaaauguuuuguaaacuuugaaa

SEQ ID NO: 3169285 - RNA, 18 nt, Human
uaaauuaguacagcacuu

SEQ ID NO: 3169286 - RNA, 21 nt, Human
uaaauuacauuuguaauuuaa

SEQ ID NO: 3169287 - RNA, 16 nt, Human
uaaauuuguguaauau

SEQ ID NO: 3169288 - RNA, 23 nt, Human
uaaauuuguguaauauuacuuua

SEQ ID NO: 3169289 - RNA, 12 nt, Human
uaaauuuuaaag

SEQ ID NO: 3169290 - RNA, 13 nt, Human
uaaauuuuaaagc

SEQ ID NO: 3169291 - RNA, 14 nt, Human
uaaauuuuaaagcc

SEQ ID NO: 3169292 - RNA, 16 nt, Human
uaaauuuuaaagccau

SEQ ID NO: 3169293 - RNA, 17 nt, Human
uaaauuuuaacuaaauu

SEQ ID NO: 3169294 - RNA, 17 nt, Human
uaaauuacauuuguaau

SEQ ID NO: 3169295 - RNA, 16 nt, Human
uaaauuacauuuguaa

SEQ ID NO: 3169296 - RNA, 15 nt, Human
uaaauuacauuugua

SEQ ID NO: 3169297 - RNA, 16 nt, Human
uaaauuacuauagcaa

SEQ ID NO: 3169298 - RNA, 17 nt, Human
uaaauuacuauagcaaa

SEQ ID NO: 3169299 - RNA, 20 nt, Human
uaaauuacuauagcaaagua

SEQ ID NO: 3169300 - RNA, 23 nt, Human
uaaauuacuauagcaaaguagua

SEQ ID NO: 3169301 - RNA, 12 nt, Human
uaaauuagaaaa

SEQ ID NO: 3169302 - RNA, 13 nt, Human
uaaauuagaaaau

SEQ ID NO: 3169303 - RNA, 16 nt, Human
uaaauuagaaaauauu

SEQ ID NO: 3169304 - RNA, 18 nt, Human
uaaauuagaaaauauucu

SEQ ID NO: 3169305 - RNA, 20 nt, Human
uaaauuagaaaauauucucu

SEQ ID NO: 3169306 - RNA, 11 nt, Human
uaaauguuuug

SEQ ID NO: 3169307 - RNA, 17 nt, Human
uaaaugauuucauucaa

SEQ ID NO: 3169308 - RNA, 20 nt, Human
uaaaugauucaaaaagucac

SEQ ID NO: 3169309 - RNA, 15 nt, Human
uaaaugauuuaaauu

SEQ ID NO: 3169310 - RNA, 20 nt, Human
uaaaugauuuaaauuuaagu

SEQ ID NO: 3169311 - RNA, 14 nt, Human
uaaaugauucaaaa

SEQ ID NO: 3169312 - RNA, 19 nt, Human
uaaauaguguuauugagag

SEQ ID NO: 3169313 - RNA, 16 nt, Human
uaaauaguguuauuga

SEQ ID NO: 3169314 - RNA, 15 nt, Human
uaaauaguguuauug

SEQ ID NO: 3169315 - RNA, 12 nt, Human
uaaauaguguua

SEQ ID NO: 3169316 - RNA, 13 nt, Human
uaaaucuaacauu

SEQ ID NO: 3169317 - RNA, 17 nt, Human
uaaauaauucuuuuuua

SEQ ID NO: 3169318 - RNA, 23 nt, Human
uaaauaauucuuuuuuauuaauc

SEQ ID NO: 3169319 - RNA, 20 nt, Human
uaaauaguaaaaauaaaauu

SEQ ID NO: 3169320 - RNA, 19 nt, Human
uaaauaguaaaaauaaaau

SEQ ID NO: 3169321 - RNA, 14 nt, Human
aauacacacucaaa

SEQ ID NO: 3169322 - RNA, 18 nt, Human
aauacaauuuuuauuucu

SEQ ID NO: 3169323 - RNA, 22 nt, Human
aauacaauuuuuauuucuuuua

SEQ ID NO: 3169324 - RNA, 16 nt, Human
aauacacaaaaucaaa

SEQ ID NO: 3169325 - RNA, 13 nt, Human
uaaauaauucuuu

SEQ ID NO: 3169326 - RNA, 19 nt, Human
aauaacauguaauuaagua

SEQ ID NO: 3169327 - RNA, 12 nt, Human
aauaacauguaa

SEQ ID NO: 3169328 - RNA, 13 nt, Human
aauaacagccgcu

SEQ ID NO: 3169329 - RNA, 22 nt, Human
aauaaauuuugaaaaguaauau

SEQ ID NO: 3169330 - RNA, 15 nt, Human
aauaaauuuugaaaa

SEQ ID NO: 3169331 - RNA, 16 nt, Human
aauaaauuuugaaaag

SEQ ID NO: 3169332 - RNA, 18 nt, Human
aauaaauuuugaaaagua

SEQ ID NO: 3169333 - RNA, 20 nt, Human
aauaaauuuugaaaaguaau

SEQ ID NO: 3169334 - RNA, 13 nt, Human
aauaaauuuugaa

SEQ ID NO: 3169335 - RNA, 14 nt, Human
aauaaauuuugaaa

SEQ ID NO: 3169336 - RNA, 12 nt, Human
aauaaauuuuga

SEQ ID NO: 3169337 - RNA, 21 nt, Human
aauaaaugugccuucauuuuu

SEQ ID NO: 3169338 - RNA, 12 nt, Human
aauaaaugugcc

SEQ ID NO: 3169339 - RNA, 12 nt, Human
aauaaauuauuu

SEQ ID NO: 3169340 - RNA, 12 nt, Human
aauaaauauacc

SEQ ID NO: 3169341 - RNA, 19 nt, Human
aauaaaguuugaucuuccu

SEQ ID NO: 3169342 - RNA, 18 nt, Human
aauaaaguuugaucuucc

SEQ ID NO: 3169343 - RNA, 15 nt, Human
aauaaaguuugaucu

SEQ ID NO: 3169344 - RNA, 19 nt, Human
aauaauuacagugccuaaa

SEQ ID NO: 3169345 - RNA, 22 nt, Human
aauaauuacagugccuaaaaua

SEQ ID NO: 3169346 - RNA, 21 nt, Human
aauaagggaaaaaucaaguau

SEQ ID NO: 3169347 - RNA, 23 nt, Human
aauaagcuaguugaauacuugaa

SEQ ID NO: 3169348 - RNA, 20 nt, Human
aauaagcuaguugaauacuu

SEQ ID NO: 3169349 - RNA, 22 nt, Human
aauaagcuaguugaauacuuga

SEQ ID NO: 3169350 - RNA, 17 nt, Human
aauaagcacuuuuuaaa

SEQ ID NO: 3169351 - RNA, 17 nt, Human
aauaagcuaguugaaua

SEQ ID NO: 3169352 - RNA, 18 nt, Human
aauaagcuaguugaauac

SEQ ID NO: 3169353 - RNA, 16 nt, Human
aauaagcuaguugaau

SEQ ID NO: 3169354 - RNA, 15 nt, Human
aauaacuaaaaggua

SEQ ID NO: 3169355 - RNA, 13 nt, Human
aauaacuaaaaug

SEQ ID NO: 3169356 - RNA, 15 nt, Human
aauaacuaaaaugua

SEQ ID NO: 3169357 - RNA, 20 nt, Human
aauaacagccgcuccagagu

SEQ ID NO: 3169358 - RNA, 15 nt, Human
aauaacuagaacaaa

SEQ ID NO: 3169359 - RNA, 19 nt, Human
aauaaaagcccaggagccc

SEQ ID NO: 3169360 - RNA, 17 nt, Human
aauaaaagcccaggagc

SEQ ID NO: 3169361 - RNA, 15 nt, Human
aauaaaagcccagga

SEQ ID NO: 3169362 - RNA, 13 nt, Human
aauaaaaauucua

SEQ ID NO: 3169363 - RNA, 14 nt, Human
aauaaaagcccagg

SEQ ID NO: 3169364 - RNA, 13 nt, Human
aauaaaagcccag

SEQ ID NO: 3169365 - RNA, 16 nt, Human
aauaaaaucuugaaaa

SEQ ID NO: 3169366 - RNA, 11 nt, Human
aauaaaauauu

SEQ ID NO: 3169367 - RNA, 12 nt, Human
aauaaaauauuu

SEQ ID NO: 3169368 - RNA, 14 nt, Human
aauaaaauauuuuc

SEQ ID NO: 3169369 - RNA, 15 nt, Human
aauaaaauauuuucu

SEQ ID NO: 3169370 - RNA, 16 nt, Human
aauaaaauauuuucug

SEQ ID NO: 3169371 - RNA, 17 nt, Human
aauaaaauauuuucugu

SEQ ID NO: 3169372 - RNA, 18 nt, Human
aauaaaauauuuucugug

SEQ ID NO: 3169373 - RNA, 19 nt, Human
aauaaaauauuuucugugu

SEQ ID NO: 3169374 - RNA, 20 nt, Human
aauaaaauauuuucugugug

SEQ ID NO: 3169375 - RNA, 22 nt, Human
aauaaaauauuuucuguguguu

SEQ ID NO: 3169376 - RNA, 23 nt, Human
aauaaaauauuuucuguguguuc

SEQ ID NO: 3169377 - RNA, 23 nt, Human
aauaaaggcagcuguugucucuu

SEQ ID NO: 3169378 - RNA, 14 nt, Human
aauaaaguaauuau

SEQ ID NO: 3169379 - RNA, 16 nt, Human
aauaaaguacaagagc

SEQ ID NO: 3169380 - RNA, 12 nt, Human
aauaaaguauaa

SEQ ID NO: 3169381 - RNA, 15 nt, Human
aauaaaguauaaugu

SEQ ID NO: 3169382 - RNA, 17 nt, Human
uaaagggcaaauaauga

SEQ ID NO: 3169383 - RNA, 18 nt, Human
uaaagggcccaaugaauu

SEQ ID NO: 3169384 - RNA, 23 nt, Human
uaaagggaagaaaacacuguuau

SEQ ID NO: 3169385 - RNA, 21 nt, Human
uaaagucuguugauuaaagau

SEQ ID NO: 3169386 - RNA, 21 nt, Human
uaaagucaguugcucaaaaag

SEQ ID NO: 3169387 - RNA, 13 nt, Human
uaaagucaggggu

SEQ ID NO: 3169388 - RNA, 22 nt, Human
uaaagggaagaaaacacuguua

SEQ ID NO: 3169389 - RNA, 17 nt, Human
uaaagggaagaaaacac

SEQ ID NO: 3169390 - RNA, 14 nt, Human
uaaagggaagaaaa

SEQ ID NO: 3169391 - RNA, 13 nt, Human
uaaagggaagaaa

SEQ ID NO: 3169392 - RNA, 22 nt, Human
uaaagucuguugauuaaagaug

SEQ ID NO: 3169393 - RNA, 19 nt, Human
uaaagugaggccacugaag

SEQ ID NO: 3169394 - RNA, 21 nt, Human
uaaagugaggccacugaagag

SEQ ID NO: 3169395 - RNA, 23 nt, Human
uaaagugaggccacugaagagga

SEQ ID NO: 3169396 - RNA, 17 nt, Human
uaaagugagaaaacugu

SEQ ID NO: 3169397 - RNA, 18 nt, Human
uaaagugagaaaacugug

SEQ ID NO: 3169398 - RNA, 15 nt, Human
aauaaaaaaaagaaa

SEQ ID NO: 3169399 - RNA, 17 nt, Human
aauaaaaaaagaaaaaa

SEQ ID NO: 3169400 - RNA, 18 nt, Human
aauaaaaaaaagaaaaaa

SEQ ID NO: 3169401 - RNA, 17 nt, Human
aauaaaaaaaagaaaaa

SEQ ID NO: 3169402 - RNA, 20 nt, Human
aaguguucuguuacaaaaug

SEQ ID NO: 3169403 - RNA, 19 nt, Human
aaguguucuguuacaaaau

SEQ ID NO: 3169404 - RNA, 17 nt, Human
aaguguucuguuacaaa

SEQ ID NO: 3169405 - RNA, 16 nt, Human
aaguguucuguuacaa

SEQ ID NO: 3169406 - RNA, 14 nt, Human
aaguguuggaaaaa

SEQ ID NO: 3169407 - RNA, 16 nt, Human
aaguguuggaaaaaau

SEQ ID NO: 3169408 - RNA, 20 nt, Human
aaguguuggaaaaaauuugu

SEQ ID NO: 3169409 - RNA, 22 nt, Human
aaguguucuguuacaaaaugua

SEQ ID NO: 3169410 - RNA, 21 nt, Human
aaguguucuguuacaaaaugu

SEQ ID NO: 3169411 - RNA, 23 nt, Human
aaguguucuguuacaaaauguaa

SEQ ID NO: 3169412 - RNA, 23 nt, Human
aaguguugggguuugguuuuguu

SEQ ID NO: 3169413 - RNA, 11 nt, Human
aaguuaaaagu

SEQ ID NO: 3169414 - RNA, 14 nt, Human
aaguuaaauaaauc

SEQ ID NO: 3169415 - RNA, 12 nt, Human
aaguuaaauaaa

SEQ ID NO: 3169416 - RNA, 14 nt, Human
aaguuaaagggaag

SEQ ID NO: 3169417 - RNA, 11 nt, Human
aaguuaaaggg

SEQ ID NO: 3169418 - RNA, 20 nt, Human
aaguucauugcaauuaaacu

SEQ ID NO: 3169419 - RNA, 21 nt, Human
uaaaauuuuaggcaaguuuuc

SEQ ID NO: 3169420 - RNA, 17 nt, Human
uaaaauuuuaggcaagu

SEQ ID NO: 3169421 - RNA, 19 nt, Human
uaaaauuuuaagcuaggaa

SEQ ID NO: 3169422 - RNA, 21 nt, Human
uaaaauuaucaccuuugucag

SEQ ID NO: 3169423 - RNA, 18 nt, Human
uaaaauuuuaagcuagga

SEQ ID NO: 3169424 - RNA, 19 nt, Human
uaaaauuaaagcugaaaac

SEQ ID NO: 3169425 - RNA, 18 nt, Human
uaaaauuaaagcugaaaa

SEQ ID NO: 3169426 - RNA, 16 nt, Human
uaaaauuaaagcugaa

SEQ ID NO: 3169427 - RNA, 23 nt, Human
uaaaauguuuucagcuaggaaca

SEQ ID NO: 3169428 - RNA, 15 nt, Human
uaaaauuaaaaguuu

SEQ ID NO: 3169429 - RNA, 15 nt, Human
uaaaauuauaccugu

SEQ ID NO: 3169430 - RNA, 14 nt, Human
uaaaauuauacugu

SEQ ID NO: 3169431 - RNA, 15 nt, Human
uaaaauuauacugug

SEQ ID NO: 3169432 - RNA, 16 nt, Human
uaaaauuauacugugu

SEQ ID NO: 3169433 - RNA, 19 nt, Human
uaaaauuauacugugugug

SEQ ID NO: 3169434 - RNA, 20 nt, Human
uaaaauuauacuguguguga

SEQ ID NO: 3169435 - RNA, 19 nt, Human
uaaaauuacaacuaaguga

SEQ ID NO: 3169436 - RNA, 18 nt, Human
uaaaauuacaguggauug

SEQ ID NO: 3169437 - RNA, 17 nt, Human
uaaaauuacaacuaagu

SEQ ID NO: 3169438 - RNA, 15 nt, Human
uaaaauuacaacuaa

SEQ ID NO: 3169439 - RNA, 13 nt, Human
uaaaauuacaacu

SEQ ID NO: 3169440 - RNA, 19 nt, Human
uaaaccaaggcuagaacca

SEQ ID NO: 3169441 - RNA, 15 nt, Human
aaguuuugacaagcu

SEQ ID NO: 3169442 - RNA, 19 nt, Human
aaguuuugacaagcuggcu

SEQ ID NO: 3169443 - RNA, 20 nt, Human
aaguuuugacaagcuggcuu

SEQ ID NO: 3169444 - RNA, 12 nt, Human
uaaaauguuuuc

SEQ ID NO: 3169445 - RNA, 21 nt, Human
uaaaauguuuucagcuaggaa

SEQ ID NO: 3169446 - RNA, 16 nt, Human
uaaaauguuuucagcu

SEQ ID NO: 3169447 - RNA, 14 nt, Human
uaaaauguuuucag

SEQ ID NO: 3169448 - RNA, 13 nt, Human
uaaaauguuuuca

SEQ ID NO: 3169449 - RNA, 19 nt, Human
aaguuuuaggguacaugug

SEQ ID NO: 3169450 - RNA, 13 nt, Human
aaguuuuaaaguu

SEQ ID NO: 3169451 - RNA, 15 nt, Human
aaguuuuaaaguuca

SEQ ID NO: 3169452 - RNA, 23 nt, Human
aaguuuucccugaaguuaugugu

SEQ ID NO: 3169453 - RNA, 16 nt, Human
aaguuuucccugaagu

SEQ ID NO: 3169454 - RNA, 11 nt, Human
aaguuugcacu

SEQ ID NO: 3169455 - RNA, 20 nt, Human
aaguuugcacucaaaucuua

SEQ ID NO: 3169456 - RNA, 19 nt, Human
aaguuucaaguuuuaaagu

SEQ ID NO: 3169457 - RNA, 20 nt, Human
aaguuucaaguuuuaaaguu

SEQ ID NO: 3169458 - RNA, 21 nt, Human
aaguuucaaaaaucugaagau

SEQ ID NO: 3169459 - RNA, 17 nt, Human
aaguuucaaaaaucuga

SEQ ID NO: 3169460 - RNA, 16 nt, Human
aaguuucaaaaaucug

SEQ ID NO: 3169461 - RNA, 15 nt, Human
aaguuucaaaaaucu

SEQ ID NO: 3169462 - RNA, 16 nt, Human
aaguuucagaguauau

SEQ ID NO: 3169463 - RNA, 18 nt, Human
aaguuucagaguauauug

SEQ ID NO: 3169464 - RNA, 14 nt, Human
aaguuucaaaaauc

SEQ ID NO: 3169465 - RNA, 14 nt, Human
aaguuuaugucuca

SEQ ID NO: 3169466 - RNA, 22 nt, Human
aaguuuaguuugaggaauucuu

SEQ ID NO: 3169467 - RNA, 16 nt, Human
uaaaccgccaaggcug

SEQ ID NO: 3169468 - RNA, 18 nt, Human
uaaaccgccaaggcuggg

SEQ ID NO: 3169469 - RNA, 18 nt, Human
uaaaccauuuuuguuacu

SEQ ID NO: 3169470 - RNA, 19 nt, Human
uaaaccauuuuuguuacuc

SEQ ID NO: 3169471 - RNA, 23 nt, Human
uaaacguggagaaucacaggcug

SEQ ID NO: 3169472 - RNA, 13 nt, Human
uaaacguggagaa

SEQ ID NO: 3169473 - RNA, 18 nt, Human
uaaacguguauguuuuuc

SEQ ID NO: 3169474 - RNA, 20 nt, Human
uaaacguguauguuuuucag

SEQ ID NO: 3169475 - RNA, 23 nt, Human
uaaacguguauguuuuucaguuc

SEQ ID NO: 3169476 - RNA, 22 nt, Human
uaaacguguauguuuuucaguu

SEQ ID NO: 3169477 - RNA, 19 nt, Human
uaaaccuguagaaucaauu

SEQ ID NO: 3169478 - RNA, 12 nt, Human
uaaaccuuaaua

SEQ ID NO: 3169479 - RNA, 14 nt, Human
uaaaccuuaauauu

SEQ ID NO: 3169480 - RNA, 19 nt, Human
uaaaccuuaauauuucuuc

SEQ ID NO: 3169481 - RNA, 13 nt, Human
uaaagaaaggaaa

SEQ ID NO: 3169482 - RNA, 15 nt, Human
uaaagaaaggaaaag

SEQ ID NO: 3169483 - RNA, 16 nt, Human
uaaagaaaggaaaaga

SEQ ID NO: 3169484 - RNA, 17 nt, Human
uaaagaaaggaaaagaa

SEQ ID NO: 3169485 - RNA, 22 nt, Human
uaaagaaaggaaaagaaaacaa

SEQ ID NO: 3169486 - RNA, 23 nt, Human
uaaagaaaggaaaagaaaacaaa

SEQ ID NO: 3169487 - RNA, 12 nt, Human
uaaacugccccc

SEQ ID NO: 3169488 - RNA, 21 nt, Human
uaaacucugaauuuaucuuug

SEQ ID NO: 3169489 - RNA, 14 nt, Human
uaaacucugaauaa

SEQ ID NO: 3169490 - RNA, 13 nt, Human
uaaacucugaaua

SEQ ID NO: 3169491 - RNA, 18 nt, Human
uaaacucugaauuuaucu

SEQ ID NO: 3169492 - RNA, 17 nt, Human
uaaacucugaauuuauc

SEQ ID NO: 3169493 - RNA, 22 nt, Human
uaaacucugaauaagcacuuuu

SEQ ID NO: 3169494 - RNA, 19 nt, Human
uaaacucugaauaagcacu

SEQ ID NO: 3169495 - RNA, 18 nt, Human
uaaacuaguuuuuccuau

SEQ ID NO: 3169496 - RNA, 11 nt, Human
uaaagacucua

SEQ ID NO: 3169497 - RNA, 15 nt, Human
uaaagacaccuacug

SEQ ID NO: 3169498 - RNA, 15 nt, Human
uaaagaccagaaauu

SEQ ID NO: 3169499 - RNA, 16 nt, Human
uaaagaccagaaauuc

SEQ ID NO: 3169500 - RNA, 14 nt, Human
uaaagaaauaauuu

SEQ ID NO: 3169501 - RNA, 12 nt, Human
uaaagaaauaau

SEQ ID NO: 3169502 - RNA, 14 nt, Human
uaaagaagguuuca

SEQ ID NO: 3169503 - RNA, 15 nt, Human
uaaagaauaggacuu

SEQ ID NO: 3169504 - RNA, 14 nt, Human
uaaagaauaggacu

SEQ ID NO: 3169505 - RNA, 20 nt, Human
uaaagaauuugucacaggaa

SEQ ID NO: 3169506 - RNA, 14 nt, Human
uaaagaauuuguca

SEQ ID NO: 3169507 - RNA, 19 nt, Human
uaaagcaaccaaaaagaaa

SEQ ID NO: 3169508 - RNA, 21 nt, Human
uaaagcaaccaaaaagaaaaa

SEQ ID NO: 3169509 - RNA, 15 nt, Human
uaaagauuucuguuc

SEQ ID NO: 3169510 - RNA, 14 nt, Human
uaaagauuucuguu

SEQ ID NO: 3169511 - RNA, 15 nt, Human
uaaagauuuugaucu

SEQ ID NO: 3169512 - RNA, 14 nt, Human
uaaagauuuugauc

SEQ ID NO: 3169513 - RNA, 21 nt, Human
uaaagauuuugaucucacauu

SEQ ID NO: 3169514 - RNA, 19 nt, Human
uaaagauuuugaucucaca

SEQ ID NO: 3169515 - RNA, 16 nt, Human
uaaagauguagcaaac

SEQ ID NO: 3169516 - RNA, 20 nt, Human
uaaagauguagcaaacccug

SEQ ID NO: 3169517 - RNA, 17 nt, Human
uaaagauuuaggccaau

SEQ ID NO: 3169518 - RNA, 13 nt, Human
uaaagauugugug

SEQ ID NO: 3169519 - RNA, 13 nt, Human
uaaagauuucugu

SEQ ID NO: 3169520 - RNA, 12 nt, Human
uaaagauuucug

SEQ ID NO: 3169521 - RNA, 19 nt, Human
uaaagaugagcuuugucua

SEQ ID NO: 3169522 - RNA, 18 nt, Human
uaaagaguuaguuugagu

SEQ ID NO: 3169523 - RNA, 17 nt, Human
aacauuaguacuuuaua

SEQ ID NO: 3169524 - RNA, 16 nt, Human
aacauuaguacuuuau

SEQ ID NO: 3169525 - RNA, 15 nt, Human
aacauuaguacuuua

SEQ ID NO: 3169526 - RNA, 21 nt, Human
aacauuaggcagguugcuuaa

SEQ ID NO: 3169527 - RNA, 24 nt, Human
aacauuaguacuuuauagaagaau

SEQ ID NO: 3169528 - RNA, 13 nt, Human
aacauuaaaauau

SEQ ID NO: 3169529 - RNA, 20 nt, Human
aacauuaauguugauuucua

SEQ ID NO: 3169530 - RNA, 19 nt, Human
aacauuaauguugauuucu

SEQ ID NO: 3169531 - RNA, 17 nt, Human
aacauuaauguugauuu

SEQ ID NO: 3169532 - RNA, 15 nt, Human
aacauuaauguugau

SEQ ID NO: 3169533 - RNA, 14 nt, Human
aacauuaauguuga

SEQ ID NO: 3169534 - RNA, 12 nt, Human
aacauuaauguu

SEQ ID NO: 3169535 - RNA, 19 nt, Human
aacauuaauccacauguuu

SEQ ID NO: 3169536 - RNA, 18 nt, Human
aacauuaaugccugcuuu

SEQ ID NO: 3169537 - RNA, 23 nt, Human
aacauuaaugccugcuuuuugga

SEQ ID NO: 3169538 - RNA, 13 nt, Human
guccuuuagaaac

SEQ ID NO: 3169539 - RNA, 12 nt, Human
guccuuuagaaa

SEQ ID NO: 3169540 - RNA, 13 nt, Human
guccugcugcagu

SEQ ID NO: 3169541 - RNA, 16 nt, Human
guccugcugcaguugc

SEQ ID NO: 3169542 - RNA, 15 nt, Human
guccugcucagcagu

SEQ ID NO: 3169543 - RNA, 23 nt, Human
gucgcccagucuggaaugcagug

SEQ ID NO: 3169544 - RNA, 20 nt, Human
gucuaccugaggggccucuu

SEQ ID NO: 3169545 - RNA, 16 nt, Human
gucuauaccuuaagaa

SEQ ID NO: 3169546 - RNA, 14 nt, Human
gucuaucauuguug

SEQ ID NO: 3169547 - RNA, 22 nt, Human
gucuauaccuuaagaaugccaa

SEQ ID NO: 3169548 - RNA, 13 nt, Human
gucgaaaguuagu

SEQ ID NO: 3169549 - RNA, 14 nt, Human
gucgaggacaggga

SEQ ID NO: 3169550 - RNA, 13 nt, Human
gucgagcuccccc

SEQ ID NO: 3169551 - RNA, 21 nt, Human
gucgagccugggggcuggagc

SEQ ID NO: 3169552 - RNA, 14 nt, Human
gucgcccagucugg

SEQ ID NO: 3169553 - RNA, 13 nt, Human
gucgcccagucug

SEQ ID NO: 3169554 - RNA, 20 nt, Human
gucgcccaggcuggagugca

SEQ ID NO: 3169555 - RNA, 15 nt, Human
gucgcccaggcugga

SEQ ID NO: 3169556 - RNA, 14 nt, Human
gucgcccaggcugg

SEQ ID NO: 3169557 - RNA, 19 nt, Human
aacauuuucucuuagaaaa

SEQ ID NO: 3169558 - RNA, 18 nt, Human
aacauuuucucuuagaaa

SEQ ID NO: 3169559 - RNA, 17 nt, Human
aacauuuucucuuagaa

SEQ ID NO: 3169560 - RNA, 14 nt, Human
aacauuuucucuua

SEQ ID NO: 3169561 - RNA, 12 nt, Human
aaccacagcagu

SEQ ID NO: 3169562 - RNA, 17 nt, Human
aaccaacaccaucacag

SEQ ID NO: 3169563 - RNA, 19 nt, Human
aaccaacaccaucacagcu

SEQ ID NO: 3169564 - RNA, 22 nt, Human
aaccaacaccaucacagcuugu

SEQ ID NO: 3169565 - RNA, 13 nt, Human
aaccacaucuugc

SEQ ID NO: 3169566 - RNA, 23 nt, Human
aaccaucauugaaaucuuuuugc

SEQ ID NO: 3169567 - RNA, 23 nt, Human
aaccacaguguaccauuaaaaua

SEQ ID NO: 3169568 - RNA, 22 nt, Human
aaccacaguguaccauuaaaau

SEQ ID NO: 3169569 - RNA, 17 nt, Human
aaccacaguguaccauu

SEQ ID NO: 3169570 - RNA, 21 nt, Human
aaccacaguguaccauuaaaa

SEQ ID NO: 3169571 - RNA, 18 nt, Human
aaccacaguguaccauua

SEQ ID NO: 3169572 - RNA, 13 nt, Human
aaccacagcuccu

SEQ ID NO: 3169573 - RNA, 19 nt, Human
aaccacagcuccuuuucca

SEQ ID NO: 3169574 - RNA, 18 nt, Human
aaccacagcuccuuuucc

SEQ ID NO: 3169575 - RNA, 23 nt, Human
gucucaguccaugaagauguaga

SEQ ID NO: 3169576 - RNA, 16 nt, Human
gucucaggucccugca

SEQ ID NO: 3169577 - RNA, 20 nt, Human
gucucagguuuguuuuguga

SEQ ID NO: 3169578 - RNA, 22 nt, Human
gucucagguuuguuuugugaau

SEQ ID NO: 3169579 - RNA, 15 nt, Human
gucucaggucccugc

SEQ ID NO: 3169580 - RNA, 22 nt, Human
gucuccaaaaaaaaaaaaaaua

SEQ ID NO: 3169581 - RNA, 23 nt, Human
gucuccaaaaaaaaaaaaaauac

SEQ ID NO: 3169582 - RNA, 14 nt, Human
gucuaugggacuca

SEQ ID NO: 3169583 - RNA, 20 nt, Human
gucuaucugguauuaaaugc

SEQ ID NO: 3169584 - RNA, 22 nt, Human
gucuaucugguauuaaaugcca

SEQ ID NO: 3169585 - RNA, 22 nt, Human
gucucaaacucuugaccucagg

SEQ ID NO: 3169586 - RNA, 19 nt, Human
gucucaaaaaaagaaaaag

SEQ ID NO: 3169587 - RNA, 14 nt, Human
gucucaaaggccag

SEQ ID NO: 3169588 - RNA, 17 nt, Human
gucucaagagggcacug

SEQ ID NO: 3169589 - RNA, 15 nt, Human
gucucaagagggcac

SEQ ID NO: 3169590 - RNA, 14 nt, Human
gucucaaugaaaua

SEQ ID NO: 3169591 - RNA, 15 nt, Human
gucucaaugaaauag

SEQ ID NO: 3169592 - RNA, 22 nt, Human
gucucaagagggcacugguggc

SEQ ID NO: 3169593 - RNA, 20 nt, Human
gucucaagagggcacuggug

SEQ ID NO: 3169594 - RNA, 15 nt, Human
aacauaauucuuauu

SEQ ID NO: 3169595 - RNA, 20 nt, Human
aacauacucccaucugugaa

SEQ ID NO: 3169596 - RNA, 18 nt, Human
aacauacucccaucugug

SEQ ID NO: 3169597 - RNA, 16 nt, Human
aacauacucccaucug

SEQ ID NO: 3169598 - RNA, 22 nt, Human
aacauagaauugcaaucuauaa

SEQ ID NO: 3169599 - RNA, 21 nt, Human
aacauagaauugcaaucuaua

SEQ ID NO: 3169600 - RNA, 22 nt, Human
aacauguuuuucuucucccuca

SEQ ID NO: 3169601 - RNA, 17 nt, Human
aacagucucaggaaauc

SEQ ID NO: 3169602 - RNA, 14 nt, Human
aacagucucaggaa

SEQ ID NO: 3169603 - RNA, 19 nt, Human
aacagucucaggaaaucaa

SEQ ID NO: 3169604 - RNA, 14 nt, Human
aacagauucuuuua

SEQ ID NO: 3169605 - RNA, 16 nt, Human
aacagauuggauuuua

SEQ ID NO: 3169606 - RNA, 17 nt, Human
aacagauucuuuuaugu

SEQ ID NO: 3169607 - RNA, 18 nt, Human
aacagauuggauuuuaug

SEQ ID NO: 3169608 - RNA, 17 nt, Human
aacagauuggauuuuau

SEQ ID NO: 3169609 - RNA, 23 nt, Human
aacagauuggauuuuauguugac

SEQ ID NO: 3169610 - RNA, 19 nt, Human
aacagauuauuaccuuaca

SEQ ID NO: 3169611 - RNA, 19 nt, Human
aacagaugaccccugccca

SEQ ID NO: 3169612 - RNA, 14 nt, Human
aacagaugcucuga

SEQ ID NO: 3169613 - RNA, 17 nt, Human
aacagaugcucugagag

SEQ ID NO: 3169614 - RNA, 20 nt, Human
aacagaggaccagcacacuc

SEQ ID NO: 3169615 - RNA, 18 nt, Human
aacagaggaccagcacac

SEQ ID NO: 3169616 - RNA, 12 nt, Human
aacagaggauau

SEQ ID NO: 3169617 - RNA, 18 nt, Human
aacagaugaccccugccc

SEQ ID NO: 3169618 - RNA, 14 nt, Human
aacagauaaagauu

SEQ ID NO: 3169619 - RNA, 16 nt, Human
aacagaguaaucuugu

SEQ ID NO: 3169620 - RNA, 21 nt, Human
aacagaggaccagcacacucc

SEQ ID NO: 3169621 - RNA, 20 nt, Human
aacagacuggaagcacagcu

SEQ ID NO: 3169622 - RNA, 13 nt, Human
guccuacccaccc

SEQ ID NO: 3169623 - RNA, 13 nt, Human
aacagaggaccag

SEQ ID NO: 3169624 - RNA, 12 nt, Human
aacagaggacca

SEQ ID NO: 3169625 - RNA, 21 nt, Human
guccuaauggugaugcagucu

SEQ ID NO: 3169626 - RNA, 20 nt, Human
guccuaagugcuaagugcuu

SEQ ID NO: 3169627 - RNA, 23 nt, Human
guccaugaagauguagaggagaa

SEQ ID NO: 3169628 - RNA, 16 nt, Human
guagcuaacuuuuauu

SEQ ID NO: 3169629 - RNA, 22 nt, Human
guagccucaaucgagugagaca

SEQ ID NO: 3169630 - RNA, 18 nt, Human
gucccaccuuggcugcag

SEQ ID NO: 3169631 - RNA, 17 nt, Human
gucccaccuuggcugca

SEQ ID NO: 3169632 - RNA, 13 nt, Human
guccauucucaag

SEQ ID NO: 3169633 - RNA, 19 nt, Human
gucccaccuuggcugcagg

SEQ ID NO: 3169634 - RNA, 12 nt, Human
gucccccucugg

SEQ ID NO: 3169635 - RNA, 14 nt, Human
gucccccucuggcu

SEQ ID NO: 3169636 - RNA, 17 nt, Human
guccccccacucccagc

SEQ ID NO: 3169637 - RNA, 13 nt, Human
gucccuuuuccuu

SEQ ID NO: 3169638 - RNA, 21 nt, Human
guccgaaagggacuuggaagc

SEQ ID NO: 3169639 - RNA, 22 nt, Human
guccgaaagggacuuggaagcu

SEQ ID NO: 3169640 - RNA, 20 nt, Human
guccgaccuggccugucugu

SEQ ID NO: 3169641 - RNA, 13 nt, Human
guccuaaugguga

SEQ ID NO: 3169642 - RNA, 13 nt, Human
gucccccugacaa

SEQ ID NO: 3169643 - RNA, 15 nt, Human
guccccgcacugggc

SEQ ID NO: 3169644 - RNA, 16 nt, Human
guccccgcacugggcu

SEQ ID NO: 3169645 - RNA, 23 nt, Human
guccccuguuuguuucugaaagg

SEQ ID NO: 3169646 - RNA, 12 nt, Human
guccccuucccg

SEQ ID NO: 3169647 - RNA, 12 nt, Human
guccccucccag

SEQ ID NO: 3169648 - RNA, 13 nt, Human
gugaagauacuuu

SEQ ID NO: 3169649 - RNA, 15 nt, Human
gugaagauacuuugu

SEQ ID NO: 3169650 - RNA, 18 nt, Human
gugaagauacuuuguauu

SEQ ID NO: 3169651 - RNA, 20 nt, Human
gugaagauacuuuguauugu

SEQ ID NO: 3169652 - RNA, 16 nt, Human
gugaagccagggcccg

SEQ ID NO: 3169653 - RNA, 21 nt, Human
gugaaggaggcuccaggcagc

SEQ ID NO: 3169654 - RNA, 21 nt, Human
gugaaggauuauggaaaaaua

SEQ ID NO: 3169655 - RNA, 22 nt, Human
gugaaggauuauggaaaaauaa

SEQ ID NO: 3169656 - RNA, 17 nt, Human
gugaaggaggcuccagg

SEQ ID NO: 3169657 - RNA, 16 nt, Human
gugaaggaggcuccag

SEQ ID NO: 3169658 - RNA, 23 nt, Human
gugaaggaccuucacucuaagau

SEQ ID NO: 3169659 - RNA, 21 nt, Human
gugaaggaccuucacucuaag

SEQ ID NO: 3169660 - RNA, 16 nt, Human
gugaagagcaagagag

SEQ ID NO: 3169661 - RNA, 16 nt, Human
gugaagacuccagaaa

SEQ ID NO: 3169662 - RNA, 22 nt, Human
gugaagaaagccuguuguuuaa

SEQ ID NO: 3169663 - RNA, 14 nt, Human
gugaagacuccaga

SEQ ID NO: 3169664 - RNA, 19 nt, Human
gugacagaggcagccccau

SEQ ID NO: 3169665 - RNA, 18 nt, Human
gugacagaggcagcccca

SEQ ID NO: 3169666 - RNA, 16 nt, Human
gugacagaggcagccc

SEQ ID NO: 3169667 - RNA, 20 nt, Human
gugacaucucuauuccccac

SEQ ID NO: 3169668 - RNA, 22 nt, Human
gugacauccacaaaugcaguuu

SEQ ID NO: 3169669 - RNA, 20 nt, Human
gugacauuugucauuuucau

SEQ ID NO: 3169670 - RNA, 17 nt, Human
gugaccaaugaugguca

SEQ ID NO: 3169671 - RNA, 23 nt, Human
gugacauuugucauuuucauuag

SEQ ID NO: 3169672 - RNA, 18 nt, Human
gugaccagcaccaucucu

SEQ ID NO: 3169673 - RNA, 21 nt, Human
gugaccagcaccaucucuccu

SEQ ID NO: 3169674 - RNA, 18 nt, Human
gugaccauguuuuguuua

SEQ ID NO: 3169675 - RNA, 21 nt, Human
gugagguggaauuauuuuaaa

SEQ ID NO: 3169676 - RNA, 15 nt, Human
gugagcaggcuguga

SEQ ID NO: 3169677 - RNA, 17 nt, Human
gugaguacuacaguccu

SEQ ID NO: 3169678 - RNA, 21 nt, Human
gugagcacuaaggugugcucu

SEQ ID NO: 3169679 - RNA, 16 nt, Human
gugagaggggaacaga

SEQ ID NO: 3169680 - RNA, 13 nt, Human
gugagagcugggu

SEQ ID NO: 3169681 - RNA, 15 nt, Human
gugagcaauccugca

SEQ ID NO: 3169682 - RNA, 17 nt, Human
gugagaggggaggccaa

SEQ ID NO: 3169683 - RNA, 12 nt, Human
gugagacagacu

SEQ ID NO: 3169684 - RNA, 12 nt, Human
gugaccccaggu

SEQ ID NO: 3169685 - RNA, 18 nt, Human
gugacuuuucaaguauuu

SEQ ID NO: 3169686 - RNA, 12 nt, Human
gugagagcuggg

SEQ ID NO: 3169687 - RNA, 15 nt, Human
gugagaaaacuguga

SEQ ID NO: 3169688 - RNA, 15 nt, Human
gugacuuuugcuuua

SEQ ID NO: 3169689 - RNA, 13 nt, Human
gugacuuuugcuu

SEQ ID NO: 3169690 - RNA, 14 nt, Human
gugaguccuccaga

SEQ ID NO: 3169691 - RNA, 17 nt, Human
gugaguccuggcauggg

SEQ ID NO: 3169692 - RNA, 19 nt, Human
gugaguacuacaguccucc

SEQ ID NO: 3169693 - RNA, 19 nt, Human
gugagucaccaagcccagu

SEQ ID NO: 3169694 - RNA, 20 nt, Human
gugaguccuggcaugggaau

SEQ ID NO: 3169695 - RNA, 17 nt, Human
gugaguccuccagaacu

SEQ ID NO: 3169696 - RNA, 16 nt, Human
gugaguccuccagaac

SEQ ID NO: 3169697 - RNA, 18 nt, Human
gugaguccuccagaacuc

SEQ ID NO: 3169698 - RNA, 12 nt, Human
aacucugccugc

SEQ ID NO: 3169699 - RNA, 15 nt, Human
aacucugcugagggu

SEQ ID NO: 3169700 - RNA, 21 nt, Human
aacucugcugaggguccagaa

SEQ ID NO: 3169701 - RNA, 13 nt, Human
gucuucacaacag

SEQ ID NO: 3169702 - RNA, 15 nt, Human
gucuggggaccagcu

SEQ ID NO: 3169703 - RNA, 23 nt, Human
gucuggaugcgggcauggcagcc

SEQ ID NO: 3169704 - RNA, 14 nt, Human
gucuggaucaguaa

SEQ ID NO: 3169705 - RNA, 19 nt, Human
gucuggaucaguaaaauua

SEQ ID NO: 3169706 - RNA, 23 nt, Human
gucugacaggcaaugcuggcugu

SEQ ID NO: 3169707 - RNA, 22 nt, Human
gucugacaggcaaugcuggcug

SEQ ID NO: 3169708 - RNA, 21 nt, Human
gucugacaggcaaugcuggcu

SEQ ID NO: 3169709 - RNA, 19 nt, Human
gucugaagucacugcacag

SEQ ID NO: 3169710 - RNA, 17 nt, Human
gucugaagucacugcac

SEQ ID NO: 3169711 - RNA, 18 nt, Human
gucuggaaugcaguggua

SEQ ID NO: 3169712 - RNA, 24 nt, Human
gucugacaucagagguaucuuacu

SEQ ID NO: 3169713 - RNA, 18 nt, Human
gucuggaggaccugcccg

SEQ ID NO: 3169714 - RNA, 13 nt, Human
gucucuugguccu

SEQ ID NO: 3169715 - RNA, 20 nt, Human
gucucuugguccugcugcag

SEQ ID NO: 3169716 - RNA, 18 nt, Human
gucucuugguccugcugc

SEQ ID NO: 3169717 - RNA, 19 nt, Human
gucucuugguccugcugca

SEQ ID NO: 3169718 - RNA, 17 nt, Human
gucucuugguccugcug

SEQ ID NO: 3169719 - RNA, 22 nt, Human
gucucuuuaaugucacaggcag

SEQ ID NO: 3169720 - RNA, 19 nt, Human
gucugaaggcuggguucug

SEQ ID NO: 3169721 - RNA, 14 nt, Human
gucugaaggcuggg

SEQ ID NO: 3169722 - RNA, 16 nt, Human
gucugaagucacugca

SEQ ID NO: 3169723 - RNA, 20 nt, Human
gucucuuuaaugucacaggc

SEQ ID NO: 3169724 - RNA, 19 nt, Human
gucucuuuaaugucacagg

SEQ ID NO: 3169725 - RNA, 18 nt, Human
gucucuuuaaugucacag

SEQ ID NO: 3169726 - RNA, 10 nt, Human
aacuaauaaa

SEQ ID NO: 3169727 - RNA, 11 nt, Human
aacuaauaaaa

SEQ ID NO: 3169728 - RNA, 12 nt, Human
aacuaauaaaau

SEQ ID NO: 3169729 - RNA, 13 nt, Human
aacuaauaaaaua

SEQ ID NO: 3169730 - RNA, 14 nt, Human
aacuaauaaaauau

SEQ ID NO: 3169731 - RNA, 16 nt, Human
aacuaauaaaauauuu

SEQ ID NO: 3169732 - RNA, 19 nt, Human
aacuaauaaaauauuuucu

SEQ ID NO: 3169733 - RNA, 20 nt, Human
aacuaauaaaauauuuucug

SEQ ID NO: 3169734 - RNA, 21 nt, Human
aacuaauaaaauauuuucugu

SEQ ID NO: 3169735 - RNA, 13 nt, Human
aacuagaacaaau

SEQ ID NO: 3169736 - RNA, 15 nt, Human
aacuaagaaacuuaa

SEQ ID NO: 3169737 - RNA, 19 nt, Human
aacuaagaaacuuaaauuu

SEQ ID NO: 3169738 - RNA, 14 nt, Human
aacuaagauucuuu

SEQ ID NO: 3169739 - RNA, 15 nt, Human
aacuaagauucuuuu

SEQ ID NO: 3169740 - RNA, 16 nt, Human
aacuaagauucuuuua

SEQ ID NO: 3169741 - RNA, 17 nt, Human
aacuaagauucuuuuaa

SEQ ID NO: 3169742 - RNA, 22 nt, Human
aacuaagauucuuuuaaauuag

SEQ ID NO: 3169743 - RNA, 23 nt, Human
aacguggcugcuucaaggauccu

SEQ ID NO: 3169744 - RNA, 16 nt, Human
aaccuuucuauaauuu

SEQ ID NO: 3169745 - RNA, 14 nt, Human
aacguguauguuuu

SEQ ID NO: 3169746 - RNA, 19 nt, Human
aacgugugcuguguuugcu

SEQ ID NO: 3169747 - RNA, 16 nt, Human
aacgugugcuguguuu

SEQ ID NO: 3169748 - RNA, 22 nt, Human
aacguguauguuuuucaguuca

SEQ ID NO: 3169749 - RNA, 20 nt, Human
aacguguauguuuuucaguu

SEQ ID NO: 3169750 - RNA, 18 nt, Human
aaccuuguuuauuaaauu

SEQ ID NO: 3169751 - RNA, 19 nt, Human
aaccuuguuuauuaaauug

SEQ ID NO: 3169752 - RNA, 20 nt, Human
aaccuuguuuauuaaauugc

SEQ ID NO: 3169753 - RNA, 13 nt, Human
aaccuuuccccca

SEQ ID NO: 3169754 - RNA, 11 nt, Human
aaccuuucccc

SEQ ID NO: 3169755 - RNA, 16 nt, Human
gucuucaguaagccgu

SEQ ID NO: 3169756 - RNA, 18 nt, Human
gucuucauccccucagaa

SEQ ID NO: 3169757 - RNA, 13 nt, Human
gucuucaugaaau

SEQ ID NO: 3169758 - RNA, 17 nt, Human
gucuucauguucccacu

SEQ ID NO: 3169759 - RNA, 23 nt, Human
gucuucaugaaaugcuaugucau

SEQ ID NO: 3169760 - RNA, 16 nt, Human
gucuucaugaaaugcu

SEQ ID NO: 3169761 - RNA, 15 nt, Human
gucuucaugaaaugc

SEQ ID NO: 3169762 - RNA, 15 nt, Human
gucuuuguacagaca

SEQ ID NO: 3169763 - RNA, 16 nt, Human
gucuuuguacagacaa

SEQ ID NO: 3169764 - RNA, 17 nt, Human
gucuuuuaaaaaguauu

SEQ ID NO: 3169765 - RNA, 15 nt, Human
gucuuuuaaaaagua

SEQ ID NO: 3169766 - RNA, 14 nt, Human
gucuuuuaaaaagu

SEQ ID NO: 3169767 - RNA, 10 nt, Human
gucuuuuaaa

SEQ ID NO: 3169768 - RNA, 12 nt, Human
aaccugugucuc

SEQ ID NO: 3169769 - RNA, 13 nt, Human
aaccuguucugcu

SEQ ID NO: 3169770 - RNA, 17 nt, Human
aaccuguucugcuuucc

SEQ ID NO: 3169771 - RNA, 12 nt, Human
aaccuuaauauu

SEQ ID NO: 3169772 - RNA, 18 nt, Human
aaccuuaauauuucuuca

SEQ ID NO: 3169773 - RNA, 19 nt, Human
aaccugauugugucucuug

SEQ ID NO: 3169774 - RNA, 18 nt, Human
aaccugauugugucucuu

SEQ ID NO: 3169775 - RNA, 23 nt, Human
gucuuuuaaaaaguauugccaaa

SEQ ID NO: 3169776 - RNA, 19 nt, Human
gucuuuuaaaaaguauugc

SEQ ID NO: 3169777 - RNA, 13 nt, Human
guggcaccagcag

SEQ ID NO: 3169778 - RNA, 14 nt, Human
guggcaccagcagc

SEQ ID NO: 3169779 - RNA, 22 nt, Human
guggcagcucaccucucccuug

SEQ ID NO: 3169780 - RNA, 14 nt, Human
guggcagcugcggu

SEQ ID NO: 3169781 - RNA, 22 nt, Human
guggcaaagcuguucuuccugg

SEQ ID NO: 3169782 - RNA, 11 nt, Human
aagaauauuug

SEQ ID NO: 3169783 - RNA, 11 nt, Human
aagaauauugu

SEQ ID NO: 3169784 - RNA, 12 nt, Human
aagaauauugua

SEQ ID NO: 3169785 - RNA, 13 nt, Human
aagaauauuguau

SEQ ID NO: 3169786 - RNA, 18 nt, Human
aagaauauuguauuguua

SEQ ID NO: 3169787 - RNA, 20 nt, Human
guggcagcucaccucucccu

SEQ ID NO: 3169788 - RNA, 17 nt, Human
guggcagcugcggucca

SEQ ID NO: 3169789 - RNA, 15 nt, Human
aagaauauuugaaug

SEQ ID NO: 3169790 - RNA, 13 nt, Human
aagaauauuuuaa

SEQ ID NO: 3169791 - RNA, 21 nt, Human
aagaaucaccuaauuaauuuc

SEQ ID NO: 3169792 - RNA, 13 nt, Human
aagacccaaaagg

SEQ ID NO: 3169793 - RNA, 20 nt, Human
aagaauuuuuuauuuuuugg

SEQ ID NO: 3169794 - RNA, 16 nt, Human
aagaauuuuuuauuuu

SEQ ID NO: 3169795 - RNA, 14 nt, Human
aagaauuuuuuauu

SEQ ID NO: 3169796 - RNA, 17 nt, Human
aagaauuugaagacuuc

SEQ ID NO: 3169797 - RNA, 20 nt, Human
aagaauuugaagacuucaaa

SEQ ID NO: 3169798 - RNA, 14 nt, Human
aagaauucagauug

SEQ ID NO: 3169799 - RNA, 13 nt, Human
gugcugcuuugau

SEQ ID NO: 3169800 - RNA, 21 nt, Human
gugcugcccugcccaccuggc

SEQ ID NO: 3169801 - RNA, 12 nt, Human
gugcugcuuuga

SEQ ID NO: 3169802 - RNA, 19 nt, Human
gugcugcccugcccaccug

SEQ ID NO: 3169803 - RNA, 20 nt, Human
gugcugcccugcccaccugg

SEQ ID NO: 3169804 - RNA, 18 nt, Human
gugcugcccugcccaccu

SEQ ID NO: 3169805 - RNA, 23 nt, Human
aagaagguuucagaaagaagugg

SEQ ID NO: 3169806 - RNA, 20 nt, Human
guggaauuauuuuaaaagau

SEQ ID NO: 3169807 - RNA, 17 nt, Human
guggaaggcagagaaau

SEQ ID NO: 3169808 - RNA, 14 nt, Human
guggaagagggcug

SEQ ID NO: 3169809 - RNA, 17 nt, Human
guggaagagggcugcaa

SEQ ID NO: 3169810 - RNA, 12 nt, Human
gugcugugaaaa

SEQ ID NO: 3169811 - RNA, 19 nt, Human
guggaauuauuuuaaaaga

SEQ ID NO: 3169812 - RNA, 24 nt, Human
guggacacagcucuucuccaggcu

SEQ ID NO: 3169813 - RNA, 23 nt, Human
guggacacagcucuucuccaggc

SEQ ID NO: 3169814 - RNA, 15 nt, Human
guggacacagcucuu

SEQ ID NO: 3169815 - RNA, 14 nt, Human
guggacacagcucu

SEQ ID NO: 3169816 - RNA, 23 nt, Human
gugcacaagcuccaagcucccag

SEQ ID NO: 3169817 - RNA, 17 nt, Human
gugcacacaccagagcc

SEQ ID NO: 3169818 - RNA, 18 nt, Human
gugcacguacacacacau

SEQ ID NO: 3169819 - RNA, 14 nt, Human
gugcacacaccaga

SEQ ID NO: 3169820 - RNA, 12 nt, Human
gugcacacacca

SEQ ID NO: 3169821 - RNA, 16 nt, Human
aacugcagucacugca

SEQ ID NO: 3169822 - RNA, 14 nt, Human
gugccaagcagagg

SEQ ID NO: 3169823 - RNA, 15 nt, Human
gugccucugggacug

SEQ ID NO: 3169824 - RNA, 14 nt, Human
gugccucugggacu

SEQ ID NO: 3169825 - RNA, 12 nt, Human
gugccugcuuca

SEQ ID NO: 3169826 - RNA, 21 nt, Human
gugccugcuucagccucccac

SEQ ID NO: 3169827 - RNA, 13 nt, Human
gugccugcuucag

SEQ ID NO: 3169828 - RNA, 16 nt, Human
gugccuggccacgccc

SEQ ID NO: 3169829 - RNA, 23 nt, Human
gugccugcuucagccucccacag

SEQ ID NO: 3169830 - RNA, 23 nt, Human
aacuugguucccauuugcuccuu

SEQ ID NO: 3169831 - RNA, 22 nt, Human
aacuugucuuuggacccugagg

SEQ ID NO: 3169832 - RNA, 15 nt, Human
aacuuguaaaugugg

SEQ ID NO: 3169833 - RNA, 14 nt, Human
aacuuggcgcugcc

SEQ ID NO: 3169834 - RNA, 16 nt, Human
aacuuggaugaguuuu

SEQ ID NO: 3169835 - RNA, 17 nt, Human
aacuuggaugaguuuug

SEQ ID NO: 3169836 - RNA, 21 nt, Human
aacuugcuuaaaugugaauua

SEQ ID NO: 3169837 - RNA, 20 nt, Human
aacuugcuuaaaugugaauu

SEQ ID NO: 3169838 - RNA, 19 nt, Human
aacuugcuuaaaugugaau

SEQ ID NO: 3169839 - RNA, 18 nt, Human
aacuugcuuaaaugugaa

SEQ ID NO: 3169840 - RNA, 16 nt, Human
aagaaaguucuacagu

SEQ ID NO: 3169841 - RNA, 17 nt, Human
aagaaaggguucuguaa

SEQ ID NO: 3169842 - RNA, 12 nt, Human
aagaagcauuuc

SEQ ID NO: 3169843 - RNA, 16 nt, Human
aagaagcccaggaaag

SEQ ID NO: 3169844 - RNA, 17 nt, Human
aagaagcccaggaaagg

SEQ ID NO: 3169845 - RNA, 14 nt, Human
aagaagcucucucc

SEQ ID NO: 3169846 - RNA, 15 nt, Human
aagaagcucucuccu

SEQ ID NO: 3169847 - RNA, 18 nt, Human
aacuuguaauaaacccuu

SEQ ID NO: 3169848 - RNA, 16 nt, Human
aacuuguuuaauaaag

SEQ ID NO: 3169849 - RNA, 16 nt, Human
aacuuguugaauuuau

SEQ ID NO: 3169850 - RNA, 20 nt, Human
aacuuguucuuccaaagcag

SEQ ID NO: 3169851 - RNA, 19 nt, Human
aacuuguucuuccaaagca

SEQ ID NO: 3169852 - RNA, 13 nt, Human
aagaaaaauauuu

SEQ ID NO: 3169853 - RNA, 12 nt, Human
aagaaaaauauu

SEQ ID NO: 3169854 - RNA, 11 nt, Human
aagaaaaauau

SEQ ID NO: 3169855 - RNA, 13 nt, Human
aagaaaaccaaac

SEQ ID NO: 3169856 - RNA, 13 nt, Human
aagaaaauaaaaa

SEQ ID NO: 3169857 - RNA, 21 nt, Human
aagaaaauaaaaaaaagaaaa

SEQ ID NO: 3169858 - RNA, 18 nt, Human
aagaaaauaaaaaaaaga

SEQ ID NO: 3169859 - RNA, 23 nt, Human
aagaaaauaaaaaaaagaaaaaa

SEQ ID NO: 3169860 - RNA, 22 nt, Human
aagaaaauaaaaaaaagaaaaa

SEQ ID NO: 3169861 - RNA, 15 nt, Human
gugggggucugugug

SEQ ID NO: 3169862 - RNA, 16 nt, Human
gugggggucugugugu

SEQ ID NO: 3169863 - RNA, 14 nt, Human
gugggggucugugu

SEQ ID NO: 3169864 - RNA, 16 nt, Human
gugggcaaaagagugu

SEQ ID NO: 3169865 - RNA, 21 nt, Human
gugggucaugaugcucuuucc

SEQ ID NO: 3169866 - RNA, 15 nt, Human
gugguguuuccuggc

SEQ ID NO: 3169867 - RNA, 16 nt, Human
gugguguuuccuggca

SEQ ID NO: 3169868 - RNA, 13 nt, Human
guggccucccaac

SEQ ID NO: 3169869 - RNA, 14 nt, Human
guggccucccaacu

SEQ ID NO: 3169870 - RNA, 21 nt, Human
guggcuucccgcucagcccuc

SEQ ID NO: 3169871 - RNA, 13 nt, Human
gugggauccucca

SEQ ID NO: 3169872 - RNA, 15 nt, Human
gugggauccuccagg

SEQ ID NO: 3169873 - RNA, 18 nt, Human
gugggauccuccaggugc

SEQ ID NO: 3169874 - RNA, 12 nt, Human
gugggagcugag

SEQ ID NO: 3169875 - RNA, 20 nt, Human
aagagaugaugaaaauauuu

SEQ ID NO: 3169876 - RNA, 23 nt, Human
aagagauggcuuacaaaaagaaa

SEQ ID NO: 3169877 - RNA, 16 nt, Human
aagagauugugguuuc

SEQ ID NO: 3169878 - RNA, 19 nt, Human
aagagauugugguuucauu

SEQ ID NO: 3169879 - RNA, 12 nt, Human
aagagcccaggc

SEQ ID NO: 3169880 - RNA, 14 nt, Human
aagagcccaggccu

SEQ ID NO: 3169881 - RNA, 16 nt, Human
aagagcccaggccucc

SEQ ID NO: 3169882 - RNA, 12 nt, Human
aagagccccacu

SEQ ID NO: 3169883 - RNA, 18 nt, Human
aagagcuguucacagcca

SEQ ID NO: 3169884 - RNA, 22 nt, Human
aagagcuaggcagggugucugc

SEQ ID NO: 3169885 - RNA, 13 nt, Human
aagagccccacuc

SEQ ID NO: 3169886 - RNA, 17 nt, Human
aagagccccacucucag

SEQ ID NO: 3169887 - RNA, 16 nt, Human
aagagccccacucuca

SEQ ID NO: 3169888 - RNA, 19 nt, Human
aagagccccacucucagag

SEQ ID NO: 3169889 - RNA, 18 nt, Human
aagagccccacucucaga

SEQ ID NO: 3169890 - RNA, 15 nt, Human
aagagcuagagaaau

SEQ ID NO: 3169891 - RNA, 16 nt, Human
aagagcuaggcagggu

SEQ ID NO: 3169892 - RNA, 13 nt, Human
aagagcuaggcag

SEQ ID NO: 3169893 - RNA, 13 nt, Human
guggccccaccug

SEQ ID NO: 3169894 - RNA, 22 nt, Human
guggccccaccuggcccucucu

SEQ ID NO: 3169895 - RNA, 16 nt, Human
guggcccgacagccug

SEQ ID NO: 3169896 - RNA, 14 nt, Human
aagacuccagaaau

SEQ ID NO: 3169897 - RNA, 13 nt, Human
aagacuccagaaa

SEQ ID NO: 3169898 - RNA, 12 nt, Human
aagacuccagaa

SEQ ID NO: 3169899 - RNA, 17 nt, Human
aagacuccaaagaaaug

SEQ ID NO: 3169900 - RNA, 16 nt, Human
aagacuccaaagaaau

SEQ ID NO: 3169901 - RNA, 14 nt, Human
aagacuccaaagaa

SEQ ID NO: 3169902 - RNA, 17 nt, Human
aagacucauucuucugu

SEQ ID NO: 3169903 - RNA, 14 nt, Human
aagacuauucaaac

SEQ ID NO: 3169904 - RNA, 13 nt, Human
aagacuauucaaa

SEQ ID NO: 3169905 - RNA, 20 nt, Human
aagacgcugugcugcccugc

SEQ ID NO: 3169906 - RNA, 23 nt, Human
aagacgcugugcugcccugccca

SEQ ID NO: 3169907 - RNA, 21 nt, Human
aagacgcugugcugcccugcc

SEQ ID NO: 3169908 - RNA, 22 nt, Human
aagacgcugugcugcccugccc

SEQ ID NO: 3169909 - RNA, 12 nt, Human
aagaccagucca

SEQ ID NO: 3169910 - RNA, 13 nt, Human
guguguguaugug

SEQ ID NO: 3169911 - RNA, 16 nt, Human
gugugugggagugugu

SEQ ID NO: 3169912 - RNA, 21 nt, Human
guguguaagaugucuuccuau

SEQ ID NO: 3169913 - RNA, 19 nt, Human
gugugguguuuccuggcac

SEQ ID NO: 3169914 - RNA, 17 nt, Human
guguguguugugugugg

SEQ ID NO: 3169915 - RNA, 14 nt, Human
guguguguaugugg

SEQ ID NO: 3169916 - RNA, 19 nt, Human
guguguguaugcgugugug

SEQ ID NO: 3169917 - RNA, 11 nt, Human
guguguuccug

SEQ ID NO: 3169918 - RNA, 12 nt, Human
guguguuccugg

SEQ ID NO: 3169919 - RNA, 13 nt, Human
guguguuccuggc

SEQ ID NO: 3169920 - RNA, 19 nt, Human
guguguuacaauguaacuu

SEQ ID NO: 3169921 - RNA, 15 nt, Human
guguguuacaaugua

SEQ ID NO: 3169922 - RNA, 13 nt, Human
guguguuacaaug

SEQ ID NO: 3169923 - RNA, 13 nt, Human
guguguguguugc

SEQ ID NO: 3169924 - RNA, 19 nt, Human
guguucuguuacaaaaugu

SEQ ID NO: 3169925 - RNA, 18 nt, Human
guguucuguuacaaaaug

SEQ ID NO: 3169926 - RNA, 17 nt, Human
guguucuguuacaaaau

SEQ ID NO: 3169927 - RNA, 15 nt, Human
guguucuguuacaaa

SEQ ID NO: 3169928 - RNA, 14 nt, Human
guguucuguuacaa

SEQ ID NO: 3169929 - RNA, 13 nt, Human
guguucuguuaca

SEQ ID NO: 3169930 - RNA, 18 nt, Human
guguugacuuuauaaauu

SEQ ID NO: 3169931 - RNA, 21 nt, Human
guguugaagagcagcuccuuc

SEQ ID NO: 3169932 - RNA, 15 nt, Human
guguuguguguggga

SEQ ID NO: 3169933 - RNA, 13 nt, Human
guguuuaagacau

SEQ ID NO: 3169934 - RNA, 14 nt, Human
guguuuaagacauu

SEQ ID NO: 3169935 - RNA, 19 nt, Human
gugucuugcaauggcagcc

SEQ ID NO: 3169936 - RNA, 15 nt, Human
gugugguguuuccug

SEQ ID NO: 3169937 - RNA, 18 nt, Human
gugugagucaccaagccc

SEQ ID NO: 3169938 - RNA, 13 nt, Human
gugugagucacca

SEQ ID NO: 3169939 - RNA, 21 nt, Human
gugucuugcaauggcagccuu

SEQ ID NO: 3169940 - RNA, 20 nt, Human
gugguucacucuuggagccu

SEQ ID NO: 3169941 - RNA, 14 nt, Human
aagaguaggaagac

SEQ ID NO: 3169942 - RNA, 18 nt, Human
gugguuauggagagggug

SEQ ID NO: 3169943 - RNA, 19 nt, Human
gugguguuuccuggcacug

SEQ ID NO: 3169944 - RNA, 16 nt, Human
aagaguaggaagacuu

SEQ ID NO: 3169945 - RNA, 18 nt, Human
aagaguaggaagacuuug

SEQ ID NO: 3169946 - RNA, 19 nt, Human
aagaguaggaagacuuugg

SEQ ID NO: 3169947 - RNA, 12 nt, Human
aagaucacuguu

SEQ ID NO: 3169948 - RNA, 14 nt, Human
aagaucacuguuua

SEQ ID NO: 3169949 - RNA, 20 nt, Human
aagaucacuguuuagauuug

SEQ ID NO: 3169950 - RNA, 12 nt, Human
aagcaaaugucu

SEQ ID NO: 3169951 - RNA, 15 nt, Human
aagaugcaauguaga

SEQ ID NO: 3169952 - RNA, 16 nt, Human
aagauguagauuuauu

SEQ ID NO: 3169953 - RNA, 22 nt, Human
aagauguagaggagaaacugga

SEQ ID NO: 3169954 - RNA, 13 nt, Human
aagcaaaauguga

SEQ ID NO: 3169955 - RNA, 22 nt, Human
aagauguagauuuauuucauca

SEQ ID NO: 3169956 - RNA, 19 nt, Human
aagauguagauuuauuuca

SEQ ID NO: 3169957 - RNA, 23 nt, Human
aagauguagcaaacccugucaaa

SEQ ID NO: 3169958 - RNA, 18 nt, Human
aagauguagcaaacccug

SEQ ID NO: 3169959 - RNA, 14 nt, Human
aagauguagcaaac

SEQ ID NO: 3169960 - RNA, 13 nt, Human
aagauguagcaaa

SEQ ID NO: 3169961 - RNA, 19 nt, Human
aagauguagaggagaaacu

SEQ ID NO: 3169962 - RNA, 22 nt, Human
aagaugagaacagauaaagauu

SEQ ID NO: 3169963 - RNA, 20 nt, Human
aagaugagaacagauaaaga

SEQ ID NO: 3169964 - RNA, 19 nt, Human
aagaugagaacagauaaag

SEQ ID NO: 3169965 - RNA, 20 nt, Human
acaccucaacuaaauccaaa

SEQ ID NO: 3169966 - RNA, 17 nt, Human
acaccucacucugcuac

SEQ ID NO: 3169967 - RNA, 18 nt, Human
acaccucacucugcuacc

SEQ ID NO: 3169968 - RNA, 20 nt, Human
acaccucacucugcuaccuu

SEQ ID NO: 3169969 - RNA, 21 nt, Human
uauaauuuaccugaagucuuu

SEQ ID NO: 3169970 - RNA, 21 nt, Human
uauaagcccuugauuggaagg

SEQ ID NO: 3169971 - RNA, 18 nt, Human
uauaagccaaaauuaagg

SEQ ID NO: 3169972 - RNA, 19 nt, Human
uauaagccaaaauuaaggu

SEQ ID NO: 3169973 - RNA, 21 nt, Human
uauaagccaaaauuaaggugu

SEQ ID NO: 3169974 - RNA, 22 nt, Human
uauaagccaaaauuaagguguu

SEQ ID NO: 3169975 - RNA, 23 nt, Human
uauaagccaaaauuaagguguuu

SEQ ID NO: 3169976 - RNA, 19 nt, Human
uauaagcaaauugcuuuuu

SEQ ID NO: 3169977 - RNA, 22 nt, Human
uauaagagcuuccaauuuuccu

SEQ ID NO: 3169978 - RNA, 17 nt, Human
uauaccauuuccguaau

SEQ ID NO: 3169979 - RNA, 13 nt, Human
uauaccauuuccg

SEQ ID NO: 3169980 - RNA, 14 nt, Human
uauacauuugauaa

SEQ ID NO: 3169981 - RNA, 20 nt, Human
uauacauguuuauguaaaca

SEQ ID NO: 3169982 - RNA, 16 nt, Human
uauacaguuauaaaau

SEQ ID NO: 3169983 - RNA, 18 nt, Human
uauacaguuauaaaauua

SEQ ID NO: 3169984 - RNA, 19 nt, Human
uauacaguuauaaaauuaa

SEQ ID NO: 3169985 - RNA, 20 nt, Human
uauacaguuauaaaauuaaa

SEQ ID NO: 3169986 - RNA, 22 nt, Human
uauacaguuauaaaauuaaaag

SEQ ID NO: 3169987 - RNA, 23 nt, Human
uauacaguuauaaaauuaaaagu

SEQ ID NO: 3169988 - RNA, 16 nt, Human
uauaccaaauuaaaaa

SEQ ID NO: 3169989 - RNA, 13 nt, Human
uauacaaguacug

SEQ ID NO: 3169990 - RNA, 16 nt, Human
uauacaaguacuggua

SEQ ID NO: 3169991 - RNA, 19 nt, Human
uauacaaguacugguaaga

SEQ ID NO: 3169992 - RNA, 23 nt, Human
uauacaaguacugguaagauugu

SEQ ID NO: 3169993 - RNA, 17 nt, Human
uauacaaccuucauuua

SEQ ID NO: 3169994 - RNA, 18 nt, Human
uauacaaccuucauuuaa

SEQ ID NO: 3169995 - RNA, 19 nt, Human
uauacaaccuucauuuaaa

SEQ ID NO: 3169996 - RNA, 20 nt, Human
uauacaaccuucauuuaaaa

SEQ ID NO: 3169997 - RNA, 14 nt, Human
uauaauuuugauag

SEQ ID NO: 3169998 - RNA, 15 nt, Human
uauaauuuugauagu

SEQ ID NO: 3169999 - RNA, 13 nt, Human
uauauauauaucu

SEQ ID NO: 3170000 - RNA, 15 nt, Human
uauauauaugcauau

SEQ ID NO: 3170001 - RNA, 14 nt, Human
uauauauaugcaua

SEQ ID NO: 3170002 - RNA, 13 nt, Human
uauauauaugcau

SEQ ID NO: 3170003 - RNA, 13 nt, Human
uauauauaucugu

SEQ ID NO: 3170004 - RNA, 13 nt, Human
uauauauaugugu

SEQ ID NO: 3170005 - RNA, 15 nt, Human
uauaucagacugcuu

SEQ ID NO: 3170006 - RNA, 21 nt, Human
uauaucagacugcuuugagaa

SEQ ID NO: 3170007 - RNA, 19 nt, Human
acacucauugaccugaggc

SEQ ID NO: 3170008 - RNA, 19 nt, Human
uauaucccugauaaauauu

SEQ ID NO: 3170009 - RNA, 16 nt, Human
uauaucccugauaaau

SEQ ID NO: 3170010 - RNA, 17 nt, Human
uauaucauucuaaagau

SEQ ID NO: 3170011 - RNA, 16 nt, Human
uauaucauucuaaaga

SEQ ID NO: 3170012 - RNA, 21 nt, Human
acacucauugaccugaggccc

SEQ ID NO: 3170013 - RNA, 23 nt, Human
acacucauugaccugaggcccuu

SEQ ID NO: 3170014 - RNA, 11 nt, Human
acacuccaacg

SEQ ID NO: 3170015 - RNA, 23 nt, Human
uauaggugcuacaaaaacacagc

SEQ ID NO: 3170016 - RNA, 20 nt, Human
uauaggugcuacaaaaacac

SEQ ID NO: 3170017 - RNA, 21 nt, Human
uauaggugcuacaaaaacaca

SEQ ID NO: 3170018 - RNA, 14 nt, Human
uauaggaauugacc

SEQ ID NO: 3170019 - RNA, 13 nt, Human
uauaggaauugac

SEQ ID NO: 3170020 - RNA, 12 nt, Human
uauaggaauuga

SEQ ID NO: 3170021 - RNA, 20 nt, Human
uauagccuaggugacagagu

SEQ ID NO: 3170022 - RNA, 18 nt, Human
uauagccuaggugacaga

SEQ ID NO: 3170023 - RNA, 22 nt, Human
uaguucuagugcagcugaaauu

SEQ ID NO: 3170024 - RNA, 23 nt, Human
uaguucuagugcagcugaaauug

SEQ ID NO: 3170025 - RNA, 12 nt, Human
uaguucuguauu

SEQ ID NO: 3170026 - RNA, 14 nt, Human
uaguucuguauuug

SEQ ID NO: 3170027 - RNA, 15 nt, Human
uaguucuguauuuga

SEQ ID NO: 3170028 - RNA, 9 nt, Human
uaguucugu

SEQ ID NO: 3170029 - RNA, 20 nt, Human
uaguuacuguaaaaugcaaa

SEQ ID NO: 3170030 - RNA, 14 nt, Human
uaguuacuguaaaa

SEQ ID NO: 3170031 - RNA, 12 nt, Human
uaguuacuguaa

SEQ ID NO: 3170032 - RNA, 19 nt, Human
uagugacuuuucaaguauu

SEQ ID NO: 3170033 - RNA, 11 nt, Human
uagugacuuuu

SEQ ID NO: 3170034 - RNA, 20 nt, Human
uaguuccucauuagcauuuu

SEQ ID NO: 3170035 - RNA, 21 nt, Human
uagucugaagugaaguacaga

SEQ ID NO: 3170036 - RNA, 21 nt, Human
uagucagcgcaggaaugcaca

SEQ ID NO: 3170037 - RNA, 17 nt, Human
uagucauuuucaagacu

SEQ ID NO: 3170038 - RNA, 19 nt, Human
acaagcugcacccucaggc

SEQ ID NO: 3170039 - RNA, 21 nt, Human
acaagcugcacccucaggcag

SEQ ID NO: 3170040 - RNA, 22 nt, Human
acaagcugcacccucaggcagg

SEQ ID NO: 3170041 - RNA, 23 nt, Human
acaagcugcacccucaggcaggu

SEQ ID NO: 3170042 - RNA, 21 nt, Human
uagucaggugccucaagagaa

SEQ ID NO: 3170043 - RNA, 20 nt, Human
uagucacugagacagcccgg

SEQ ID NO: 3170044 - RNA, 19 nt, Human
acaaggaagaaauuaacuu

SEQ ID NO: 3170045 - RNA, 14 nt, Human
acaaggaagaaauu

SEQ ID NO: 3170046 - RNA, 19 nt, Human
acaagcuggcuuacacugg

SEQ ID NO: 3170047 - RNA, 20 nt, Human
acaagcuguugaccaggcac

SEQ ID NO: 3170048 - RNA, 22 nt, Human
acaagcuguugaccaggcaccu

SEQ ID NO: 3170049 - RNA, 13 nt, Human
acaagcuggcuua

SEQ ID NO: 3170050 - RNA, 23 nt, Human
uaguuuuauuuucuaaaguacug

SEQ ID NO: 3170051 - RNA, 13 nt, Human
uaguuuucucagc

SEQ ID NO: 3170052 - RNA, 14 nt, Human
uaguuuuauuuaua

SEQ ID NO: 3170053 - RNA, 15 nt, Human
uaguuuuauuuauau

SEQ ID NO: 3170054 - RNA, 21 nt, Human
uaguuuuauuuauauuuauug

SEQ ID NO: 3170055 - RNA, 22 nt, Human
uaguuuuauuuauauuuauuga

SEQ ID NO: 3170056 - RNA, 15 nt, Human
uaguuuuauuuucua

SEQ ID NO: 3170057 - RNA, 19 nt, Human
uaguuuuauuuucuaaagu

SEQ ID NO: 3170058 - RNA, 17 nt, Human
uaguuuuauuuucuaaa

SEQ ID NO: 3170059 - RNA, 22 nt, Human
acacaucagcuugcccuguuaa

SEQ ID NO: 3170060 - RNA, 14 nt, Human
acacaucaucugua

SEQ ID NO: 3170061 - RNA, 12 nt, Human
uauaaaauaacu

SEQ ID NO: 3170062 - RNA, 15 nt, Human
uauaaaauaacuaaa

SEQ ID NO: 3170063 - RNA, 19 nt, Human
uauaaaauaacuaaaaugu

SEQ ID NO: 3170064 - RNA, 16 nt, Human
acacaucaucuguaag

SEQ ID NO: 3170065 - RNA, 15 nt, Human
acacaucaucuguaa

SEQ ID NO: 3170066 - RNA, 21 nt, Human
acacccagcccacuucugcca

SEQ ID NO: 3170067 - RNA, 20 nt, Human
acacccagcccacuucugcc

SEQ ID NO: 3170068 - RNA, 19 nt, Human
acacccagcccacuucugc

SEQ ID NO: 3170069 - RNA, 12 nt, Human
acacccugugau

SEQ ID NO: 3170070 - RNA, 18 nt, Human
acacccugugauggggcc

SEQ ID NO: 3170071 - RNA, 11 nt, Human
acacccuguga

SEQ ID NO: 3170072 - RNA, 16 nt, Human
acaccgggccuggaga

SEQ ID NO: 3170073 - RNA, 17 nt, Human
uauggggauagaugugu

SEQ ID NO: 3170074 - RNA, 18 nt, Human
uauggggauagaugugug

SEQ ID NO: 3170075 - RNA, 19 nt, Human
uauggggauagaugugugg

SEQ ID NO: 3170076 - RNA, 14 nt, Human
acagccuggcacag

SEQ ID NO: 3170077 - RNA, 15 nt, Human
acagccuggcacagg

SEQ ID NO: 3170078 - RNA, 17 nt, Human
uauggcuauaggugcua

SEQ ID NO: 3170079 - RNA, 21 nt, Human
uauggcugcauaguauuccau

SEQ ID NO: 3170080 - RNA, 10 nt, Human
uaugggagag

SEQ ID NO: 3170081 - RNA, 21 nt, Human
uauggcuuuauuuuuuugaac

SEQ ID NO: 3170082 - RNA, 14 nt, Human
acagcuaacaugga

SEQ ID NO: 3170083 - RNA, 15 nt, Human
acagcuaacauggaa

SEQ ID NO: 3170084 - RNA, 12 nt, Human
acagccuggcac

SEQ ID NO: 3170085 - RNA, 21 nt, Human
acagccuggucgccuuccacc

SEQ ID NO: 3170086 - RNA, 20 nt, Human
acagccuggucgccuuccac

SEQ ID NO: 3170087 - RNA, 17 nt, Human
acagcuaacauggaagu

SEQ ID NO: 3170088 - RNA, 20 nt, Human
acagcuaaucagcauucuca

SEQ ID NO: 3170089 - RNA, 16 nt, Human
uauggcuauaggugcu

SEQ ID NO: 3170090 - RNA, 19 nt, Human
uaugcucugcauguuacau

SEQ ID NO: 3170091 - RNA, 17 nt, Human
uaugauuaaaaauauca

SEQ ID NO: 3170092 - RNA, 21 nt, Human
uaugauuaaaaauaucaaauu

SEQ ID NO: 3170093 - RNA, 21 nt, Human
uaugaugacguacaaguaguu

SEQ ID NO: 3170094 - RNA, 14 nt, Human
uaugcucugcaugu

SEQ ID NO: 3170095 - RNA, 12 nt, Human
uaugauuaaaaa

SEQ ID NO: 3170096 - RNA, 14 nt, Human
uaugauuaaaaaua

SEQ ID NO: 3170097 - RNA, 20 nt, Human
uaugauguuaguuuuccuua

SEQ ID NO: 3170098 - RNA, 18 nt, Human
uaugcucugcauguuaca

SEQ ID NO: 3170099 - RNA, 19 nt, Human
uaugauguuaguuuuccuu

SEQ ID NO: 3170100 - RNA, 15 nt, Human
uaucuugaagacuuu

SEQ ID NO: 3170101 - RNA, 20 nt, Human
uaucuugcuugaacuuacag

SEQ ID NO: 3170102 - RNA, 13 nt, Human
uaucuugcuugaa

SEQ ID NO: 3170103 - RNA, 17 nt, Human
uaucuugaaggaaaaau

SEQ ID NO: 3170104 - RNA, 14 nt, Human
uaucuugaaggaaa

SEQ ID NO: 3170105 - RNA, 13 nt, Human
uaugauaaauuug

SEQ ID NO: 3170106 - RNA, 23 nt, Human
uaugaucacggcucacugcagcc

SEQ ID NO: 3170107 - RNA, 21 nt, Human
uaugaucacggcucacugcag

SEQ ID NO: 3170108 - RNA, 14 nt, Human
uaugaucacggcuc

SEQ ID NO: 3170109 - RNA, 13 nt, Human
acagcccaccugg

SEQ ID NO: 3170110 - RNA, 14 nt, Human
uaucuugaagacuu

SEQ ID NO: 3170111 - RNA, 17 nt, Human
acagcagccccugcaca

SEQ ID NO: 3170112 - RNA, 18 nt, Human
acagcagccccugcacaa

SEQ ID NO: 3170113 - RNA, 18 nt, Human
acagaguuuucacucuua

SEQ ID NO: 3170114 - RNA, 20 nt, Human
acagaguuuucacucuuauu

SEQ ID NO: 3170115 - RNA, 13 nt, Human
acagauaaagauu

SEQ ID NO: 3170116 - RNA, 14 nt, Human
acagauaaaugauu

SEQ ID NO: 3170117 - RNA, 17 nt, Human
acagauaaagauugugu

SEQ ID NO: 3170118 - RNA, 22 nt, Human
acagaguggacuguucccugag

SEQ ID NO: 3170119 - RNA, 22 nt, Human
acagagugccaacuucuuucau

SEQ ID NO: 3170120 - RNA, 21 nt, Human
acagagugagacucugucuca

SEQ ID NO: 3170121 - RNA, 16 nt, Human
acagagcuacacaggg

SEQ ID NO: 3170122 - RNA, 15 nt, Human
acagagccugcccca

SEQ ID NO: 3170123 - RNA, 12 nt, Human
acagagccugcc

SEQ ID NO: 3170124 - RNA, 19 nt, Human
acagagccugccccagcgc

SEQ ID NO: 3170125 - RNA, 17 nt, Human
acagagcgacagagcag

SEQ ID NO: 3170126 - RNA, 16 nt, Human
acagagcgacagagca

SEQ ID NO: 3170127 - RNA, 20 nt, Human
acagagcccacgcccccacu

SEQ ID NO: 3170128 - RNA, 17 nt, Human
acagagccguaaaaacu

SEQ ID NO: 3170129 - RNA, 22 nt, Human
acagacuggaagcacagcuuca

SEQ ID NO: 3170130 - RNA, 20 nt, Human
acagacuggauguaccacca

SEQ ID NO: 3170131 - RNA, 14 nt, Human
acagacuucugaaa

SEQ ID NO: 3170132 - RNA, 12 nt, Human
acagacuuguau

SEQ ID NO: 3170133 - RNA, 13 nt, Human
acagacuucugaa

SEQ ID NO: 3170134 - RNA, 20 nt, Human
acagagagagauacucuggg

SEQ ID NO: 3170135 - RNA, 19 nt, Human
acagagagagauacucugg

SEQ ID NO: 3170136 - RNA, 20 nt, Human
acagacuuuagcuuucugag

SEQ ID NO: 3170137 - RNA, 19 nt, Human
acagacuuuagcuuucuga

SEQ ID NO: 3170138 - RNA, 17 nt, Human
acagacuuuagcuuucu

SEQ ID NO: 3170139 - RNA, 16 nt, Human
acagacuuuagcuuuc

SEQ ID NO: 3170140 - RNA, 14 nt, Human
acagacuuguauau

SEQ ID NO: 3170141 - RNA, 14 nt, Human
uaucuaguaauaua

SEQ ID NO: 3170142 - RNA, 15 nt, Human
uaucuagauguaaau

SEQ ID NO: 3170143 - RNA, 13 nt, Human
uaucuagauguaa

SEQ ID NO: 3170144 - RNA, 17 nt, Human
uaucuagauguaaauuu

SEQ ID NO: 3170145 - RNA, 18 nt, Human
uaucuagcugcauaucuu

SEQ ID NO: 3170146 - RNA, 13 nt, Human
uaucuagcugcau

SEQ ID NO: 3170147 - RNA, 16 nt, Human
uaucucccccagcccc

SEQ ID NO: 3170148 - RNA, 18 nt, Human
uaucucccccagccccau

SEQ ID NO: 3170149 - RNA, 17 nt, Human
uaucucccccagcccca

SEQ ID NO: 3170150 - RNA, 23 nt, Human
uaucuaguaauauauuuaaaggg

SEQ ID NO: 3170151 - RNA, 16 nt, Human
uaucuaguguuugauu

SEQ ID NO: 3170152 - RNA, 15 nt, Human
uaucuaguguuugau

SEQ ID NO: 3170153 - RNA, 13 nt, Human
uaucuacuugugu

SEQ ID NO: 3170154 - RNA, 14 nt, Human
acagacuggaagca

SEQ ID NO: 3170155 - RNA, 17 nt, Human
uauauucuauuuuacaa

SEQ ID NO: 3170156 - RNA, 18 nt, Human
acagacccugcccugugg

SEQ ID NO: 3170157 - RNA, 20 nt, Human
acagacccugcccugugggc

SEQ ID NO: 3170158 - RNA, 21 nt, Human
acagacacucccacuuggcau

SEQ ID NO: 3170159 - RNA, 13 nt, Human
acagacagcccuc

SEQ ID NO: 3170160 - RNA, 17 nt, Human
acagacccugcccugug

SEQ ID NO: 3170161 - RNA, 16 nt, Human
acagacccugcccugu

SEQ ID NO: 3170162 - RNA, 11 nt, Human
acacuccuuca

SEQ ID NO: 3170163 - RNA, 23 nt, Human
acagacacaggcccggcuccagg

SEQ ID NO: 3170164 - RNA, 22 nt, Human
acagacacaggcccggcuccag

SEQ ID NO: 3170165 - RNA, 18 nt, Human
uauauuuacaacacuuua

SEQ ID NO: 3170166 - RNA, 15 nt, Human
uauauugguuuuaug

SEQ ID NO: 3170167 - RNA, 16 nt, Human
uauauugguuuuauga

SEQ ID NO: 3170168 - RNA, 17 nt, Human
uauauugguuuuaugau

SEQ ID NO: 3170169 - RNA, 19 nt, Human
uauauugcacaauuauaaa

SEQ ID NO: 3170170 - RNA, 13 nt, Human
uaucacucauuaa

SEQ ID NO: 3170171 - RNA, 19 nt, Human
uaucacucauuaauuaacc

SEQ ID NO: 3170172 - RNA, 20 nt, Human
uaucacugugcaguugcugu

SEQ ID NO: 3170173 - RNA, 12 nt, Human
uaucaauguguc

SEQ ID NO: 3170174 - RNA, 15 nt, Human
uaucaaugugucuuu

SEQ ID NO: 3170175 - RNA, 16 nt, Human
uaucaaugugucuuuc

SEQ ID NO: 3170176 - RNA, 14 nt, Human
uauguguguguguu

SEQ ID NO: 3170177 - RNA, 22 nt, Human
uauguguguguguugugugugg

SEQ ID NO: 3170178 - RNA, 11 nt, Human
uaugugugugu

SEQ ID NO: 3170179 - RNA, 13 nt, Human
acagcugcuuucu

SEQ ID NO: 3170180 - RNA, 16 nt, Human
acagcucccccagcuc

SEQ ID NO: 3170181 - RNA, 12 nt, Human
acagcuccccca

SEQ ID NO: 3170182 - RNA, 23 nt, Human
uauguguguguguuguguguggg

SEQ ID NO: 3170183 - RNA, 19 nt, Human
uauguuuuaagaggcaggg

SEQ ID NO: 3170184 - RNA, 17 nt, Human
uauguuuuaagaggcag

SEQ ID NO: 3170185 - RNA, 12 nt, Human
uauuaaaacuca

SEQ ID NO: 3170186 - RNA, 18 nt, Human
uauuaaaauuguuguccg

SEQ ID NO: 3170187 - RNA, 12 nt, Human
uauuaaacaaag

SEQ ID NO: 3170188 - RNA, 13 nt, Human
uauuaaacaaagu

SEQ ID NO: 3170189 - RNA, 17 nt, Human
uauuaaacaaaguuuca

SEQ ID NO: 3170190 - RNA, 18 nt, Human
uauuaaacaaaguuucag

SEQ ID NO: 3170191 - RNA, 19 nt, Human
uauuaaacaaaguuucaga

SEQ ID NO: 3170192 - RNA, 17 nt, Human
uauuaaaccauaagaug

SEQ ID NO: 3170193 - RNA, 20 nt, Human
uauuaaaccauaagauggca

SEQ ID NO: 3170194 - RNA, 13 nt, Human
uauuaaaguuuca

SEQ ID NO: 3170195 - RNA, 18 nt, Human
uauuaaaguuucaaaaau

SEQ ID NO: 3170196 - RNA, 16 nt, Human
uauuaaaguuucaaaa

SEQ ID NO: 3170197 - RNA, 15 nt, Human
uauuaaaguuucaaa

SEQ ID NO: 3170198 - RNA, 14 nt, Human
uauuaaaguuucaa

SEQ ID NO: 3170199 - RNA, 22 nt, Human
uauuaaaguuucaaaaaucuga

SEQ ID NO: 3170200 - RNA, 21 nt, Human
uauuaaaguuucaaaaaucug

SEQ ID NO: 3170201 - RNA, 19 nt, Human
uauucaggggaaacuugau

SEQ ID NO: 3170202 - RNA, 15 nt, Human
uauucaggcuuuagg

SEQ ID NO: 3170203 - RNA, 22 nt, Human
uauucagcaaggcgcuaacuug

SEQ ID NO: 3170204 - RNA, 23 nt, Human
uauucagcaaggcgcuaacuugc

SEQ ID NO: 3170205 - RNA, 18 nt, Human
uauucaggaagcucaggg

SEQ ID NO: 3170206 - RNA, 22 nt, Human
uauucaggaagcucagggccug

SEQ ID NO: 3170207 - RNA, 17 nt, Human
uauucauaguagaacuu

SEQ ID NO: 3170208 - RNA, 23 nt, Human
uauucauagcagcuuauucacaa

SEQ ID NO: 3170209 - RNA, 15 nt, Human
uauucauauuuguac

SEQ ID NO: 3170210 - RNA, 13 nt, Human
uauucauauuugu

SEQ ID NO: 3170211 - RNA, 23 nt, Human
uauucauauuuguacuuucuguu

SEQ ID NO: 3170212 - RNA, 22 nt, Human
uauucauauuuguacuuucugu

SEQ ID NO: 3170213 - RNA, 17 nt, Human
uauucauauuuguacuu

SEQ ID NO: 3170214 - RNA, 16 nt, Human
uauucauauuuguacu

SEQ ID NO: 3170215 - RNA, 17 nt, Human
uauucaccuucaguuuu

SEQ ID NO: 3170216 - RNA, 16 nt, Human
uauucaggaagcucag

SEQ ID NO: 3170217 - RNA, 20 nt, Human
uauuaccaccaucccgugcu

SEQ ID NO: 3170218 - RNA, 12 nt, Human
uauuagagaaga

SEQ ID NO: 3170219 - RNA, 20 nt, Human
uauuacgaaguucaagauca

SEQ ID NO: 3170220 - RNA, 21 nt, Human
uauuacgaaguucaagaucaa

SEQ ID NO: 3170221 - RNA, 22 nt, Human
uauuagaucaaauaguugcaua

SEQ ID NO: 3170222 - RNA, 23 nt, Human
uauuagacuucuguuuucaaucu

SEQ ID NO: 3170223 - RNA, 21 nt, Human
uauuagacuucuguuuucaau

SEQ ID NO: 3170224 - RNA, 20 nt, Human
uauuagacuucuguuuucaa

SEQ ID NO: 3170225 - RNA, 17 nt, Human
uauuagacuucuguuuu

SEQ ID NO: 3170226 - RNA, 20 nt, Human
uauuagcgacaacagauugg

SEQ ID NO: 3170227 - RNA, 18 nt, Human
uauuagcgacaacagauu

SEQ ID NO: 3170228 - RNA, 16 nt, Human
uauuagcccugcauuu

SEQ ID NO: 3170229 - RNA, 17 nt, Human
uauuagcccugcauuuu

SEQ ID NO: 3170230 - RNA, 20 nt, Human
uauuagcccugcauuuucau

SEQ ID NO: 3170231 - RNA, 22 nt, Human
uauuagcccugcauuuucauag

SEQ ID NO: 3170232 - RNA, 23 nt, Human
uauuagcagcugacuuucaaagu

SEQ ID NO: 3170233 - RNA, 23 nt, Human
uauuaguguuauaugaacauaca

SEQ ID NO: 3170234 - RNA, 13 nt, Human
uauuauaaaaaua

SEQ ID NO: 3170235 - RNA, 17 nt, Human
uauuauaaaaauauuaa

SEQ ID NO: 3170236 - RNA, 23 nt, Human
uauuauaaacaagaaugaagguu

SEQ ID NO: 3170237 - RNA, 19 nt, Human
uauuauaaacaagaaugaa

SEQ ID NO: 3170238 - RNA, 13 nt, Human
uauuauaaacaag

SEQ ID NO: 3170239 - RNA, 23 nt, Human
uauuagcgacaacagauuggauu

SEQ ID NO: 3170240 - RNA, 21 nt, Human
uauuagcgacaacagauugga

SEQ ID NO: 3170241 - RNA, 21 nt, Human
uauuagugaccucagcuuuga

SEQ ID NO: 3170242 - RNA, 22 nt, Human
uauuaguuccccaaauacaaag

SEQ ID NO: 3170243 - RNA, 18 nt, Human
uauuaguguuauaugaac

SEQ ID NO: 3170244 - RNA, 21 nt, Human
uauuaguguuauaugaacaua

SEQ ID NO: 3170245 - RNA, 13 nt, Human
uauuaguguuaua

SEQ ID NO: 3170246 - RNA, 14 nt, Human
uauuaguguuauau

SEQ ID NO: 3170247 - RNA, 16 nt, Human
uauuaguguuauauga

SEQ ID NO: 3170248 - RNA, 17 nt, Human
uauuaguguuauaugaa

SEQ ID NO: 3170249 - RNA, 17 nt, Human
acagucucaggaaauca

SEQ ID NO: 3170250 - RNA, 18 nt, Human
acagucucugagaacugg

SEQ ID NO: 3170251 - RNA, 13 nt, Human
acagucuccccca

SEQ ID NO: 3170252 - RNA, 22 nt, Human
acagucucaccauuuccccagg

SEQ ID NO: 3170253 - RNA, 18 nt, Human
acagucucaccauuuccc

SEQ ID NO: 3170254 - RNA, 12 nt, Human
acagucucacca

SEQ ID NO: 3170255 - RNA, 14 nt, Human
acagucuucauuuu

SEQ ID NO: 3170256 - RNA, 23 nt, Human
acagucuucauuuuuuuuaauug

SEQ ID NO: 3170257 - RNA, 16 nt, Human
acagucucaggaaauc

SEQ ID NO: 3170258 - RNA, 15 nt, Human
acagucucaggaaau

SEQ ID NO: 3170259 - RNA, 14 nt, Human
acagucucaggaaa

SEQ ID NO: 3170260 - RNA, 13 nt, Human
acagucucaggaa

SEQ ID NO: 3170261 - RNA, 21 nt, Human
acaguccuuaccagcagagca

SEQ ID NO: 3170262 - RNA, 22 nt, Human
acaguccuuaccagcagagcac

SEQ ID NO: 3170263 - RNA, 11 nt, Human
acaguguuccg

SEQ ID NO: 3170264 - RNA, 16 nt, Human
acaguguugagaacua

SEQ ID NO: 3170265 - RNA, 18 nt, Human
acaguuaaggagaaucau

SEQ ID NO: 3170266 - RNA, 15 nt, Human
acaguuaagagaaau

SEQ ID NO: 3170267 - RNA, 14 nt, Human
acaguguuuucaga

SEQ ID NO: 3170268 - RNA, 16 nt, Human
acaguguuuucagaag

SEQ ID NO: 3170269 - RNA, 14 nt, Human
acagugagacucug

SEQ ID NO: 3170270 - RNA, 18 nt, Human
acagugagacucugucuc

SEQ ID NO: 3170271 - RNA, 14 nt, Human
acagugugauuuug

SEQ ID NO: 3170272 - RNA, 21 nt, Human
acaguauggcagcuuuccuca

SEQ ID NO: 3170273 - RNA, 13 nt, Human
acaguauauuuua

SEQ ID NO: 3170274 - RNA, 15 nt, Human
acaguauauuuuauu

SEQ ID NO: 3170275 - RNA, 17 nt, Human
acaguauauuuuauuuc

SEQ ID NO: 3170276 - RNA, 18 nt, Human
acaguauauuuuauuuca

SEQ ID NO: 3170277 - RNA, 21 nt, Human
acaguauauuuuauuucaaug

SEQ ID NO: 3170278 - RNA, 23 nt, Human
acaguauauuuuauuucaaugua

SEQ ID NO: 3170279 - RNA, 13 nt, Human
acaguaaaaauaa

SEQ ID NO: 3170280 - RNA, 14 nt, Human
acaguaaaaauaaa

SEQ ID NO: 3170281 - RNA, 16 nt, Human
acaguaaaaauaaaau

SEQ ID NO: 3170282 - RNA, 16 nt, Human
acagggcaugaaauga

SEQ ID NO: 3170283 - RNA, 17 nt, Human
acaggcugggcuucagu

SEQ ID NO: 3170284 - RNA, 14 nt, Human
acaggcugggcuuc

SEQ ID NO: 3170285 - RNA, 20 nt, Human
acagggcacaccgggcacuc

SEQ ID NO: 3170286 - RNA, 17 nt, Human
acaggcugggcugggca

SEQ ID NO: 3170287 - RNA, 15 nt, Human
acaggcugggcuggg

SEQ ID NO: 3170288 - RNA, 12 nt, Human
acaggcugggcu

SEQ ID NO: 3170289 - RNA, 22 nt, Human
acagguuuuccugaagaauuga

SEQ ID NO: 3170290 - RNA, 22 nt, Human
acagggcacaccgggcacucag

SEQ ID NO: 3170291 - RNA, 21 nt, Human
acaggcugggcugggcacugc

SEQ ID NO: 3170292 - RNA, 12 nt, Human
acagucccugcc

SEQ ID NO: 3170293 - RNA, 13 nt, Human
acagucccugcca

SEQ ID NO: 3170294 - RNA, 16 nt, Human
acagucaagauagaaa

SEQ ID NO: 3170295 - RNA, 19 nt, Human
acaguauuacuucugcuac

SEQ ID NO: 3170296 - RNA, 17 nt, Human
acaguauuacuucugcu

SEQ ID NO: 3170297 - RNA, 16 nt, Human
acaguauuacuucugc

SEQ ID NO: 3170298 - RNA, 15 nt, Human
acaguauuacuucug

SEQ ID NO: 3170299 - RNA, 15 nt, Human
acagucccugccaau

SEQ ID NO: 3170300 - RNA, 13 nt, Human
acaguccucccau

SEQ ID NO: 3170301 - RNA, 14 nt, Human
acaguccucccauc

SEQ ID NO: 3170302 - RNA, 15 nt, Human
acaguccucccaucu

SEQ ID NO: 3170303 - RNA, 18 nt, Human
acaguccuuaccagcaga

SEQ ID NO: 3170304 - RNA, 20 nt, Human
acaguccuuaccagcagagc

SEQ ID NO: 3170305 - RNA, 17 nt, Human
acaguccucccaucuca

SEQ ID NO: 3170306 - RNA, 22 nt, Human
acaguccuauuuagacauguaa

SEQ ID NO: 3170307 - RNA, 16 nt, Human
acaguucucuccuucu

SEQ ID NO: 3170308 - RNA, 19 nt, Human
acaguuccaaucaguagcu

SEQ ID NO: 3170309 - RNA, 20 nt, Human
acaguucaauucucauuugu

SEQ ID NO: 3170310 - RNA, 19 nt, Human
acaguucauucagggccga

SEQ ID NO: 3170311 - RNA, 23 nt, Human
acaguuacuuuuccuugcauaca

SEQ ID NO: 3170312 - RNA, 20 nt, Human
acaguuacuuuuccuugcau

SEQ ID NO: 3170313 - RNA, 16 nt, Human
acaguuacuuuuccuu

SEQ ID NO: 3170314 - RNA, 15 nt, Human
acaguuacuuuuccu

SEQ ID NO: 3170315 - RNA, 14 nt, Human
acaguuacuuuucc

SEQ ID NO: 3170316 - RNA, 13 nt, Human
acaguuacuuuuc

SEQ ID NO: 3170317 - RNA, 12 nt, Human
acaguuacuuuu

SEQ ID NO: 3170318 - RNA, 14 nt, Human
acaguuauaaaauu

SEQ ID NO: 3170319 - RNA, 17 nt, Human
acaguuauaaaauuaaa

SEQ ID NO: 3170320 - RNA, 19 nt, Human
acaguuauaaaauuaaaag

SEQ ID NO: 3170321 - RNA, 16 nt, Human
acaguuauagaaagca

SEQ ID NO: 3170322 - RNA, 13 nt, Human
acaguuauuacau

SEQ ID NO: 3170323 - RNA, 17 nt, Human
acaguucucuccuucuu

SEQ ID NO: 3170324 - RNA, 16 nt, Human
uauucucuguacauau

SEQ ID NO: 3170325 - RNA, 15 nt, Human
uauucucuguacaua

SEQ ID NO: 3170326 - RNA, 14 nt, Human
uauucucuguacau

SEQ ID NO: 3170327 - RNA, 13 nt, Human
uauucucuguaca

SEQ ID NO: 3170328 - RNA, 16 nt, Human
uauucuguuggccagu

SEQ ID NO: 3170329 - RNA, 22 nt, Human
uauucugugcuguuacaguuuu

SEQ ID NO: 3170330 - RNA, 15 nt, Human
uauucuuauuuaaug

SEQ ID NO: 3170331 - RNA, 18 nt, Human
uauucucuguacauauua

SEQ ID NO: 3170332 - RNA, 18 nt, Human
acaguucuacagaaaaac

SEQ ID NO: 3170333 - RNA, 13 nt, Human
uauucucuuuuca

SEQ ID NO: 3170334 - RNA, 15 nt, Human
uauucugucuucauc

SEQ ID NO: 3170335 - RNA, 16 nt, Human
uauucugggaauguau

SEQ ID NO: 3170336 - RNA, 19 nt, Human
uauucugggaauguauagu

SEQ ID NO: 3170337 - RNA, 17 nt, Human
uauucugggaauguaua

SEQ ID NO: 3170338 - RNA, 23 nt, Human
uauucugggaauguauaguauuu

SEQ ID NO: 3170339 - RNA, 20 nt, Human
uauucugggcaccacaaaau

SEQ ID NO: 3170340 - RNA, 22 nt, Human
uauucugggcaccacaaaauau

SEQ ID NO: 3170341 - RNA, 21 nt, Human
uauucugggaauguauaguau

SEQ ID NO: 3170342 - RNA, 17 nt, Human
uauugguguaagguacu

SEQ ID NO: 3170343 - RNA, 15 nt, Human
uauugguuuuaugau

SEQ ID NO: 3170344 - RNA, 13 nt, Human
uauugguuuuaug

SEQ ID NO: 3170345 - RNA, 14 nt, Human
uauugguuuuauga

SEQ ID NO: 3170346 - RNA, 19 nt, Human
uauuguaagaaauacugua

SEQ ID NO: 3170347 - RNA, 17 nt, Human
uauuguaagaaauacug

SEQ ID NO: 3170348 - RNA, 11 nt, Human
uauuguaagaa

SEQ ID NO: 3170349 - RNA, 16 nt, Human
uauuguaacuauguuu

SEQ ID NO: 3170350 - RNA, 19 nt, Human
uauugguauauccuuuucu

SEQ ID NO: 3170351 - RNA, 17 nt, Human
uauugguauauccuuuu

SEQ ID NO: 3170352 - RNA, 14 nt, Human
uauugguauauccu

SEQ ID NO: 3170353 - RNA, 15 nt, Human
uauugguauacuguu

SEQ ID NO: 3170354 - RNA, 19 nt, Human
uauugaguuccaguugaag

SEQ ID NO: 3170355 - RNA, 21 nt, Human
uauugaguuccaguugaaguu

SEQ ID NO: 3170356 - RNA, 20 nt, Human
uauugagggaaauguuuuca

SEQ ID NO: 3170357 - RNA, 22 nt, Human
uauugaggaaaaauaugugaag

SEQ ID NO: 3170358 - RNA, 21 nt, Human
uauugaggaaaaauaugugaa

SEQ ID NO: 3170359 - RNA, 19 nt, Human
uauugaggaaaaauaugug

SEQ ID NO: 3170360 - RNA, 17 nt, Human
uauugacaguugugcag

SEQ ID NO: 3170361 - RNA, 19 nt, Human
uauugagcaauaugucagu

SEQ ID NO: 3170362 - RNA, 17 nt, Human
uauugagcagaauucau

SEQ ID NO: 3170363 - RNA, 18 nt, Human
uauugagcagaauucauu

SEQ ID NO: 3170364 - RNA, 19 nt, Human
uauugagcagaauucauuc

SEQ ID NO: 3170365 - RNA, 21 nt, Human
uauugagcagaauucauucau

SEQ ID NO: 3170366 - RNA, 16 nt, Human
uauugagagagaugug

SEQ ID NO: 3170367 - RNA, 17 nt, Human
uauugaggaaaaauaug

SEQ ID NO: 3170368 - RNA, 15 nt, Human
uauugaggaaaaaua

SEQ ID NO: 3170369 - RNA, 22 nt, Human
uauugagagagauguguaauuu

SEQ ID NO: 3170370 - RNA, 19 nt, Human
uauugagagagauguguaa

SEQ ID NO: 3170371 - RNA, 13 nt, Human
uauugaaauucua

SEQ ID NO: 3170372 - RNA, 17 nt, Human
uauucuuuuuuucucua

SEQ ID NO: 3170373 - RNA, 14 nt, Human
uauugaaaauugaa

SEQ ID NO: 3170374 - RNA, 19 nt, Human
uauugaaaauugaaaagua

SEQ ID NO: 3170375 - RNA, 20 nt, Human
uauugaaaauugaaaaguac

SEQ ID NO: 3170376 - RNA, 19 nt, Human
uauucuuuguuaauuugga

SEQ ID NO: 3170377 - RNA, 17 nt, Human
uauucuuuguuaauuug

SEQ ID NO: 3170378 - RNA, 15 nt, Human
uauucuuuguuaauu

SEQ ID NO: 3170379 - RNA, 13 nt, Human
uauucuuuguuaa

SEQ ID NO: 3170380 - RNA, 19 nt, Human
uauucuugaugaaaagcuu

SEQ ID NO: 3170381 - RNA, 15 nt, Human
uauucuugaugaaaa

SEQ ID NO: 3170382 - RNA, 14 nt, Human
uauucuugaugaaa

SEQ ID NO: 3170383 - RNA, 23 nt, Human
uauucuugaucaguaguuugcau

SEQ ID NO: 3170384 - RNA, 22 nt, Human
uauucuugaucaguaguuugca

SEQ ID NO: 3170385 - RNA, 19 nt, Human
uauucuugaucaguaguuu

SEQ ID NO: 3170386 - RNA, 16 nt, Human
uauucuuucuccuuuu

SEQ ID NO: 3170387 - RNA, 12 nt, Human
uauucuuucucc

SEQ ID NO: 3170388 - RNA, 12 nt, Human
uauucuuuguua

SEQ ID NO: 3170389 - RNA, 22 nt, Human
uauucuuugcacuuuuucuuaa

SEQ ID NO: 3170390 - RNA, 16 nt, Human
uauucuuugcacuuuu

SEQ ID NO: 3170391 - RNA, 14 nt, Human
uauucuuugcacuu

SEQ ID NO: 3170392 - RNA, 12 nt, Human
uauugacaguug

SEQ ID NO: 3170393 - RNA, 23 nt, Human
uauuuaauuuuuuugagacagag

SEQ ID NO: 3170394 - RNA, 15 nt, Human
uauuuacacaauuua

SEQ ID NO: 3170395 - RNA, 20 nt, Human
uauuuacaacacuuuaaugg

SEQ ID NO: 3170396 - RNA, 16 nt, Human
uauuuacaaccuagaa

SEQ ID NO: 3170397 - RNA, 11 nt, Human
uauuuacaaga

SEQ ID NO: 3170398 - RNA, 15 nt, Human
uauuuacaagaagaa

SEQ ID NO: 3170399 - RNA, 16 nt, Human
uauuuacaagaagaac

SEQ ID NO: 3170400 - RNA, 14 nt, Human
uauuuacaauguau

SEQ ID NO: 3170401 - RNA, 15 nt, Human
uauuuacaauguauu

SEQ ID NO: 3170402 - RNA, 16 nt, Human
uauuuacaauguauua

SEQ ID NO: 3170403 - RNA, 17 nt, Human
uauuuacaauguauuaa

SEQ ID NO: 3170404 - RNA, 13 nt, Human
uauuuaauguuga

SEQ ID NO: 3170405 - RNA, 12 nt, Human
uauuuaauguug

SEQ ID NO: 3170406 - RNA, 18 nt, Human
uauuuaauguugaacaaa

SEQ ID NO: 3170407 - RNA, 17 nt, Human
uauuuaauguugaacaa

SEQ ID NO: 3170408 - RNA, 15 nt, Human
uauuuaauguugaac

SEQ ID NO: 3170409 - RNA, 14 nt, Human
uauuuaauguugaa

SEQ ID NO: 3170410 - RNA, 23 nt, Human
uauuuaauguugaacaaaauaaa

SEQ ID NO: 3170411 - RNA, 20 nt, Human
uauuuaauguugaacaaaau

SEQ ID NO: 3170412 - RNA, 18 nt, Human
uauuuacuucuuauacau

SEQ ID NO: 3170413 - RNA, 20 nt, Human
uauuuagcaccagggaaggg

SEQ ID NO: 3170414 - RNA, 20 nt, Human
uauuuagaugcauauuacug

SEQ ID NO: 3170415 - RNA, 13 nt, Human
uauuuauuuaaau

SEQ ID NO: 3170416 - RNA, 14 nt, Human
uauuuauuuaaauu

SEQ ID NO: 3170417 - RNA, 14 nt, Human
uauuuauuuaguau

SEQ ID NO: 3170418 - RNA, 19 nt, Human
uauuucaaguacacugaau

SEQ ID NO: 3170419 - RNA, 15 nt, Human
uauuucaauguaauu

SEQ ID NO: 3170420 - RNA, 16 nt, Human
uauuucaauguaauua

SEQ ID NO: 3170421 - RNA, 19 nt, Human
uauuucaauguaauuaaac

SEQ ID NO: 3170422 - RNA, 20 nt, Human
uauuuauuuuuuuuaauugu

SEQ ID NO: 3170423 - RNA, 22 nt, Human
uauuuauuuuuuuuaauuguau

SEQ ID NO: 3170424 - RNA, 20 nt, Human
uauugucccuggcuuccuua

SEQ ID NO: 3170425 - RNA, 22 nt, Human
uauuguccuauuaguguuauau

SEQ ID NO: 3170426 - RNA, 13 nt, Human
uauugucuguaaa

SEQ ID NO: 3170427 - RNA, 14 nt, Human
uauugucuguaaau

SEQ ID NO: 3170428 - RNA, 16 nt, Human
uauugucuguaaaucu

SEQ ID NO: 3170429 - RNA, 22 nt, Human
uauugucuguaaaucuaacauu

SEQ ID NO: 3170430 - RNA, 17 nt, Human
uauuguccuauuagugu

SEQ ID NO: 3170431 - RNA, 18 nt, Human
uauuguccuauuaguguu

SEQ ID NO: 3170432 - RNA, 22 nt, Human
uauugucccuggcuuccuuacu

SEQ ID NO: 3170433 - RNA, 21 nt, Human
uauugucccuggcuuccuuac

SEQ ID NO: 3170434 - RNA, 21 nt, Human
uauuuaaugaaagacuguaca

SEQ ID NO: 3170435 - RNA, 15 nt, Human
uauuuaaugaaagac

SEQ ID NO: 3170436 - RNA, 15 nt, Human
uauuuaauaugcuua

SEQ ID NO: 3170437 - RNA, 24 nt, Human
uauuuaagccuaaagauuuugauc

SEQ ID NO: 3170438 - RNA, 17 nt, Human
uauuuaagccuaaagau

SEQ ID NO: 3170439 - RNA, 22 nt, Human
uauuuaagccuaaagauuuuga

SEQ ID NO: 3170440 - RNA, 18 nt, Human
uauuuaagccuaaagauu

SEQ ID NO: 3170441 - RNA, 11 nt, Human
uauuguaauau

SEQ ID NO: 3170442 - RNA, 23 nt, Human
uauuguaauauagaaaaaaacau

SEQ ID NO: 3170443 - RNA, 18 nt, Human
uauuguaaugagugaauu

SEQ ID NO: 3170444 - RNA, 21 nt, Human
uauuguaaugagugaauugaa

SEQ ID NO: 3170445 - RNA, 13 nt, Human
uauugucaaagug

SEQ ID NO: 3170446 - RNA, 17 nt, Human
uauugucaaagugguga

SEQ ID NO: 3170447 - RNA, 16 nt, Human
uauuguauuguuagau

SEQ ID NO: 3170448 - RNA, 17 nt, Human
uauuguauuguuagaug

SEQ ID NO: 3170449 - RNA, 18 nt, Human
uauuguauuguuagaugu

SEQ ID NO: 3170450 - RNA, 22 nt, Human
uauuguaucaaucuuuagaaaa

SEQ ID NO: 3170451 - RNA, 18 nt, Human
aauucuuugaccuguugg

SEQ ID NO: 3170452 - RNA, 22 nt, Human
aauucuuugaccuguugggagu

SEQ ID NO: 3170453 - RNA, 15 nt, Human
aauugaaaagaagua

SEQ ID NO: 3170454 - RNA, 16 nt, Human
aauugaaaagaaguag

SEQ ID NO: 3170455 - RNA, 14 nt, Human
aauugaaaaguaca

SEQ ID NO: 3170456 - RNA, 14 nt, Human
aauugaaaaguuau

SEQ ID NO: 3170457 - RNA, 18 nt, Human
aauucuuuuuuauuaauc

SEQ ID NO: 3170458 - RNA, 21 nt, Human
aauucuuuuuuauuaaucacu

SEQ ID NO: 3170459 - RNA, 22 nt, Human
aauucuuuuuuauuaaucacug

SEQ ID NO: 3170460 - RNA, 23 nt, Human
aauucuuuuuuauuaaucacugu

SEQ ID NO: 3170461 - RNA, 18 nt, Human
aauucuuugcaaaaaucc

SEQ ID NO: 3170462 - RNA, 17 nt, Human
aauucuuugcaaaaauc

SEQ ID NO: 3170463 - RNA, 13 nt, Human
aauucuuuuuuau

SEQ ID NO: 3170464 - RNA, 14 nt, Human
aauucuuuuuuauu

SEQ ID NO: 3170465 - RNA, 16 nt, Human
aauucuuuuuuauuaa

SEQ ID NO: 3170466 - RNA, 17 nt, Human
aauucuuuuuuauuaau

SEQ ID NO: 3170467 - RNA, 17 nt, Human
aauucuuuaaaauuaca

SEQ ID NO: 3170468 - RNA, 22 nt, Human
aauucuuuaaaauuacaacuaa

SEQ ID NO: 3170469 - RNA, 13 nt, Human
aauugacccacaa

SEQ ID NO: 3170470 - RNA, 16 nt, Human
aauugaagguuuuuga

SEQ ID NO: 3170471 - RNA, 18 nt, Human
aauugaagguuuuugaua

SEQ ID NO: 3170472 - RNA, 19 nt, Human
aauugaagguuuuugauag

SEQ ID NO: 3170473 - RNA, 16 nt, Human
aauugacccacaagaa

SEQ ID NO: 3170474 - RNA, 19 nt, Human
aauugacccacaagaaaug

SEQ ID NO: 3170475 - RNA, 21 nt, Human
aauugaagguuuuugauagca

SEQ ID NO: 3170476 - RNA, 22 nt, Human
aauucuucuccacuuucuagcc

SEQ ID NO: 3170477 - RNA, 13 nt, Human
aauucuuaaauau

SEQ ID NO: 3170478 - RNA, 16 nt, Human
uacccuuuuucuugaa

SEQ ID NO: 3170479 - RNA, 23 nt, Human
aauucuuauuccauauuagaaaa

SEQ ID NO: 3170480 - RNA, 22 nt, Human
aauucuuauuccauauuagaaa

SEQ ID NO: 3170481 - RNA, 19 nt, Human
aauucuuauuccauauuag

SEQ ID NO: 3170482 - RNA, 18 nt, Human
aauucuuauuccauauua

SEQ ID NO: 3170483 - RNA, 21 nt, Human
aauucuuauuacuagacugcc

SEQ ID NO: 3170484 - RNA, 21 nt, Human
uacucugugucagguggggca

SEQ ID NO: 3170485 - RNA, 14 nt, Human
uacucacagccagc

SEQ ID NO: 3170486 - RNA, 22 nt, Human
uacucuucaguuaagccuuugg

SEQ ID NO: 3170487 - RNA, 18 nt, Human
uacucuucucucugcucu

SEQ ID NO: 3170488 - RNA, 17 nt, Human
uacucuucucucugcuc

SEQ ID NO: 3170489 - RNA, 16 nt, Human
uacucuucucucugcu

SEQ ID NO: 3170490 - RNA, 13 nt, Human
uacucuucucucu

SEQ ID NO: 3170491 - RNA, 18 nt, Human
uacucuuauagacaacau

SEQ ID NO: 3170492 - RNA, 20 nt, Human
uacuguaaaaugcaaaaaau

SEQ ID NO: 3170493 - RNA, 19 nt, Human
uacugaaugaagcaguauu

SEQ ID NO: 3170494 - RNA, 21 nt, Human
uacugaaugaagcaguauuuu

SEQ ID NO: 3170495 - RNA, 14 nt, Human
uacucuugggacau

SEQ ID NO: 3170496 - RNA, 19 nt, Human
uacucuucucucugcucug

SEQ ID NO: 3170497 - RNA, 23 nt, Human
uacugaaccacuuguagauuuga

SEQ ID NO: 3170498 - RNA, 19 nt, Human
uacugaaccacuuguagau

SEQ ID NO: 3170499 - RNA, 22 nt, Human
uacugaaccacuuguagauuug

SEQ ID NO: 3170500 - RNA, 16 nt, Human
uacugaaccacuugua

SEQ ID NO: 3170501 - RNA, 17 nt, Human
uacugaaccacuuguag

SEQ ID NO: 3170502 - RNA, 12 nt, Human
uacguaguucua

SEQ ID NO: 3170503 - RNA, 14 nt, Human
uacgugucaaugug

SEQ ID NO: 3170504 - RNA, 16 nt, Human
uacgugucaaugugug

SEQ ID NO: 3170505 - RNA, 17 nt, Human
uacgugucaaugugugc

SEQ ID NO: 3170506 - RNA, 14 nt, Human
uacguuaccaggca

SEQ ID NO: 3170507 - RNA, 14 nt, Human
uacgugugcaugug

SEQ ID NO: 3170508 - RNA, 16 nt, Human
uacuauaauuuaccug

SEQ ID NO: 3170509 - RNA, 16 nt, Human
uacuauguaucaauga

SEQ ID NO: 3170510 - RNA, 21 nt, Human
uacuauaacauagaauugcaa

SEQ ID NO: 3170511 - RNA, 16 nt, Human
uacuauagcaaaguag

SEQ ID NO: 3170512 - RNA, 17 nt, Human
uacuauagcaaaguagu

SEQ ID NO: 3170513 - RNA, 14 nt, Human
uacuauguaucaau

SEQ ID NO: 3170514 - RNA, 16 nt, Human
aauuuaucuuugauaa

SEQ ID NO: 3170515 - RNA, 15 nt, Human
aauuuaucuuugaua

SEQ ID NO: 3170516 - RNA, 19 nt, Human
aauuucucccagucauuua

SEQ ID NO: 3170517 - RNA, 20 nt, Human
aauuucucccagucauuuaa

SEQ ID NO: 3170518 - RNA, 17 nt, Human
aauuuagaaauauaauu

SEQ ID NO: 3170519 - RNA, 13 nt, Human
aauuuaucuuuga

SEQ ID NO: 3170520 - RNA, 13 nt, Human
aauuugaaacauu

SEQ ID NO: 3170521 - RNA, 12 nt, Human
aauuugaaacau

SEQ ID NO: 3170522 - RNA, 21 nt, Human
aauuugaaacauugcuuuuaa

SEQ ID NO: 3170523 - RNA, 15 nt, Human
aauuugaaacauugc

SEQ ID NO: 3170524 - RNA, 14 nt, Human
aauuugaaacauug

SEQ ID NO: 3170525 - RNA, 23 nt, Human
aauuucucuuaaguacugaaaua

SEQ ID NO: 3170526 - RNA, 14 nt, Human
aauuucugccauuu

SEQ ID NO: 3170527 - RNA, 17 nt, Human
aauuucugccauuucau

SEQ ID NO: 3170528 - RNA, 18 nt, Human
aauuucugccauuucaug

SEQ ID NO: 3170529 - RNA, 20 nt, Human
aauuucugccauuucauguc

SEQ ID NO: 3170530 - RNA, 22 nt, Human
aauuugaauuaucagcaaagaa

SEQ ID NO: 3170531 - RNA, 17 nt, Human
aauuugaagacuucaaa

SEQ ID NO: 3170532 - RNA, 18 nt, Human
aauuugaagacuucaaaa

SEQ ID NO: 3170533 - RNA, 15 nt, Human
aauugugugaacuug

SEQ ID NO: 3170534 - RNA, 18 nt, Human
aauugugugaacuuggaa

SEQ ID NO: 3170535 - RNA, 15 nt, Human
aauugugugauauuu

SEQ ID NO: 3170536 - RNA, 23 nt, Human
aauugugugauauuucagaaaua

SEQ ID NO: 3170537 - RNA, 22 nt, Human
aauugugugauauuucagaaau

SEQ ID NO: 3170538 - RNA, 21 nt, Human
aauugugugauauuucagaaa

SEQ ID NO: 3170539 - RNA, 19 nt, Human
aauugugugauauuucaga

SEQ ID NO: 3170540 - RNA, 22 nt, Human
aauugcucacaguuauuacaua

SEQ ID NO: 3170541 - RNA, 13 nt, Human
aauugcugaggca

SEQ ID NO: 3170542 - RNA, 23 nt, Human
uacuguaaaaugcaaaaaaucuu

SEQ ID NO: 3170543 - RNA, 21 nt, Human
aauugcucacaguuauuacau

SEQ ID NO: 3170544 - RNA, 17 nt, Human
aauugcucacaguuauu

SEQ ID NO: 3170545 - RNA, 12 nt, Human
aauugcuccuug

SEQ ID NO: 3170546 - RNA, 13 nt, Human
aauugcucacagu

SEQ ID NO: 3170547 - RNA, 22 nt, Human
aauuguuuggggaugagaaagg

SEQ ID NO: 3170548 - RNA, 22 nt, Human
aauuguuuagauuuuguguuua

SEQ ID NO: 3170549 - RNA, 14 nt, Human
aauuguuuagauuu

SEQ ID NO: 3170550 - RNA, 13 nt, Human
aauuguuguuugu

SEQ ID NO: 3170551 - RNA, 17 nt, Human
aauuguuguuuguaugu

SEQ ID NO: 3170552 - RNA, 14 nt, Human
aauuguuguuugua

SEQ ID NO: 3170553 - RNA, 23 nt, Human
aauuguuguuuguauguauaauu

SEQ ID NO: 3170554 - RNA, 22 nt, Human
aauuguuguuuguauguauaau

SEQ ID NO: 3170555 - RNA, 21 nt, Human
aauuguuguuuguauguauaa

SEQ ID NO: 3170556 - RNA, 19 nt, Human
aauuguuguuuguauguau

SEQ ID NO: 3170557 - RNA, 23 nt, Human
aauuguuguccgguuuacuuuaa

SEQ ID NO: 3170558 - RNA, 22 nt, Human
aauuguuguccgguuuacuuua

SEQ ID NO: 3170559 - RNA, 20 nt, Human
aauuguuguccgguuuacuu

SEQ ID NO: 3170560 - RNA, 13 nt, Human
aauuuaaaagucu

SEQ ID NO: 3170561 - RNA, 17 nt, Human
aauuuaaaaagcccaac

SEQ ID NO: 3170562 - RNA, 15 nt, Human
aauuuaaaaguaaaa

SEQ ID NO: 3170563 - RNA, 16 nt, Human
aauuuaaaaguaaaau

SEQ ID NO: 3170564 - RNA, 21 nt, Human
aauuuaaaaguaaaaugucuu

SEQ ID NO: 3170565 - RNA, 20 nt, Human
aauuuaaagaaaaaaauguc

SEQ ID NO: 3170566 - RNA, 13 nt, Human
aauuuaaaauaua

SEQ ID NO: 3170567 - RNA, 19 nt, Human
aauuuacauacucugcuua

SEQ ID NO: 3170568 - RNA, 15 nt, Human
aauuuacauacucug

SEQ ID NO: 3170569 - RNA, 18 nt, Human
aauuuaaguguuggaaaa

SEQ ID NO: 3170570 - RNA, 12 nt, Human
aauuuaaguuuu

SEQ ID NO: 3170571 - RNA, 15 nt, Human
aauuuaaguuuugac

SEQ ID NO: 3170572 - RNA, 17 nt, Human
aauuuaaguuuugacaa

SEQ ID NO: 3170573 - RNA, 24 nt, Human
aauuuaaguuuugacaagcuggcu

SEQ ID NO: 3170574 - RNA, 20 nt, Human
aauuuaaguuuugacaagcu

SEQ ID NO: 3170575 - RNA, 23 nt, Human
aauuuaaguuuugacaagcuggc

SEQ ID NO: 3170576 - RNA, 22 nt, Human
uagaucaacucauguuaauuga

SEQ ID NO: 3170577 - RNA, 18 nt, Human
uagaucaaauaguugcau

SEQ ID NO: 3170578 - RNA, 20 nt, Human
uagaucaaauaguugcauag

SEQ ID NO: 3170579 - RNA, 13 nt, Human
uagaucauaguuu

SEQ ID NO: 3170580 - RNA, 15 nt, Human
uagagcagaaauucu

SEQ ID NO: 3170581 - RNA, 14 nt, Human
uagagcagaaauuc

SEQ ID NO: 3170582 - RNA, 13 nt, Human
uagagcagaaauu

SEQ ID NO: 3170583 - RNA, 20 nt, Human
acaaaaagauaccuuaaaau

SEQ ID NO: 3170584 - RNA, 16 nt, Human
acaaaaagaugucuca

SEQ ID NO: 3170585 - RNA, 12 nt, Human
uagagcagaaau

SEQ ID NO: 3170586 - RNA, 15 nt, Human
uagagcuucuggcac

SEQ ID NO: 3170587 - RNA, 16 nt, Human
uagcaccagggaaggg

SEQ ID NO: 3170588 - RNA, 24 nt, Human
uagcacagacccugcccugugggc

SEQ ID NO: 3170589 - RNA, 23 nt, Human
uagauuuuguguuuauucuugau

SEQ ID NO: 3170590 - RNA, 22 nt, Human
uagauuuuguguuuauucuuga

SEQ ID NO: 3170591 - RNA, 21 nt, Human
uagauuuuguguuuauucuug

SEQ ID NO: 3170592 - RNA, 15 nt, Human
uagauuuuguguuua

SEQ ID NO: 3170593 - RNA, 12 nt, Human
uagcacagcucc

SEQ ID NO: 3170594 - RNA, 20 nt, Human
uagcacagcguuaugugucu

SEQ ID NO: 3170595 - RNA, 13 nt, Human
uagcaccagggaa

SEQ ID NO: 3170596 - RNA, 14 nt, Human
uagcaccagggaag

SEQ ID NO: 3170597 - RNA, 21 nt, Human
uagcacaggcugagugcaggc

SEQ ID NO: 3170598 - RNA, 20 nt, Human
uagcacaggcugagugcagg

SEQ ID NO: 3170599 - RNA, 19 nt, Human
uagcacaggcugagugcag

SEQ ID NO: 3170600 - RNA, 15 nt, Human
uagcacaggcugagu

SEQ ID NO: 3170601 - RNA, 13 nt, Human
uagcacaggcuga

SEQ ID NO: 3170602 - RNA, 12 nt, Human
uagcacaggcug

SEQ ID NO: 3170603 - RNA, 14 nt, Human
uagcacagcucccu

SEQ ID NO: 3170604 - RNA, 13 nt, Human
uagcacagcuccc

SEQ ID NO: 3170605 - RNA, 16 nt, Human
uagcacagacccugcc

SEQ ID NO: 3170606 - RNA, 17 nt, Human
uagcacagacccugccc

SEQ ID NO: 3170607 - RNA, 18 nt, Human
uagcacagacccugcccu

SEQ ID NO: 3170608 - RNA, 19 nt, Human
uagcacagacccugcccug

SEQ ID NO: 3170609 - RNA, 22 nt, Human
uagauuuuagacccuauugcug

SEQ ID NO: 3170610 - RNA, 17 nt, Human
uagaucauaguuuuauu

SEQ ID NO: 3170611 - RNA, 19 nt, Human
uagaucauaguuuuauuua

SEQ ID NO: 3170612 - RNA, 13 nt, Human
uagauuuuauagu

SEQ ID NO: 3170613 - RNA, 15 nt, Human
uagauuuuauagugu

SEQ ID NO: 3170614 - RNA, 19 nt, Human
uagauuuuauaguguguug

SEQ ID NO: 3170615 - RNA, 15 nt, Human
acaagcauauaaaau

SEQ ID NO: 3170616 - RNA, 19 nt, Human
acaagcauauaaaauggca

SEQ ID NO: 3170617 - RNA, 17 nt, Human
acaagcauauaaaaugg

SEQ ID NO: 3170618 - RNA, 17 nt, Human
acaagacaacauuguaa

SEQ ID NO: 3170619 - RNA, 17 nt, Human
acaagagcccaggccuc

SEQ ID NO: 3170620 - RNA, 15 nt, Human
acaagacaacauugu

SEQ ID NO: 3170621 - RNA, 12 nt, Human
acaagccacccc

SEQ ID NO: 3170622 - RNA, 21 nt, Human
acaagcgugagccacugcacc

SEQ ID NO: 3170623 - RNA, 20 nt, Human
acaagcgugagccacugcac

SEQ ID NO: 3170624 - RNA, 13 nt, Human
acaagcugcaccc

SEQ ID NO: 3170625 - RNA, 18 nt, Human
acaagcgugagccacugc

SEQ ID NO: 3170626 - RNA, 22 nt, Human
acaagaaaugaaagcagggacu

SEQ ID NO: 3170627 - RNA, 19 nt, Human
acaagaagaauuugaagac

SEQ ID NO: 3170628 - RNA, 19 nt, Human
acaacaccaaaaaauaucu

SEQ ID NO: 3170629 - RNA, 23 nt, Human
acaagaaugaagguuuuuguaaa

SEQ ID NO: 3170630 - RNA, 15 nt, Human
acaagaaugaagguu

SEQ ID NO: 3170631 - RNA, 18 nt, Human
acaagaauaaaggcagcu

SEQ ID NO: 3170632 - RNA, 17 nt, Human
acaagaauaaaggcagc

SEQ ID NO: 3170633 - RNA, 15 nt, Human
acaacaacaaaauga

SEQ ID NO: 3170634 - RNA, 15 nt, Human
acaacaaccugguca

SEQ ID NO: 3170635 - RNA, 12 nt, Human
acaacacucaca

SEQ ID NO: 3170636 - RNA, 13 nt, Human
acaaauguuucua

SEQ ID NO: 3170637 - RNA, 15 nt, Human
uagcauuuggugcuu

SEQ ID NO: 3170638 - RNA, 21 nt, Human
acaaauuaugcuaagaauuuu

SEQ ID NO: 3170639 - RNA, 18 nt, Human
acaaauuaugcuaagaau

SEQ ID NO: 3170640 - RNA, 20 nt, Human
acaaauuauaauguauucau

SEQ ID NO: 3170641 - RNA, 15 nt, Human
acaaauuauaaugua

SEQ ID NO: 3170642 - RNA, 17 nt, Human
acaaauuauaauguauu

SEQ ID NO: 3170643 - RNA, 16 nt, Human
acaaauuauaauguau

SEQ ID NO: 3170644 - RNA, 22 nt, Human
uagcauugucuauuuuucucuu

SEQ ID NO: 3170645 - RNA, 22 nt, Human
uagcauuuaugguaaucauauu

SEQ ID NO: 3170646 - RNA, 15 nt, Human
uagcauuuaugguaa

SEQ ID NO: 3170647 - RNA, 14 nt, Human
uagcauucuuugga

SEQ ID NO: 3170648 - RNA, 17 nt, Human
uagcauucuuuggaguu

SEQ ID NO: 3170649 - RNA, 20 nt, Human
uagcauucuuuggaguuaaa

SEQ ID NO: 3170650 - RNA, 13 nt, Human
uagcauguuguag

SEQ ID NO: 3170651 - RNA, 15 nt, Human
uagcauguuguagau

SEQ ID NO: 3170652 - RNA, 22 nt, Human
uagcauuguaagcguauggcuu

SEQ ID NO: 3170653 - RNA, 19 nt, Human
uagcauuguaaaagcauuu

SEQ ID NO: 3170654 - RNA, 18 nt, Human
uagcauuguaaaagcauu

SEQ ID NO: 3170655 - RNA, 14 nt, Human
aauuuuuuuguaug

SEQ ID NO: 3170656 - RNA, 17 nt, Human
aauuuuuuugagacaga

SEQ ID NO: 3170657 - RNA, 16 nt, Human
acaaaaacacagcaag

SEQ ID NO: 3170658 - RNA, 14 nt, Human
aauuuuucauauuu

SEQ ID NO: 3170659 - RNA, 13 nt, Human
aauuuuucauauu

SEQ ID NO: 3170660 - RNA, 18 nt, Human
aauuuuucuguauagaca

SEQ ID NO: 3170661 - RNA, 14 nt, Human
aauuuuucuguaua

SEQ ID NO: 3170662 - RNA, 13 nt, Human
aauuuuucuguau

SEQ ID NO: 3170663 - RNA, 12 nt, Human
aauuuuucugua

SEQ ID NO: 3170664 - RNA, 14 nt, Human
aauuuuuguauuuu

SEQ ID NO: 3170665 - RNA, 21 nt, Human
aauuuuuuaagugaaaauaua

SEQ ID NO: 3170666 - RNA, 23 nt, Human
aauuuuaagcuaggaaaagaaau

SEQ ID NO: 3170667 - RNA, 18 nt, Human
aauuuuaagcuaggaaaa

SEQ ID NO: 3170668 - RNA, 23 nt, Human
aauuuuaagccuuuguugaacug

SEQ ID NO: 3170669 - RNA, 20 nt, Human
aauuuuaagccuuuguugaa

SEQ ID NO: 3170670 - RNA, 12 nt, Human
aauuuuaaagcc

SEQ ID NO: 3170671 - RNA, 13 nt, Human
aauuuuaaagcca

SEQ ID NO: 3170672 - RNA, 15 nt, Human
aauuuuaaagccauu

SEQ ID NO: 3170673 - RNA, 12 nt, Human
aauuuuaaagua

SEQ ID NO: 3170674 - RNA, 13 nt, Human
aauuuuaaaguau

SEQ ID NO: 3170675 - RNA, 14 nt, Human
aauuuuaaaguaug

SEQ ID NO: 3170676 - RNA, 16 nt, Human
aauuuuaaaguaugca

SEQ ID NO: 3170677 - RNA, 18 nt, Human
aauuuuaaaguaugcauu

SEQ ID NO: 3170678 - RNA, 18 nt, Human
aauuuuuauuaaauuaug

SEQ ID NO: 3170679 - RNA, 17 nt, Human
aauuuuuauuaaauuau

SEQ ID NO: 3170680 - RNA, 14 nt, Human
aauuuuuaugugug

SEQ ID NO: 3170681 - RNA, 13 nt, Human
aauuuuuaugugu

SEQ ID NO: 3170682 - RNA, 14 nt, Human
aauuuuuauuucuu

SEQ ID NO: 3170683 - RNA, 15 nt, Human
aauuuuuauuucuuu

SEQ ID NO: 3170684 - RNA, 12 nt, Human
uagacagucccu

SEQ ID NO: 3170685 - RNA, 14 nt, Human
uagacagucccugc

SEQ ID NO: 3170686 - RNA, 19 nt, Human
uagacaggagaagaaagaa

SEQ ID NO: 3170687 - RNA, 18 nt, Human
uagacaggagaagaaaga

SEQ ID NO: 3170688 - RNA, 15 nt, Human
uagacaggagaagaa

SEQ ID NO: 3170689 - RNA, 17 nt, Human
aauuuguaccauuucag

SEQ ID NO: 3170690 - RNA, 12 nt, Human
aauuuuaaaaaa

SEQ ID NO: 3170691 - RNA, 23 nt, Human
aauuuuaaaaaagggaguuuuug

SEQ ID NO: 3170692 - RNA, 18 nt, Human
uagaacucccuuucaaca

SEQ ID NO: 3170693 - RNA, 15 nt, Human
uagaagucacacagu

SEQ ID NO: 3170694 - RNA, 17 nt, Human
uagaagagucuauuguc

SEQ ID NO: 3170695 - RNA, 22 nt, Human
uacuucaaaaguuuguuugcuu

SEQ ID NO: 3170696 - RNA, 17 nt, Human
uacuucaaaaguuuguu

SEQ ID NO: 3170697 - RNA, 23 nt, Human
uagaacgccagggaccccagaau

SEQ ID NO: 3170698 - RNA, 19 nt, Human
uagaagucuuagauguaua

SEQ ID NO: 3170699 - RNA, 18 nt, Human
uagaagucuuagauguau

SEQ ID NO: 3170700 - RNA, 23 nt, Human
uagaauugaagguuuuugauagc

SEQ ID NO: 3170701 - RNA, 20 nt, Human
uagaauugaagguuuuugau

SEQ ID NO: 3170702 - RNA, 21 nt, Human
uagaauugaagguuuuugaua

SEQ ID NO: 3170703 - RNA, 17 nt, Human
uagaauugcaaucuaua

SEQ ID NO: 3170704 - RNA, 19 nt, Human
uagaauugaagguuuuuga

SEQ ID NO: 3170705 - RNA, 18 nt, Human
uagaauugaagguuuuug

SEQ ID NO: 3170706 - RNA, 17 nt, Human
uagaagucuuagaugua

SEQ ID NO: 3170707 - RNA, 16 nt, Human
uagaagucuuagaugu

SEQ ID NO: 3170708 - RNA, 16 nt, Human
uagaagucacacagua

SEQ ID NO: 3170709 - RNA, 18 nt, Human
uagacaauauaagagcuu

SEQ ID NO: 3170710 - RNA, 21 nt, Human
uagacagagucucacuguugc

SEQ ID NO: 3170711 - RNA, 14 nt, Human
uagacagcaugaga

SEQ ID NO: 3170712 - RNA, 22 nt, Human
uagacaggaaaagcaugucuua

SEQ ID NO: 3170713 - RNA, 20 nt, Human
uagaauugcaaucuauaaua

SEQ ID NO: 3170714 - RNA, 18 nt, Human
uagaauugcaaucuauaa

SEQ ID NO: 3170715 - RNA, 20 nt, Human
uacauuagcaguuugcuuug

SEQ ID NO: 3170716 - RNA, 19 nt, Human
uacauuagcaguuugcuuu

SEQ ID NO: 3170717 - RNA, 14 nt, Human
uacauguuuaugua

SEQ ID NO: 3170718 - RNA, 18 nt, Human
uacauguuuauguaaaca

SEQ ID NO: 3170719 - RNA, 15 nt, Human
uacauguuuauguaa

SEQ ID NO: 3170720 - RNA, 21 nt, Human
uacauguuuauguaaacaaau

SEQ ID NO: 3170721 - RNA, 19 nt, Human
uacauguuuauguaaacaa

SEQ ID NO: 3170722 - RNA, 17 nt, Human
uacauguauuaaauuac

SEQ ID NO: 3170723 - RNA, 19 nt, Human
uacauguaucaagccuaga

SEQ ID NO: 3170724 - RNA, 23 nt, Human
uacauguauuaaauuacauuugu

SEQ ID NO: 3170725 - RNA, 20 nt, Human
uacauguauuaaauuacauu

SEQ ID NO: 3170726 - RNA, 19 nt, Human
uacauguauuaaauuacau

SEQ ID NO: 3170727 - RNA, 18 nt, Human
uacauguauuaaauuaca

SEQ ID NO: 3170728 - RNA, 20 nt, Human
aauuaagguguuugaaaaua

SEQ ID NO: 3170729 - RNA, 18 nt, Human
uacaugggacuaugcuuu

SEQ ID NO: 3170730 - RNA, 13 nt, Human
uacaugggacuau

SEQ ID NO: 3170731 - RNA, 19 nt, Human
uacaugggacuaugcuuuu

SEQ ID NO: 3170732 - RNA, 15 nt, Human
aauuaagguguuuga

SEQ ID NO: 3170733 - RNA, 16 nt, Human
aauuaagguguuugaa

SEQ ID NO: 3170734 - RNA, 17 nt, Human
aauuaagguguuugaaa

SEQ ID NO: 3170735 - RNA, 18 nt, Human
aauuaagguguuugaaaa

SEQ ID NO: 3170736 - RNA, 13 nt, Human
aauuaagguguuu

SEQ ID NO: 3170737 - RNA, 17 nt, Human
aauuaacacuuaagguu

SEQ ID NO: 3170738 - RNA, 19 nt, Human
aaugugaacagcggcugga

SEQ ID NO: 3170739 - RNA, 15 nt, Human
aaugucaaaugugaa

SEQ ID NO: 3170740 - RNA, 16 nt, Human
aaugugaaauguaacu

SEQ ID NO: 3170741 - RNA, 17 nt, Human
aaugugaauuacuaacu

SEQ ID NO: 3170742 - RNA, 12 nt, Human
aaugugaauuac

SEQ ID NO: 3170743 - RNA, 23 nt, Human
aauguugaagaacucaugugauu

SEQ ID NO: 3170744 - RNA, 16 nt, Human
aauguugaagaacuca

SEQ ID NO: 3170745 - RNA, 22 nt, Human
aauguugaacaaaauaaauugg

SEQ ID NO: 3170746 - RNA, 21 nt, Human
aauguugaacaaaauaaauug

SEQ ID NO: 3170747 - RNA, 17 nt, Human
aauguugaacaaaauaa

SEQ ID NO: 3170748 - RNA, 16 nt, Human
aauguugaacaaaaua

SEQ ID NO: 3170749 - RNA, 12 nt, Human
aauguugauuuc

SEQ ID NO: 3170750 - RNA, 16 nt, Human
aauguugauuucuagu

SEQ ID NO: 3170751 - RNA, 15 nt, Human
aauguugauuucuag

SEQ ID NO: 3170752 - RNA, 14 nt, Human
aauguugauuucua

SEQ ID NO: 3170753 - RNA, 13 nt, Human
aauguugauuucu

SEQ ID NO: 3170754 - RNA, 21 nt, Human
aauguugauuucuaguuauuu

SEQ ID NO: 3170755 - RNA, 20 nt, Human
aauguugauuucuaguuauu

SEQ ID NO: 3170756 - RNA, 18 nt, Human
aauguugauuucuaguua

SEQ ID NO: 3170757 - RNA, 17 nt, Human
aauguugauuucuaguu

SEQ ID NO: 3170758 - RNA, 23 nt, Human
aauguugauuucuaguuauuuau

SEQ ID NO: 3170759 - RNA, 20 nt, Human
aauguugcuaugugccuuau

SEQ ID NO: 3170760 - RNA, 22 nt, Human
aauguugauuucuaguuauuua

SEQ ID NO: 3170761 - RNA, 16 nt, Human
uaccccauggaccaug

SEQ ID NO: 3170762 - RNA, 17 nt, Human
uaccauccccuguagag

SEQ ID NO: 3170763 - RNA, 19 nt, Human
uaccccaagcgcccuggcc

SEQ ID NO: 3170764 - RNA, 18 nt, Human
uaccacugaaucuguaca

SEQ ID NO: 3170765 - RNA, 16 nt, Human
uaccacugaaucugua

SEQ ID NO: 3170766 - RNA, 15 nt, Human
uaccacugaaucugu

SEQ ID NO: 3170767 - RNA, 11 nt, Human
uaccacugaau

SEQ ID NO: 3170768 - RNA, 20 nt, Human
uaccacugaaucuguacaga

SEQ ID NO: 3170769 - RNA, 19 nt, Human
uaccacugaaucuguacag

SEQ ID NO: 3170770 - RNA, 15 nt, Human
uaccacuuuagauga

SEQ ID NO: 3170771 - RNA, 14 nt, Human
uacauuuaaauuuu

SEQ ID NO: 3170772 - RNA, 23 nt, Human
uacauuuaaaccuuuuauuauaa

SEQ ID NO: 3170773 - RNA, 20 nt, Human
uacauuuaaaacauuaaaau

SEQ ID NO: 3170774 - RNA, 15 nt, Human
uacauuuaaaacauu

SEQ ID NO: 3170775 - RNA, 19 nt, Human
uacauuuaaaacauuaaaa

SEQ ID NO: 3170776 - RNA, 16 nt, Human
uacauuuaaaacauua

SEQ ID NO: 3170777 - RNA, 22 nt, Human
uacccuggcacuauaauguaag

SEQ ID NO: 3170778 - RNA, 20 nt, Human
uacccuggcacuauaaugua

SEQ ID NO: 3170779 - RNA, 23 nt, Human
uaccccucccggcccugccugcu

SEQ ID NO: 3170780 - RNA, 19 nt, Human
uaccccugacuucuguuua

SEQ ID NO: 3170781 - RNA, 20 nt, Human
uacccgggaagggggcuggg

SEQ ID NO: 3170782 - RNA, 22 nt, Human
uaccccucccggcccugccugc

SEQ ID NO: 3170783 - RNA, 21 nt, Human
uaccccucccggcccugccug

SEQ ID NO: 3170784 - RNA, 12 nt, Human
aauguagagggg

SEQ ID NO: 3170785 - RNA, 17 nt, Human
aauguagcuucagucau

SEQ ID NO: 3170786 - RNA, 22 nt, Human
aauguagcuucagucauuaaau

SEQ ID NO: 3170787 - RNA, 20 nt, Human
aauguaggggaaaguuucau

SEQ ID NO: 3170788 - RNA, 15 nt, Human
uacauacuuuaucaa

SEQ ID NO: 3170789 - RNA, 19 nt, Human
uacauacuuuaucaaugug

SEQ ID NO: 3170790 - RNA, 23 nt, Human
uacauacuuuaucaaugugucuu

SEQ ID NO: 3170791 - RNA, 15 nt, Human
uacauacugcaucuu

SEQ ID NO: 3170792 - RNA, 16 nt, Human
aauguaugcuucauac

SEQ ID NO: 3170793 - RNA, 15 nt, Human
aauguaugcuucaua

SEQ ID NO: 3170794 - RNA, 13 nt, Human
aauguaucuaaga

SEQ ID NO: 3170795 - RNA, 14 nt, Human
aauguaucuaagaa

SEQ ID NO: 3170796 - RNA, 14 nt, Human
aaugucacaggcag

SEQ ID NO: 3170797 - RNA, 13 nt, Human
aaugucacaggca

SEQ ID NO: 3170798 - RNA, 18 nt, Human
aaugucaaaaauauuuag

SEQ ID NO: 3170799 - RNA, 20 nt, Human
aauguaugcauucacauuua

SEQ ID NO: 3170800 - RNA, 14 nt, Human
aaugucaaaaguag

SEQ ID NO: 3170801 - RNA, 15 nt, Human
aaugucaaaaguaga

SEQ ID NO: 3170802 - RNA, 19 nt, Human
aaugucaaaaguagaacuu

SEQ ID NO: 3170803 - RNA, 23 nt, Human
aaugucaaaaguagaacuuugua

SEQ ID NO: 3170804 - RNA, 20 nt, Human
uacauaauacugaaccacuu

SEQ ID NO: 3170805 - RNA, 23 nt, Human
uacauaauacugaaccacuugua

SEQ ID NO: 3170806 - RNA, 16 nt, Human
uacaguggauugcuca

SEQ ID NO: 3170807 - RNA, 22 nt, Human
uacaguggauugcucaucucag

SEQ ID NO: 3170808 - RNA, 16 nt, Human
uacagugccuaaaaua

SEQ ID NO: 3170809 - RNA, 22 nt, Human
uacagugcauaguuguagacaa

SEQ ID NO: 3170810 - RNA, 18 nt, Human
uacaguaucucagggccu

SEQ ID NO: 3170811 - RNA, 12 nt, Human
uacaguccuccc

SEQ ID NO: 3170812 - RNA, 15 nt, Human
uacaguccucccauc

SEQ ID NO: 3170813 - RNA, 17 nt, Human
uacaguccucccaucuc

SEQ ID NO: 3170814 - RNA, 18 nt, Human
uacaguccucccaucuca

SEQ ID NO: 3170815 - RNA, 18 nt, Human
uacagucaagauagaaag

SEQ ID NO: 3170816 - RNA, 23 nt, Human
aauguaaaaaggaauaugaaagu

SEQ ID NO: 3170817 - RNA, 15 nt, Human
aauguaagcucuacu

SEQ ID NO: 3170818 - RNA, 13 nt, Human
aauguaagcucua

SEQ ID NO: 3170819 - RNA, 17 nt, Human
aaugguuuucuugugug

SEQ ID NO: 3170820 - RNA, 18 nt, Human
aaugguuuucuugugugu

SEQ ID NO: 3170821 - RNA, 22 nt, Human
aaugguuuucuuguguguuuau

SEQ ID NO: 3170822 - RNA, 16 nt, Human
aaugguuuucuugugu

SEQ ID NO: 3170823 - RNA, 16 nt, Human
aaugguuuaaaugguc

SEQ ID NO: 3170824 - RNA, 17 nt, Human
uacaauauuugugugcu

SEQ ID NO: 3170825 - RNA, 16 nt, Human
uacaauauguacauuu

SEQ ID NO: 3170826 - RNA, 15 nt, Human
uacaauauguacauu

SEQ ID NO: 3170827 - RNA, 21 nt, Human
uacaauauguacauuucuaag

SEQ ID NO: 3170828 - RNA, 13 nt, Human
uacaaucagcugc

SEQ ID NO: 3170829 - RNA, 14 nt, Human
uacaaucagcugcu

SEQ ID NO: 3170830 - RNA, 15 nt, Human
uacaaucagcugcuu

SEQ ID NO: 3170831 - RNA, 16 nt, Human
uacaaucagcugcuuu

SEQ ID NO: 3170832 - RNA, 18 nt, Human
uacaaucagcugcuuugu

SEQ ID NO: 3170833 - RNA, 19 nt, Human
uacaaucagcugcuuuguu

SEQ ID NO: 3170834 - RNA, 20 nt, Human
uacaaucagcugcuuuguua

SEQ ID NO: 3170835 - RNA, 22 nt, Human
uacaaucagcugcuuuguuacc

SEQ ID NO: 3170836 - RNA, 23 nt, Human
uacaaucagcugcuuuguuaccu

SEQ ID NO: 3170837 - RNA, 19 nt, Human
uacagacuggauguaccac

SEQ ID NO: 3170838 - RNA, 16 nt, Human
uacagagaaagaaauu

SEQ ID NO: 3170839 - RNA, 15 nt, Human
uacagagaaagaaau

SEQ ID NO: 3170840 - RNA, 14 nt, Human
aauguacauguauu

SEQ ID NO: 3170841 - RNA, 20 nt, Human
aauguacauguauuaaauua

SEQ ID NO: 3170842 - RNA, 16 nt, Human
aauguacauguauuaa

SEQ ID NO: 3170843 - RNA, 22 nt, Human
uacacgguucaaaccugugaag

SEQ ID NO: 3170844 - RNA, 17 nt, Human
uaauucaggcauauuuu

SEQ ID NO: 3170845 - RNA, 19 nt, Human
uaauucaggcauauuuuaa

SEQ ID NO: 3170846 - RNA, 14 nt, Human
uaauuuaaguuuug

SEQ ID NO: 3170847 - RNA, 15 nt, Human
uaauuuaaguuuuga

SEQ ID NO: 3170848 - RNA, 20 nt, Human
uaauuuaaguuuugacaagc

SEQ ID NO: 3170849 - RNA, 17 nt, Human
uaauuuccuuaaagcaa

SEQ ID NO: 3170850 - RNA, 17 nt, Human
uaauuuaccugaagucu

SEQ ID NO: 3170851 - RNA, 18 nt, Human
uaauuuaccugaagucuu

SEQ ID NO: 3170852 - RNA, 18 nt, Human
uaauuucugccauuucau

SEQ ID NO: 3170853 - RNA, 19 nt, Human
uaauuucugccauuucaug

SEQ ID NO: 3170854 - RNA, 13 nt, Human
uaauuugcugcug

SEQ ID NO: 3170855 - RNA, 14 nt, Human
uaauuugcugcuga

SEQ ID NO: 3170856 - RNA, 11 nt, Human
uaauuuggaaa

SEQ ID NO: 3170857 - RNA, 15 nt, Human
uaauuuggaaacuaa

SEQ ID NO: 3170858 - RNA, 21 nt, Human
uaauuuuuguauuuuuaguag

SEQ ID NO: 3170859 - RNA, 18 nt, Human
uacaaaaacacagcaagg

SEQ ID NO: 3170860 - RNA, 17 nt, Human
uacaaaaacacagcaag

SEQ ID NO: 3170861 - RNA, 16 nt, Human
uacaaaaacacagcaa

SEQ ID NO: 3170862 - RNA, 20 nt, Human
uacaagcgugagccacugca

SEQ ID NO: 3170863 - RNA, 19 nt, Human
uacaagcgugagccacugc

SEQ ID NO: 3170864 - RNA, 18 nt, Human
uacaagcgugagccacug

SEQ ID NO: 3170865 - RNA, 16 nt, Human
uacaagcgugagccac

SEQ ID NO: 3170866 - RNA, 20 nt, Human
uacaauaaaaucuugaaaau

SEQ ID NO: 3170867 - RNA, 16 nt, Human
uacaaguuauaguacu

SEQ ID NO: 3170868 - RNA, 15 nt, Human
uaauuauaaucucuu

SEQ ID NO: 3170869 - RNA, 19 nt, Human
aaugcacaaacagaggccg

SEQ ID NO: 3170870 - RNA, 20 nt, Human
aaugcacaaacagaggccgc

SEQ ID NO: 3170871 - RNA, 13 nt, Human
aaugcacuuuguu

SEQ ID NO: 3170872 - RNA, 16 nt, Human
aaugcacuuuguucug

SEQ ID NO: 3170873 - RNA, 19 nt, Human
aaugcacuuuguucuggcu

SEQ ID NO: 3170874 - RNA, 23 nt, Human
uaauuaguuccucauuagcauuu

SEQ ID NO: 3170875 - RNA, 20 nt, Human
uaauuauacccccugcaaag

SEQ ID NO: 3170876 - RNA, 15 nt, Human
aaugcaauaugugaa

SEQ ID NO: 3170877 - RNA, 13 nt, Human
aaugaccuuucaa

SEQ ID NO: 3170878 - RNA, 14 nt, Human
aaugaccuuucaau

SEQ ID NO: 3170879 - RNA, 14 nt, Human
aaugcaaaccauca

SEQ ID NO: 3170880 - RNA, 16 nt, Human
aaugcaaaccaucauu

SEQ ID NO: 3170881 - RNA, 20 nt, Human
aaugaaugucagugugacug

SEQ ID NO: 3170882 - RNA, 21 nt, Human
aaugaaugucagugugacuga

SEQ ID NO: 3170883 - RNA, 18 nt, Human
aaugaccuuguaauguaa

SEQ ID NO: 3170884 - RNA, 16 nt, Human
aaugaccuuguaaugu

SEQ ID NO: 3170885 - RNA, 14 nt, Human
aaugaccuuguaau

SEQ ID NO: 3170886 - RNA, 13 nt, Human
aaugaccuuguaa

SEQ ID NO: 3170887 - RNA, 18 nt, Human
aaugcacaaacagaggcc

SEQ ID NO: 3170888 - RNA, 13 nt, Human
aaugcaaccauuu

SEQ ID NO: 3170889 - RNA, 18 nt, Human
aaugcaaccauuugaaac

SEQ ID NO: 3170890 - RNA, 17 nt, Human
aaugcaaccauuugaaa

SEQ ID NO: 3170891 - RNA, 22 nt, Human
aaugcaaaccaucauugaaauc

SEQ ID NO: 3170892 - RNA, 23 nt, Human
aaugcaaaccaucauugaaaucu

SEQ ID NO: 3170893 - RNA, 22 nt, Human
aaugaccuuguaauguaacugc

SEQ ID NO: 3170894 - RNA, 21 nt, Human
aaugaccuuguaauguaacug

SEQ ID NO: 3170895 - RNA, 20 nt, Human
aaugaccuuguaauguaacu

SEQ ID NO: 3170896 - RNA, 19 nt, Human
aaugaccuuguaauguaac

SEQ ID NO: 3170897 - RNA, 12 nt, Human
uaaucauuuuuu

SEQ ID NO: 3170898 - RNA, 15 nt, Human
uaaucaugaaccaau

SEQ ID NO: 3170899 - RNA, 13 nt, Human
uaaucaugaauau

SEQ ID NO: 3170900 - RNA, 20 nt, Human
uaaucagggaccaccagagg

SEQ ID NO: 3170901 - RNA, 17 nt, Human
uaauauugaaaauugaa

SEQ ID NO: 3170902 - RNA, 20 nt, Human
uaauauugaaaauugaaaag

SEQ ID NO: 3170903 - RNA, 21 nt, Human
uaauauugaaaauugaaaagu

SEQ ID NO: 3170904 - RNA, 22 nt, Human
uaauauugaaaauugaaaagua

SEQ ID NO: 3170905 - RNA, 21 nt, Human
uaauauugauaugcuuauaca

SEQ ID NO: 3170906 - RNA, 17 nt, Human
uaauacuguuauucuuu

SEQ ID NO: 3170907 - RNA, 16 nt, Human
uaauacuguuauucuu

SEQ ID NO: 3170908 - RNA, 15 nt, Human
uaauacuguuauucu

SEQ ID NO: 3170909 - RNA, 13 nt, Human
uaauacuguuauu

SEQ ID NO: 3170910 - RNA, 22 nt, Human
uaauacuguuauucuuugcacu

SEQ ID NO: 3170911 - RNA, 20 nt, Human
uaauacuguuauucuuugca

SEQ ID NO: 3170912 - RNA, 13 nt, Human
uaauacuuuguau

SEQ ID NO: 3170913 - RNA, 20 nt, Human
uaauacuuuguauacaagua

SEQ ID NO: 3170914 - RNA, 13 nt, Human
uaauaccucccuu

SEQ ID NO: 3170915 - RNA, 21 nt, Human
aauacauaugauaaauuugac

SEQ ID NO: 3170916 - RNA, 20 nt, Human
aauacaguaucucagggccu

SEQ ID NO: 3170917 - RNA, 17 nt, Human
uaauguaagcucuacug

SEQ ID NO: 3170918 - RNA, 16 nt, Human
uaauguaagcucuacu

SEQ ID NO: 3170919 - RNA, 14 nt, Human
uaaugaacaaaauu

SEQ ID NO: 3170920 - RNA, 17 nt, Human
uaaugaacaaaauuauu

SEQ ID NO: 3170921 - RNA, 16 nt, Human
uaaucuugugaaaaua

SEQ ID NO: 3170922 - RNA, 19 nt, Human
uaaucuugugaaaauaauu

SEQ ID NO: 3170923 - RNA, 17 nt, Human
uaaucuuguugauaaaa

SEQ ID NO: 3170924 - RNA, 19 nt, Human
uaaucuuguugauaaaaau

SEQ ID NO: 3170925 - RNA, 22 nt, Human
uaauguaacugcucuugggcaa

SEQ ID NO: 3170926 - RNA, 15 nt, Human
uaaugucacaggcag

SEQ ID NO: 3170927 - RNA, 17 nt, Human
uaaugucacaggcaggu

SEQ ID NO: 3170928 - RNA, 16 nt, Human
uaaugucacaggcagg

SEQ ID NO: 3170929 - RNA, 22 nt, Human
aaucuuuucugaaucuucugaa

SEQ ID NO: 3170930 - RNA, 13 nt, Human
aaucuuuucuuau

SEQ ID NO: 3170931 - RNA, 14 nt, Human
aaucuuuucuuauu

SEQ ID NO: 3170932 - RNA, 15 nt, Human
aaucuuuucuuauuu

SEQ ID NO: 3170933 - RNA, 14 nt, Human
aaucuuuucugaau

SEQ ID NO: 3170934 - RNA, 15 nt, Human
aaugaaugaaugaau

SEQ ID NO: 3170935 - RNA, 14 nt, Human
aaugaaugaaacau

SEQ ID NO: 3170936 - RNA, 15 nt, Human
aaugaaugucagugu

SEQ ID NO: 3170937 - RNA, 14 nt, Human
aaugaaugucagug

SEQ ID NO: 3170938 - RNA, 23 nt, Human
aaucuucugaacuuggcgcugcc

SEQ ID NO: 3170939 - RNA, 13 nt, Human
uaaugugaaaugu

SEQ ID NO: 3170940 - RNA, 14 nt, Human
uaaugugaaaugua

SEQ ID NO: 3170941 - RNA, 19 nt, Human
uaaugugaaauguaacugu

SEQ ID NO: 3170942 - RNA, 23 nt, Human
uaaugugaaauguaacuguccgu

SEQ ID NO: 3170943 - RNA, 13 nt, Human
aaucuugaaaaug

SEQ ID NO: 3170944 - RNA, 13 nt, Human
uaauguggcuucu

SEQ ID NO: 3170945 - RNA, 12 nt, Human
aaaaacacagca

SEQ ID NO: 3170946 - RNA, 18 nt, Human
aaaaacacagcaagggug

SEQ ID NO: 3170947 - RNA, 13 nt, Human
aaaaacacagcaa

SEQ ID NO: 3170948 - RNA, 21 nt, Human
aaaaaauucagugaugugccu

SEQ ID NO: 3170949 - RNA, 22 nt, Human
aaaaaccguguuugucucuucu

SEQ ID NO: 3170950 - RNA, 18 nt, Human
aaaaacagauuuggaaag

SEQ ID NO: 3170951 - RNA, 22 nt, Human
aaaaacucaaccaaaugguaca

SEQ ID NO: 3170952 - RNA, 18 nt, Human
aaaaacucaaccaaaugg

SEQ ID NO: 3170953 - RNA, 15 nt, Human
aaaaaauauuuuccu

SEQ ID NO: 3170954 - RNA, 22 nt, Human
aaaaaaugcugaacauugcaua

SEQ ID NO: 3170955 - RNA, 20 nt, Human
aaaaaaugcugaacauugca

SEQ ID NO: 3170956 - RNA, 12 nt, Human
aaaaaauaucua

SEQ ID NO: 3170957 - RNA, 16 nt, Human
aauuaaaaaaaaauug

SEQ ID NO: 3170958 - RNA, 17 nt, Human
aauuaaaaaaaaauugu

SEQ ID NO: 3170959 - RNA, 18 nt, Human
aauuaaaaaaaaauugua

SEQ ID NO: 3170960 - RNA, 16 nt, Human
aaugcggccuuuucau

SEQ ID NO: 3170961 - RNA, 22 nt, Human
aaugcgcaggcuggcccugccc

SEQ ID NO: 3170962 - RNA, 21 nt, Human
aaugcgcaggcuggcccugcc

SEQ ID NO: 3170963 - RNA, 13 nt, Human
aaugccuuuguaa

SEQ ID NO: 3170964 - RNA, 23 nt, Human
aaugccuuuguaaccacaacuuu

SEQ ID NO: 3170965 - RNA, 20 nt, Human
aaugccugcuuuuuggaaag

SEQ ID NO: 3170966 - RNA, 21 nt, Human
aaugccugcuuuuuggaaagu

SEQ ID NO: 3170967 - RNA, 23 nt, Human
aaugcuauaacuauguugauaaa

SEQ ID NO: 3170968 - RNA, 18 nt, Human
aaugcuaugucauuucau

SEQ ID NO: 3170969 - RNA, 17 nt, Human
aaugcuaugucauuuca

SEQ ID NO: 3170970 - RNA, 16 nt, Human
aaugcuaugucauuuc

SEQ ID NO: 3170971 - RNA, 15 nt, Human
aaugcuaugucauuu

SEQ ID NO: 3170972 - RNA, 13 nt, Human
aaugcugauuuaa

SEQ ID NO: 3170973 - RNA, 23 nt, Human
aaugcugacccaugggcaggaga

SEQ ID NO: 3170974 - RNA, 22 nt, Human
aaugcugacccaugggcaggag

SEQ ID NO: 3170975 - RNA, 17 nt, Human
aaugcugacccaugggc

SEQ ID NO: 3170976 - RNA, 15 nt, Human
aaugcugacccaugg

SEQ ID NO: 3170977 - RNA, 15 nt, Human
aaugcugaaaauugc

SEQ ID NO: 3170978 - RNA, 18 nt, Human
aaugcugaacauugcaua

SEQ ID NO: 3170979 - RNA, 21 nt, Human
aaugcuaugucauuucauguc

SEQ ID NO: 3170980 - RNA, 22 nt, Human
aaugcuggagaaaaauaucugu

SEQ ID NO: 3170981 - RNA, 20 nt, Human
aaugcuggcuggccuugugg

SEQ ID NO: 3170982 - RNA, 23 nt, Human
aaugcuggcuggccuuguggucc

SEQ ID NO: 3170983 - RNA, 13 nt, Human
aaugucaguaugu

SEQ ID NO: 3170984 - RNA, 15 nt, Human
aaugucaguaugugg

SEQ ID NO: 3170985 - RNA, 21 nt, Human
aaugucauaaagugagaaaac

SEQ ID NO: 3170986 - RNA, 23 nt, Human
aaugucauaaagugagaaaacug

SEQ ID NO: 3170987 - RNA, 17 nt, Human
aauguccaguaagauca

SEQ ID NO: 3170988 - RNA, 16 nt, Human
aauguuuauuaaaugc

SEQ ID NO: 3170989 - RNA, 22 nt, Human
aauguuuacagauccccaagcc

SEQ ID NO: 3170990 - RNA, 12 nt, Human
aauguuuacaaa

SEQ ID NO: 3170991 - RNA, 15 nt, Human
aauguuugccucugc

SEQ ID NO: 3170992 - RNA, 12 nt, Human
aauguuucuaag

SEQ ID NO: 3170993 - RNA, 15 nt, Human
aauguuucauuugca

SEQ ID NO: 3170994 - RNA, 15 nt, Human
aaugugaaaagaaaa

SEQ ID NO: 3170995 - RNA, 20 nt, Human
aauguuuaagcagaauugga

SEQ ID NO: 3170996 - RNA, 15 nt, Human
aauguuuaagcagaa

SEQ ID NO: 3170997 - RNA, 22 nt, Human
aauguuuaagcagaauuggaaa

SEQ ID NO: 3170998 - RNA, 21 nt, Human
aauguuuaagcagaauuggaa

SEQ ID NO: 3170999 - RNA, 15 nt, Human
aaugugaaaaaucug

SEQ ID NO: 3171000 - RNA, 18 nt, Human
aaugugaaaaaucugcug

SEQ ID NO: 3171001 - RNA, 15 nt, Human
aaugucuuuccaaau

SEQ ID NO: 3171002 - RNA, 23 nt, Human
aaugucuuuccaaauuauuucuu

SEQ ID NO: 3171003 - RNA, 19 nt, Human
aauguccaguaagaucacu

SEQ ID NO: 3171004 - RNA, 20 nt, Human
aauguccaguaagaucacug

SEQ ID NO: 3171005 - RNA, 22 nt, Human
aauguccaguaagaucacuguu

SEQ ID NO: 3171006 - RNA, 13 nt, Human
aauauuaaaaaac

SEQ ID NO: 3171007 - RNA, 21 nt, Human
aauauuaaaaaacuucaugua

SEQ ID NO: 3171008 - RNA, 20 nt, Human
aauauaugccuuguauaaua

SEQ ID NO: 3171009 - RNA, 21 nt, Human
aauauaugccuuguauaauau

SEQ ID NO: 3171010 - RNA, 15 nt, Human
aauagacaaaaagua

SEQ ID NO: 3171011 - RNA, 17 nt, Human
aauagacaaaaaguaua

SEQ ID NO: 3171012 - RNA, 18 nt, Human
aauagacaaaaaguauau

SEQ ID NO: 3171013 - RNA, 20 nt, Human
aauauacucauuagaauuac

SEQ ID NO: 3171014 - RNA, 20 nt, Human
aauauacauguuuauguaaa

SEQ ID NO: 3171015 - RNA, 18 nt, Human
aauauacauguuuaugua

SEQ ID NO: 3171016 - RNA, 16 nt, Human
aaucacccuaccaacu

SEQ ID NO: 3171017 - RNA, 14 nt, Human
aaucaccgaaaacg

SEQ ID NO: 3171018 - RNA, 19 nt, Human
aaucacauucgaguguuuc

SEQ ID NO: 3171019 - RNA, 17 nt, Human
aaucaaguauuauaaac

SEQ ID NO: 3171020 - RNA, 14 nt, Human
aaucaaguaaugaa

SEQ ID NO: 3171021 - RNA, 15 nt, Human
aaucaaguaaugaau

SEQ ID NO: 3171022 - RNA, 20 nt, Human
aaucaccagggccaaaagcu

SEQ ID NO: 3171023 - RNA, 15 nt, Human
aaucaagaaacuuaa

SEQ ID NO: 3171024 - RNA, 17 nt, Human
aaucaagagccuuaaaa

SEQ ID NO: 3171025 - RNA, 19 nt, Human
aaucaagagccuuaaaaca

SEQ ID NO: 3171026 - RNA, 13 nt, Human
aauauuauauuug

SEQ ID NO: 3171027 - RNA, 19 nt, Human
aauauuauauuuggaugca

SEQ ID NO: 3171028 - RNA, 17 nt, Human
aauauuauauuuggaug

SEQ ID NO: 3171029 - RNA, 21 nt, Human
aaucaagagccuuaaaacauc

SEQ ID NO: 3171030 - RNA, 22 nt, Human
aaucaagagccuuaaaacauca

SEQ ID NO: 3171031 - RNA, 21 nt, Human
aauauuagugaccucagcuuu

SEQ ID NO: 3171032 - RNA, 20 nt, Human
aauauuaaaaagucuuuuaa

SEQ ID NO: 3171033 - RNA, 21 nt, Human
aauauuaaaaagucuuuuaaa

SEQ ID NO: 3171034 - RNA, 12 nt, Human
aauauuaaaaga

SEQ ID NO: 3171035 - RNA, 13 nt, Human
aauauuaaaagaa

SEQ ID NO: 3171036 - RNA, 19 nt, Human
aauauuaaaaagucuuuua

SEQ ID NO: 3171037 - RNA, 17 nt, Human
aauauuaaaaagucuuu

SEQ ID NO: 3171038 - RNA, 16 nt, Human
aauauuaaaaagucuu

SEQ ID NO: 3171039 - RNA, 13 nt, Human
aauauuaaaaagu

SEQ ID NO: 3171040 - RNA, 20 nt, Human
aauacucuacccucuuagaa

SEQ ID NO: 3171041 - RNA, 22 nt, Human
aauacucuacccucuuagaaaa

SEQ ID NO: 3171042 - RNA, 13 nt, Human
aauacugaaccac

SEQ ID NO: 3171043 - RNA, 14 nt, Human
aauacugaaccacu

SEQ ID NO: 3171044 - RNA, 15 nt, Human
aauacugaaccacuu

SEQ ID NO: 3171045 - RNA, 12 nt, Human
aauacucuauuu

SEQ ID NO: 3171046 - RNA, 17 nt, Human
aauacucuauuuuuaca

SEQ ID NO: 3171047 - RNA, 18 nt, Human
aauacucuauuuuuacau

SEQ ID NO: 3171048 - RNA, 23 nt, Human
aauacuuugcagcacagcugaga

SEQ ID NO: 3171049 - RNA, 12 nt, Human
aauacuuuguau

SEQ ID NO: 3171050 - RNA, 17 nt, Human
aauacuuuguauacaag

SEQ ID NO: 3171051 - RNA, 23 nt, Human
aauacuuuguauacaaguacugg

SEQ ID NO: 3171052 - RNA, 18 nt, Human
aauacugaaccacuugua

SEQ ID NO: 3171053 - RNA, 18 nt, Human
aauacugauggaauuuuu

SEQ ID NO: 3171054 - RNA, 20 nt, Human
aauacugaaccacuuguaga

SEQ ID NO: 3171055 - RNA, 23 nt, Human
aauacugacuccaaccauucaaa

SEQ ID NO: 3171056 - RNA, 13 nt, Human
aauacugcuugaa

SEQ ID NO: 3171057 - RNA, 22 nt, Human
aauacuguacaaugacuuuauu

SEQ ID NO: 3171058 - RNA, 15 nt, Human
aauacuguuauucuu

SEQ ID NO: 3171059 - RNA, 14 nt, Human
aauacuguuauucu

SEQ ID NO: 3171060 - RNA, 17 nt, Human
aauccagacccggcugc

SEQ ID NO: 3171061 - RNA, 19 nt, Human
aauccagacccggcugcgu

SEQ ID NO: 3171062 - RNA, 22 nt, Human
aaucucaacaugucuccuacug

SEQ ID NO: 3171063 - RNA, 23 nt, Human
aauccaggacccugccaggcaca

SEQ ID NO: 3171064 - RNA, 19 nt, Human
aauccaggacccugccagg

SEQ ID NO: 3171065 - RNA, 16 nt, Human
aaucucuucuguguuu

SEQ ID NO: 3171066 - RNA, 19 nt, Human
aaucucuucuuauacagau

SEQ ID NO: 3171067 - RNA, 12 nt, Human
aaucucuucugu

SEQ ID NO: 3171068 - RNA, 11 nt, Human
aaucucuucug

SEQ ID NO: 3171069 - RNA, 17 nt, Human
aaugaucgaaaaaauaa

SEQ ID NO: 3171070 - RNA, 18 nt, Human
aaugaucgaaaaaauaau

SEQ ID NO: 3171071 - RNA, 21 nt, Human
aaugaucgaaaaaauaauuau

SEQ ID NO: 3171072 - RNA, 23 nt, Human
aaugaucgaaaaaauaauuauuu

SEQ ID NO: 3171073 - RNA, 16 nt, Human
aaugauuaauuaaaac

SEQ ID NO: 3171074 - RNA, 22 nt, Human
aaugaagguuuuuguaaagauu

SEQ ID NO: 3171075 - RNA, 20 nt, Human
aaugaagguuuuuguaaaga

SEQ ID NO: 3171076 - RNA, 19 nt, Human
aaugaagguuuuuguaaag

SEQ ID NO: 3171077 - RNA, 19 nt, Human
aaugaaauaggagggaaac

SEQ ID NO: 3171078 - RNA, 23 nt, Human
aaugaaauaggagggaaaccuuu

SEQ ID NO: 3171079 - RNA, 15 nt, Human
aaugaagguuuuugu

SEQ ID NO: 3171080 - RNA, 20 nt, Human
aagucucauagguuaaaaaa

SEQ ID NO: 3171081 - RNA, 21 nt, Human
aagucucauagguuaaaaaaa

SEQ ID NO: 3171082 - RNA, 16 nt, Human
aagucucuuuuuuaca

SEQ ID NO: 3171083 - RNA, 15 nt, Human
aagucucuuuuuuac

SEQ ID NO: 3171084 - RNA, 14 nt, Human
aagucucuuuuuua

SEQ ID NO: 3171085 - RNA, 18 nt, Human
aagucucuuuuuuacaaa

SEQ ID NO: 3171086 - RNA, 20 nt, Human
aagucuguugauuaaagaug

SEQ ID NO: 3171087 - RNA, 18 nt, Human
aaguugaguauauuauaa

SEQ ID NO: 3171088 - RNA, 16 nt, Human
aaguugaguauauuau

SEQ ID NO: 3171089 - RNA, 19 nt, Human
aaguugagcuaugacuuaa

SEQ ID NO: 3171090 - RNA, 20 nt, Human
aaguugagcuaugacuuaac

SEQ ID NO: 3171091 - RNA, 16 nt, Human
aaguugagcuaugacu

SEQ ID NO: 3171092 - RNA, 18 nt, Human
aaguugagcuaugacuua

SEQ ID NO: 3171093 - RNA, 21 nt, Human
aaguugacucugcucuugcau

SEQ ID NO: 3171094 - RNA, 20 nt, Human
aaguugacucugcucuugca

SEQ ID NO: 3171095 - RNA, 15 nt, Human
aaguguacuggauuu

SEQ ID NO: 3171096 - RNA, 19 nt, Human
aaguggaaaaauagccugc

SEQ ID NO: 3171097 - RNA, 21 nt, Human
aaguggaaaaauagccugccu

SEQ ID NO: 3171098 - RNA, 15 nt, Human
aaggugauaaaauca

SEQ ID NO: 3171099 - RNA, 13 nt, Human
aaggugauguugu

SEQ ID NO: 3171100 - RNA, 17 nt, Human
aaggugagcauaaauca

SEQ ID NO: 3171101 - RNA, 20 nt, Human
aaguagaagucuuagaugua

SEQ ID NO: 3171102 - RNA, 19 nt, Human
aaguagaagucuuagaugu

SEQ ID NO: 3171103 - RNA, 14 nt, Human
aaggugcaggcagg

SEQ ID NO: 3171104 - RNA, 22 nt, Human
aaggugauaaaaucauaaguau

SEQ ID NO: 3171105 - RNA, 19 nt, Human
aaggugauaagggaaaaga

SEQ ID NO: 3171106 - RNA, 17 nt, Human
aaguagaacuuuguaua

SEQ ID NO: 3171107 - RNA, 18 nt, Human
aaguagaacuuuguauag

SEQ ID NO: 3171108 - RNA, 21 nt, Human
aaguagggacuucugucuuca

SEQ ID NO: 3171109 - RNA, 20 nt, Human
aaguaggggaagaauaauuu

SEQ ID NO: 3171110 - RNA, 19 nt, Human
aaguaggggaagaauaauu

SEQ ID NO: 3171111 - RNA, 17 nt, Human
aaguaggggaagaauaa

SEQ ID NO: 3171112 - RNA, 21 nt, Human
aaguagaagucuuagauguau

SEQ ID NO: 3171113 - RNA, 21 nt, Human
aaguagaacuuuguauaguua

SEQ ID NO: 3171114 - RNA, 23 nt, Human
aaguagaacuuuguauaguuaug

SEQ ID NO: 3171115 - RNA, 18 nt, Human
aagucuaucugguauuaa

SEQ ID NO: 3171116 - RNA, 13 nt, Human
aagucucaaggua

SEQ ID NO: 3171117 - RNA, 17 nt, Human
aagucucaaugaaauag

SEQ ID NO: 3171118 - RNA, 22 nt, Human
aaguccucuuuucugagaggac

SEQ ID NO: 3171119 - RNA, 20 nt, Human
aaguccuuugagcuccuggg

SEQ ID NO: 3171120 - RNA, 22 nt, Human
aaguccuuggcuugccauuuuu

SEQ ID NO: 3171121 - RNA, 18 nt, Human
aaguccuuugagcuccug

SEQ ID NO: 3171122 - RNA, 16 nt, Human
aagucgguuaaaaugg

SEQ ID NO: 3171123 - RNA, 18 nt, Human
aaguaguacuucuucugu

SEQ ID NO: 3171124 - RNA, 19 nt, Human
aaguaguacuucuucugua

SEQ ID NO: 3171125 - RNA, 20 nt, Human
aaguaguacuucuucuguaa

SEQ ID NO: 3171126 - RNA, 22 nt, Human
aaguaguacuucuucuguaaua

SEQ ID NO: 3171127 - RNA, 17 nt, Human
aaguccaagcauaccaa

SEQ ID NO: 3171128 - RNA, 21 nt, Human
aaguauccugagagcccagaa

SEQ ID NO: 3171129 - RNA, 22 nt, Human
aaguagugucuggaucaguaaa

SEQ ID NO: 3171130 - RNA, 18 nt, Human
aaguccucuuuucugaga

SEQ ID NO: 3171131 - RNA, 22 nt, Human
aagucccuguaauuguuguuug

SEQ ID NO: 3171132 - RNA, 17 nt, Human
aagggaaacugccagca

SEQ ID NO: 3171133 - RNA, 16 nt, Human
aagggaaacugccagc

SEQ ID NO: 3171134 - RNA, 20 nt, Human
aagggaaaaaucaaguauua

SEQ ID NO: 3171135 - RNA, 23 nt, Human
aagggaaacugccagcaacgcag

SEQ ID NO: 3171136 - RNA, 21 nt, Human
aagggaauagaaauguuugcu

SEQ ID NO: 3171137 - RNA, 16 nt, Human
aagggaggcccagcgc

SEQ ID NO: 3171138 - RNA, 18 nt, Human
aagggagcuggcuccagc

SEQ ID NO: 3171139 - RNA, 21 nt, Human
aagggaccagggagaugccac

SEQ ID NO: 3171140 - RNA, 21 nt, Human
aagcugugucugcccaaugaa

SEQ ID NO: 3171141 - RNA, 23 nt, Human
aagcugugucugcccaaugaaua

SEQ ID NO: 3171142 - RNA, 21 nt, Human
aagcuggucccacucagucca

SEQ ID NO: 3171143 - RNA, 18 nt, Human
aagcuggucccacucagu

SEQ ID NO: 3171144 - RNA, 15 nt, Human
aagcugggcagguug

SEQ ID NO: 3171145 - RNA, 21 nt, Human
aagcugugugcucuccaagcc

SEQ ID NO: 3171146 - RNA, 13 nt, Human
aaggacacuagaa

SEQ ID NO: 3171147 - RNA, 13 nt, Human
aaggacagccccu

SEQ ID NO: 3171148 - RNA, 19 nt, Human
aaggacagccccuccucca

SEQ ID NO: 3171149 - RNA, 21 nt, Human
aaggacaguccuauuuagaca

SEQ ID NO: 3171150 - RNA, 13 nt, Human
aaggacuuccuga

SEQ ID NO: 3171151 - RNA, 21 nt, Human
aaggcagcuguugucucuucu

SEQ ID NO: 3171152 - RNA, 18 nt, Human
aaggcagcuguugucucu

SEQ ID NO: 3171153 - RNA, 22 nt, Human
aaggcagcuguugucucuucuc

SEQ ID NO: 3171154 - RNA, 12 nt, Human
aaggcagggagg

SEQ ID NO: 3171155 - RNA, 15 nt, Human
aaggauugcuacugu

SEQ ID NO: 3171156 - RNA, 22 nt, Human
aaggacuuccugauugguuucu

SEQ ID NO: 3171157 - RNA, 15 nt, Human
aaggauguucuagca

SEQ ID NO: 3171158 - RNA, 16 nt, Human
aaggauuauggaaaaa

SEQ ID NO: 3171159 - RNA, 19 nt, Human
aaggauuauggaaaaauaa

SEQ ID NO: 3171160 - RNA, 20 nt, Human
aaggauuauggaaaaauaaa

SEQ ID NO: 3171161 - RNA, 17 nt, Human
aagcgauucuucugcuu

SEQ ID NO: 3171162 - RNA, 19 nt, Human
aagcgcccuggcccccaca

SEQ ID NO: 3171163 - RNA, 15 nt, Human
aagcgcccuggcccc

SEQ ID NO: 3171164 - RNA, 14 nt, Human
aagcgcccuggccc

SEQ ID NO: 3171165 - RNA, 13 nt, Human
aagcgcccuggcc

SEQ ID NO: 3171166 - RNA, 21 nt, Human
aagcgauucuucugcuucagc

SEQ ID NO: 3171167 - RNA, 21 nt, Human
aagcgcccuggcccccacaug

SEQ ID NO: 3171168 - RNA, 17 nt, Human
aagcagcauaaagaauu

SEQ ID NO: 3171169 - RNA, 19 nt, Human
aagccagcaggcucucagg

SEQ ID NO: 3171170 - RNA, 20 nt, Human
aagccagcaggcucucaggc

SEQ ID NO: 3171171 - RNA, 23 nt, Human
aagccagcaggcucucaggccag

SEQ ID NO: 3171172 - RNA, 20 nt, Human
aagccagccaagcuuuaaau

SEQ ID NO: 3171173 - RNA, 22 nt, Human
aagccagccaagcuuuaaauua

SEQ ID NO: 3171174 - RNA, 20 nt, Human
aagauguucuggauaccauu

SEQ ID NO: 3171175 - RNA, 15 nt, Human
aagauguucuggaua

SEQ ID NO: 3171176 - RNA, 15 nt, Human
aagauguguucuuau

SEQ ID NO: 3171177 - RNA, 16 nt, Human
aagauguguucuuauu

SEQ ID NO: 3171178 - RNA, 17 nt, Human
aagauguguucuuauuu

SEQ ID NO: 3171179 - RNA, 18 nt, Human
aagauguguucuuauuuu

SEQ ID NO: 3171180 - RNA, 14 nt, Human
aagauguuauauuu

SEQ ID NO: 3171181 - RNA, 12 nt, Human
aagauguuauau

SEQ ID NO: 3171182 - RNA, 22 nt, Human
aagauguuauauuuuucuuaaa

SEQ ID NO: 3171183 - RNA, 18 nt, Human
aagauguuauauuuuucu

SEQ ID NO: 3171184 - RNA, 16 nt, Human
aagauguuauauuuuu

SEQ ID NO: 3171185 - RNA, 13 nt, Human
aagauaaaugugc

SEQ ID NO: 3171186 - RNA, 12 nt, Human
aagauaaaugug

SEQ ID NO: 3171187 - RNA, 18 nt, Human
aagauaaaaaaacagcuu

SEQ ID NO: 3171188 - RNA, 21 nt, Human
aagauaccuuuuuuuuucuuu

SEQ ID NO: 3171189 - RNA, 20 nt, Human
aagauaccuuuuuuuuucuu

SEQ ID NO: 3171190 - RNA, 18 nt, Human
aagauaccuuuuuuuuuc

SEQ ID NO: 3171191 - RNA, 23 nt, Human
aagauaccuuaaaauuugaaaca

SEQ ID NO: 3171192 - RNA, 21 nt, Human
aagauaccuuaaaauuugaaa

SEQ ID NO: 3171193 - RNA, 20 nt, Human
aagauaccuuaaaauuugaa

SEQ ID NO: 3171194 - RNA, 19 nt, Human
aagauaccuuaaaauuuga

SEQ ID NO: 3171195 - RNA, 18 nt, Human
aagauaccuuaaaauuug

SEQ ID NO: 3171196 - RNA, 17 nt, Human
aagauaccuuaaaauuu

SEQ ID NO: 3171197 - RNA, 16 nt, Human
aagauaccuuaaaauu

SEQ ID NO: 3171198 - RNA, 15 nt, Human
aagauaccuuaaaau

SEQ ID NO: 3171199 - RNA, 14 nt, Human
aagauaccuuaaaa

SEQ ID NO: 3171200 - RNA, 18 nt, Human
aagauaaagaccagaaau

SEQ ID NO: 3171201 - RNA, 15 nt, Human
aagaguggccccacc

SEQ ID NO: 3171202 - RNA, 22 nt, Human
aagaguggcagcuauaggaaau

SEQ ID NO: 3171203 - RNA, 21 nt, Human
aagaguggccccaccuggccc

SEQ ID NO: 3171204 - RNA, 19 nt, Human
aagaguggccccaccuggc

SEQ ID NO: 3171205 - RNA, 17 nt, Human
aagaguggccccaccug

SEQ ID NO: 3171206 - RNA, 16 nt, Human
aagaguggccccaccu

SEQ ID NO: 3171207 - RNA, 22 nt, Human
aagaguggccccaccuggcccu

SEQ ID NO: 3171208 - RNA, 17 nt, Human
aagaguguaaaauauuu

SEQ ID NO: 3171209 - RNA, 15 nt, Human
aagaguguaaaauau

SEQ ID NO: 3171210 - RNA, 19 nt, Human
aagaguuugccuuauaaau

SEQ ID NO: 3171211 - RNA, 17 nt, Human
aagagucuggggaccag

SEQ ID NO: 3171212 - RNA, 16 nt, Human
aagagucuuucuucuu

SEQ ID NO: 3171213 - RNA, 13 nt, Human
aagagucuuucuu

SEQ ID NO: 3171214 - RNA, 22 nt, Human
aagagugaaauaccauuauuau

SEQ ID NO: 3171215 - RNA, 15 nt, Human
aagagucuauugucu

SEQ ID NO: 3171216 - RNA, 16 nt, Human
aagagucuauugucuc

SEQ ID NO: 3171217 - RNA, 19 nt, Human
aacuuucaagaacuuguuu

SEQ ID NO: 3171218 - RNA, 16 nt, Human
aacuuucaagaacuug

SEQ ID NO: 3171219 - RNA, 22 nt, Human
aacuuucacuauaaugugaaau

SEQ ID NO: 3171220 - RNA, 21 nt, Human
aacuuucaagaacuuguuuaa

SEQ ID NO: 3171221 - RNA, 19 nt, Human
aaccaccagaagcccagaa

SEQ ID NO: 3171222 - RNA, 18 nt, Human
aaccaccagaagcccaga

SEQ ID NO: 3171223 - RNA, 16 nt, Human
aacauccacucucucu

SEQ ID NO: 3171224 - RNA, 13 nt, Human
aaccacgcuggac

SEQ ID NO: 3171225 - RNA, 15 nt, Human
aacauccacucucuc

SEQ ID NO: 3171226 - RNA, 13 nt, Human
aacauccacucuc

SEQ ID NO: 3171227 - RNA, 16 nt, Human
aacauccaaguggccu

SEQ ID NO: 3171228 - RNA, 24 nt, Human
aacauccaaguggccuccgucacu

SEQ ID NO: 3171229 - RNA, 17 nt, Human
aacauccaaguggccuc

SEQ ID NO: 3171230 - RNA, 15 nt, Human
aacagcuucauguuc

SEQ ID NO: 3171231 - RNA, 15 nt, Human
aacagcuguugacuc

SEQ ID NO: 3171232 - RNA, 14 nt, Human
aacaucauuccuuu

SEQ ID NO: 3171233 - RNA, 22 nt, Human
aacagcuucauguucccaaaau

SEQ ID NO: 3171234 - RNA, 17 nt, Human
aacaucauuccuuuuua

SEQ ID NO: 3171235 - RNA, 20 nt, Human
aacaucauuccuuuuuauuu

SEQ ID NO: 3171236 - RNA, 21 nt, Human
aacaucauuccuuuuuauuua

SEQ ID NO: 3171237 - RNA, 22 nt, Human
aacaucauuccuuuuuauuuau

SEQ ID NO: 3171238 - RNA, 15 nt, Human
aaccaccuaccccug

SEQ ID NO: 3171239 - RNA, 16 nt, Human
aaccaccuauuuuuga

SEQ ID NO: 3171240 - RNA, 15 nt, Human
aaccacuucagcuga

SEQ ID NO: 3171241 - RNA, 12 nt, Human
aaccagacacaa

SEQ ID NO: 3171242 - RNA, 22 nt, Human
aaccacuuguagauuugauuuu

SEQ ID NO: 3171243 - RNA, 17 nt, Human
aaccacuuguagauuug

SEQ ID NO: 3171244 - RNA, 18 nt, Human
aaccacuuguagauuuga

SEQ ID NO: 3171245 - RNA, 20 nt, Human
aaccacuuguagauuugauu

SEQ ID NO: 3171246 - RNA, 21 nt, Human
aaccacuuguagauuugauuu

SEQ ID NO: 3171247 - RNA, 12 nt, Human
aaccacuuguag

SEQ ID NO: 3171248 - RNA, 16 nt, Human
aacccgggaggcagag

SEQ ID NO: 3171249 - RNA, 16 nt, Human
aacccuugccaggucc

SEQ ID NO: 3171250 - RNA, 21 nt, Human
aacccuuggagccaauggaga

SEQ ID NO: 3171251 - RNA, 16 nt, Human
aacccuucuucauguu

SEQ ID NO: 3171252 - RNA, 15 nt, Human
aacccuauugguaaa

SEQ ID NO: 3171253 - RNA, 14 nt, Human
aaccuaauuaauau

SEQ ID NO: 3171254 - RNA, 18 nt, Human
aaccuaauuaauauauua

SEQ ID NO: 3171255 - RNA, 18 nt, Human
aacagcaguuucagguag

SEQ ID NO: 3171256 - RNA, 15 nt, Human
aacagcaagugugaa

SEQ ID NO: 3171257 - RNA, 16 nt, Human
aacagcaagugugaau

SEQ ID NO: 3171258 - RNA, 16 nt, Human
aaaucuuauuaaaguu

SEQ ID NO: 3171259 - RNA, 14 nt, Human
aaaucuuauuaaag

SEQ ID NO: 3171260 - RNA, 12 nt, Human
aaaucuuauuaa

SEQ ID NO: 3171261 - RNA, 23 nt, Human
aaaucuuaauacuguuauucuuu

SEQ ID NO: 3171262 - RNA, 19 nt, Human
aaaucuuaauacuguuauu

SEQ ID NO: 3171263 - RNA, 22 nt, Human
aaauguuguucucuucuuuaaa

SEQ ID NO: 3171264 - RNA, 12 nt, Human
aaauguuucuaa

SEQ ID NO: 3171265 - RNA, 19 nt, Human
aaauugacacuuaaaaaug

SEQ ID NO: 3171266 - RNA, 21 nt, Human
aaauugccuuucuguguuuau

SEQ ID NO: 3171267 - RNA, 20 nt, Human
aaauugccuuucuguguuua

SEQ ID NO: 3171268 - RNA, 19 nt, Human
aaauugccuuucuguguuu

SEQ ID NO: 3171269 - RNA, 16 nt, Human
aaauugccuuucugug

SEQ ID NO: 3171270 - RNA, 14 nt, Human
aaauugccuuucug

SEQ ID NO: 3171271 - RNA, 20 nt, Human
aaauuuuuuuguaugaaaac

SEQ ID NO: 3171272 - RNA, 14 nt, Human
aaauugcuccuuga

SEQ ID NO: 3171273 - RNA, 23 nt, Human
aaauugcucacaguuauuacaua

SEQ ID NO: 3171274 - RNA, 18 nt, Human
aaauugcucacaguuauu

SEQ ID NO: 3171275 - RNA, 15 nt, Human
aaauugcucacaguu

SEQ ID NO: 3171276 - RNA, 13 nt, Human
aaauugcuccuug

SEQ ID NO: 3171277 - RNA, 17 nt, Human
aaauuaaagcugaaaac

SEQ ID NO: 3171278 - RNA, 13 nt, Human
aaauuaaagcuga

SEQ ID NO: 3171279 - RNA, 14 nt, Human
aaauugaaaaguua

SEQ ID NO: 3171280 - RNA, 21 nt, Human
aaauugaaaaguuauuucccu

SEQ ID NO: 3171281 - RNA, 16 nt, Human
aacacaucagcuugcc

SEQ ID NO: 3171282 - RNA, 12 nt, Human
aacacaucagcu

SEQ ID NO: 3171283 - RNA, 18 nt, Human
aacaaauuuacagagaca

SEQ ID NO: 3171284 - RNA, 20 nt, Human
aacaacagucuucauuuuuu

SEQ ID NO: 3171285 - RNA, 14 nt, Human
aacaacauauacaa

SEQ ID NO: 3171286 - RNA, 17 nt, Human
aacaacauuuauaugua

SEQ ID NO: 3171287 - RNA, 23 nt, Human
aaauuuuuuuucaugcuuuauca

SEQ ID NO: 3171288 - RNA, 12 nt, Human
aacacauuucuu

SEQ ID NO: 3171289 - RNA, 22 nt, Human
aacacauuucuuuuuaaaaaaa

SEQ ID NO: 3171290 - RNA, 15 nt, Human
aacacauuucuuuuu

SEQ ID NO: 3171291 - RNA, 18 nt, Human
aacaccaucacagcuugu

SEQ ID NO: 3171292 - RNA, 15 nt, Human
aacacccacaggcau

SEQ ID NO: 3171293 - RNA, 13 nt, Human
aacacuaaauguu

SEQ ID NO: 3171294 - RNA, 15 nt, Human
aacacuaaauguuaa

SEQ ID NO: 3171295 - RNA, 14 nt, Human
aacacuaaauguua

SEQ ID NO: 3171296 - RNA, 13 nt, Human
aacacguuuuaag

SEQ ID NO: 3171297 - RNA, 22 nt, Human
aacacuaaauguuaaagaugua

SEQ ID NO: 3171298 - RNA, 21 nt, Human
aacacuaaauguuaaagaugu

SEQ ID NO: 3171299 - RNA, 19 nt, Human
aacacuaaauguuaaagau

SEQ ID NO: 3171300 - RNA, 18 nt, Human
aacacuaaauguuaaaga

SEQ ID NO: 3171301 - RNA, 16 nt, Human
aacacuaaauguuaaa

SEQ ID NO: 3171302 - RNA, 20 nt, Human
aacuuuaugcuaagugaaau

SEQ ID NO: 3171303 - RNA, 21 nt, Human
aacuuuaugcuaagugaaaua

SEQ ID NO: 3171304 - RNA, 22 nt, Human
aacuuuaucagggaaacuaaga

SEQ ID NO: 3171305 - RNA, 20 nt, Human
aacugagaugugaacacauc

SEQ ID NO: 3171306 - RNA, 19 nt, Human
aacugaccagccuccaugc

SEQ ID NO: 3171307 - RNA, 13 nt, Human
aacugacuugcug

SEQ ID NO: 3171308 - RNA, 16 nt, Human
aacugagugccuuuug

SEQ ID NO: 3171309 - RNA, 19 nt, Human
aacuuaaauuuuaguucuu

SEQ ID NO: 3171310 - RNA, 12 nt, Human
aacuuaacaugc

SEQ ID NO: 3171311 - RNA, 13 nt, Human
aacuuaacaugcu

SEQ ID NO: 3171312 - RNA, 15 nt, Human
aacuuaacaugcugu

SEQ ID NO: 3171313 - RNA, 15 nt, Human
aacuuaauaaucaag

SEQ ID NO: 3171314 - RNA, 17 nt, Human
aacuuaauaaucaagag

SEQ ID NO: 3171315 - RNA, 13 nt, Human
aacuuaauaauca

SEQ ID NO: 3171316 - RNA, 20 nt, Human
aacuuaauaaucaagagccu

SEQ ID NO: 3171317 - RNA, 15 nt, Human
aacgauccuucaaag

SEQ ID NO: 3171318 - RNA, 22 nt, Human
aacgaucacaaaugacuuuauu

SEQ ID NO: 3171319 - RNA, 15 nt, Human
aacgauuuaauuuau

SEQ ID NO: 3171320 - RNA, 11 nt, Human
aacgcagcccu

SEQ ID NO: 3171321 - RNA, 15 nt, Human
aacgcugauuuaaag

SEQ ID NO: 3171322 - RNA, 17 nt, Human
aacuauuuaaagaaaua

SEQ ID NO: 3171323 - RNA, 15 nt, Human
aacuauuuaaagaaa

SEQ ID NO: 3171324 - RNA, 14 nt, Human
aacggccccagcuu

SEQ ID NO: 3171325 - RNA, 17 nt, Human
aacggccccagcuucuc

SEQ ID NO: 3171326 - RNA, 15 nt, Human
aacggccccagcuuc

SEQ ID NO: 3171327 - RNA, 17 nt, Human
aaagccaaugugaacag

SEQ ID NO: 3171328 - RNA, 15 nt, Human
aaagccaaugugaac

SEQ ID NO: 3171329 - RNA, 23 nt, Human
aaagcccuuccaugucgccucug

SEQ ID NO: 3171330 - RNA, 22 nt, Human
aaagcccuuccaugucgccucu

SEQ ID NO: 3171331 - RNA, 16 nt, Human
aaaggcaaacauuuga

SEQ ID NO: 3171332 - RNA, 14 nt, Human
aaaggcagaagcaa

SEQ ID NO: 3171333 - RNA, 21 nt, Human
aaaggcacauggaauauauuu

SEQ ID NO: 3171334 - RNA, 20 nt, Human
aaaggcacauggaauauauu

SEQ ID NO: 3171335 - RNA, 12 nt, Human
aaaggcccagag

SEQ ID NO: 3171336 - RNA, 15 nt, Human
aaaggcuccaggagc

SEQ ID NO: 3171337 - RNA, 16 nt, Human
aaaggcuccaggagca

SEQ ID NO: 3171338 - RNA, 21 nt, Human
aaaggccuaauucuaugccug

SEQ ID NO: 3171339 - RNA, 12 nt, Human
aaauaaaacugu

SEQ ID NO: 3171340 - RNA, 22 nt, Human
aaaguggcaccugucugcucca

SEQ ID NO: 3171341 - RNA, 20 nt, Human
aaaguggcaccugucugcuc

SEQ ID NO: 3171342 - RNA, 18 nt, Human
aaaguggcaccugucugc

SEQ ID NO: 3171343 - RNA, 13 nt, Human
aaaguggaaaaau

SEQ ID NO: 3171344 - RNA, 14 nt, Human
aaagugcugggauu

SEQ ID NO: 3171345 - RNA, 18 nt, Human
aaagucucaaugaaauag

SEQ ID NO: 3171346 - RNA, 21 nt, Human
aaaguccauaccuuauauaug

SEQ ID NO: 3171347 - RNA, 19 nt, Human
aaaggcuccaggagcagcc

SEQ ID NO: 3171348 - RNA, 20 nt, Human
aaaggcuccaggagcagcca

SEQ ID NO: 3171349 - RNA, 17 nt, Human
aaauaaaucuacuguuu

SEQ ID NO: 3171350 - RNA, 21 nt, Human
aaauaaaugguuuggugcuuu

SEQ ID NO: 3171351 - RNA, 13 nt, Human
aaauaaauauacc

SEQ ID NO: 3171352 - RNA, 12 nt, Human
aaauaguuuauu

SEQ ID NO: 3171353 - RNA, 17 nt, Human
aaauaguuuauuuuaaa

SEQ ID NO: 3171354 - RNA, 20 nt, Human
aaauaguuuauuuuaaaaca

SEQ ID NO: 3171355 - RNA, 13 nt, Human
aaaucaaagugcu

SEQ ID NO: 3171356 - RNA, 21 nt, Human
aaauaguuuauuuuaaaacaa

SEQ ID NO: 3171357 - RNA, 14 nt, Human
aaaucaaauaugca

SEQ ID NO: 3171358 - RNA, 12 nt, Human
aaaucaaauaug

SEQ ID NO: 3171359 - RNA, 15 nt, Human
aaaucaaauaugcaa

SEQ ID NO: 3171360 - RNA, 14 nt, Human
aaaucaaagugcua

SEQ ID NO: 3171361 - RNA, 15 nt, Human
aaaucaaagugcuau

SEQ ID NO: 3171362 - RNA, 17 nt, Human
aaaucaaguauuauaaa

SEQ ID NO: 3171363 - RNA, 22 nt, Human
aaaucaaauaauaccuuagaag

SEQ ID NO: 3171364 - RNA, 17 nt, Human
aaaucuuaauacuguua

SEQ ID NO: 3171365 - RNA, 16 nt, Human
aaaucuuaauacuguu

SEQ ID NO: 3171366 - RNA, 15 nt, Human
aaaucuuaauacugu

SEQ ID NO: 3171367 - RNA, 16 nt, Human
aaaucuuaagaaauaa

SEQ ID NO: 3171368 - RNA, 14 nt, Human
aaaucugucugcug

SEQ ID NO: 3171369 - RNA, 12 nt, Human
aaaucugucugc

SEQ ID NO: 3171370 - RNA, 18 nt, Human
aaaucugcuuuuuaaaga

SEQ ID NO: 3171371 - RNA, 19 nt, Human
aaaucaaugcuauaacuau

SEQ ID NO: 3171372 - RNA, 17 nt, Human
aaaucaauaugcagaau

SEQ ID NO: 3171373 - RNA, 16 nt, Human
aaaucaauaugcagaa

SEQ ID NO: 3171374 - RNA, 20 nt, Human
aaaucaaucuguaaaacuaa

SEQ ID NO: 3171375 - RNA, 15 nt, Human
aaaucaauaguugaa

SEQ ID NO: 3171376 - RNA, 17 nt, Human
aaaucaauaguugaauu

SEQ ID NO: 3171377 - RNA, 23 nt, Human
aaaucaaguauuauaaacaagaa

SEQ ID NO: 3171378 - RNA, 24 nt, Human
aaauagcucaggugucccugcacu

SEQ ID NO: 3171379 - RNA, 19 nt, Human
aaauaggcuauuaaaaaag

SEQ ID NO: 3171380 - RNA, 14 nt, Human
aaauaggcuuuuua

SEQ ID NO: 3171381 - RNA, 13 nt, Human
aaauagugugaaa

SEQ ID NO: 3171382 - RNA, 15 nt, Human
aaauagugugaaaua

SEQ ID NO: 3171383 - RNA, 18 nt, Human
aaauagugugaaauauau

SEQ ID NO: 3171384 - RNA, 20 nt, Human
aaauaguguggaaauuaaga

SEQ ID NO: 3171385 - RNA, 21 nt, Human
aaauaguguggaaauuaagaa

SEQ ID NO: 3171386 - RNA, 19 nt, Human
aaauaguguuauugagaga

SEQ ID NO: 3171387 - RNA, 20 nt, Human
aaauaguugcauagcaguau

SEQ ID NO: 3171388 - RNA, 22 nt, Human
aaauaguugcauagcaguauau

SEQ ID NO: 3171389 - RNA, 23 nt, Human
aaauaguugcauagcaguauaug

SEQ ID NO: 3171390 - RNA, 23 nt, Human
aaauaguucugugacuaggaaaa

SEQ ID NO: 3171391 - RNA, 22 nt, Human
aaauaguucugugacuaggaaa

SEQ ID NO: 3171392 - RNA, 16 nt, Human
aaauaguucugugacu

SEQ ID NO: 3171393 - RNA, 18 nt, Human
aaauaggagggaaaccuu

SEQ ID NO: 3171394 - RNA, 19 nt, Human
aaauaggagggaaaccuuu

SEQ ID NO: 3171395 - RNA, 22 nt, Human
aaagaaaucuauagaaaguguu

SEQ ID NO: 3171396 - RNA, 21 nt, Human
aaagaaaucuauagaaagugu

SEQ ID NO: 3171397 - RNA, 18 nt, Human
aaagaaaucuauagaaag

SEQ ID NO: 3171398 - RNA, 15 nt, Human
aaagaaaucuauaga

SEQ ID NO: 3171399 - RNA, 23 nt, Human
aaacugagaugugaacacaucag

SEQ ID NO: 3171400 - RNA, 21 nt, Human
aaacugagaugugaacacauc

SEQ ID NO: 3171401 - RNA, 17 nt, Human
aaacucugaauuuaucu

SEQ ID NO: 3171402 - RNA, 15 nt, Human
aaacucugaauuuau

SEQ ID NO: 3171403 - RNA, 18 nt, Human
aaacucugaauuuaucuu

SEQ ID NO: 3171404 - RNA, 23 nt, Human
aaagaaaucuauagaaaguguuc

SEQ ID NO: 3171405 - RNA, 14 nt, Human
aaagaguaggaaga

SEQ ID NO: 3171406 - RNA, 20 nt, Human
aaagaagguuucagaaagaa

SEQ ID NO: 3171407 - RNA, 14 nt, Human
aaagagucuuucuu

SEQ ID NO: 3171408 - RNA, 17 nt, Human
aaagaaggaaagauggu

SEQ ID NO: 3171409 - RNA, 15 nt, Human
aaagauaaagaccag

SEQ ID NO: 3171410 - RNA, 16 nt, Human
aaagaguguaaaauau

SEQ ID NO: 3171411 - RNA, 18 nt, Human
aaagaguguaaaauauuu

SEQ ID NO: 3171412 - RNA, 18 nt, Human
aaaccccuguaggccuca

SEQ ID NO: 3171413 - RNA, 16 nt, Human
aaacccuauugguaaa

SEQ ID NO: 3171414 - RNA, 18 nt, Human
aaacucuccucugcugcu

SEQ ID NO: 3171415 - RNA, 15 nt, Human
aaacccugucaaaca

SEQ ID NO: 3171416 - RNA, 13 nt, Human
aaacucuccucug

SEQ ID NO: 3171417 - RNA, 18 nt, Human
aaacccucauuguguuuc

SEQ ID NO: 3171418 - RNA, 14 nt, Human
aaacccugucaaac

SEQ ID NO: 3171419 - RNA, 18 nt, Human
aaaccaucauugaaaucu

SEQ ID NO: 3171420 - RNA, 14 nt, Human
aaaauaaacuuucu

SEQ ID NO: 3171421 - RNA, 22 nt, Human
aaaauaaacuuucuuaauauuu

SEQ ID NO: 3171422 - RNA, 17 nt, Human
aaaaucaugccaguauu

SEQ ID NO: 3171423 - RNA, 18 nt, Human
aaaaucaugccaguauuu

SEQ ID NO: 3171424 - RNA, 19 nt, Human
aaaaucaugccaguauuuu

SEQ ID NO: 3171425 - RNA, 21 nt, Human
aaaaucuacacuccagugaga

SEQ ID NO: 3171426 - RNA, 22 nt, Human
aaaaucccuuaccucggugccu

SEQ ID NO: 3171427 - RNA, 18 nt, Human
aaaaguucugcagauaaa

SEQ ID NO: 3171428 - RNA, 17 nt, Human
aaaaguuauuaaaauug

SEQ ID NO: 3171429 - RNA, 15 nt, Human
aaaaguuauuaaaau

SEQ ID NO: 3171430 - RNA, 18 nt, Human
aaaaguugaagaucguga

SEQ ID NO: 3171431 - RNA, 15 nt, Human
aaaauaaaauaaaua

SEQ ID NO: 3171432 - RNA, 17 nt, Human
aaaauaaaauacuuuga

SEQ ID NO: 3171433 - RNA, 19 nt, Human
aaaauaaaauuaaagcuga

SEQ ID NO: 3171434 - RNA, 15 nt, Human
aaaaagaaaggaggg

SEQ ID NO: 3171435 - RNA, 20 nt, Human
aaaaacucuuuaacuuguaa

SEQ ID NO: 3171436 - RNA, 19 nt, Human
aaaaacucuuuaacuugua

SEQ ID NO: 3171437 - RNA, 13 nt, Human
aaaaagaaaaaag

SEQ ID NO: 3171438 - RNA, 11 nt, Human
aaaaagaaaaa

SEQ ID NO: 3171439 - RNA, 12 nt, Human
aaaaacugaagu

SEQ ID NO: 3171440 - RNA, 18 nt, Human
aaaaagaaagaaagagga

SEQ ID NO: 3171441 - RNA, 22 nt, Human
aaaagugcugcagggcuuuaaa

SEQ ID NO: 3171442 - RNA, 16 nt, Human
aaacacuguucucugc

SEQ ID NO: 3171443 - RNA, 20 nt, Human
aaacacuugugacuuuugcu

SEQ ID NO: 3171444 - RNA, 16 nt, Human
aaacacuugugacuuu

SEQ ID NO: 3171445 - RNA, 14 nt, Human
aaacacucagcugu

SEQ ID NO: 3171446 - RNA, 15 nt, Human
aaacacucagcuguu

SEQ ID NO: 3171447 - RNA, 16 nt, Human
aaacacucagcuguuc

SEQ ID NO: 3171448 - RNA, 17 nt, Human
aaacacguuuuaaggac

SEQ ID NO: 3171449 - RNA, 18 nt, Human
aaacacguuuuaaggacu

SEQ ID NO: 3171450 - RNA, 22 nt, Human
aaacacguuuuaaggacugacu

SEQ ID NO: 3171451 - RNA, 13 nt, Human
aaacacuaaaugu

SEQ ID NO: 3171452 - RNA, 22 nt, Human
aaacacuaaauguuaaagaugu

SEQ ID NO: 3171453 - RNA, 21 nt, Human
aaacacuaaauguuaaagaug

SEQ ID NO: 3171454 - RNA, 20 nt, Human
aaacacuaaauguuaaagau

SEQ ID NO: 3171455 - RNA, 19 nt, Human
aaacacuaaauguuaaaga

SEQ ID NO: 3171456 - RNA, 17 nt, Human
aaacacuaaauguuaaa

SEQ ID NO: 3171457 - RNA, 16 nt, Human
aaacacuaaauguuaa

SEQ ID NO: 3171458 - RNA, 15 nt, Human
aaacacuaaauguua

SEQ ID NO: 3171459 - RNA, 14 nt, Human
aaacacuaaauguu

SEQ ID NO: 3171460 - RNA, 14 nt, Human
aaacaccuucuaua

SEQ ID NO: 3171461 - RNA, 22 nt, Human
aaaauugaguucuuccuguaau

SEQ ID NO: 3171462 - RNA, 23 nt, Human
aaaauugaguucuuccuguaauc

SEQ ID NO: 3171463 - RNA, 14 nt, Human
aaacagaaauuggu

SEQ ID NO: 3171464 - RNA, 15 nt, Human
aaacagaaauuggua

SEQ ID NO: 3171465 - RNA, 20 nt, Human
accugcccugcugaguccca

SEQ ID NO: 3171466 - RNA, 14 nt, Human
accucugggagcug

SEQ ID NO: 3171467 - RNA, 13 nt, Human
accucugggagcu

SEQ ID NO: 3171468 - RNA, 15 nt, Human
accucugcuuuuauc

SEQ ID NO: 3171469 - RNA, 19 nt, Human
accucugcuuuuaucucag

SEQ ID NO: 3171470 - RNA, 24 nt, Human
accucugcuuuuaucucagauguu

SEQ ID NO: 3171471 - RNA, 20 nt, Human
accugucugcuccagcucug

SEQ ID NO: 3171472 - RNA, 17 nt, Human
accuguuaaaauuauac

SEQ ID NO: 3171473 - RNA, 19 nt, Human
accugucugcuccagcucu

SEQ ID NO: 3171474 - RNA, 14 nt, Human
accugucugcucca

SEQ ID NO: 3171475 - RNA, 13 nt, Human
accugucugcucc

SEQ ID NO: 3171476 - RNA, 11 nt, Human
accugucugcu

SEQ ID NO: 3171477 - RNA, 12 nt, Human
accugucccccu

SEQ ID NO: 3171478 - RNA, 15 nt, Human
accugucccccugac

SEQ ID NO: 3171479 - RNA, 16 nt, Human
accugucccccugaca

SEQ ID NO: 3171480 - RNA, 15 nt, Human
accuuuaagagaaau

SEQ ID NO: 3171481 - RNA, 20 nt, Human
accuuguuuauuaaauugca

SEQ ID NO: 3171482 - RNA, 16 nt, Human
accuuuaaucuguuuu

SEQ ID NO: 3171483 - RNA, 22 nt, Human
accuuuaaucagguccugcuca

SEQ ID NO: 3171484 - RNA, 18 nt, Human
accuuucccaucuuccaa

SEQ ID NO: 3171485 - RNA, 13 nt, Human
accuuucccaucu

SEQ ID NO: 3171486 - RNA, 17 nt, Human
accuuggcugcagggag

SEQ ID NO: 3171487 - RNA, 14 nt, Human
accuuggcugcagg

SEQ ID NO: 3171488 - RNA, 21 nt, Human
accuuggcuuggcccuggcag

SEQ ID NO: 3171489 - RNA, 20 nt, Human
accuuggcuuggcccuggca

SEQ ID NO: 3171490 - RNA, 17 nt, Human
accuuggcuuggcccug

SEQ ID NO: 3171491 - RNA, 12 nt, Human
accuuggcuugg

SEQ ID NO: 3171492 - RNA, 18 nt, Human
accuuggcugcagggagu

SEQ ID NO: 3171493 - RNA, 15 nt, Human
accuugguuggaagg

SEQ ID NO: 3171494 - RNA, 15 nt, Human
accuugguuccuggg

SEQ ID NO: 3171495 - RNA, 13 nt, Human
accuugguuccug

SEQ ID NO: 3171496 - RNA, 14 nt, Human
accuuguaauguaa

SEQ ID NO: 3171497 - RNA, 23 nt, Human
accucugccugaagucacacagu

SEQ ID NO: 3171498 - RNA, 19 nt, Human
accucugccuuugugguga

SEQ ID NO: 3171499 - RNA, 22 nt, Human
acuaacuucuaaaacuguacuu

SEQ ID NO: 3171500 - RNA, 19 nt, Human
acuaacuucuaaaacugua

SEQ ID NO: 3171501 - RNA, 18 nt, Human
acuaacuucuaaaacugu

SEQ ID NO: 3171502 - RNA, 21 nt, Human
acgugaugugcucaucagaaa

SEQ ID NO: 3171503 - RNA, 17 nt, Human
acuaacuucuaaaacug

SEQ ID NO: 3171504 - RNA, 11 nt, Human
acgugaguccu

SEQ ID NO: 3171505 - RNA, 22 nt, Human
acgucuauuucaucagaacagc

SEQ ID NO: 3171506 - RNA, 21 nt, Human
acgucuauuucaucagaacag

SEQ ID NO: 3171507 - RNA, 23 nt, Human
acuaagucucuuuuuuacaaagg

SEQ ID NO: 3171508 - RNA, 22 nt, Human
acuaagucucuuuuuuacaaag

SEQ ID NO: 3171509 - RNA, 15 nt, Human
acuaagucucuuuuu

SEQ ID NO: 3171510 - RNA, 21 nt, Human
acuaagucucuuuuuuacaaa

SEQ ID NO: 3171511 - RNA, 20 nt, Human
acuaagucucuuuuuuacaa

SEQ ID NO: 3171512 - RNA, 19 nt, Human
acuaagucucuuuuuuaca

SEQ ID NO: 3171513 - RNA, 18 nt, Human
acuaagucucuuuuuuac

SEQ ID NO: 3171514 - RNA, 22 nt, Human
acgcaggcccccaggugccagu

SEQ ID NO: 3171515 - RNA, 19 nt, Human
acgcaggcccccaggugcc

SEQ ID NO: 3171516 - RNA, 12 nt, Human
acgcugugcugc

SEQ ID NO: 3171517 - RNA, 14 nt, Human
acgcugugcugccc

SEQ ID NO: 3171518 - RNA, 11 nt, Human
acgcugugcug

SEQ ID NO: 3171519 - RNA, 15 nt, Human
acgccacauccccca

SEQ ID NO: 3171520 - RNA, 12 nt, Human
acgccacauccc

SEQ ID NO: 3171521 - RNA, 14 nt, Human
acgucugacaggca

SEQ ID NO: 3171522 - RNA, 17 nt, Human
acgucuagcuaugcugu

SEQ ID NO: 3171523 - RNA, 19 nt, Human
acgucuagcuaugcuguau

SEQ ID NO: 3171524 - RNA, 23 nt, Human
acgucuagcuaugcuguaucugu

SEQ ID NO: 3171525 - RNA, 18 nt, Human
acgucuauuucaucagaa

SEQ ID NO: 3171526 - RNA, 13 nt, Human
acgucugacaggc

SEQ ID NO: 3171527 - RNA, 18 nt, Human
acuauucaaacagucuca

SEQ ID NO: 3171528 - RNA, 21 nt, Human
acuauucaaacagucucagga

SEQ ID NO: 3171529 - RNA, 16 nt, Human
acuaguauuuguugag

SEQ ID NO: 3171530 - RNA, 14 nt, Human
acucaaaucaagaa

SEQ ID NO: 3171531 - RNA, 13 nt, Human
acucaaaagcugg

SEQ ID NO: 3171532 - RNA, 17 nt, Human
acucagcccucauuggc

SEQ ID NO: 3171533 - RNA, 21 nt, Human
acucagcccucauuggcucuu

SEQ ID NO: 3171534 - RNA, 18 nt, Human
acucaaaucuuaagaaau

SEQ ID NO: 3171535 - RNA, 22 nt, Human
acucaaaucuuaagaaauaaau

SEQ ID NO: 3171536 - RNA, 19 nt, Human
acucaguccauagcagaga

SEQ ID NO: 3171537 - RNA, 18 nt, Human
acuagauuacauucaguu

SEQ ID NO: 3171538 - RNA, 13 nt, Human
acuagauuacauu

SEQ ID NO: 3171539 - RNA, 15 nt, Human
acuagauuugggaga

SEQ ID NO: 3171540 - RNA, 13 nt, Human
acucuauggucuu

SEQ ID NO: 3171541 - RNA, 19 nt, Human
acucugucgcccagucugg

SEQ ID NO: 3171542 - RNA, 17 nt, Human
acucuauguucuaagaa

SEQ ID NO: 3171543 - RNA, 17 nt, Human
acucuaguacugugaau

SEQ ID NO: 3171544 - RNA, 16 nt, Human
acucuaguacugugaa

SEQ ID NO: 3171545 - RNA, 18 nt, Human
acucuaggauguauauuu

SEQ ID NO: 3171546 - RNA, 20 nt, Human
acucuaggauguauauuuua

SEQ ID NO: 3171547 - RNA, 21 nt, Human
acucuaggauguauauuuuau

SEQ ID NO: 3171548 - RNA, 22 nt, Human
acucuaggauguauauuuuaua

SEQ ID NO: 3171549 - RNA, 15 nt, Human
acucuagggaaaaac

SEQ ID NO: 3171550 - RNA, 17 nt, Human
acucuagggaaaaacca

SEQ ID NO: 3171551 - RNA, 22 nt, Human
acucauauccccuauuuaacag

SEQ ID NO: 3171552 - RNA, 13 nt, Human
acugccagcaacg

SEQ ID NO: 3171553 - RNA, 20 nt, Human
acucugucucaguccaugaa

SEQ ID NO: 3171554 - RNA, 18 nt, Human
acucugucucaguccaug

SEQ ID NO: 3171555 - RNA, 17 nt, Human
acucugucucaguccau

SEQ ID NO: 3171556 - RNA, 21 nt, Human
acucugucgagccugggggcu

SEQ ID NO: 3171557 - RNA, 13 nt, Human
acugguccaucug

SEQ ID NO: 3171558 - RNA, 14 nt, Human
acuggagaaaaugg

SEQ ID NO: 3171559 - RNA, 15 nt, Human
acuggagaaaaugga

SEQ ID NO: 3171560 - RNA, 17 nt, Human
acuggaagcacagcuuc

SEQ ID NO: 3171561 - RNA, 16 nt, Human
acugcccccucugccc

SEQ ID NO: 3171562 - RNA, 17 nt, Human
acugcccccucugcccu

SEQ ID NO: 3171563 - RNA, 19 nt, Human
acuggaagcacagcuucau

SEQ ID NO: 3171564 - RNA, 16 nt, Human
acuggaagcacagcuu

SEQ ID NO: 3171565 - RNA, 14 nt, Human
acugcccccucugc

SEQ ID NO: 3171566 - RNA, 15 nt, Human
acugcccccucugcc

SEQ ID NO: 3171567 - RNA, 16 nt, Human
acugccagcucuuccu

SEQ ID NO: 3171568 - RNA, 12 nt, Human
acugccagcucu

SEQ ID NO: 3171569 - RNA, 17 nt, Human
acugccagcucuuccua

SEQ ID NO: 3171570 - RNA, 14 nt, Human
acugugacaucucu

SEQ ID NO: 3171571 - RNA, 16 nt, Human
acugugaccaaguaua

SEQ ID NO: 3171572 - RNA, 22 nt, Human
acugugaccaaguauaaacuuu

SEQ ID NO: 3171573 - RNA, 22 nt, Human
acugugcgcauaggccugcuuu

SEQ ID NO: 3171574 - RNA, 16 nt, Human
acugugaagagaacca

SEQ ID NO: 3171575 - RNA, 15 nt, Human
acugugaagagcugg

SEQ ID NO: 3171576 - RNA, 12 nt, Human
acugugaagagc

SEQ ID NO: 3171577 - RNA, 21 nt, Human
acugucucaagagggcacugg

SEQ ID NO: 3171578 - RNA, 20 nt, Human
acugucucaagagggcacug

SEQ ID NO: 3171579 - RNA, 23 nt, Human
acugucucaagagggcacuggug

SEQ ID NO: 3171580 - RNA, 19 nt, Human
acugucucaagagggcacu

SEQ ID NO: 3171581 - RNA, 14 nt, Human
acugguuauuuaaa

SEQ ID NO: 3171582 - RNA, 21 nt, Human
acuucugucuucacaacagau

SEQ ID NO: 3171583 - RNA, 19 nt, Human
acuucaaaacaaacagaug

SEQ ID NO: 3171584 - RNA, 16 nt, Human
acuuauuucacuuuag

SEQ ID NO: 3171585 - RNA, 22 nt, Human
acuguuugauauaccaaauuaa

SEQ ID NO: 3171586 - RNA, 23 nt, Human
acuguuugauauaccaaauuaaa

SEQ ID NO: 3171587 - RNA, 21 nt, Human
acuuggucugugagaugcuag

SEQ ID NO: 3171588 - RNA, 22 nt, Human
acuuggugcuuauugauauucu

SEQ ID NO: 3171589 - RNA, 16 nt, Human
acuugguuuuuaaaaa

SEQ ID NO: 3171590 - RNA, 22 nt, Human
acuucugucuucacaacagauu

SEQ ID NO: 3171591 - RNA, 18 nt, Human
acuucuuauacauuugau

SEQ ID NO: 3171592 - RNA, 11 nt, Human
acuucuucugu

SEQ ID NO: 3171593 - RNA, 13 nt, Human
acuucuucuguaa

SEQ ID NO: 3171594 - RNA, 14 nt, Human
acuucuucuguaau

SEQ ID NO: 3171595 - RNA, 16 nt, Human
acuucuucuguaauau

SEQ ID NO: 3171596 - RNA, 21 nt, Human
acuucuucuguaauauuuaca

SEQ ID NO: 3171597 - RNA, 14 nt, Human
acuugggccacugu

SEQ ID NO: 3171598 - RNA, 20 nt, Human
acuucuucuguccaagcaga

SEQ ID NO: 3171599 - RNA, 15 nt, Human
acuugggccacugug

SEQ ID NO: 3171600 - RNA, 20 nt, Human
acugugcugagucugaaggc

SEQ ID NO: 3171601 - RNA, 23 nt, Human
acugugcguggggcucccgccuc

SEQ ID NO: 3171602 - RNA, 17 nt, Human
acugugcguggggcucc

SEQ ID NO: 3171603 - RNA, 23 nt, Human
agaaaaucugaauuggaaugcac

SEQ ID NO: 3171604 - RNA, 23 nt, Human
agaaaguacuucuccacccugcu

SEQ ID NO: 3171605 - RNA, 17 nt, Human
agaaaguaaauaaaagg

SEQ ID NO: 3171606 - RNA, 22 nt, Human
agaaaguaaggugcuuggaguu

SEQ ID NO: 3171607 - RNA, 22 nt, Human
agaaaguacuucuccacccugc

SEQ ID NO: 3171608 - RNA, 19 nt, Human
agaaaggguucuguaaaau

SEQ ID NO: 3171609 - RNA, 20 nt, Human
agaaaguguucuguuacaaa

SEQ ID NO: 3171610 - RNA, 19 nt, Human
agaaaguguucuguuacaa

SEQ ID NO: 3171611 - RNA, 23 nt, Human
agaaaguguucuguuacaaaaug

SEQ ID NO: 3171612 - RNA, 14 nt, Human
agaaauaaauauac

SEQ ID NO: 3171613 - RNA, 21 nt, Human
agaaauaaauccacccauguu

SEQ ID NO: 3171614 - RNA, 14 nt, Human
agaaaguguucugu

SEQ ID NO: 3171615 - RNA, 18 nt, Human
agaaaguguucuguuaca

SEQ ID NO: 3171616 - RNA, 16 nt, Human
agaaaguguucuguua

SEQ ID NO: 3171617 - RNA, 17 nt, Human
agaaauaaauuuauuuc

SEQ ID NO: 3171618 - RNA, 14 nt, Human
agaaauaauaaaaa

SEQ ID NO: 3171619 - RNA, 19 nt, Human
acuuuaucaaugugucuuu

SEQ ID NO: 3171620 - RNA, 18 nt, Human
acuuuauagaagaaugca

SEQ ID NO: 3171621 - RNA, 17 nt, Human
acuuuauagaagaaugc

SEQ ID NO: 3171622 - RNA, 22 nt, Human
acuuuuagaugugguuaauuuu

SEQ ID NO: 3171623 - RNA, 23 nt, Human
acuuuuauuuccagugaaaucag

SEQ ID NO: 3171624 - RNA, 20 nt, Human
acuuuucauaaccuagccuu

SEQ ID NO: 3171625 - RNA, 16 nt, Human
acuuuucuuucagcca

SEQ ID NO: 3171626 - RNA, 16 nt, Human
acuuuucaaguauuua

SEQ ID NO: 3171627 - RNA, 17 nt, Human
acuuuucauaucauuuc

SEQ ID NO: 3171628 - RNA, 18 nt, Human
acuuuucauaucauuucu

SEQ ID NO: 3171629 - RNA, 20 nt, Human
acuuuuccaauaugugauuu

SEQ ID NO: 3171630 - RNA, 17 nt, Human
acuuuuccaauauguga

SEQ ID NO: 3171631 - RNA, 19 nt, Human
acuuuuccaguauuuuagu

SEQ ID NO: 3171632 - RNA, 18 nt, Human
acuuuuccaguauuuuag

SEQ ID NO: 3171633 - RNA, 16 nt, Human
acuuuuccaguauuuu

SEQ ID NO: 3171634 - RNA, 15 nt, Human
acuuuuccaguauuu

SEQ ID NO: 3171635 - RNA, 14 nt, Human
acuuuuccaguauu

SEQ ID NO: 3171636 - RNA, 11 nt, Human
acuuuuccagu

SEQ ID NO: 3171637 - RNA, 21 nt, Human
acuuuuccaauaugugauuuu

SEQ ID NO: 3171638 - RNA, 12 nt, Human
acuuuugcuuua

SEQ ID NO: 3171639 - RNA, 13 nt, Human
acuuuugcuuuaa

SEQ ID NO: 3171640 - RNA, 14 nt, Human
acuuuucuuugugg

SEQ ID NO: 3171641 - RNA, 16 nt, Human
agaaaaucaggcuggc

SEQ ID NO: 3171642 - RNA, 18 nt, Human
agaaaauacuuaaauguu

SEQ ID NO: 3171643 - RNA, 17 nt, Human
agaaaauacuuaaaugu

SEQ ID NO: 3171644 - RNA, 19 nt, Human
agaaaauacuuaaauguua

SEQ ID NO: 3171645 - RNA, 19 nt, Human
agaaaauagagaugagcuu

SEQ ID NO: 3171646 - RNA, 12 nt, Human
acuuuuagaugu

SEQ ID NO: 3171647 - RNA, 19 nt, Human
acuuuguucuggcucuucc

SEQ ID NO: 3171648 - RNA, 18 nt, Human
acuuuuaaggauaaauca

SEQ ID NO: 3171649 - RNA, 19 nt, Human
acuuuuaaggauaaaucau

SEQ ID NO: 3171650 - RNA, 20 nt, Human
acuuuuaaggauaaaucaua

SEQ ID NO: 3171651 - RNA, 13 nt, Human
acuuuaucaugaa

SEQ ID NO: 3171652 - RNA, 16 nt, Human
acuuuaucaugaaugc

SEQ ID NO: 3171653 - RNA, 18 nt, Human
acuuuaucaugaaugcuu

SEQ ID NO: 3171654 - RNA, 17 nt, Human
acuuuauugccaaaacc

SEQ ID NO: 3171655 - RNA, 13 nt, Human
acuuuauugcauc

SEQ ID NO: 3171656 - RNA, 16 nt, Human
acuuuauuagcagcug

SEQ ID NO: 3171657 - RNA, 16 nt, Human
acuuuguucuggcucu

SEQ ID NO: 3171658 - RNA, 17 nt, Human
acuuuguucuggcucuu

SEQ ID NO: 3171659 - RNA, 20 nt, Human
accccucaacaccucugcac

SEQ ID NO: 3171660 - RNA, 19 nt, Human
accccuccaugugggcuag

SEQ ID NO: 3171661 - RNA, 16 nt, Human
accccuccaugugggc

SEQ ID NO: 3171662 - RNA, 17 nt, Human
accccucauagcccuca

SEQ ID NO: 3171663 - RNA, 21 nt, Human
accccucccggcccugccugc

SEQ ID NO: 3171664 - RNA, 20 nt, Human
accccucccggcccugccug

SEQ ID NO: 3171665 - RNA, 19 nt, Human
accccucccggcccugccu

SEQ ID NO: 3171666 - RNA, 18 nt, Human
accccucccggcccugcc

SEQ ID NO: 3171667 - RNA, 19 nt, Human
acccaguggcagggcacag

SEQ ID NO: 3171668 - RNA, 18 nt, Human
acccaguggcagggcaca

SEQ ID NO: 3171669 - RNA, 17 nt, Human
acccaguggcagggcac

SEQ ID NO: 3171670 - RNA, 16 nt, Human
acccaguggcagggca

SEQ ID NO: 3171671 - RNA, 15 nt, Human
acccaguggcagggc

SEQ ID NO: 3171672 - RNA, 14 nt, Human
acccaguggcaggg

SEQ ID NO: 3171673 - RNA, 13 nt, Human
acccaguggcagg

SEQ ID NO: 3171674 - RNA, 11 nt, Human
acccaguggca

SEQ ID NO: 3171675 - RNA, 22 nt, Human
acccaguggcagggcacagggc

SEQ ID NO: 3171676 - RNA, 20 nt, Human
acccaguggcagggcacagg

SEQ ID NO: 3171677 - RNA, 24 nt, Human
acccaguggcagggcacagggccu

SEQ ID NO: 3171678 - RNA, 17 nt, Human
acccaugggcaggagac

SEQ ID NO: 3171679 - RNA, 16 nt, Human
acccaugggcaggaga

SEQ ID NO: 3171680 - RNA, 14 nt, Human
acccaugggcagga

SEQ ID NO: 3171681 - RNA, 16 nt, Human
acccaccucagccucc

SEQ ID NO: 3171682 - RNA, 11 nt, Human
acccccugaau

SEQ ID NO: 3171683 - RNA, 14 nt, Human
acccccugcaaagc

SEQ ID NO: 3171684 - RNA, 17 nt, Human
acccccugcaaagccca

SEQ ID NO: 3171685 - RNA, 22 nt, Human
acccccugcaaagcccagcuug

SEQ ID NO: 3171686 - RNA, 18 nt, Human
acccccugcaaagcccag

SEQ ID NO: 3171687 - RNA, 20 nt, Human
acccccugcaaagcccagcu

SEQ ID NO: 3171688 - RNA, 18 nt, Human
acccaugggcaggagacu

SEQ ID NO: 3171689 - RNA, 15 nt, Human
acccacaagaaauga

SEQ ID NO: 3171690 - RNA, 17 nt, Human
acccacaagaaaugaaa

SEQ ID NO: 3171691 - RNA, 21 nt, Human
acccacaagaaaugaaagcag

SEQ ID NO: 3171692 - RNA, 15 nt, Human
acccaccucagccuc

SEQ ID NO: 3171693 - RNA, 14 nt, Human
acccaccucagccu

SEQ ID NO: 3171694 - RNA, 13 nt, Human
acccaccucagcc

SEQ ID NO: 3171695 - RNA, 19 nt, Human
acccaagggccuggccuga

SEQ ID NO: 3171696 - RNA, 22 nt, Human
acccaagggccuggccugagcu

SEQ ID NO: 3171697 - RNA, 18 nt, Human
acccaagggccuggccug

SEQ ID NO: 3171698 - RNA, 13 nt, Human
accagaugagaau

SEQ ID NO: 3171699 - RNA, 16 nt, Human
accagaugagaauuag

SEQ ID NO: 3171700 - RNA, 18 nt, Human
accagaugagaauuaggc

SEQ ID NO: 3171701 - RNA, 19 nt, Human
accagagcugccaccugcc

SEQ ID NO: 3171702 - RNA, 13 nt, Human
accaccuaccccu

SEQ ID NO: 3171703 - RNA, 14 nt, Human
accagaugugacag

SEQ ID NO: 3171704 - RNA, 13 nt, Human
accagcacacucc

SEQ ID NO: 3171705 - RNA, 18 nt, Human
accagcacacucccgaga

SEQ ID NO: 3171706 - RNA, 17 nt, Human
accagcacacucccgag

SEQ ID NO: 3171707 - RNA, 16 nt, Human
accagcacacucccga

SEQ ID NO: 3171708 - RNA, 15 nt, Human
accagcacacucccg

SEQ ID NO: 3171709 - RNA, 14 nt, Human
accagcacacuccc

SEQ ID NO: 3171710 - RNA, 11 nt, Human
accagcccacg

SEQ ID NO: 3171711 - RNA, 21 nt, Human
accagcccacgcugacuacag

SEQ ID NO: 3171712 - RNA, 17 nt, Human
accagcccacgcugacu

SEQ ID NO: 3171713 - RNA, 19 nt, Human
accagccagggaaagacug

SEQ ID NO: 3171714 - RNA, 19 nt, Human
accagccccaauccaaaac

SEQ ID NO: 3171715 - RNA, 22 nt, Human
accagcccacgcugacuacagg

SEQ ID NO: 3171716 - RNA, 23 nt, Human
acauuugucauuuucauuagcaa

SEQ ID NO: 3171717 - RNA, 22 nt, Human
acauuugucauuuucauuagca

SEQ ID NO: 3171718 - RNA, 19 nt, Human
acauuugucauuuucauua

SEQ ID NO: 3171719 - RNA, 18 nt, Human
acauuugucauuuucauu

SEQ ID NO: 3171720 - RNA, 17 nt, Human
acauuugucauuuucau

SEQ ID NO: 3171721 - RNA, 23 nt, Human
acauuuguuugguuauagugcaa

SEQ ID NO: 3171722 - RNA, 22 nt, Human
acauuucacugucugucugguc

SEQ ID NO: 3171723 - RNA, 23 nt, Human
acauuucauaauuuguuuccagc

SEQ ID NO: 3171724 - RNA, 11 nt, Human
acauuugucau

SEQ ID NO: 3171725 - RNA, 16 nt, Human
acauuugucauuuuca

SEQ ID NO: 3171726 - RNA, 14 nt, Human
acauuugucauuuu

SEQ ID NO: 3171727 - RNA, 16 nt, Human
acauuucacauuauuc

SEQ ID NO: 3171728 - RNA, 16 nt, Human
acauuucacugucugu

SEQ ID NO: 3171729 - RNA, 15 nt, Human
acauuucacugucug

SEQ ID NO: 3171730 - RNA, 15 nt, Human
acauuuauucugcuc

SEQ ID NO: 3171731 - RNA, 20 nt, Human
accaaggcugauuaaaccaa

SEQ ID NO: 3171732 - RNA, 20 nt, Human
accaagguagaaugaccuug

SEQ ID NO: 3171733 - RNA, 18 nt, Human
accaagugugcuaaaaau

SEQ ID NO: 3171734 - RNA, 23 nt, Human
accaagguagaaugaccuuguaa

SEQ ID NO: 3171735 - RNA, 17 nt, Human
accaauaaaauaauuuu

SEQ ID NO: 3171736 - RNA, 14 nt, Human
acauuuauucugcu

SEQ ID NO: 3171737 - RNA, 12 nt, Human
acauguuucaga

SEQ ID NO: 3171738 - RNA, 14 nt, Human
acauguuuauguaa

SEQ ID NO: 3171739 - RNA, 23 nt, Human
acauguuuauguaaacaaaucuu

SEQ ID NO: 3171740 - RNA, 21 nt, Human
acauguuuauguaaacaaauc

SEQ ID NO: 3171741 - RNA, 18 nt, Human
acaugugcacaugcacgu

SEQ ID NO: 3171742 - RNA, 16 nt, Human
acaugugcacaugcac

SEQ ID NO: 3171743 - RNA, 19 nt, Human
acaugaucuucuuuauaau

SEQ ID NO: 3171744 - RNA, 22 nt, Human
acaugauuucacaaauauuaaa

SEQ ID NO: 3171745 - RNA, 21 nt, Human
acaugauuucacaaauauuaa

SEQ ID NO: 3171746 - RNA, 20 nt, Human
acaugauuucacaaauauua

SEQ ID NO: 3171747 - RNA, 19 nt, Human
acaugauuucacaaauauu

SEQ ID NO: 3171748 - RNA, 18 nt, Human
acaugauuucacaaauau

SEQ ID NO: 3171749 - RNA, 17 nt, Human
acaugauuucacaaaua

SEQ ID NO: 3171750 - RNA, 16 nt, Human
acaugaugauuucaga

SEQ ID NO: 3171751 - RNA, 15 nt, Human
acaugauuucacaaa

SEQ ID NO: 3171752 - RNA, 14 nt, Human
acaugauuucacaa

SEQ ID NO: 3171753 - RNA, 13 nt, Human
acaugauuucaca

SEQ ID NO: 3171754 - RNA, 12 nt, Human
acaugauuucac

SEQ ID NO: 3171755 - RNA, 23 nt, Human
acagggucucuagugcugugaaa

SEQ ID NO: 3171756 - RNA, 23 nt, Human
acaggcaaugcuggcuguuggcu

SEQ ID NO: 3171757 - RNA, 19 nt, Human
acaggcaaugcuggcuguu

SEQ ID NO: 3171758 - RNA, 19 nt, Human
acaggguuuugccauguug

SEQ ID NO: 3171759 - RNA, 21 nt, Human
acacugccaacugaucuguua

SEQ ID NO: 3171760 - RNA, 21 nt, Human
acacuggcaaugguaguuucu

SEQ ID NO: 3171761 - RNA, 20 nt, Human
acacuggcaaugguaguuuc

SEQ ID NO: 3171762 - RNA, 18 nt, Human
acagcaguugaaaagacu

SEQ ID NO: 3171763 - RNA, 16 nt, Human
acagcaguuucaggua

SEQ ID NO: 3171764 - RNA, 23 nt, Human
acagcaguugaaaagacuccaaa

SEQ ID NO: 3171765 - RNA, 22 nt, Human
acagcaguugaaaagacuccaa

SEQ ID NO: 3171766 - RNA, 21 nt, Human
acagcaguugaaaagacucca

SEQ ID NO: 3171767 - RNA, 19 nt, Human
acagagugagacucugucu

SEQ ID NO: 3171768 - RNA, 15 nt, Human
acagagugagacucu

SEQ ID NO: 3171769 - RNA, 23 nt, Human
acagagucucacuguugcccagg

SEQ ID NO: 3171770 - RNA, 13 nt, Human
acagaauuugaau

SEQ ID NO: 3171771 - RNA, 23 nt, Human
acagaauuugaauuaucagcaaa

SEQ ID NO: 3171772 - RNA, 11 nt, Human
acagacacagg

SEQ ID NO: 3171773 - RNA, 15 nt, Human
acacuguacugcaau

SEQ ID NO: 3171774 - RNA, 18 nt, Human
acagaaucuuguuuugaa

SEQ ID NO: 3171775 - RNA, 19 nt, Human
acagaaucuuguuuugaaa

SEQ ID NO: 3171776 - RNA, 15 nt, Human
acagaggcagcccca

SEQ ID NO: 3171777 - RNA, 14 nt, Human
acagaggcagcccc

SEQ ID NO: 3171778 - RNA, 14 nt, Human
acagacacaggccc

SEQ ID NO: 3171779 - RNA, 13 nt, Human
acagacacaggcc

SEQ ID NO: 3171780 - RNA, 23 nt, Human
acagaggccaugggccuccugug

SEQ ID NO: 3171781 - RNA, 19 nt, Human
acagaggcagccccauucu

SEQ ID NO: 3171782 - RNA, 14 nt, Human
acaggauuauugga

SEQ ID NO: 3171783 - RNA, 23 nt, Human
acaggcaaauccgaaaucagcag

SEQ ID NO: 3171784 - RNA, 15 nt, Human
acaggcaaacauuuu

SEQ ID NO: 3171785 - RNA, 14 nt, Human
acaggcaaacauuu

SEQ ID NO: 3171786 - RNA, 12 nt, Human
acaggcaagcac

SEQ ID NO: 3171787 - RNA, 18 nt, Human
acaggcaaugcuggcugu

SEQ ID NO: 3171788 - RNA, 15 nt, Human
acaggaucagucuga

SEQ ID NO: 3171789 - RNA, 17 nt, Human
acagcucuucuccaggc

SEQ ID NO: 3171790 - RNA, 16 nt, Human
acagcucuucuccagg

SEQ ID NO: 3171791 - RNA, 17 nt, Human
acagcucuguccuggga

SEQ ID NO: 3171792 - RNA, 15 nt, Human
acagccacggccagg

SEQ ID NO: 3171793 - RNA, 17 nt, Human
acagccacggccaggcc

SEQ ID NO: 3171794 - RNA, 16 nt, Human
acagccacggccaggc

SEQ ID NO: 3171795 - RNA, 18 nt, Human
acagccacggccaggcca

SEQ ID NO: 3171796 - RNA, 19 nt, Human
acacgagcaggcuacuguc

SEQ ID NO: 3171797 - RNA, 14 nt, Human
acacgagcaggcua

SEQ ID NO: 3171798 - RNA, 19 nt, Human
acaccaaaaaaauccagaa

SEQ ID NO: 3171799 - RNA, 15 nt, Human
acaccaaaaaauauc

SEQ ID NO: 3171800 - RNA, 14 nt, Human
acaccaaaaaauau

SEQ ID NO: 3171801 - RNA, 21 nt, Human
acacgagcaggcuacugucag

SEQ ID NO: 3171802 - RNA, 17 nt, Human
acacgcgugcacacacc

SEQ ID NO: 3171803 - RNA, 15 nt, Human
acacgcgugcacaca

SEQ ID NO: 3171804 - RNA, 14 nt, Human
acacgcuccuuccu

SEQ ID NO: 3171805 - RNA, 11 nt, Human
acacagcucuu

SEQ ID NO: 3171806 - RNA, 19 nt, Human
acacagaggcugccucucc

SEQ ID NO: 3171807 - RNA, 14 nt, Human
acacagcucugucc

SEQ ID NO: 3171808 - RNA, 17 nt, Human
acacagauuugagcuca

SEQ ID NO: 3171809 - RNA, 20 nt, Human
acacagcucuguccugggag

SEQ ID NO: 3171810 - RNA, 21 nt, Human
acaauucucccgggacucugc

SEQ ID NO: 3171811 - RNA, 10 nt, Human
acaagaaaau

SEQ ID NO: 3171812 - RNA, 20 nt, Human
acaacuuuuuuuucuuuuuu

SEQ ID NO: 3171813 - RNA, 18 nt, Human
acaacuuuuuuuucuuuu

SEQ ID NO: 3171814 - RNA, 15 nt, Human
acaacuuuuuuuucu

SEQ ID NO: 3171815 - RNA, 10 nt, Human
acaacuaagu

SEQ ID NO: 3171816 - RNA, 22 nt, Human
acaacuaagugauuuguauguc

SEQ ID NO: 3171817 - RNA, 12 nt, Human
acaaggcaaggc

SEQ ID NO: 3171818 - RNA, 14 nt, Human
acaaggcaaggcug

SEQ ID NO: 3171819 - RNA, 17 nt, Human
acaaggauugcuacugu

SEQ ID NO: 3171820 - RNA, 20 nt, Human
acaaaauguaggguuauaau

SEQ ID NO: 3171821 - RNA, 22 nt, Human
acaaaauguaggguuauaauaa

SEQ ID NO: 3171822 - RNA, 11 nt, Human
acaaacaaaag

SEQ ID NO: 3171823 - RNA, 16 nt, Human
acaaaauucuuucugg

SEQ ID NO: 3171824 - RNA, 14 nt, Human
acaaaauuauuugu

SEQ ID NO: 3171825 - RNA, 16 nt, Human
acaaaauuauuuguaa

SEQ ID NO: 3171826 - RNA, 13 nt, Human
acaaaauucaaag

SEQ ID NO: 3171827 - RNA, 18 nt, Human
acaaaauucaaagcaugg

SEQ ID NO: 3171828 - RNA, 18 nt, Human
acaaccuucuguggcuca

SEQ ID NO: 3171829 - RNA, 16 nt, Human
acaacgagccuuuuca

SEQ ID NO: 3171830 - RNA, 23 nt, Human
acaaccuuggcuuggcccuggca

SEQ ID NO: 3171831 - RNA, 14 nt, Human
acaaacaaaagcau

SEQ ID NO: 3171832 - RNA, 13 nt, Human
acaaacaaaagca

SEQ ID NO: 3171833 - RNA, 20 nt, Human
acaaggcaaggcugucaauu

SEQ ID NO: 3171834 - RNA, 17 nt, Human
acaaggcaaaaacaaag

SEQ ID NO: 3171835 - RNA, 15 nt, Human
acaaggcaaaaacaa

SEQ ID NO: 3171836 - RNA, 23 nt, Human
acaagggaaaauaaaaaaagaaa

SEQ ID NO: 3171837 - RNA, 22 nt, Human
acaaggcuugcugcagauacua

SEQ ID NO: 3171838 - RNA, 17 nt, Human
acaaggcuugcugcaga

SEQ ID NO: 3171839 - RNA, 22 nt, Human
aauuuuguguaagaaauacaga

SEQ ID NO: 3171840 - RNA, 18 nt, Human
aauuuuguguaagaaaua

SEQ ID NO: 3171841 - RNA, 16 nt, Human
aauuuugugcccccau

SEQ ID NO: 3171842 - RNA, 17 nt, Human
aauuuuguguaagaaau

SEQ ID NO: 3171843 - RNA, 15 nt, Human
aauuuuguguaagaa

SEQ ID NO: 3171844 - RNA, 23 nt, Human
aauuuugugaaacagacuuguau

SEQ ID NO: 3171845 - RNA, 14 nt, Human
aauuuuguguaaga

SEQ ID NO: 3171846 - RNA, 18 nt, Human
aauuuuguaauguaucaa

SEQ ID NO: 3171847 - RNA, 22 nt, Human
aauuuugucugccccaaguuuu

SEQ ID NO: 3171848 - RNA, 21 nt, Human
aauuuugucugccccaaguuu

SEQ ID NO: 3171849 - RNA, 23 nt, Human
aauuuuccuuuaauaugaaauuu

SEQ ID NO: 3171850 - RNA, 15 nt, Human
aauuuucuaaaagcu

SEQ ID NO: 3171851 - RNA, 16 nt, Human
aauuuucuaaaagcuu

SEQ ID NO: 3171852 - RNA, 21 nt, Human
aauuuucuaaaagcuuucaug

SEQ ID NO: 3171853 - RNA, 20 nt, Human
aauuuuccuuuaauaugaaa

SEQ ID NO: 3171854 - RNA, 11 nt, Human
aauuuuccuuu

SEQ ID NO: 3171855 - RNA, 20 nt, Human
aauuuuccuucagauauuuu

SEQ ID NO: 3171856 - RNA, 13 nt, Human
agccgcuggggcc

SEQ ID NO: 3171857 - RNA, 13 nt, Human
agccgcuccagag

SEQ ID NO: 3171858 - RNA, 22 nt, Human
agccgcggugcccaaccacacu

SEQ ID NO: 3171859 - RNA, 16 nt, Human
agccgccuucacagca

SEQ ID NO: 3171860 - RNA, 17 nt, Human
agccgccuucacagcag

SEQ ID NO: 3171861 - RNA, 21 nt, Human
agccgccaugcuccuggccca

SEQ ID NO: 3171862 - RNA, 19 nt, Human
agccucccgaguagcuggg

SEQ ID NO: 3171863 - RNA, 18 nt, Human
agccucccgaguagcugg

SEQ ID NO: 3171864 - RNA, 20 nt, Human
agccucccgaguagcuggga

SEQ ID NO: 3171865 - RNA, 14 nt, Human
agccuccuccagcc

SEQ ID NO: 3171866 - RNA, 22 nt, Human
agccuccgcuucccugguucaa

SEQ ID NO: 3171867 - RNA, 20 nt, Human
agccuccgcuucccugguuc

SEQ ID NO: 3171868 - RNA, 18 nt, Human
agccuccgcuucccuggu

SEQ ID NO: 3171869 - RNA, 17 nt, Human
agccuccgcuucccugg

SEQ ID NO: 3171870 - RNA, 16 nt, Human
agccuccgcuucccug

SEQ ID NO: 3171871 - RNA, 20 nt, Human
agccucccaaagugcuggga

SEQ ID NO: 3171872 - RNA, 17 nt, Human
agccgugccuucagcuc

SEQ ID NO: 3171873 - RNA, 21 nt, Human
agccucccaaagugcugggau

SEQ ID NO: 3171874 - RNA, 22 nt, Human
agccucccacgacugcccggca

SEQ ID NO: 3171875 - RNA, 18 nt, Human
agccucccacagugcugg

SEQ ID NO: 3171876 - RNA, 14 nt, Human
agccucccacagug

SEQ ID NO: 3171877 - RNA, 16 nt, Human
agccgugccuucagcu

SEQ ID NO: 3171878 - RNA, 15 nt, Human
agccgugccuucagc

SEQ ID NO: 3171879 - RNA, 18 nt, Human
agccagcaggcucucagg

SEQ ID NO: 3171880 - RNA, 19 nt, Human
agccagcaggcucucaggc

SEQ ID NO: 3171881 - RNA, 17 nt, Human
agccagcaggcucucag

SEQ ID NO: 3171882 - RNA, 20 nt, Human
agccagcaggcucucaggcc

SEQ ID NO: 3171883 - RNA, 15 nt, Human
agccccagugcccac

SEQ ID NO: 3171884 - RNA, 14 nt, Human
agccccagugccca

SEQ ID NO: 3171885 - RNA, 15 nt, Human
agccccauuaacugc

SEQ ID NO: 3171886 - RNA, 14 nt, Human
agccccauuaacug

SEQ ID NO: 3171887 - RNA, 13 nt, Human
agccccagugccc

SEQ ID NO: 3171888 - RNA, 21 nt, Human
agcccgggcucugccucccau

SEQ ID NO: 3171889 - RNA, 16 nt, Human
agccccauucugccug

SEQ ID NO: 3171890 - RNA, 13 nt, Human
agccccauucugc

SEQ ID NO: 3171891 - RNA, 16 nt, Human
agcccuauuucuugau

SEQ ID NO: 3171892 - RNA, 17 nt, Human
agcccucacccuggggc

SEQ ID NO: 3171893 - RNA, 18 nt, Human
agcacugaaccugggaaa

SEQ ID NO: 3171894 - RNA, 16 nt, Human
agcacugaaccuggga

SEQ ID NO: 3171895 - RNA, 20 nt, Human
agcacugaaaguauguuuua

SEQ ID NO: 3171896 - RNA, 18 nt, Human
agcacagacccugcccug

SEQ ID NO: 3171897 - RNA, 19 nt, Human
agcacagacccugcccugu

SEQ ID NO: 3171898 - RNA, 20 nt, Human
agcacagacccugcccugug

SEQ ID NO: 3171899 - RNA, 17 nt, Human
agcacagacccugcccu

SEQ ID NO: 3171900 - RNA, 23 nt, Human
agcacacuugacaucaacugcau

SEQ ID NO: 3171901 - RNA, 22 nt, Human
agcacaccaaucuuacuuugua

SEQ ID NO: 3171902 - RNA, 19 nt, Human
agcacaccaaucuuacuuu

SEQ ID NO: 3171903 - RNA, 21 nt, Human
agcacaccaaucuuacuuugu

SEQ ID NO: 3171904 - RNA, 22 nt, Human
agcagcuccuuccuagccuugc

SEQ ID NO: 3171905 - RNA, 21 nt, Human
agcagcuccuuccuagccuug

SEQ ID NO: 3171906 - RNA, 18 nt, Human
agcagugcaugcuguccc

SEQ ID NO: 3171907 - RNA, 13 nt, Human
agcagugcccagg

SEQ ID NO: 3171908 - RNA, 12 nt, Human
agcagugcccag

SEQ ID NO: 3171909 - RNA, 14 nt, Human
agcagugggccugg

SEQ ID NO: 3171910 - RNA, 23 nt, Human
agcagugcccagguggcugugga

SEQ ID NO: 3171911 - RNA, 20 nt, Human
agcagugcccagguggcugu

SEQ ID NO: 3171912 - RNA, 16 nt, Human
agcagugcccaggugg

SEQ ID NO: 3171913 - RNA, 14 nt, Human
agcagugcccaggu

SEQ ID NO: 3171914 - RNA, 19 nt, Human
agcagugcaugcugucccu

SEQ ID NO: 3171915 - RNA, 20 nt, Human
agcagugcaugcugucccuu

SEQ ID NO: 3171916 - RNA, 19 nt, Human
agcagcugacuuucaaagu

SEQ ID NO: 3171917 - RNA, 18 nt, Human
agcagugggccuggccag

SEQ ID NO: 3171918 - RNA, 22 nt, Human
agcagugggucaugaugcucuu

SEQ ID NO: 3171919 - RNA, 21 nt, Human
agcaguuaugugaccucacgu

SEQ ID NO: 3171920 - RNA, 16 nt, Human
agcaguugaaaagacu

SEQ ID NO: 3171921 - RNA, 21 nt, Human
agcaguucuuaacccaguguc

SEQ ID NO: 3171922 - RNA, 13 nt, Human
agcaguugaaaag

SEQ ID NO: 3171923 - RNA, 22 nt, Human
agcaugaagauaaacacagcug

SEQ ID NO: 3171924 - RNA, 19 nt, Human
agcaucgcacucuggcagc

SEQ ID NO: 3171925 - RNA, 14 nt, Human
agcaucgcacucug

SEQ ID NO: 3171926 - RNA, 21 nt, Human
agcaugacagaaaauauguau

SEQ ID NO: 3171927 - RNA, 18 nt, Human
agcaugacagaaaauaug

SEQ ID NO: 3171928 - RNA, 23 nt, Human
agcaugacagaaaauauguauua

SEQ ID NO: 3171929 - RNA, 14 nt, Human
agcaugacagaaaa

SEQ ID NO: 3171930 - RNA, 23 nt, Human
agcauccuggcacccggccccug

SEQ ID NO: 3171931 - RNA, 22 nt, Human
agcauccuggcacccggccccu

SEQ ID NO: 3171932 - RNA, 18 nt, Human
agcauccuggcacccggc

SEQ ID NO: 3171933 - RNA, 23 nt, Human
agccaagugugguagagugugcc

SEQ ID NO: 3171934 - RNA, 20 nt, Human
agcaugccuggauggggcug

SEQ ID NO: 3171935 - RNA, 23 nt, Human
agcaugccuggauggggcugcac

SEQ ID NO: 3171936 - RNA, 15 nt, Human
agcaugccuucaaau

SEQ ID NO: 3171937 - RNA, 14 nt, Human
agcauggacauuua

SEQ ID NO: 3171938 - RNA, 17 nt, Human
agcauggacauuuagaa

SEQ ID NO: 3171939 - RNA, 18 nt, Human
agcauggacauuuagaag

SEQ ID NO: 3171940 - RNA, 20 nt, Human
agcauggacauuuagaagaa

SEQ ID NO: 3171941 - RNA, 23 nt, Human
agccaaagcuaggccuggccaga

SEQ ID NO: 3171942 - RNA, 17 nt, Human
agagggaugcauggaga

SEQ ID NO: 3171943 - RNA, 12 nt, Human
agagggcacaga

SEQ ID NO: 3171944 - RNA, 22 nt, Human
agagggccauugaacucugaga

SEQ ID NO: 3171945 - RNA, 22 nt, Human
agaggguggugaccucugccug

SEQ ID NO: 3171946 - RNA, 20 nt, Human
agaggguggugaccucugcc

SEQ ID NO: 3171947 - RNA, 19 nt, Human
agaggguggugaccucugc

SEQ ID NO: 3171948 - RNA, 14 nt, Human
agagugugccugaa

SEQ ID NO: 3171949 - RNA, 13 nt, Human
agaguuacuugau

SEQ ID NO: 3171950 - RNA, 19 nt, Human
agaguggggauaugauuua

SEQ ID NO: 3171951 - RNA, 23 nt, Human
agaguggcuccucccggugccca

SEQ ID NO: 3171952 - RNA, 11 nt, Human
agagugggagc

SEQ ID NO: 3171953 - RNA, 19 nt, Human
agaguggcuccucccggug

SEQ ID NO: 3171954 - RNA, 15 nt, Human
agaguggcuccuccc

SEQ ID NO: 3171955 - RNA, 20 nt, Human
agaggacaguauuugugggg

SEQ ID NO: 3171956 - RNA, 12 nt, Human
agaggaccagca

SEQ ID NO: 3171957 - RNA, 15 nt, Human
agaggagagaggacc

SEQ ID NO: 3171958 - RNA, 16 nt, Human
agaggagagaggaccc

SEQ ID NO: 3171959 - RNA, 23 nt, Human
agaggacuuuucuuuguggcuuc

SEQ ID NO: 3171960 - RNA, 20 nt, Human
agaggagaacuugcugccuc

SEQ ID NO: 3171961 - RNA, 19 nt, Human
agaggagaacuugcugccu

SEQ ID NO: 3171962 - RNA, 21 nt, Human
agaggaaaucaccgaaaacgu

SEQ ID NO: 3171963 - RNA, 20 nt, Human
agaggaaccucugauuuauu

SEQ ID NO: 3171964 - RNA, 16 nt, Human
agaggaaggagaggag

SEQ ID NO: 3171965 - RNA, 15 nt, Human
agagcccaggccucc

SEQ ID NO: 3171966 - RNA, 13 nt, Human
agagcccaggccu

SEQ ID NO: 3171967 - RNA, 14 nt, Human
agagcccaggccuc

SEQ ID NO: 3171968 - RNA, 14 nt, Human
agauggcugugccu

SEQ ID NO: 3171969 - RNA, 14 nt, Human
agaucuucuguggg

SEQ ID NO: 3171970 - RNA, 19 nt, Human
agauauaugcucugcaugu

SEQ ID NO: 3171971 - RNA, 17 nt, Human
agauauccacuuaccug

SEQ ID NO: 3171972 - RNA, 18 nt, Human
agaguucagggaagauaa

SEQ ID NO: 3171973 - RNA, 16 nt, Human
agaguucagggaagau

SEQ ID NO: 3171974 - RNA, 17 nt, Human
agaguuacuugauaagg

SEQ ID NO: 3171975 - RNA, 14 nt, Human
agaguuacuugaua

SEQ ID NO: 3171976 - RNA, 22 nt, Human
agacugccagcucuuccuagcu

SEQ ID NO: 3171977 - RNA, 18 nt, Human
agacugccagcucuuccu

SEQ ID NO: 3171978 - RNA, 14 nt, Human
agacugccagcucu

SEQ ID NO: 3171979 - RNA, 13 nt, Human
agacugccagcuc

SEQ ID NO: 3171980 - RNA, 12 nt, Human
agacugccagcu

SEQ ID NO: 3171981 - RNA, 11 nt, Human
agacugccagc

SEQ ID NO: 3171982 - RNA, 22 nt, Human
agacugccacaaggaagaaauu

SEQ ID NO: 3171983 - RNA, 15 nt, Human
agacugccacaagga

SEQ ID NO: 3171984 - RNA, 17 nt, Human
agacugcuccugagccc

SEQ ID NO: 3171985 - RNA, 16 nt, Human
agacugcuccugagcc

SEQ ID NO: 3171986 - RNA, 23 nt, Human
agacugcuccugagcccccagcu

SEQ ID NO: 3171987 - RNA, 21 nt, Human
agacugcuccugagcccccag

SEQ ID NO: 3171988 - RNA, 20 nt, Human
agacugcuccugagccccca

SEQ ID NO: 3171989 - RNA, 19 nt, Human
agacugcuccugagccccc

SEQ ID NO: 3171990 - RNA, 16 nt, Human
agacuggaagcacagc

SEQ ID NO: 3171991 - RNA, 17 nt, Human
agacuggaagcacagcu

SEQ ID NO: 3171992 - RNA, 19 nt, Human
agacuggaagcacagcuuc

SEQ ID NO: 3171993 - RNA, 21 nt, Human
agagaaaagaaaaaaaaagaa

SEQ ID NO: 3171994 - RNA, 15 nt, Human
agagaaaagaaaaaa

SEQ ID NO: 3171995 - RNA, 14 nt, Human
agagaaaagaaaaa

SEQ ID NO: 3171996 - RNA, 13 nt, Human
agagaaaagaaaa

SEQ ID NO: 3171997 - RNA, 12 nt, Human
agagaaaagaaa

SEQ ID NO: 3171998 - RNA, 11 nt, Human
agagaaaagaa

SEQ ID NO: 3171999 - RNA, 10 nt, Human
agagaaaaga

SEQ ID NO: 3172000 - RNA, 23 nt, Human
agagagcaagacgcugugcugcc

SEQ ID NO: 3172001 - RNA, 22 nt, Human
agagagcgcagccgccuucaca

SEQ ID NO: 3172002 - RNA, 20 nt, Human
agagagcgcagccgccuuca

SEQ ID NO: 3172003 - RNA, 13 nt, Human
agagagcgcagcc

SEQ ID NO: 3172004 - RNA, 21 nt, Human
agagaggguggugaccucugc

SEQ ID NO: 3172005 - RNA, 20 nt, Human
agagaggguggugaccucug

SEQ ID NO: 3172006 - RNA, 22 nt, Human
agagaggguggugaccucugcc

SEQ ID NO: 3172007 - RNA, 13 nt, Human
agagcccaccuug

SEQ ID NO: 3172008 - RNA, 16 nt, Human
agagcccacgccccca

SEQ ID NO: 3172009 - RNA, 23 nt, Human
agagagggugaguccuccagaac

SEQ ID NO: 3172010 - RNA, 13 nt, Human
agagcccacgccc

SEQ ID NO: 3172011 - RNA, 19 nt, Human
agagcccaccuuggcucaa

SEQ ID NO: 3172012 - RNA, 20 nt, Human
agacgcugugcugcccugcc

SEQ ID NO: 3172013 - RNA, 22 nt, Human
agacgcugugcugcccugccca

SEQ ID NO: 3172014 - RNA, 21 nt, Human
agacgcugugcugcccugccc

SEQ ID NO: 3172015 - RNA, 11 nt, Human
agacagcucuu

SEQ ID NO: 3172016 - RNA, 12 nt, Human
agacagcucuua

SEQ ID NO: 3172017 - RNA, 12 nt, Human
agacagcugccu

SEQ ID NO: 3172018 - RNA, 14 nt, Human
agacagcccgggcu

SEQ ID NO: 3172019 - RNA, 15 nt, Human
agacagcccgggcuc

SEQ ID NO: 3172020 - RNA, 22 nt, Human
agacagcccgauccuccccugg

SEQ ID NO: 3172021 - RNA, 23 nt, Human
agacagagucucacuguugccca

SEQ ID NO: 3172022 - RNA, 15 nt, Human
agacaaccaaguaug

SEQ ID NO: 3172023 - RNA, 22 nt, Human
agcuucuggugaccuuccaaga

SEQ ID NO: 3172024 - RNA, 21 nt, Human
agcuucuggugaccuuccaag

SEQ ID NO: 3172025 - RNA, 19 nt, Human
agcuucuguugcugccuca

SEQ ID NO: 3172026 - RNA, 19 nt, Human
agcuucugggagauuuuuu

SEQ ID NO: 3172027 - RNA, 22 nt, Human
agcuucugggagauuuuuuuga

SEQ ID NO: 3172028 - RNA, 19 nt, Human
agcuuccagcaggagggac

SEQ ID NO: 3172029 - RNA, 17 nt, Human
agcuuccagcaggaggg

SEQ ID NO: 3172030 - RNA, 16 nt, Human
agcuuccagcaggagg

SEQ ID NO: 3172031 - RNA, 14 nt, Human
agcuuccagcagga

SEQ ID NO: 3172032 - RNA, 13 nt, Human
agcuuccagcagg

SEQ ID NO: 3172033 - RNA, 12 nt, Human
agcuuccagcag

SEQ ID NO: 3172034 - RNA, 18 nt, Human
agcuuccaauuuuccuuc

SEQ ID NO: 3172035 - RNA, 17 nt, Human
agcuuccaauuuuccuu

SEQ ID NO: 3172036 - RNA, 18 nt, Human
agcuucccucccugcugu

SEQ ID NO: 3172037 - RNA, 12 nt, Human
agcuucccuccc

SEQ ID NO: 3172038 - RNA, 16 nt, Human
agcuucccucccugcu

SEQ ID NO: 3172039 - RNA, 15 nt, Human
agcuucccucccugc

SEQ ID NO: 3172040 - RNA, 18 nt, Human
agcuuccccaguagcugg

SEQ ID NO: 3172041 - RNA, 19 nt, Human
agcugcucagaucccacuu

SEQ ID NO: 3172042 - RNA, 23 nt, Human
agcugcgguccacccaggagccc

SEQ ID NO: 3172043 - RNA, 18 nt, Human
agcugcggugucucccug

SEQ ID NO: 3172044 - RNA, 21 nt, Human
agcugcuacucgugagcgcca

SEQ ID NO: 3172045 - RNA, 14 nt, Human
agcugagcaggugu

SEQ ID NO: 3172046 - RNA, 21 nt, Human
agcugcgguccacccaggagc

SEQ ID NO: 3172047 - RNA, 20 nt, Human
agcugagcacccagcucugu

SEQ ID NO: 3172048 - RNA, 23 nt, Human
agcugagauuauaggcaccuacc

SEQ ID NO: 3172049 - RNA, 11 nt, Human
agcugagaaga

SEQ ID NO: 3172050 - RNA, 13 nt, Human
agcugagaagacu

SEQ ID NO: 3172051 - RNA, 21 nt, Human
agcugagaagacucaaguccc

SEQ ID NO: 3172052 - RNA, 21 nt, Human
agcugacuuuucuguccgagc

SEQ ID NO: 3172053 - RNA, 15 nt, Human
agcucuuuuccuaga

SEQ ID NO: 3172054 - RNA, 19 nt, Human
agcugaaauugaaaaguua

SEQ ID NO: 3172055 - RNA, 13 nt, Human
agcugaaauuuua

SEQ ID NO: 3172056 - RNA, 17 nt, Human
agcugaaauuuuagaaa

SEQ ID NO: 3172057 - RNA, 20 nt, Human
agcugaaauuuuagaaauau

SEQ ID NO: 3172058 - RNA, 16 nt, Human
agcugaaauugaaaag

SEQ ID NO: 3172059 - RNA, 13 nt, Human
agcugaaauugaa

SEQ ID NO: 3172060 - RNA, 12 nt, Human
agcugaaauuga

SEQ ID NO: 3172061 - RNA, 19 nt, Human
agcuccggcguguguucag

SEQ ID NO: 3172062 - RNA, 23 nt, Human
agcuccgcuuucuacccagcgag

SEQ ID NO: 3172063 - RNA, 21 nt, Human
agcuccgcuuucuacccagcg

SEQ ID NO: 3172064 - RNA, 20 nt, Human
agcuccgcuuucuacccagc

SEQ ID NO: 3172065 - RNA, 19 nt, Human
agcuccuuccuagccuugc

SEQ ID NO: 3172066 - RNA, 12 nt, Human
agcuccuucugu

SEQ ID NO: 3172067 - RNA, 22 nt, Human
agcuccccucggagaagagcug

SEQ ID NO: 3172068 - RNA, 20 nt, Human
agcucccucaaagaggcagu

SEQ ID NO: 3172069 - RNA, 18 nt, Human
agcucccgcuccgggcuc

SEQ ID NO: 3172070 - RNA, 12 nt, Human
agcuuuugaugu

SEQ ID NO: 3172071 - RNA, 15 nt, Human
agcuuuuugaaaacc

SEQ ID NO: 3172072 - RNA, 13 nt, Human
agcuuuuuggaau

SEQ ID NO: 3172073 - RNA, 14 nt, Human
agcuuuuuggaauc

SEQ ID NO: 3172074 - RNA, 12 nt, Human
agcuuuuuaauu

SEQ ID NO: 3172075 - RNA, 17 nt, Human
agcuuuuuaauuaagca

SEQ ID NO: 3172076 - RNA, 21 nt, Human
aggaaucaugugccaagcaga

SEQ ID NO: 3172077 - RNA, 17 nt, Human
aggaauccagacccggc

SEQ ID NO: 3172078 - RNA, 18 nt, Human
aggacccugccaggcaca

SEQ ID NO: 3172079 - RNA, 23 nt, Human
aggacccugccaggcacaggcag

SEQ ID NO: 3172080 - RNA, 22 nt, Human
aggacccugccaggcacaggca

SEQ ID NO: 3172081 - RNA, 21 nt, Human
aggacccugccaggcacaggc

SEQ ID NO: 3172082 - RNA, 19 nt, Human
aggacccugccaggcacag

SEQ ID NO: 3172083 - RNA, 21 nt, Human
aggagucccugccaucauguu

SEQ ID NO: 3172084 - RNA, 22 nt, Human
aggagucccacuccaagccagc

SEQ ID NO: 3172085 - RNA, 21 nt, Human
aggagucccacuccaagccag

SEQ ID NO: 3172086 - RNA, 23 nt, Human
aggagucccacuccaagccagca

SEQ ID NO: 3172087 - RNA, 19 nt, Human
aggagugguuuuucuuuuc

SEQ ID NO: 3172088 - RNA, 13 nt, Human
aggaccucaggug

SEQ ID NO: 3172089 - RNA, 20 nt, Human
aggagaauagccugaaccug

SEQ ID NO: 3172090 - RNA, 19 nt, Human
aggagaaucauguuucuuu

SEQ ID NO: 3172091 - RNA, 17 nt, Human
aggagaaucauguuucu

SEQ ID NO: 3172092 - RNA, 17 nt, Human
aggauguugaaaaaguu

SEQ ID NO: 3172093 - RNA, 14 nt, Human
aggauuaaauaaug

SEQ ID NO: 3172094 - RNA, 14 nt, Human
aggauuauuggaaa

SEQ ID NO: 3172095 - RNA, 20 nt, Human
aggauuaaauaauguaaaua

SEQ ID NO: 3172096 - RNA, 17 nt, Human
aggauuaguuuagaaca

SEQ ID NO: 3172097 - RNA, 14 nt, Human
aggauucacacccc

SEQ ID NO: 3172098 - RNA, 15 nt, Human
aggauuaguuuagaa

SEQ ID NO: 3172099 - RNA, 16 nt, Human
aggauuaguuuagaac

SEQ ID NO: 3172100 - RNA, 18 nt, Human
aggauuaguuuagaacag

SEQ ID NO: 3172101 - RNA, 12 nt, Human
aggauuauggaa

SEQ ID NO: 3172102 - RNA, 15 nt, Human
aggauuauggaaaaa

SEQ ID NO: 3172103 - RNA, 22 nt, Human
aggauguucuagcauggcugcc

SEQ ID NO: 3172104 - RNA, 16 nt, Human
aggauguauauuuuau

SEQ ID NO: 3172105 - RNA, 20 nt, Human
aggauguauauuuuauauaa

SEQ ID NO: 3172106 - RNA, 21 nt, Human
aggauguauauuuuauauaaa

SEQ ID NO: 3172107 - RNA, 22 nt, Human
aggauguacaaggacagccccu

SEQ ID NO: 3172108 - RNA, 16 nt, Human
aggauguucugggaca

SEQ ID NO: 3172109 - RNA, 15 nt, Human
aggauguucugggac

SEQ ID NO: 3172110 - RNA, 17 nt, Human
aggcuacugucagcucc

SEQ ID NO: 3172111 - RNA, 21 nt, Human
aggcuagaaccaccugccuau

SEQ ID NO: 3172112 - RNA, 12 nt, Human
aggcuaaaaugu

SEQ ID NO: 3172113 - RNA, 13 nt, Human
aggcuaaaauguu

SEQ ID NO: 3172114 - RNA, 15 nt, Human
aggcuaaaauguuuu

SEQ ID NO: 3172115 - RNA, 14 nt, Human
aggcuaaaauguuu

SEQ ID NO: 3172116 - RNA, 19 nt, Human
aggcuaaaauguuuucagc

SEQ ID NO: 3172117 - RNA, 18 nt, Human
aggcuaaaauguuuucag

SEQ ID NO: 3172118 - RNA, 17 nt, Human
aggcuaaaauguuuuca

SEQ ID NO: 3172119 - RNA, 16 nt, Human
aggcuaaaauguuuuc

SEQ ID NO: 3172120 - RNA, 21 nt, Human
aggcgugagccaccgugccug

SEQ ID NO: 3172121 - RNA, 20 nt, Human
aggcccuucucuccagcccc

SEQ ID NO: 3172122 - RNA, 21 nt, Human
aggcccuucucuccagccccu

SEQ ID NO: 3172123 - RNA, 18 nt, Human
aggcccuuccucuccacu

SEQ ID NO: 3172124 - RNA, 17 nt, Human
aggcccuuccucuccac

SEQ ID NO: 3172125 - RNA, 15 nt, Human
aggcccuuccucucc

SEQ ID NO: 3172126 - RNA, 13 nt, Human
aggcccuuccucu

SEQ ID NO: 3172127 - RNA, 22 nt, Human
aggcccuucucuccagccccug

SEQ ID NO: 3172128 - RNA, 23 nt, Human
aggcccuucucuccagccccugg

SEQ ID NO: 3172129 - RNA, 20 nt, Human
aggcugucaguguuuggugc

SEQ ID NO: 3172130 - RNA, 21 nt, Human
aggcugucaauuacaggaagu

SEQ ID NO: 3172131 - RNA, 22 nt, Human
agggacagaggggguggccucc

SEQ ID NO: 3172132 - RNA, 22 nt, Human
aggcugucucagauaaauuaug

SEQ ID NO: 3172133 - RNA, 20 nt, Human
agggacagaggggguggccu

SEQ ID NO: 3172134 - RNA, 23 nt, Human
agggacagaggggguggccuccc

SEQ ID NO: 3172135 - RNA, 19 nt, Human
aggcugucaauuacaggaa

SEQ ID NO: 3172136 - RNA, 20 nt, Human
aggcugucaauuacaggaag

SEQ ID NO: 3172137 - RNA, 18 nt, Human
aggcuguaucccaugagc

SEQ ID NO: 3172138 - RNA, 13 nt, Human
aggcuguauccca

SEQ ID NO: 3172139 - RNA, 18 nt, Human
agguaaagggcaaauaau

SEQ ID NO: 3172140 - RNA, 19 nt, Human
agguaaagggcaaauaaug

SEQ ID NO: 3172141 - RNA, 23 nt, Human
agguaacaagaugagaacagaua

SEQ ID NO: 3172142 - RNA, 21 nt, Human
agguaaucgaccugccucggc

SEQ ID NO: 3172143 - RNA, 19 nt, Human
agguaaucgaccugccucg

SEQ ID NO: 3172144 - RNA, 17 nt, Human
agguacaaccuguucug

SEQ ID NO: 3172145 - RNA, 23 nt, Human
aggguuuugccauguuggccagg

SEQ ID NO: 3172146 - RNA, 12 nt, Human
agguaaaaaguu

SEQ ID NO: 3172147 - RNA, 23 nt, Human
aggucugaguuguuaccccaagc

SEQ ID NO: 3172148 - RNA, 20 nt, Human
aggucugaguuguuacccca

SEQ ID NO: 3172149 - RNA, 13 nt, Human
aggucugaguugu

SEQ ID NO: 3172150 - RNA, 22 nt, Human
aggugcuacaaaaacacagcaa

SEQ ID NO: 3172151 - RNA, 21 nt, Human
aggugcuacaaaaacacagca

SEQ ID NO: 3172152 - RNA, 20 nt, Human
aggugcuacaaaaacacagc

SEQ ID NO: 3172153 - RNA, 19 nt, Human
aggugcuacaaaaacacag

SEQ ID NO: 3172154 - RNA, 18 nt, Human
aggugcuacaaaaacaca

SEQ ID NO: 3172155 - RNA, 16 nt, Human
aggucuguuugcuguu

SEQ ID NO: 3172156 - RNA, 15 nt, Human
aggucuguuugcugu

SEQ ID NO: 3172157 - RNA, 14 nt, Human
aggucuguuugcug

SEQ ID NO: 3172158 - RNA, 21 nt, Human
agguggaauuauuuuaaaaga

SEQ ID NO: 3172159 - RNA, 17 nt, Human
agguggaauuauuuuaa

SEQ ID NO: 3172160 - RNA, 17 nt, Human
aggugcucaaaaugcaa

SEQ ID NO: 3172161 - RNA, 23 nt, Human
aggugcuaggaacacuccuucac

SEQ ID NO: 3172162 - RNA, 16 nt, Human
aggugcucaaaaugca

SEQ ID NO: 3172163 - RNA, 16 nt, Human
aggugcuacaaaaaca

SEQ ID NO: 3172164 - RNA, 17 nt, Human
aggucuguuugcuguug

SEQ ID NO: 3172165 - RNA, 24 nt, Human
aggugcuacaaaaacacagcaagg

SEQ ID NO: 3172166 - RNA, 23 nt, Human
aggugcuacaaaaacacagcaag

SEQ ID NO: 3172167 - RNA, 19 nt, Human
aggugcuaggaacacuccu

SEQ ID NO: 3172168 - RNA, 22 nt, Human
aggugcuaggaacacuccuuca

SEQ ID NO: 3172169 - RNA, 12 nt, Human
agguuaaaaaaa

SEQ ID NO: 3172170 - RNA, 18 nt, Human
agguuaaaaaaaaaaguc

SEQ ID NO: 3172171 - RNA, 19 nt, Human
agguuaaauguuuuguaaa

SEQ ID NO: 3172172 - RNA, 18 nt, Human
agguuaaauguuuuguaa

SEQ ID NO: 3172173 - RNA, 17 nt, Human
agguuaaauguuuugua

SEQ ID NO: 3172174 - RNA, 14 nt, Human
agguuaaauguuuu

SEQ ID NO: 3172175 - RNA, 13 nt, Human
agguuaaauguuu

SEQ ID NO: 3172176 - RNA, 12 nt, Human
agguuaaauguu

SEQ ID NO: 3172177 - RNA, 11 nt, Human
agguuaaaugu

SEQ ID NO: 3172178 - RNA, 22 nt, Human
agguuaaaagaccauaagcaaa

SEQ ID NO: 3172179 - RNA, 22 nt, Human
agguggagcguucaccagugac

SEQ ID NO: 3172180 - RNA, 13 nt, Human
agguguuugaaaa

SEQ ID NO: 3172181 - RNA, 22 nt, Human
agguguuugaacagaggccaca

SEQ ID NO: 3172182 - RNA, 14 nt, Human
agguguuugaaaau

SEQ ID NO: 3172183 - RNA, 15 nt, Human
agguguuugaaaaua

SEQ ID NO: 3172184 - RNA, 17 nt, Human
agguguuugaaaauagu

SEQ ID NO: 3172185 - RNA, 15 nt, Human
agguguuugaacaga

SEQ ID NO: 3172186 - RNA, 22 nt, Human
agguucccuuugacgccauccc

SEQ ID NO: 3172187 - RNA, 13 nt, Human
agguucccuuuga

SEQ ID NO: 3172188 - RNA, 21 nt, Human
agguuaggcaguauaaagaau

SEQ ID NO: 3172189 - RNA, 19 nt, Human
agguuaggcaguauaaaga

SEQ ID NO: 3172190 - RNA, 23 nt, Human
agguuagaaauaaugucaaaaau

SEQ ID NO: 3172191 - RNA, 20 nt, Human
agguuagaaauaaugucaaa

SEQ ID NO: 3172192 - RNA, 16 nt, Human
agguuauugcaauaaa

SEQ ID NO: 3172193 - RNA, 21 nt, Human
agguuauugcaauaaaguaua

SEQ ID NO: 3172194 - RNA, 23 nt, Human
agguuaggcaguauaaagaauag

SEQ ID NO: 3172195 - RNA, 23 nt, Human
agguucccuuugacgccauccca

SEQ ID NO: 3172196 - RNA, 21 nt, Human
aggguaucaggugcugccauc

SEQ ID NO: 3172197 - RNA, 18 nt, Human
aggguaucaggugcugcc

SEQ ID NO: 3172198 - RNA, 19 nt, Human
aggguaucaggugcugcca

SEQ ID NO: 3172199 - RNA, 19 nt, Human
aggggccucuuaugggcug

SEQ ID NO: 3172200 - RNA, 20 nt, Human
aggggccucuuaugggcugg

SEQ ID NO: 3172201 - RNA, 21 nt, Human
aggggccucuuaugggcuggg

SEQ ID NO: 3172202 - RNA, 11 nt, Human
agggucccugg

SEQ ID NO: 3172203 - RNA, 21 nt, Human
aggguccuggggaaccugacc

SEQ ID NO: 3172204 - RNA, 23 nt, Human
aggguccuggggaaccugacccc

SEQ ID NO: 3172205 - RNA, 12 nt, Human
aggguccugggg

SEQ ID NO: 3172206 - RNA, 15 nt, Human
aggguccuggggaac

SEQ ID NO: 3172207 - RNA, 22 nt, Human
aucuugaaggaaaaauucaaua

SEQ ID NO: 3172208 - RNA, 22 nt, Human
aucuucugaacuuggcgcugcc

SEQ ID NO: 3172209 - RNA, 18 nt, Human
aucuugaagacuuuucuu

SEQ ID NO: 3172210 - RNA, 17 nt, Human
aucuugaaggaaaaauu

SEQ ID NO: 3172211 - RNA, 20 nt, Human
aucuugaaggaaaaauucaa

SEQ ID NO: 3172212 - RNA, 18 nt, Human
aucuugaaggaaaaauuc

SEQ ID NO: 3172213 - RNA, 14 nt, Human
aucuucuuuauaau

SEQ ID NO: 3172214 - RNA, 19 nt, Human
aucuucuggacuauagcug

SEQ ID NO: 3172215 - RNA, 17 nt, Human
aucucugcuuuggaaau

SEQ ID NO: 3172216 - RNA, 20 nt, Human
aucucuuaagacagcaugug

SEQ ID NO: 3172217 - RNA, 16 nt, Human
aucucggcucacugca

SEQ ID NO: 3172218 - RNA, 15 nt, Human
aucucguauagaagu

SEQ ID NO: 3172219 - RNA, 19 nt, Human
aucucguauagaagucuuc

SEQ ID NO: 3172220 - RNA, 14 nt, Human
aucucggcucacug

SEQ ID NO: 3172221 - RNA, 15 nt, Human
aucucggcucacugc

SEQ ID NO: 3172222 - RNA, 16 nt, Human
aucuccuuagaaaagc

SEQ ID NO: 3172223 - RNA, 18 nt, Human
aucuccuuuguauucugu

SEQ ID NO: 3172224 - RNA, 22 nt, Human
aucugcuuuuuaaagaaugcuc

SEQ ID NO: 3172225 - RNA, 22 nt, Human
aucuggaccccaucugugaaua

SEQ ID NO: 3172226 - RNA, 18 nt, Human
aucuggacuccucugucc

SEQ ID NO: 3172227 - RNA, 17 nt, Human
aucuggacuccucuguc

SEQ ID NO: 3172228 - RNA, 16 nt, Human
aucuggacuccucugu

SEQ ID NO: 3172229 - RNA, 15 nt, Human
aucuggacuccucug

SEQ ID NO: 3172230 - RNA, 19 nt, Human
aucuggacuccucugucca

SEQ ID NO: 3172231 - RNA, 21 nt, Human
aucuggaccccaucugugaau

SEQ ID NO: 3172232 - RNA, 21 nt, Human
aucucccccagccccauccuc

SEQ ID NO: 3172233 - RNA, 16 nt, Human
aucuaucuggugauuu

SEQ ID NO: 3172234 - RNA, 19 nt, Human
aucuaucuggugauuucua

SEQ ID NO: 3172235 - RNA, 20 nt, Human
aucuaucuggugauuucuag

SEQ ID NO: 3172236 - RNA, 21 nt, Human
aucuaucuggugauuucuagc

SEQ ID NO: 3172237 - RNA, 23 nt, Human
aucuaucuggugauuucuagcuc

SEQ ID NO: 3172238 - RNA, 18 nt, Human
augaagguuuuuguaaag

SEQ ID NO: 3172239 - RNA, 17 nt, Human
augaagguuuuuguaaa

SEQ ID NO: 3172240 - RNA, 21 nt, Human
augaagguuuuuguaaagauu

SEQ ID NO: 3172241 - RNA, 17 nt, Human
augaaagacuguacaaa

SEQ ID NO: 3172242 - RNA, 16 nt, Human
augaaagacuguacaa

SEQ ID NO: 3172243 - RNA, 13 nt, Human
augaaagacugua

SEQ ID NO: 3172244 - RNA, 21 nt, Human
augaccuuucaauaggaaaaa

SEQ ID NO: 3172245 - RNA, 18 nt, Human
augaccuuucaauaggaa

SEQ ID NO: 3172246 - RNA, 22 nt, Human
augaccuuucaauaggaaaaac

SEQ ID NO: 3172247 - RNA, 23 nt, Human
augaccuuucaauaggaaaaacu

SEQ ID NO: 3172248 - RNA, 20 nt, Human
augaggcagcacgugcacaa

SEQ ID NO: 3172249 - RNA, 19 nt, Human
augaggaguaaaauucagu

SEQ ID NO: 3172250 - RNA, 14 nt, Human
aucagccugugcca

SEQ ID NO: 3172251 - RNA, 23 nt, Human
aucagcgccggccuccagaacuu

SEQ ID NO: 3172252 - RNA, 21 nt, Human
aucagcugcugaaacaacaaa

SEQ ID NO: 3172253 - RNA, 19 nt, Human
aucagccugcuccagcugu

SEQ ID NO: 3172254 - RNA, 17 nt, Human
aucagccugcuccagcu

SEQ ID NO: 3172255 - RNA, 18 nt, Human
aucagccugcuccagcug

SEQ ID NO: 3172256 - RNA, 19 nt, Human
aucaccgaaaacguggcug

SEQ ID NO: 3172257 - RNA, 14 nt, Human
aucaccgaaaacgu

SEQ ID NO: 3172258 - RNA, 19 nt, Human
aucaccaacgucugugcca

SEQ ID NO: 3172259 - RNA, 23 nt, Human
aucacccgcuaagagggagggag

SEQ ID NO: 3172260 - RNA, 18 nt, Human
aucaccaacgucugugcc

SEQ ID NO: 3172261 - RNA, 15 nt, Human
aucacauguggacuu

SEQ ID NO: 3172262 - RNA, 21 nt, Human
aucacagccucugaaaaccaa

SEQ ID NO: 3172263 - RNA, 13 nt, Human
aucacagccucug

SEQ ID NO: 3172264 - RNA, 23 nt, Human
aucacaggcugggcugggcacug

SEQ ID NO: 3172265 - RNA, 22 nt, Human
aucacaggcugggcugggcacu

SEQ ID NO: 3172266 - RNA, 21 nt, Human
aucacaggcugggcugggcac

SEQ ID NO: 3172267 - RNA, 20 nt, Human
aucacaggcugggcugggca

SEQ ID NO: 3172268 - RNA, 14 nt, Human
aucacagcuuguuu

SEQ ID NO: 3172269 - RNA, 18 nt, Human
aucacagcuuguuuugga

SEQ ID NO: 3172270 - RNA, 21 nt, Human
aucacagcuuguuuuggacuu

SEQ ID NO: 3172271 - RNA, 13 nt, Human
aucacaggcuggg

SEQ ID NO: 3172272 - RNA, 15 nt, Human
aucacaggcugggcu

SEQ ID NO: 3172273 - RNA, 14 nt, Human
aucacaggcugggc

SEQ ID NO: 3172274 - RNA, 18 nt, Human
aucaugugcgucagucca

SEQ ID NO: 3172275 - RNA, 13 nt, Human
aucagcugcuuug

SEQ ID NO: 3172276 - RNA, 16 nt, Human
aucagcugcuuuguua

SEQ ID NO: 3172277 - RNA, 19 nt, Human
aucagcugcuuuguuaccu

SEQ ID NO: 3172278 - RNA, 17 nt, Human
aucagcugcugaaacaa

SEQ ID NO: 3172279 - RNA, 18 nt, Human
aucagcugagccuucuga

SEQ ID NO: 3172280 - RNA, 23 nt, Human
aucagcugcugaaacaacaaaua

SEQ ID NO: 3172281 - RNA, 22 nt, Human
aucagcugcugaaacaacaaau

SEQ ID NO: 3172282 - RNA, 10 nt, Human
auccagaaac

SEQ ID NO: 3172283 - RNA, 20 nt, Human
auccagaaacuuguucuucc

SEQ ID NO: 3172284 - RNA, 19 nt, Human
auccagaaacuuguucuuc

SEQ ID NO: 3172285 - RNA, 14 nt, Human
aucccauuuaaaaa

SEQ ID NO: 3172286 - RNA, 15 nt, Human
aucccauuuaaaaaa

SEQ ID NO: 3172287 - RNA, 13 nt, Human
auccccaagccug

SEQ ID NO: 3172288 - RNA, 18 nt, Human
auccaggacccugccagg

SEQ ID NO: 3172289 - RNA, 15 nt, Human
auccaggacccugcc

SEQ ID NO: 3172290 - RNA, 13 nt, Human
auccaggacccug

SEQ ID NO: 3172291 - RNA, 11 nt, Human
auccaggaccc

SEQ ID NO: 3172292 - RNA, 21 nt, Human
auccagaaacuuguucuucca

SEQ ID NO: 3172293 - RNA, 23 nt, Human
auccaggacccugccaggcacag

SEQ ID NO: 3172294 - RNA, 22 nt, Human
auccaggacccugccaggcaca

SEQ ID NO: 3172295 - RNA, 20 nt, Human
auccaggacccugccaggca

SEQ ID NO: 3172296 - RNA, 19 nt, Human
auccaggacccugccaggc

SEQ ID NO: 3172297 - RNA, 18 nt, Human
auccccuuccuaccaccc

SEQ ID NO: 3172298 - RNA, 11 nt, Human
auccccuuccu

SEQ ID NO: 3172299 - RNA, 15 nt, Human
auccccuguagagug

SEQ ID NO: 3172300 - RNA, 23 nt, Human
auccucauacccacccccaccca

SEQ ID NO: 3172301 - RNA, 11 nt, Human
auccuccaggu

SEQ ID NO: 3172302 - RNA, 23 nt, Human
auccuccaggugcacaagcucca

SEQ ID NO: 3172303 - RNA, 13 nt, Human
auccuccagggcu

SEQ ID NO: 3172304 - RNA, 12 nt, Human
auccuccagggc

SEQ ID NO: 3172305 - RNA, 15 nt, Human
auccucccaccucag

SEQ ID NO: 3172306 - RNA, 19 nt, Human
auccucccaccucagccuc

SEQ ID NO: 3172307 - RNA, 18 nt, Human
auccucccaccucagccu

SEQ ID NO: 3172308 - RNA, 20 nt, Human
auccucccaccucagccucc

SEQ ID NO: 3172309 - RNA, 15 nt, Human
aucggcauuuguuuc

SEQ ID NO: 3172310 - RNA, 18 nt, Human
auguuugccucugccucu

SEQ ID NO: 3172311 - RNA, 15 nt, Human
auguuugccuucugc

SEQ ID NO: 3172312 - RNA, 22 nt, Human
auguuugccucugccucugaca

SEQ ID NO: 3172313 - RNA, 19 nt, Human
auguuugccucugccucug

SEQ ID NO: 3172314 - RNA, 15 nt, Human
auuaaaucauacucc

SEQ ID NO: 3172315 - RNA, 14 nt, Human
auuaaauauauuuu

SEQ ID NO: 3172316 - RNA, 18 nt, Human
auuaaaugaacaucuaua

SEQ ID NO: 3172317 - RNA, 19 nt, Human
auguuuucagcuaggaaca

SEQ ID NO: 3172318 - RNA, 12 nt, Human
auguuuucagcu

SEQ ID NO: 3172319 - RNA, 22 nt, Human
auguuuuaucguccagugacuu

SEQ ID NO: 3172320 - RNA, 15 nt, Human
auguuuucaaaugga

SEQ ID NO: 3172321 - RNA, 13 nt, Human
auguuuucaaaug

SEQ ID NO: 3172322 - RNA, 12 nt, Human
auguuuucaaau

SEQ ID NO: 3172323 - RNA, 17 nt, Human
auguuuuagcacagcgu

SEQ ID NO: 3172324 - RNA, 20 nt, Human
auguuugcugaacauuggag

SEQ ID NO: 3172325 - RNA, 17 nt, Human
auguucuaagaagugaa

SEQ ID NO: 3172326 - RNA, 21 nt, Human
augugugauucaaugccucug

SEQ ID NO: 3172327 - RNA, 15 nt, Human
augugugcccagcuu

SEQ ID NO: 3172328 - RNA, 14 nt, Human
augugugcccagcu

SEQ ID NO: 3172329 - RNA, 13 nt, Human
augugugcccagc

SEQ ID NO: 3172330 - RNA, 18 nt, Human
augugggcagugauguca

SEQ ID NO: 3172331 - RNA, 16 nt, Human
augugugagugcaugu

SEQ ID NO: 3172332 - RNA, 12 nt, Human
auguucugggac

SEQ ID NO: 3172333 - RNA, 11 nt, Human
auguucuggga

SEQ ID NO: 3172334 - RNA, 14 nt, Human
augugaaaggauau

SEQ ID NO: 3172335 - RNA, 18 nt, Human
augugaaaggauaugaau

SEQ ID NO: 3172336 - RNA, 20 nt, Human
augugaaaggauaugaaucu

SEQ ID NO: 3172337 - RNA, 14 nt, Human
augucuuuucuugc

SEQ ID NO: 3172338 - RNA, 18 nt, Human
augucuuuccaaauuauu

SEQ ID NO: 3172339 - RNA, 19 nt, Human
augucuuuccaaauuauuu

SEQ ID NO: 3172340 - RNA, 21 nt, Human
augucuuuccaaauuauuucu

SEQ ID NO: 3172341 - RNA, 13 nt, Human
augucuuccugga

SEQ ID NO: 3172342 - RNA, 15 nt, Human
augucaaaaguagaa

SEQ ID NO: 3172343 - RNA, 17 nt, Human
augucaaaaguagaacu

SEQ ID NO: 3172344 - RNA, 20 nt, Human
augucaaaaguagaacuuug

SEQ ID NO: 3172345 - RNA, 22 nt, Human
augucaaaaguagaacuuugua

SEQ ID NO: 3172346 - RNA, 23 nt, Human
augucaaaaguagaacuuuguau

SEQ ID NO: 3172347 - RNA, 20 nt, Human
augugaaggaccuucacucu

SEQ ID NO: 3172348 - RNA, 22 nt, Human
augugaauuacuaacuucuaaa

SEQ ID NO: 3172349 - RNA, 21 nt, Human
augugaauuacuaacuucuaa

SEQ ID NO: 3172350 - RNA, 14 nt, Human
augugaauuacuaa

SEQ ID NO: 3172351 - RNA, 13 nt, Human
augugaauuacua

SEQ ID NO: 3172352 - RNA, 20 nt, Human
augugaauuacuaacuucua

SEQ ID NO: 3172353 - RNA, 18 nt, Human
augugaauuacuaacuuc

SEQ ID NO: 3172354 - RNA, 17 nt, Human
augugaauuacuaacuu

SEQ ID NO: 3172355 - RNA, 16 nt, Human
augugaauuacuaacu

SEQ ID NO: 3172356 - RNA, 18 nt, Human
auguauucuguaaaagaa

SEQ ID NO: 3172357 - RNA, 21 nt, Human
auguauucauauuuguacuuu

SEQ ID NO: 3172358 - RNA, 23 nt, Human
augucaaaaauauuuaggaauuu

SEQ ID NO: 3172359 - RNA, 17 nt, Human
augucaaaaauauuuag

SEQ ID NO: 3172360 - RNA, 23 nt, Human
auguauuuugugaguuuguuucu

SEQ ID NO: 3172361 - RNA, 20 nt, Human
auguauuuugugaguuuguu

SEQ ID NO: 3172362 - RNA, 12 nt, Human
auguauuuugug

SEQ ID NO: 3172363 - RNA, 14 nt, Human
auguauuuugugag

SEQ ID NO: 3172364 - RNA, 13 nt, Human
auguauuuuguga

SEQ ID NO: 3172365 - RNA, 19 nt, Human
auguauuuugugaguuugu

SEQ ID NO: 3172366 - RNA, 17 nt, Human
auguauuuugugaguuu

SEQ ID NO: 3172367 - RNA, 16 nt, Human
auguauuuugugaguu

SEQ ID NO: 3172368 - RNA, 15 nt, Human
auguauuuugugagu

SEQ ID NO: 3172369 - RNA, 16 nt, Human
auguaagggaaacugc

SEQ ID NO: 3172370 - RNA, 14 nt, Human
auguaagggaaacu

SEQ ID NO: 3172371 - RNA, 19 nt, Human
auguaagggaaacugccag

SEQ ID NO: 3172372 - RNA, 18 nt, Human
auguaauuaaacuguuaa

SEQ ID NO: 3172373 - RNA, 19 nt, Human
auguaauuaaacuguuaac

SEQ ID NO: 3172374 - RNA, 17 nt, Human
auguaauuaaguacuau

SEQ ID NO: 3172375 - RNA, 15 nt, Human
auguaauuaaguacu

SEQ ID NO: 3172376 - RNA, 15 nt, Human
auggucauauuuaaa

SEQ ID NO: 3172377 - RNA, 19 nt, Human
auggucaccaaaucagcug

SEQ ID NO: 3172378 - RNA, 19 nt, Human
augguaugcacaauuccau

SEQ ID NO: 3172379 - RNA, 18 nt, Human
augguaugcacaauucca

SEQ ID NO: 3172380 - RNA, 14 nt, Human
augguauccagaau

SEQ ID NO: 3172381 - RNA, 18 nt, Human
augguaucaaaauuacau

SEQ ID NO: 3172382 - RNA, 21 nt, Human
augguaucaaaauuacauaua

SEQ ID NO: 3172383 - RNA, 20 nt, Human
augcauauauauaugugugu

SEQ ID NO: 3172384 - RNA, 12 nt, Human
augcaucuuuga

SEQ ID NO: 3172385 - RNA, 13 nt, Human
augcaucuuugau

SEQ ID NO: 3172386 - RNA, 14 nt, Human
augcauauuacugu

SEQ ID NO: 3172387 - RNA, 13 nt, Human
augcauauuacug

SEQ ID NO: 3172388 - RNA, 17 nt, Human
augccucucucaggcca

SEQ ID NO: 3172389 - RNA, 19 nt, Human
augccucucucaggccaaa

SEQ ID NO: 3172390 - RNA, 15 nt, Human
augcaucuuugaugu

SEQ ID NO: 3172391 - RNA, 16 nt, Human
augcaucuuugaugug

SEQ ID NO: 3172392 - RNA, 19 nt, Human
augcaucuuugauguguug

SEQ ID NO: 3172393 - RNA, 21 nt, Human
augcaucuuugauguguuguu

SEQ ID NO: 3172394 - RNA, 16 nt, Human
augcauauauauaugu

SEQ ID NO: 3172395 - RNA, 15 nt, Human
augcauauauauaug

SEQ ID NO: 3172396 - RNA, 16 nt, Human
augcacaaacagaggc

SEQ ID NO: 3172397 - RNA, 17 nt, Human
augcacaaacagaggcc

SEQ ID NO: 3172398 - RNA, 16 nt, Human
augaugccaugaggaa

SEQ ID NO: 3172399 - RNA, 17 nt, Human
augaugccaugaggaac

SEQ ID NO: 3172400 - RNA, 24 nt, Human
augauguuuuccaugaguccccug

SEQ ID NO: 3172401 - RNA, 17 nt, Human
augauguuaguuuuccu

SEQ ID NO: 3172402 - RNA, 19 nt, Human
augauguuaguuuuccuua

SEQ ID NO: 3172403 - RNA, 16 nt, Human
augaugcucuuuccca

SEQ ID NO: 3172404 - RNA, 15 nt, Human
augcacaaacagagg

SEQ ID NO: 3172405 - RNA, 17 nt, Human
augcaauuuuucuuucu

SEQ ID NO: 3172406 - RNA, 17 nt, Human
augauguuuuuaaaauc

SEQ ID NO: 3172407 - RNA, 13 nt, Human
augauguuuuuaa

SEQ ID NO: 3172408 - RNA, 17 nt, Human
augauuaaaaauaucaa

SEQ ID NO: 3172409 - RNA, 14 nt, Human
augauuaaaaauau

SEQ ID NO: 3172410 - RNA, 22 nt, Human
augauguuuuuaaaaucuuauu

SEQ ID NO: 3172411 - RNA, 21 nt, Human
augauguuuuuaaaaucuuau

SEQ ID NO: 3172412 - RNA, 20 nt, Human
augauguuuuuaaaaucuua

SEQ ID NO: 3172413 - RNA, 19 nt, Human
augauguuuuuaaaaucuu

SEQ ID NO: 3172414 - RNA, 18 nt, Human
augauguuuuuaaaaucu

SEQ ID NO: 3172415 - RNA, 16 nt, Human
auggcuguggagugug

SEQ ID NO: 3172416 - RNA, 20 nt, Human
auggcugugccucugccugu

SEQ ID NO: 3172417 - RNA, 19 nt, Human
auggcugugccucugccug

SEQ ID NO: 3172418 - RNA, 11 nt, Human
augcugcccug

SEQ ID NO: 3172419 - RNA, 15 nt, Human
augcugccccugccu

SEQ ID NO: 3172420 - RNA, 11 nt, Human
augcugccccu

SEQ ID NO: 3172421 - RNA, 16 nt, Human
augcucuuuacuucau

SEQ ID NO: 3172422 - RNA, 12 nt, Human
augcucuuuccc

SEQ ID NO: 3172423 - RNA, 21 nt, Human
augcucuuucccacccagccu

SEQ ID NO: 3172424 - RNA, 15 nt, Human
augcucuuucccacc

SEQ ID NO: 3172425 - RNA, 23 nt, Human
augcugaacauugcauauaacuu

SEQ ID NO: 3172426 - RNA, 17 nt, Human
augcugaacauugcaua

SEQ ID NO: 3172427 - RNA, 23 nt, Human
augcucuuucccacccagccugg

SEQ ID NO: 3172428 - RNA, 22 nt, Human
augcucuuucccacccagccug

SEQ ID NO: 3172429 - RNA, 22 nt, Human
augcugaaaauugccuuucugu

SEQ ID NO: 3172430 - RNA, 14 nt, Human
augcugaaaauugc

SEQ ID NO: 3172431 - RNA, 15 nt, Human
auggauuuccagcca

SEQ ID NO: 3172432 - RNA, 23 nt, Human
auggauuggguaucaaaaugaau

SEQ ID NO: 3172433 - RNA, 18 nt, Human
auggcugugccucugccu

SEQ ID NO: 3172434 - RNA, 17 nt, Human
auggaggagaguguuua

SEQ ID NO: 3172435 - RNA, 16 nt, Human
auggaggaaaaccaag

SEQ ID NO: 3172436 - RNA, 22 nt, Human
auggaggaaaaccaagccgugg

SEQ ID NO: 3172437 - RNA, 18 nt, Human
auggaggaagaacugaaa

SEQ ID NO: 3172438 - RNA, 20 nt, Human
auggaggaagaacugaaagg

SEQ ID NO: 3172439 - RNA, 22 nt, Human
auggaggaccacgucuauuuca

SEQ ID NO: 3172440 - RNA, 16 nt, Human
augcugccccugccuu

SEQ ID NO: 3172441 - RNA, 20 nt, Human
auggaaacagaggaccagca

SEQ ID NO: 3172442 - RNA, 18 nt, Human
auggaaacagaggaccag

SEQ ID NO: 3172443 - RNA, 20 nt, Human
auggaaaaugccaugaauua

SEQ ID NO: 3172444 - RNA, 16 nt, Human
aguggcuggaucugug

SEQ ID NO: 3172445 - RNA, 21 nt, Human
aguggcuccucccggugccca

SEQ ID NO: 3172446 - RNA, 17 nt, Human
aguggcuccucccggug

SEQ ID NO: 3172447 - RNA, 13 nt, Human
aguggcuccuccc

SEQ ID NO: 3172448 - RNA, 23 nt, Human
aguggcuuaaaacaacacucaca

SEQ ID NO: 3172449 - RNA, 23 nt, Human
aguggcgaaaucccugcucacug

SEQ ID NO: 3172450 - RNA, 21 nt, Human
aguggcgaaaucccugcucac

SEQ ID NO: 3172451 - RNA, 18 nt, Human
aguggcgaaaucccugcu

SEQ ID NO: 3172452 - RNA, 17 nt, Human
aguguauuaaaugaaca

SEQ ID NO: 3172453 - RNA, 14 nt, Human
aguguauuaaauga

SEQ ID NO: 3172454 - RNA, 14 nt, Human
agugggagcugccu

SEQ ID NO: 3172455 - RNA, 15 nt, Human
agugggagcugccug

SEQ ID NO: 3172456 - RNA, 15 nt, Human
agugucuuaauuaaa

SEQ ID NO: 3172457 - RNA, 18 nt, Human
agugucuuaauuaaaaga

SEQ ID NO: 3172458 - RNA, 17 nt, Human
agugucuuaauuaaaag

SEQ ID NO: 3172459 - RNA, 18 nt, Human
aguucauaaauuuauggu

SEQ ID NO: 3172460 - RNA, 19 nt, Human
aguucagguaacaggcaga

SEQ ID NO: 3172461 - RNA, 18 nt, Human
aguucagguaacaggcag

SEQ ID NO: 3172462 - RNA, 20 nt, Human
aguucagguaacaggcagau

SEQ ID NO: 3172463 - RNA, 22 nt, Human
aguucaucuugaauuguaagga

SEQ ID NO: 3172464 - RNA, 14 nt, Human
aguucauucauauu

SEQ ID NO: 3172465 - RNA, 16 nt, Human
aguucauucagggccg

SEQ ID NO: 3172466 - RNA, 21 nt, Human
aguugaaaagacuccaaagaa

SEQ ID NO: 3172467 - RNA, 23 nt, Human
aguucauucauauuacaauauuu

SEQ ID NO: 3172468 - RNA, 15 nt, Human
aguucauugcaauua

SEQ ID NO: 3172469 - RNA, 17 nt, Human
aguucauucauauuaca

SEQ ID NO: 3172470 - RNA, 16 nt, Human
aguucauucauauuac

SEQ ID NO: 3172471 - RNA, 15 nt, Human
aguucauucauauua

SEQ ID NO: 3172472 - RNA, 14 nt, Human
aguuacagacaaag

SEQ ID NO: 3172473 - RNA, 16 nt, Human
aguuacagacaaagcg

SEQ ID NO: 3172474 - RNA, 18 nt, Human
aguuacacuaaaagguga

SEQ ID NO: 3172475 - RNA, 15 nt, Human
aguuaauguauauaa

SEQ ID NO: 3172476 - RNA, 17 nt, Human
aguuaauguauauaaaa

SEQ ID NO: 3172477 - RNA, 18 nt, Human
aguuaauguauauaaaaa

SEQ ID NO: 3172478 - RNA, 13 nt, Human
aguuaaucuauaa

SEQ ID NO: 3172479 - RNA, 12 nt, Human
aguuaaauaaau

SEQ ID NO: 3172480 - RNA, 13 nt, Human
aguuaagccuuug

SEQ ID NO: 3172481 - RNA, 23 nt, Human
aguuaaagugaggccacugaaga

SEQ ID NO: 3172482 - RNA, 16 nt, Human
aguuaagauucuuggu

SEQ ID NO: 3172483 - RNA, 23 nt, Human
aguuaaagggaagaaaacacugu

SEQ ID NO: 3172484 - RNA, 18 nt, Human
aguuaaggagaaucaugu

SEQ ID NO: 3172485 - RNA, 22 nt, Human
aguuaaggagaaucauguuucu

SEQ ID NO: 3172486 - RNA, 21 nt, Human
aguuaaggagaaucauguuuc

SEQ ID NO: 3172487 - RNA, 14 nt, Human
aguuaagccuuugg

SEQ ID NO: 3172488 - RNA, 22 nt, Human
aguuaagucuaucugguauuaa

SEQ ID NO: 3172489 - RNA, 13 nt, Human
aguuaaagggaag

SEQ ID NO: 3172490 - RNA, 18 nt, Human
aguuaaagggaagaaaac

SEQ ID NO: 3172491 - RNA, 17 nt, Human
aguuaaagggaagaaaa

SEQ ID NO: 3172492 - RNA, 21 nt, Human
aguuaaagaagacauuugcca

SEQ ID NO: 3172493 - RNA, 13 nt, Human
aguuaaagaaagg

SEQ ID NO: 3172494 - RNA, 14 nt, Human
aguuaaagaaagga

SEQ ID NO: 3172495 - RNA, 16 nt, Human
aguuaaagaaaggaaa

SEQ ID NO: 3172496 - RNA, 18 nt, Human
aguuaaagaaaggaaaag

SEQ ID NO: 3172497 - RNA, 18 nt, Human
aguuaaaagcacaaagga

SEQ ID NO: 3172498 - RNA, 17 nt, Human
aguuaaaaguaaaagag

SEQ ID NO: 3172499 - RNA, 22 nt, Human
aguugaaaagacuccaaagaaa

SEQ ID NO: 3172500 - RNA, 14 nt, Human
aguugaagacagag

SEQ ID NO: 3172501 - RNA, 16 nt, Human
aguuguguguaugugu

SEQ ID NO: 3172502 - RNA, 18 nt, Human
aguuguguguaugugugu

SEQ ID NO: 3172503 - RNA, 23 nt, Human
aguuguuucuagacuauaaaugu

SEQ ID NO: 3172504 - RNA, 13 nt, Human
aguuguuugaugc

SEQ ID NO: 3172505 - RNA, 11 nt, Human
aguuguuugau

SEQ ID NO: 3172506 - RNA, 17 nt, Human
aguuguguuuuuuaaga

SEQ ID NO: 3172507 - RNA, 19 nt, Human
aguuguguuuuuuaagaug

SEQ ID NO: 3172508 - RNA, 21 nt, Human
aguuguguuuuuuaagauggc

SEQ ID NO: 3172509 - RNA, 20 nt, Human
aguuguuugauucagacagc

SEQ ID NO: 3172510 - RNA, 16 nt, Human
aguaugaauaaagaca

SEQ ID NO: 3172511 - RNA, 18 nt, Human
aguaugcacuauauacau

SEQ ID NO: 3172512 - RNA, 16 nt, Human
aguaugcauuauuaaa

SEQ ID NO: 3172513 - RNA, 19 nt, Human
aguaugcauuauuaaauug

SEQ ID NO: 3172514 - RNA, 21 nt, Human
aguaugcauuauuaaauugua

SEQ ID NO: 3172515 - RNA, 11 nt, Human
aguaucuugaa

SEQ ID NO: 3172516 - RNA, 14 nt, Human
aguaucugugaacu

SEQ ID NO: 3172517 - RNA, 12 nt, Human
aguaucuugaag

SEQ ID NO: 3172518 - RNA, 15 nt, Human
aguaucuugaagacu

SEQ ID NO: 3172519 - RNA, 15 nt, Human
aguaucucagggccu

SEQ ID NO: 3172520 - RNA, 22 nt, Human
agucaaauguaauguggcuucu

SEQ ID NO: 3172521 - RNA, 23 nt, Human
agucaaauguaauguggcuucug

SEQ ID NO: 3172522 - RNA, 22 nt, Human
agucaaacacuugugacuuuug

SEQ ID NO: 3172523 - RNA, 19 nt, Human
agucaaacacuugugacuu

SEQ ID NO: 3172524 - RNA, 17 nt, Human
aguaugggacuggccuc

SEQ ID NO: 3172525 - RNA, 20 nt, Human
aguaugggacuggccucugc

SEQ ID NO: 3172526 - RNA, 12 nt, Human
agucaacaguac

SEQ ID NO: 3172527 - RNA, 19 nt, Human
agucaacaguacccugguu

SEQ ID NO: 3172528 - RNA, 12 nt, Human
agucugaaggcu

SEQ ID NO: 3172529 - RNA, 16 nt, Human
agucugaaggcugggu

SEQ ID NO: 3172530 - RNA, 13 nt, Human
agucugaaggcug

SEQ ID NO: 3172531 - RNA, 15 nt, Human
agucugaaggcuggg

SEQ ID NO: 3172532 - RNA, 20 nt, Human
aguccuggcaugggaaugaa

SEQ ID NO: 3172533 - RNA, 21 nt, Human
aguccuggcaugggaaugaau

SEQ ID NO: 3172534 - RNA, 22 nt, Human
aguccuggcaugggaaugaaug

SEQ ID NO: 3172535 - RNA, 20 nt, Human
agugaacuugggccacugug

SEQ ID NO: 3172536 - RNA, 17 nt, Human
agucuggaaugcagugg

SEQ ID NO: 3172537 - RNA, 18 nt, Human
agucugauucccaagcuc

SEQ ID NO: 3172538 - RNA, 16 nt, Human
agucugauucccaagc

SEQ ID NO: 3172539 - RNA, 12 nt, Human
agucugcauaua

SEQ ID NO: 3172540 - RNA, 14 nt, Human
agucugcauauauu

SEQ ID NO: 3172541 - RNA, 15 nt, Human
agugaagacuccaga

SEQ ID NO: 3172542 - RNA, 16 nt, Human
agugaagacuccagaa

SEQ ID NO: 3172543 - RNA, 17 nt, Human
agugaagacuccagaaa

SEQ ID NO: 3172544 - RNA, 18 nt, Human
agugaccauacuaauuau

SEQ ID NO: 3172545 - RNA, 18 nt, Human
agugaccauugcaugccg

SEQ ID NO: 3172546 - RNA, 16 nt, Human
auaucaaaagacacag

SEQ ID NO: 3172547 - RNA, 14 nt, Human
auaucaaaagacac

SEQ ID NO: 3172548 - RNA, 21 nt, Human
auaucaaauuaauugugugaa

SEQ ID NO: 3172549 - RNA, 17 nt, Human
auaucaaaagacacagg

SEQ ID NO: 3172550 - RNA, 13 nt, Human
auaucaaauuaau

SEQ ID NO: 3172551 - RNA, 18 nt, Human
auaucaaauuaauugugu

SEQ ID NO: 3172552 - RNA, 19 nt, Human
auaucaaauuaauugugug

SEQ ID NO: 3172553 - RNA, 20 nt, Human
auaucaaauuaauuguguga

SEQ ID NO: 3172554 - RNA, 16 nt, Human
auauuauauuuggaug

SEQ ID NO: 3172555 - RNA, 15 nt, Human
auauuauauuuggau

SEQ ID NO: 3172556 - RNA, 22 nt, Human
auauuauauuuggaugcagagu

SEQ ID NO: 3172557 - RNA, 13 nt, Human
auauuauaucaga

SEQ ID NO: 3172558 - RNA, 20 nt, Human
auauuagaaaacuuuguuag

SEQ ID NO: 3172559 - RNA, 18 nt, Human
auauuagaaaacuuuguu

SEQ ID NO: 3172560 - RNA, 17 nt, Human
auauuagaaaacuuugu

SEQ ID NO: 3172561 - RNA, 16 nt, Human
auauuagaaaacuuug

SEQ ID NO: 3172562 - RNA, 14 nt, Human
auauuauauuugga

SEQ ID NO: 3172563 - RNA, 13 nt, Human
auauuauauuugg

SEQ ID NO: 3172564 - RNA, 12 nt, Human
auauuauauuug

SEQ ID NO: 3172565 - RNA, 13 nt, Human
auauuuauugacu

SEQ ID NO: 3172566 - RNA, 16 nt, Human
auauuuauugacucuu

SEQ ID NO: 3172567 - RNA, 18 nt, Human
auauuuauugacucuuga

SEQ ID NO: 3172568 - RNA, 19 nt, Human
auauuuacuucuuauacau

SEQ ID NO: 3172569 - RNA, 17 nt, Human
auauuauuuguguuucc

SEQ ID NO: 3172570 - RNA, 18 nt, Human
auauuauuuguguuuccu

SEQ ID NO: 3172571 - RNA, 21 nt, Human
auaugcuuauacacuuacacu

SEQ ID NO: 3172572 - RNA, 11 nt, Human
auauuacuuua

SEQ ID NO: 3172573 - RNA, 17 nt, Human
auauuacuuuaacaugc

SEQ ID NO: 3172574 - RNA, 21 nt, Human
auauuacuguacaugggacua

SEQ ID NO: 3172575 - RNA, 17 nt, Human
auauuacuguacauggg

SEQ ID NO: 3172576 - RNA, 15 nt, Human
auauuagaaaacuuu

SEQ ID NO: 3172577 - RNA, 14 nt, Human
auauuagaaaacuu

SEQ ID NO: 3172578 - RNA, 14 nt, Human
auauccacacauuu

SEQ ID NO: 3172579 - RNA, 12 nt, Human
auaucauuucuu

SEQ ID NO: 3172580 - RNA, 13 nt, Human
auaucauucuaaa

SEQ ID NO: 3172581 - RNA, 17 nt, Human
auaucauucuaaagaua

SEQ ID NO: 3172582 - RNA, 15 nt, Human
auaucauucuaaaga

SEQ ID NO: 3172583 - RNA, 20 nt, Human
auauacuuguuuuuguaaag

SEQ ID NO: 3172584 - RNA, 18 nt, Human
auauacuuguuuuuguaa

SEQ ID NO: 3172585 - RNA, 14 nt, Human
auauacuuguuuuu

SEQ ID NO: 3172586 - RNA, 15 nt, Human
auauagauuaaauca

SEQ ID NO: 3172587 - RNA, 17 nt, Human
auauagagucauuguaa

SEQ ID NO: 3172588 - RNA, 22 nt, Human
auauagagucauuguaauguug

SEQ ID NO: 3172589 - RNA, 19 nt, Human
auauagagucauuguaaug

SEQ ID NO: 3172590 - RNA, 18 nt, Human
auauagagucauuguaau

SEQ ID NO: 3172591 - RNA, 21 nt, Human
auauacuuguuuuuguaaaga

SEQ ID NO: 3172592 - RNA, 14 nt, Human
auaguauuugaaaa

SEQ ID NO: 3172593 - RNA, 13 nt, Human
auaguauuugaaa

SEQ ID NO: 3172594 - RNA, 22 nt, Human
auaguauuugaaaacagaaauu

SEQ ID NO: 3172595 - RNA, 20 nt, Human
auaguauuugaaaacagaaa

SEQ ID NO: 3172596 - RNA, 19 nt, Human
auaguauuugaaaacagaa

SEQ ID NO: 3172597 - RNA, 18 nt, Human
auaguauuugaaaacaga

SEQ ID NO: 3172598 - RNA, 18 nt, Human
auaguaugguggcugggu

SEQ ID NO: 3172599 - RNA, 17 nt, Human
auaguaugguggcuggg

SEQ ID NO: 3172600 - RNA, 16 nt, Human
auaguaugguggcugg

SEQ ID NO: 3172601 - RNA, 12 nt, Human
auagguuauuuu

SEQ ID NO: 3172602 - RNA, 17 nt, Human
auagguuagauauagag

SEQ ID NO: 3172603 - RNA, 12 nt, Human
auagguuucuaa

SEQ ID NO: 3172604 - RNA, 23 nt, Human
auaggugcuacaaaaacacagca

SEQ ID NO: 3172605 - RNA, 14 nt, Human
auagguuagauaua

SEQ ID NO: 3172606 - RNA, 21 nt, Human
auagguuaaaaaaaaaaguca

SEQ ID NO: 3172607 - RNA, 21 nt, Human
auaggugcuacaaaaacacag

SEQ ID NO: 3172608 - RNA, 15 nt, Human
auaggugcuacaaaa

SEQ ID NO: 3172609 - RNA, 14 nt, Human
auaggugcuacaaa

SEQ ID NO: 3172610 - RNA, 17 nt, Human
auagguccuuuagaaac

SEQ ID NO: 3172611 - RNA, 16 nt, Human
auagguccuuuagaaa

SEQ ID NO: 3172612 - RNA, 21 nt, Human
auagguauaaguggugugugu

SEQ ID NO: 3172613 - RNA, 15 nt, Human
auagccccucucccc

SEQ ID NO: 3172614 - RNA, 18 nt, Human
auagcagcuuauucacaa

SEQ ID NO: 3172615 - RNA, 16 nt, Human
auagcaguagucuuuu

SEQ ID NO: 3172616 - RNA, 18 nt, Human
auagcaguauauguuaau

SEQ ID NO: 3172617 - RNA, 22 nt, Human
auagcaguauauguuaauuugu

SEQ ID NO: 3172618 - RNA, 20 nt, Human
auagcaucacuuaaaacacg

SEQ ID NO: 3172619 - RNA, 15 nt, Human
auagcaucacuuaaa

SEQ ID NO: 3172620 - RNA, 16 nt, Human
auagcaucacuuaaaa

SEQ ID NO: 3172621 - RNA, 17 nt, Human
auagcaucacuuaaaac

SEQ ID NO: 3172622 - RNA, 18 nt, Human
auagcaucacuuaaaaca

SEQ ID NO: 3172623 - RNA, 13 nt, Human
auagcaucacuua

SEQ ID NO: 3172624 - RNA, 23 nt, Human
auagcauaugacaaauguuucua

SEQ ID NO: 3172625 - RNA, 22 nt, Human
auagcauaugacaaauguuucu

SEQ ID NO: 3172626 - RNA, 20 nt, Human
auagcauaugacaaauguuu

SEQ ID NO: 3172627 - RNA, 19 nt, Human
auagcauaugacaaauguu

SEQ ID NO: 3172628 - RNA, 18 nt, Human
auagcauaugacaaaugu

SEQ ID NO: 3172629 - RNA, 17 nt, Human
auagcauaugacaaaug

SEQ ID NO: 3172630 - RNA, 15 nt, Human
auagccaaggccaaa

SEQ ID NO: 3172631 - RNA, 21 nt, Human
auagccaaggccaaaggaagc

SEQ ID NO: 3172632 - RNA, 21 nt, Human
auagcccaggauauauuuuau

SEQ ID NO: 3172633 - RNA, 20 nt, Human
auagcccaggauauauuuua

SEQ ID NO: 3172634 - RNA, 18 nt, Human
auagcccaggauauauuu

SEQ ID NO: 3172635 - RNA, 18 nt, Human
auaauuaacacuuaaggu

SEQ ID NO: 3172636 - RNA, 12 nt, Human
auaauuaacacu

SEQ ID NO: 3172637 - RNA, 19 nt, Human
auaauuaacacuuaagguu

SEQ ID NO: 3172638 - RNA, 23 nt, Human
auaauguauucauauuuguacuu

SEQ ID NO: 3172639 - RNA, 15 nt, Human
auaauguaagcucua

SEQ ID NO: 3172640 - RNA, 19 nt, Human
auaauguacugauuucagu

SEQ ID NO: 3172641 - RNA, 20 nt, Human
auaauguacugauuucagua

SEQ ID NO: 3172642 - RNA, 15 nt, Human
auaauguauucauau

SEQ ID NO: 3172643 - RNA, 19 nt, Human
auaauguauucauauuugu

SEQ ID NO: 3172644 - RNA, 18 nt, Human
auaauguauucauauuug

SEQ ID NO: 3172645 - RNA, 18 nt, Human
auacacacucaaaucaag

SEQ ID NO: 3172646 - RNA, 17 nt, Human
auacacacucaaaucaa

SEQ ID NO: 3172647 - RNA, 11 nt, Human
auacacacgcu

SEQ ID NO: 3172648 - RNA, 15 nt, Human
auacacacgcugccu

SEQ ID NO: 3172649 - RNA, 14 nt, Human
auacacacgcugcc

SEQ ID NO: 3172650 - RNA, 15 nt, Human
auaccauuuccguaa

SEQ ID NO: 3172651 - RNA, 13 nt, Human
auaccauuuccgu

SEQ ID NO: 3172652 - RNA, 20 nt, Human
auaccauuauuaucaaguag

SEQ ID NO: 3172653 - RNA, 16 nt, Human
auacacacgcugccuu

SEQ ID NO: 3172654 - RNA, 23 nt, Human
auaccauuauauguucccccugu

SEQ ID NO: 3172655 - RNA, 16 nt, Human
auaaggccucauccuc

SEQ ID NO: 3172656 - RNA, 15 nt, Human
auaaggacuuccuga

SEQ ID NO: 3172657 - RNA, 14 nt, Human
auaauguaagcucu

SEQ ID NO: 3172658 - RNA, 16 nt, Human
auaauggaaaaugcca

SEQ ID NO: 3172659 - RNA, 22 nt, Human
auaauggaaaaugccaugaauu

SEQ ID NO: 3172660 - RNA, 12 nt, Human
auacccaccccc

SEQ ID NO: 3172661 - RNA, 11 nt, Human
auacccacccc

SEQ ID NO: 3172662 - RNA, 18 nt, Human
auaccugucccccugaca

SEQ ID NO: 3172663 - RNA, 17 nt, Human
auaccugucccccugac

SEQ ID NO: 3172664 - RNA, 12 nt, Human
auaccuguugcu

SEQ ID NO: 3172665 - RNA, 18 nt, Human
auaccuuaaaauuugaaa

SEQ ID NO: 3172666 - RNA, 17 nt, Human
auaccuuaaaauuugaa

SEQ ID NO: 3172667 - RNA, 16 nt, Human
auaccuuaaaauuuga

SEQ ID NO: 3172668 - RNA, 15 nt, Human
auaccuuaaaauuug

SEQ ID NO: 3172669 - RNA, 13 nt, Human
auaccuuaaaauu

SEQ ID NO: 3172670 - RNA, 17 nt, Human
auaccuguuuaaauugc

SEQ ID NO: 3172671 - RNA, 15 nt, Human
auaccuguuuaaauu

SEQ ID NO: 3172672 - RNA, 14 nt, Human
auaccuugcuuauu

SEQ ID NO: 3172673 - RNA, 14 nt, Human
auaccuuagaaggu

SEQ ID NO: 3172674 - RNA, 13 nt, Human
auaccuucuuauu

SEQ ID NO: 3172675 - RNA, 18 nt, Human
auaccuuauauaugcacu

SEQ ID NO: 3172676 - RNA, 23 nt, Human
auaccuuaaaauuugaaacauug

SEQ ID NO: 3172677 - RNA, 22 nt, Human
auaccuuaaaauuugaaacauu

SEQ ID NO: 3172678 - RNA, 21 nt, Human
auaccuuaaaauuugaaacau

SEQ ID NO: 3172679 - RNA, 19 nt, Human
auaccuuaaaauuugaaac

SEQ ID NO: 3172680 - RNA, 22 nt, Human
auaaagcucaaaugaaauguau

SEQ ID NO: 3172681 - RNA, 22 nt, Human
auaaagcgaaaaacucaaccaa

SEQ ID NO: 3172682 - RNA, 15 nt, Human
auaaaggaaucuagc

SEQ ID NO: 3172683 - RNA, 17 nt, Human
auaaagcagacaggugu

SEQ ID NO: 3172684 - RNA, 15 nt, Human
auaaagaauaggacu

SEQ ID NO: 3172685 - RNA, 12 nt, Human
auaaagacaccu

SEQ ID NO: 3172686 - RNA, 23 nt, Human
auaaagaauaggacuuguuuuug

SEQ ID NO: 3172687 - RNA, 19 nt, Human
auaaagaauaggacuuguu

SEQ ID NO: 3172688 - RNA, 14 nt, Human
auaaaaauacugac

SEQ ID NO: 3172689 - RNA, 22 nt, Human
auaaauuuugaaaaguaauauu

SEQ ID NO: 3172690 - RNA, 14 nt, Human
auaacaacuuuuuu

SEQ ID NO: 3172691 - RNA, 13 nt, Human
auaacaacuuuuu

SEQ ID NO: 3172692 - RNA, 15 nt, Human
auaacaguaguguua

SEQ ID NO: 3172693 - RNA, 23 nt, Human
auaacaaagaaccuaacauuuau

SEQ ID NO: 3172694 - RNA, 13 nt, Human
auaacaaagaacc

SEQ ID NO: 3172695 - RNA, 12 nt, Human
auaacauagaau

SEQ ID NO: 3172696 - RNA, 14 nt, Human
auaacaucuuuauu

SEQ ID NO: 3172697 - RNA, 18 nt, Human
auaacaucuuuauugaaa

SEQ ID NO: 3172698 - RNA, 20 nt, Human
auaacaucuuuauugaaauu

SEQ ID NO: 3172699 - RNA, 21 nt, Human
auaacaucuuuauugaaauuc

SEQ ID NO: 3172700 - RNA, 22 nt, Human
auaacauagaauugcaaucuau

SEQ ID NO: 3172701 - RNA, 15 nt, Human
caccagaagcccaga

SEQ ID NO: 3172702 - RNA, 14 nt, Human
caccagaagcccag

SEQ ID NO: 3172703 - RNA, 13 nt, Human
caccagaagccca

SEQ ID NO: 3172704 - RNA, 16 nt, Human
caccacucaagaccaa

SEQ ID NO: 3172705 - RNA, 17 nt, Human
caccagaagcccagaau

SEQ ID NO: 3172706 - RNA, 16 nt, Human
caccagaagcccagaa

SEQ ID NO: 3172707 - RNA, 16 nt, Human
cacccaagggccuggc

SEQ ID NO: 3172708 - RNA, 17 nt, Human
cacccaagggccuggcc

SEQ ID NO: 3172709 - RNA, 18 nt, Human
cacccaagggccuggccu

SEQ ID NO: 3172710 - RNA, 19 nt, Human
cacccaagggccuggccug

SEQ ID NO: 3172711 - RNA, 20 nt, Human
cacccaagggccuggccuga

SEQ ID NO: 3172712 - RNA, 21 nt, Human
cacccaagggccuggccugag

SEQ ID NO: 3172713 - RNA, 23 nt, Human
cacccaagggccuggccugagcu

SEQ ID NO: 3172714 - RNA, 15 nt, Human
cacccacaggcaugu

SEQ ID NO: 3172715 - RNA, 22 nt, Human
cacccaccaucaugucuggcua

SEQ ID NO: 3172716 - RNA, 20 nt, Human
cacccaccaucaugucuggc

SEQ ID NO: 3172717 - RNA, 16 nt, Human
cacccaccucagccuc

SEQ ID NO: 3172718 - RNA, 14 nt, Human
cacccaccucagcc

SEQ ID NO: 3172719 - RNA, 13 nt, Human
cacccaccucagc

SEQ ID NO: 3172720 - RNA, 12 nt, Human
cacccaccucag

SEQ ID NO: 3172721 - RNA, 12 nt, Human
caccccagcccc

SEQ ID NO: 3172722 - RNA, 13 nt, Human
caccccagcccca

SEQ ID NO: 3172723 - RNA, 15 nt, Human
caccccauggccggc

SEQ ID NO: 3172724 - RNA, 12 nt, Human
caccccauccuc

SEQ ID NO: 3172725 - RNA, 22 nt, Human
cacccccacccaagggccuggc

SEQ ID NO: 3172726 - RNA, 14 nt, Human
caccccggccaccu

SEQ ID NO: 3172727 - RNA, 15 nt, Human
caccccggccaccug

SEQ ID NO: 3172728 - RNA, 16 nt, Human
caccccggccaccugc

SEQ ID NO: 3172729 - RNA, 17 nt, Human
caccccggccaccugcg

SEQ ID NO: 3172730 - RNA, 14 nt, Human
caccccuaaagaga

SEQ ID NO: 3172731 - RNA, 14 nt, Human
caaauaugcaaagc

SEQ ID NO: 3172732 - RNA, 12 nt, Human
caaauaguguga

SEQ ID NO: 3172733 - RNA, 15 nt, Human
caaauagugugaaau

SEQ ID NO: 3172734 - RNA, 21 nt, Human
caaauagugugaaauauauua

SEQ ID NO: 3172735 - RNA, 13 nt, Human
caaauaguugcau

SEQ ID NO: 3172736 - RNA, 19 nt, Human
caaauaguugcauagcagu

SEQ ID NO: 3172737 - RNA, 23 nt, Human
caaauaguaggcaagauggcaca

SEQ ID NO: 3172738 - RNA, 21 nt, Human
caaauaggcaucaucaauaaa

SEQ ID NO: 3172739 - RNA, 17 nt, Human
caaauaggcuauuaaaa

SEQ ID NO: 3172740 - RNA, 20 nt, Human
caaauaggcuauuaaaaaag

SEQ ID NO: 3172741 - RNA, 23 nt, Human
caaauaggcuauuaaaaaagucu

SEQ ID NO: 3172742 - RNA, 18 nt, Human
caaauaauaccuuagaag

SEQ ID NO: 3172743 - RNA, 22 nt, Human
caaauaauauguuuccuucccu

SEQ ID NO: 3172744 - RNA, 19 nt, Human
caaauaauaccuuagaagg

SEQ ID NO: 3172745 - RNA, 22 nt, Human
caaauaaugaucgaaaaaauaa

SEQ ID NO: 3172746 - RNA, 23 nt, Human
caaauaaugaucgaaaaaauaau

SEQ ID NO: 3172747 - RNA, 19 nt, Human
caaauacauuuaaaacauu

SEQ ID NO: 3172748 - RNA, 21 nt, Human
caaaggaugcccaaagaugca

SEQ ID NO: 3172749 - RNA, 20 nt, Human
caaaguuuucaugugcucag

SEQ ID NO: 3172750 - RNA, 16 nt, Human
caaaguuucagaguau

SEQ ID NO: 3172751 - RNA, 17 nt, Human
caaaguuucagaguaua

SEQ ID NO: 3172752 - RNA, 18 nt, Human
caaaguuucagaguauau

SEQ ID NO: 3172753 - RNA, 20 nt, Human
caaaguuucagaguauauug

SEQ ID NO: 3172754 - RNA, 21 nt, Human
caaauguucaucaaugaauga

SEQ ID NO: 3172755 - RNA, 20 nt, Human
caaauguucaucaaugaaug

SEQ ID NO: 3172756 - RNA, 14 nt, Human
caaauguggcuccu

SEQ ID NO: 3172757 - RNA, 22 nt, Human
caaauucugcuugcuugcuuuu

SEQ ID NO: 3172758 - RNA, 23 nt, Human
caaauucauggcaugcuuaaauu

SEQ ID NO: 3172759 - RNA, 17 nt, Human
caaauguguuuuggucc

SEQ ID NO: 3172760 - RNA, 18 nt, Human
caaaugugugcccagcuu

SEQ ID NO: 3172761 - RNA, 17 nt, Human
caaaugugugcccagcu

SEQ ID NO: 3172762 - RNA, 16 nt, Human
caaaugugugcccagc

SEQ ID NO: 3172763 - RNA, 15 nt, Human
caaaugugugcccag

SEQ ID NO: 3172764 - RNA, 18 nt, Human
caaauaugcaaagcacug

SEQ ID NO: 3172765 - RNA, 17 nt, Human
caaauaugcaaagcacu

SEQ ID NO: 3172766 - RNA, 16 nt, Human
caaauaugcaaagcac

SEQ ID NO: 3172767 - RNA, 13 nt, Human
caaaucagcugcu

SEQ ID NO: 3172768 - RNA, 16 nt, Human
caaaucagcugcuacu

SEQ ID NO: 3172769 - RNA, 15 nt, Human
caaaugucuuccugg

SEQ ID NO: 3172770 - RNA, 18 nt, Human
caaaugucuuccuggauu

SEQ ID NO: 3172771 - RNA, 15 nt, Human
auuuuuuuagauuga

SEQ ID NO: 3172772 - RNA, 16 nt, Human
caaaaaaauccagaaa

SEQ ID NO: 3172773 - RNA, 19 nt, Human
caaaaaaucuuaauacugu

SEQ ID NO: 3172774 - RNA, 13 nt, Human
caaaaaaucuuaa

SEQ ID NO: 3172775 - RNA, 23 nt, Human
caaaaaauaucuaguaauauauu

SEQ ID NO: 3172776 - RNA, 19 nt, Human
caaaaaauaucuaguaaua

SEQ ID NO: 3172777 - RNA, 21 nt, Human
caaagaaaaaaaaaaaagcca

SEQ ID NO: 3172778 - RNA, 21 nt, Human
caaacuuuagguuuuuuuaau

SEQ ID NO: 3172779 - RNA, 23 nt, Human
caaacuuuagguuuuuuuaauga

SEQ ID NO: 3172780 - RNA, 17 nt, Human
caaagcauguuuugcau

SEQ ID NO: 3172781 - RNA, 18 nt, Human
caaagaggcacagagcca

SEQ ID NO: 3172782 - RNA, 23 nt, Human
caaagaggcaguugcccagccuc

SEQ ID NO: 3172783 - RNA, 15 nt, Human
caaagcuaggccugg

SEQ ID NO: 3172784 - RNA, 21 nt, Human
caaagccaaagcuaggccugg

SEQ ID NO: 3172785 - RNA, 20 nt, Human
caaagccaaagcuaggccug

SEQ ID NO: 3172786 - RNA, 20 nt, Human
caaagcauuugacuuucugu

SEQ ID NO: 3172787 - RNA, 17 nt, Human
caaagcuaggccuggcc

SEQ ID NO: 3172788 - RNA, 16 nt, Human
caaagcuaggccuggc

SEQ ID NO: 3172789 - RNA, 17 nt, Human
caaagcuguucuuccug

SEQ ID NO: 3172790 - RNA, 16 nt, Human
caaagcuguucuuccu

SEQ ID NO: 3172791 - RNA, 16 nt, Human
caaagcuuguuaagau

SEQ ID NO: 3172792 - RNA, 18 nt, Human
caaagcuguucuuccugg

SEQ ID NO: 3172793 - RNA, 20 nt, Human
caaagcuucccgauuaacug

SEQ ID NO: 3172794 - RNA, 14 nt, Human
caaagcuuuuugaa

SEQ ID NO: 3172795 - RNA, 20 nt, Human
caaagcuuuuugaaaaccaa

SEQ ID NO: 3172796 - RNA, 17 nt, Human
caaagcuuucuuuguuu

SEQ ID NO: 3172797 - RNA, 17 nt, Human
caacuuucaagaacuug

SEQ ID NO: 3172798 - RNA, 24 nt, Human
caacuuucacuauaaugugaaaug

SEQ ID NO: 3172799 - RNA, 12 nt, Human
caacuuuacugu

SEQ ID NO: 3172800 - RNA, 16 nt, Human
caacuuuacuguccua

SEQ ID NO: 3172801 - RNA, 15 nt, Human
caacuucaucuggaa

SEQ ID NO: 3172802 - RNA, 16 nt, Human
caacuucaucuggaag

SEQ ID NO: 3172803 - RNA, 17 nt, Human
caacuucaucuggaagu

SEQ ID NO: 3172804 - RNA, 17 nt, Human
caacuuacauaugucuu

SEQ ID NO: 3172805 - RNA, 20 nt, Human
caacucuccuccagagucag

SEQ ID NO: 3172806 - RNA, 16 nt, Human
caacugcauuggcuuu

SEQ ID NO: 3172807 - RNA, 15 nt, Human
caacucugcugaggg

SEQ ID NO: 3172808 - RNA, 16 nt, Human
caacucugcugagggu

SEQ ID NO: 3172809 - RNA, 21 nt, Human
caacucugcugaggguccaga

SEQ ID NO: 3172810 - RNA, 22 nt, Human
caacucugcugaggguccagaa

SEQ ID NO: 3172811 - RNA, 18 nt, Human
caacucuucccugaacuu

SEQ ID NO: 3172812 - RNA, 12 nt, Human
caacccucauca

SEQ ID NO: 3172813 - RNA, 15 nt, Human
caacccucaucacca

SEQ ID NO: 3172814 - RNA, 14 nt, Human
caaccucuuccucc

SEQ ID NO: 3172815 - RNA, 19 nt, Human
caacccuucuucauguuca

SEQ ID NO: 3172816 - RNA, 20 nt, Human
caaccucuuccuccugacac

SEQ ID NO: 3172817 - RNA, 16 nt, Human
caaccucuuccuccug

SEQ ID NO: 3172818 - RNA, 16 nt, Human
caaccugauugugucu

SEQ ID NO: 3172819 - RNA, 17 nt, Human
caacgagccuuuucacc

SEQ ID NO: 3172820 - RNA, 19 nt, Human
caacucuccuccagaguca

SEQ ID NO: 3172821 - RNA, 18 nt, Human
caacgcagcccugcuuug

SEQ ID NO: 3172822 - RNA, 20 nt, Human
caacgaucacaaaugacuuu

SEQ ID NO: 3172823 - RNA, 15 nt, Human
caacgcagcccugcu

SEQ ID NO: 3172824 - RNA, 13 nt, Human
caacgcagcccug

SEQ ID NO: 3172825 - RNA, 12 nt, Human
caacgcagcccu

SEQ ID NO: 3172826 - RNA, 18 nt, Human
caacgaucacaaaugacu

SEQ ID NO: 3172827 - RNA, 19 nt, Human
caacgaucacaaaugacuu

SEQ ID NO: 3172828 - RNA, 16 nt, Human
caacgaucacaaauga

SEQ ID NO: 3172829 - RNA, 14 nt, Human
caaauuuacagaga

SEQ ID NO: 3172830 - RNA, 15 nt, Human
caaauuuacagagac

SEQ ID NO: 3172831 - RNA, 23 nt, Human
caacaggcugggcuucaguggca

SEQ ID NO: 3172832 - RNA, 24 nt, Human
caacaggcugggcuucaguggcag

SEQ ID NO: 3172833 - RNA, 13 nt, Human
caaauuuaacagg

SEQ ID NO: 3172834 - RNA, 19 nt, Human
caacagguuuuccugaaga

SEQ ID NO: 3172835 - RNA, 21 nt, Human
caacagguagcauagcucugu

SEQ ID NO: 3172836 - RNA, 18 nt, Human
caacaggguuuuuuucca

SEQ ID NO: 3172837 - RNA, 15 nt, Human
caacagguuuuccug

SEQ ID NO: 3172838 - RNA, 22 nt, Human
caacaucuuggucagauuugaa

SEQ ID NO: 3172839 - RNA, 14 nt, Human
caacauccacucuc

SEQ ID NO: 3172840 - RNA, 13 nt, Human
caacauccacucu

SEQ ID NO: 3172841 - RNA, 12 nt, Human
caacaucagcuu

SEQ ID NO: 3172842 - RNA, 13 nt, Human
caacaucagcuug

SEQ ID NO: 3172843 - RNA, 14 nt, Human
caacaucagcuuga

SEQ ID NO: 3172844 - RNA, 15 nt, Human
caacaucagcuugac

SEQ ID NO: 3172845 - RNA, 19 nt, Human
caaccccuucgcuccugug

SEQ ID NO: 3172846 - RNA, 18 nt, Human
caaccccuucgcuccugu

SEQ ID NO: 3172847 - RNA, 21 nt, Human
caaccccuucgcuccuguguc

SEQ ID NO: 3172848 - RNA, 18 nt, Human
caacccucagagccaccc

SEQ ID NO: 3172849 - RNA, 21 nt, Human
caacccucagagccaccccua

SEQ ID NO: 3172850 - RNA, 16 nt, Human
caacauuguagccuca

SEQ ID NO: 3172851 - RNA, 12 nt, Human
caaccaaauggu

SEQ ID NO: 3172852 - RNA, 22 nt, Human
caaccaaguaugaaucuauuug

SEQ ID NO: 3172853 - RNA, 14 nt, Human
caaccaagugugcu

SEQ ID NO: 3172854 - RNA, 13 nt, Human
caaccacaaaacu

SEQ ID NO: 3172855 - RNA, 21 nt, Human
caaccacacuugucggcucca

SEQ ID NO: 3172856 - RNA, 20 nt, Human
caaccacacuugucggcucc

SEQ ID NO: 3172857 - RNA, 21 nt, Human
caacauggcuacuugcuuuga

SEQ ID NO: 3172858 - RNA, 22 nt, Human
caagcacuucaggccuauguuu

SEQ ID NO: 3172859 - RNA, 18 nt, Human
caagcaccuccugccucg

SEQ ID NO: 3172860 - RNA, 17 nt, Human
caagaaaggaaaccuuu

SEQ ID NO: 3172861 - RNA, 12 nt, Human
caagaaaagagu

SEQ ID NO: 3172862 - RNA, 20 nt, Human
caagaaacaaacaaaagcug

SEQ ID NO: 3172863 - RNA, 21 nt, Human
caagccaccaacauacuccca

SEQ ID NO: 3172864 - RNA, 16 nt, Human
caagcgugagccacug

SEQ ID NO: 3172865 - RNA, 23 nt, Human
caagcgcccuggcccccacaugg

SEQ ID NO: 3172866 - RNA, 19 nt, Human
caagcgcccuggcccccac

SEQ ID NO: 3172867 - RNA, 18 nt, Human
caagcgcccuggccccca

SEQ ID NO: 3172868 - RNA, 17 nt, Human
caagcgcccuggccccc

SEQ ID NO: 3172869 - RNA, 16 nt, Human
caagccguggcuuccc

SEQ ID NO: 3172870 - RNA, 15 nt, Human
caagccguggcuucc

SEQ ID NO: 3172871 - RNA, 14 nt, Human
caagccguggcuuc

SEQ ID NO: 3172872 - RNA, 17 nt, Human
caagcgugagccacugc

SEQ ID NO: 3172873 - RNA, 18 nt, Human
caaggaagaaauuaacuu

SEQ ID NO: 3172874 - RNA, 13 nt, Human
caaggaagaaauu

SEQ ID NO: 3172875 - RNA, 18 nt, Human
caaggacagccccuccuc

SEQ ID NO: 3172876 - RNA, 13 nt, Human
caaggauccugag

SEQ ID NO: 3172877 - RNA, 21 nt, Human
caaggaugaucuaggaagacu

SEQ ID NO: 3172878 - RNA, 22 nt, Human
caaggauccugagccagauuuc

SEQ ID NO: 3172879 - RNA, 19 nt, Human
caaggaugccccguccccc

SEQ ID NO: 3172880 - RNA, 21 nt, Human
caaggacgcuucacaggacag

SEQ ID NO: 3172881 - RNA, 20 nt, Human
caaggacgcuucacaggaca

SEQ ID NO: 3172882 - RNA, 15 nt, Human
caaggacgcuucaca

SEQ ID NO: 3172883 - RNA, 17 nt, Human
caagugauucuccugcc

SEQ ID NO: 3172884 - RNA, 16 nt, Human
caagugauucuccugc

SEQ ID NO: 3172885 - RNA, 19 nt, Human
caagugaaaaaggaggaag

SEQ ID NO: 3172886 - RNA, 21 nt, Human
caagugauucucaugccucag

SEQ ID NO: 3172887 - RNA, 22 nt, Human
caagugauucucaugccucagc

SEQ ID NO: 3172888 - RNA, 21 nt, Human
caagugauucuccugccucag

SEQ ID NO: 3172889 - RNA, 22 nt, Human
caagugauucuccugccucagc

SEQ ID NO: 3172890 - RNA, 21 nt, Human
caagucuuugcuauugugaau

SEQ ID NO: 3172891 - RNA, 22 nt, Human
caagugugguagagugugccug

SEQ ID NO: 3172892 - RNA, 23 nt, Human
caaggugggaggauugcuugagc

SEQ ID NO: 3172893 - RNA, 12 nt, Human
caaggugggagg

SEQ ID NO: 3172894 - RNA, 19 nt, Human
caaggugcaggcaggcugg

SEQ ID NO: 3172895 - RNA, 19 nt, Human
caagggccuggccugagcu

SEQ ID NO: 3172896 - RNA, 18 nt, Human
caaggauaccuucuuauu

SEQ ID NO: 3172897 - RNA, 16 nt, Human
caagggcggccuuucc

SEQ ID NO: 3172898 - RNA, 19 nt, Human
caagggcggccuuucccac

SEQ ID NO: 3172899 - RNA, 18 nt, Human
caagggcggccuuuccca

SEQ ID NO: 3172900 - RNA, 16 nt, Human
caagggccuggccuga

SEQ ID NO: 3172901 - RNA, 15 nt, Human
caaggauugcuacug

SEQ ID NO: 3172902 - RNA, 15 nt, Human
caaggucuugcucuc

SEQ ID NO: 3172903 - RNA, 13 nt, Human
caaggucuugcuc

SEQ ID NO: 3172904 - RNA, 17 nt, Human
caaggugcaggcaggcu

SEQ ID NO: 3172905 - RNA, 15 nt, Human
caaggugcaggcagg

SEQ ID NO: 3172906 - RNA, 14 nt, Human
caaggugcaggcag

SEQ ID NO: 3172907 - RNA, 13 nt, Human
caagggcuuuccu

SEQ ID NO: 3172908 - RNA, 21 nt, Human
caagggcuuuccugugccagg

SEQ ID NO: 3172909 - RNA, 18 nt, Human
caagggcuuuccugugcc

SEQ ID NO: 3172910 - RNA, 22 nt, Human
cacauggugacuuuugaaaaga

SEQ ID NO: 3172911 - RNA, 12 nt, Human
cacauggugaug

SEQ ID NO: 3172912 - RNA, 15 nt, Human
cacauggugauguug

SEQ ID NO: 3172913 - RNA, 23 nt, Human
cacauguccaagaagcccaggaa

SEQ ID NO: 3172914 - RNA, 14 nt, Human
cacaugguuuuccu

SEQ ID NO: 3172915 - RNA, 19 nt, Human
cacaugccucucucaggcc

SEQ ID NO: 3172916 - RNA, 15 nt, Human
cacauggaaugaggg

SEQ ID NO: 3172917 - RNA, 17 nt, Human
cacauggaaugaggguu

SEQ ID NO: 3172918 - RNA, 19 nt, Human
cacauggaaugaggguuug

SEQ ID NO: 3172919 - RNA, 14 nt, Human
cacauauuuuucca

SEQ ID NO: 3172920 - RNA, 13 nt, Human
cacaugccucucu

SEQ ID NO: 3172921 - RNA, 17 nt, Human
cacaugccucucucagg

SEQ ID NO: 3172922 - RNA, 18 nt, Human
cacaugccucucucaggc

SEQ ID NO: 3172923 - RNA, 17 nt, Human
cacauauuucagugagg

SEQ ID NO: 3172924 - RNA, 12 nt, Human
cacauaucuguc

SEQ ID NO: 3172925 - RNA, 15 nt, Human
cacaugugcacaugc

SEQ ID NO: 3172926 - RNA, 14 nt, Human
cacaugugcacaug

SEQ ID NO: 3172927 - RNA, 17 nt, Human
cacaugugcacaugcac

SEQ ID NO: 3172928 - RNA, 13 nt, Human
cacauguggacuu

SEQ ID NO: 3172929 - RNA, 15 nt, Human
cacauguuuucaaau

SEQ ID NO: 3172930 - RNA, 14 nt, Human
cacauguuuucaaa

SEQ ID NO: 3172931 - RNA, 13 nt, Human
cacauguuuucaa

SEQ ID NO: 3172932 - RNA, 12 nt, Human
cacauguuuuca

SEQ ID NO: 3172933 - RNA, 12 nt, Human
cacauguuacug

SEQ ID NO: 3172934 - RNA, 16 nt, Human
cacauuccugaugcuu

SEQ ID NO: 3172935 - RNA, 15 nt, Human
cacauuaucuucugg

SEQ ID NO: 3172936 - RNA, 18 nt, Human
cacauguuuucaaaugga

SEQ ID NO: 3172937 - RNA, 16 nt, Human
cacauguuuucaaaug

SEQ ID NO: 3172938 - RNA, 20 nt, Human
cacauuacuagaguuggcau

SEQ ID NO: 3172939 - RNA, 22 nt, Human
caccaagccuggucagcccaaa

SEQ ID NO: 3172940 - RNA, 21 nt, Human
cacauuggucuaucuacuggc

SEQ ID NO: 3172941 - RNA, 12 nt, Human
cacauugugcag

SEQ ID NO: 3172942 - RNA, 12 nt, Human
caccacaaaaua

SEQ ID NO: 3172943 - RNA, 15 nt, Human
caccacacccagccc

SEQ ID NO: 3172944 - RNA, 13 nt, Human
caccacacccagc

SEQ ID NO: 3172945 - RNA, 19 nt, Human
caccaagccuggucagccc

SEQ ID NO: 3172946 - RNA, 21 nt, Human
caccaagccuggucagcccaa

SEQ ID NO: 3172947 - RNA, 20 nt, Human
caccaagccuggucagccca

SEQ ID NO: 3172948 - RNA, 15 nt, Human
caccaagcccaguua

SEQ ID NO: 3172949 - RNA, 14 nt, Human
caccaccucuuugg

SEQ ID NO: 3172950 - RNA, 18 nt, Human
caccacaugugcacaugc

SEQ ID NO: 3172951 - RNA, 15 nt, Human
caccacaugugcaca

SEQ ID NO: 3172952 - RNA, 19 nt, Human
caccacaugugcacaugca

SEQ ID NO: 3172953 - RNA, 23 nt, Human
caccacauaaggucagcucagag

SEQ ID NO: 3172954 - RNA, 17 nt, Human
caccacccuccuuccca

SEQ ID NO: 3172955 - RNA, 21 nt, Human
cacauagugaugguuccccug

SEQ ID NO: 3172956 - RNA, 23 nt, Human
cacauauaaauugucuuaaugga

SEQ ID NO: 3172957 - RNA, 17 nt, Human
cacauacacacacacgc

SEQ ID NO: 3172958 - RNA, 20 nt, Human
cacauacacccaaacacuua

SEQ ID NO: 3172959 - RNA, 15 nt, Human
cacauaauuaacacu

SEQ ID NO: 3172960 - RNA, 14 nt, Human
cacaguuuucugag

SEQ ID NO: 3172961 - RNA, 22 nt, Human
cacauaauucaggaagcagcuu

SEQ ID NO: 3172962 - RNA, 23 nt, Human
cacaggcccggcuccaggcuccu

SEQ ID NO: 3172963 - RNA, 20 nt, Human
cacaggcccggcuccaggcu

SEQ ID NO: 3172964 - RNA, 18 nt, Human
cacagugagucgaggaca

SEQ ID NO: 3172965 - RNA, 18 nt, Human
cacaggcagggcaggacc

SEQ ID NO: 3172966 - RNA, 14 nt, Human
cacaggcagggcag

SEQ ID NO: 3172967 - RNA, 13 nt, Human
cacaggcagggca

SEQ ID NO: 3172968 - RNA, 12 nt, Human
cacaggcagggc

SEQ ID NO: 3172969 - RNA, 20 nt, Human
cacagugagucgaggacagg

SEQ ID NO: 3172970 - RNA, 19 nt, Human
cacagugagucgaggacag

SEQ ID NO: 3172971 - RNA, 10 nt, Human
cacaggcagg

SEQ ID NO: 3172972 - RNA, 19 nt, Human
cacaggcccggcuccaggc

SEQ ID NO: 3172973 - RNA, 18 nt, Human
cacaggcccggcuccagg

SEQ ID NO: 3172974 - RNA, 17 nt, Human
cacaggcccggcuccag

SEQ ID NO: 3172975 - RNA, 16 nt, Human
cacaggcccggcucca

SEQ ID NO: 3172976 - RNA, 16 nt, Human
cacaggaucagucuga

SEQ ID NO: 3172977 - RNA, 15 nt, Human
cacaggaucagucug

SEQ ID NO: 3172978 - RNA, 12 nt, Human
cacaggaucagu

SEQ ID NO: 3172979 - RNA, 22 nt, Human
cacagcaguugaaaagacucca

SEQ ID NO: 3172980 - RNA, 14 nt, Human
cacagcauuucaag

SEQ ID NO: 3172981 - RNA, 20 nt, Human
cacagaugggugcuuggagg

SEQ ID NO: 3172982 - RNA, 20 nt, Human
cacagcacgggggccaagga

SEQ ID NO: 3172983 - RNA, 21 nt, Human
cacagcacuugaguaaaauac

SEQ ID NO: 3172984 - RNA, 16 nt, Human
cacagcagccccugca

SEQ ID NO: 3172985 - RNA, 14 nt, Human
cacagaugggugcu

SEQ ID NO: 3172986 - RNA, 18 nt, Human
cacagaugggugcuugga

SEQ ID NO: 3172987 - RNA, 20 nt, Human
cacagagccaaauugguaga

SEQ ID NO: 3172988 - RNA, 14 nt, Human
cacacaccagagcc

SEQ ID NO: 3172989 - RNA, 12 nt, Human
cacacagcucug

SEQ ID NO: 3172990 - RNA, 19 nt, Human
cacacagaggcugccucuc

SEQ ID NO: 3172991 - RNA, 22 nt, Human
cacacagaaggggacugccacc

SEQ ID NO: 3172992 - RNA, 12 nt, Human
cacacagaaggg

SEQ ID NO: 3172993 - RNA, 13 nt, Human
cacaccuccuggg

SEQ ID NO: 3172994 - RNA, 23 nt, Human
cacaccuccucccacugcccacu

SEQ ID NO: 3172995 - RNA, 18 nt, Human
cacaccugcagccucccu

SEQ ID NO: 3172996 - RNA, 16 nt, Human
cacaccuguaauucca

SEQ ID NO: 3172997 - RNA, 15 nt, Human
cacaccccaccugcg

SEQ ID NO: 3172998 - RNA, 14 nt, Human
cacaccccaccugc

SEQ ID NO: 3172999 - RNA, 13 nt, Human
cacaccccaccug

SEQ ID NO: 3173000 - RNA, 12 nt, Human
cacaccccaccu

SEQ ID NO: 3173001 - RNA, 17 nt, Human
cacaccccaccugcgcu

SEQ ID NO: 3173002 - RNA, 16 nt, Human
cacaccccaccugcgc

SEQ ID NO: 3173003 - RNA, 19 nt, Human
cacaccccaccugcgcuuc

SEQ ID NO: 3173004 - RNA, 14 nt, Human
cacacccuguuuua

SEQ ID NO: 3173005 - RNA, 22 nt, Human
cacaccuccucccacugcccac

SEQ ID NO: 3173006 - RNA, 13 nt, Human
cacaccagagccc

SEQ ID NO: 3173007 - RNA, 12 nt, Human
cacaccagagcc

SEQ ID NO: 3173008 - RNA, 15 nt, Human
cacaccagagcccac

SEQ ID NO: 3173009 - RNA, 23 nt, Human
cacaccaaucuuacuuuguaaau

SEQ ID NO: 3173010 - RNA, 12 nt, Human
cacacuuagcug

SEQ ID NO: 3173011 - RNA, 16 nt, Human
cacacuuagcuggaga

SEQ ID NO: 3173012 - RNA, 17 nt, Human
cacacuucaggcucuuc

SEQ ID NO: 3173013 - RNA, 14 nt, Human
cacacuucaggcuc

SEQ ID NO: 3173014 - RNA, 22 nt, Human
cacacuucaggcucuucuccuu

SEQ ID NO: 3173015 - RNA, 21 nt, Human
cacacuucaggcucuucuccu

SEQ ID NO: 3173016 - RNA, 20 nt, Human
cacacuucaggcucuucucc

SEQ ID NO: 3173017 - RNA, 18 nt, Human
cacacuucaggcucuucu

SEQ ID NO: 3173018 - RNA, 19 nt, Human
cacacucaaaucaagaaac

SEQ ID NO: 3173019 - RNA, 21 nt, Human
cacacuugacaucaacugcau

SEQ ID NO: 3173020 - RNA, 22 nt, Human
cacagacccugcccugugggcc

SEQ ID NO: 3173021 - RNA, 23 nt, Human
cacacuugucggcuccagucccc

SEQ ID NO: 3173022 - RNA, 22 nt, Human
cacacuugucggcuccaguccc

SEQ ID NO: 3173023 - RNA, 18 nt, Human
cacacuugucggcuccag

SEQ ID NO: 3173024 - RNA, 17 nt, Human
cacacuugucggcucca

SEQ ID NO: 3173025 - RNA, 21 nt, Human
cacagagaaaguacuucucca

SEQ ID NO: 3173026 - RNA, 20 nt, Human
cacagacuuuagcuuucuga

SEQ ID NO: 3173027 - RNA, 11 nt, Human
cacaacagauu

SEQ ID NO: 3173028 - RNA, 15 nt, Human
cacaaauuucucugu

SEQ ID NO: 3173029 - RNA, 20 nt, Human
cacaaauuaugcuaagaauu

SEQ ID NO: 3173030 - RNA, 22 nt, Human
cacaacacacagauuugagcuc

SEQ ID NO: 3173031 - RNA, 14 nt, Human
cacaacccccagcu

SEQ ID NO: 3173032 - RNA, 18 nt, Human
cacaacccccagcucccg

SEQ ID NO: 3173033 - RNA, 17 nt, Human
cacaacccccagcuccc

SEQ ID NO: 3173034 - RNA, 16 nt, Human
cacaacccccagcucc

SEQ ID NO: 3173035 - RNA, 15 nt, Human
cacaacccccagcuc

SEQ ID NO: 3173036 - RNA, 23 nt, Human
cacaaccuucuguggcucacaga

SEQ ID NO: 3173037 - RNA, 19 nt, Human
cacaaccuucuguggcuca

SEQ ID NO: 3173038 - RNA, 18 nt, Human
cacaaccuucuguggcuc

SEQ ID NO: 3173039 - RNA, 17 nt, Human
cacaaccuucuguggcu

SEQ ID NO: 3173040 - RNA, 18 nt, Human
cacaaaaguuucucuuuu

SEQ ID NO: 3173041 - RNA, 16 nt, Human
cacaaaaguuucucuu

SEQ ID NO: 3173042 - RNA, 22 nt, Human
cacaaaaagauaccuuaaaauu

SEQ ID NO: 3173043 - RNA, 22 nt, Human
caauuuuaacuuagagcuuuuu

SEQ ID NO: 3173044 - RNA, 11 nt, Human
caauuuuccuu

SEQ ID NO: 3173045 - RNA, 21 nt, Human
caauuuuccuucagauauuuu

SEQ ID NO: 3173046 - RNA, 22 nt, Human
caauuuuauaaggacuuccuga

SEQ ID NO: 3173047 - RNA, 12 nt, Human
caauuuucagau

SEQ ID NO: 3173048 - RNA, 19 nt, Human
caauuuucagauuugcaca

SEQ ID NO: 3173049 - RNA, 16 nt, Human
caauuuucagauuugc

SEQ ID NO: 3173050 - RNA, 14 nt, Human
caauuuucagauuu

SEQ ID NO: 3173051 - RNA, 12 nt, Human
caaugugaaaaa

SEQ ID NO: 3173052 - RNA, 14 nt, Human
caaugugaaaaauc

SEQ ID NO: 3173053 - RNA, 18 nt, Human
caauuaaagaaauaauuu

SEQ ID NO: 3173054 - RNA, 17 nt, Human
caauuaaagaaauaauu

SEQ ID NO: 3173055 - RNA, 19 nt, Human
caauuaaacuuccaaagaa

SEQ ID NO: 3173056 - RNA, 15 nt, Human
caauuaaagaaauaa

SEQ ID NO: 3173057 - RNA, 13 nt, Human
caauuaaagaaau

SEQ ID NO: 3173058 - RNA, 21 nt, Human
caauaucuuuuuuuuaauaaa

SEQ ID NO: 3173059 - RNA, 21 nt, Human
caauaggaaaaacugauuuuu

SEQ ID NO: 3173060 - RNA, 21 nt, Human
caauaggaugggcuucugugc

SEQ ID NO: 3173061 - RNA, 15 nt, Human
caauaggcaaauuaa

SEQ ID NO: 3173062 - RNA, 17 nt, Human
caauaggcaaauuaauc

SEQ ID NO: 3173063 - RNA, 20 nt, Human
caauaggaaaaacugauuuu

SEQ ID NO: 3173064 - RNA, 18 nt, Human
caauaggaaaaacugauu

SEQ ID NO: 3173065 - RNA, 22 nt, Human
caaugaaugaaugaauggcuaa

SEQ ID NO: 3173066 - RNA, 17 nt, Human
caaugaauauacucauu

SEQ ID NO: 3173067 - RNA, 18 nt, Human
caaugaauauacucauua

SEQ ID NO: 3173068 - RNA, 19 nt, Human
caaugcaaaccaucauuga

SEQ ID NO: 3173069 - RNA, 22 nt, Human
caaugcacuuuguucuggcucu

SEQ ID NO: 3173070 - RNA, 23 nt, Human
caaugcacuuuguucuggcucuu

SEQ ID NO: 3173071 - RNA, 13 nt, Human
caaugcagaacuc

SEQ ID NO: 3173072 - RNA, 14 nt, Human
caaugcaaaccauc

SEQ ID NO: 3173073 - RNA, 13 nt, Human
caaugaauuauua

SEQ ID NO: 3173074 - RNA, 17 nt, Human
caaugcaaaccaucauu

SEQ ID NO: 3173075 - RNA, 18 nt, Human
caaugcaaaccaucauug

SEQ ID NO: 3173076 - RNA, 11 nt, Human
uuuguggggag

SEQ ID NO: 3173077 - RNA, 13 nt, Human
uuuguggugauuu

SEQ ID NO: 3173078 - RNA, 15 nt, Human
uuugugguuuggaau

SEQ ID NO: 3173079 - RNA, 16 nt, Human
uuugugguuuggaaua

SEQ ID NO: 3173080 - RNA, 23 nt, Human
uuuguguaauauuacuuuaacau

SEQ ID NO: 3173081 - RNA, 21 nt, Human
uuuguguaaauuauugaugaa

SEQ ID NO: 3173082 - RNA, 12 nt, Human
uuuguguaaauu

SEQ ID NO: 3173083 - RNA, 16 nt, Human
uuggcagcucuacucu

SEQ ID NO: 3173084 - RNA, 22 nt, Human
uuggcagaugcagcucuuccug

SEQ ID NO: 3173085 - RNA, 13 nt, Human
uuggcagaugcag

SEQ ID NO: 3173086 - RNA, 21 nt, Human
uuggcagaugcagcucuuccu

SEQ ID NO: 3173087 - RNA, 16 nt, Human
uuggcagaugcagcuc

SEQ ID NO: 3173088 - RNA, 19 nt, Human
uuggcacuugccauuccaa

SEQ ID NO: 3173089 - RNA, 20 nt, Human
uuggcacuugccauuccaaa

SEQ ID NO: 3173090 - RNA, 23 nt, Human
uuggcaccuucccccucccccag

SEQ ID NO: 3173091 - RNA, 16 nt, Human
uuggcaccuucccccu

SEQ ID NO: 3173092 - RNA, 20 nt, Human
uuggcaauaaauuuugaaaa

SEQ ID NO: 3173093 - RNA, 22 nt, Human
uuggcaauaaauuuugaaaagu

SEQ ID NO: 3173094 - RNA, 18 nt, Human
uuggcaauaaauuuugaa

SEQ ID NO: 3173095 - RNA, 24 nt, Human
uuggauuuuauguugacauuuguu

SEQ ID NO: 3173096 - RNA, 22 nt, Human
uuggauuuuauguugacauuug

SEQ ID NO: 3173097 - RNA, 19 nt, Human
uuggauuuggagagaaaua

SEQ ID NO: 3173098 - RNA, 14 nt, Human
uuggauuuggagag

SEQ ID NO: 3173099 - RNA, 20 nt, Human
uuggauuuuauguugacauu

SEQ ID NO: 3173100 - RNA, 18 nt, Human
uuggauuuuauguugaca

SEQ ID NO: 3173101 - RNA, 17 nt, Human
uuggauuuuauguugac

SEQ ID NO: 3173102 - RNA, 13 nt, Human
uuggauuuuaugu

SEQ ID NO: 3173103 - RNA, 14 nt, Human
uuggauuguccccg

SEQ ID NO: 3173104 - RNA, 15 nt, Human
uuggauuguccccga

SEQ ID NO: 3173105 - RNA, 15 nt, Human
uuggacccugaggcc

SEQ ID NO: 3173106 - RNA, 18 nt, Human
uuggacccugaggcccag

SEQ ID NO: 3173107 - RNA, 19 nt, Human
uuggacccugaggcccaga

SEQ ID NO: 3173108 - RNA, 21 nt, Human
uuggacccugaggcccagagg

SEQ ID NO: 3173109 - RNA, 22 nt, Human
uuggaagcacaccaaucuuacu

SEQ ID NO: 3173110 - RNA, 18 nt, Human
uuggaagcagguuaaaug

SEQ ID NO: 3173111 - RNA, 19 nt, Human
uuggaagcuccgcuuucua

SEQ ID NO: 3173112 - RNA, 18 nt, Human
uuggaagcuguuuggaaa

SEQ ID NO: 3173113 - RNA, 21 nt, Human
uuggaagcuguuuggaaaaga

SEQ ID NO: 3173114 - RNA, 21 nt, Human
uuggaagcagguuaaauguuu

SEQ ID NO: 3173115 - RNA, 20 nt, Human
uuggaagcagguuaaauguu

SEQ ID NO: 3173116 - RNA, 19 nt, Human
uuggaagcagguuaaaugu

SEQ ID NO: 3173117 - RNA, 19 nt, Human
uugcugugacagugauggc

SEQ ID NO: 3173118 - RNA, 21 nt, Human
uuggacauaacugacuuaguu

SEQ ID NO: 3173119 - RNA, 22 nt, Human
uuggacauaacugacuuaguuc

SEQ ID NO: 3173120 - RNA, 18 nt, Human
uuggacacuuaauucugu

SEQ ID NO: 3173121 - RNA, 19 nt, Human
uuggacacuuaauucuguu

SEQ ID NO: 3173122 - RNA, 23 nt, Human
uuggaauuagaacccuugcacag

SEQ ID NO: 3173123 - RNA, 13 nt, Human
uuggaauauuaaa

SEQ ID NO: 3173124 - RNA, 16 nt, Human
uuggaauauuaaaaaa

SEQ ID NO: 3173125 - RNA, 17 nt, Human
uuggaauauuaaaaaac

SEQ ID NO: 3173126 - RNA, 23 nt, Human
uuggaauauuaaaaaacuucaug

SEQ ID NO: 3173127 - RNA, 23 nt, Human
uuggaaugcacucagacuguaua

SEQ ID NO: 3173128 - RNA, 21 nt, Human
uuggaaugcacucagacugua

SEQ ID NO: 3173129 - RNA, 16 nt, Human
uugcggcaaaaggaaa

SEQ ID NO: 3173130 - RNA, 17 nt, Human
uugcggcaaaaggaaag

SEQ ID NO: 3173131 - RNA, 14 nt, Human
uugcugcuugaggc

SEQ ID NO: 3173132 - RNA, 16 nt, Human
uugcugcuugaggcaa

SEQ ID NO: 3173133 - RNA, 17 nt, Human
uugcugcugauaaugua

SEQ ID NO: 3173134 - RNA, 18 nt, Human
uugcugucccuuuuccuu

SEQ ID NO: 3173135 - RNA, 16 nt, Human
uugcugucccuuuucc

SEQ ID NO: 3173136 - RNA, 14 nt, Human
uugcuggaaagagc

SEQ ID NO: 3173137 - RNA, 21 nt, Human
uugcgaauauuuuguaaauua

SEQ ID NO: 3173138 - RNA, 17 nt, Human
uugccuuugaagaguga

SEQ ID NO: 3173139 - RNA, 14 nt, Human
uugccuuugaagag

SEQ ID NO: 3173140 - RNA, 19 nt, Human
uugccuuucuguguuuauu

SEQ ID NO: 3173141 - RNA, 17 nt, Human
uugccuuucuguguuua

SEQ ID NO: 3173142 - RNA, 14 nt, Human
uugccuuucugugu

SEQ ID NO: 3173143 - RNA, 12 nt, Human
uugccuuucugu

SEQ ID NO: 3173144 - RNA, 21 nt, Human
uugccauguuggccaggcugg

SEQ ID NO: 3173145 - RNA, 20 nt, Human
uugccauguuggccaggcug

SEQ ID NO: 3173146 - RNA, 13 nt, Human
uugccaugugcuu

SEQ ID NO: 3173147 - RNA, 20 nt, Human
uugccaugugcuucugccac

SEQ ID NO: 3173148 - RNA, 20 nt, Human
uugggaccccuggugguuca

SEQ ID NO: 3173149 - RNA, 16 nt, Human
uugggaccccuggugg

SEQ ID NO: 3173150 - RNA, 15 nt, Human
uugggaccccuggug

SEQ ID NO: 3173151 - RNA, 14 nt, Human
uugggaccccuggu

SEQ ID NO: 3173152 - RNA, 22 nt, Human
uugggaaguuaaagggaagaaa

SEQ ID NO: 3173153 - RNA, 18 nt, Human
uugggaagagcuuagaaa

SEQ ID NO: 3173154 - RNA, 17 nt, Human
uugggaagagcuuagaa

SEQ ID NO: 3173155 - RNA, 15 nt, Human
uugggacccaguggc

SEQ ID NO: 3173156 - RNA, 22 nt, Human
uugggacccaguggcagggcac

SEQ ID NO: 3173157 - RNA, 20 nt, Human
uugggacccaguggcagggc

SEQ ID NO: 3173158 - RNA, 14 nt, Human
uugggaauuuuauu

SEQ ID NO: 3173159 - RNA, 23 nt, Human
uuggcuucacggaagagccuugc

SEQ ID NO: 3173160 - RNA, 13 nt, Human
uuggcuuggcccu

SEQ ID NO: 3173161 - RNA, 16 nt, Human
uuggcuugccauuuuu

SEQ ID NO: 3173162 - RNA, 20 nt, Human
uuggcagguaggaauauuau

SEQ ID NO: 3173163 - RNA, 19 nt, Human
uuggcagguaggaauauua

SEQ ID NO: 3173164 - RNA, 22 nt, Human
uugggcaauauucucuguacau

SEQ ID NO: 3173165 - RNA, 21 nt, Human
uugggcaauauucucuguaca

SEQ ID NO: 3173166 - RNA, 19 nt, Human
uugggcaauauucucugua

SEQ ID NO: 3173167 - RNA, 19 nt, Human
uugggauccaggccccucc

SEQ ID NO: 3173168 - RNA, 21 nt, Human
uugggauccaggccccucccu

SEQ ID NO: 3173169 - RNA, 12 nt, Human
uuguaaaauggu

SEQ ID NO: 3173170 - RNA, 13 nt, Human
uuguaaaauggug

SEQ ID NO: 3173171 - RNA, 20 nt, Human
uuggucugacccacugcuuu

SEQ ID NO: 3173172 - RNA, 21 nt, Human
uuggucucccauaugcagaaa

SEQ ID NO: 3173173 - RNA, 13 nt, Human
uugguccugcugc

SEQ ID NO: 3173174 - RNA, 21 nt, Human
uugguccuggaggcucaaauu

SEQ ID NO: 3173175 - RNA, 15 nt, Human
uuguacuuuaaaaau

SEQ ID NO: 3173176 - RNA, 17 nt, Human
uuguacuuucuguuaaa

SEQ ID NO: 3173177 - RNA, 15 nt, Human
uuguacuuucuguua

SEQ ID NO: 3173178 - RNA, 13 nt, Human
uuguacuuucugu

SEQ ID NO: 3173179 - RNA, 15 nt, Human
uuguacuuuaucaug

SEQ ID NO: 3173180 - RNA, 19 nt, Human
uuguacuuuaucaugaaug

SEQ ID NO: 3173181 - RNA, 22 nt, Human
uuguacuuucuguuaaaaugca

SEQ ID NO: 3173182 - RNA, 20 nt, Human
uuguacuuucuguuaaaaug

SEQ ID NO: 3173183 - RNA, 14 nt, Human
uuguagauuugauu

SEQ ID NO: 3173184 - RNA, 15 nt, Human
uuguagauuugauuu

SEQ ID NO: 3173185 - RNA, 16 nt, Human
uuguaccgcaauguga

SEQ ID NO: 3173186 - RNA, 15 nt, Human
uuguaccaaaauuuu

SEQ ID NO: 3173187 - RNA, 18 nt, Human
uuguaccaaaauuuuaaa

SEQ ID NO: 3173188 - RNA, 21 nt, Human
uuguaaacuuugaaauauaug

SEQ ID NO: 3173189 - RNA, 19 nt, Human
uuguaaacuuugaaauaua

SEQ ID NO: 3173190 - RNA, 18 nt, Human
uuguaaacuuugaaauau

SEQ ID NO: 3173191 - RNA, 20 nt, Human
uuguaaaauggugugaccac

SEQ ID NO: 3173192 - RNA, 15 nt, Human
uuguaaaauguauua

SEQ ID NO: 3173193 - RNA, 18 nt, Human
uuguaaaauguauuaugu

SEQ ID NO: 3173194 - RNA, 12 nt, Human
uuguaaacuuug

SEQ ID NO: 3173195 - RNA, 17 nt, Human
uuguaaacuuugaaaua

SEQ ID NO: 3173196 - RNA, 15 nt, Human
uuguaaacuuugaaa

SEQ ID NO: 3173197 - RNA, 14 nt, Human
uuguaaacuuugaa

SEQ ID NO: 3173198 - RNA, 13 nt, Human
uuguaaacuuuga

SEQ ID NO: 3173199 - RNA, 22 nt, Human
uugucaagaauagcauuguaaa

SEQ ID NO: 3173200 - RNA, 20 nt, Human
uugucuaugggacucaaugc

SEQ ID NO: 3173201 - RNA, 23 nt, Human
uugucuauuuuucucuucauauu

SEQ ID NO: 3173202 - RNA, 22 nt, Human
uugucuuaaaaaguggaaaaau

SEQ ID NO: 3173203 - RNA, 18 nt, Human
uugucugaagucacugca

SEQ ID NO: 3173204 - RNA, 13 nt, Human
uugucuuaaugga

SEQ ID NO: 3173205 - RNA, 17 nt, Human
uugucugaagucacugc

SEQ ID NO: 3173206 - RNA, 15 nt, Human
uugucugaaacauuu

SEQ ID NO: 3173207 - RNA, 17 nt, Human
uugucugaaacauuuca

SEQ ID NO: 3173208 - RNA, 15 nt, Human
uugucucuucuccuu

SEQ ID NO: 3173209 - RNA, 22 nt, Human
uugucaaaguggugagaggcau

SEQ ID NO: 3173210 - RNA, 14 nt, Human
uugucuaugggacu

SEQ ID NO: 3173211 - RNA, 15 nt, Human
uuguauuuuuccaga

SEQ ID NO: 3173212 - RNA, 16 nt, Human
uuguauuuuuguuguu

SEQ ID NO: 3173213 - RNA, 19 nt, Human
uuguauuuuuguuguuggg

SEQ ID NO: 3173214 - RNA, 20 nt, Human
uuguauuuuacuaauaaaau

SEQ ID NO: 3173215 - RNA, 24 nt, Human
uuguaugcaagcaguuucaauaaa

SEQ ID NO: 3173216 - RNA, 22 nt, Human
uuguaugcaagcaguuucaaua

SEQ ID NO: 3173217 - RNA, 20 nt, Human
uuguaugcaagcaguuucaa

SEQ ID NO: 3173218 - RNA, 19 nt, Human
uuguaugcaagcaguuuca

SEQ ID NO: 3173219 - RNA, 22 nt, Human
uuguaugaaagauggcugugcc

SEQ ID NO: 3173220 - RNA, 17 nt, Human
uuguaugaaauauaugu

SEQ ID NO: 3173221 - RNA, 22 nt, Human
uuguaugaaauauaugugaaag

SEQ ID NO: 3173222 - RNA, 20 nt, Human
uuguaugauccuaaugaaug

SEQ ID NO: 3173223 - RNA, 12 nt, Human
uuguaugaaaac

SEQ ID NO: 3173224 - RNA, 19 nt, Human
uuguaugaucugugccuuu

SEQ ID NO: 3173225 - RNA, 13 nt, Human
uuguaugaucugu

SEQ ID NO: 3173226 - RNA, 22 nt, Human
uugaaugacuaagaggaaagua

SEQ ID NO: 3173227 - RNA, 12 nt, Human
uugaaugaugcc

SEQ ID NO: 3173228 - RNA, 16 nt, Human
uugaaugaugccauga

SEQ ID NO: 3173229 - RNA, 18 nt, Human
uugaagagcagcuccuuc

SEQ ID NO: 3173230 - RNA, 14 nt, Human
uugaagagugaaau

SEQ ID NO: 3173231 - RNA, 19 nt, Human
uugaagaggggagcucagu

SEQ ID NO: 3173232 - RNA, 16 nt, Human
uugaagcaaacaguug

SEQ ID NO: 3173233 - RNA, 21 nt, Human
uucuuuccugaggcugggcuc

SEQ ID NO: 3173234 - RNA, 11 nt, Human
uucuuuacaaa

SEQ ID NO: 3173235 - RNA, 16 nt, Human
uugaaaauugaaaagu

SEQ ID NO: 3173236 - RNA, 14 nt, Human
uucuuucccuuccu

SEQ ID NO: 3173237 - RNA, 14 nt, Human
uugaaaauaguuua

SEQ ID NO: 3173238 - RNA, 23 nt, Human
uugaaaauaguuuauuuuaaaac

SEQ ID NO: 3173239 - RNA, 11 nt, Human
uugaaacauug

SEQ ID NO: 3173240 - RNA, 14 nt, Human
uugaaacauugcuu

SEQ ID NO: 3173241 - RNA, 12 nt, Human
uugaaacauugc

SEQ ID NO: 3173242 - RNA, 19 nt, Human
uugaaacauugcuuuuaaa

SEQ ID NO: 3173243 - RNA, 18 nt, Human
uugaaacauugcuuuuaa

SEQ ID NO: 3173244 - RNA, 13 nt, Human
uucuucagagacu

SEQ ID NO: 3173245 - RNA, 17 nt, Human
uucuuauuacuagacug

SEQ ID NO: 3173246 - RNA, 17 nt, Human
uucuuauguugcccagu

SEQ ID NO: 3173247 - RNA, 15 nt, Human
uucuucauguucaau

SEQ ID NO: 3173248 - RNA, 17 nt, Human
uucuuauuccauauuag

SEQ ID NO: 3173249 - RNA, 21 nt, Human
uucuaaguaaaaccacagcag

SEQ ID NO: 3173250 - RNA, 24 nt, Human
uucuaaguaaaaccacagcaguug

SEQ ID NO: 3173251 - RNA, 20 nt, Human
uucuaaguugaguauauuau

SEQ ID NO: 3173252 - RNA, 23 nt, Human
uucuaagucaaacacuugugacu

SEQ ID NO: 3173253 - RNA, 20 nt, Human
uucuggcagaguugaagaca

SEQ ID NO: 3173254 - RNA, 15 nt, Human
uucuggcagaggagg

SEQ ID NO: 3173255 - RNA, 23 nt, Human
uucuguauagacaggagaagaaa

SEQ ID NO: 3173256 - RNA, 18 nt, Human
uucuguauagacaggaga

SEQ ID NO: 3173257 - RNA, 11 nt, Human
uucuguauuug

SEQ ID NO: 3173258 - RNA, 13 nt, Human
uucuguauuugaa

SEQ ID NO: 3173259 - RNA, 23 nt, Human
uucugugcuguuacaguuuucuu

SEQ ID NO: 3173260 - RNA, 24 nt, Human
uucugugcccagaauacugaugga

SEQ ID NO: 3173261 - RNA, 14 nt, Human
uucugugcaccugg

SEQ ID NO: 3173262 - RNA, 19 nt, Human
uucugugcccagaauacug

SEQ ID NO: 3173263 - RNA, 20 nt, Human
uucugugcccagaauacuga

SEQ ID NO: 3173264 - RNA, 23 nt, Human
uucugugcccagaauacugaugg

SEQ ID NO: 3173265 - RNA, 18 nt, Human
uugaucucccuuuccuau

SEQ ID NO: 3173266 - RNA, 12 nt, Human
uugaucucccca

SEQ ID NO: 3173267 - RNA, 14 nt, Human
uugaucucacauuu

SEQ ID NO: 3173268 - RNA, 16 nt, Human
uugauucagcucugca

SEQ ID NO: 3173269 - RNA, 23 nt, Human
uugauucagacagcugccuggga

SEQ ID NO: 3173270 - RNA, 17 nt, Human
uugauucagacagcugc

SEQ ID NO: 3173271 - RNA, 21 nt, Human
uugauucagacagcugccugg

SEQ ID NO: 3173272 - RNA, 20 nt, Human
uugaggcuuauauuugugua

SEQ ID NO: 3173273 - RNA, 16 nt, Human
uugauaugcuuauaca

SEQ ID NO: 3173274 - RNA, 18 nt, Human
uugaucaguaguuugcau

SEQ ID NO: 3173275 - RNA, 17 nt, Human
uugaucaguaguuugca

SEQ ID NO: 3173276 - RNA, 15 nt, Human
uugauauucuaagaa

SEQ ID NO: 3173277 - RNA, 18 nt, Human
uugauauucuaagaaaua

SEQ ID NO: 3173278 - RNA, 22 nt, Human
uugauauucuaagaaauaucug

SEQ ID NO: 3173279 - RNA, 23 nt, Human
uugauauucuaagaaauaucugu

SEQ ID NO: 3173280 - RNA, 15 nt, Human
uugauauuuguauuu

SEQ ID NO: 3173281 - RNA, 13 nt, Human
uugauauuuguau

SEQ ID NO: 3173282 - RNA, 22 nt, Human
uugauauuuucaacgcagcccu

SEQ ID NO: 3173283 - RNA, 22 nt, Human
uugauauuuguauuuauucuuu

SEQ ID NO: 3173284 - RNA, 14 nt, Human
uugagccugggagg

SEQ ID NO: 3173285 - RNA, 12 nt, Human
uugaauuaucag

SEQ ID NO: 3173286 - RNA, 20 nt, Human
uugaauuaucagcaaagaaa

SEQ ID NO: 3173287 - RNA, 19 nt, Human
uugagcuacuggauucuua

SEQ ID NO: 3173288 - RNA, 20 nt, Human
uugagcuacuggauucuuau

SEQ ID NO: 3173289 - RNA, 11 nt, Human
uugagcuauga

SEQ ID NO: 3173290 - RNA, 14 nt, Human
uugagcuaugacuu

SEQ ID NO: 3173291 - RNA, 13 nt, Human
uugagcucagccc

SEQ ID NO: 3173292 - RNA, 15 nt, Human
uugagcuaugacuua

SEQ ID NO: 3173293 - RNA, 16 nt, Human
uugagcuaugacuuaa

SEQ ID NO: 3173294 - RNA, 22 nt, Human
uugagcucccacuucugccaga

SEQ ID NO: 3173295 - RNA, 13 nt, Human
uugagcuccuggg

SEQ ID NO: 3173296 - RNA, 12 nt, Human
uugagcucccac

SEQ ID NO: 3173297 - RNA, 16 nt, Human
uugaggagugguuuuu

SEQ ID NO: 3173298 - RNA, 16 nt, Human
uugaggagcacugaaa

SEQ ID NO: 3173299 - RNA, 14 nt, Human
uugaggauuaguuu

SEQ ID NO: 3173300 - RNA, 17 nt, Human
uugaggauuaguuuaga

SEQ ID NO: 3173301 - RNA, 18 nt, Human
uugaggauuaguuuagaa

SEQ ID NO: 3173302 - RNA, 19 nt, Human
uugaggauuaguuuagaac

SEQ ID NO: 3173303 - RNA, 15 nt, Human
uugcaguuuuucauu

SEQ ID NO: 3173304 - RNA, 19 nt, Human
uugccaguaacacaggcca

SEQ ID NO: 3173305 - RNA, 17 nt, Human
uugccagcugcugagcc

SEQ ID NO: 3173306 - RNA, 22 nt, Human
uugccagcugcugagccgcaga

SEQ ID NO: 3173307 - RNA, 20 nt, Human
uugccagcugcugagccgca

SEQ ID NO: 3173308 - RNA, 12 nt, Human
uugccagcccau

SEQ ID NO: 3173309 - RNA, 20 nt, Human
uugccagcccauuugggcag

SEQ ID NO: 3173310 - RNA, 15 nt, Human
uugccagcccauuug

SEQ ID NO: 3173311 - RNA, 22 nt, Human
uugccaggaaaggagaguacuu

SEQ ID NO: 3173312 - RNA, 17 nt, Human
uugccaucucugcucca

SEQ ID NO: 3173313 - RNA, 15 nt, Human
uugccaucucugcuc

SEQ ID NO: 3173314 - RNA, 19 nt, Human
uugccauguuggccaggcu

SEQ ID NO: 3173315 - RNA, 18 nt, Human
uugccauguuggccaggc

SEQ ID NO: 3173316 - RNA, 17 nt, Human
uugccauguuggccagg

SEQ ID NO: 3173317 - RNA, 16 nt, Human
uugccauguuggccag

SEQ ID NO: 3173318 - RNA, 18 nt, Human
uugcagcucagaaccaca

SEQ ID NO: 3173319 - RNA, 17 nt, Human
uugcagcacagcugaga

SEQ ID NO: 3173320 - RNA, 23 nt, Human
uugcagacaggcaagcaccuccu

SEQ ID NO: 3173321 - RNA, 13 nt, Human
uugauucauaaug

SEQ ID NO: 3173322 - RNA, 17 nt, Human
uugauucauaaugacuu

SEQ ID NO: 3173323 - RNA, 22 nt, Human
uugcagacaggcaagcaccucc

SEQ ID NO: 3173324 - RNA, 21 nt, Human
uugcacuuucagacucucucu

SEQ ID NO: 3173325 - RNA, 22 nt, Human
uugcacuuuuucuuaaucauuu

SEQ ID NO: 3173326 - RNA, 17 nt, Human
uugcacuuuuucuuaau

SEQ ID NO: 3173327 - RNA, 15 nt, Human
uugcacuuucagacu

SEQ ID NO: 3173328 - RNA, 12 nt, Human
uugcacugaagu

SEQ ID NO: 3173329 - RNA, 11 nt, Human
uugcacugaag

SEQ ID NO: 3173330 - RNA, 16 nt, Human
uugcacugaaguuuga

SEQ ID NO: 3173331 - RNA, 13 nt, Human
uugcacugaaguu

SEQ ID NO: 3173332 - RNA, 16 nt, Human
uuucagccaagaauuc

SEQ ID NO: 3173333 - RNA, 17 nt, Human
uuucagccaagaauucu

SEQ ID NO: 3173334 - RNA, 14 nt, Human
uuucagccuaagag

SEQ ID NO: 3173335 - RNA, 16 nt, Human
uuucacagugugauuu

SEQ ID NO: 3173336 - RNA, 17 nt, Human
uuucacagcuaugaaga

SEQ ID NO: 3173337 - RNA, 20 nt, Human
uuucacagugugauuuugau

SEQ ID NO: 3173338 - RNA, 14 nt, Human
uuucaauguguaua

SEQ ID NO: 3173339 - RNA, 19 nt, Human
uuucaauguguauaaauug

SEQ ID NO: 3173340 - RNA, 23 nt, Human
uuucaaugugauauaaacagcuu

SEQ ID NO: 3173341 - RNA, 15 nt, Human
uuucaauguaauuaa

SEQ ID NO: 3173342 - RNA, 20 nt, Human
uuucaauguaauuaaacugu

SEQ ID NO: 3173343 - RNA, 19 nt, Human
uuuccacuccuccuagcca

SEQ ID NO: 3173344 - RNA, 18 nt, Human
uuuccacuccuccuagcc

SEQ ID NO: 3173345 - RNA, 14 nt, Human
uuuccaccuucuca

SEQ ID NO: 3173346 - RNA, 23 nt, Human
uuucauuuugcuuuaauuuuagc

SEQ ID NO: 3173347 - RNA, 15 nt, Human
uuuccaaaacaaaaa

SEQ ID NO: 3173348 - RNA, 22 nt, Human
uuuccaaaacaaaaagaugucu

SEQ ID NO: 3173349 - RNA, 15 nt, Human
uuucauuuugcuuua

SEQ ID NO: 3173350 - RNA, 20 nt, Human
uuucauuuugcuuuaauuuu

SEQ ID NO: 3173351 - RNA, 16 nt, Human
uuucauuuugcuuuaa

SEQ ID NO: 3173352 - RNA, 16 nt, Human
uuucaguaagaucaag

SEQ ID NO: 3173353 - RNA, 19 nt, Human
uuucaguaaaccugucuga

SEQ ID NO: 3173354 - RNA, 15 nt, Human
uuucagucaaaacuu

SEQ ID NO: 3173355 - RNA, 16 nt, Human
uuucagucaaaacuuu

SEQ ID NO: 3173356 - RNA, 21 nt, Human
uuucauuuuacaguuacuuuu

SEQ ID NO: 3173357 - RNA, 14 nt, Human
uuucauuuuaaaaa

SEQ ID NO: 3173358 - RNA, 16 nt, Human
uuucauuuuaaaaagu

SEQ ID NO: 3173359 - RNA, 17 nt, Human
uuucauuuuaaaaaguc

SEQ ID NO: 3173360 - RNA, 22 nt, Human
uuucagcuaggaacaaaucuuc

SEQ ID NO: 3173361 - RNA, 15 nt, Human
uuucagcuaggaaca

SEQ ID NO: 3173362 - RNA, 21 nt, Human
uuucagcuaggaacaaaucuu

SEQ ID NO: 3173363 - RNA, 19 nt, Human
uuucagcuaggaacaaauc

SEQ ID NO: 3173364 - RNA, 22 nt, Human
uuucaggugcucaaaaugcaaa

SEQ ID NO: 3173365 - RNA, 20 nt, Human
uuucaggugcucaaaaugca

SEQ ID NO: 3173366 - RNA, 19 nt, Human
uuucaggugcucaaaaugc

SEQ ID NO: 3173367 - RNA, 16 nt, Human
uuucaggugcucaaaa

SEQ ID NO: 3173368 - RNA, 14 nt, Human
uuucuaaaguacug

SEQ ID NO: 3173369 - RNA, 15 nt, Human
uuucuaaugugugaa

SEQ ID NO: 3173370 - RNA, 19 nt, Human
uuucuaauuggcuuuacua

SEQ ID NO: 3173371 - RNA, 14 nt, Human
uuucuaauuugcug

SEQ ID NO: 3173372 - RNA, 16 nt, Human
uuucuaauuugcugcu

SEQ ID NO: 3173373 - RNA, 17 nt, Human
uuucuaauuugcugcug

SEQ ID NO: 3173374 - RNA, 19 nt, Human
uuuccuggcacugcuucca

SEQ ID NO: 3173375 - RNA, 23 nt, Human
uuuccucugaggaugauguacuu

SEQ ID NO: 3173376 - RNA, 23 nt, Human
uuuccuggcacugcuuccaguga

SEQ ID NO: 3173377 - RNA, 17 nt, Human
uuuccucuuagaagaau

SEQ ID NO: 3173378 - RNA, 19 nt, Human
uuuccugggacaucuucug

SEQ ID NO: 3173379 - RNA, 19 nt, Human
uuucuccuuuuguguucca

SEQ ID NO: 3173380 - RNA, 16 nt, Human
uuucuccuuuuguguu

SEQ ID NO: 3173381 - RNA, 17 nt, Human
uuucuacucauuuuaau

SEQ ID NO: 3173382 - RNA, 13 nt, Human
uuucuacucauuu

SEQ ID NO: 3173383 - RNA, 18 nt, Human
uuucuacccagcgagccc

SEQ ID NO: 3173384 - RNA, 15 nt, Human
uuucuacccagcgag

SEQ ID NO: 3173385 - RNA, 22 nt, Human
uuucuacccagcgagcccuggu

SEQ ID NO: 3173386 - RNA, 19 nt, Human
uuucucucuauuucccccu

SEQ ID NO: 3173387 - RNA, 15 nt, Human
uuucucuuugaaaca

SEQ ID NO: 3173388 - RNA, 20 nt, Human
uuucucuuugaaacaugcuu

SEQ ID NO: 3173389 - RNA, 15 nt, Human
uuugauaagaaaacc

SEQ ID NO: 3173390 - RNA, 23 nt, Human
uuugauaacagggauugauuuua

SEQ ID NO: 3173391 - RNA, 14 nt, Human
uuugauaaauagug

SEQ ID NO: 3173392 - RNA, 13 nt, Human
uuugauaaauagu

SEQ ID NO: 3173393 - RNA, 23 nt, Human
uuugaggauuaguuuagaacagg

SEQ ID NO: 3173394 - RNA, 20 nt, Human
uuugaggcucaccagaauua

SEQ ID NO: 3173395 - RNA, 17 nt, Human
uuugaggauuaguuuag

SEQ ID NO: 3173396 - RNA, 18 nt, Human
uuugaggauuaguuuaga

SEQ ID NO: 3173397 - RNA, 19 nt, Human
uuugaggauuaguuuagaa

SEQ ID NO: 3173398 - RNA, 22 nt, Human
uuugaggauuaguuuagaacag

SEQ ID NO: 3173399 - RNA, 15 nt, Human
uuugaggagugguuu

SEQ ID NO: 3173400 - RNA, 19 nt, Human
uuugaggagugguuuuucu

SEQ ID NO: 3173401 - RNA, 16 nt, Human
uuugaggauuaguuua

SEQ ID NO: 3173402 - RNA, 18 nt, Human
uuugaggaaauuugcagc

SEQ ID NO: 3173403 - RNA, 21 nt, Human
uuugagaucuaaaaauaacug

SEQ ID NO: 3173404 - RNA, 18 nt, Human
uuugagaucuaaaaauaa

SEQ ID NO: 3173405 - RNA, 17 nt, Human
uuugagaucuaaaaaua

SEQ ID NO: 3173406 - RNA, 16 nt, Human
uuugagaucuaaaaau

SEQ ID NO: 3173407 - RNA, 14 nt, Human
uuugagaucuaaaa

SEQ ID NO: 3173408 - RNA, 16 nt, Human
uuugagaucagccugg

SEQ ID NO: 3173409 - RNA, 17 nt, Human
uuugagaucagccuggg

SEQ ID NO: 3173410 - RNA, 23 nt, Human
uuucugaucugaugcaagcaaga

SEQ ID NO: 3173411 - RNA, 13 nt, Human
uuucuugcucccu

SEQ ID NO: 3173412 - RNA, 18 nt, Human
uuucuugcucccugacug

SEQ ID NO: 3173413 - RNA, 19 nt, Human
uuucuuguguguuuauugu

SEQ ID NO: 3173414 - RNA, 21 nt, Human
uuucuuggacacuuaauucug

SEQ ID NO: 3173415 - RNA, 23 nt, Human
uuucuuggacacuuaauucuguu

SEQ ID NO: 3173416 - RNA, 14 nt, Human
uuucuuguaucugg

SEQ ID NO: 3173417 - RNA, 13 nt, Human
uuugaaccaauaa

SEQ ID NO: 3173418 - RNA, 19 nt, Human
uuugguagcugggaaagca

SEQ ID NO: 3173419 - RNA, 15 nt, Human
uuuggagagaaauau

SEQ ID NO: 3173420 - RNA, 14 nt, Human
uuuggagagaaaua

SEQ ID NO: 3173421 - RNA, 15 nt, Human
uuugguugaauaaac

SEQ ID NO: 3173422 - RNA, 14 nt, Human
uuugguugaauaaa

SEQ ID NO: 3173423 - RNA, 13 nt, Human
uuuguaaaaugua

SEQ ID NO: 3173424 - RNA, 15 nt, Human
uuuguaaaauguauu

SEQ ID NO: 3173425 - RNA, 16 nt, Human
uuuguaaaauguauua

SEQ ID NO: 3173426 - RNA, 17 nt, Human
uuugguugaauaaacua

SEQ ID NO: 3173427 - RNA, 22 nt, Human
uuuguauucaauuaaagaaaua

SEQ ID NO: 3173428 - RNA, 16 nt, Human
uuuguaugcacuuugu

SEQ ID NO: 3173429 - RNA, 15 nt, Human
uuuguauguauaauu

SEQ ID NO: 3173430 - RNA, 14 nt, Human
uuuguauguauaau

SEQ ID NO: 3173431 - RNA, 18 nt, Human
uuuguaaagauuucuguu

SEQ ID NO: 3173432 - RNA, 18 nt, Human
uuuguaaagaaaaauauu

SEQ ID NO: 3173433 - RNA, 17 nt, Human
uuuguaaagaaaaauau

SEQ ID NO: 3173434 - RNA, 16 nt, Human
uuuguaaagaaaaaua

SEQ ID NO: 3173435 - RNA, 15 nt, Human
uuuguaaagaaaaau

SEQ ID NO: 3173436 - RNA, 21 nt, Human
uuuguaaacuuugaaauauau

SEQ ID NO: 3173437 - RNA, 19 nt, Human
uuuguaaacuuugaaauau

SEQ ID NO: 3173438 - RNA, 16 nt, Human
uuuguaaacuuugaaa

SEQ ID NO: 3173439 - RNA, 15 nt, Human
uuuguaaacuuugaa

SEQ ID NO: 3173440 - RNA, 23 nt, Human
uuugcuuguggcuccacacacac

SEQ ID NO: 3173441 - RNA, 12 nt, Human
uuugcuuuaauu

SEQ ID NO: 3173442 - RNA, 15 nt, Human
uuuggacccugaggc

SEQ ID NO: 3173443 - RNA, 19 nt, Human
uuuggacccugaggcccag

SEQ ID NO: 3173444 - RNA, 13 nt, Human
uuuggacccugag

SEQ ID NO: 3173445 - RNA, 17 nt, Human
uuugcuuuaauuuuagc

SEQ ID NO: 3173446 - RNA, 15 nt, Human
uuuggacuuuguuac

SEQ ID NO: 3173447 - RNA, 13 nt, Human
uuugaucaugaau

SEQ ID NO: 3173448 - RNA, 12 nt, Human
uuugaucaugaa

SEQ ID NO: 3173449 - RNA, 15 nt, Human
uuugcauuucagaaa

SEQ ID NO: 3173450 - RNA, 21 nt, Human
uuugcauuucagaaagccuuu

SEQ ID NO: 3173451 - RNA, 19 nt, Human
uuugaucaugaauaacuga

SEQ ID NO: 3173452 - RNA, 10 nt, Human
uuugccagcc

SEQ ID NO: 3173453 - RNA, 17 nt, Human
uuugccagcccauuugg

SEQ ID NO: 3173454 - RNA, 20 nt, Human
uuuacagaggacaguauuug

SEQ ID NO: 3173455 - RNA, 21 nt, Human
uuuacagagaugucucuuaua

SEQ ID NO: 3173456 - RNA, 13 nt, Human
uuuacagagacag

SEQ ID NO: 3173457 - RNA, 12 nt, Human
uuuaaucagaaa

SEQ ID NO: 3173458 - RNA, 16 nt, Human
uuuaauaugaaauuuu

SEQ ID NO: 3173459 - RNA, 15 nt, Human
uuuaauaugaaauuu

SEQ ID NO: 3173460 - RNA, 13 nt, Human
uuuacagcugccu

SEQ ID NO: 3173461 - RNA, 14 nt, Human
uuuacauacuuuau

SEQ ID NO: 3173462 - RNA, 13 nt, Human
uuuacauagucug

SEQ ID NO: 3173463 - RNA, 23 nt, Human
uuuacauagucugaagugaagua

SEQ ID NO: 3173464 - RNA, 15 nt, Human
uuuacaguuacuuuu

SEQ ID NO: 3173465 - RNA, 21 nt, Human
uuuacaguuacuuuuccuugc

SEQ ID NO: 3173466 - RNA, 19 nt, Human
uuuacaguuacuuuuccuu

SEQ ID NO: 3173467 - RNA, 15 nt, Human
uuuacaguuauagaa

SEQ ID NO: 3173468 - RNA, 21 nt, Human
uuuaccaugcucaaugaaaag

SEQ ID NO: 3173469 - RNA, 13 nt, Human
uuuaauaaaccau

SEQ ID NO: 3173470 - RNA, 15 nt, Human
uuuaauaauuagaaa

SEQ ID NO: 3173471 - RNA, 16 nt, Human
uuuauaccuguuuaaa

SEQ ID NO: 3173472 - RNA, 17 nt, Human
uuuauaccuguuuaaau

SEQ ID NO: 3173473 - RNA, 15 nt, Human
uuuauacgagaacag

SEQ ID NO: 3173474 - RNA, 18 nt, Human
uuuauaccuguuuaaauu

SEQ ID NO: 3173475 - RNA, 18 nt, Human
uuuaucccuuaagaauga

SEQ ID NO: 3173476 - RNA, 16 nt, Human
uuuaucccuuaagaau

SEQ ID NO: 3173477 - RNA, 15 nt, Human
uuuaucccuuaagaa

SEQ ID NO: 3173478 - RNA, 21 nt, Human
uuuaucgcccuggcaggcagg

SEQ ID NO: 3173479 - RNA, 16 nt, Human
uuuaucucagauguua

SEQ ID NO: 3173480 - RNA, 18 nt, Human
uuuaucucagauguuaaa

SEQ ID NO: 3173481 - RNA, 19 nt, Human
uuuaucucagauguuaaaa

SEQ ID NO: 3173482 - RNA, 21 nt, Human
uuuaucucagauguuaaaaua

SEQ ID NO: 3173483 - RNA, 21 nt, Human
uuuaucuugaaggaaaaauuc

SEQ ID NO: 3173484 - RNA, 17 nt, Human
uuuaucuugaaggaaaa

SEQ ID NO: 3173485 - RNA, 22 nt, Human
uuuagacccuauugcugcuuga

SEQ ID NO: 3173486 - RNA, 21 nt, Human
uuuagacauguaauuugugua

SEQ ID NO: 3173487 - RNA, 19 nt, Human
uuuagacccuauugcugcu

SEQ ID NO: 3173488 - RNA, 15 nt, Human
uuuacccuauaucua

SEQ ID NO: 3173489 - RNA, 18 nt, Human
uuuacccuauaucuauaa

SEQ ID NO: 3173490 - RNA, 16 nt, Human
uuuacccuauaucuau

SEQ ID NO: 3173491 - RNA, 17 nt, Human
uuuauaacaucuuuauu

SEQ ID NO: 3173492 - RNA, 20 nt, Human
uuuauaacaucuuuauugaa

SEQ ID NO: 3173493 - RNA, 23 nt, Human
uuuauacagaugccauauagugu

SEQ ID NO: 3173494 - RNA, 15 nt, Human
uuguuuagaagaagu

SEQ ID NO: 3173495 - RNA, 18 nt, Human
uuguuuagaagaagugug

SEQ ID NO: 3173496 - RNA, 17 nt, Human
uuguuuaaaaucauuuc

SEQ ID NO: 3173497 - RNA, 18 nt, Human
uuguuuaaaaucauuucu

SEQ ID NO: 3173498 - RNA, 15 nt, Human
uugucuuuggacccu

SEQ ID NO: 3173499 - RNA, 12 nt, Human
uugucuuucugg

SEQ ID NO: 3173500 - RNA, 18 nt, Human
uugucuuguguauuucag

SEQ ID NO: 3173501 - RNA, 19 nt, Human
uugucuuccuauuucagaa

SEQ ID NO: 3173502 - RNA, 15 nt, Human
uugucuuauugacag

SEQ ID NO: 3173503 - RNA, 19 nt, Human
uugucuuaauggaugaaau

SEQ ID NO: 3173504 - RNA, 17 nt, Human
uugucuuaauggaugaa

SEQ ID NO: 3173505 - RNA, 23 nt, Human
uugucuuccuauuucagaaguuu

SEQ ID NO: 3173506 - RNA, 20 nt, Human
uugucuuuggacccugaggc

SEQ ID NO: 3173507 - RNA, 24 nt, Human
uugucuuuggacccugaggcccag

SEQ ID NO: 3173508 - RNA, 14 nt, Human
uugucuuucugggg

SEQ ID NO: 3173509 - RNA, 13 nt, Human
uuguuauuaaaug

SEQ ID NO: 3173510 - RNA, 14 nt, Human
uuguuauuaaaugu

SEQ ID NO: 3173511 - RNA, 15 nt, Human
uuguuauuaaaugua

SEQ ID NO: 3173512 - RNA, 22 nt, Human
uuguuuguauguauaauucaaa

SEQ ID NO: 3173513 - RNA, 21 nt, Human
uuguuugguuauagugcaaua

SEQ ID NO: 3173514 - RNA, 19 nt, Human
uuguuuguauguauaauuc

SEQ ID NO: 3173515 - RNA, 13 nt, Human
uuguuuguaugua

SEQ ID NO: 3173516 - RNA, 18 nt, Human
uuguuugguuauagugca

SEQ ID NO: 3173517 - RNA, 19 nt, Human
uuguuuguuaauaaagugc

SEQ ID NO: 3173518 - RNA, 13 nt, Human
uuguuuguuucaa

SEQ ID NO: 3173519 - RNA, 12 nt, Human
uuguuuguuuca

SEQ ID NO: 3173520 - RNA, 18 nt, Human
uuuaaaacaccuucuaua

SEQ ID NO: 3173521 - RNA, 19 nt, Human
uuguuuagauuuuguguuu

SEQ ID NO: 3173522 - RNA, 23 nt, Human
uuguuuagucuuuauacugcaaa

SEQ ID NO: 3173523 - RNA, 20 nt, Human
uuguuuagauuuuguguuua

SEQ ID NO: 3173524 - RNA, 19 nt, Human
uuguuuaucuagauguaaa

SEQ ID NO: 3173525 - RNA, 17 nt, Human
uuguuuaucuagaugua

SEQ ID NO: 3173526 - RNA, 20 nt, Human
uuguuuggggaugagaaagg

SEQ ID NO: 3173527 - RNA, 19 nt, Human
uuguuucuuucucugagga

SEQ ID NO: 3173528 - RNA, 16 nt, Human
uuguuucuuucucuga

SEQ ID NO: 3173529 - RNA, 17 nt, Human
uuguuucuuaauuugga

SEQ ID NO: 3173530 - RNA, 16 nt, Human
uuuaaaauugugaugu

SEQ ID NO: 3173531 - RNA, 19 nt, Human
uuuaaaauucucuuccaac

SEQ ID NO: 3173532 - RNA, 16 nt, Human
uuuaaaauuacaacua

SEQ ID NO: 3173533 - RNA, 21 nt, Human
uuuaaaauguacauguauuaa

SEQ ID NO: 3173534 - RNA, 20 nt, Human
uuuaaaauguacauguauua

SEQ ID NO: 3173535 - RNA, 13 nt, Human
uuuaaaauguaca

SEQ ID NO: 3173536 - RNA, 14 nt, Human
uuuaaaauuuuaag

SEQ ID NO: 3173537 - RNA, 13 nt, Human
uuuaaaauuucau

SEQ ID NO: 3173538 - RNA, 18 nt, Human
uuuaaaccuuuuauuaua

SEQ ID NO: 3173539 - RNA, 15 nt, Human
uuuaaacugucgugu

SEQ ID NO: 3173540 - RNA, 21 nt, Human
uuuaaacucugaauuuaucuu

SEQ ID NO: 3173541 - RNA, 18 nt, Human
uuuaaaagaugcaaugua

SEQ ID NO: 3173542 - RNA, 19 nt, Human
uuuaaaagcccuuuccaaa

SEQ ID NO: 3173543 - RNA, 20 nt, Human
uuuaaaagauaaauauuaua

SEQ ID NO: 3173544 - RNA, 16 nt, Human
uuuaaaacuacuuagc

SEQ ID NO: 3173545 - RNA, 20 nt, Human
uuuaaaacuaguuagauuca

SEQ ID NO: 3173546 - RNA, 13 nt, Human
uuuaaaacuacuu

SEQ ID NO: 3173547 - RNA, 16 nt, Human
uuuaaaaucauuucug

SEQ ID NO: 3173548 - RNA, 22 nt, Human
uuuaaaaucuuauuaaaguuuc

SEQ ID NO: 3173549 - RNA, 21 nt, Human
uuuaaaaucuuauuaaaguuu

SEQ ID NO: 3173550 - RNA, 20 nt, Human
uuuaaaaucuuauuaaaguu

SEQ ID NO: 3173551 - RNA, 16 nt, Human
uuuaaaaucuuauuaa

SEQ ID NO: 3173552 - RNA, 18 nt, Human
uuuaaaaucuccuaaaug

SEQ ID NO: 3173553 - RNA, 20 nt, Human
uuuaaaaucuccuaaaugcu

SEQ ID NO: 3173554 - RNA, 18 nt, Human
uuuaaaauacuguagaua

SEQ ID NO: 3173555 - RNA, 17 nt, Human
uuuaaaauacuguagau

SEQ ID NO: 3173556 - RNA, 19 nt, Human
uuuaaaauacacacucaaa

SEQ ID NO: 3173557 - RNA, 12 nt, Human
uuuaaaauacug

SEQ ID NO: 3173558 - RNA, 16 nt, Human
uuuaaaauacuguaga

SEQ ID NO: 3173559 - RNA, 15 nt, Human
uuuaaaauacuguag

SEQ ID NO: 3173560 - RNA, 13 nt, Human
uuuaaaauaaacu

SEQ ID NO: 3173561 - RNA, 13 nt, Human
uuuaaaaguaaaa

SEQ ID NO: 3173562 - RNA, 23 nt, Human
uuuaaaaguaaaaugucuuucca

SEQ ID NO: 3173563 - RNA, 20 nt, Human
uuuaaaagcccuuuccaaag

SEQ ID NO: 3173564 - RNA, 15 nt, Human
uuaugcagugcugcu

SEQ ID NO: 3173565 - RNA, 16 nt, Human
uuaugcagugcugcuu

SEQ ID NO: 3173566 - RNA, 19 nt, Human
uuaucuuggccuuacugua

SEQ ID NO: 3173567 - RNA, 11 nt, Human
uuaucuuugau

SEQ ID NO: 3173568 - RNA, 22 nt, Human
uuaugcaaggucuugcauuuaa

SEQ ID NO: 3173569 - RNA, 10 nt, Human
uuaugcuaag

SEQ ID NO: 3173570 - RNA, 20 nt, Human
uuaugcuaagaauuuuuuau

SEQ ID NO: 3173571 - RNA, 16 nt, Human
uuaugcuaagaauuuu

SEQ ID NO: 3173572 - RNA, 15 nt, Human
uuaugcuaagaauuu

SEQ ID NO: 3173573 - RNA, 18 nt, Human
uuaugcuguaaaagcaag

SEQ ID NO: 3173574 - RNA, 16 nt, Human
uuaugcuuaaauucaa

SEQ ID NO: 3173575 - RNA, 16 nt, Human
uuaugcuuccagaaac

SEQ ID NO: 3173576 - RNA, 15 nt, Human
uuaugcuuccagaaa

SEQ ID NO: 3173577 - RNA, 14 nt, Human
uuaugcuuccagaa

SEQ ID NO: 3173578 - RNA, 11 nt, Human
uuaguuuagaa

SEQ ID NO: 3173579 - RNA, 23 nt, Human
uuaguuccccaaauacaaaguua

SEQ ID NO: 3173580 - RNA, 16 nt, Human
uuaguuccucauuagc

SEQ ID NO: 3173581 - RNA, 14 nt, Human
uuaguuccuugagu

SEQ ID NO: 3173582 - RNA, 19 nt, Human
uuaucuagauguaaauuuu

SEQ ID NO: 3173583 - RNA, 18 nt, Human
uuaucuagauguaaauuu

SEQ ID NO: 3173584 - RNA, 17 nt, Human
uuaucuagauguaaauu

SEQ ID NO: 3173585 - RNA, 16 nt, Human
uuaucuagauguaaau

SEQ ID NO: 3173586 - RNA, 15 nt, Human
uuaucuagauguaaa

SEQ ID NO: 3173587 - RNA, 14 nt, Human
uuaucuagauguaa

SEQ ID NO: 3173588 - RNA, 14 nt, Human
uuaucuagcugcau

SEQ ID NO: 3173589 - RNA, 17 nt, Human
uuauugauauucuaaga

SEQ ID NO: 3173590 - RNA, 19 nt, Human
uuauugauauucuaagaaa

SEQ ID NO: 3173591 - RNA, 21 nt, Human
uuauugauauucuaagaaaua

SEQ ID NO: 3173592 - RNA, 22 nt, Human
uuauugaggaaaaauaugugaa

SEQ ID NO: 3173593 - RNA, 21 nt, Human
uuauugaggaaaaauauguga

SEQ ID NO: 3173594 - RNA, 19 nt, Human
uuauugaggaaaaauaugu

SEQ ID NO: 3173595 - RNA, 22 nt, Human
uuauugagagagauguguaauu

SEQ ID NO: 3173596 - RNA, 20 nt, Human
uuauugagagagauguguaa

SEQ ID NO: 3173597 - RNA, 19 nt, Human
uuauugagagagaugugua

SEQ ID NO: 3173598 - RNA, 18 nt, Human
uuauugagagagaugugu

SEQ ID NO: 3173599 - RNA, 16 nt, Human
uuauugacucuugagu

SEQ ID NO: 3173600 - RNA, 17 nt, Human
uuauugacucuugaguu

SEQ ID NO: 3173601 - RNA, 20 nt, Human
uuauugacucuugaguuguu

SEQ ID NO: 3173602 - RNA, 21 nt, Human
uuauugacucuugaguuguuu

SEQ ID NO: 3173603 - RNA, 15 nt, Human
uuauugcccacgcug

SEQ ID NO: 3173604 - RNA, 13 nt, Human
uuauugaugaaaa

SEQ ID NO: 3173605 - RNA, 23 nt, Human
uuauugaggaaaaauaugugaag

SEQ ID NO: 3173606 - RNA, 19 nt, Human
uuauugaguuccaguugaa

SEQ ID NO: 3173607 - RNA, 14 nt, Human
uuauugaugaaaau

SEQ ID NO: 3173608 - RNA, 17 nt, Human
uuauugcaauaaaguau

SEQ ID NO: 3173609 - RNA, 11 nt, Human
uuauucugcuc

SEQ ID NO: 3173610 - RNA, 19 nt, Human
uuauucugggaauguauag

SEQ ID NO: 3173611 - RNA, 20 nt, Human
uuauucugggaauguauagu

SEQ ID NO: 3173612 - RNA, 22 nt, Human
uuauucugggcaccacaaaaua

SEQ ID NO: 3173613 - RNA, 23 nt, Human
uuauucugggcaccacaaaauau

SEQ ID NO: 3173614 - RNA, 22 nt, Human
uuauucuuuuuuucucuagagu

SEQ ID NO: 3173615 - RNA, 17 nt, Human
uuauucuuugcacuuuu

SEQ ID NO: 3173616 - RNA, 15 nt, Human
uuauucuuucuccuu

SEQ ID NO: 3173617 - RNA, 15 nt, Human
uuauucuuugcacuu

SEQ ID NO: 3173618 - RNA, 14 nt, Human
uuauucuuugcacu

SEQ ID NO: 3173619 - RNA, 15 nt, Human
uuauucuugaugaaa

SEQ ID NO: 3173620 - RNA, 14 nt, Human
uuauucuugaugaa

SEQ ID NO: 3173621 - RNA, 13 nt, Human
uuauucuugauca

SEQ ID NO: 3173622 - RNA, 11 nt, Human
uuauucuugau

SEQ ID NO: 3173623 - RNA, 18 nt, Human
uuauugacaguugugcag

SEQ ID NO: 3173624 - RNA, 14 nt, Human
uuauugacucuuga

SEQ ID NO: 3173625 - RNA, 14 nt, Human
uuauuaaugcuuug

SEQ ID NO: 3173626 - RNA, 13 nt, Human
uuauuaaugcuuu

SEQ ID NO: 3173627 - RNA, 20 nt, Human
uuauuccugcccugcuguuu

SEQ ID NO: 3173628 - RNA, 12 nt, Human
uuauucuaauua

SEQ ID NO: 3173629 - RNA, 14 nt, Human
uuauuaaucacugu

SEQ ID NO: 3173630 - RNA, 16 nt, Human
uuauuaaucacugugu

SEQ ID NO: 3173631 - RNA, 18 nt, Human
uuauuaaucacuguguau

SEQ ID NO: 3173632 - RNA, 19 nt, Human
uuauuaaaguuucaaaaau

SEQ ID NO: 3173633 - RNA, 17 nt, Human
uuauuaaaguuucaaaa

SEQ ID NO: 3173634 - RNA, 15 nt, Human
uuauuaaaguuucaa

SEQ ID NO: 3173635 - RNA, 14 nt, Human
uuauuaaaguuuca

SEQ ID NO: 3173636 - RNA, 12 nt, Human
uuauuaaaauug

SEQ ID NO: 3173637 - RNA, 13 nt, Human
uuauuaaaauugu

SEQ ID NO: 3173638 - RNA, 17 nt, Human
uuauggcuauaggugcu

SEQ ID NO: 3173639 - RNA, 15 nt, Human
uuauggaaaaauaaa

SEQ ID NO: 3173640 - RNA, 17 nt, Human
uuauggaaaaauaaaac

SEQ ID NO: 3173641 - RNA, 22 nt, Human
uucacucuaagauguuauauuu

SEQ ID NO: 3173642 - RNA, 20 nt, Human
uucagacauagaauuaacac

SEQ ID NO: 3173643 - RNA, 19 nt, Human
uucagagacuccugcaggc

SEQ ID NO: 3173644 - RNA, 16 nt, Human
uucagacauagaauua

SEQ ID NO: 3173645 - RNA, 21 nt, Human
uucagacagcugccugggauc

SEQ ID NO: 3173646 - RNA, 13 nt, Human
uucacucuccuug

SEQ ID NO: 3173647 - RNA, 16 nt, Human
uucacucuaagauguu

SEQ ID NO: 3173648 - RNA, 18 nt, Human
uucacucuaagauguuau

SEQ ID NO: 3173649 - RNA, 17 nt, Human
uucacucuaagauguua

SEQ ID NO: 3173650 - RNA, 16 nt, Human
uucacuauaaugugaa

SEQ ID NO: 3173651 - RNA, 15 nt, Human
uucacgugguccuaa

SEQ ID NO: 3173652 - RNA, 18 nt, Human
uucacggaagagccuugc

SEQ ID NO: 3173653 - RNA, 19 nt, Human
uucacgucauaggaaguua

SEQ ID NO: 3173654 - RNA, 13 nt, Human
uucaauaggaaaa

SEQ ID NO: 3173655 - RNA, 15 nt, Human
uucaauaggaaaaac

SEQ ID NO: 3173656 - RNA, 18 nt, Human
uucaauaggaaaaacuga

SEQ ID NO: 3173657 - RNA, 17 nt, Human
uuauuuuaauucaguug

SEQ ID NO: 3173658 - RNA, 17 nt, Human
uucaaagucaugauguu

SEQ ID NO: 3173659 - RNA, 21 nt, Human
uucaaagucaugauguuuuua

SEQ ID NO: 3173660 - RNA, 11 nt, Human
uucaaagucuc

SEQ ID NO: 3173661 - RNA, 19 nt, Human
uucaaagucucaaugaaau

SEQ ID NO: 3173662 - RNA, 20 nt, Human
uucaaagucucaaugaaaua

SEQ ID NO: 3173663 - RNA, 19 nt, Human
uucaaagucaugauguuuu

SEQ ID NO: 3173664 - RNA, 18 nt, Human
uucaaagucaugauguuu

SEQ ID NO: 3173665 - RNA, 19 nt, Human
uucaaaggagcaagaacuu

SEQ ID NO: 3173666 - RNA, 23 nt, Human
uucaaaucaaucuguaaaacuaa

SEQ ID NO: 3173667 - RNA, 22 nt, Human
uucaaaucaaucuguaaaacua

SEQ ID NO: 3173668 - RNA, 15 nt, Human
uucaacgcagcccug

SEQ ID NO: 3173669 - RNA, 17 nt, Human
uucaacugaccagccuc

SEQ ID NO: 3173670 - RNA, 20 nt, Human
uucaacgcagcccugcuuug

SEQ ID NO: 3173671 - RNA, 19 nt, Human
uucaacgcagcccugcuuu

SEQ ID NO: 3173672 - RNA, 16 nt, Human
uucaacgcagcccugc

SEQ ID NO: 3173673 - RNA, 13 nt, Human
uuauugucuguaa

SEQ ID NO: 3173674 - RNA, 14 nt, Human
uuauugucuguaaa

SEQ ID NO: 3173675 - RNA, 15 nt, Human
uuauugucuguaaau

SEQ ID NO: 3173676 - RNA, 18 nt, Human
uuauugucaaagugguga

SEQ ID NO: 3173677 - RNA, 17 nt, Human
uuauugucaaaguggug

SEQ ID NO: 3173678 - RNA, 21 nt, Human
uuauugcccaugauauaacuu

SEQ ID NO: 3173679 - RNA, 20 nt, Human
uuauugccaaaacccagcug

SEQ ID NO: 3173680 - RNA, 22 nt, Human
uuauugccaaaacccagcugca

SEQ ID NO: 3173681 - RNA, 19 nt, Human
uuauugccaggaaaggaga

SEQ ID NO: 3173682 - RNA, 21 nt, Human
uuauugccaaaacccagcugc

SEQ ID NO: 3173683 - RNA, 19 nt, Human
uuauuggugaguuaggaac

SEQ ID NO: 3173684 - RNA, 16 nt, Human
uucccugaaggaacca

SEQ ID NO: 3173685 - RNA, 12 nt, Human
uucccugaggug

SEQ ID NO: 3173686 - RNA, 17 nt, Human
uucccucgucuuuccca

SEQ ID NO: 3173687 - RNA, 19 nt, Human
uucccucggaguucuucuu

SEQ ID NO: 3173688 - RNA, 18 nt, Human
uucccucggaguucuucu

SEQ ID NO: 3173689 - RNA, 17 nt, Human
uucccuuccuccauccu

SEQ ID NO: 3173690 - RNA, 14 nt, Human
uucccuuccuccau

SEQ ID NO: 3173691 - RNA, 13 nt, Human
uucccuuccucca

SEQ ID NO: 3173692 - RNA, 20 nt, Human
uucccuuugacgccauccca

SEQ ID NO: 3173693 - RNA, 21 nt, Human
uucccuuugacgccaucccag

SEQ ID NO: 3173694 - RNA, 22 nt, Human
uucccuuugacgccaucccagc

SEQ ID NO: 3173695 - RNA, 18 nt, Human
uuccuauaccauuuccgu

SEQ ID NO: 3173696 - RNA, 18 nt, Human
uucccuuugccacacugu

SEQ ID NO: 3173697 - RNA, 17 nt, Human
uuccuaucaaaaagaua

SEQ ID NO: 3173698 - RNA, 18 nt, Human
uuccuaucaaaaagauau

SEQ ID NO: 3173699 - RNA, 15 nt, Human
uuccuaucauguuaa

SEQ ID NO: 3173700 - RNA, 13 nt, Human
uuccucauuagca

SEQ ID NO: 3173701 - RNA, 18 nt, Human
uuccuccauccuccuccu

SEQ ID NO: 3173702 - RNA, 14 nt, Human
uuccuccauccucc

SEQ ID NO: 3173703 - RNA, 24 nt, Human
uuccuccauccuccuccuuccuag

SEQ ID NO: 3173704 - RNA, 22 nt, Human
uuccuccauccuccuccuuccu

SEQ ID NO: 3173705 - RNA, 15 nt, Human
uuccuauuucagaag

SEQ ID NO: 3173706 - RNA, 13 nt, Human
uuccuauuucaga

SEQ ID NO: 3173707 - RNA, 23 nt, Human
uuccuauuucagaaguuuaaaua

SEQ ID NO: 3173708 - RNA, 16 nt, Human
uuccuauuucagaagu

SEQ ID NO: 3173709 - RNA, 21 nt, Human
uuccucaacaguguuuucaga

SEQ ID NO: 3173710 - RNA, 22 nt, Human
uuccucaacaguguuuucagaa

SEQ ID NO: 3173711 - RNA, 20 nt, Human
uuccuucuuugcccuuuacu

SEQ ID NO: 3173712 - RNA, 15 nt, Human
uuccuucuuugcccu

SEQ ID NO: 3173713 - RNA, 14 nt, Human
uuccuggcacugcu

SEQ ID NO: 3173714 - RNA, 18 nt, Human
uuccuggacaggccaggu

SEQ ID NO: 3173715 - RNA, 18 nt, Human
uuccugaugcuucuucag

SEQ ID NO: 3173716 - RNA, 19 nt, Human
uuccugaugcuucuucaga

SEQ ID NO: 3173717 - RNA, 15 nt, Human
uuccugaugcuucuu

SEQ ID NO: 3173718 - RNA, 17 nt, Human
uuccugccaggcauggu

SEQ ID NO: 3173719 - RNA, 18 nt, Human
uuccugcauuugugaaau

SEQ ID NO: 3173720 - RNA, 16 nt, Human
uuccugcauuugugaa

SEQ ID NO: 3173721 - RNA, 15 nt, Human
uuccugcauuuguga

SEQ ID NO: 3173722 - RNA, 17 nt, Human
uuccuuggacucauuuu

SEQ ID NO: 3173723 - RNA, 22 nt, Human
uuccuugaggggagccaggagg

SEQ ID NO: 3173724 - RNA, 20 nt, Human
uuccuugaggggagccagga

SEQ ID NO: 3173725 - RNA, 20 nt, Human
uuccuuggacucauuuuaaa

SEQ ID NO: 3173726 - RNA, 23 nt, Human
uuccuugaggggagccaggaggg

SEQ ID NO: 3173727 - RNA, 22 nt, Human
uucggccuccauccugaggcuc

SEQ ID NO: 3173728 - RNA, 20 nt, Human
uucgggaggucgaggcagga

SEQ ID NO: 3173729 - RNA, 13 nt, Human
uucuaaagcugcc

SEQ ID NO: 3173730 - RNA, 17 nt, Human
uucuaaagcugccagcc

SEQ ID NO: 3173731 - RNA, 17 nt, Human
uucuaaaagcuuucaug

SEQ ID NO: 3173732 - RNA, 20 nt, Human
uucuaaaacuguacuuugau

SEQ ID NO: 3173733 - RNA, 19 nt, Human
uucuaaaacuguacuuuga

SEQ ID NO: 3173734 - RNA, 18 nt, Human
uucuaaaacuguacuuug

SEQ ID NO: 3173735 - RNA, 17 nt, Human
uucguuuguuuguuuca

SEQ ID NO: 3173736 - RNA, 14 nt, Human
uucguucucugcca

SEQ ID NO: 3173737 - RNA, 14 nt, Human
uucuaaaaagucag

SEQ ID NO: 3173738 - RNA, 15 nt, Human
uucuaaaaagucaga

SEQ ID NO: 3173739 - RNA, 18 nt, Human
uucuaaaaagucagaugu

SEQ ID NO: 3173740 - RNA, 20 nt, Human
uucuaaaaagucagauguuu

SEQ ID NO: 3173741 - RNA, 16 nt, Human
uucuaaaacuguacuu

SEQ ID NO: 3173742 - RNA, 15 nt, Human
uucuaaaacuguacu

SEQ ID NO: 3173743 - RNA, 13 nt, Human
uucuaaaacugua

SEQ ID NO: 3173744 - RNA, 12 nt, Human
uucuaaaacugu

SEQ ID NO: 3173745 - RNA, 13 nt, Human
uucauuugcuauc

SEQ ID NO: 3173746 - RNA, 12 nt, Human
uucauuugcuuu

SEQ ID NO: 3173747 - RNA, 16 nt, Human
uucauuugcacaagua

SEQ ID NO: 3173748 - RNA, 16 nt, Human
uucauuuccugugucu

SEQ ID NO: 3173749 - RNA, 15 nt, Human
uucauuuccuguguc

SEQ ID NO: 3173750 - RNA, 14 nt, Human
uucaugcaaguauu

SEQ ID NO: 3173751 - RNA, 11 nt, Human
uucaggaagcu

SEQ ID NO: 3173752 - RNA, 19 nt, Human
uucaggaaagcagcaguuu

SEQ ID NO: 3173753 - RNA, 13 nt, Human
uucaggaagcuca

SEQ ID NO: 3173754 - RNA, 17 nt, Human
uucaucuugaauuguaa

SEQ ID NO: 3173755 - RNA, 21 nt, Human
uucaucuugaauuguaaggaa

SEQ ID NO: 3173756 - RNA, 22 nt, Human
uuccaaacaugagguucucucu

SEQ ID NO: 3173757 - RNA, 14 nt, Human
uuccaaaauauuau

SEQ ID NO: 3173758 - RNA, 16 nt, Human
uucauuugcuuuggaa

SEQ ID NO: 3173759 - RNA, 12 nt, Human
uuccaaagaaag

SEQ ID NO: 3173760 - RNA, 14 nt, Human
uuccaaagaaaguu

SEQ ID NO: 3173761 - RNA, 14 nt, Human
uuccaaacaugguu

SEQ ID NO: 3173762 - RNA, 20 nt, Human
uuccaaauaauauguuuccu

SEQ ID NO: 3173763 - RNA, 15 nt, Human
uuccaaauucugcuu

SEQ ID NO: 3173764 - RNA, 23 nt, Human
uuccaaauaauauguuuccuucc

SEQ ID NO: 3173765 - RNA, 13 nt, Human
uuccaaauuauuu

SEQ ID NO: 3173766 - RNA, 16 nt, Human
uuccaaauuauuucuu

SEQ ID NO: 3173767 - RNA, 18 nt, Human
uuccaaauuauuucuuaa

SEQ ID NO: 3173768 - RNA, 19 nt, Human
uuccaaauuauuucuuaau

SEQ ID NO: 3173769 - RNA, 23 nt, Human
uuccaaauuauuucuuaauuauu

SEQ ID NO: 3173770 - RNA, 13 nt, Human
uuccaaauucaug

SEQ ID NO: 3173771 - RNA, 21 nt, Human
uuccacuccuccuagccaccc

SEQ ID NO: 3173772 - RNA, 20 nt, Human
uuccagagacaaauauuucu

SEQ ID NO: 3173773 - RNA, 18 nt, Human
uuccacuccuccuagcca

SEQ ID NO: 3173774 - RNA, 16 nt, Human
uuccacuccuccuagc

SEQ ID NO: 3173775 - RNA, 21 nt, Human
uuccagagaguggcuccuccc

SEQ ID NO: 3173776 - RNA, 10 nt, Human
uuccagagca

SEQ ID NO: 3173777 - RNA, 20 nt, Human
uuccagagaguggcuccucc

SEQ ID NO: 3173778 - RNA, 19 nt, Human
uuccagagaguggcuccuc

SEQ ID NO: 3173779 - RNA, 18 nt, Human
uuccagagaguggcuccu

SEQ ID NO: 3173780 - RNA, 17 nt, Human
uuccagagaguggcucc

SEQ ID NO: 3173781 - RNA, 17 nt, Human
uuccccaggaggccagc

SEQ ID NO: 3173782 - RNA, 18 nt, Human
uuccccaggaggccagcc

SEQ ID NO: 3173783 - RNA, 19 nt, Human
uuccccaggaggccagccu

SEQ ID NO: 3173784 - RNA, 20 nt, Human
uuccccaggaggccagccuu

SEQ ID NO: 3173785 - RNA, 21 nt, Human
uuccccaggaggccagccuug

SEQ ID NO: 3173786 - RNA, 11 nt, Human
uuccccauggg

SEQ ID NO: 3173787 - RNA, 19 nt, Human
uuccccaugucucgacuca

SEQ ID NO: 3173788 - RNA, 20 nt, Human
uucccucccuuccucuuucc

SEQ ID NO: 3173789 - RNA, 17 nt, Human
uucccucccuuccucuu

SEQ ID NO: 3173790 - RNA, 11 nt, Human
uucccucccuu

SEQ ID NO: 3173791 - RNA, 16 nt, Human
uucccccauuuuuccc

SEQ ID NO: 3173792 - RNA, 22 nt, Human
uuccccauuauaucacacuuau

SEQ ID NO: 3173793 - RNA, 16 nt, Human
uucccauuugcuccuu

SEQ ID NO: 3173794 - RNA, 22 nt, Human
uucccauuuagaauggugauuu

SEQ ID NO: 3173795 - RNA, 15 nt, Human
uucccauuuagaaug

SEQ ID NO: 3173796 - RNA, 14 nt, Human
uucccauuuagaau

SEQ ID NO: 3173797 - RNA, 13 nt, Human
uucccauuuagaa

SEQ ID NO: 3173798 - RNA, 15 nt, Human
uuccccaggaggcca

SEQ ID NO: 3173799 - RNA, 16 nt, Human
uuccccaggaggccag

SEQ ID NO: 3173800 - RNA, 13 nt, Human
uucccaucuccuu

SEQ ID NO: 3173801 - RNA, 21 nt, Human
uucccaucuccuuucucuggu

SEQ ID NO: 3173802 - RNA, 11 nt, Human
uucccauucca

SEQ ID NO: 3173803 - RNA, 14 nt, Human
uucccauucuugca

SEQ ID NO: 3173804 - RNA, 20 nt, Human
uuccagcaauucuccugccu

SEQ ID NO: 3173805 - RNA, 21 nt, Human
uuccagcaauucuccugccuc

SEQ ID NO: 3173806 - RNA, 22 nt, Human
uuccagcaauucuccugccuca

SEQ ID NO: 3173807 - RNA, 21 nt, Human
uuccagaugcugguuuuuccc

SEQ ID NO: 3173808 - RNA, 16 nt, Human
uguuuagaagaagugu

SEQ ID NO: 3173809 - RNA, 19 nt, Human
uguuuagaagaaguguguc

SEQ ID NO: 3173810 - RNA, 12 nt, Human
uguuuagaauug

SEQ ID NO: 3173811 - RNA, 14 nt, Human
uguuuagaauugaa

SEQ ID NO: 3173812 - RNA, 15 nt, Human
uguuuagaauugaag

SEQ ID NO: 3173813 - RNA, 17 nt, Human
uguuuagaauugaaggu

SEQ ID NO: 3173814 - RNA, 23 nt, Human
uguuuagaauugaagguuuuuga

SEQ ID NO: 3173815 - RNA, 22 nt, Human
uguuucaaguucacaccugcag

SEQ ID NO: 3173816 - RNA, 21 nt, Human
uguuucagaggcucagauugu

SEQ ID NO: 3173817 - RNA, 12 nt, Human
uguuucauccuu

SEQ ID NO: 3173818 - RNA, 20 nt, Human
uguuuuaagaggcagggucu

SEQ ID NO: 3173819 - RNA, 17 nt, Human
uguuugugcaguaacuu

SEQ ID NO: 3173820 - RNA, 15 nt, Human
uguuugucucuucug

SEQ ID NO: 3173821 - RNA, 14 nt, Human
uguuugucucuucu

SEQ ID NO: 3173822 - RNA, 18 nt, Human
uguuugguuauagugcaa

SEQ ID NO: 3173823 - RNA, 24 nt, Human
uguuugguuuuuuguucuugcgau

SEQ ID NO: 3173824 - RNA, 22 nt, Human
uguuugguuuuaaaauacugua

SEQ ID NO: 3173825 - RNA, 21 nt, Human
uguuugguuuuaaaauacugu

SEQ ID NO: 3173826 - RNA, 16 nt, Human
uguuugguuuuaaaau

SEQ ID NO: 3173827 - RNA, 14 nt, Human
uguuugguuauagu

SEQ ID NO: 3173828 - RNA, 15 nt, Human
uguuuguauguauaa

SEQ ID NO: 3173829 - RNA, 17 nt, Human
uguuuguacaagauugu

SEQ ID NO: 3173830 - RNA, 20 nt, Human
uguuuguacaagauugucau

SEQ ID NO: 3173831 - RNA, 18 nt, Human
uguuuguacaagauuguc

SEQ ID NO: 3173832 - RNA, 16 nt, Human
uguuuguaacaagaaa

SEQ ID NO: 3173833 - RNA, 16 nt, Human
uguuuguaaaaaugua

SEQ ID NO: 3173834 - RNA, 23 nt, Human
uguuuccuggcacugcuuccagu

SEQ ID NO: 3173835 - RNA, 23 nt, Human
uguuuccuugaggggagccagga

SEQ ID NO: 3173836 - RNA, 13 nt, Human
uguuuccuucccu

SEQ ID NO: 3173837 - RNA, 18 nt, Human
uguuucauccuucccacu

SEQ ID NO: 3173838 - RNA, 14 nt, Human
uguuucaucuaagu

SEQ ID NO: 3173839 - RNA, 15 nt, Human
uguuucauccuuccc

SEQ ID NO: 3173840 - RNA, 16 nt, Human
uguuucauuaacugug

SEQ ID NO: 3173841 - RNA, 19 nt, Human
uguuuggggaugagaaagg

SEQ ID NO: 3173842 - RNA, 18 nt, Human
uguuucuaauuugcugcu

SEQ ID NO: 3173843 - RNA, 20 nt, Human
uguuucuaccggagagagaa

SEQ ID NO: 3173844 - RNA, 16 nt, Human
uguuucuagaguuccu

SEQ ID NO: 3173845 - RNA, 22 nt, Human
uguuucuaagguaacaagauga

SEQ ID NO: 3173846 - RNA, 21 nt, Human
uuaaaagaugcaauguagagg

SEQ ID NO: 3173847 - RNA, 18 nt, Human
uuaaaagaugaaaauauu

SEQ ID NO: 3173848 - RNA, 15 nt, Human
uuaaaagaugaaaau

SEQ ID NO: 3173849 - RNA, 19 nt, Human
uuaaaauacacacucaaau

SEQ ID NO: 3173850 - RNA, 21 nt, Human
uuaaaagccuuggccucagag

SEQ ID NO: 3173851 - RNA, 16 nt, Human
uuaaaagcuaucuuca

SEQ ID NO: 3173852 - RNA, 19 nt, Human
uuaaaagcuaucuucaugu

SEQ ID NO: 3173853 - RNA, 21 nt, Human
uuaaaagcuaucuucauguaa

SEQ ID NO: 3173854 - RNA, 23 nt, Human
uuaaaagcuaucuucauguaaau

SEQ ID NO: 3173855 - RNA, 15 nt, Human
uuaaaaguaaaagag

SEQ ID NO: 3173856 - RNA, 15 nt, Human
uuaaaaguaaaaugu

SEQ ID NO: 3173857 - RNA, 17 nt, Human
uuaaaaguaaaaugucu

SEQ ID NO: 3173858 - RNA, 18 nt, Human
uuaaaaguaaaaugucuu

SEQ ID NO: 3173859 - RNA, 13 nt, Human
uuaaagaagacau

SEQ ID NO: 3173860 - RNA, 20 nt, Human
uuaaagaaauauguauucug

SEQ ID NO: 3173861 - RNA, 14 nt, Human
uuaaagaaaggaaa

SEQ ID NO: 3173862 - RNA, 16 nt, Human
uuaaagaaaggaaaag

SEQ ID NO: 3173863 - RNA, 17 nt, Human
uuaaagaaaggaaaaga

SEQ ID NO: 3173864 - RNA, 20 nt, Human
uuaaacugucgugucauacu

SEQ ID NO: 3173865 - RNA, 20 nt, Human
uuaaacucugaauuuaucuu

SEQ ID NO: 3173866 - RNA, 13 nt, Human
uuaaacucugaau

SEQ ID NO: 3173867 - RNA, 22 nt, Human
uuaaacucugaauuuaucuuug

SEQ ID NO: 3173868 - RNA, 11 nt, Human
uuaaaauacug

SEQ ID NO: 3173869 - RNA, 17 nt, Human
uuaaaauacuguagaua

SEQ ID NO: 3173870 - RNA, 16 nt, Human
uuaaaauacuguagau

SEQ ID NO: 3173871 - RNA, 13 nt, Human
uuaaaauacugua

SEQ ID NO: 3173872 - RNA, 12 nt, Human
uuaaaauacugu

SEQ ID NO: 3173873 - RNA, 20 nt, Human
uuaaaauacuguagauaauu

SEQ ID NO: 3173874 - RNA, 18 nt, Human
uuaaaauacuguagauaa

SEQ ID NO: 3173875 - RNA, 20 nt, Human
uuaaaagaaaggguucugua

SEQ ID NO: 3173876 - RNA, 21 nt, Human
uuaaaagaaaggguucuguaa

SEQ ID NO: 3173877 - RNA, 22 nt, Human
uuaaaagaaaggguucuguaaa

SEQ ID NO: 3173878 - RNA, 23 nt, Human
uuaaaagaaaggguucuguaaaa

SEQ ID NO: 3173879 - RNA, 23 nt, Human
uuaaaagaaaauaaaaaaaagaa

SEQ ID NO: 3173880 - RNA, 22 nt, Human
uuaaaagaaaauaaaaaaaaga

SEQ ID NO: 3173881 - RNA, 19 nt, Human
uguuuuuuuuuuccacuua

SEQ ID NO: 3173882 - RNA, 18 nt, Human
uguuuuuuuuuuccacuu

SEQ ID NO: 3173883 - RNA, 22 nt, Human
uuaaaagaauauuuuaacuucc

SEQ ID NO: 3173884 - RNA, 21 nt, Human
uuaaaagaauauuuuaacuuc

SEQ ID NO: 3173885 - RNA, 22 nt, Human
uguuuuaagaggcagggucuca

SEQ ID NO: 3173886 - RNA, 19 nt, Human
uguuuugugguuuggaaua

SEQ ID NO: 3173887 - RNA, 17 nt, Human
uguuuugugaauuuucu

SEQ ID NO: 3173888 - RNA, 23 nt, Human
uguuugugcaguaacuugggagu

SEQ ID NO: 3173889 - RNA, 16 nt, Human
uguuuuguacagaugu

SEQ ID NO: 3173890 - RNA, 15 nt, Human
uguuuuguacagaug

SEQ ID NO: 3173891 - RNA, 17 nt, Human
uguuuuguuuggagaca

SEQ ID NO: 3173892 - RNA, 20 nt, Human
uguuuuguugcacugaaguu

SEQ ID NO: 3173893 - RNA, 18 nt, Human
uguuuuguugcacugaag

SEQ ID NO: 3173894 - RNA, 14 nt, Human
uguuuuguugcacu

SEQ ID NO: 3173895 - RNA, 22 nt, Human
uguuuuguugcacugaaguuug

SEQ ID NO: 3173896 - RNA, 18 nt, Human
uguuuuuuguuuuucugc

SEQ ID NO: 3173897 - RNA, 21 nt, Human
uguuuuuuuaggguuucugau

SEQ ID NO: 3173898 - RNA, 12 nt, Human
uuaacucagucu

SEQ ID NO: 3173899 - RNA, 15 nt, Human
uuaacuccacugcuu

SEQ ID NO: 3173900 - RNA, 20 nt, Human
uuaacuccacugcuuaccua

SEQ ID NO: 3173901 - RNA, 22 nt, Human
uuaacuguccguaagcaguaua

SEQ ID NO: 3173902 - RNA, 17 nt, Human
uuaacugcucaguguuu

SEQ ID NO: 3173903 - RNA, 24 nt, Human
uuaacugcuuccuauaauuuugau

SEQ ID NO: 3173904 - RNA, 15 nt, Human
uuaacugcuuccuau

SEQ ID NO: 3173905 - RNA, 22 nt, Human
uuaagcagaauuggaaaagacu

SEQ ID NO: 3173906 - RNA, 18 nt, Human
uuaagcagaauuggaaaa

SEQ ID NO: 3173907 - RNA, 17 nt, Human
uuaagcagaauuggaaa

SEQ ID NO: 3173908 - RNA, 18 nt, Human
uuaacuuaguuuugcaua

SEQ ID NO: 3173909 - RNA, 17 nt, Human
uuaacuuaauaaucaag

SEQ ID NO: 3173910 - RNA, 17 nt, Human
uuaacuuaguuuugcau

SEQ ID NO: 3173911 - RNA, 14 nt, Human
uuaacuuaguuuug

SEQ ID NO: 3173912 - RNA, 14 nt, Human
uuaacuuaauaauc

SEQ ID NO: 3173913 - RNA, 16 nt, Human
uuaacuuaauaaucaa

SEQ ID NO: 3173914 - RNA, 18 nt, Human
uuaaauuacauuuguaau

SEQ ID NO: 3173915 - RNA, 17 nt, Human
uuaaauuacauuuguaa

SEQ ID NO: 3173916 - RNA, 14 nt, Human
uuaaauuagaaaau

SEQ ID NO: 3173917 - RNA, 15 nt, Human
uuaaauuagaaaaua

SEQ ID NO: 3173918 - RNA, 17 nt, Human
uuaaauuagaaaauauu

SEQ ID NO: 3173919 - RNA, 17 nt, Human
uuaaauuaguuugugaa

SEQ ID NO: 3173920 - RNA, 16 nt, Human
uuaaauuacauuugua

SEQ ID NO: 3173921 - RNA, 11 nt, Human
uuaaauuaaua

SEQ ID NO: 3173922 - RNA, 16 nt, Human
uuaaauuaauaucuuu

SEQ ID NO: 3173923 - RNA, 22 nt, Human
uuaaauuaauaucuuucugcac

SEQ ID NO: 3173924 - RNA, 23 nt, Human
uuaaauguuuuguaaacuuugaa

SEQ ID NO: 3173925 - RNA, 21 nt, Human
uuaaauguuuuguaaacuuug

SEQ ID NO: 3173926 - RNA, 11 nt, Human
uuaaauguuuu

SEQ ID NO: 3173927 - RNA, 14 nt, Human
uuaaauguuuugua

SEQ ID NO: 3173928 - RNA, 12 nt, Human
uuaaauguuuug

SEQ ID NO: 3173929 - RNA, 20 nt, Human
uuaaauguuuuguaaacuuu

SEQ ID NO: 3173930 - RNA, 19 nt, Human
uuaaauguuuuguaaacuu

SEQ ID NO: 3173931 - RNA, 18 nt, Human
uuaaauguuuuguaaacu

SEQ ID NO: 3173932 - RNA, 15 nt, Human
uuaaauguuuuguaa

SEQ ID NO: 3173933 - RNA, 17 nt, Human
uuaacuaaauuuuaaag

SEQ ID NO: 3173934 - RNA, 18 nt, Human
uuaacuaaauuuuaaagc

SEQ ID NO: 3173935 - RNA, 20 nt, Human
uuaacuaaauuuuaaagcca

SEQ ID NO: 3173936 - RNA, 15 nt, Human
uuaaccucugcuuuu

SEQ ID NO: 3173937 - RNA, 17 nt, Human
uuaaccacuucagcuga

SEQ ID NO: 3173938 - RNA, 18 nt, Human
uuaaccccauaauuagau

SEQ ID NO: 3173939 - RNA, 19 nt, Human
uuaaugauauacugaucuu

SEQ ID NO: 3173940 - RNA, 21 nt, Human
uuaaugauaugcuuguaacua

SEQ ID NO: 3173941 - RNA, 22 nt, Human
uuaauauugauaugcuuauaca

SEQ ID NO: 3173942 - RNA, 18 nt, Human
uuaauauugauaugcuua

SEQ ID NO: 3173943 - RNA, 15 nt, Human
uuaauaucacucauu

SEQ ID NO: 3173944 - RNA, 16 nt, Human
uuaauaucacucauua

SEQ ID NO: 3173945 - RNA, 17 nt, Human
uuaauaucacucauuaa

SEQ ID NO: 3173946 - RNA, 18 nt, Human
uuaauaucacucauuaau

SEQ ID NO: 3173947 - RNA, 20 nt, Human
uuaauaucacucauuaauua

SEQ ID NO: 3173948 - RNA, 13 nt, Human
uuaauauauuaaa

SEQ ID NO: 3173949 - RNA, 16 nt, Human
uuaauauauuaaaauu

SEQ ID NO: 3173950 - RNA, 18 nt, Human
uuaauauauuaaaauucc

SEQ ID NO: 3173951 - RNA, 20 nt, Human
uuaauauauuaaaauuccaa

SEQ ID NO: 3173952 - RNA, 15 nt, Human
uuaagccuuuggaaa

SEQ ID NO: 3173953 - RNA, 16 nt, Human
uuaagccuuuggaaac

SEQ ID NO: 3173954 - RNA, 17 nt, Human
uuaagcuguuacugucu

SEQ ID NO: 3173955 - RNA, 17 nt, Human
uuaagccuuuguugaac

SEQ ID NO: 3173956 - RNA, 19 nt, Human
uuaagcuaggaaaagaaau

SEQ ID NO: 3173957 - RNA, 18 nt, Human
uuaagccuuuguugaacu

SEQ ID NO: 3173958 - RNA, 22 nt, Human
uuaagcuaggaaaagaaaucua

SEQ ID NO: 3173959 - RNA, 11 nt, Human
uuaagcugcag

SEQ ID NO: 3173960 - RNA, 14 nt, Human
uuaauguauauaaa

SEQ ID NO: 3173961 - RNA, 17 nt, Human
uuaauguauauaaaaau

SEQ ID NO: 3173962 - RNA, 21 nt, Human
uuaauguauauaaaaauggcu

SEQ ID NO: 3173963 - RNA, 20 nt, Human
uuacaagcgugagccacugc

SEQ ID NO: 3173964 - RNA, 15 nt, Human
uuaauguugauuucu

SEQ ID NO: 3173965 - RNA, 14 nt, Human
uuaauguugauuuc

SEQ ID NO: 3173966 - RNA, 23 nt, Human
uuaauguugaacaaaauaaauug

SEQ ID NO: 3173967 - RNA, 17 nt, Human
uuaauguugaacaaaau

SEQ ID NO: 3173968 - RNA, 21 nt, Human
uuaauguugauuucuaguuau

SEQ ID NO: 3173969 - RNA, 17 nt, Human
uuaauguugauuucuag

SEQ ID NO: 3173970 - RNA, 21 nt, Human
uuacaagcgugagccacugca

SEQ ID NO: 3173971 - RNA, 11 nt, Human
uuacuguguua

SEQ ID NO: 3173972 - RNA, 21 nt, Human
uuacuuaaaccgccaaggcug

SEQ ID NO: 3173973 - RNA, 23 nt, Human
uuacuguucauuugauuuguaca

SEQ ID NO: 3173974 - RNA, 23 nt, Human
uuacuucuuauacauuugauaaa

SEQ ID NO: 3173975 - RNA, 12 nt, Human
uuacuucugcua

SEQ ID NO: 3173976 - RNA, 11 nt, Human
uuacuucugcu

SEQ ID NO: 3173977 - RNA, 18 nt, Human
uuacuuagguguggggga

SEQ ID NO: 3173978 - RNA, 21 nt, Human
uuacuaggugcccagaaugag

SEQ ID NO: 3173979 - RNA, 17 nt, Human
uuacuaguuucccuugc

SEQ ID NO: 3173980 - RNA, 19 nt, Human
uuacuaucaugucaaacgu

SEQ ID NO: 3173981 - RNA, 15 nt, Human
uuacuauagcaaagu

SEQ ID NO: 3173982 - RNA, 17 nt, Human
uuacuauagcaaaguag

SEQ ID NO: 3173983 - RNA, 18 nt, Human
uuacuauagcaaaguagu

SEQ ID NO: 3173984 - RNA, 22 nt, Human
uuacuauagcaaaguaguacuu

SEQ ID NO: 3173985 - RNA, 21 nt, Human
uuacuaucaugucaaacguga

SEQ ID NO: 3173986 - RNA, 17 nt, Human
uuacuaccuccucuccu

SEQ ID NO: 3173987 - RNA, 19 nt, Human
uuacuacaauauguacauu

SEQ ID NO: 3173988 - RNA, 18 nt, Human
uuacuacagccuuaauau

SEQ ID NO: 3173989 - RNA, 17 nt, Human
uuacuacaauauguaca

SEQ ID NO: 3173990 - RNA, 21 nt, Human
uuacuaacuucuaaaacugua

SEQ ID NO: 3173991 - RNA, 20 nt, Human
uuacuaacuucuaaaacugu

SEQ ID NO: 3173992 - RNA, 19 nt, Human
uuacuaacuucuaaaacug

SEQ ID NO: 3173993 - RNA, 17 nt, Human
uuacuaacuucuaaaac

SEQ ID NO: 3173994 - RNA, 15 nt, Human
uuacuaacuucuaaa

SEQ ID NO: 3173995 - RNA, 11 nt, Human
uuacuaacuuc

SEQ ID NO: 3173996 - RNA, 17 nt, Human
uuagacauguaauuugu

SEQ ID NO: 3173997 - RNA, 19 nt, Human
uuagaccagaggucuagau

SEQ ID NO: 3173998 - RNA, 16 nt, Human
uuagacagucccugcc

SEQ ID NO: 3173999 - RNA, 17 nt, Human
uuagacagucccugcca

SEQ ID NO: 3174000 - RNA, 18 nt, Human
uuagacagucccugccaa

SEQ ID NO: 3174001 - RNA, 14 nt, Human
uuagacagucccug

SEQ ID NO: 3174002 - RNA, 22 nt, Human
uuagaaaaggugauaaaaucau

SEQ ID NO: 3174003 - RNA, 13 nt, Human
uuagaaaagugaa

SEQ ID NO: 3174004 - RNA, 13 nt, Human
uuagagaacuaaa

SEQ ID NO: 3174005 - RNA, 22 nt, Human
uuagacuuuuccaauaugugau

SEQ ID NO: 3174006 - RNA, 21 nt, Human
uuagacuuuuccaauauguga

SEQ ID NO: 3174007 - RNA, 24 nt, Human
uuagagacagagcgacagagcagu

SEQ ID NO: 3174008 - RNA, 12 nt, Human
uuagacuugaaa

SEQ ID NO: 3174009 - RNA, 13 nt, Human
uuagacuugaaaa

SEQ ID NO: 3174010 - RNA, 19 nt, Human
uuagacuugaaaagagaca

SEQ ID NO: 3174011 - RNA, 20 nt, Human
uuagacuugaaaagagacag

SEQ ID NO: 3174012 - RNA, 14 nt, Human
uuagacuucuguuu

SEQ ID NO: 3174013 - RNA, 19 nt, Human
uuagacuucuguuuucaau

SEQ ID NO: 3174014 - RNA, 18 nt, Human
uuagacuucuguuuucaa

SEQ ID NO: 3174015 - RNA, 17 nt, Human
uuagacuucuguuuuca

SEQ ID NO: 3174016 - RNA, 15 nt, Human
uuagacuucuguuuu

SEQ ID NO: 3174017 - RNA, 14 nt, Human
uuagacugccagcu

SEQ ID NO: 3174018 - RNA, 17 nt, Human
uuagacugccagcucuu

SEQ ID NO: 3174019 - RNA, 16 nt, Human
uuagacugccagcucu

SEQ ID NO: 3174020 - RNA, 13 nt, Human
uuagacugccagc

SEQ ID NO: 3174021 - RNA, 15 nt, Human
uuagacagucccugc

SEQ ID NO: 3174022 - RNA, 20 nt, Human
uuacuuuuccuugcauacaa

SEQ ID NO: 3174023 - RNA, 13 nt, Human
uuagaaaacuuug

SEQ ID NO: 3174024 - RNA, 12 nt, Human
uuagaaaaggca

SEQ ID NO: 3174025 - RNA, 23 nt, Human
uuagaaaagggaguuuaaaaaug

SEQ ID NO: 3174026 - RNA, 21 nt, Human
uuagaaaaggugauaaaauca

SEQ ID NO: 3174027 - RNA, 20 nt, Human
uuagaaaaggugauaaaauc

SEQ ID NO: 3174028 - RNA, 16 nt, Human
uuagaaaacuuuguua

SEQ ID NO: 3174029 - RNA, 15 nt, Human
uuagaaaacuuuguu

SEQ ID NO: 3174030 - RNA, 14 nt, Human
uuagaaaacuuugu

SEQ ID NO: 3174031 - RNA, 14 nt, Human
uuacuuuguguuca

SEQ ID NO: 3174032 - RNA, 18 nt, Human
uuacuuuuccucuuagaa

SEQ ID NO: 3174033 - RNA, 19 nt, Human
uuacuuuuccuugcauaca

SEQ ID NO: 3174034 - RNA, 23 nt, Human
uuacuuuguaaauucugauuucu

SEQ ID NO: 3174035 - RNA, 18 nt, Human
uuacuuuaaaaggagcca

SEQ ID NO: 3174036 - RNA, 17 nt, Human
uuacuuuaaaaggagcc

SEQ ID NO: 3174037 - RNA, 18 nt, Human
uuacuugaauaguauugu

SEQ ID NO: 3174038 - RNA, 17 nt, Human
uuacuugauaagggacu

SEQ ID NO: 3174039 - RNA, 15 nt, Human
uuacuugauaaggga

SEQ ID NO: 3174040 - RNA, 17 nt, Human
uuacuuggaaauauuaa

SEQ ID NO: 3174041 - RNA, 18 nt, Human
uuacuuggaaauauuaaa

SEQ ID NO: 3174042 - RNA, 21 nt, Human
uuacuuggaaauauuaaaaga

SEQ ID NO: 3174043 - RNA, 21 nt, Human
uuacuugucuuucugggguuu

SEQ ID NO: 3174044 - RNA, 17 nt, Human
uuacuuguugccuauaa

SEQ ID NO: 3174045 - RNA, 23 nt, Human
uuacuuguugccuauaagccaaa

SEQ ID NO: 3174046 - RNA, 15 nt, Human
uuacuuuaacaugcc

SEQ ID NO: 3174047 - RNA, 22 nt, Human
uuacuuuaacuuaguuuugcau

SEQ ID NO: 3174048 - RNA, 14 nt, Human
uuacuuuccucuga

SEQ ID NO: 3174049 - RNA, 13 nt, Human
uuacuuuagaaaa

SEQ ID NO: 3174050 - RNA, 19 nt, Human
uuacuuuccaauucuccuu

SEQ ID NO: 3174051 - RNA, 11 nt, Human
uuacuuuguaa

SEQ ID NO: 3174052 - RNA, 13 nt, Human
uuacuuuguaaau

SEQ ID NO: 3174053 - RNA, 14 nt, Human
uuacuuuguaaauu

SEQ ID NO: 3174054 - RNA, 17 nt, Human
uuacuuuguaaauucug

SEQ ID NO: 3174055 - RNA, 18 nt, Human
uuacuuuguaaauucuga

SEQ ID NO: 3174056 - RNA, 19 nt, Human
uuacuuuguaaauucugau

SEQ ID NO: 3174057 - RNA, 20 nt, Human
uuacuuuguaaauucugauu

SEQ ID NO: 3174058 - RNA, 22 nt, Human
uuacuuuguaaauucugauuuc

SEQ ID NO: 3174059 - RNA, 14 nt, Human
uuaguguuauauga

SEQ ID NO: 3174060 - RNA, 15 nt, Human
uuaguguuauaugaa

SEQ ID NO: 3174061 - RNA, 13 nt, Human
uuaguauuaucuu

SEQ ID NO: 3174062 - RNA, 20 nt, Human
uuagucucaguucucuuaau

SEQ ID NO: 3174063 - RNA, 12 nt, Human
uuagugugauug

SEQ ID NO: 3174064 - RNA, 18 nt, Human
uuagugugguuuucuguu

SEQ ID NO: 3174065 - RNA, 19 nt, Human
uuagugugguuuucuguuu

SEQ ID NO: 3174066 - RNA, 22 nt, Human
uuaguuacuaccuccucuccug

SEQ ID NO: 3174067 - RNA, 16 nt, Human
uuaguuccacugagac

SEQ ID NO: 3174068 - RNA, 15 nt, Human
uuaguuccacugaga

SEQ ID NO: 3174069 - RNA, 22 nt, Human
uuaguaggauaugccugcucuu

SEQ ID NO: 3174070 - RNA, 18 nt, Human
uuaggauguugaaaaagu

SEQ ID NO: 3174071 - RNA, 15 nt, Human
uuaggaguuuugaga

SEQ ID NO: 3174072 - RNA, 12 nt, Human
uuaggacaaauc

SEQ ID NO: 3174073 - RNA, 17 nt, Human
uuaguagagacaggguu

SEQ ID NO: 3174074 - RNA, 19 nt, Human
uuaguaggauaugccugcu

SEQ ID NO: 3174075 - RNA, 16 nt, Human
uuaguaggauaugccu

SEQ ID NO: 3174076 - RNA, 18 nt, Human
uuaggcaguauaaagaau

SEQ ID NO: 3174077 - RNA, 19 nt, Human
uuaggccaaagacaaauag

SEQ ID NO: 3174078 - RNA, 18 nt, Human
uuaggccaaagacaaaua

SEQ ID NO: 3174079 - RNA, 15 nt, Human
uuaggccaaagacaa

SEQ ID NO: 3174080 - RNA, 18 nt, Human
uuaggcaugguuuugggc

SEQ ID NO: 3174081 - RNA, 20 nt, Human
uuaggcaguauaaagaauag

SEQ ID NO: 3174082 - RNA, 17 nt, Human
uuagcuguaacaguucu

SEQ ID NO: 3174083 - RNA, 18 nt, Human
uuagcuguguuauuauag

SEQ ID NO: 3174084 - RNA, 14 nt, Human
uuagcuguguuauu

SEQ ID NO: 3174085 - RNA, 20 nt, Human
uuagcuuucugagcaagagg

SEQ ID NO: 3174086 - RNA, 13 nt, Human
uuagcuguaacag

SEQ ID NO: 3174087 - RNA, 12 nt, Human
uuagcugggaga

SEQ ID NO: 3174088 - RNA, 18 nt, Human
uuagcugccugaaaauca

SEQ ID NO: 3174089 - RNA, 18 nt, Human
uuagcuacguuuacucac

SEQ ID NO: 3174090 - RNA, 14 nt, Human
uuagcggagacgga

SEQ ID NO: 3174091 - RNA, 16 nt, Human
uuagaucauaguuuua

SEQ ID NO: 3174092 - RNA, 17 nt, Human
uuagaucauaguuuuau

SEQ ID NO: 3174093 - RNA, 14 nt, Human
uuagauccauuaau

SEQ ID NO: 3174094 - RNA, 15 nt, Human
uuagauccauuaauu

SEQ ID NO: 3174095 - RNA, 20 nt, Human
uuagauccauuaauuuaaau

SEQ ID NO: 3174096 - RNA, 23 nt, Human
uuagauccauuaauuuaaaugau

SEQ ID NO: 3174097 - RNA, 15 nt, Human
uuagaucauaguuuu

SEQ ID NO: 3174098 - RNA, 15 nt, Human
uuagauaaauauuga

SEQ ID NO: 3174099 - RNA, 20 nt, Human
uuagagcaacuuucuggggc

SEQ ID NO: 3174100 - RNA, 22 nt, Human
uuagagcuuuuuuuuuuuaauu

SEQ ID NO: 3174101 - RNA, 22 nt, Human
uuagagucaacuacacaaagca

SEQ ID NO: 3174102 - RNA, 23 nt, Human
uaugagcuggggaugucucucau

SEQ ID NO: 3174103 - RNA, 14 nt, Human
uaugagauacuuug

SEQ ID NO: 3174104 - RNA, 16 nt, Human
uaugagauacuuugca

SEQ ID NO: 3174105 - RNA, 16 nt, Human
uaugacuccagaauuu

SEQ ID NO: 3174106 - RNA, 17 nt, Human
uaugacuccagaauuuc

SEQ ID NO: 3174107 - RNA, 23 nt, Human
uaugacuccagaauuucccaaag

SEQ ID NO: 3174108 - RNA, 12 nt, Human
uaugcaaagcac

SEQ ID NO: 3174109 - RNA, 14 nt, Human
uaugcaaagcacug

SEQ ID NO: 3174110 - RNA, 13 nt, Human
uaugcaaagcacu

SEQ ID NO: 3174111 - RNA, 17 nt, Human
uaugauuuaauuugaaa

SEQ ID NO: 3174112 - RNA, 18 nt, Human
uaugauuuaauuugaaau

SEQ ID NO: 3174113 - RNA, 17 nt, Human
uaugauuuggaaaauaa

SEQ ID NO: 3174114 - RNA, 15 nt, Human
uaugauuuggaaaau

SEQ ID NO: 3174115 - RNA, 18 nt, Human
uaugauuuggaaaauaaa

SEQ ID NO: 3174116 - RNA, 15 nt, Human
uaugcaaagcacuga

SEQ ID NO: 3174117 - RNA, 18 nt, Human
uaugcaaucaaaucugcu

SEQ ID NO: 3174118 - RNA, 13 nt, Human
uaugcaagcaguu

SEQ ID NO: 3174119 - RNA, 23 nt, Human
uaugcaagcaguuucaauaaagu

SEQ ID NO: 3174120 - RNA, 18 nt, Human
uaugcaagcaguuucaau

SEQ ID NO: 3174121 - RNA, 17 nt, Human
uaugcaagcaguuucaa

SEQ ID NO: 3174122 - RNA, 16 nt, Human
uaugcaagcaguuuca

SEQ ID NO: 3174123 - RNA, 20 nt, Human
uaugcacaauuccaugacaa

SEQ ID NO: 3174124 - RNA, 15 nt, Human
uaugcacaauuccau

SEQ ID NO: 3174125 - RNA, 17 nt, Human
uaugcuucauacaggga

SEQ ID NO: 3174126 - RNA, 23 nt, Human
uaugcuuccagaaacacccacag

SEQ ID NO: 3174127 - RNA, 17 nt, Human
uaugcuuccagaaacac

SEQ ID NO: 3174128 - RNA, 14 nt, Human
uaugcuuccagaaa

SEQ ID NO: 3174129 - RNA, 19 nt, Human
uaugcuugcauauauuuca

SEQ ID NO: 3174130 - RNA, 20 nt, Human
uaugcuuguaacuaaaauaa

SEQ ID NO: 3174131 - RNA, 18 nt, Human
uaugcuuguaacuaaaau

SEQ ID NO: 3174132 - RNA, 14 nt, Human
uauggaaaaauaaa

SEQ ID NO: 3174133 - RNA, 15 nt, Human
uauggaaaaauaaaa

SEQ ID NO: 3174134 - RNA, 20 nt, Human
uauggaaaaauaaaacuguc

SEQ ID NO: 3174135 - RNA, 14 nt, Human
uaugcuuuucucaa

SEQ ID NO: 3174136 - RNA, 13 nt, Human
uauggaacacucu

SEQ ID NO: 3174137 - RNA, 16 nt, Human
uauggaacacucugag

SEQ ID NO: 3174138 - RNA, 17 nt, Human
uauggaacacucugaga

SEQ ID NO: 3174139 - RNA, 18 nt, Human
uauggaacacucugagac

SEQ ID NO: 3174140 - RNA, 19 nt, Human
uauggaacacucugagacu

SEQ ID NO: 3174141 - RNA, 16 nt, Human
uauggaaaugcaaacu

SEQ ID NO: 3174142 - RNA, 19 nt, Human
uauggaagguggagcguuc

SEQ ID NO: 3174143 - RNA, 16 nt, Human
uauggaagguggagcg

SEQ ID NO: 3174144 - RNA, 13 nt, Human
uauggaagaaagu

SEQ ID NO: 3174145 - RNA, 14 nt, Human
uauggaagaaagua

SEQ ID NO: 3174146 - RNA, 17 nt, Human
uauggacaaugacccag

SEQ ID NO: 3174147 - RNA, 22 nt, Human
uauggacacuggugccauguca

SEQ ID NO: 3174148 - RNA, 20 nt, Human
uaugcauauauauaugugug

SEQ ID NO: 3174149 - RNA, 19 nt, Human
uaugcauauauauaugugu

SEQ ID NO: 3174150 - RNA, 17 nt, Human
uaugcauauauauaugu

SEQ ID NO: 3174151 - RNA, 24 nt, Human
uaugcauaauaauccugcaaagua

SEQ ID NO: 3174152 - RNA, 14 nt, Human
uaugcagugcugcu

SEQ ID NO: 3174153 - RNA, 15 nt, Human
uaugcagugcugcuu

SEQ ID NO: 3174154 - RNA, 18 nt, Human
uaugcaguguagauuuua

SEQ ID NO: 3174155 - RNA, 18 nt, Human
uaugcagagguccacaac

SEQ ID NO: 3174156 - RNA, 19 nt, Human
uaugcagaauggcauuugc

SEQ ID NO: 3174157 - RNA, 16 nt, Human
uaugcagaauggcauu

SEQ ID NO: 3174158 - RNA, 18 nt, Human
uaugcacuaagucucuuu

SEQ ID NO: 3174159 - RNA, 17 nt, Human
uaugcacuaagucucuu

SEQ ID NO: 3174160 - RNA, 16 nt, Human
uaugcacuaagucucu

SEQ ID NO: 3174161 - RNA, 18 nt, Human
uaugcagaaauagacaaa

SEQ ID NO: 3174162 - RNA, 20 nt, Human
uaugcagaaauagacaaaaa

SEQ ID NO: 3174163 - RNA, 21 nt, Human
uaugcagaaauagacaaaaag

SEQ ID NO: 3174164 - RNA, 22 nt, Human
uaugcagaaauagacaaaaagu

SEQ ID NO: 3174165 - RNA, 16 nt, Human
uaugcuucauacaggg

SEQ ID NO: 3174166 - RNA, 14 nt, Human
uaugcuucauacag

SEQ ID NO: 3174167 - RNA, 13 nt, Human
uaugcuucauaca

SEQ ID NO: 3174168 - RNA, 12 nt, Human
uaugcuucauac

SEQ ID NO: 3174169 - RNA, 22 nt, Human
uaugcuuauacacuuacacuuu

SEQ ID NO: 3174170 - RNA, 16 nt, Human
uaucuaaauguugaaa

SEQ ID NO: 3174171 - RNA, 16 nt, Human
uaucgguauaaaggca

SEQ ID NO: 3174172 - RNA, 18 nt, Human
uauccugagagcccagaa

SEQ ID NO: 3174173 - RNA, 12 nt, Human
uauccugaauaa

SEQ ID NO: 3174174 - RNA, 15 nt, Human
uauccuucagccuga

SEQ ID NO: 3174175 - RNA, 14 nt, Human
uauccuucagccug

SEQ ID NO: 3174176 - RNA, 19 nt, Human
uauauguuuuaagaggcag

SEQ ID NO: 3174177 - RNA, 19 nt, Human
uauauguuuuugaaggcag

SEQ ID NO: 3174178 - RNA, 13 nt, Human
uauauuaaaauuc

SEQ ID NO: 3174179 - RNA, 20 nt, Human
uaucuaccaacuuucaagaa

SEQ ID NO: 3174180 - RNA, 19 nt, Human
uaucuaccaacuuucaaga

SEQ ID NO: 3174181 - RNA, 18 nt, Human
uaucuaccaacuuucaag

SEQ ID NO: 3174182 - RNA, 17 nt, Human
uaucuaccaacuuucaa

SEQ ID NO: 3174183 - RNA, 16 nt, Human
uaucuaccaacuuuca

SEQ ID NO: 3174184 - RNA, 15 nt, Human
uaucuaauuuggauu

SEQ ID NO: 3174185 - RNA, 15 nt, Human
uaucuaccaacuuuc

SEQ ID NO: 3174186 - RNA, 21 nt, Human
uaucuaauauguaacaagcca

SEQ ID NO: 3174187 - RNA, 18 nt, Human
uaucguauucaccuucag

SEQ ID NO: 3174188 - RNA, 16 nt, Human
uaucguauucaccuuc

SEQ ID NO: 3174189 - RNA, 13 nt, Human
uaucuaagaauaa

SEQ ID NO: 3174190 - RNA, 15 nt, Human
uaucuaagaauaaua

SEQ ID NO: 3174191 - RNA, 19 nt, Human
uaucuaagaauaauaaaau

SEQ ID NO: 3174192 - RNA, 16 nt, Human
uaucuggauucaaauu

SEQ ID NO: 3174193 - RNA, 18 nt, Human
uaucuggauucaaauuua

SEQ ID NO: 3174194 - RNA, 19 nt, Human
uaucuggauucaaauuuau

SEQ ID NO: 3174195 - RNA, 19 nt, Human
uaucugcccaccucggccu

SEQ ID NO: 3174196 - RNA, 14 nt, Human
uaugaccacacucc

SEQ ID NO: 3174197 - RNA, 19 nt, Human
uaugaccacacuccagcug

SEQ ID NO: 3174198 - RNA, 17 nt, Human
uaugacaaauguuucua

SEQ ID NO: 3174199 - RNA, 13 nt, Human
uaugacaaauguu

SEQ ID NO: 3174200 - RNA, 16 nt, Human
uaugacaaauguuucu

SEQ ID NO: 3174201 - RNA, 14 nt, Human
uaugacaaauguuu

SEQ ID NO: 3174202 - RNA, 17 nt, Human
uaucuucugcucuuucu

SEQ ID NO: 3174203 - RNA, 15 nt, Human
uaucuucuggacuau

SEQ ID NO: 3174204 - RNA, 21 nt, Human
uaucuucuggacuauagcugu

SEQ ID NO: 3174205 - RNA, 15 nt, Human
uaugaauacuuugca

SEQ ID NO: 3174206 - RNA, 13 nt, Human
uaugaauacuuug

SEQ ID NO: 3174207 - RNA, 15 nt, Human
uaugaaucugagaga

SEQ ID NO: 3174208 - RNA, 21 nt, Human
uaugaaucugagagaugcugu

SEQ ID NO: 3174209 - RNA, 20 nt, Human
uaugaaucuauuugugggug

SEQ ID NO: 3174210 - RNA, 16 nt, Human
uaucuguuuacagugu

SEQ ID NO: 3174211 - RNA, 17 nt, Human
uaucuguuuacaguguu

SEQ ID NO: 3174212 - RNA, 14 nt, Human
uaucuuacuuuccu

SEQ ID NO: 3174213 - RNA, 18 nt, Human
uaugaauaaagacaccua

SEQ ID NO: 3174214 - RNA, 10 nt, Human
uaucuucauc

SEQ ID NO: 3174215 - RNA, 14 nt, Human
uaucuucauguaaa

SEQ ID NO: 3174216 - RNA, 15 nt, Human
uaucuucauguaaau

SEQ ID NO: 3174217 - RNA, 16 nt, Human
uaucuucauguaaauu

SEQ ID NO: 3174218 - RNA, 18 nt, Human
uaucuucauguaaauuga

SEQ ID NO: 3174219 - RNA, 23 nt, Human
uaucuucauguaaauugacugua

SEQ ID NO: 3174220 - RNA, 23 nt, Human
uaucuuaucucagauauuugcac

SEQ ID NO: 3174221 - RNA, 18 nt, Human
uaucuuaucucagauauu

SEQ ID NO: 3174222 - RNA, 20 nt, Human
uaucuucguuaguaaucugu

SEQ ID NO: 3174223 - RNA, 21 nt, Human
uaucuucguuaguaaucugua

SEQ ID NO: 3174224 - RNA, 23 nt, Human
uaucuucguuaguaaucuguaua

SEQ ID NO: 3174225 - RNA, 16 nt, Human
uaucugugaaauauca

SEQ ID NO: 3174226 - RNA, 17 nt, Human
uaucugugaaauaucau

SEQ ID NO: 3174227 - RNA, 15 nt, Human
uaucuguuagaugcu

SEQ ID NO: 3174228 - RNA, 23 nt, Human
uaucugucauuugagcagggcuc

SEQ ID NO: 3174229 - RNA, 21 nt, Human
uaucugucauuugagcagggc

SEQ ID NO: 3174230 - RNA, 20 nt, Human
uaucugucauuugagcaggg

SEQ ID NO: 3174231 - RNA, 15 nt, Human
uaucuguaagagugu

SEQ ID NO: 3174232 - RNA, 19 nt, Human
uaucugguauuaaaugcca

SEQ ID NO: 3174233 - RNA, 20 nt, Human
uaggcuccuucaacaaggcu

SEQ ID NO: 3174234 - RNA, 16 nt, Human
uaggcuauuaaaaaag

SEQ ID NO: 3174235 - RNA, 17 nt, Human
uaggcuauuaaaaaagu

SEQ ID NO: 3174236 - RNA, 20 nt, Human
uagggaaaaaccagcgugug

SEQ ID NO: 3174237 - RNA, 21 nt, Human
uagggaaaaaccagcguguga

SEQ ID NO: 3174238 - RNA, 19 nt, Human
uagggaaaaaccagcgugu

SEQ ID NO: 3174239 - RNA, 11 nt, Human
uagggaaaaac

SEQ ID NO: 3174240 - RNA, 15 nt, Human
uagguagagucugag

SEQ ID NO: 3174241 - RNA, 20 nt, Human
uagguauaaguggugugugu

SEQ ID NO: 3174242 - RNA, 20 nt, Human
uagguauaucucccagugcu

SEQ ID NO: 3174243 - RNA, 19 nt, Human
uaggucguuuuaaaaacaa

SEQ ID NO: 3174244 - RNA, 16 nt, Human
uagguccuuuagaaac

SEQ ID NO: 3174245 - RNA, 15 nt, Human
uagguccuuuagaaa

SEQ ID NO: 3174246 - RNA, 19 nt, Human
uaggacaagggaaaauaaa

SEQ ID NO: 3174247 - RNA, 19 nt, Human
uaggacaaggugcaggcag

SEQ ID NO: 3174248 - RNA, 15 nt, Human
uaggacaaggugcag

SEQ ID NO: 3174249 - RNA, 20 nt, Human
uaggacaaggugcaggcagg

SEQ ID NO: 3174250 - RNA, 12 nt, Human
uaggaauugacc

SEQ ID NO: 3174251 - RNA, 23 nt, Human
uaggaauauuauauuuggaugca

SEQ ID NO: 3174252 - RNA, 20 nt, Human
uaggaauauuauauuuggau

SEQ ID NO: 3174253 - RNA, 18 nt, Human
uaggaauauuauauuugg

SEQ ID NO: 3174254 - RNA, 17 nt, Human
uaggaauauuauauuug

SEQ ID NO: 3174255 - RNA, 16 nt, Human
uaggaauauuauauuu

SEQ ID NO: 3174256 - RNA, 15 nt, Human
uaggaauauuauauu

SEQ ID NO: 3174257 - RNA, 14 nt, Human
uaggaauauuauau

SEQ ID NO: 3174258 - RNA, 13 nt, Human
uaggaauauuaua

SEQ ID NO: 3174259 - RNA, 18 nt, Human
uaggccaugggacaggga

SEQ ID NO: 3174260 - RNA, 16 nt, Human
uaggccaugggacagg

SEQ ID NO: 3174261 - RNA, 15 nt, Human
uaggccuggccagau

SEQ ID NO: 3174262 - RNA, 15 nt, Human
uaggcccuuucagug

SEQ ID NO: 3174263 - RNA, 14 nt, Human
uaggcccuuucagu

SEQ ID NO: 3174264 - RNA, 18 nt, Human
uaggccuggccagaugca

SEQ ID NO: 3174265 - RNA, 22 nt, Human
uaguauuugaaaacagaaauug

SEQ ID NO: 3174266 - RNA, 17 nt, Human
uaguauuugaaaacaga

SEQ ID NO: 3174267 - RNA, 14 nt, Human
uaguauuugaaaac

SEQ ID NO: 3174268 - RNA, 12 nt, Human
uaguauuugaaa

SEQ ID NO: 3174269 - RNA, 13 nt, Human
uaguaucaaaaga

SEQ ID NO: 3174270 - RNA, 23 nt, Human
uaggugacagagugagacucugu

SEQ ID NO: 3174271 - RNA, 21 nt, Human
uaggugauccacucgccuuca

SEQ ID NO: 3174272 - RNA, 20 nt, Human
uaguagggguaccacugaau

SEQ ID NO: 3174273 - RNA, 13 nt, Human
uaguguuauauga

SEQ ID NO: 3174274 - RNA, 15 nt, Human
uaguguuauaugaac

SEQ ID NO: 3174275 - RNA, 16 nt, Human
uaguguuauaugaaca

SEQ ID NO: 3174276 - RNA, 17 nt, Human
uaguguuauaugaacau

SEQ ID NO: 3174277 - RNA, 18 nt, Human
uaguguuauaugaacaua

SEQ ID NO: 3174278 - RNA, 22 nt, Human
uaguguuauaugaacauacaaa

SEQ ID NO: 3174279 - RNA, 16 nt, Human
uaguguucagaaaaaa

SEQ ID NO: 3174280 - RNA, 22 nt, Human
uaguguuauugagagagaugug

SEQ ID NO: 3174281 - RNA, 14 nt, Human
uaguguuauugcca

SEQ ID NO: 3174282 - RNA, 12 nt, Human
uaguguguugug

SEQ ID NO: 3174283 - RNA, 20 nt, Human
uaguguguugugcuuucaag

SEQ ID NO: 3174284 - RNA, 18 nt, Human
uagugugguuuucuguuu

SEQ ID NO: 3174285 - RNA, 22 nt, Human
uagugugguuuucuguuucuaa

SEQ ID NO: 3174286 - RNA, 22 nt, Human
uaguguggaaauuaagaagaaa

SEQ ID NO: 3174287 - RNA, 18 nt, Human
uaguguggaaauuaagaa

SEQ ID NO: 3174288 - RNA, 18 nt, Human
uagugucuggaucaguaa

SEQ ID NO: 3174289 - RNA, 19 nt, Human
uagugucuggaucaguaaa

SEQ ID NO: 3174290 - RNA, 21 nt, Human
uagugucuggaucaguaaaau

SEQ ID NO: 3174291 - RNA, 11 nt, Human
uagugugaaau

SEQ ID NO: 3174292 - RNA, 17 nt, Human
uagugugaaauauauua

SEQ ID NO: 3174293 - RNA, 23 nt, Human
uagucaaauguaauguggcuucu

SEQ ID NO: 3174294 - RNA, 15 nt, Human
uagugcaauauauuu

SEQ ID NO: 3174295 - RNA, 14 nt, Human
uagugcaauauauu

SEQ ID NO: 3174296 - RNA, 15 nt, Human
uagugcagcagggca

SEQ ID NO: 3174297 - RNA, 23 nt, Human
uagugcaauauauuuuguaugca

SEQ ID NO: 3174298 - RNA, 22 nt, Human
uagugcaauauauuuuguaugc

SEQ ID NO: 3174299 - RNA, 19 nt, Human
uagugcaauauauuuugua

SEQ ID NO: 3174300 - RNA, 18 nt, Human
uagugcaauauauuuugu

SEQ ID NO: 3174301 - RNA, 17 nt, Human
uagugcaauauauuuug

SEQ ID NO: 3174302 - RNA, 16 nt, Human
uagugcaauauauuuu

SEQ ID NO: 3174303 - RNA, 15 nt, Human
uagugcagcugaaau

SEQ ID NO: 3174304 - RNA, 17 nt, Human
uagugcagcugaaauug

SEQ ID NO: 3174305 - RNA, 16 nt, Human
uagugcagcugaaauu

SEQ ID NO: 3174306 - RNA, 22 nt, Human
uagugcagcugaaauugaaaag

SEQ ID NO: 3174307 - RNA, 21 nt, Human
uagugcagcugaaauugaaaa

SEQ ID NO: 3174308 - RNA, 20 nt, Human
uagugcagcugaaauugaaa

SEQ ID NO: 3174309 - RNA, 18 nt, Human
uagugcagcugaaauuga

SEQ ID NO: 3174310 - RNA, 13 nt, Human
uauaccuguugcu

SEQ ID NO: 3174311 - RNA, 23 nt, Human
uauaauugugugauauuucagaa

SEQ ID NO: 3174312 - RNA, 12 nt, Human
uauaauugugug

SEQ ID NO: 3174313 - RNA, 22 nt, Human
uauaauugugugauauuucaga

SEQ ID NO: 3174314 - RNA, 20 nt, Human
uauaauugugugauauuuca

SEQ ID NO: 3174315 - RNA, 16 nt, Human
uauaauguugcccagu

SEQ ID NO: 3174316 - RNA, 16 nt, Human
uauaaugaacaaaauu

SEQ ID NO: 3174317 - RNA, 15 nt, Human
uauaaugugaaaugu

SEQ ID NO: 3174318 - RNA, 16 nt, Human
uauaaugugaaaugua

SEQ ID NO: 3174319 - RNA, 19 nt, Human
uauaaugugaaauguaacu

SEQ ID NO: 3174320 - RNA, 17 nt, Human
uauaauguuuauuaaau

SEQ ID NO: 3174321 - RNA, 18 nt, Human
uauaauguuuauuaaaug

SEQ ID NO: 3174322 - RNA, 20 nt, Human
uauaauguuuauuaaaugcu

SEQ ID NO: 3174323 - RNA, 22 nt, Human
uauaauccuugauaauauauug

SEQ ID NO: 3174324 - RNA, 15 nt, Human
uauaaucucuucuua

SEQ ID NO: 3174325 - RNA, 21 nt, Human
uauaaucucuucuuauacaga

SEQ ID NO: 3174326 - RNA, 14 nt, Human
uauaaucagaaugg

SEQ ID NO: 3174327 - RNA, 16 nt, Human
uauaaucaccagggcc

SEQ ID NO: 3174328 - RNA, 12 nt, Human
uauaaacuuuua

SEQ ID NO: 3174329 - RNA, 19 nt, Human
uaguugcauagcaguauau

SEQ ID NO: 3174330 - RNA, 20 nt, Human
uaguugcauagcaguauaug

SEQ ID NO: 3174331 - RNA, 18 nt, Human
uaguugaggaaagcacag

SEQ ID NO: 3174332 - RNA, 12 nt, Human
uauaaagaauag

SEQ ID NO: 3174333 - RNA, 21 nt, Human
uauaaagaauaggacuuguuu

SEQ ID NO: 3174334 - RNA, 17 nt, Human
uauaaagaauaggacuu

SEQ ID NO: 3174335 - RNA, 14 nt, Human
uauaauacuuugua

SEQ ID NO: 3174336 - RNA, 15 nt, Human
uauaauacuuuguau

SEQ ID NO: 3174337 - RNA, 19 nt, Human
uauaauacuuuguauacaa

SEQ ID NO: 3174338 - RNA, 20 nt, Human
uauaauacuuuguauacaag

SEQ ID NO: 3174339 - RNA, 21 nt, Human
uauaauacuuuguauacaagu

SEQ ID NO: 3174340 - RNA, 22 nt, Human
uauaauacuuuguauacaagua

SEQ ID NO: 3174341 - RNA, 23 nt, Human
uauaauacacaaaaucaaauaau

SEQ ID NO: 3174342 - RNA, 20 nt, Human
uauaauacagaaucuuguuu

SEQ ID NO: 3174343 - RNA, 18 nt, Human
uauaauacacaaaaucaa

SEQ ID NO: 3174344 - RNA, 16 nt, Human
uauaauacacaaaauc

SEQ ID NO: 3174345 - RNA, 15 nt, Human
uauaauacacaaaau

SEQ ID NO: 3174346 - RNA, 16 nt, Human
uauaauauugaaaauu

SEQ ID NO: 3174347 - RNA, 19 nt, Human
uauaauauugaaaauugaa

SEQ ID NO: 3174348 - RNA, 12 nt, Human
uauaaaugugug

SEQ ID NO: 3174349 - RNA, 13 nt, Human
uauaaaugugugu

SEQ ID NO: 3174350 - RNA, 14 nt, Human
uauaaaugugugua

SEQ ID NO: 3174351 - RNA, 16 nt, Human
uauaaauguguguaug

SEQ ID NO: 3174352 - RNA, 15 nt, Human
uauaaauuauauucc

SEQ ID NO: 3174353 - RNA, 19 nt, Human
uauaguuaaucuauaacua

SEQ ID NO: 3174354 - RNA, 17 nt, Human
uauaguuacuguccugu

SEQ ID NO: 3174355 - RNA, 15 nt, Human
uauagugcaauauau

SEQ ID NO: 3174356 - RNA, 19 nt, Human
uauagugcaauauauuuug

SEQ ID NO: 3174357 - RNA, 16 nt, Human
uauagugcaauauauu

SEQ ID NO: 3174358 - RNA, 14 nt, Human
uauaguguguugug

SEQ ID NO: 3174359 - RNA, 16 nt, Human
uauaguguguugugcu

SEQ ID NO: 3174360 - RNA, 16 nt, Human
uauaguuauguaaaua

SEQ ID NO: 3174361 - RNA, 20 nt, Human
uauaguuauguaaauaauuc

SEQ ID NO: 3174362 - RNA, 22 nt, Human
uauaguuauguaaauaauucuu

SEQ ID NO: 3174363 - RNA, 22 nt, Human
uauacugcaaacuauuuaaaga

SEQ ID NO: 3174364 - RNA, 23 nt, Human
uauacugaucuucauuaccaaua

SEQ ID NO: 3174365 - RNA, 21 nt, Human
uauaccuguuuaaauugcuca

SEQ ID NO: 3174366 - RNA, 19 nt, Human
uauaccuguuuaaauugcu

SEQ ID NO: 3174367 - RNA, 18 nt, Human
uauaccuguuuaaauugc

SEQ ID NO: 3174368 - RNA, 17 nt, Human
uauaccuguuuaaauug

SEQ ID NO: 3174369 - RNA, 23 nt, Human
uauaccuguugcuuaauuacaau

SEQ ID NO: 3174370 - RNA, 16 nt, Human
uauacgagaacaggca

SEQ ID NO: 3174371 - RNA, 13 nt, Human
uauacguuucaaa

SEQ ID NO: 3174372 - RNA, 14 nt, Human
uauauguauguguu

SEQ ID NO: 3174373 - RNA, 21 nt, Human
uauaugcucugcauguuacau

SEQ ID NO: 3174374 - RNA, 20 nt, Human
uauaugcucugcauguuaca

SEQ ID NO: 3174375 - RNA, 19 nt, Human
uauauguauguguuuagaa

SEQ ID NO: 3174376 - RNA, 22 nt, Human
uauauguauguguuuagaauug

SEQ ID NO: 3174377 - RNA, 15 nt, Human
uauauguauguguuu

SEQ ID NO: 3174378 - RNA, 16 nt, Human
uauauguauguguuua

SEQ ID NO: 3174379 - RNA, 18 nt, Human
uauauguauguguuuaga

SEQ ID NO: 3174380 - RNA, 18 nt, Human
uauaugugaaaggauaug

SEQ ID NO: 3174381 - RNA, 17 nt, Human
uauaugugccacauuuu

SEQ ID NO: 3174382 - RNA, 13 nt, Human
uauauguguccau

SEQ ID NO: 3174383 - RNA, 16 nt, Human
uauaucuccuuuguau

SEQ ID NO: 3174384 - RNA, 12 nt, Human
uauaucuccuuu

SEQ ID NO: 3174385 - RNA, 19 nt, Human
uauaucucaaauuguaauu

SEQ ID NO: 3174386 - RNA, 17 nt, Human
uauaucucaaauuguaa

SEQ ID NO: 3174387 - RNA, 16 nt, Human
uauauaaaguauucuu

SEQ ID NO: 3174388 - RNA, 19 nt, Human
uauauaaaguauucuuuuu

SEQ ID NO: 3174389 - RNA, 17 nt, Human
ucaccaacgucugugcc

SEQ ID NO: 3174390 - RNA, 18 nt, Human
ucaccaacgucugugcca

SEQ ID NO: 3174391 - RNA, 21 nt, Human
ucaccaaaucagcugcuacua

SEQ ID NO: 3174392 - RNA, 14 nt, Human
ucacauuuauucug

SEQ ID NO: 3174393 - RNA, 13 nt, Human
ucaccaagcccag

SEQ ID NO: 3174394 - RNA, 16 nt, Human
ucaccacaugugcaca

SEQ ID NO: 3174395 - RNA, 19 nt, Human
ucacauuuagaaaagugaa

SEQ ID NO: 3174396 - RNA, 18 nt, Human
ucacccgcuaagagggag

SEQ ID NO: 3174397 - RNA, 21 nt, Human
ucacccgaucgccagcaaaac

SEQ ID NO: 3174398 - RNA, 12 nt, Human
ucacccuuuucu

SEQ ID NO: 3174399 - RNA, 14 nt, Human
ucaccgaaaacgug

SEQ ID NO: 3174400 - RNA, 20 nt, Human
ucacccuggggcuaggaaau

SEQ ID NO: 3174401 - RNA, 19 nt, Human
ucacccgcuaagagggagg

SEQ ID NO: 3174402 - RNA, 16 nt, Human
ucacccggugaccucu

SEQ ID NO: 3174403 - RNA, 19 nt, Human
ucacccuaccaacuuuacu

SEQ ID NO: 3174404 - RNA, 15 nt, Human
ucaccgaaaacgugg

SEQ ID NO: 3174405 - RNA, 19 nt, Human
ucaccgaaaacguggcugc

SEQ ID NO: 3174406 - RNA, 20 nt, Human
ucaccgaaaacguggcugcu

SEQ ID NO: 3174407 - RNA, 21 nt, Human
ucaccgaaaacguggcugcuu

SEQ ID NO: 3174408 - RNA, 22 nt, Human
ucaccgaaaacguggcugcuuc

SEQ ID NO: 3174409 - RNA, 23 nt, Human
ucaccgaaaacguggcugcuuca

SEQ ID NO: 3174410 - RNA, 18 nt, Human
ucacaagacccaaaaggc

SEQ ID NO: 3174411 - RNA, 18 nt, Human
ucaauucccaccuaugag

SEQ ID NO: 3174412 - RNA, 22 nt, Human
ucacaagacccaaaaggcagaa

SEQ ID NO: 3174413 - RNA, 19 nt, Human
ucaaggauaccuucuuauu

SEQ ID NO: 3174414 - RNA, 15 nt, Human
ucaauuauuuccccc

SEQ ID NO: 3174415 - RNA, 17 nt, Human
ucaauuauuucccccau

SEQ ID NO: 3174416 - RNA, 22 nt, Human
ucaauuauacuacuucuaaggu

SEQ ID NO: 3174417 - RNA, 20 nt, Human
ucaauuagcguuuaagguga

SEQ ID NO: 3174418 - RNA, 19 nt, Human
ucaauuaaagaaauaauuu

SEQ ID NO: 3174419 - RNA, 17 nt, Human
ucaauuaaagaaauaau

SEQ ID NO: 3174420 - RNA, 22 nt, Human
ucacacaugagcaucaggccag

SEQ ID NO: 3174421 - RNA, 23 nt, Human
ucacacaugagcaucaggccagg

SEQ ID NO: 3174422 - RNA, 15 nt, Human
ucacacacuuuggcu

SEQ ID NO: 3174423 - RNA, 18 nt, Human
ucacaggacucugccucc

SEQ ID NO: 3174424 - RNA, 17 nt, Human
ucacaggacucugccuc

SEQ ID NO: 3174425 - RNA, 16 nt, Human
ucacaggacucugccu

SEQ ID NO: 3174426 - RNA, 15 nt, Human
ucacaguaaaaauaa

SEQ ID NO: 3174427 - RNA, 16 nt, Human
ucacaguaaaaauaaa

SEQ ID NO: 3174428 - RNA, 18 nt, Human
ucacaguaaaaauaaaau

SEQ ID NO: 3174429 - RNA, 21 nt, Human
ucacaguaaaaauaaaauacu

SEQ ID NO: 3174430 - RNA, 23 nt, Human
ucacaggacucugccuccucuuc

SEQ ID NO: 3174431 - RNA, 19 nt, Human
ucacaggacucugccuccu

SEQ ID NO: 3174432 - RNA, 19 nt, Human
ucacaggagggagggggaa

SEQ ID NO: 3174433 - RNA, 21 nt, Human
ucaaagaggcacagagccaaa

SEQ ID NO: 3174434 - RNA, 17 nt, Human
ucaaauaugcaaagcac

SEQ ID NO: 3174435 - RNA, 16 nt, Human
ucaaauaugcaaagca

SEQ ID NO: 3174436 - RNA, 12 nt, Human
ucaaagagguuu

SEQ ID NO: 3174437 - RNA, 23 nt, Human
ucaaagagguuuuaaaaaaaucc

SEQ ID NO: 3174438 - RNA, 19 nt, Human
ucaaauaugcaaagcacug

SEQ ID NO: 3174439 - RNA, 18 nt, Human
ucaaauaugcaaagcacu

SEQ ID NO: 3174440 - RNA, 16 nt, Human
ucaaauguguuuuggu

SEQ ID NO: 3174441 - RNA, 14 nt, Human
ucaaauguguuuug

SEQ ID NO: 3174442 - RNA, 22 nt, Human
ucaaauguaauguggcuucugg

SEQ ID NO: 3174443 - RNA, 18 nt, Human
ucaaaucuuaagaaauaa

SEQ ID NO: 3174444 - RNA, 15 nt, Human
ucaaauguaaaguuu

SEQ ID NO: 3174445 - RNA, 13 nt, Human
ucaaaugaaaugu

SEQ ID NO: 3174446 - RNA, 14 nt, Human
ucaaaugaaaugua

SEQ ID NO: 3174447 - RNA, 15 nt, Human
ucaaaugaaauguau

SEQ ID NO: 3174448 - RNA, 20 nt, Human
ucaaaugaaauguaugcauu

SEQ ID NO: 3174449 - RNA, 23 nt, Human
ucaaaugaaauguaugcauucac

SEQ ID NO: 3174450 - RNA, 19 nt, Human
ucaaaugaauaaugccuuu

SEQ ID NO: 3174451 - RNA, 21 nt, Human
ucaaaugaauaaugccuuugu

SEQ ID NO: 3174452 - RNA, 22 nt, Human
ucaaaugaauaaugccuuugua

SEQ ID NO: 3174453 - RNA, 22 nt, Human
ucaaaucucuacaaauuuuucu

SEQ ID NO: 3174454 - RNA, 17 nt, Human
ucaaaucuuaagaaaua

SEQ ID NO: 3174455 - RNA, 14 nt, Human
ucaaaucuuaagaa

SEQ ID NO: 3174456 - RNA, 23 nt, Human
uauuugaauguaugcuucauaca

SEQ ID NO: 3174457 - RNA, 22 nt, Human
uauuugaauguaugcuucauac

SEQ ID NO: 3174458 - RNA, 17 nt, Human
uauuugaauuauuucug

SEQ ID NO: 3174459 - RNA, 15 nt, Human
uauuugaaugacuaa

SEQ ID NO: 3174460 - RNA, 23 nt, Human
uauuugauuuauuaacuuaauaa

SEQ ID NO: 3174461 - RNA, 13 nt, Human
uauuugauuuauu

SEQ ID NO: 3174462 - RNA, 15 nt, Human
uauuugauuuauuaa

SEQ ID NO: 3174463 - RNA, 16 nt, Human
uauuugauuuauuaac

SEQ ID NO: 3174464 - RNA, 19 nt, Human
uauuugauuuauuaacuua

SEQ ID NO: 3174465 - RNA, 22 nt, Human
ucaaacagucucaggaaaucaa

SEQ ID NO: 3174466 - RNA, 11 nt, Human
uauuugcaguc

SEQ ID NO: 3174467 - RNA, 17 nt, Human
uauuugcagucauggag

SEQ ID NO: 3174468 - RNA, 18 nt, Human
uauuugcagucauggaga

SEQ ID NO: 3174469 - RNA, 23 nt, Human
uauuugcagucauggagaaccac

SEQ ID NO: 3174470 - RNA, 15 nt, Human
ucaaaccccugaccu

SEQ ID NO: 3174471 - RNA, 14 nt, Human
ucaaaccccugacc

SEQ ID NO: 3174472 - RNA, 23 nt, Human
ucaaaccccgaccaccugcccaa

SEQ ID NO: 3174473 - RNA, 13 nt, Human
ucaaaccugugaa

SEQ ID NO: 3174474 - RNA, 20 nt, Human
ucaaaccccgaccaccugcc

SEQ ID NO: 3174475 - RNA, 19 nt, Human
ucaaaccccgaccaccugc

SEQ ID NO: 3174476 - RNA, 15 nt, Human
ucaaacauuaguacu

SEQ ID NO: 3174477 - RNA, 19 nt, Human
ucaaacauuaguacuuuau

SEQ ID NO: 3174478 - RNA, 18 nt, Human
ucaaacauuaguacuuua

SEQ ID NO: 3174479 - RNA, 17 nt, Human
ucaaacauuaguacuuu

SEQ ID NO: 3174480 - RNA, 16 nt, Human
ucaaacauuaguacuu

SEQ ID NO: 3174481 - RNA, 20 nt, Human
ucaaacauuaguacuuuaua

SEQ ID NO: 3174482 - RNA, 14 nt, Human
ucaacucccugccc

SEQ ID NO: 3174483 - RNA, 15 nt, Human
ucaacucccugcccc

SEQ ID NO: 3174484 - RNA, 21 nt, Human
ucaacucccugccccccagcc

SEQ ID NO: 3174485 - RNA, 22 nt, Human
ucaacucccugccccccagccc

SEQ ID NO: 3174486 - RNA, 20 nt, Human
ucaacucuccuccagaguca

SEQ ID NO: 3174487 - RNA, 15 nt, Human
ucaacucugcugagg

SEQ ID NO: 3174488 - RNA, 17 nt, Human
ucaacucugcugagggu

SEQ ID NO: 3174489 - RNA, 18 nt, Human
ucaacucugcugaggguc

SEQ ID NO: 3174490 - RNA, 22 nt, Human
ucaacucugcugaggguccaga

SEQ ID NO: 3174491 - RNA, 18 nt, Human
ucaacugaccagccucca

SEQ ID NO: 3174492 - RNA, 19 nt, Human
ucaaccccuucgcuccugu

SEQ ID NO: 3174493 - RNA, 18 nt, Human
ucaaccccuucgcuccug

SEQ ID NO: 3174494 - RNA, 18 nt, Human
ucaaauguguuuuggucc

SEQ ID NO: 3174495 - RNA, 15 nt, Human
ucaaccuccugggcu

SEQ ID NO: 3174496 - RNA, 14 nt, Human
ucaaccuccugggc

SEQ ID NO: 3174497 - RNA, 16 nt, Human
ucaaccuccugggcua

SEQ ID NO: 3174498 - RNA, 13 nt, Human
ucaaggauccuga

SEQ ID NO: 3174499 - RNA, 14 nt, Human
ucaaggauccugag

SEQ ID NO: 3174500 - RNA, 15 nt, Human
ucaaggauccugagc

SEQ ID NO: 3174501 - RNA, 16 nt, Human
ucaaggauccugagcc

SEQ ID NO: 3174502 - RNA, 19 nt, Human
ucaagcgauucuucugcuu

SEQ ID NO: 3174503 - RNA, 18 nt, Human
ucaagcgauucuucugcu

SEQ ID NO: 3174504 - RNA, 14 nt, Human
ucaagcuuauuuug

SEQ ID NO: 3174505 - RNA, 12 nt, Human
ucaagccaccaa

SEQ ID NO: 3174506 - RNA, 20 nt, Human
ucaagccaccaacauacucc

SEQ ID NO: 3174507 - RNA, 17 nt, Human
ucaagcgauucuucugc

SEQ ID NO: 3174508 - RNA, 13 nt, Human
ucaagcccaggag

SEQ ID NO: 3174509 - RNA, 14 nt, Human
ucaagcccaggagg

SEQ ID NO: 3174510 - RNA, 16 nt, Human
ucaagccagacucugc

SEQ ID NO: 3174511 - RNA, 21 nt, Human
uauuugaauguaugcuucaua

SEQ ID NO: 3174512 - RNA, 14 nt, Human
uauuugaaagugcc

SEQ ID NO: 3174513 - RNA, 16 nt, Human
uauuugaaccaauaaa

SEQ ID NO: 3174514 - RNA, 15 nt, Human
uauuugaaagugccu

SEQ ID NO: 3174515 - RNA, 20 nt, Human
uauuugaaagugccuuugca

SEQ ID NO: 3174516 - RNA, 23 nt, Human
uauuucuucaaauaucucuauuu

SEQ ID NO: 3174517 - RNA, 18 nt, Human
uauuugaaaacagaaauu

SEQ ID NO: 3174518 - RNA, 14 nt, Human
uauuugaaaacaga

SEQ ID NO: 3174519 - RNA, 22 nt, Human
uauuugaaaacagaaauuggua

SEQ ID NO: 3174520 - RNA, 20 nt, Human
uauuugaaaacagaaauugg

SEQ ID NO: 3174521 - RNA, 19 nt, Human
uauuugaaaacagaaauug

SEQ ID NO: 3174522 - RNA, 11 nt, Human
uauuuauuaaa

SEQ ID NO: 3174523 - RNA, 22 nt, Human
uauuuauuaaaugcccagcccc

SEQ ID NO: 3174524 - RNA, 21 nt, Human
uauuuaugaagaaaauacuua

SEQ ID NO: 3174525 - RNA, 18 nt, Human
uauuuaaagggaaauuga

SEQ ID NO: 3174526 - RNA, 12 nt, Human
uauuuaaaggga

SEQ ID NO: 3174527 - RNA, 20 nt, Human
uauuguuuaaaaucauuucu

SEQ ID NO: 3174528 - RNA, 17 nt, Human
uauuuaugggauccugg

SEQ ID NO: 3174529 - RNA, 14 nt, Human
uauuuaugaagaaa

SEQ ID NO: 3174530 - RNA, 20 nt, Human
uauuuaugaagaaaauacuu

SEQ ID NO: 3174531 - RNA, 15 nt, Human
uauuuaugaagaaaa

SEQ ID NO: 3174532 - RNA, 16 nt, Human
uauuuaucuguucaaa

SEQ ID NO: 3174533 - RNA, 22 nt, Human
uauuuauauguauguguuuaga

SEQ ID NO: 3174534 - RNA, 15 nt, Human
uauuuauauuuauug

SEQ ID NO: 3174535 - RNA, 16 nt, Human
uauuuauauuuauuga

SEQ ID NO: 3174536 - RNA, 17 nt, Human
uauuuauauuuauugac

SEQ ID NO: 3174537 - RNA, 18 nt, Human
uauuuauauuuauugacu

SEQ ID NO: 3174538 - RNA, 12 nt, Human
uauuuauaugua

SEQ ID NO: 3174539 - RNA, 14 nt, Human
uauuuauauguaug

SEQ ID NO: 3174540 - RNA, 15 nt, Human
uauuuauauguaugu

SEQ ID NO: 3174541 - RNA, 16 nt, Human
uauuuauauguaugug

SEQ ID NO: 3174542 - RNA, 17 nt, Human
uauuuauauguaugugu

SEQ ID NO: 3174543 - RNA, 18 nt, Human
uauuuauauguauguguu

SEQ ID NO: 3174544 - RNA, 19 nt, Human
uauuuauauguauguguuu

SEQ ID NO: 3174545 - RNA, 21 nt, Human
uauuuauauguauguguuuag

SEQ ID NO: 3174546 - RNA, 20 nt, Human
uauugauaugcuuauacacu

SEQ ID NO: 3174547 - RNA, 18 nt, Human
uauucauuguggucauag

SEQ ID NO: 3174548 - RNA, 16 nt, Human
uauuccaaaccaaauu

SEQ ID NO: 3174549 - RNA, 17 nt, Human
uauuccaaaccaaauuu

SEQ ID NO: 3174550 - RNA, 21 nt, Human
uauuccaaaccaaauuuuaau

SEQ ID NO: 3174551 - RNA, 14 nt, Human
uauugcaauaaagu

SEQ ID NO: 3174552 - RNA, 16 nt, Human
uauugcaauaaaguau

SEQ ID NO: 3174553 - RNA, 18 nt, Human
uauugcaauaaaguauaa

SEQ ID NO: 3174554 - RNA, 22 nt, Human
uauugcaucuggguagcuguaa

SEQ ID NO: 3174555 - RNA, 17 nt, Human
uauugccaaacauuaau

SEQ ID NO: 3174556 - RNA, 15 nt, Human
uauugccaaacauua

SEQ ID NO: 3174557 - RNA, 14 nt, Human
uauugccaaacauu

SEQ ID NO: 3174558 - RNA, 22 nt, Human
uauugccaaaacccagcugcac

SEQ ID NO: 3174559 - RNA, 21 nt, Human
uauugccaaaacccagcugca

SEQ ID NO: 3174560 - RNA, 20 nt, Human
uauugccaaaacccagcugc

SEQ ID NO: 3174561 - RNA, 19 nt, Human
uauugccaaaacccagcug

SEQ ID NO: 3174562 - RNA, 18 nt, Human
uauugccaaaacccagcu

SEQ ID NO: 3174563 - RNA, 15 nt, Human
uauuguuuaaaauca

SEQ ID NO: 3174564 - RNA, 17 nt, Human
uauuguuuaaaaucauu

SEQ ID NO: 3174565 - RNA, 16 nt, Human
uauuguuuaaaaucau

SEQ ID NO: 3174566 - RNA, 17 nt, Human
uauuguguugacuuuau

SEQ ID NO: 3174567 - RNA, 22 nt, Human
uauuguguugacuuuauaaauu

SEQ ID NO: 3174568 - RNA, 15 nt, Human
uauugugcuguucua

SEQ ID NO: 3174569 - RNA, 15 nt, Human
uauugcccacgcugg

SEQ ID NO: 3174570 - RNA, 22 nt, Human
uauugccaggaaaggagaguac

SEQ ID NO: 3174571 - RNA, 20 nt, Human
uauugcccaugauauaacuu

SEQ ID NO: 3174572 - RNA, 22 nt, Human
uauugccaaacauuaauguuga

SEQ ID NO: 3174573 - RNA, 21 nt, Human
uauugccaaacauuaauguug

SEQ ID NO: 3174574 - RNA, 19 nt, Human
uauugccaaacauuaaugu

SEQ ID NO: 3174575 - RNA, 18 nt, Human
uauugccaaacauuaaug

SEQ ID NO: 3174576 - RNA, 14 nt, Human
uauugcccacgcug

SEQ ID NO: 3174577 - RNA, 13 nt, Human
uauugcccacgcu

SEQ ID NO: 3174578 - RNA, 23 nt, Human
uauugcugauggugcaaugaccu

SEQ ID NO: 3174579 - RNA, 22 nt, Human
uauugcugauggugcaaugacc

SEQ ID NO: 3174580 - RNA, 13 nt, Human
uauuauauuugga

SEQ ID NO: 3174581 - RNA, 12 nt, Human
uauuauauuugg

SEQ ID NO: 3174582 - RNA, 11 nt, Human
uauuauauuug

SEQ ID NO: 3174583 - RNA, 13 nt, Human
uauuauauacaua

SEQ ID NO: 3174584 - RNA, 22 nt, Human
uauuauagagcagaaauucugu

SEQ ID NO: 3174585 - RNA, 20 nt, Human
uauuauagagcagaaauucu

SEQ ID NO: 3174586 - RNA, 19 nt, Human
uauuauagagcagaaauuc

SEQ ID NO: 3174587 - RNA, 18 nt, Human
uauuauagagcagaaauu

SEQ ID NO: 3174588 - RNA, 17 nt, Human
uauuauagagcagaaau

SEQ ID NO: 3174589 - RNA, 16 nt, Human
uauuauagagcagaaa

SEQ ID NO: 3174590 - RNA, 20 nt, Human
uauuaagcaugacagaaaau

SEQ ID NO: 3174591 - RNA, 21 nt, Human
uauuaagcccacaguauauuu

SEQ ID NO: 3174592 - RNA, 13 nt, Human
uauuaagcuuuuu

SEQ ID NO: 3174593 - RNA, 16 nt, Human
uauuaagcuuuuugga

SEQ ID NO: 3174594 - RNA, 19 nt, Human
uauuaagcuuuuuggaauc

SEQ ID NO: 3174595 - RNA, 16 nt, Human
uauuaagcaugacaga

SEQ ID NO: 3174596 - RNA, 22 nt, Human
uauuaagauuauaauuguugca

SEQ ID NO: 3174597 - RNA, 18 nt, Human
uauuaagauuauaauugu

SEQ ID NO: 3174598 - RNA, 14 nt, Human
uauuaaggaagaca

SEQ ID NO: 3174599 - RNA, 13 nt, Human
uauuaauaaaaag

SEQ ID NO: 3174600 - RNA, 16 nt, Human
uauuaauaaaaagaca

SEQ ID NO: 3174601 - RNA, 18 nt, Human
uauuauaagucuuacaua

SEQ ID NO: 3174602 - RNA, 19 nt, Human
uauuauaagucuuacauaa

SEQ ID NO: 3174603 - RNA, 20 nt, Human
uauuaaguaagucucaaggu

SEQ ID NO: 3174604 - RNA, 19 nt, Human
uauuauguccugugagaug

SEQ ID NO: 3174605 - RNA, 21 nt, Human
uauuauguccugugagaugug

SEQ ID NO: 3174606 - RNA, 22 nt, Human
uauuauguccugugagaugugu

SEQ ID NO: 3174607 - RNA, 22 nt, Human
uauuauuuauuuuuuuuaauug

SEQ ID NO: 3174608 - RNA, 18 nt, Human
uauuaucuuguucaggaa

SEQ ID NO: 3174609 - RNA, 20 nt, Human
uauuaucuuguucaggaaaa

SEQ ID NO: 3174610 - RNA, 21 nt, Human
uauuaucuuguucaggaaaag

SEQ ID NO: 3174611 - RNA, 22 nt, Human
uauuaucaaguagacuacuguu

SEQ ID NO: 3174612 - RNA, 16 nt, Human
uauuaucaaguagacu

SEQ ID NO: 3174613 - RNA, 14 nt, Human
uauuaucaaguaga

SEQ ID NO: 3174614 - RNA, 17 nt, Human
uauuauauuuggaugca

SEQ ID NO: 3174615 - RNA, 16 nt, Human
uauuauauuuggaugc

SEQ ID NO: 3174616 - RNA, 15 nt, Human
uauuauauuuggaug

SEQ ID NO: 3174617 - RNA, 14 nt, Human
uauuauauuuggau

SEQ ID NO: 3174618 - RNA, 18 nt, Human
uauggacagcauugccag

SEQ ID NO: 3174619 - RNA, 16 nt, Human
uauguguguuucuguc

SEQ ID NO: 3174620 - RNA, 18 nt, Human
uauguguguuucuguccu

SEQ ID NO: 3174621 - RNA, 19 nt, Human
uauggaggcuuugcauaga

SEQ ID NO: 3174622 - RNA, 23 nt, Human
uauggaggagaguguuuaacuga

SEQ ID NO: 3174623 - RNA, 13 nt, Human
uauguguuuagaa

SEQ ID NO: 3174624 - RNA, 16 nt, Human
uauguguuuagaauug

SEQ ID NO: 3174625 - RNA, 14 nt, Human
uauguguuuuucuc

SEQ ID NO: 3174626 - RNA, 17 nt, Human
uauguguuuuucucaua

SEQ ID NO: 3174627 - RNA, 21 nt, Human
uauguguuuuucucauauuug

SEQ ID NO: 3174628 - RNA, 20 nt, Human
uauguuauacaaccuucauu

SEQ ID NO: 3174629 - RNA, 21 nt, Human
uauguuauacaaccuucauuu

SEQ ID NO: 3174630 - RNA, 22 nt, Human
uauguuauacaaccuucauuua

SEQ ID NO: 3174631 - RNA, 17 nt, Human
uauguucuaagaaguga

SEQ ID NO: 3174632 - RNA, 22 nt, Human
uauguucuuaguggauguucug

SEQ ID NO: 3174633 - RNA, 16 nt, Human
uauguugaaaaaauuu

SEQ ID NO: 3174634 - RNA, 21 nt, Human
uauguugcccaggcaggucuu

SEQ ID NO: 3174635 - RNA, 17 nt, Human
uauguugaagccuuugu

SEQ ID NO: 3174636 - RNA, 14 nt, Human
uauuaacaauuaau

SEQ ID NO: 3174637 - RNA, 15 nt, Human
uauuaacaauuaauu

SEQ ID NO: 3174638 - RNA, 19 nt, Human
uauuaacaauuaauugucu

SEQ ID NO: 3174639 - RNA, 20 nt, Human
uauuaacaauuaauugucuu

SEQ ID NO: 3174640 - RNA, 17 nt, Human
uauuaacacuacucaaa

SEQ ID NO: 3174641 - RNA, 23 nt, Human
uauuaaaugcuucauuuguaugu

SEQ ID NO: 3174642 - RNA, 12 nt, Human
uauuaaaugcca

SEQ ID NO: 3174643 - RNA, 16 nt, Human
uauuaagaaagacuau

SEQ ID NO: 3174644 - RNA, 15 nt, Human
uauuaacuuaauaau

SEQ ID NO: 3174645 - RNA, 22 nt, Human
uauuaacugcucaguguuucau

SEQ ID NO: 3174646 - RNA, 19 nt, Human
uauuaacugcucaguguuu

SEQ ID NO: 3174647 - RNA, 20 nt, Human
uauuaacuuaauaaucaaga

SEQ ID NO: 3174648 - RNA, 16 nt, Human
uauuaacuuaauaauc

SEQ ID NO: 3174649 - RNA, 18 nt, Human
uauuaacuuaauaaucaa

SEQ ID NO: 3174650 - RNA, 17 nt, Human
uauuaaaugcccagccc

SEQ ID NO: 3174651 - RNA, 19 nt, Human
uauuaaaugcccagccccu

SEQ ID NO: 3174652 - RNA, 15 nt, Human
uauuaaaugcccagc

SEQ ID NO: 3174653 - RNA, 23 nt, Human
ucucaguccaugaagauguagag

SEQ ID NO: 3174654 - RNA, 12 nt, Human
ucucagucucac

SEQ ID NO: 3174655 - RNA, 13 nt, Human
ucuaugggacuca

SEQ ID NO: 3174656 - RNA, 12 nt, Human
ucuaugggacuc

SEQ ID NO: 3174657 - RNA, 19 nt, Human
ucuaugggacucaaugcac

SEQ ID NO: 3174658 - RNA, 18 nt, Human
ucucauacucaccucacc

SEQ ID NO: 3174659 - RNA, 16 nt, Human
ucucauacucaccuca

SEQ ID NO: 3174660 - RNA, 13 nt, Human
ucucagucucaca

SEQ ID NO: 3174661 - RNA, 17 nt, Human
ucucaucuugacagagc

SEQ ID NO: 3174662 - RNA, 22 nt, Human
ucucaucuugacagagccugcc

SEQ ID NO: 3174663 - RNA, 14 nt, Human
ucuccaccugccag

SEQ ID NO: 3174664 - RNA, 15 nt, Human
ucuccaccugccagg

SEQ ID NO: 3174665 - RNA, 16 nt, Human
ucuccaccugccaggg

SEQ ID NO: 3174666 - RNA, 17 nt, Human
ucuccaccugccaggga

SEQ ID NO: 3174667 - RNA, 19 nt, Human
ucuccaccugccagggaca

SEQ ID NO: 3174668 - RNA, 22 nt, Human
ucuccaccugccagggacagag

SEQ ID NO: 3174669 - RNA, 13 nt, Human
ucuccacuccaga

SEQ ID NO: 3174670 - RNA, 16 nt, Human
ucuccacccugcucuc

SEQ ID NO: 3174671 - RNA, 14 nt, Human
ucuccacccugcuc

SEQ ID NO: 3174672 - RNA, 17 nt, Human
ucuccacccugcucucc

SEQ ID NO: 3174673 - RNA, 12 nt, Human
ucuccacccugc

SEQ ID NO: 3174674 - RNA, 13 nt, Human
ucuccacccugcu

SEQ ID NO: 3174675 - RNA, 16 nt, Human
ucucaugccucagccu

SEQ ID NO: 3174676 - RNA, 19 nt, Human
ucucaugccucagccuccu

SEQ ID NO: 3174677 - RNA, 13 nt, Human
ucucaugccucag

SEQ ID NO: 3174678 - RNA, 22 nt, Human
ucuccagccccuggaugcagcc

SEQ ID NO: 3174679 - RNA, 16 nt, Human
ucuccagccccuggau

SEQ ID NO: 3174680 - RNA, 18 nt, Human
ucuccagccccuggaugc

SEQ ID NO: 3174681 - RNA, 12 nt, Human
ucuccagccccu

SEQ ID NO: 3174682 - RNA, 13 nt, Human
ucuccagccccug

SEQ ID NO: 3174683 - RNA, 14 nt, Human
ucuccagccccugg

SEQ ID NO: 3174684 - RNA, 15 nt, Human
ucuccagccccugga

SEQ ID NO: 3174685 - RNA, 14 nt, Human
ucuccagcaggccc

SEQ ID NO: 3174686 - RNA, 11 nt, Human
ucuccagcagg

SEQ ID NO: 3174687 - RNA, 14 nt, Human
ucuccacugccuuc

SEQ ID NO: 3174688 - RNA, 14 nt, Human
ucucccucccuugg

SEQ ID NO: 3174689 - RNA, 23 nt, Human
ucucccucagucuggcccuuccu

SEQ ID NO: 3174690 - RNA, 18 nt, Human
ucucccucagucuggccc

SEQ ID NO: 3174691 - RNA, 12 nt, Human
ucucccccagcc

SEQ ID NO: 3174692 - RNA, 23 nt, Human
ucucccccacccuuguuccaguu

SEQ ID NO: 3174693 - RNA, 21 nt, Human
ucucccccacccuuguuccag

SEQ ID NO: 3174694 - RNA, 20 nt, Human
ucucccccacccuuguucca

SEQ ID NO: 3174695 - RNA, 13 nt, Human
ucucccccacccu

SEQ ID NO: 3174696 - RNA, 16 nt, Human
ucuccccgcaguguuu

SEQ ID NO: 3174697 - RNA, 19 nt, Human
ucuacugggagccuaccca

SEQ ID NO: 3174698 - RNA, 16 nt, Human
ucuacugggagccuac

SEQ ID NO: 3174699 - RNA, 20 nt, Human
ucuacuucauguaauccaaa

SEQ ID NO: 3174700 - RNA, 15 nt, Human
ucuacuuccaagacu

SEQ ID NO: 3174701 - RNA, 14 nt, Human
ucuaccuuccugca

SEQ ID NO: 3174702 - RNA, 14 nt, Human
ucuaccuucauaag

SEQ ID NO: 3174703 - RNA, 15 nt, Human
ucuacagaggccaug

SEQ ID NO: 3174704 - RNA, 21 nt, Human
ucuacacauauaaauugucuu

SEQ ID NO: 3174705 - RNA, 12 nt, Human
ucuacagaaaaa

SEQ ID NO: 3174706 - RNA, 13 nt, Human
ucuacagaaaaac

SEQ ID NO: 3174707 - RNA, 21 nt, Human
ucuacacugugcugagucuga

SEQ ID NO: 3174708 - RNA, 17 nt, Human
ucuacaaauuuuucugu

SEQ ID NO: 3174709 - RNA, 14 nt, Human
ucuaucaccaagga

SEQ ID NO: 3174710 - RNA, 13 nt, Human
ucuaucauuguug

SEQ ID NO: 3174711 - RNA, 23 nt, Human
ucuagugcugugaaaaaaaaaau

SEQ ID NO: 3174712 - RNA, 19 nt, Human
ucuagugcugugaaaaaaa

SEQ ID NO: 3174713 - RNA, 16 nt, Human
ucuagugcugugaaaa

SEQ ID NO: 3174714 - RNA, 15 nt, Human
ucuagugcugugaaa

SEQ ID NO: 3174715 - RNA, 14 nt, Human
ucuagugcugugaa

SEQ ID NO: 3174716 - RNA, 13 nt, Human
ucuagugcuguga

SEQ ID NO: 3174717 - RNA, 12 nt, Human
ucuaggaagacu

SEQ ID NO: 3174718 - RNA, 19 nt, Human
ucuaggaagacuuuggaaa

SEQ ID NO: 3174719 - RNA, 15 nt, Human
ucuaggaagacuuug

SEQ ID NO: 3174720 - RNA, 16 nt, Human
ucuaggaagacuuugg

SEQ ID NO: 3174721 - RNA, 16 nt, Human
uccuuagaaaagccau

SEQ ID NO: 3174722 - RNA, 18 nt, Human
ucggacuuagcugggaga

SEQ ID NO: 3174723 - RNA, 12 nt, Human
ucggagaagagc

SEQ ID NO: 3174724 - RNA, 16 nt, Human
ucggagaagagcuguu

SEQ ID NO: 3174725 - RNA, 14 nt, Human
ucggagaagagcug

SEQ ID NO: 3174726 - RNA, 13 nt, Human
ucgugacaacacu

SEQ ID NO: 3174727 - RNA, 18 nt, Human
ucgugacaauguuuacaa

SEQ ID NO: 3174728 - RNA, 15 nt, Human
ucgucuuucccaaag

SEQ ID NO: 3174729 - RNA, 14 nt, Human
ucggcacagccugg

SEQ ID NO: 3174730 - RNA, 13 nt, Human
ucggcacagccug

SEQ ID NO: 3174731 - RNA, 15 nt, Human
ucggauccccuuccu

SEQ ID NO: 3174732 - RNA, 14 nt, Human
ucggaucagcugag

SEQ ID NO: 3174733 - RNA, 13 nt, Human
ucggaguucuucu

SEQ ID NO: 3174734 - RNA, 12 nt, Human
ucggaguucuuc

SEQ ID NO: 3174735 - RNA, 16 nt, Human
ucggaucaggcuccca

SEQ ID NO: 3174736 - RNA, 19 nt, Human
ucggaucagcugagccuuc

SEQ ID NO: 3174737 - RNA, 13 nt, Human
ucggauccccuuc

SEQ ID NO: 3174738 - RNA, 16 nt, Human
ucuaaaguacugagca

SEQ ID NO: 3174739 - RNA, 17 nt, Human
ucuaaaguaauugguua

SEQ ID NO: 3174740 - RNA, 16 nt, Human
ucguguccccuauccu

SEQ ID NO: 3174741 - RNA, 22 nt, Human
ucgugucauacucgagucugag

SEQ ID NO: 3174742 - RNA, 13 nt, Human
uccuguagcccua

SEQ ID NO: 3174743 - RNA, 11 nt, Human
uccuguagccc

SEQ ID NO: 3174744 - RNA, 12 nt, Human
uccuggccucaa

SEQ ID NO: 3174745 - RNA, 19 nt, Human
uccuggccggugugggggc

SEQ ID NO: 3174746 - RNA, 22 nt, Human
uccuggcacuaccaaaggacac

SEQ ID NO: 3174747 - RNA, 13 nt, Human
uccuggcacugcu

SEQ ID NO: 3174748 - RNA, 16 nt, Human
uccuggcacugcuucc

SEQ ID NO: 3174749 - RNA, 22 nt, Human
uccuggcacccggccccugcug

SEQ ID NO: 3174750 - RNA, 23 nt, Human
uccuggcacccggccccugcugg

SEQ ID NO: 3174751 - RNA, 14 nt, Human
uccuggaguucugg

SEQ ID NO: 3174752 - RNA, 23 nt, Human
uccuggaggcucaaauuuugagu

SEQ ID NO: 3174753 - RNA, 16 nt, Human
uccugccuaaggcuga

SEQ ID NO: 3174754 - RNA, 19 nt, Human
uccugccuaaggcugaacu

SEQ ID NO: 3174755 - RNA, 17 nt, Human
uccuggacaggccaggu

SEQ ID NO: 3174756 - RNA, 15 nt, Human
uccuggacaggccag

SEQ ID NO: 3174757 - RNA, 17 nt, Human
uccugcccuuaccugcc

SEQ ID NO: 3174758 - RNA, 21 nt, Human
uccugcccugggaggcaguga

SEQ ID NO: 3174759 - RNA, 16 nt, Human
uccugcccugcuguuu

SEQ ID NO: 3174760 - RNA, 11 nt, Human
uccugcccugg

SEQ ID NO: 3174761 - RNA, 12 nt, Human
uccugcccuggg

SEQ ID NO: 3174762 - RNA, 14 nt, Human
uccugcccugggag

SEQ ID NO: 3174763 - RNA, 15 nt, Human
uccugcccugggagg

SEQ ID NO: 3174764 - RNA, 20 nt, Human
uccugcccuuaccugccagg

SEQ ID NO: 3174765 - RNA, 13 nt, Human
uccuccugacacc

SEQ ID NO: 3174766 - RNA, 22 nt, Human
uccucuguccaggcacugcugc

SEQ ID NO: 3174767 - RNA, 16 nt, Human
uccucuuaacuguggu

SEQ ID NO: 3174768 - RNA, 15 nt, Human
uccucuuagaagaau

SEQ ID NO: 3174769 - RNA, 20 nt, Human
uccucuuagaagaauauugu

SEQ ID NO: 3174770 - RNA, 18 nt, Human
uccuccuccuuccuaguu

SEQ ID NO: 3174771 - RNA, 16 nt, Human
uccuccuccuuccuag

SEQ ID NO: 3174772 - RNA, 21 nt, Human
uccugagccagauuucacucu

SEQ ID NO: 3174773 - RNA, 11 nt, Human
uccugagcccc

SEQ ID NO: 3174774 - RNA, 19 nt, Human
uccugagcccccagcuucc

SEQ ID NO: 3174775 - RNA, 18 nt, Human
uccugagcccccagcuuc

SEQ ID NO: 3174776 - RNA, 17 nt, Human
uccugagcccccagcuu

SEQ ID NO: 3174777 - RNA, 16 nt, Human
uccugagcccccagcu

SEQ ID NO: 3174778 - RNA, 13 nt, Human
uccugagccccca

SEQ ID NO: 3174779 - RNA, 18 nt, Human
uccugccccugagcccau

SEQ ID NO: 3174780 - RNA, 10 nt, Human
uccugcccug

SEQ ID NO: 3174781 - RNA, 17 nt, Human
uccugccccugagccca

SEQ ID NO: 3174782 - RNA, 15 nt, Human
uccugcccacugaua

SEQ ID NO: 3174783 - RNA, 17 nt, Human
uccugaggcuccacuug

SEQ ID NO: 3174784 - RNA, 16 nt, Human
uccugcauuugugaaa

SEQ ID NO: 3174785 - RNA, 19 nt, Human
uccugaggcuccacuuggu

SEQ ID NO: 3174786 - RNA, 20 nt, Human
uccugaggcuccacuugguc

SEQ ID NO: 3174787 - RNA, 13 nt, Human
uccugccaggcau

SEQ ID NO: 3174788 - RNA, 14 nt, Human
uccugccaggcaug

SEQ ID NO: 3174789 - RNA, 11 nt, Human
uccugccacca

SEQ ID NO: 3174790 - RNA, 16 nt, Human
uccugccaccacgccc

SEQ ID NO: 3174791 - RNA, 16 nt, Human
uccuacacaggacagg

SEQ ID NO: 3174792 - RNA, 15 nt, Human
uccuacacaggacag

SEQ ID NO: 3174793 - RNA, 14 nt, Human
uccuacacaggaca

SEQ ID NO: 3174794 - RNA, 12 nt, Human
uccuacacagga

SEQ ID NO: 3174795 - RNA, 23 nt, Human
uccuagugaaagaggcagcuuga

SEQ ID NO: 3174796 - RNA, 14 nt, Human
uccuagugaaagag

SEQ ID NO: 3174797 - RNA, 21 nt, Human
uccuauauuguuuucagugua

SEQ ID NO: 3174798 - RNA, 20 nt, Human
uccuaguucaucccuucucu

SEQ ID NO: 3174799 - RNA, 19 nt, Human
uccuaguucaucccuucuc

SEQ ID NO: 3174800 - RNA, 23 nt, Human
uccuauauuguuuucaguguaca

SEQ ID NO: 3174801 - RNA, 23 nt, Human
uccucauucccucgucuuuccca

SEQ ID NO: 3174802 - RNA, 22 nt, Human
uccucauucccucgucuuuccc

SEQ ID NO: 3174803 - RNA, 18 nt, Human
uccucauuagcauuuugc

SEQ ID NO: 3174804 - RNA, 17 nt, Human
uccucauuagcauuuug

SEQ ID NO: 3174805 - RNA, 14 nt, Human
uccuccaaggacag

SEQ ID NO: 3174806 - RNA, 19 nt, Human
uccuccagggcucaacacu

SEQ ID NO: 3174807 - RNA, 12 nt, Human
uccucccaccuc

SEQ ID NO: 3174808 - RNA, 15 nt, Human
uccuccauccuccuc

SEQ ID NO: 3174809 - RNA, 23 nt, Human
uccgaguguguuucauccuuccc

SEQ ID NO: 3174810 - RNA, 19 nt, Human
uccgaguguguuucauccu

SEQ ID NO: 3174811 - RNA, 13 nt, Human
uccgaguguguuu

SEQ ID NO: 3174812 - RNA, 14 nt, Human
uccgccucuugggu

SEQ ID NO: 3174813 - RNA, 21 nt, Human
uccuaagcuauucaguaauaa

SEQ ID NO: 3174814 - RNA, 20 nt, Human
uccuaagcuauucaguaaua

SEQ ID NO: 3174815 - RNA, 18 nt, Human
uccuaagcuauucaguaa

SEQ ID NO: 3174816 - RNA, 18 nt, Human
uccgcuuucuacccagcg

SEQ ID NO: 3174817 - RNA, 16 nt, Human
uccgcuuucuacccag

SEQ ID NO: 3174818 - RNA, 13 nt, Human
uccgcuucccugg

SEQ ID NO: 3174819 - RNA, 12 nt, Human
uccgcuucccug

SEQ ID NO: 3174820 - RNA, 16 nt, Human
uccgcuucccugguuc

SEQ ID NO: 3174821 - RNA, 20 nt, Human
uccgcuccccugcuccuguc

SEQ ID NO: 3174822 - RNA, 22 nt, Human
ucccuucaaccauuccccaugg

SEQ ID NO: 3174823 - RNA, 21 nt, Human
ucccccuguuucagaggcuca

SEQ ID NO: 3174824 - RNA, 15 nt, Human
ucccccuuccaugga

SEQ ID NO: 3174825 - RNA, 16 nt, Human
ucccuuccucuuucca

SEQ ID NO: 3174826 - RNA, 15 nt, Human
ucccuuccucuuucc

SEQ ID NO: 3174827 - RNA, 13 nt, Human
ucccuuccuccau

SEQ ID NO: 3174828 - RNA, 20 nt, Human
ucaggaauugcccauuguuu

SEQ ID NO: 3174829 - RNA, 19 nt, Human
ucagcuuccccaguagcug

SEQ ID NO: 3174830 - RNA, 18 nt, Human
ucagcuuccccaguagcu

SEQ ID NO: 3174831 - RNA, 21 nt, Human
ucaggccugggggcugggcag

SEQ ID NO: 3174832 - RNA, 20 nt, Human
ucaggccgggcagagcacag

SEQ ID NO: 3174833 - RNA, 18 nt, Human
ucaggccgggcagagcac

SEQ ID NO: 3174834 - RNA, 15 nt, Human
ucaggcucuucuccu

SEQ ID NO: 3174835 - RNA, 20 nt, Human
ucaggaucaaaccccgacca

SEQ ID NO: 3174836 - RNA, 23 nt, Human
ucaggaagcucagggccuggcuc

SEQ ID NO: 3174837 - RNA, 17 nt, Human
ucagcuuccccaguagc

SEQ ID NO: 3174838 - RNA, 13 nt, Human
ucagcuuccccag

SEQ ID NO: 3174839 - RNA, 15 nt, Human
ucagcuguucagauu

SEQ ID NO: 3174840 - RNA, 23 nt, Human
ucagcucugcaagaauugaagca

SEQ ID NO: 3174841 - RNA, 22 nt, Human
ucagcuccagcucaccagcccc

SEQ ID NO: 3174842 - RNA, 16 nt, Human
ucaccuaauuaauuuc

SEQ ID NO: 3174843 - RNA, 24 nt, Human
ucagcuccagcucaccagccccag

SEQ ID NO: 3174844 - RNA, 23 nt, Human
ucagcuccagcucaccagcccca

SEQ ID NO: 3174845 - RNA, 22 nt, Human
ucagucuuuaaucugagaggcc

SEQ ID NO: 3174846 - RNA, 16 nt, Human
ucagugaugugccuaa

SEQ ID NO: 3174847 - RNA, 15 nt, Human
ucagugaugugccua

SEQ ID NO: 3174848 - RNA, 22 nt, Human
ucagugaccuacuacgcagagg

SEQ ID NO: 3174849 - RNA, 23 nt, Human
ucagucugauucccaagcucugc

SEQ ID NO: 3174850 - RNA, 22 nt, Human
ucagucugauucccaagcucug

SEQ ID NO: 3174851 - RNA, 21 nt, Human
ucagucugauucccaagcucu

SEQ ID NO: 3174852 - RNA, 19 nt, Human
ucagucugauucccaagcu

SEQ ID NO: 3174853 - RNA, 20 nt, Human
ucagguggggcagcuugagg

SEQ ID NO: 3174854 - RNA, 16 nt, Human
ucagucucccucccuu

SEQ ID NO: 3174855 - RNA, 13 nt, Human
ucagucaaaacuu

SEQ ID NO: 3174856 - RNA, 14 nt, Human
ucagucaaaacuuu

SEQ ID NO: 3174857 - RNA, 15 nt, Human
ucagucaaaacuuua

SEQ ID NO: 3174858 - RNA, 16 nt, Human
ucagucaaaacuuuaa

SEQ ID NO: 3174859 - RNA, 23 nt, Human
ucagucgccuuucagcaggcagc

SEQ ID NO: 3174860 - RNA, 20 nt, Human
ucagucacuaaaaggaagac

SEQ ID NO: 3174861 - RNA, 19 nt, Human
ucagguggggcagcuugag

SEQ ID NO: 3174862 - RNA, 18 nt, Human
ucagguggggcagcuuga

SEQ ID NO: 3174863 - RNA, 17 nt, Human
ucagguggggcagcuug

SEQ ID NO: 3174864 - RNA, 23 nt, Human
ucaggugauccacccaccucagc

SEQ ID NO: 3174865 - RNA, 23 nt, Human
ucaggugagaagcagaggaagga

SEQ ID NO: 3174866 - RNA, 16 nt, Human
ucaggugauccaccca

SEQ ID NO: 3174867 - RNA, 21 nt, Human
ucaggugaaacuccagaugcc

SEQ ID NO: 3174868 - RNA, 14 nt, Human
ucagguccugcuca

SEQ ID NO: 3174869 - RNA, 18 nt, Human
ucagguccugcucagcag

SEQ ID NO: 3174870 - RNA, 16 nt, Human
ucagguccugcucagc

SEQ ID NO: 3174871 - RNA, 12 nt, Human
ucaggucccugc

SEQ ID NO: 3174872 - RNA, 17 nt, Human
ucagggaccaccagagg

SEQ ID NO: 3174873 - RNA, 21 nt, Human
ucaggcucuucuccuuucaca

SEQ ID NO: 3174874 - RNA, 16 nt, Human
ucaggcucuucuccuu

SEQ ID NO: 3174875 - RNA, 14 nt, Human
ucaggcugagcuga

SEQ ID NO: 3174876 - RNA, 20 nt, Human
ucagggaagauaaguuggaa

SEQ ID NO: 3174877 - RNA, 16 nt, Human
ucagggaagauaaguu

SEQ ID NO: 3174878 - RNA, 22 nt, Human
uccaaacaugagguucucucua

SEQ ID NO: 3174879 - RNA, 14 nt, Human
uccaaaagaaaaac

SEQ ID NO: 3174880 - RNA, 13 nt, Human
uccaaaagaaaaa

SEQ ID NO: 3174881 - RNA, 17 nt, Human
uccaaagaaauguaagg

SEQ ID NO: 3174882 - RNA, 14 nt, Human
uccaaagaaaugua

SEQ ID NO: 3174883 - RNA, 14 nt, Human
uccaaaccaaauuu

SEQ ID NO: 3174884 - RNA, 17 nt, Human
uccaaaccaaauuuuaa

SEQ ID NO: 3174885 - RNA, 22 nt, Human
uccaaacaugguuuauugguga

SEQ ID NO: 3174886 - RNA, 14 nt, Human
uccaaacacaggca

SEQ ID NO: 3174887 - RNA, 12 nt, Human
uccaaagaaaug

SEQ ID NO: 3174888 - RNA, 16 nt, Human
ucauuagcaaaaaaag

SEQ ID NO: 3174889 - RNA, 12 nt, Human
ucauuagcaaaa

SEQ ID NO: 3174890 - RNA, 17 nt, Human
ucauuagaauuaccauu

SEQ ID NO: 3174891 - RNA, 16 nt, Human
ucauuaggauggcuag

SEQ ID NO: 3174892 - RNA, 22 nt, Human
ucauuagcaaaaaaaguuguau

SEQ ID NO: 3174893 - RNA, 20 nt, Human
ucauuagcaaaaaaaguugu

SEQ ID NO: 3174894 - RNA, 18 nt, Human
ucauuagcaaaaaaaguu

SEQ ID NO: 3174895 - RNA, 17 nt, Human
ucauuagcaaaaaaagu

SEQ ID NO: 3174896 - RNA, 19 nt, Human
ucauuguaauguugugaau

SEQ ID NO: 3174897 - RNA, 21 nt, Human
ucauuuacaagacaacauugu

SEQ ID NO: 3174898 - RNA, 22 nt, Human
ucauuguccagagcugcuuccc

SEQ ID NO: 3174899 - RNA, 15 nt, Human
ucauuguccagagcu

SEQ ID NO: 3174900 - RNA, 18 nt, Human
ucauuguuggacauuugg

SEQ ID NO: 3174901 - RNA, 22 nt, Human
ucauuuaaaaagguuuaaaacu

SEQ ID NO: 3174902 - RNA, 19 nt, Human
ucaucuugaauuguaagga

SEQ ID NO: 3174903 - RNA, 21 nt, Human
ucaucuugacagagccugccc

SEQ ID NO: 3174904 - RNA, 19 nt, Human
ucaucuugacagagccugc

SEQ ID NO: 3174905 - RNA, 17 nt, Human
ucauccacugugccaug

SEQ ID NO: 3174906 - RNA, 14 nt, Human
ucauccacugugcc

SEQ ID NO: 3174907 - RNA, 16 nt, Human
ucaucucaguccucaa

SEQ ID NO: 3174908 - RNA, 19 nt, Human
ucauggggggagcacccug

SEQ ID NO: 3174909 - RNA, 20 nt, Human
ucauggggggagcacccuga

SEQ ID NO: 3174910 - RNA, 22 nt, Human
ucauggggggagcacccugagg

SEQ ID NO: 3174911 - RNA, 17 nt, Human
ucaucaaugaaugaaug

SEQ ID NO: 3174912 - RNA, 13 nt, Human
ucaucaauaaaac

SEQ ID NO: 3174913 - RNA, 14 nt, Human
ucaucauccuaagc

SEQ ID NO: 3174914 - RNA, 15 nt, Human
ucaucauguuuugau

SEQ ID NO: 3174915 - RNA, 13 nt, Human
ucaucauuauuau

SEQ ID NO: 3174916 - RNA, 14 nt, Human
ucaucauuauuauu

SEQ ID NO: 3174917 - RNA, 13 nt, Human
ucaucaugucuau

SEQ ID NO: 3174918 - RNA, 16 nt, Human
ucaucaugucuauugu

SEQ ID NO: 3174919 - RNA, 18 nt, Human
ucaucaugucuauugucc

SEQ ID NO: 3174920 - RNA, 11 nt, Human
ucauagcagcu

SEQ ID NO: 3174921 - RNA, 12 nt, Human
ucauagaauagc

SEQ ID NO: 3174922 - RNA, 16 nt, Human
ucauagaauagcaugu

SEQ ID NO: 3174923 - RNA, 18 nt, Human
ucauagaauagcauguug

SEQ ID NO: 3174924 - RNA, 21 nt, Human
ucauagaauagcauguuguag

SEQ ID NO: 3174925 - RNA, 22 nt, Human
ucauagaauagcauguuguaga

SEQ ID NO: 3174926 - RNA, 11 nt, Human
ucaguguacau

SEQ ID NO: 3174927 - RNA, 20 nt, Human
ucaguguacauggaauaaca

SEQ ID NO: 3174928 - RNA, 24 nt, Human
uccacuuuuuaacucguuugcuga

SEQ ID NO: 3174929 - RNA, 17 nt, Human
uccagaaacacccacag

SEQ ID NO: 3174930 - RNA, 15 nt, Human
uccagaaacuuguuc

SEQ ID NO: 3174931 - RNA, 18 nt, Human
uccacuuuuccaguauuu

SEQ ID NO: 3174932 - RNA, 20 nt, Human
uccagaaacuuguucuucca

SEQ ID NO: 3174933 - RNA, 17 nt, Human
uccagaaacuuguucuu

SEQ ID NO: 3174934 - RNA, 16 nt, Human
uccagaaacuuguucu

SEQ ID NO: 3174935 - RNA, 23 nt, Human
uccacuuggucugugagaugcua

SEQ ID NO: 3174936 - RNA, 19 nt, Human
uccacuuucuagccagagg

SEQ ID NO: 3174937 - RNA, 16 nt, Human
uccaaagguuucaacu

SEQ ID NO: 3174938 - RNA, 20 nt, Human
uccacuuucuagccagagga

SEQ ID NO: 3174939 - RNA, 21 nt, Human
uccacuuucuagccagaggag

SEQ ID NO: 3174940 - RNA, 21 nt, Human
uccacuuggucugugagaugc

SEQ ID NO: 3174941 - RNA, 17 nt, Human
uccacuuggucugugag

SEQ ID NO: 3174942 - RNA, 14 nt, Human
uccagcaccacacu

SEQ ID NO: 3174943 - RNA, 21 nt, Human
uccagcaauucuccugccuca

SEQ ID NO: 3174944 - RNA, 22 nt, Human
uccagcaauucuccugccucag

SEQ ID NO: 3174945 - RNA, 15 nt, Human
uccagcucuggcaug

SEQ ID NO: 3174946 - RNA, 21 nt, Human
uccagcacaaccuucaagcug

SEQ ID NO: 3174947 - RNA, 12 nt, Human
uccaggagcagc

SEQ ID NO: 3174948 - RNA, 13 nt, Human
uccaggagcagcc

SEQ ID NO: 3174949 - RNA, 14 nt, Human
uccaggagcagcca

SEQ ID NO: 3174950 - RNA, 15 nt, Human
uccaggagcagccac

SEQ ID NO: 3174951 - RNA, 19 nt, Human
uccaggggugggacacccu

SEQ ID NO: 3174952 - RNA, 20 nt, Human
uccaggggugggacacccug

SEQ ID NO: 3174953 - RNA, 21 nt, Human
uccauaaucuggacuccucug

SEQ ID NO: 3174954 - RNA, 14 nt, Human
uccauagagagcaa

SEQ ID NO: 3174955 - RNA, 22 nt, Human
uccaucaagccaagccuccugu

SEQ ID NO: 3174956 - RNA, 23 nt, Human
uccauauuuuuuuccuuacauaa

SEQ ID NO: 3174957 - RNA, 22 nt, Human
uccauauuuuuuuccuuacaua

SEQ ID NO: 3174958 - RNA, 18 nt, Human
uccauauuuuuuuccuua

SEQ ID NO: 3174959 - RNA, 17 nt, Human
uccauauuuuuuuccuu

SEQ ID NO: 3174960 - RNA, 16 nt, Human
uccauauuuuuuuccu

SEQ ID NO: 3174961 - RNA, 16 nt, Human
uccauauuuuuacaac

SEQ ID NO: 3174962 - RNA, 14 nt, Human
uccaucaggccacu

SEQ ID NO: 3174963 - RNA, 21 nt, Human
uccaucaggugaggugugcuc

SEQ ID NO: 3174964 - RNA, 23 nt, Human
uccauggcgaaaacaucuccuua

SEQ ID NO: 3174965 - RNA, 15 nt, Human
uccaugcugccucca

SEQ ID NO: 3174966 - RNA, 14 nt, Human
uccaugcugccucc

SEQ ID NO: 3174967 - RNA, 18 nt, Human
uccagguuuaagcuguua

SEQ ID NO: 3174968 - RNA, 21 nt, Human
uccaggguucucuuguuuuga

SEQ ID NO: 3174969 - RNA, 20 nt, Human
uccagguuuaagcuguuacu

SEQ ID NO: 3174970 - RNA, 17 nt, Human
uccaguaagaucacugu

SEQ ID NO: 3174971 - RNA, 18 nt, Human
uccaguaagaucacuguu

SEQ ID NO: 3174972 - RNA, 19 nt, Human
uccaguaagaucacuguuu

SEQ ID NO: 3174973 - RNA, 20 nt, Human
uccaguaagaucacuguuua

SEQ ID NO: 3174974 - RNA, 15 nt, Human
uccaguaagaucacu

SEQ ID NO: 3174975 - RNA, 14 nt, Human
uccaguaaaauaau

SEQ ID NO: 3174976 - RNA, 14 nt, Human
uccaguuuuucaua

SEQ ID NO: 3174977 - RNA, 19 nt, Human
uccaguuucagaguucuca

SEQ ID NO: 3174978 - RNA, 21 nt, Human
uccaguugaaguuaguggaaa

SEQ ID NO: 3174979 - RNA, 13 nt, Human
uccaguuuauucc

SEQ ID NO: 3174980 - RNA, 15 nt, Human
uccaguuuauuccag

SEQ ID NO: 3174981 - RNA, 16 nt, Human
uccaguuacuuuccaa

SEQ ID NO: 3174982 - RNA, 13 nt, Human
ucccaccuuggcu

SEQ ID NO: 3174983 - RNA, 20 nt, Human
ucccagcugugcucuggaca

SEQ ID NO: 3174984 - RNA, 17 nt, Human
ucccaccuuggcugcag

SEQ ID NO: 3174985 - RNA, 16 nt, Human
ucccaccuuggcugca

SEQ ID NO: 3174986 - RNA, 20 nt, Human
uccaugugggcuaguugggc

SEQ ID NO: 3174987 - RNA, 16 nt, Human
uccauguggacuuagg

SEQ ID NO: 3174988 - RNA, 19 nt, Human
uccauguggacuuaggaag

SEQ ID NO: 3174989 - RNA, 18 nt, Human
uccauguggacuuaggaa

SEQ ID NO: 3174990 - RNA, 20 nt, Human
uccauguggacuuaggaagg

SEQ ID NO: 3174991 - RNA, 22 nt, Human
ucccaccucucucacuccuuga

SEQ ID NO: 3174992 - RNA, 13 nt, Human
uccauuaauuuaa

SEQ ID NO: 3174993 - RNA, 15 nt, Human
uccauuaauuuaaau

SEQ ID NO: 3174994 - RNA, 17 nt, Human
uccauuaauuuaaauga

SEQ ID NO: 3174995 - RNA, 19 nt, Human
uccauuaauuuaaaugauu

SEQ ID NO: 3174996 - RNA, 21 nt, Human
uccauuaauuuaaaugauuua

SEQ ID NO: 3174997 - RNA, 22 nt, Human
uccauuaauuuaaaugauuuaa

SEQ ID NO: 3174998 - RNA, 19 nt, Human
ucccaugagccucagcauc

SEQ ID NO: 3174999 - RNA, 18 nt, Human
ucccaugagccucagcau

SEQ ID NO: 3175000 - RNA, 23 nt, Human
ucccaucuuuuuaaccucuguuc

SEQ ID NO: 3175001 - RNA, 21 nt, Human
ucccaucugugaaaggaaaga

SEQ ID NO: 3175002 - RNA, 15 nt, Human
ucccaucuuccaagg

SEQ ID NO: 3175003 - RNA, 16 nt, Human
ucccaggcgccccuuc

SEQ ID NO: 3175004 - RNA, 21 nt, Human
ucccaucuuuuuaaccucugu

SEQ ID NO: 3175005 - RNA, 22 nt, Human
ucccagcugugcucuggacagg

SEQ ID NO: 3175006 - RNA, 21 nt, Human
ucccagcugugcucuggacag

SEQ ID NO: 3175007 - RNA, 23 nt, Human
ucccagcugugcucuggacaggc

SEQ ID NO: 3175008 - RNA, 19 nt, Human
ucccagcuucggcauuuga

SEQ ID NO: 3175009 - RNA, 20 nt, Human
ucccaggaaagaagcauuuc

SEQ ID NO: 3175010 - RNA, 23 nt, Human
ucccaggcauuccccaggaggcc

SEQ ID NO: 3175011 - RNA, 24 nt, Human
ucccaggcauuccccaggaggcca

SEQ ID NO: 3175012 - RNA, 17 nt, Human
ucccaugagccucagca

SEQ ID NO: 3175013 - RNA, 20 nt, Human
ucccaugagccucagcaucc

SEQ ID NO: 3175014 - RNA, 18 nt, Human
uccccagauugcaacagg

SEQ ID NO: 3175015 - RNA, 13 nt, Human
uccccagauugca

SEQ ID NO: 3175016 - RNA, 22 nt, Human
uccccagcaagugagagcuggg

SEQ ID NO: 3175017 - RNA, 21 nt, Human
uccccagcaagugagagcugg

SEQ ID NO: 3175018 - RNA, 20 nt, Human
uccccagcaagugagagcug

SEQ ID NO: 3175019 - RNA, 23 nt, Human
uccccagauugcaacaggcuggg

SEQ ID NO: 3175020 - RNA, 22 nt, Human
uccccagauugcaacaggcugg

SEQ ID NO: 3175021 - RNA, 20 nt, Human
uccccagauugcaacaggcu

SEQ ID NO: 3175022 - RNA, 19 nt, Human
uccccagauugcaacaggc

SEQ ID NO: 3175023 - RNA, 13 nt, Human
uccccaggaggcc

SEQ ID NO: 3175024 - RNA, 17 nt, Human
ucccccagccccauccu

SEQ ID NO: 3175025 - RNA, 15 nt, Human
uccccaggaggccag

SEQ ID NO: 3175026 - RNA, 16 nt, Human
uccccaggaggccagc

SEQ ID NO: 3175027 - RNA, 20 nt, Human
ucccccagccccauccucug

SEQ ID NO: 3175028 - RNA, 21 nt, Human
ucccccagccccauccucugu

SEQ ID NO: 3175029 - RNA, 17 nt, Human
ucccccauuuuucccag

SEQ ID NO: 3175030 - RNA, 14 nt, Human
uccccaggaggcca

SEQ ID NO: 3175031 - RNA, 22 nt, Human
uccccagcccuuccucugcucc

SEQ ID NO: 3175032 - RNA, 21 nt, Human
uccccagcccuuccucugcuc

SEQ ID NO: 3175033 - RNA, 20 nt, Human
uccccagcccuuccucugcu

SEQ ID NO: 3175034 - RNA, 18 nt, Human
uccccagcccuuccucug

SEQ ID NO: 3175035 - RNA, 21 nt, Human
uccccagccagccuggcuggg

SEQ ID NO: 3175036 - RNA, 20 nt, Human
uccccagccagccuggcugg

SEQ ID NO: 3175037 - RNA, 19 nt, Human
uccccagccagccuggcug

SEQ ID NO: 3175038 - RNA, 13 nt, Human
uccccagccagcc

SEQ ID NO: 3175039 - RNA, 16 nt, Human
uccccagccagccugg

SEQ ID NO: 3175040 - RNA, 14 nt, Human
uccccagccagccu

SEQ ID NO: 3175041 - RNA, 12 nt, Human
ugagcuccuggg

SEQ ID NO: 3175042 - RNA, 15 nt, Human
ugagccucagcaucc

SEQ ID NO: 3175043 - RNA, 19 nt, Human
ugagcugcuuuuuuugaaa

SEQ ID NO: 3175044 - RNA, 18 nt, Human
ugagcugcuuuuuuugaa

SEQ ID NO: 3175045 - RNA, 17 nt, Human
ugagcugcuuuuuuuga

SEQ ID NO: 3175046 - RNA, 17 nt, Human
ugagccucagcauccug

SEQ ID NO: 3175047 - RNA, 21 nt, Human
ugagccgagaucacgccacug

SEQ ID NO: 3175048 - RNA, 19 nt, Human
ugagccgagaucacgccac

SEQ ID NO: 3175049 - RNA, 18 nt, Human
ugagcccuguccugccua

SEQ ID NO: 3175050 - RNA, 21 nt, Human
ugagccucagcauccuggcac

SEQ ID NO: 3175051 - RNA, 18 nt, Human
ugagccucagcauccugg

SEQ ID NO: 3175052 - RNA, 22 nt, Human
ugagccucagcauccuggcacc

SEQ ID NO: 3175053 - RNA, 14 nt, Human
ugagccucagucuc

SEQ ID NO: 3175054 - RNA, 16 nt, Human
ugagcccugaggaggc

SEQ ID NO: 3175055 - RNA, 15 nt, Human
ugagcccuuguuuca

SEQ ID NO: 3175056 - RNA, 24 nt, Human
ugagcccuucggaggaccagggcu

SEQ ID NO: 3175057 - RNA, 13 nt, Human
ugagccccaaaag

SEQ ID NO: 3175058 - RNA, 20 nt, Human
ugagcaucaggccaggcccu

SEQ ID NO: 3175059 - RNA, 18 nt, Human
ugagcaucaggccaggcc

SEQ ID NO: 3175060 - RNA, 19 nt, Human
ugagcaucaggccaggccc

SEQ ID NO: 3175061 - RNA, 15 nt, Human
ugagcccccagcuuc

SEQ ID NO: 3175062 - RNA, 13 nt, Human
ugagcccccagcu

SEQ ID NO: 3175063 - RNA, 22 nt, Human
ugagcccccagcuuccagcagg

SEQ ID NO: 3175064 - RNA, 17 nt, Human
ugagcccccagcuucca

SEQ ID NO: 3175065 - RNA, 16 nt, Human
ugagcccccagcuucc

SEQ ID NO: 3175066 - RNA, 16 nt, Human
ugagcaucaggccagg

SEQ ID NO: 3175067 - RNA, 23 nt, Human
ugagcagugauauucuuuguuaa

SEQ ID NO: 3175068 - RNA, 17 nt, Human
ugagcagggcucagcgg

SEQ ID NO: 3175069 - RNA, 16 nt, Human
ugagcagggcucagcg

SEQ ID NO: 3175070 - RNA, 19 nt, Human
ugagcagggcucagcgggg

SEQ ID NO: 3175071 - RNA, 22 nt, Human
ugagcagugauauucuuuguua

SEQ ID NO: 3175072 - RNA, 20 nt, Human
ugagcagugauauucuuugu

SEQ ID NO: 3175073 - RNA, 17 nt, Human
ugagcagugauauucuu

SEQ ID NO: 3175074 - RNA, 14 nt, Human
ugagcagugauauu

SEQ ID NO: 3175075 - RNA, 17 nt, Human
ugagaacagauaaagau

SEQ ID NO: 3175076 - RNA, 23 nt, Human
ugagaacagauaaagauugugug

SEQ ID NO: 3175077 - RNA, 18 nt, Human
ugagaacagauaaagauu

SEQ ID NO: 3175078 - RNA, 21 nt, Human
ugaccucaggugauccaccca

SEQ ID NO: 3175079 - RNA, 20 nt, Human
ugaccucaggugauccaccc

SEQ ID NO: 3175080 - RNA, 22 nt, Human
ugaccucagcuuugauauuuca

SEQ ID NO: 3175081 - RNA, 16 nt, Human
ugaccucagcuuugau

SEQ ID NO: 3175082 - RNA, 20 nt, Human
ugaccgacagcuuuccagua

SEQ ID NO: 3175083 - RNA, 19 nt, Human
ugagacucgcgacaaugca

SEQ ID NO: 3175084 - RNA, 16 nt, Human
ugagagugaacaaauu

SEQ ID NO: 3175085 - RNA, 20 nt, Human
ugagacucgcgacaaugcaa

SEQ ID NO: 3175086 - RNA, 21 nt, Human
ugagacucgcgacaaugcaaa

SEQ ID NO: 3175087 - RNA, 22 nt, Human
ugagacucgcgacaaugcaaac

SEQ ID NO: 3175088 - RNA, 23 nt, Human
ugagacucgcgacaaugcaaacc

SEQ ID NO: 3175089 - RNA, 15 nt, Human
ugagaucaaaacggu

SEQ ID NO: 3175090 - RNA, 14 nt, Human
ugagaucagccugg

SEQ ID NO: 3175091 - RNA, 15 nt, Human
ugagcagggcucagc

SEQ ID NO: 3175092 - RNA, 14 nt, Human
ugagcagggcucag

SEQ ID NO: 3175093 - RNA, 13 nt, Human
ugagcagggcuca

SEQ ID NO: 3175094 - RNA, 12 nt, Human
ugagcagggcuc

SEQ ID NO: 3175095 - RNA, 17 nt, Human
ugaggcagguccccaga

SEQ ID NO: 3175096 - RNA, 16 nt, Human
ugaggcagguccccag

SEQ ID NO: 3175097 - RNA, 14 nt, Human
ugaggcaggucccc

SEQ ID NO: 3175098 - RNA, 20 nt, Human
ugagcuggggaugucucuca

SEQ ID NO: 3175099 - RNA, 13 nt, Human
ugagcugggauga

SEQ ID NO: 3175100 - RNA, 23 nt, Human
ugaggcuagugugguguuuccug

SEQ ID NO: 3175101 - RNA, 17 nt, Human
ugaggcuaguguggugu

SEQ ID NO: 3175102 - RNA, 23 nt, Human
ugaggcaucgcaauguaagacuc

SEQ ID NO: 3175103 - RNA, 14 nt, Human
ugaggcaguuugag

SEQ ID NO: 3175104 - RNA, 14 nt, Human
ugaggugggagaug

SEQ ID NO: 3175105 - RNA, 12 nt, Human
ugaggugggagg

SEQ ID NO: 3175106 - RNA, 13 nt, Human
ugaggugggagga

SEQ ID NO: 3175107 - RNA, 18 nt, Human
ugaggcuccacuuggucu

SEQ ID NO: 3175108 - RNA, 20 nt, Human
ugaggcuccacuuggucugu

SEQ ID NO: 3175109 - RNA, 13 nt, Human
ugaggcucugccc

SEQ ID NO: 3175110 - RNA, 14 nt, Human
ugaggcucugcccu

SEQ ID NO: 3175111 - RNA, 17 nt, Human
ugagggaacagagaggu

SEQ ID NO: 3175112 - RNA, 23 nt, Human
ugaggcuccuuaggguuuucucu

SEQ ID NO: 3175113 - RNA, 21 nt, Human
ugagggaagaauaaagagcug

SEQ ID NO: 3175114 - RNA, 16 nt, Human
ugaguugauagcacag

SEQ ID NO: 3175115 - RNA, 20 nt, Human
ugaguugauagcacagaccc

SEQ ID NO: 3175116 - RNA, 23 nt, Human
ugaguuugggccccagaggcugg

SEQ ID NO: 3175117 - RNA, 22 nt, Human
ugaguuugggccccagaggcug

SEQ ID NO: 3175118 - RNA, 14 nt, Human
ugaguuucuuagac

SEQ ID NO: 3175119 - RNA, 13 nt, Human
ugaguuucuuaga

SEQ ID NO: 3175120 - RNA, 15 nt, Human
ugaguucuguguauu

SEQ ID NO: 3175121 - RNA, 15 nt, Human
ugaguucuuccugua

SEQ ID NO: 3175122 - RNA, 17 nt, Human
ugaguucuuccuguaau

SEQ ID NO: 3175123 - RNA, 21 nt, Human
ugauaacaauguuuuaacaag

SEQ ID NO: 3175124 - RNA, 20 nt, Human
ugauaacagggauugauuuu

SEQ ID NO: 3175125 - RNA, 20 nt, Human
ugauaaccauagcauuaaua

SEQ ID NO: 3175126 - RNA, 23 nt, Human
ugauaacagggauugauuuuaaa

SEQ ID NO: 3175127 - RNA, 22 nt, Human
ugauaacagggauugauuuuaa

SEQ ID NO: 3175128 - RNA, 21 nt, Human
ugauaacagggauugauuuua

SEQ ID NO: 3175129 - RNA, 20 nt, Human
ugauaacaauguuuuaacaa

SEQ ID NO: 3175130 - RNA, 17 nt, Human
ugauaacaauguuuuaa

SEQ ID NO: 3175131 - RNA, 19 nt, Human
ugaguuuugggaaguuaaa

SEQ ID NO: 3175132 - RNA, 22 nt, Human
ugaguuuugggaaguuaaaggg

SEQ ID NO: 3175133 - RNA, 20 nt, Human
ugaguuuguuucuuugaauu

SEQ ID NO: 3175134 - RNA, 19 nt, Human
ugaguuuguuucuuugaau

SEQ ID NO: 3175135 - RNA, 14 nt, Human
ugaguuuguuucuu

SEQ ID NO: 3175136 - RNA, 13 nt, Human
ugaguuuguuucu

SEQ ID NO: 3175137 - RNA, 13 nt, Human
ugagucugaaggc

SEQ ID NO: 3175138 - RNA, 15 nt, Human
ugagucugaaggcug

SEQ ID NO: 3175139 - RNA, 17 nt, Human
ugagucugaaggcuggg

SEQ ID NO: 3175140 - RNA, 18 nt, Human
ugagucugaaggcugggu

SEQ ID NO: 3175141 - RNA, 15 nt, Human
ugagugagaggggag

SEQ ID NO: 3175142 - RNA, 13 nt, Human
ugagugagaauau

SEQ ID NO: 3175143 - RNA, 22 nt, Human
ugagucuuuuuuuuuuaaguga

SEQ ID NO: 3175144 - RNA, 20 nt, Human
ugagucuuuuuuuuuuaagu

SEQ ID NO: 3175145 - RNA, 12 nt, Human
ugagucuuuuuu

SEQ ID NO: 3175146 - RNA, 17 nt, Human
ugagucuguucugguaa

SEQ ID NO: 3175147 - RNA, 14 nt, Human
ugagucuguucugg

SEQ ID NO: 3175148 - RNA, 16 nt, Human
ugagucuguucuggua

SEQ ID NO: 3175149 - RNA, 19 nt, Human
ugagucuucauguucccac

SEQ ID NO: 3175150 - RNA, 18 nt, Human
ugagucuucauguuccca

SEQ ID NO: 3175151 - RNA, 19 nt, Human
ugagucgaggacagggagg

SEQ ID NO: 3175152 - RNA, 18 nt, Human
ugagucgaggacagggag

SEQ ID NO: 3175153 - RNA, 13 nt, Human
ugaguccagaagu

SEQ ID NO: 3175154 - RNA, 19 nt, Human
ugaguccagaaguuugaga

SEQ ID NO: 3175155 - RNA, 15 nt, Human
ugagucccaggcuga

SEQ ID NO: 3175156 - RNA, 18 nt, Human
ugagguggcaugguccau

SEQ ID NO: 3175157 - RNA, 21 nt, Human
ugauuaguaagucuugccuau

SEQ ID NO: 3175158 - RNA, 14 nt, Human
ugauuaguaagucu

SEQ ID NO: 3175159 - RNA, 16 nt, Human
ugauuaccagggacug

SEQ ID NO: 3175160 - RNA, 19 nt, Human
ugauguugaugcaauccuu

SEQ ID NO: 3175161 - RNA, 15 nt, Human
ugauguugaugcaau

SEQ ID NO: 3175162 - RNA, 20 nt, Human
ugauguugacaucacuggca

SEQ ID NO: 3175163 - RNA, 14 nt, Human
ugauguugaugcaa

SEQ ID NO: 3175164 - RNA, 20 nt, Human
ugauguucuuucacccuuuu

SEQ ID NO: 3175165 - RNA, 20 nt, Human
ugauucaacagguuuuccug

SEQ ID NO: 3175166 - RNA, 13 nt, Human
ugauucagacagc

SEQ ID NO: 3175167 - RNA, 14 nt, Human
ugauucagacagcu

SEQ ID NO: 3175168 - RNA, 15 nt, Human
ugauucagacagcug

SEQ ID NO: 3175169 - RNA, 16 nt, Human
ugauucagacagcugc

SEQ ID NO: 3175170 - RNA, 21 nt, Human
ugauucacauguuuucaaaug

SEQ ID NO: 3175171 - RNA, 20 nt, Human
ugauucacauguuuucaaau

SEQ ID NO: 3175172 - RNA, 12 nt, Human
ugauucacagug

SEQ ID NO: 3175173 - RNA, 19 nt, Human
ugauucacauguuuucaaa

SEQ ID NO: 3175174 - RNA, 18 nt, Human
ugauucacauguuuucaa

SEQ ID NO: 3175175 - RNA, 17 nt, Human
ugauucacauguuuuca

SEQ ID NO: 3175176 - RNA, 16 nt, Human
ugauucacauguuuuc

SEQ ID NO: 3175177 - RNA, 15 nt, Human
ugauucacauguuuu

SEQ ID NO: 3175178 - RNA, 14 nt, Human
ugauucacauguuu

SEQ ID NO: 3175179 - RNA, 13 nt, Human
ugauucacauguu

SEQ ID NO: 3175180 - RNA, 14 nt, Human
ugauugaagaaaca

SEQ ID NO: 3175181 - RNA, 12 nt, Human
ugauugaagaaa

SEQ ID NO: 3175182 - RNA, 11 nt, Human
ugauucucucc

SEQ ID NO: 3175183 - RNA, 21 nt, Human
ugauugcagaauuguuuagau

SEQ ID NO: 3175184 - RNA, 20 nt, Human
ugauugcagaauuguuuaga

SEQ ID NO: 3175185 - RNA, 18 nt, Human
ugauugaagaaacagcua

SEQ ID NO: 3175186 - RNA, 18 nt, Human
ugauucagacagcugccu

SEQ ID NO: 3175187 - RNA, 19 nt, Human
ugauucagacagcugccug

SEQ ID NO: 3175188 - RNA, 20 nt, Human
ugauucagacagcugccugg

SEQ ID NO: 3175189 - RNA, 21 nt, Human
ugauucagacagcugccuggg

SEQ ID NO: 3175190 - RNA, 23 nt, Human
ugauucagacagcugccugggau

SEQ ID NO: 3175191 - RNA, 21 nt, Human
ugauucuccugccucagccuc

SEQ ID NO: 3175192 - RNA, 20 nt, Human
ugauucuccugccucagccu

SEQ ID NO: 3175193 - RNA, 16 nt, Human
ugauugugucucuugg

SEQ ID NO: 3175194 - RNA, 21 nt, Human
ugauuuaaacuucuuaacugg

SEQ ID NO: 3175195 - RNA, 13 nt, Human
ugauuuaaacuuc

SEQ ID NO: 3175196 - RNA, 17 nt, Human
ugauugguuucucuucu

SEQ ID NO: 3175197 - RNA, 13 nt, Human
ugauuggaggggg

SEQ ID NO: 3175198 - RNA, 20 nt, Human
ugauuggaagggcuuuucaa

SEQ ID NO: 3175199 - RNA, 19 nt, Human
ugauuggaagggcuuuuca

SEQ ID NO: 3175200 - RNA, 22 nt, Human
ugauugcuuuuaaaauuuuaag

SEQ ID NO: 3175201 - RNA, 20 nt, Human
ugauugcuuuuaaaauuuua

SEQ ID NO: 3175202 - RNA, 19 nt, Human
ugauugcuuuuaaaauuuu

SEQ ID NO: 3175203 - RNA, 17 nt, Human
ugauugcuuuuaaaauu

SEQ ID NO: 3175204 - RNA, 16 nt, Human
ugauugcuuuuaaaau

SEQ ID NO: 3175205 - RNA, 14 nt, Human
ugauugcuuuuaaa

SEQ ID NO: 3175206 - RNA, 21 nt, Human
ugauuggaggggggagguggg

SEQ ID NO: 3175207 - RNA, 23 nt, Human
ugauuggaagggcuuuucaaaau

SEQ ID NO: 3175208 - RNA, 22 nt, Human
ugauuggaagggcuuuucaaaa

SEQ ID NO: 3175209 - RNA, 20 nt, Human
ugauuggcaggaguuggaag

SEQ ID NO: 3175210 - RNA, 14 nt, Human
ugauguguuguucu

SEQ ID NO: 3175211 - RNA, 22 nt, Human
ugauguguuguucuuggcaaua

SEQ ID NO: 3175212 - RNA, 16 nt, Human
ugauguguuaucucuu

SEQ ID NO: 3175213 - RNA, 20 nt, Human
ugauguguugccacuuucca

SEQ ID NO: 3175214 - RNA, 18 nt, Human
ugauguguugccacuuuc

SEQ ID NO: 3175215 - RNA, 22 nt, Human
ugaugucagcaguugcugguaa

SEQ ID NO: 3175216 - RNA, 23 nt, Human
ugaugucagcaguugcugguaaa

SEQ ID NO: 3175217 - RNA, 18 nt, Human
ugaugucagcaguugcug

SEQ ID NO: 3175218 - RNA, 18 nt, Human
ugaugucaauaacaguau

SEQ ID NO: 3175219 - RNA, 14 nt, Human
ugaugguuccccug

SEQ ID NO: 3175220 - RNA, 13 nt, Human
ugaugcuguauuc

SEQ ID NO: 3175221 - RNA, 16 nt, Human
ugaugcuucuucagag

SEQ ID NO: 3175222 - RNA, 17 nt, Human
ugaugcuucuucagaga

SEQ ID NO: 3175223 - RNA, 15 nt, Human
ugaugccugugaacu

SEQ ID NO: 3175224 - RNA, 20 nt, Human
ugaugccugugaacugaacu

SEQ ID NO: 3175225 - RNA, 21 nt, Human
ugaugccugugaacugaacuc

SEQ ID NO: 3175226 - RNA, 16 nt, Human
ugaugcgcaguugcug

SEQ ID NO: 3175227 - RNA, 17 nt, Human
ugaucuuuaaaauacac

SEQ ID NO: 3175228 - RNA, 16 nt, Human
ugaucuuugcagacag

SEQ ID NO: 3175229 - RNA, 15 nt, Human
ugaugauuucagaaa

SEQ ID NO: 3175230 - RNA, 23 nt, Human
ugaugcaauccuuacaaaugauu

SEQ ID NO: 3175231 - RNA, 19 nt, Human
ugaugcaauccuuacaaau

SEQ ID NO: 3175232 - RNA, 18 nt, Human
ugaugcaauccuuacaaa

SEQ ID NO: 3175233 - RNA, 16 nt, Human
ugaugauuucagaaac

SEQ ID NO: 3175234 - RNA, 21 nt, Human
ugaugcauuaaaagaaaauaa

SEQ ID NO: 3175235 - RNA, 19 nt, Human
ugaugcauuaaaagaaaau

SEQ ID NO: 3175236 - RNA, 22 nt, Human
ugaugcaugcuauucacaauua

SEQ ID NO: 3175237 - RNA, 18 nt, Human
ugaugcauuaaaagaaaa

SEQ ID NO: 3175238 - RNA, 17 nt, Human
ugaugcauuaaaagaaa

SEQ ID NO: 3175239 - RNA, 14 nt, Human
ugaucuuuaaaaua

SEQ ID NO: 3175240 - RNA, 21 nt, Human
ugaucuuccucugcuaaauug

SEQ ID NO: 3175241 - RNA, 20 nt, Human
ugaucuuccucugcuaaauu

SEQ ID NO: 3175242 - RNA, 18 nt, Human
ugaucuuccucugcuaaa

SEQ ID NO: 3175243 - RNA, 20 nt, Human
ugaucuucuuuauaauucua

SEQ ID NO: 3175244 - RNA, 12 nt, Human
ugaucuucacua

SEQ ID NO: 3175245 - RNA, 17 nt, Human
ugaucuuccucugcuaa

SEQ ID NO: 3175246 - RNA, 16 nt, Human
ugaucuuccucugcua

SEQ ID NO: 3175247 - RNA, 15 nt, Human
ugaucuguuauaggu

SEQ ID NO: 3175248 - RNA, 15 nt, Human
ugaucugugggcaca

SEQ ID NO: 3175249 - RNA, 23 nt, Human
ugaucugugccuuuuuuauaucu

SEQ ID NO: 3175250 - RNA, 14 nt, Human
ugaucugugccuuu

SEQ ID NO: 3175251 - RNA, 18 nt, Human
ugauccacccaccucagc

SEQ ID NO: 3175252 - RNA, 17 nt, Human
ugauccacccaccucag

SEQ ID NO: 3175253 - RNA, 14 nt, Human
ugaucucauuguuc

SEQ ID NO: 3175254 - RNA, 19 nt, Human
ugaucauucaccaguacau

SEQ ID NO: 3175255 - RNA, 18 nt, Human
ugauagcaaauggccuca

SEQ ID NO: 3175256 - RNA, 17 nt, Human
ugauagcaaaaucaaga

SEQ ID NO: 3175257 - RNA, 19 nt, Human
ugaucaguaguuugcauuu

SEQ ID NO: 3175258 - RNA, 17 nt, Human
ugaucaguaguuugcau

SEQ ID NO: 3175259 - RNA, 12 nt, Human
ugauaagaaaac

SEQ ID NO: 3175260 - RNA, 16 nt, Human
ugauagcaaaaucaag

SEQ ID NO: 3175261 - RNA, 13 nt, Human
ugauagcacagac

SEQ ID NO: 3175262 - RNA, 16 nt, Human
ugauccacccaccuca

SEQ ID NO: 3175263 - RNA, 15 nt, Human
ugauccaagcugguc

SEQ ID NO: 3175264 - RNA, 14 nt, Human
ugauccaagcuggu

SEQ ID NO: 3175265 - RNA, 13 nt, Human
ugauccaagcugg

SEQ ID NO: 3175266 - RNA, 17 nt, Human
ugacauacauccaacau

SEQ ID NO: 3175267 - RNA, 19 nt, Human
ugacagagugagacucugu

SEQ ID NO: 3175268 - RNA, 22 nt, Human
ugacagagggauggaggaagaa

SEQ ID NO: 3175269 - RNA, 17 nt, Human
ugacagagugagacucu

SEQ ID NO: 3175270 - RNA, 14 nt, Human
ugacagagugagac

SEQ ID NO: 3175271 - RNA, 23 nt, Human
ugacagaggcagccccauucugc

SEQ ID NO: 3175272 - RNA, 18 nt, Human
ugacagaggcagccccau

SEQ ID NO: 3175273 - RNA, 17 nt, Human
ugacagaggcagcccca

SEQ ID NO: 3175274 - RNA, 16 nt, Human
ugacagaggcagcccc

SEQ ID NO: 3175275 - RNA, 15 nt, Human
ugacagaggcagccc

SEQ ID NO: 3175276 - RNA, 14 nt, Human
ugacagaggcagcc

SEQ ID NO: 3175277 - RNA, 23 nt, Human
ugacagacacaggcccggcucca

SEQ ID NO: 3175278 - RNA, 20 nt, Human
ugacagacacaggcccggcu

SEQ ID NO: 3175279 - RNA, 13 nt, Human
ugacagaggcagc

SEQ ID NO: 3175280 - RNA, 16 nt, Human
ugacagacagcccucc

SEQ ID NO: 3175281 - RNA, 23 nt, Human
ugacagaaaauauguauuaacac

SEQ ID NO: 3175282 - RNA, 20 nt, Human
ugacagaaaauauguauuaa

SEQ ID NO: 3175283 - RNA, 19 nt, Human
ugacacuuuucauaucauu

SEQ ID NO: 3175284 - RNA, 20 nt, Human
ugacacuuuucauaucauuu

SEQ ID NO: 3175285 - RNA, 19 nt, Human
ugacagaaaauauguauua

SEQ ID NO: 3175286 - RNA, 14 nt, Human
ugacagaaaauaug

SEQ ID NO: 3175287 - RNA, 14 nt, Human
ugacaauguuuaca

SEQ ID NO: 3175288 - RNA, 21 nt, Human
ugacaagaguuggggacagaa

SEQ ID NO: 3175289 - RNA, 14 nt, Human
ugaauuggaaugca

SEQ ID NO: 3175290 - RNA, 15 nt, Human
ugaauuggaaugcac

SEQ ID NO: 3175291 - RNA, 15 nt, Human
ugaauuguaaaagca

SEQ ID NO: 3175292 - RNA, 21 nt, Human
ugaauuguaaaagcaacauca

SEQ ID NO: 3175293 - RNA, 14 nt, Human
ugacaagcuggcuu

SEQ ID NO: 3175294 - RNA, 21 nt, Human
ugacaagcuggcuuacacugg

SEQ ID NO: 3175295 - RNA, 23 nt, Human
ugacaagcuggcuuacacuggca

SEQ ID NO: 3175296 - RNA, 18 nt, Human
ugaccacugcagaagaca

SEQ ID NO: 3175297 - RNA, 20 nt, Human
ugaccacugcagaagacagu

SEQ ID NO: 3175298 - RNA, 19 nt, Human
ugaccagcaccaucucucc

SEQ ID NO: 3175299 - RNA, 15 nt, Human
ugacaugucuuuucu

SEQ ID NO: 3175300 - RNA, 18 nt, Human
ugacauguauuuuuuccu

SEQ ID NO: 3175301 - RNA, 13 nt, Human
ugacaugucuuuu

SEQ ID NO: 3175302 - RNA, 14 nt, Human
ugaccauucuccac

SEQ ID NO: 3175303 - RNA, 14 nt, Human
ugaccaucauuuca

SEQ ID NO: 3175304 - RNA, 13 nt, Human
ugaccauaaaauu

SEQ ID NO: 3175305 - RNA, 18 nt, Human
ugaccgacagcuuuccag

SEQ ID NO: 3175306 - RNA, 13 nt, Human
ugaccgugaggcc

SEQ ID NO: 3175307 - RNA, 14 nt, Human
ugaccgugaggcca

SEQ ID NO: 3175308 - RNA, 16 nt, Human
ugaccgugaggccaga

SEQ ID NO: 3175309 - RNA, 20 nt, Human
ugaccgugaggccagagaca

SEQ ID NO: 3175310 - RNA, 17 nt, Human
ugaccauucuccaccug

SEQ ID NO: 3175311 - RNA, 18 nt, Human
ugaccauucuccaccugc

SEQ ID NO: 3175312 - RNA, 16 nt, Human
ugaccauucuccaccu

SEQ ID NO: 3175313 - RNA, 23 nt, Human
ugaccagccuccaugcugccucc

SEQ ID NO: 3175314 - RNA, 19 nt, Human
ugaccaguggcuauggccu

SEQ ID NO: 3175315 - RNA, 18 nt, Human
ugaccaguauaaaauuac

SEQ ID NO: 3175316 - RNA, 22 nt, Human
ugaccaggcaccuccccucccg

SEQ ID NO: 3175317 - RNA, 14 nt, Human
ugaauaaagacacc

SEQ ID NO: 3175318 - RNA, 13 nt, Human
ugaaucuuuaauu

SEQ ID NO: 3175319 - RNA, 18 nt, Human
ugaauccaacugcuuaaa

SEQ ID NO: 3175320 - RNA, 21 nt, Human
ugaauccaaaagaaaaacagc

SEQ ID NO: 3175321 - RNA, 18 nt, Human
ugaauccaaaagaaaaac

SEQ ID NO: 3175322 - RNA, 17 nt, Human
ugaauccaaaagaaaaa

SEQ ID NO: 3175323 - RNA, 20 nt, Human
ugaaugaauggcuaagcaaa

SEQ ID NO: 3175324 - RNA, 22 nt, Human
ugaaugacuuccccaauaucuu

SEQ ID NO: 3175325 - RNA, 21 nt, Human
ugaaugacuuccccaauaucu

SEQ ID NO: 3175326 - RNA, 17 nt, Human
ugaaugacuaagaggaa

SEQ ID NO: 3175327 - RNA, 18 nt, Human
ugaauuauuauauacaua

SEQ ID NO: 3175328 - RNA, 19 nt, Human
ugaauucaccacagacuuu

SEQ ID NO: 3175329 - RNA, 12 nt, Human
ugaauugaaguu

SEQ ID NO: 3175330 - RNA, 16 nt, Human
ugaauugaaguuucaa

SEQ ID NO: 3175331 - RNA, 17 nt, Human
ugaauugaaguuucaag

SEQ ID NO: 3175332 - RNA, 19 nt, Human
ugaauugaaguuucaaguu

SEQ ID NO: 3175333 - RNA, 13 nt, Human
ugaauugauuuug

SEQ ID NO: 3175334 - RNA, 20 nt, Human
ugaauugagccuaaaaauaa

SEQ ID NO: 3175335 - RNA, 18 nt, Human
ugaauugagccuaaaaau

SEQ ID NO: 3175336 - RNA, 17 nt, Human
ugaauugagccuaaaaa

SEQ ID NO: 3175337 - RNA, 17 nt, Human
ugaauugacuuauuuca

SEQ ID NO: 3175338 - RNA, 17 nt, Human
ugaauuaccuggauguu

SEQ ID NO: 3175339 - RNA, 15 nt, Human
ugaauuagugaguau

SEQ ID NO: 3175340 - RNA, 18 nt, Human
ugaauuagugaguauagu

SEQ ID NO: 3175341 - RNA, 15 nt, Human
ugaauuaucagcaaa

SEQ ID NO: 3175342 - RNA, 17 nt, Human
ugaauuaucagcaaaga

SEQ ID NO: 3175343 - RNA, 18 nt, Human
ugaauuaucagcaaagaa

SEQ ID NO: 3175344 - RNA, 19 nt, Human
ugaauuaucagcaaagaaa

SEQ ID NO: 3175345 - RNA, 20 nt, Human
ugaauuaucagcaaagaaaa

SEQ ID NO: 3175346 - RNA, 13 nt, Human
ugaauuacuaacu

SEQ ID NO: 3175347 - RNA, 16 nt, Human
ugaauuacuaacuucu

SEQ ID NO: 3175348 - RNA, 15 nt, Human
ugaauuacuaacuuc

SEQ ID NO: 3175349 - RNA, 21 nt, Human
ugaauuacuaacuucuaaaac

SEQ ID NO: 3175350 - RNA, 20 nt, Human
ugaauuacuaacuucuaaaa

SEQ ID NO: 3175351 - RNA, 19 nt, Human
ugaauuacuaacuucuaaa

SEQ ID NO: 3175352 - RNA, 18 nt, Human
ugaauuacuaacuucuaa

SEQ ID NO: 3175353 - RNA, 20 nt, Human
ugaauguugcaaugugaaaa

SEQ ID NO: 3175354 - RNA, 22 nt, Human
ugaagucaugcuccccugugcc

SEQ ID NO: 3175355 - RNA, 13 nt, Human
ugaagugccuuaa

SEQ ID NO: 3175356 - RNA, 21 nt, Human
ugaagucacugcacagugcau

SEQ ID NO: 3175357 - RNA, 16 nt, Human
ugaagucaugcucccc

SEQ ID NO: 3175358 - RNA, 16 nt, Human
ugaaggccacuugagu

SEQ ID NO: 3175359 - RNA, 18 nt, Human
ugaaggcagaaagcaaaa

SEQ ID NO: 3175360 - RNA, 17 nt, Human
ugaaggccccgcccagg

SEQ ID NO: 3175361 - RNA, 12 nt, Human
ugaaguuauauu

SEQ ID NO: 3175362 - RNA, 19 nt, Human
ugaaguuauguguauguga

SEQ ID NO: 3175363 - RNA, 16 nt, Human
ugaaguuauauuuccu

SEQ ID NO: 3175364 - RNA, 13 nt, Human
ugaaguuauauuu

SEQ ID NO: 3175365 - RNA, 15 nt, Human
ugaaguuaguggaaa

SEQ ID NO: 3175366 - RNA, 16 nt, Human
ugaaguuaguggaaau

SEQ ID NO: 3175367 - RNA, 21 nt, Human
ugaaguuaguggaaaucugaa

SEQ ID NO: 3175368 - RNA, 10 nt, Human
ugaaguguug

SEQ ID NO: 3175369 - RNA, 16 nt, Human
ugaagugccuuaaaua

SEQ ID NO: 3175370 - RNA, 20 nt, Human
ugaauaaacuagauuacauu

SEQ ID NO: 3175371 - RNA, 21 nt, Human
ugaaguucugccucugaugua

SEQ ID NO: 3175372 - RNA, 22 nt, Human
ugaaguucugccucugauguau

SEQ ID NO: 3175373 - RNA, 20 nt, Human
ugaaggacauugcggacagc

SEQ ID NO: 3175374 - RNA, 19 nt, Human
ugaaggacauugcggacag

SEQ ID NO: 3175375 - RNA, 22 nt, Human
ugaaggacauugcggacagcca

SEQ ID NO: 3175376 - RNA, 21 nt, Human
ugaaggaccuucacucuaaga

SEQ ID NO: 3175377 - RNA, 15 nt, Human
ugaaggccccgccca

SEQ ID NO: 3175378 - RNA, 16 nt, Human
ugaaggccccgcccag

SEQ ID NO: 3175379 - RNA, 16 nt, Human
ugaaggagagcccuuc

SEQ ID NO: 3175380 - RNA, 15 nt, Human
ugaaggcagaaagca

SEQ ID NO: 3175381 - RNA, 17 nt, Human
ugaacuccuggccucaa

SEQ ID NO: 3175382 - RNA, 15 nt, Human
ugaaccaaucuggau

SEQ ID NO: 3175383 - RNA, 16 nt, Human
ugaacucugacaacag

SEQ ID NO: 3175384 - RNA, 14 nt, Human
ugaacucugagaga

SEQ ID NO: 3175385 - RNA, 12 nt, Human
ugaacucugaga

SEQ ID NO: 3175386 - RNA, 14 nt, Human
ugaagauacuuugu

SEQ ID NO: 3175387 - RNA, 15 nt, Human
ugaagauacuuugua

SEQ ID NO: 3175388 - RNA, 12 nt, Human
ugaagauacuuu

SEQ ID NO: 3175389 - RNA, 20 nt, Human
ugaaggaauaaauugcuccu

SEQ ID NO: 3175390 - RNA, 16 nt, Human
ugaagauacuuuguau

SEQ ID NO: 3175391 - RNA, 17 nt, Human
ugaagauacuuuguauu

SEQ ID NO: 3175392 - RNA, 15 nt, Human
ugaacagcggcugga

SEQ ID NO: 3175393 - RNA, 21 nt, Human
ugaacagaugaccccugccca

SEQ ID NO: 3175394 - RNA, 19 nt, Human
ugaacagaggccacauuac

SEQ ID NO: 3175395 - RNA, 22 nt, Human
ugaacagcggcuggacuuggag

SEQ ID NO: 3175396 - RNA, 21 nt, Human
ugaacagcggcuggacuugga

SEQ ID NO: 3175397 - RNA, 12 nt, Human
ugaacagugcac

SEQ ID NO: 3175398 - RNA, 19 nt, Human
ugaacaggugggugucugc

SEQ ID NO: 3175399 - RNA, 15 nt, Human
ugaacaagcauucuc

SEQ ID NO: 3175400 - RNA, 15 nt, Human
ugaacaagucccugu

SEQ ID NO: 3175401 - RNA, 16 nt, Human
ugaacuccuggccuca

SEQ ID NO: 3175402 - RNA, 20 nt, Human
ugaaccaccacacccagccc

SEQ ID NO: 3175403 - RNA, 17 nt, Human
ugaaccaccacacccag

SEQ ID NO: 3175404 - RNA, 23 nt, Human
ugaaccacaucuugcucugcuga

SEQ ID NO: 3175405 - RNA, 22 nt, Human
ugaaccaagaacuuuccaggaa

SEQ ID NO: 3175406 - RNA, 22 nt, Human
ugaaccacaucuugcucugcug

SEQ ID NO: 3175407 - RNA, 22 nt, Human
ugaacaguuuaugcagugcugc

SEQ ID NO: 3175408 - RNA, 20 nt, Human
ugaacauugguucuuucauu

SEQ ID NO: 3175409 - RNA, 22 nt, Human
ugaacauugcauauaacuuaua

SEQ ID NO: 3175410 - RNA, 12 nt, Human
ugaacauugcau

SEQ ID NO: 3175411 - RNA, 14 nt, Human
ugaaauucacaaag

SEQ ID NO: 3175412 - RNA, 18 nt, Human
ugaaauucacaaaguuaa

SEQ ID NO: 3175413 - RNA, 13 nt, Human
ugaaauucuauuu

SEQ ID NO: 3175414 - RNA, 12 nt, Human
ugaaauuacccu

SEQ ID NO: 3175415 - RNA, 16 nt, Human
ugaaaucaguuacucu

SEQ ID NO: 3175416 - RNA, 17 nt, Human
ugaaaucaguuacucuu

SEQ ID NO: 3175417 - RNA, 17 nt, Human
ugaaaucaguaaacacu

SEQ ID NO: 3175418 - RNA, 17 nt, Human
ugaaaucauauuuggaa

SEQ ID NO: 3175419 - RNA, 22 nt, Human
ugaaaucaguaaacacugugua

SEQ ID NO: 3175420 - RNA, 20 nt, Human
ugaaaucaguaaacacugug

SEQ ID NO: 3175421 - RNA, 19 nt, Human
ugaaaucaguaaacacugu

SEQ ID NO: 3175422 - RNA, 17 nt, Human
ugaaaugugugugaugu

SEQ ID NO: 3175423 - RNA, 16 nt, Human
ugaaaugugugugaug

SEQ ID NO: 3175424 - RNA, 14 nt, Human
ugaaauguguguga

SEQ ID NO: 3175425 - RNA, 12 nt, Human
ugaaaugugugu

SEQ ID NO: 3175426 - RNA, 24 nt, Human
ugaaaugugugugaugugacauuu

SEQ ID NO: 3175427 - RNA, 15 nt, Human
ugaaauguuaacaau

SEQ ID NO: 3175428 - RNA, 21 nt, Human
ugaaauguuaacaaugccuau

SEQ ID NO: 3175429 - RNA, 22 nt, Human
ugaaaugugugugaugugacau

SEQ ID NO: 3175430 - RNA, 21 nt, Human
ugaaaugugugugaugugaca

SEQ ID NO: 3175431 - RNA, 20 nt, Human
ugaaaugugugugaugugac

SEQ ID NO: 3175432 - RNA, 19 nt, Human
ugaaaugugugugauguga

SEQ ID NO: 3175433 - RNA, 22 nt, Human
ugaaacaacaaauaggaauugu

SEQ ID NO: 3175434 - RNA, 14 nt, Human
ugaaacauuuuguc

SEQ ID NO: 3175435 - RNA, 18 nt, Human
ugaaacauugcuuuuaaa

SEQ ID NO: 3175436 - RNA, 21 nt, Human
ugaaacauugcuuuuaaaacu

SEQ ID NO: 3175437 - RNA, 19 nt, Human
ugaaacauugcuuuuaaaa

SEQ ID NO: 3175438 - RNA, 18 nt, Human
ugaaaccaaauguaacua

SEQ ID NO: 3175439 - RNA, 14 nt, Human
ugaaaagcaauauu

SEQ ID NO: 3175440 - RNA, 16 nt, Human
ugaaaagcaauauugu

SEQ ID NO: 3175441 - RNA, 19 nt, Human
ugaaaagcaauauuguaua

SEQ ID NO: 3175442 - RNA, 18 nt, Human
ugaaagaggcagcuugaa

SEQ ID NO: 3175443 - RNA, 20 nt, Human
ugaaaccccuguaggccuca

SEQ ID NO: 3175444 - RNA, 18 nt, Human
ugaaagaggaaugaagua

SEQ ID NO: 3175445 - RNA, 23 nt, Human
ugaaagaggccaaacaggcccuc

SEQ ID NO: 3175446 - RNA, 15 nt, Human
ugaaagagucuuucu

SEQ ID NO: 3175447 - RNA, 23 nt, Human
ugaaagcagggacuugaacccau

SEQ ID NO: 3175448 - RNA, 18 nt, Human
ugaaagauggcugugccu

SEQ ID NO: 3175449 - RNA, 18 nt, Human
ugaaagcccugagcuuuc

SEQ ID NO: 3175450 - RNA, 15 nt, Human
ugaaagguagacuuu

SEQ ID NO: 3175451 - RNA, 18 nt, Human
ugaaagguagacuuuuau

SEQ ID NO: 3175452 - RNA, 18 nt, Human
ugaaagggcccagagagg

SEQ ID NO: 3175453 - RNA, 13 nt, Human
ugaaagggcccag

SEQ ID NO: 3175454 - RNA, 11 nt, Human
ugaaaggcuuu

SEQ ID NO: 3175455 - RNA, 20 nt, Human
ugaaaggcaguagucauuuu

SEQ ID NO: 3175456 - RNA, 15 nt, Human
ugaaaggcuuuucaa

SEQ ID NO: 3175457 - RNA, 21 nt, Human
ugaaaggcuuuucaaccacaa

SEQ ID NO: 3175458 - RNA, 17 nt, Human
ucuuucaacucauugca

SEQ ID NO: 3175459 - RNA, 20 nt, Human
ucuuucaacaguuucaaaau

SEQ ID NO: 3175460 - RNA, 23 nt, Human
ucuuucacccuuuucuguuugcu

SEQ ID NO: 3175461 - RNA, 18 nt, Human
ucuuucaagggcuuuccu

SEQ ID NO: 3175462 - RNA, 21 nt, Human
ucuuucaagggcuuuccugug

SEQ ID NO: 3175463 - RNA, 20 nt, Human
ucuuucaagggcuuuccugu

SEQ ID NO: 3175464 - RNA, 23 nt, Human
ucuuguuuuuaaguuugcacuca

SEQ ID NO: 3175465 - RNA, 16 nt, Human
ucuuguuuuuaaguuu

SEQ ID NO: 3175466 - RNA, 16 nt, Human
ucuuguuuugcuuccc

SEQ ID NO: 3175467 - RNA, 21 nt, Human
ucuuguuuuuaaguuugcacu

SEQ ID NO: 3175468 - RNA, 17 nt, Human
ucuuguuuuuaaguuug

SEQ ID NO: 3175469 - RNA, 14 nt, Human
ucuugcuugaacuu

SEQ ID NO: 3175470 - RNA, 16 nt, Human
ucuuguguguuuauug

SEQ ID NO: 3175471 - RNA, 21 nt, Human
ucuuguguguuuauugucaaa

SEQ ID NO: 3175472 - RNA, 19 nt, Human
ucuuguuaugguagaaaaa

SEQ ID NO: 3175473 - RNA, 15 nt, Human
ucuuguucaggaaaa

SEQ ID NO: 3175474 - RNA, 14 nt, Human
ucuuguugauaaaa

SEQ ID NO: 3175475 - RNA, 16 nt, Human
ucuuguugauaaaaau

SEQ ID NO: 3175476 - RNA, 11 nt, Human
ucuuguugguu

SEQ ID NO: 3175477 - RNA, 13 nt, Human
ucuuguuuugcuu

SEQ ID NO: 3175478 - RNA, 13 nt, Human
ucuuguuuugaaa

SEQ ID NO: 3175479 - RNA, 16 nt, Human
ucuuguuuugaaaaua

SEQ ID NO: 3175480 - RNA, 14 nt, Human
ucuuguuucucccg

SEQ ID NO: 3175481 - RNA, 16 nt, Human
ucuccucuugccacug

SEQ ID NO: 3175482 - RNA, 13 nt, Human
ucuccucuugcca

SEQ ID NO: 3175483 - RNA, 16 nt, Human
ucucccuucauccuuc

SEQ ID NO: 3175484 - RNA, 20 nt, Human
ucuccucugcugcuggcugg

SEQ ID NO: 3175485 - RNA, 23 nt, Human
ucuugcaauggcagccuuggcaa

SEQ ID NO: 3175486 - RNA, 17 nt, Human
ucuccucuugccacugc

SEQ ID NO: 3175487 - RNA, 13 nt, Human
ucuuugauucugu

SEQ ID NO: 3175488 - RNA, 14 nt, Human
ucuuugcaguuccc

SEQ ID NO: 3175489 - RNA, 22 nt, Human
ucuuugcaaaaauccaaauauu

SEQ ID NO: 3175490 - RNA, 11 nt, Human
ucuuucuuuuu

SEQ ID NO: 3175491 - RNA, 19 nt, Human
ucuuugaaacaugcuugug

SEQ ID NO: 3175492 - RNA, 16 nt, Human
ucuuugauaacaggga

SEQ ID NO: 3175493 - RNA, 13 nt, Human
ucuuugauguguu

SEQ ID NO: 3175494 - RNA, 20 nt, Human
ucuuugaucaugaauaacug

SEQ ID NO: 3175495 - RNA, 14 nt, Human
ucuuugaucaugaa

SEQ ID NO: 3175496 - RNA, 14 nt, Human
ucuuugauguguug

SEQ ID NO: 3175497 - RNA, 16 nt, Human
ucuuugauguguuguu

SEQ ID NO: 3175498 - RNA, 17 nt, Human
ucuuuggacacucacac

SEQ ID NO: 3175499 - RNA, 21 nt, Human
ucuuuggaaaaggaagguagu

SEQ ID NO: 3175500 - RNA, 18 nt, Human
ucuuugcaguucccaucu

SEQ ID NO: 3175501 - RNA, 23 nt, Human
ucuuuuacuuuuuuuaguaaguu

SEQ ID NO: 3175502 - RNA, 12 nt, Human
ucuuuuauucuu

SEQ ID NO: 3175503 - RNA, 22 nt, Human
ucuuuccacuccuccuagccac

SEQ ID NO: 3175504 - RNA, 21 nt, Human
ucuuuccacuccuccuagcca

SEQ ID NO: 3175505 - RNA, 21 nt, Human
ucuuucauuugcuuuggaagu

SEQ ID NO: 3175506 - RNA, 20 nt, Human
ucuuucuugcucccugacug

SEQ ID NO: 3175507 - RNA, 19 nt, Human
ucuuucuugcucccugacu

SEQ ID NO: 3175508 - RNA, 18 nt, Human
ucuuucuugcucccugac

SEQ ID NO: 3175509 - RNA, 14 nt, Human
ucuuucuugcuccc

SEQ ID NO: 3175510 - RNA, 22 nt, Human
ucuuucuucuucaaaccuuugu

SEQ ID NO: 3175511 - RNA, 18 nt, Human
ucuuucuucuuccacaca

SEQ ID NO: 3175512 - RNA, 16 nt, Human
ucuuuccauauccaua

SEQ ID NO: 3175513 - RNA, 15 nt, Human
ucuuuccauauccau

SEQ ID NO: 3175514 - RNA, 16 nt, Human
ucuuucagccaagaau

SEQ ID NO: 3175515 - RNA, 19 nt, Human
ucuuucagccaagaauucu

SEQ ID NO: 3175516 - RNA, 20 nt, Human
ucuuucagccaagaauucuu

SEQ ID NO: 3175517 - RNA, 21 nt, Human
ucuuucagccaagaauucuua

SEQ ID NO: 3175518 - RNA, 20 nt, Human
ugggggaggggagacuuuga

SEQ ID NO: 3175519 - RNA, 16 nt, Human
ugggggaguggccaca

SEQ ID NO: 3175520 - RNA, 14 nt, Human
ugggggucugugug

SEQ ID NO: 3175521 - RNA, 18 nt, Human
uggguacuuguggacaca

SEQ ID NO: 3175522 - RNA, 17 nt, Human
uggguacuuguggacac

SEQ ID NO: 3175523 - RNA, 20 nt, Human
uggggguucuuucuuccucu

SEQ ID NO: 3175524 - RNA, 19 nt, Human
uggggguucuuucuuccuc

SEQ ID NO: 3175525 - RNA, 15 nt, Human
uggggguucuuucuu

SEQ ID NO: 3175526 - RNA, 22 nt, Human
uggggguguucagccacugagg

SEQ ID NO: 3175527 - RNA, 20 nt, Human
uggggccaguuggucccccu

SEQ ID NO: 3175528 - RNA, 23 nt, Human
uggggaugagaaagguugaagca

SEQ ID NO: 3175529 - RNA, 15 nt, Human
uggggaugagaaagg

SEQ ID NO: 3175530 - RNA, 16 nt, Human
uggggauagaugugug

SEQ ID NO: 3175531 - RNA, 17 nt, Human
uggggauagaugugugg

SEQ ID NO: 3175532 - RNA, 18 nt, Human
uggggauagaugugugga

SEQ ID NO: 3175533 - RNA, 20 nt, Human
uggggauagauguguggaca

SEQ ID NO: 3175534 - RNA, 14 nt, Human
ugggcuugcugugg

SEQ ID NO: 3175535 - RNA, 16 nt, Human
ugggcuucugugccca

SEQ ID NO: 3175536 - RNA, 22 nt, Human
ugggcuucauccuccucagauc

SEQ ID NO: 3175537 - RNA, 12 nt, Human
ugggccuucagg

SEQ ID NO: 3175538 - RNA, 12 nt, Human
ugggcuucugug

SEQ ID NO: 3175539 - RNA, 11 nt, Human
ugggagugugu

SEQ ID NO: 3175540 - RNA, 19 nt, Human
ugggaucacauguggacuu

SEQ ID NO: 3175541 - RNA, 18 nt, Human
ugggagugugguuucuuu

SEQ ID NO: 3175542 - RNA, 14 nt, Human
ugggagugggccca

SEQ ID NO: 3175543 - RNA, 16 nt, Human
ugggagugggcccaau

SEQ ID NO: 3175544 - RNA, 22 nt, Human
ugggagugaggaugucugggcc

SEQ ID NO: 3175545 - RNA, 20 nt, Human
uggcugggggccucagugcc

SEQ ID NO: 3175546 - RNA, 17 nt, Human
uggcugggggccucagu

SEQ ID NO: 3175547 - RNA, 16 nt, Human
uggcugggggccucag

SEQ ID NO: 3175548 - RNA, 22 nt, Human
ugggcagagcagagaccauccc

SEQ ID NO: 3175549 - RNA, 18 nt, Human
ugggcagagcagagacca

SEQ ID NO: 3175550 - RNA, 17 nt, Human
ugggauuacaggcguga

SEQ ID NO: 3175551 - RNA, 22 nt, Human
ugggauuacaagcgugagccac

SEQ ID NO: 3175552 - RNA, 12 nt, Human
ugggauccucca

SEQ ID NO: 3175553 - RNA, 13 nt, Human
ugggauccuccag

SEQ ID NO: 3175554 - RNA, 18 nt, Human
ugggauccaggccccucc

SEQ ID NO: 3175555 - RNA, 15 nt, Human
ugggauccaggcccc

SEQ ID NO: 3175556 - RNA, 20 nt, Human
ugggauccaggccccucccu

SEQ ID NO: 3175557 - RNA, 14 nt, Human
ugggccuggcuccc

SEQ ID NO: 3175558 - RNA, 19 nt, Human
ugggccuggcucccucacu

SEQ ID NO: 3175559 - RNA, 21 nt, Human
ugggccuggcucccucacucu

SEQ ID NO: 3175560 - RNA, 11 nt, Human
ugggccuucag

SEQ ID NO: 3175561 - RNA, 14 nt, Human
ugggcaggagacug

SEQ ID NO: 3175562 - RNA, 23 nt, Human
ugggcagagcagagaccaucccu

SEQ ID NO: 3175563 - RNA, 14 nt, Human
ugguccucacacuc

SEQ ID NO: 3175564 - RNA, 16 nt, Human
ugguccuaggcuggaa

SEQ ID NO: 3175565 - RNA, 18 nt, Human
ugguccuaggcuggaagg

SEQ ID NO: 3175566 - RNA, 19 nt, Human
ugguccuaggcuggaagga

SEQ ID NO: 3175567 - RNA, 23 nt, Human
ugguccuaggcuggaaggaggaa

SEQ ID NO: 3175568 - RNA, 17 nt, Human
ugguccuaaucuucuga

SEQ ID NO: 3175569 - RNA, 19 nt, Human
ugguccuaaucuucugaac

SEQ ID NO: 3175570 - RNA, 13 nt, Human
ugguccugcugca

SEQ ID NO: 3175571 - RNA, 15 nt, Human
ugguccugcugcagu

SEQ ID NO: 3175572 - RNA, 23 nt, Human
ugguccugcugcaguugccaguc

SEQ ID NO: 3175573 - RNA, 15 nt, Human
uggucccccuuccau

SEQ ID NO: 3175574 - RNA, 16 nt, Human
uggucccccuuccaug

SEQ ID NO: 3175575 - RNA, 18 nt, Human
uggucccccuuccaugga

SEQ ID NO: 3175576 - RNA, 23 nt, Human
uggucccccuuccauggacuuug

SEQ ID NO: 3175577 - RNA, 22 nt, Human
uggucacaggaaguagaggagg

SEQ ID NO: 3175578 - RNA, 18 nt, Human
uggucacaggacucugcc

SEQ ID NO: 3175579 - RNA, 17 nt, Human
uggucacaggaaguaga

SEQ ID NO: 3175580 - RNA, 19 nt, Human
uggucacaggacucugccu

SEQ ID NO: 3175581 - RNA, 13 nt, Human
uggucccacucag

SEQ ID NO: 3175582 - RNA, 14 nt, Human
uggucccccuucca

SEQ ID NO: 3175583 - RNA, 18 nt, Human
ugguauuuggauaucugu

SEQ ID NO: 3175584 - RNA, 18 nt, Human
ugguaugaucacggcuca

SEQ ID NO: 3175585 - RNA, 22 nt, Human
ugguaugcuugcauauauuuca

SEQ ID NO: 3175586 - RNA, 22 nt, Human
uggugaccuuccaagagccuga

SEQ ID NO: 3175587 - RNA, 21 nt, Human
uggugaccuuccaagagccug

SEQ ID NO: 3175588 - RNA, 19 nt, Human
uggugacuuuccucuuugg

SEQ ID NO: 3175589 - RNA, 22 nt, Human
uggugaccucugccugaaguca

SEQ ID NO: 3175590 - RNA, 17 nt, Human
uggugaccucugccuga

SEQ ID NO: 3175591 - RNA, 16 nt, Human
uggugaccucugccug

SEQ ID NO: 3175592 - RNA, 15 nt, Human
uggugaccucugccu

SEQ ID NO: 3175593 - RNA, 15 nt, Human
uggugaguuaggaac

SEQ ID NO: 3175594 - RNA, 14 nt, Human
uggugaugcagucu

SEQ ID NO: 3175595 - RNA, 18 nt, Human
uggugagcauuacaggca

SEQ ID NO: 3175596 - RNA, 12 nt, Human
uggugagcauua

SEQ ID NO: 3175597 - RNA, 16 nt, Human
uggugacuuugcuuca

SEQ ID NO: 3175598 - RNA, 21 nt, Human
uggugcaaugaccuuucaaua

SEQ ID NO: 3175599 - RNA, 20 nt, Human
uggugcaaugaccuuucaau

SEQ ID NO: 3175600 - RNA, 23 nt, Human
uggugcacgcuggggaagaauuu

SEQ ID NO: 3175601 - RNA, 21 nt, Human
uggucuaauguuuaagcagaa

SEQ ID NO: 3175602 - RNA, 19 nt, Human
uggucuaauguuuaagcag

SEQ ID NO: 3175603 - RNA, 15 nt, Human
uggucuaauguuuaa

SEQ ID NO: 3175604 - RNA, 14 nt, Human
uggugaccucugcc

SEQ ID NO: 3175605 - RNA, 13 nt, Human
uggugaccucugc

SEQ ID NO: 3175606 - RNA, 15 nt, Human
uggucuacacugugc

SEQ ID NO: 3175607 - RNA, 16 nt, Human
uggucuacacugugcu

SEQ ID NO: 3175608 - RNA, 17 nt, Human
uggucuacacugugcug

SEQ ID NO: 3175609 - RNA, 18 nt, Human
uggucuacacugugcuga

SEQ ID NO: 3175610 - RNA, 14 nt, Human
uggucuaauguuua

SEQ ID NO: 3175611 - RNA, 19 nt, Human
uggucguaaacaucucaga

SEQ ID NO: 3175612 - RNA, 18 nt, Human
uggucgccuuccaccucu

SEQ ID NO: 3175613 - RNA, 20 nt, Human
uggucgaaaguuaguaggau

SEQ ID NO: 3175614 - RNA, 20 nt, Human
ugguccuguaggaguucuau

SEQ ID NO: 3175615 - RNA, 13 nt, Human
ugguccuguagga

SEQ ID NO: 3175616 - RNA, 20 nt, Human
ugguccuggaggcucaaauu

SEQ ID NO: 3175617 - RNA, 20 nt, Human
uggcuccauugguguugaca

SEQ ID NO: 3175618 - RNA, 22 nt, Human
uggcguagcagaguuaaaucuc

SEQ ID NO: 3175619 - RNA, 20 nt, Human
uggcucccacaggcccuucc

SEQ ID NO: 3175620 - RNA, 17 nt, Human
uggcucccacaggcccu

SEQ ID NO: 3175621 - RNA, 14 nt, Human
uggcucccacaggc

SEQ ID NO: 3175622 - RNA, 15 nt, Human
uggcugcuucaagga

SEQ ID NO: 3175623 - RNA, 15 nt, Human
uggcugggggccuca

SEQ ID NO: 3175624 - RNA, 11 nt, Human
uggcugcuuca

SEQ ID NO: 3175625 - RNA, 16 nt, Human
uggcuccucccggugc

SEQ ID NO: 3175626 - RNA, 14 nt, Human
uggcuccucccggu

SEQ ID NO: 3175627 - RNA, 19 nt, Human
uggcuccucccggugccca

SEQ ID NO: 3175628 - RNA, 18 nt, Human
uggcuccucccggugccc

SEQ ID NO: 3175629 - RNA, 15 nt, Human
uggcgcugccccugg

SEQ ID NO: 3175630 - RNA, 23 nt, Human
uggcgcugccccuggcagccccu

SEQ ID NO: 3175631 - RNA, 16 nt, Human
uggcgcugccccuggc

SEQ ID NO: 3175632 - RNA, 22 nt, Human
uggcgcagcauauucaggaagc

SEQ ID NO: 3175633 - RNA, 23 nt, Human
uggcgcagcauauucaggaagcu

SEQ ID NO: 3175634 - RNA, 23 nt, Human
uggccucccaacucaccccagcc

SEQ ID NO: 3175635 - RNA, 22 nt, Human
uggccucagaggacccuuucca

SEQ ID NO: 3175636 - RNA, 12 nt, Human
uggcagaggagg

SEQ ID NO: 3175637 - RNA, 15 nt, Human
uggcagaguugaaga

SEQ ID NO: 3175638 - RNA, 21 nt, Human
uggcagaguggauucuugaac

SEQ ID NO: 3175639 - RNA, 17 nt, Human
uggcagaguugaagaca

SEQ ID NO: 3175640 - RNA, 19 nt, Human
uggcagaguugaagacaga

SEQ ID NO: 3175641 - RNA, 18 nt, Human
uggccagaugcaccagcc

SEQ ID NO: 3175642 - RNA, 17 nt, Human
uggccagaugcaccagc

SEQ ID NO: 3175643 - RNA, 15 nt, Human
uggccagaugcacca

SEQ ID NO: 3175644 - RNA, 19 nt, Human
uggccagaugcaccagccc

SEQ ID NO: 3175645 - RNA, 19 nt, Human
uggccaggaaguagcacag

SEQ ID NO: 3175646 - RNA, 20 nt, Human
uggccaggaaguagcacagg

SEQ ID NO: 3175647 - RNA, 16 nt, Human
uggccaggcugcucuu

SEQ ID NO: 3175648 - RNA, 17 nt, Human
uggccaggcugcucuug

SEQ ID NO: 3175649 - RNA, 22 nt, Human
uggccaggaaguagcacaggcu

SEQ ID NO: 3175650 - RNA, 21 nt, Human
uggccaggaaguagcacaggc

SEQ ID NO: 3175651 - RNA, 13 nt, Human
uggccaggcugcu

SEQ ID NO: 3175652 - RNA, 19 nt, Human
uggccaggcugcucucaaa

SEQ ID NO: 3175653 - RNA, 17 nt, Human
uggccaggcugcucuca

SEQ ID NO: 3175654 - RNA, 17 nt, Human
uggcccccacaugguga

SEQ ID NO: 3175655 - RNA, 13 nt, Human
uggccaggcuggu

SEQ ID NO: 3175656 - RNA, 20 nt, Human
uggccaggcugcucuugaac

SEQ ID NO: 3175657 - RNA, 23 nt, Human
uggcccagggugagguggcaugg

SEQ ID NO: 3175658 - RNA, 21 nt, Human
uggcccagggggcuuccugag

SEQ ID NO: 3175659 - RNA, 19 nt, Human
uggcccagggggcuuccug

SEQ ID NO: 3175660 - RNA, 16 nt, Human
uggccccugcccggcu

SEQ ID NO: 3175661 - RNA, 15 nt, Human
uggccccugcccggc

SEQ ID NO: 3175662 - RNA, 14 nt, Human
uggccccugcccgg

SEQ ID NO: 3175663 - RNA, 15 nt, Human
uggaucugugagggg

SEQ ID NO: 3175664 - RNA, 14 nt, Human
uggaucucuuaaga

SEQ ID NO: 3175665 - RNA, 11 nt, Human
uggaguuggag

SEQ ID NO: 3175666 - RNA, 19 nt, Human
uggaguuggggcagaggag

SEQ ID NO: 3175667 - RNA, 16 nt, Human
uggaguuggaguucau

SEQ ID NO: 3175668 - RNA, 15 nt, Human
uggauaacaccacca

SEQ ID NO: 3175669 - RNA, 15 nt, Human
uggauaaauuguuua

SEQ ID NO: 3175670 - RNA, 17 nt, Human
uggauaaauuguuuagu

SEQ ID NO: 3175671 - RNA, 21 nt, Human
uggaggaaggaaacccagcuc

SEQ ID NO: 3175672 - RNA, 23 nt, Human
uggaggaaggaaacccagcucug

SEQ ID NO: 3175673 - RNA, 14 nt, Human
uggagacugucuca

SEQ ID NO: 3175674 - RNA, 20 nt, Human
uggaggaaggaaacccagcu

SEQ ID NO: 3175675 - RNA, 19 nt, Human
uggcaaacucuccaccaca

SEQ ID NO: 3175676 - RNA, 23 nt, Human
uggcaaagcagcaacacacaugc

SEQ ID NO: 3175677 - RNA, 20 nt, Human
uggcaaagcuguucuuccug

SEQ ID NO: 3175678 - RNA, 19 nt, Human
uggcaaagcuguucuuccu

SEQ ID NO: 3175679 - RNA, 17 nt, Human
uggcaaagcuguucuuc

SEQ ID NO: 3175680 - RNA, 19 nt, Human
uggaucugugaggggcucu

SEQ ID NO: 3175681 - RNA, 12 nt, Human
uggcaaaaaggc

SEQ ID NO: 3175682 - RNA, 16 nt, Human
uggcaaaaaggcagga

SEQ ID NO: 3175683 - RNA, 17 nt, Human
uggcaauaaauuuugaa

SEQ ID NO: 3175684 - RNA, 18 nt, Human
uggcaauaaauuuugaaa

SEQ ID NO: 3175685 - RNA, 20 nt, Human
uggcaauaaauuuugaaaag

SEQ ID NO: 3175686 - RNA, 21 nt, Human
uggcaauaaauuuugaaaagu

SEQ ID NO: 3175687 - RNA, 12 nt, Human
uggcaauagacc

SEQ ID NO: 3175688 - RNA, 16 nt, Human
uggcacuauaauguaa

SEQ ID NO: 3175689 - RNA, 15 nt, Human
uggcacuauaaugua

SEQ ID NO: 3175690 - RNA, 18 nt, Human
uggacucagaaacuccau

SEQ ID NO: 3175691 - RNA, 13 nt, Human
uggacuccucugu

SEQ ID NO: 3175692 - RNA, 21 nt, Human
uggagaagcucccugaaguaa

SEQ ID NO: 3175693 - RNA, 22 nt, Human
uggagaaugcaccauacucaug

SEQ ID NO: 3175694 - RNA, 21 nt, Human
uggagaaugcaccauacucau

SEQ ID NO: 3175695 - RNA, 20 nt, Human
uggagaaucucaacaugucu

SEQ ID NO: 3175696 - RNA, 23 nt, Human
uggagaaucacaggcugggcugg

SEQ ID NO: 3175697 - RNA, 15 nt, Human
uggagaaucacaggc

SEQ ID NO: 3175698 - RNA, 17 nt, Human
uggagaaucacaggcug

SEQ ID NO: 3175699 - RNA, 16 nt, Human
uggagaaucacaggcu

SEQ ID NO: 3175700 - RNA, 22 nt, Human
uggagaaucacaggcugggcug

SEQ ID NO: 3175701 - RNA, 20 nt, Human
uggagaaucacaggcugggc

SEQ ID NO: 3175702 - RNA, 19 nt, Human
uggagaaucacaggcuggg

SEQ ID NO: 3175703 - RNA, 18 nt, Human
uggagaaucacaggcugg

SEQ ID NO: 3175704 - RNA, 20 nt, Human
uggagacugcuccugagccc

SEQ ID NO: 3175705 - RNA, 23 nt, Human
uggagacugcuccugagccccca

SEQ ID NO: 3175706 - RNA, 22 nt, Human
uggagacugcuccugagccccc

SEQ ID NO: 3175707 - RNA, 23 nt, Human
ugcuguuucccggggaggaaaca

SEQ ID NO: 3175708 - RNA, 22 nt, Human
ugcuguuuaucccuuaagaaug

SEQ ID NO: 3175709 - RNA, 17 nt, Human
ugcuguugcugauuuua

SEQ ID NO: 3175710 - RNA, 20 nt, Human
uggacauaacugacuuaguu

SEQ ID NO: 3175711 - RNA, 23 nt, Human
uggacaggcauguucucugagga

SEQ ID NO: 3175712 - RNA, 13 nt, Human
uggacacuuaauu

SEQ ID NO: 3175713 - RNA, 17 nt, Human
uggacacuuaauucugu

SEQ ID NO: 3175714 - RNA, 18 nt, Human
uggacacuuaauucuguu

SEQ ID NO: 3175715 - RNA, 20 nt, Human
uggacacuuaauucuguucu

SEQ ID NO: 3175716 - RNA, 19 nt, Human
ugcccagaaugaggcugcu

SEQ ID NO: 3175717 - RNA, 19 nt, Human
ugcccaggcuggcgugcag

SEQ ID NO: 3175718 - RNA, 18 nt, Human
ugcccaggcuggcgugca

SEQ ID NO: 3175719 - RNA, 16 nt, Human
ugccccaacccuucuu

SEQ ID NO: 3175720 - RNA, 17 nt, Human
ugccccaacccuucuuc

SEQ ID NO: 3175721 - RNA, 20 nt, Human
ugccccaacccuucuucaug

SEQ ID NO: 3175722 - RNA, 22 nt, Human
ugccccaaguuuugugaaauuu

SEQ ID NO: 3175723 - RNA, 20 nt, Human
ugcccaggcuggcgugcagu

SEQ ID NO: 3175724 - RNA, 13 nt, Human
ugcccaggcuggc

SEQ ID NO: 3175725 - RNA, 19 nt, Human
ugcccauuguuuuucugau

SEQ ID NO: 3175726 - RNA, 23 nt, Human
ugccccaaauggauuccuguuuc

SEQ ID NO: 3175727 - RNA, 14 nt, Human
ugcccggcugcgga

SEQ ID NO: 3175728 - RNA, 12 nt, Human
ugcccggcugcg

SEQ ID NO: 3175729 - RNA, 13 nt, Human
ugcccgccaccac

SEQ ID NO: 3175730 - RNA, 16 nt, Human
ugccccuggcagcccc

SEQ ID NO: 3175731 - RNA, 19 nt, Human
ugccccuccucucugcccu

SEQ ID NO: 3175732 - RNA, 20 nt, Human
ugccccuccucucugcccua

SEQ ID NO: 3175733 - RNA, 17 nt, Human
ugccccuccucucugcc

SEQ ID NO: 3175734 - RNA, 18 nt, Human
ugccccuccucucugccc

SEQ ID NO: 3175735 - RNA, 16 nt, Human
ugccccucccuucaac

SEQ ID NO: 3175736 - RNA, 15 nt, Human
ugccccucccuucaa

SEQ ID NO: 3175737 - RNA, 13 nt, Human
ugccccucccuuc

SEQ ID NO: 3175738 - RNA, 14 nt, Human
ugccucaagagaag

SEQ ID NO: 3175739 - RNA, 15 nt, Human
ugccucaagagaagg

SEQ ID NO: 3175740 - RNA, 15 nt, Human
ugccuauuguaauau

SEQ ID NO: 3175741 - RNA, 20 nt, Human
ugccuaaauaaguuauaaag

SEQ ID NO: 3175742 - RNA, 18 nt, Human
ugccuaaauccacucugc

SEQ ID NO: 3175743 - RNA, 12 nt, Human
ugccuaaaauaa

SEQ ID NO: 3175744 - RNA, 16 nt, Human
ugccuaacaaaauauu

SEQ ID NO: 3175745 - RNA, 21 nt, Human
ugccuauaagccaaaauuaag

SEQ ID NO: 3175746 - RNA, 15 nt, Human
ugccuauauuuuccu

SEQ ID NO: 3175747 - RNA, 16 nt, Human
ugccuauaagccaaaa

SEQ ID NO: 3175748 - RNA, 17 nt, Human
ugccuauaagccaaaau

SEQ ID NO: 3175749 - RNA, 20 nt, Human
ugccuauaagccaaaauuaa

SEQ ID NO: 3175750 - RNA, 19 nt, Human
ugccucacauuuuuuucua

SEQ ID NO: 3175751 - RNA, 16 nt, Human
ugccuccucuucaacu

SEQ ID NO: 3175752 - RNA, 22 nt, Human
ugccuccugacacaccugcagc

SEQ ID NO: 3175753 - RNA, 14 nt, Human
ugccuccucuucaa

SEQ ID NO: 3175754 - RNA, 16 nt, Human
ugccucggauccccuu

SEQ ID NO: 3175755 - RNA, 18 nt, Human
ugccucggauccccuucc

SEQ ID NO: 3175756 - RNA, 16 nt, Human
ugcccugucaggaggc

SEQ ID NO: 3175757 - RNA, 19 nt, Human
ugcccugucaggaggcaga

SEQ ID NO: 3175758 - RNA, 19 nt, Human
ugcccugguuuccugcccu

SEQ ID NO: 3175759 - RNA, 20 nt, Human
ugcccugguuuccugcccug

SEQ ID NO: 3175760 - RNA, 23 nt, Human
ugcccugguuuccugcccuggga

SEQ ID NO: 3175761 - RNA, 17 nt, Human
ugcccugguuuccugcc

SEQ ID NO: 3175762 - RNA, 18 nt, Human
ugcccugguuuccugccc

SEQ ID NO: 3175763 - RNA, 17 nt, Human
ugcccuggugcugccac

SEQ ID NO: 3175764 - RNA, 15 nt, Human
ugcccugguuuccug

SEQ ID NO: 3175765 - RNA, 16 nt, Human
ugcccuggugcugcca

SEQ ID NO: 3175766 - RNA, 14 nt, Human
ugcccuggugcugc

SEQ ID NO: 3175767 - RNA, 12 nt, Human
ugcccuggugcu

SEQ ID NO: 3175768 - RNA, 16 nt, Human
ugcccugcccaccugg

SEQ ID NO: 3175769 - RNA, 20 nt, Human
ugcccugcccaccuggccuc

SEQ ID NO: 3175770 - RNA, 15 nt, Human
ugcccugcccaccug

SEQ ID NO: 3175771 - RNA, 14 nt, Human
ugcccugcccaccu

SEQ ID NO: 3175772 - RNA, 15 nt, Human
ugcccugggaggcag

SEQ ID NO: 3175773 - RNA, 17 nt, Human
ugcccugggaggcagug

SEQ ID NO: 3175774 - RNA, 18 nt, Human
ugcccugggaggcaguga

SEQ ID NO: 3175775 - RNA, 13 nt, Human
ugcccugggaggc

SEQ ID NO: 3175776 - RNA, 20 nt, Human
ugcauagguuagauauagag

SEQ ID NO: 3175777 - RNA, 15 nt, Human
ugcauagcaguauau

SEQ ID NO: 3175778 - RNA, 16 nt, Human
ugcauagcaguauaug

SEQ ID NO: 3175779 - RNA, 15 nt, Human
ugcaguugccaguca

SEQ ID NO: 3175780 - RNA, 16 nt, Human
ugcaguugccagucac

SEQ ID NO: 3175781 - RNA, 22 nt, Human
ugcauauuacuguacaugggac

SEQ ID NO: 3175782 - RNA, 13 nt, Human
ugcauauuacugu

SEQ ID NO: 3175783 - RNA, 18 nt, Human
ugcauaguuguagacaaa

SEQ ID NO: 3175784 - RNA, 21 nt, Human
ugcauaguuguagacaaagua

SEQ ID NO: 3175785 - RNA, 14 nt, Human
ugcauaguauucca

SEQ ID NO: 3175786 - RNA, 22 nt, Human
ugcauaguaaauguaguucaua

SEQ ID NO: 3175787 - RNA, 14 nt, Human
ugcauauaacuuau

SEQ ID NO: 3175788 - RNA, 16 nt, Human
ugcauauaacuuauau

SEQ ID NO: 3175789 - RNA, 15 nt, Human
ugcauauaacuuaua

SEQ ID NO: 3175790 - RNA, 22 nt, Human
ugcaucaauuuuucuuauuuca

SEQ ID NO: 3175791 - RNA, 19 nt, Human
ugcaucaagaugugacaug

SEQ ID NO: 3175792 - RNA, 12 nt, Human
ugcaguugcugu

SEQ ID NO: 3175793 - RNA, 22 nt, Human
ugcauauucuaguaauaaagac

SEQ ID NO: 3175794 - RNA, 21 nt, Human
ugcaguuacacuaaaagguga

SEQ ID NO: 3175795 - RNA, 14 nt, Human
ugcaguguagauuu

SEQ ID NO: 3175796 - RNA, 15 nt, Human
ugcaguguagauuuu

SEQ ID NO: 3175797 - RNA, 18 nt, Human
ugcaguuacaaauuauaa

SEQ ID NO: 3175798 - RNA, 13 nt, Human
ugcaguuacaaau

SEQ ID NO: 3175799 - RNA, 21 nt, Human
ugcaguuacaaauuauaaugu

SEQ ID NO: 3175800 - RNA, 19 nt, Human
ugcaguuacaaauuauaau

SEQ ID NO: 3175801 - RNA, 23 nt, Human
ugcaguuccccuggaagcagugc

SEQ ID NO: 3175802 - RNA, 23 nt, Human
ugcaguuacaaauuauaauguau

SEQ ID NO: 3175803 - RNA, 13 nt, Human
ugcaguucccauc

SEQ ID NO: 3175804 - RNA, 21 nt, Human
ugcaguggugcgaucuggguu

SEQ ID NO: 3175805 - RNA, 20 nt, Human
ugcaguggugcgaucugggu

SEQ ID NO: 3175806 - RNA, 13 nt, Human
ugcagggaguccg

SEQ ID NO: 3175807 - RNA, 16 nt, Human
ugccacuaaauugaca

SEQ ID NO: 3175808 - RNA, 20 nt, Human
ugccaggaagccagcaggcu

SEQ ID NO: 3175809 - RNA, 22 nt, Human
ugccaggaagccagcaggcucu

SEQ ID NO: 3175810 - RNA, 10 nt, Human
ugccaggcau

SEQ ID NO: 3175811 - RNA, 14 nt, Human
ugccaggcauggug

SEQ ID NO: 3175812 - RNA, 20 nt, Human
ugccacccuggggagaaagu

SEQ ID NO: 3175813 - RNA, 13 nt, Human
ugccaccuccccu

SEQ ID NO: 3175814 - RNA, 10 nt, Human
ugccaccucc

SEQ ID NO: 3175815 - RNA, 22 nt, Human
ugccaccuccccuugccagcug

SEQ ID NO: 3175816 - RNA, 21 nt, Human
ugccaccuccccuugccagcu

SEQ ID NO: 3175817 - RNA, 18 nt, Human
ugccaccuccccuugcca

SEQ ID NO: 3175818 - RNA, 17 nt, Human
ugccaccuccccuugcc

SEQ ID NO: 3175819 - RNA, 13 nt, Human
ugcaucagcugcu

SEQ ID NO: 3175820 - RNA, 13 nt, Human
ugcauuuggaaca

SEQ ID NO: 3175821 - RNA, 14 nt, Human
ugcauuugcuuuug

SEQ ID NO: 3175822 - RNA, 20 nt, Human
ugccaaacauuaauguugau

SEQ ID NO: 3175823 - RNA, 19 nt, Human
ugccaaacauuaauguuga

SEQ ID NO: 3175824 - RNA, 12 nt, Human
ugccaaacauua

SEQ ID NO: 3175825 - RNA, 20 nt, Human
ugccaaauaaaguuaaaagu

SEQ ID NO: 3175826 - RNA, 11 nt, Human
ugccaaaguac

SEQ ID NO: 3175827 - RNA, 19 nt, Human
ugccaaaguacagaauuug

SEQ ID NO: 3175828 - RNA, 22 nt, Human
ugccaaaguacagaauuugaau

SEQ ID NO: 3175829 - RNA, 22 nt, Human
ugcuaagaauauuugaauguau

SEQ ID NO: 3175830 - RNA, 21 nt, Human
ugcuaagaauauuugaaugua

SEQ ID NO: 3175831 - RNA, 17 nt, Human
ugcuaagaauauuugaa

SEQ ID NO: 3175832 - RNA, 20 nt, Human
ugcuaagaauuuuuuauuuu

SEQ ID NO: 3175833 - RNA, 19 nt, Human
ugcuaagaauuuuuuauuu

SEQ ID NO: 3175834 - RNA, 16 nt, Human
ugcuaagaauuuuuua

SEQ ID NO: 3175835 - RNA, 22 nt, Human
ugcuacuguccuacccacccuc

SEQ ID NO: 3175836 - RNA, 21 nt, Human
ugcuacuguccuacccacccu

SEQ ID NO: 3175837 - RNA, 13 nt, Human
ugcuagaaaaauu

SEQ ID NO: 3175838 - RNA, 19 nt, Human
ugcgcuuguuuuaaagugg

SEQ ID NO: 3175839 - RNA, 22 nt, Human
ugcgcuucacuuggguccaggc

SEQ ID NO: 3175840 - RNA, 15 nt, Human
ugcguguucucagag

SEQ ID NO: 3175841 - RNA, 14 nt, Human
ugcuaagaaaccag

SEQ ID NO: 3175842 - RNA, 16 nt, Human
ugcuaaacguguaugu

SEQ ID NO: 3175843 - RNA, 15 nt, Human
ugcuaaacguguaug

SEQ ID NO: 3175844 - RNA, 23 nt, Human
ugcuaaaaaugagcuugauuaaa

SEQ ID NO: 3175845 - RNA, 19 nt, Human
ugccuugcccacuccugcu

SEQ ID NO: 3175846 - RNA, 16 nt, Human
ugccucggcuggcucc

SEQ ID NO: 3175847 - RNA, 20 nt, Human
ugccucggcuggcuccccug

SEQ ID NO: 3175848 - RNA, 21 nt, Human
ugccucggcuggcuccccugc

SEQ ID NO: 3175849 - RNA, 23 nt, Human
ugccucggcuggcuccccugcag

SEQ ID NO: 3175850 - RNA, 22 nt, Human
ugcgcaggcuggcccugcccug

SEQ ID NO: 3175851 - RNA, 23 nt, Human
ugcgcaggcuggcccugcccugg

SEQ ID NO: 3175852 - RNA, 21 nt, Human
ugcgcaggcuggcccugcccu

SEQ ID NO: 3175853 - RNA, 23 nt, Human
ugccuugcccacuccugcucugc

SEQ ID NO: 3175854 - RNA, 19 nt, Human
ugcgcaggcuggcccugcc

SEQ ID NO: 3175855 - RNA, 13 nt, Human
ugcgcaguugcug

SEQ ID NO: 3175856 - RNA, 20 nt, Human
ugcgcauaggccugcuuugu

SEQ ID NO: 3175857 - RNA, 15 nt, Human
ugcgcauaggccugc

SEQ ID NO: 3175858 - RNA, 16 nt, Human
ugcgcuucacuugggu

SEQ ID NO: 3175859 - RNA, 15 nt, Human
ugcgcuucacuuggg

SEQ ID NO: 3175860 - RNA, 14 nt, Human
ugcgcuucacuugg

SEQ ID NO: 3175861 - RNA, 11 nt, Human
ugcgcuucacu

SEQ ID NO: 3175862 - RNA, 18 nt, Human
ugcucuugggcaauauuc

SEQ ID NO: 3175863 - RNA, 17 nt, Human
ugcucuugggcaauauu

SEQ ID NO: 3175864 - RNA, 15 nt, Human
ugcucuugggcaaua

SEQ ID NO: 3175865 - RNA, 21 nt, Human
ugcucuugggcaauauucucu

SEQ ID NO: 3175866 - RNA, 19 nt, Human
ugcucuugggcaauauucu

SEQ ID NO: 3175867 - RNA, 24 nt, Human
ugcucuugggcaauauucucugua

SEQ ID NO: 3175868 - RNA, 21 nt, Human
ugcucuuucccacccagccug

SEQ ID NO: 3175869 - RNA, 20 nt, Human
ugcucuuucccacccagccu

SEQ ID NO: 3175870 - RNA, 19 nt, Human
ugcucuuucccacccagcc

SEQ ID NO: 3175871 - RNA, 16 nt, Human
ugcucuuucccaccca

SEQ ID NO: 3175872 - RNA, 23 nt, Human
ugcucuccgaccagacaccuuga

SEQ ID NO: 3175873 - RNA, 12 nt, Human
ugcucuccucuu

SEQ ID NO: 3175874 - RNA, 20 nt, Human
ugcucuaaaauauuuaugaa

SEQ ID NO: 3175875 - RNA, 19 nt, Human
ugcucuaaaauauuuauga

SEQ ID NO: 3175876 - RNA, 15 nt, Human
ugcucuaaaauauuu

SEQ ID NO: 3175877 - RNA, 14 nt, Human
ugcucuaaaauauu

SEQ ID NO: 3175878 - RNA, 13 nt, Human
ugcucuaaaauau

SEQ ID NO: 3175879 - RNA, 23 nt, Human
ugcucuaaaauauuuaugaagaa

SEQ ID NO: 3175880 - RNA, 12 nt, Human
ugcucuaaaaua

SEQ ID NO: 3175881 - RNA, 16 nt, Human
ugcucaguguuucaua

SEQ ID NO: 3175882 - RNA, 15 nt, Human
ugcucaguguuucau

SEQ ID NO: 3175883 - RNA, 19 nt, Human
ugcucagugucuggcugca

SEQ ID NO: 3175884 - RNA, 17 nt, Human
ugcucacauaucuguca

SEQ ID NO: 3175885 - RNA, 13 nt, Human
ugcuagaacuccc

SEQ ID NO: 3175886 - RNA, 14 nt, Human
ugcuagaacucccu

SEQ ID NO: 3175887 - RNA, 15 nt, Human
ugcuagaacucccuu

SEQ ID NO: 3175888 - RNA, 17 nt, Human
ugcuagaacucccuuuc

SEQ ID NO: 3175889 - RNA, 21 nt, Human
ugcuaggaacacuccuucaca

SEQ ID NO: 3175890 - RNA, 20 nt, Human
ugcuaggaacacuccuucac

SEQ ID NO: 3175891 - RNA, 22 nt, Human
ugcuaggaacacuccuucacag

SEQ ID NO: 3175892 - RNA, 19 nt, Human
ugcugcuugaggcaacuca

SEQ ID NO: 3175893 - RNA, 20 nt, Human
ugcugggauuacagguguga

SEQ ID NO: 3175894 - RNA, 12 nt, Human
ugcugcuugagg

SEQ ID NO: 3175895 - RNA, 15 nt, Human
ugcugcuucauguuu

SEQ ID NO: 3175896 - RNA, 20 nt, Human
ugcugccucggauccccuuc

SEQ ID NO: 3175897 - RNA, 19 nt, Human
ugcugccucggauccccuu

SEQ ID NO: 3175898 - RNA, 22 nt, Human
ugcugccucggauccccuuccu

SEQ ID NO: 3175899 - RNA, 15 nt, Human
ugcuguaaaagcaag

SEQ ID NO: 3175900 - RNA, 16 nt, Human
ugcuguuaucccugcc

SEQ ID NO: 3175901 - RNA, 13 nt, Human
ugcuguuacaugc

SEQ ID NO: 3175902 - RNA, 18 nt, Human
ugcuguuacaguuuucuu

SEQ ID NO: 3175903 - RNA, 21 nt, Human
ugcuguguguugccugggaca

SEQ ID NO: 3175904 - RNA, 18 nt, Human
ugcuguguguggcuucug

SEQ ID NO: 3175905 - RNA, 17 nt, Human
ugcuguuacaguuuucu

SEQ ID NO: 3175906 - RNA, 13 nt, Human
ugcuguguuugcu

SEQ ID NO: 3175907 - RNA, 22 nt, Human
ugcuguuaacugcaaccuuguu

SEQ ID NO: 3175908 - RNA, 20 nt, Human
ugcugggggggauuguaaaa

SEQ ID NO: 3175909 - RNA, 17 nt, Human
ugcugggcuugucugua

SEQ ID NO: 3175910 - RNA, 22 nt, Human
ugcuggugggcuugucauagcc

SEQ ID NO: 3175911 - RNA, 19 nt, Human
ugcugguaaaaugaagaau

SEQ ID NO: 3175912 - RNA, 14 nt, Human
ugcugguaaaauga

SEQ ID NO: 3175913 - RNA, 16 nt, Human
ugcugguaaaaugaag

SEQ ID NO: 3175914 - RNA, 17 nt, Human
ugcugguaaaaugaaga

SEQ ID NO: 3175915 - RNA, 18 nt, Human
ugcugguaaaaugaagaa

SEQ ID NO: 3175916 - RNA, 13 nt, Human
ugcuggguguggc

SEQ ID NO: 3175917 - RNA, 15 nt, Human
gugaggaugucuggg

SEQ ID NO: 3175918 - RNA, 23 nt, Human
gugaggauuaaauaauguaaaua

SEQ ID NO: 3175919 - RNA, 11 nt, Human
gugaggccaga

SEQ ID NO: 3175920 - RNA, 15 nt, Human
gugaggccacugaag

SEQ ID NO: 3175921 - RNA, 16 nt, Human
gugaggccacugaaga

SEQ ID NO: 3175922 - RNA, 20 nt, Human
gugaggccacugaagaggag

SEQ ID NO: 3175923 - RNA, 21 nt, Human
gugaggccacugaagaggagg

SEQ ID NO: 3175924 - RNA, 22 nt, Human
gugaggccacugaagaggagga

SEQ ID NO: 3175925 - RNA, 23 nt, Human
gugaggccacugaagaggaggag

SEQ ID NO: 3175926 - RNA, 20 nt, Human
gugauccacccaccucagcc

SEQ ID NO: 3175927 - RNA, 18 nt, Human
gugauccacccaccucag

SEQ ID NO: 3175928 - RNA, 15 nt, Human
gugauccacccaccu

SEQ ID NO: 3175929 - RNA, 18 nt, Human
gugauccucccaccucag

SEQ ID NO: 3175930 - RNA, 15 nt, Human
gugauccucccaccu

SEQ ID NO: 3175931 - RNA, 14 nt, Human
gugauccucccacc

SEQ ID NO: 3175932 - RNA, 14 nt, Human
gugauccacucgcc

SEQ ID NO: 3175933 - RNA, 22 nt, Human
gugauccucccaccucagccuc

SEQ ID NO: 3175934 - RNA, 20 nt, Human
gugauccucccaccucagcc

SEQ ID NO: 3175935 - RNA, 20 nt, Human
gugauucacagugugaaucu

SEQ ID NO: 3175936 - RNA, 12 nt, Human
gugauuuucauu

SEQ ID NO: 3175937 - RNA, 12 nt, Human
gugcaaagccac

SEQ ID NO: 3175938 - RNA, 23 nt, Human
gugauucuccugccucagccucc

SEQ ID NO: 3175939 - RNA, 22 nt, Human
gugauucuccugccucagccuc

SEQ ID NO: 3175940 - RNA, 20 nt, Human
gugauucuccugccucagcc

SEQ ID NO: 3175941 - RNA, 19 nt, Human
gugauucuccugccucagc

SEQ ID NO: 3175942 - RNA, 18 nt, Human
gugauucuccugccucag

SEQ ID NO: 3175943 - RNA, 17 nt, Human
gugauucuccugccuca

SEQ ID NO: 3175944 - RNA, 16 nt, Human
gugauucuccugccuc

SEQ ID NO: 3175945 - RNA, 14 nt, Human
gugauucuccugcc

SEQ ID NO: 3175946 - RNA, 20 nt, Human
gugauucucaugccucagcc

SEQ ID NO: 3175947 - RNA, 22 nt, Human
gugcaaaguucccuacuuccug

SEQ ID NO: 3175948 - RNA, 19 nt, Human
gugcauaaguuaacuucca

SEQ ID NO: 3175949 - RNA, 18 nt, Human
gugcaguaacuugggagu

SEQ ID NO: 3175950 - RNA, 13 nt, Human
gugcaguagugca

SEQ ID NO: 3175951 - RNA, 15 nt, Human
gugcaucucagccca

SEQ ID NO: 3175952 - RNA, 22 nt, Human
gugccagguuuuuggucugacc

SEQ ID NO: 3175953 - RNA, 20 nt, Human
gugccagguuuuuggucuga

SEQ ID NO: 3175954 - RNA, 18 nt, Human
gugcaugcagcaucuaag

SEQ ID NO: 3175955 - RNA, 18 nt, Human
gugcaucucagcccacau

SEQ ID NO: 3175956 - RNA, 14 nt, Human
gugcaucucagccc

SEQ ID NO: 3175957 - RNA, 20 nt, Human
gugcccacaggaucagucug

SEQ ID NO: 3175958 - RNA, 23 nt, Human
gugcccaagaauagaugcugacu

SEQ ID NO: 3175959 - RNA, 11 nt, Human
gugcccagcuu

SEQ ID NO: 3175960 - RNA, 19 nt, Human
gugaccuuccaagagccug

SEQ ID NO: 3175961 - RNA, 16 nt, Human
gugacaacacuugugu

SEQ ID NO: 3175962 - RNA, 15 nt, Human
gugaccucugccuga

SEQ ID NO: 3175963 - RNA, 19 nt, Human
gugaccuccggccaggugc

SEQ ID NO: 3175964 - RNA, 19 nt, Human
gugaccucuagcccugccc

SEQ ID NO: 3175965 - RNA, 20 nt, Human
gugaccucuagcccugcccg

SEQ ID NO: 3175966 - RNA, 16 nt, Human
gugaccucagcuuuga

SEQ ID NO: 3175967 - RNA, 22 nt, Human
gugagccaccgugccuggccac

SEQ ID NO: 3175968 - RNA, 19 nt, Human
gugagcugcugccaugaac

SEQ ID NO: 3175969 - RNA, 17 nt, Human
gugagcugcugccauga

SEQ ID NO: 3175970 - RNA, 13 nt, Human
gugagcugcacca

SEQ ID NO: 3175971 - RNA, 16 nt, Human
gugaggaagccgcugg

SEQ ID NO: 3175972 - RNA, 19 nt, Human
gugaggaagccgcuggggc

SEQ ID NO: 3175973 - RNA, 11 nt, Human
gugaggaagcc

SEQ ID NO: 3175974 - RNA, 14 nt, Human
gugaggaaaucaaa

SEQ ID NO: 3175975 - RNA, 18 nt, Human
gugaggaaaucaaagugc

SEQ ID NO: 3175976 - RNA, 22 nt, Human
gugaggaaaucaaagugcuauu

SEQ ID NO: 3175977 - RNA, 11 nt, Human
gugagcuggag

SEQ ID NO: 3175978 - RNA, 17 nt, Human
gugagcaggcugugagu

SEQ ID NO: 3175979 - RNA, 17 nt, Human
gugacugaucucucgug

SEQ ID NO: 3175980 - RNA, 13 nt, Human
gugagccacugca

SEQ ID NO: 3175981 - RNA, 17 nt, Human
gugagccaccgugccug

SEQ ID NO: 3175982 - RNA, 21 nt, Human
gugagccaccgugccuggcca

SEQ ID NO: 3175983 - RNA, 16 nt, Human
gugagccaccacgccc

SEQ ID NO: 3175984 - RNA, 15 nt, Human
gugagccaccgugcc

SEQ ID NO: 3175985 - RNA, 15 nt, Human
gugagccaccacgcc

SEQ ID NO: 3175986 - RNA, 12 nt, Human
gugaaauuuuuc

SEQ ID NO: 3175987 - RNA, 14 nt, Human
gugaauaauuacag

SEQ ID NO: 3175988 - RNA, 14 nt, Human
gugaaauguaacug

SEQ ID NO: 3175989 - RNA, 12 nt, Human
gugaaauaucau

SEQ ID NO: 3175990 - RNA, 19 nt, Human
gugaaaggauaugaaucug

SEQ ID NO: 3175991 - RNA, 19 nt, Human
gugaaaggaaagagggagg

SEQ ID NO: 3175992 - RNA, 16 nt, Human
gugaauuacuaacuuc

SEQ ID NO: 3175993 - RNA, 19 nt, Human
gugaauuacuaacuucuaa

SEQ ID NO: 3175994 - RNA, 18 nt, Human
gugaauuacuaacuucua

SEQ ID NO: 3175995 - RNA, 14 nt, Human
gugaaucagagcac

SEQ ID NO: 3175996 - RNA, 14 nt, Human
gugaauauaaaugu

SEQ ID NO: 3175997 - RNA, 16 nt, Human
gugaauauaaaugugu

SEQ ID NO: 3175998 - RNA, 17 nt, Human
gugaauauaaaugugug

SEQ ID NO: 3175999 - RNA, 22 nt, Human
gugaauacugcuugaauaaaca

SEQ ID NO: 3176000 - RNA, 16 nt, Human
gugaaaaugugugugu

SEQ ID NO: 3176001 - RNA, 12 nt, Human
gugaaaagaaua

SEQ ID NO: 3176002 - RNA, 13 nt, Human
gugaaaauaauug

SEQ ID NO: 3176003 - RNA, 22 nt, Human
gugaaaauaagccaugagaaug

SEQ ID NO: 3176004 - RNA, 14 nt, Human
gugaaaagaaaaau

SEQ ID NO: 3176005 - RNA, 23 nt, Human
gugaaaagaaaaaugagccuggc

SEQ ID NO: 3176006 - RNA, 15 nt, Human
guggcagugggagcu

SEQ ID NO: 3176007 - RNA, 17 nt, Human
guggcagugggagcugc

SEQ ID NO: 3176008 - RNA, 16 nt, Human
guggcagugggagcug

SEQ ID NO: 3176009 - RNA, 20 nt, Human
guggcagggcacagggccug

SEQ ID NO: 3176010 - RNA, 19 nt, Human
guggcagggcacagggccu

SEQ ID NO: 3176011 - RNA, 18 nt, Human
guggcagggcacagggcc

SEQ ID NO: 3176012 - RNA, 15 nt, Human
guggcagggcacagg

SEQ ID NO: 3176013 - RNA, 14 nt, Human
guggcagggcacag

SEQ ID NO: 3176014 - RNA, 17 nt, Human
guggcaggacacugcag

SEQ ID NO: 3176015 - RNA, 19 nt, Human
guggcagcugcuuuugucu

SEQ ID NO: 3176016 - RNA, 13 nt, Human
guggcagcugcuu

SEQ ID NO: 3176017 - RNA, 12 nt, Human
guggcagcugcu

SEQ ID NO: 3176018 - RNA, 23 nt, Human
guggcagcugcgguccacccagg

SEQ ID NO: 3176019 - RNA, 22 nt, Human
guggcagcugcgguccacccag

SEQ ID NO: 3176020 - RNA, 21 nt, Human
guggcagcugcgguccaccca

SEQ ID NO: 3176021 - RNA, 19 nt, Human
guggcagcugcgguccacc

SEQ ID NO: 3176022 - RNA, 15 nt, Human
guggcaguuuggcaa

SEQ ID NO: 3176023 - RNA, 21 nt, Human
guggcagugggagcugccugu

SEQ ID NO: 3176024 - RNA, 19 nt, Human
guggcagugggagcugccu

SEQ ID NO: 3176025 - RNA, 11 nt, Human
guggccccacc

SEQ ID NO: 3176026 - RNA, 21 nt, Human
guggccacuccagaccccugg

SEQ ID NO: 3176027 - RNA, 16 nt, Human
guggccaucauuucug

SEQ ID NO: 3176028 - RNA, 14 nt, Human
guggagucauuucu

SEQ ID NO: 3176029 - RNA, 22 nt, Human
guggagucagccucgcaggccu

SEQ ID NO: 3176030 - RNA, 20 nt, Human
guggagguugcugguacaca

SEQ ID NO: 3176031 - RNA, 17 nt, Human
guggaguucaucuugaa

SEQ ID NO: 3176032 - RNA, 17 nt, Human
guggauacgugucaaug

SEQ ID NO: 3176033 - RNA, 18 nt, Human
guggaugccugguggcag

SEQ ID NO: 3176034 - RNA, 16 nt, Human
guggaugccugguggc

SEQ ID NO: 3176035 - RNA, 16 nt, Human
guggaugcaauuuuuc

SEQ ID NO: 3176036 - RNA, 20 nt, Human
guggagaagcggcuggcagc

SEQ ID NO: 3176037 - RNA, 13 nt, Human
guggacuuuuauu

SEQ ID NO: 3176038 - RNA, 23 nt, Human
guggacuuaggaagguggccuuc

SEQ ID NO: 3176039 - RNA, 21 nt, Human
guggaaauuaagaagaaacua

SEQ ID NO: 3176040 - RNA, 17 nt, Human
guggagaaucacaggcu

SEQ ID NO: 3176041 - RNA, 14 nt, Human
guggagacugcucc

SEQ ID NO: 3176042 - RNA, 21 nt, Human
guggagaaucacaggcugggc

SEQ ID NO: 3176043 - RNA, 20 nt, Human
guggagaaucacaggcuggg

SEQ ID NO: 3176044 - RNA, 19 nt, Human
guggagaaucacaggcugg

SEQ ID NO: 3176045 - RNA, 18 nt, Human
guggagaaucacaggcug

SEQ ID NO: 3176046 - RNA, 22 nt, Human
guggagacugcuccugagcccc

SEQ ID NO: 3176047 - RNA, 15 nt, Human
guggagacugcuccu

SEQ ID NO: 3176048 - RNA, 18 nt, Human
guggagaggcccggccuc

SEQ ID NO: 3176049 - RNA, 23 nt, Human
guggagccugacagccagaacuc

SEQ ID NO: 3176050 - RNA, 16 nt, Human
guggagcguucaccag

SEQ ID NO: 3176051 - RNA, 19 nt, Human
guggagccugacagccaga

SEQ ID NO: 3176052 - RNA, 22 nt, Human
guggagccugacagccagaacu

SEQ ID NO: 3176053 - RNA, 21 nt, Human
guggagccugacagccagaac

SEQ ID NO: 3176054 - RNA, 15 nt, Human
guggagcccaggagu

SEQ ID NO: 3176055 - RNA, 14 nt, Human
guggagcccaggag

SEQ ID NO: 3176056 - RNA, 18 nt, Human
gugcuuauguaugaggua

SEQ ID NO: 3176057 - RNA, 21 nt, Human
gugcuuauugauauucuaaga

SEQ ID NO: 3176058 - RNA, 13 nt, Human
gugcuuggaggaa

SEQ ID NO: 3176059 - RNA, 15 nt, Human
gugcuuggaggaagg

SEQ ID NO: 3176060 - RNA, 12 nt, Human
gugcuuggagga

SEQ ID NO: 3176061 - RNA, 21 nt, Human
gugcuucugccacccugcuga

SEQ ID NO: 3176062 - RNA, 22 nt, Human
gugcuucugccacccugcugag

SEQ ID NO: 3176063 - RNA, 22 nt, Human
gugcuuagcaaaaaauaaugac

SEQ ID NO: 3176064 - RNA, 19 nt, Human
gugcuguguuugcuccccu

SEQ ID NO: 3176065 - RNA, 21 nt, Human
gugcugccacacuucaggcuc

SEQ ID NO: 3176066 - RNA, 22 nt, Human
gugcugccauccagguucagcu

SEQ ID NO: 3176067 - RNA, 11 nt, Human
gugcugcccug

SEQ ID NO: 3176068 - RNA, 23 nt, Human
guggaaaagccaagaggcugcag

SEQ ID NO: 3176069 - RNA, 18 nt, Human
guggaaaaauagccugcc

SEQ ID NO: 3176070 - RNA, 16 nt, Human
gugcuuuuuauaaaaa

SEQ ID NO: 3176071 - RNA, 18 nt, Human
gugcuuuuuauaaaaaga

SEQ ID NO: 3176072 - RNA, 20 nt, Human
guggaaauuaagaagaaacu

SEQ ID NO: 3176073 - RNA, 19 nt, Human
guggaaauuaagaagaaac

SEQ ID NO: 3176074 - RNA, 18 nt, Human
guggaaauuaagaagaaa

SEQ ID NO: 3176075 - RNA, 17 nt, Human
guggaaauuaagaagaa

SEQ ID NO: 3176076 - RNA, 18 nt, Human
gugcuugugaaagagguc

SEQ ID NO: 3176077 - RNA, 17 nt, Human
gugccuuugcagcucag

SEQ ID NO: 3176078 - RNA, 16 nt, Human
gugcucuggacaggca

SEQ ID NO: 3176079 - RNA, 15 nt, Human
gugcucuggacaggc

SEQ ID NO: 3176080 - RNA, 21 nt, Human
gugccuuggggacaagagcag

SEQ ID NO: 3176081 - RNA, 18 nt, Human
gugcucuggacaggcaug

SEQ ID NO: 3176082 - RNA, 17 nt, Human
gugcucuggacaggcau

SEQ ID NO: 3176083 - RNA, 23 nt, Human
gugcugaaugguuuucaaaauaa

SEQ ID NO: 3176084 - RNA, 20 nt, Human
gugcugaaugguuuucaaaa

SEQ ID NO: 3176085 - RNA, 19 nt, Human
gugcugaaugguuuucaaa

SEQ ID NO: 3176086 - RNA, 16 nt, Human
gugcugagucugaagg

SEQ ID NO: 3176087 - RNA, 17 nt, Human
gugcugagucugaaggc

SEQ ID NO: 3176088 - RNA, 18 nt, Human
gugcugagucugaaggcu

SEQ ID NO: 3176089 - RNA, 19 nt, Human
gugcugagucugaaggcug

SEQ ID NO: 3176090 - RNA, 12 nt, Human
gugcugagucug

SEQ ID NO: 3176091 - RNA, 19 nt, Human
gugcugccauccagguuca

SEQ ID NO: 3176092 - RNA, 18 nt, Human
gugcugccauccagguuc

SEQ ID NO: 3176093 - RNA, 15 nt, Human
gugcugccauccagg

SEQ ID NO: 3176094 - RNA, 12 nt, Human
gugcugccacac

SEQ ID NO: 3176095 - RNA, 13 nt, Human
gugcugcaguaug

SEQ ID NO: 3176096 - RNA, 22 nt, Human
gugcugcagggcuuuaaaauuc

SEQ ID NO: 3176097 - RNA, 22 nt, Human
gucagcccaaaccaccagaagc

SEQ ID NO: 3176098 - RNA, 23 nt, Human
gucagcccaaaccaccagaagcc

SEQ ID NO: 3176099 - RNA, 14 nt, Human
gucagcaguugcug

SEQ ID NO: 3176100 - RNA, 23 nt, Human
gucagcaguugcugguaaaauga

SEQ ID NO: 3176101 - RNA, 22 nt, Human
gucaccugggcgucaucugguc

SEQ ID NO: 3176102 - RNA, 17 nt, Human
gucaccugcuucucugc

SEQ ID NO: 3176103 - RNA, 23 nt, Human
gucaccucacucagcaccacuca

SEQ ID NO: 3176104 - RNA, 13 nt, Human
gucaccugcuucu

SEQ ID NO: 3176105 - RNA, 16 nt, Human
gucaccugcuucucug

SEQ ID NO: 3176106 - RNA, 14 nt, Human
gucaccugcuucuc

SEQ ID NO: 3176107 - RNA, 23 nt, Human
gucagccucgcaggccucccugc

SEQ ID NO: 3176108 - RNA, 16 nt, Human
gucagccucgcaggcc

SEQ ID NO: 3176109 - RNA, 19 nt, Human
gucauacucgagucugagg

SEQ ID NO: 3176110 - RNA, 20 nt, Human
gucauacucgagucugaggc

SEQ ID NO: 3176111 - RNA, 18 nt, Human
gucauacucgagucugag

SEQ ID NO: 3176112 - RNA, 13 nt, Human
gucauacauagga

SEQ ID NO: 3176113 - RNA, 19 nt, Human
gucaucugagaaugaacaa

SEQ ID NO: 3176114 - RNA, 15 nt, Human
gucaucugagaauga

SEQ ID NO: 3176115 - RNA, 13 nt, Human
gucaucugagaau

SEQ ID NO: 3176116 - RNA, 22 nt, Human
gucaugcagaguauuucuaaag

SEQ ID NO: 3176117 - RNA, 23 nt, Human
gucaugauguuuuuaaaaucuua

SEQ ID NO: 3176118 - RNA, 22 nt, Human
gucaugauguuuuuaaaaucuu

SEQ ID NO: 3176119 - RNA, 13 nt, Human
gucaugauguuuu

SEQ ID NO: 3176120 - RNA, 19 nt, Human
gucaugaugcucuuuccca

SEQ ID NO: 3176121 - RNA, 20 nt, Human
gucaugauguuuuuaaaauc

SEQ ID NO: 3176122 - RNA, 16 nt, Human
gucaugauguuuuuaa

SEQ ID NO: 3176123 - RNA, 15 nt, Human
gucaugauguuuuua

SEQ ID NO: 3176124 - RNA, 14 nt, Human
gucaugauguuuuu

SEQ ID NO: 3176125 - RNA, 14 nt, Human
gucaugaugaauca

SEQ ID NO: 3176126 - RNA, 19 nt, Human
gucaugaugaaucaguccu

SEQ ID NO: 3176127 - RNA, 16 nt, Human
gucaugaugcucuuuc

SEQ ID NO: 3176128 - RNA, 18 nt, Human
gucaucauguuuugauuu

SEQ ID NO: 3176129 - RNA, 16 nt, Human
gucaucucagcuggau

SEQ ID NO: 3176130 - RNA, 13 nt, Human
gucaucuagcauu

SEQ ID NO: 3176131 - RNA, 21 nt, Human
gucaucuagcauuagguauau

SEQ ID NO: 3176132 - RNA, 21 nt, Human
gucauauaagauucauauuua

SEQ ID NO: 3176133 - RNA, 16 nt, Human
gucauaggaaguuagc

SEQ ID NO: 3176134 - RNA, 15 nt, Human
gucauaggaaguuag

SEQ ID NO: 3176135 - RNA, 17 nt, Human
gucauauuuaaacagaa

SEQ ID NO: 3176136 - RNA, 14 nt, Human
gucauauguuugcu

SEQ ID NO: 3176137 - RNA, 20 nt, Human
gucccagaaugccuccugca

SEQ ID NO: 3176138 - RNA, 17 nt, Human
gucccagauacuugggg

SEQ ID NO: 3176139 - RNA, 14 nt, Human
gucccagcagccag

SEQ ID NO: 3176140 - RNA, 11 nt, Human
gucccagcagc

SEQ ID NO: 3176141 - RNA, 16 nt, Human
gucccagcagccagcc

SEQ ID NO: 3176142 - RNA, 15 nt, Human
gucccagcagccagc

SEQ ID NO: 3176143 - RNA, 17 nt, Human
gucccagcagccagcca

SEQ ID NO: 3176144 - RNA, 14 nt, Human
gucccacucagucc

SEQ ID NO: 3176145 - RNA, 15 nt, Human
gucccacucagucca

SEQ ID NO: 3176146 - RNA, 19 nt, Human
gucccacuccaagccagca

SEQ ID NO: 3176147 - RNA, 13 nt, Human
gucccacuccaag

SEQ ID NO: 3176148 - RNA, 22 nt, Human
guccaggacaggagaugcugug

SEQ ID NO: 3176149 - RNA, 24 nt, Human
guccaggccuacuccugucuucug

SEQ ID NO: 3176150 - RNA, 23 nt, Human
guccaggccuacuccugucuucu

SEQ ID NO: 3176151 - RNA, 21 nt, Human
guccaggccuacuccugucuu

SEQ ID NO: 3176152 - RNA, 20 nt, Human
guccaggccuacuccugucu

SEQ ID NO: 3176153 - RNA, 19 nt, Human
guccaggccuacuccuguc

SEQ ID NO: 3176154 - RNA, 15 nt, Human
guccaggccuacucc

SEQ ID NO: 3176155 - RNA, 16 nt, Human
guccacccaggagccc

SEQ ID NO: 3176156 - RNA, 15 nt, Human
guccacccaggagcc

SEQ ID NO: 3176157 - RNA, 13 nt, Human
guccacccaggag

SEQ ID NO: 3176158 - RNA, 14 nt, Human
guccacccaggagc

SEQ ID NO: 3176159 - RNA, 16 nt, Human
gucauggagaaccacc

SEQ ID NO: 3176160 - RNA, 18 nt, Human
gucauggagaaccaccua

SEQ ID NO: 3176161 - RNA, 22 nt, Human
gucauggagaaccaccuacccc

SEQ ID NO: 3176162 - RNA, 15 nt, Human
gucaugcuccccugu

SEQ ID NO: 3176163 - RNA, 23 nt, Human
gucaugcuccccugugccagccc

SEQ ID NO: 3176164 - RNA, 20 nt, Human
gucaugcuccccugugccag

SEQ ID NO: 3176165 - RNA, 19 nt, Human
gucaugcuccccugugcca

SEQ ID NO: 3176166 - RNA, 17 nt, Human
gucaugcuccccugugc

SEQ ID NO: 3176167 - RNA, 12 nt, Human
guccacuuuucc

SEQ ID NO: 3176168 - RNA, 22 nt, Human
guccacuuuuccaguauuuuag

SEQ ID NO: 3176169 - RNA, 21 nt, Human
guccacuuuuccaguauuuua

SEQ ID NO: 3176170 - RNA, 20 nt, Human
guccacuuuuccaguauuuu

SEQ ID NO: 3176171 - RNA, 19 nt, Human
guccacuuuuccaguauuu

SEQ ID NO: 3176172 - RNA, 18 nt, Human
guccacuuuuccaguauu

SEQ ID NO: 3176173 - RNA, 15 nt, Human
guccacuuuuccagu

SEQ ID NO: 3176174 - RNA, 14 nt, Human
guccacuuuuccag

SEQ ID NO: 3176175 - RNA, 17 nt, Human
guccagaaggagggggu

SEQ ID NO: 3176176 - RNA, 21 nt, Human
guccagaaggagggggugacc

SEQ ID NO: 3176177 - RNA, 20 nt, Human
guauuaucuuguucaggaaa

SEQ ID NO: 3176178 - RNA, 23 nt, Human
guauuauguccugugagaugugu

SEQ ID NO: 3176179 - RNA, 23 nt, Human
guauuauaaacaagaaugaaggu

SEQ ID NO: 3176180 - RNA, 15 nt, Human
guauuacuucugcua

SEQ ID NO: 3176181 - RNA, 14 nt, Human
guauuacuucugcu

SEQ ID NO: 3176182 - RNA, 13 nt, Human
guauuacuucugc

SEQ ID NO: 3176183 - RNA, 15 nt, Human
guagagugggagcug

SEQ ID NO: 3176184 - RNA, 14 nt, Human
guagagucugaggg

SEQ ID NO: 3176185 - RNA, 21 nt, Human
guagagucugagggcuuguag

SEQ ID NO: 3176186 - RNA, 12 nt, Human
guagagucugag

SEQ ID NO: 3176187 - RNA, 13 nt, Human
guagagugggagc

SEQ ID NO: 3176188 - RNA, 15 nt, Human
guagagguauaauug

SEQ ID NO: 3176189 - RNA, 19 nt, Human
guagagguauaauugugug

SEQ ID NO: 3176190 - RNA, 16 nt, Human
guagagguauaauugu

SEQ ID NO: 3176191 - RNA, 20 nt, Human
guauuugaaaacagaaauug

SEQ ID NO: 3176192 - RNA, 17 nt, Human
guauuugaaagugccuu

SEQ ID NO: 3176193 - RNA, 17 nt, Human
guauuuggaauuagaac

SEQ ID NO: 3176194 - RNA, 16 nt, Human
guauuuggauaucugu

SEQ ID NO: 3176195 - RNA, 15 nt, Human
guauuugaaaacaga

SEQ ID NO: 3176196 - RNA, 19 nt, Human
guauuugaaaacagaaauu

SEQ ID NO: 3176197 - RNA, 16 nt, Human
guauuugaaaacagaa

SEQ ID NO: 3176198 - RNA, 11 nt, Human
guauuuauuca

SEQ ID NO: 3176199 - RNA, 23 nt, Human
guauucauauuuguacuuucugu

SEQ ID NO: 3176200 - RNA, 23 nt, Human
guauucagcaaggcgcuaacuug

SEQ ID NO: 3176201 - RNA, 22 nt, Human
guauucaauuaaagaaauaauu

SEQ ID NO: 3176202 - RNA, 14 nt, Human
guauucauauuugu

SEQ ID NO: 3176203 - RNA, 19 nt, Human
guauucauauuuguacuuu

SEQ ID NO: 3176204 - RNA, 17 nt, Human
guauucauauuuguacu

SEQ ID NO: 3176205 - RNA, 19 nt, Human
guauuuauuuaguauuuau

SEQ ID NO: 3176206 - RNA, 12 nt, Human
guauuuauucuu

SEQ ID NO: 3176207 - RNA, 22 nt, Human
gucaaguggcaaagcuguucuu

SEQ ID NO: 3176208 - RNA, 20 nt, Human
gucaaguggcaaagcuguuc

SEQ ID NO: 3176209 - RNA, 14 nt, Human
gucaaguggcaaag

SEQ ID NO: 3176210 - RNA, 13 nt, Human
gucaauuacagga

SEQ ID NO: 3176211 - RNA, 15 nt, Human
gucaauuacaggaag

SEQ ID NO: 3176212 - RNA, 14 nt, Human
gucaaugugugcac

SEQ ID NO: 3176213 - RNA, 20 nt, Human
gucaccugaagacucauucu

SEQ ID NO: 3176214 - RNA, 21 nt, Human
gucaccucacucagcaccacu

SEQ ID NO: 3176215 - RNA, 19 nt, Human
gucaccucacucagcacca

SEQ ID NO: 3176216 - RNA, 16 nt, Human
gucaccucacucagca

SEQ ID NO: 3176217 - RNA, 15 nt, Human
gucaccucacucagc

SEQ ID NO: 3176218 - RNA, 13 nt, Human
gucaccucacuca

SEQ ID NO: 3176219 - RNA, 13 nt, Human
gucaccccggcca

SEQ ID NO: 3176220 - RNA, 14 nt, Human
gucacccaugacag

SEQ ID NO: 3176221 - RNA, 12 nt, Human
guauuuggguuu

SEQ ID NO: 3176222 - RNA, 19 nt, Human
gucaagagggucugaggaa

SEQ ID NO: 3176223 - RNA, 18 nt, Human
gucaagagggucugagga

SEQ ID NO: 3176224 - RNA, 19 nt, Human
gucaagugaaaaaggagga

SEQ ID NO: 3176225 - RNA, 16 nt, Human
gucaagugaaaaagga

SEQ ID NO: 3176226 - RNA, 18 nt, Human
gucaagugaaaaaggagg

SEQ ID NO: 3176227 - RNA, 21 nt, Human
gucaagaauagcauuguaaaa

SEQ ID NO: 3176228 - RNA, 13 nt, Human
guccucacacuca

SEQ ID NO: 3176229 - RNA, 21 nt, Human
guccuauuaguguuauaugaa

SEQ ID NO: 3176230 - RNA, 22 nt, Human
guccuauuaguguuauaugaac

SEQ ID NO: 3176231 - RNA, 17 nt, Human
guccuauuaguguuaua

SEQ ID NO: 3176232 - RNA, 20 nt, Human
guccuauuaguguuauauga

SEQ ID NO: 3176233 - RNA, 16 nt, Human
guccuaggcuggaagg

SEQ ID NO: 3176234 - RNA, 17 nt, Human
guccuaggcuggaagga

SEQ ID NO: 3176235 - RNA, 22 nt, Human
guccuaggcuggaaggaggaag

SEQ ID NO: 3176236 - RNA, 13 nt, Human
guccuccagaacu

SEQ ID NO: 3176237 - RNA, 12 nt, Human
guccuccagaac

SEQ ID NO: 3176238 - RNA, 15 nt, Human
gucccuggcuuccuu

SEQ ID NO: 3176239 - RNA, 12 nt, Human
gucccagugccg

SEQ ID NO: 3176240 - RNA, 21 nt, Human
gucccaggcugagccucaguc

SEQ ID NO: 3176241 - RNA, 18 nt, Human
guccuagaauguuucauu

SEQ ID NO: 3176242 - RNA, 17 nt, Human
guccuagacuucaggga

SEQ ID NO: 3176243 - RNA, 23 nt, Human
guccuagaaauuccccacccuga

SEQ ID NO: 3176244 - RNA, 23 nt, Human
guccuacucugugucaggugggg

SEQ ID NO: 3176245 - RNA, 15 nt, Human
guccuacucuguguc

SEQ ID NO: 3176246 - RNA, 16 nt, Human
gucccugguggcagcu

SEQ ID NO: 3176247 - RNA, 16 nt, Human
gucccuggcuuccuua

SEQ ID NO: 3176248 - RNA, 17 nt, Human
gucccugguggcagcuc

SEQ ID NO: 3176249 - RNA, 13 nt, Human
guccuacucugug

SEQ ID NO: 3176250 - RNA, 16 nt, Human
guccugugagaugugu

SEQ ID NO: 3176251 - RNA, 18 nt, Human
guccuguaggaguucuau

SEQ ID NO: 3176252 - RNA, 14 nt, Human
guccuguaaacacu

SEQ ID NO: 3176253 - RNA, 16 nt, Human
guccuguaaacacuca

SEQ ID NO: 3176254 - RNA, 21 nt, Human
guccuguaaacacucagcugu

SEQ ID NO: 3176255 - RNA, 20 nt, Human
guccuggggaaccugacccc

SEQ ID NO: 3176256 - RNA, 19 nt, Human
guccuggggaaccugaccc

SEQ ID NO: 3176257 - RNA, 18 nt, Human
guccugggagugagcugg

SEQ ID NO: 3176258 - RNA, 17 nt, Human
guccugggagugagcug

SEQ ID NO: 3176259 - RNA, 19 nt, Human
guccugggagugagcuggu

SEQ ID NO: 3176260 - RNA, 23 nt, Human
guccucccaucucacacaugagc

SEQ ID NO: 3176261 - RNA, 13 nt, Human
guccucccaucuc

SEQ ID NO: 3176262 - RNA, 14 nt, Human
guccucccaucuca

SEQ ID NO: 3176263 - RNA, 12 nt, Human
guccucccaucu

SEQ ID NO: 3176264 - RNA, 20 nt, Human
guccuccagaacucuuccuc

SEQ ID NO: 3176265 - RNA, 17 nt, Human
guccuggcaugggaaug

SEQ ID NO: 3176266 - RNA, 16 nt, Human
guccugggagugagcu

SEQ ID NO: 3176267 - RNA, 15 nt, Human
guccugggagugagc

SEQ ID NO: 3176268 - RNA, 17 nt, Human
gucuaauguuuaagcag

SEQ ID NO: 3176269 - RNA, 15 nt, Human
gucuaauguuuaagc

SEQ ID NO: 3176270 - RNA, 15 nt, Human
gucuacacugugcug

SEQ ID NO: 3176271 - RNA, 15 nt, Human
gucuacagcuccccc

SEQ ID NO: 3176272 - RNA, 13 nt, Human
gucuacagcuccc

SEQ ID NO: 3176273 - RNA, 21 nt, Human
gucuacagcucccccagcucc

SEQ ID NO: 3176274 - RNA, 17 nt, Human
gucuacagcucccccag

SEQ ID NO: 3176275 - RNA, 12 nt, Human
gucuacauuuca

SEQ ID NO: 3176276 - RNA, 23 nt, Human
gucuaccccucccggcccugccu

SEQ ID NO: 3176277 - RNA, 16 nt, Human
guccuuaccagcagag

SEQ ID NO: 3176278 - RNA, 17 nt, Human
guccuuaccagcagagc

SEQ ID NO: 3176279 - RNA, 15 nt, Human
guccuuaccagcaga

SEQ ID NO: 3176280 - RNA, 16 nt, Human
guccugugucaguuua

SEQ ID NO: 3176281 - RNA, 15 nt, Human
gucguuuuaaaaaca

SEQ ID NO: 3176282 - RNA, 23 nt, Human
gucguuaaaaacagauuuggaaa

SEQ ID NO: 3176283 - RNA, 22 nt, Human
guccugugucaguuuauguuuu

SEQ ID NO: 3176284 - RNA, 17 nt, Human
guccugugucaguuuau

SEQ ID NO: 3176285 - RNA, 22 nt, Human
gucucgcucuguugcccaggcu

SEQ ID NO: 3176286 - RNA, 23 nt, Human
gucucacuguugcccaggcuggc

SEQ ID NO: 3176287 - RNA, 22 nt, Human
gucucacuguugcccaggcugg

SEQ ID NO: 3176288 - RNA, 21 nt, Human
gucucacuguugcccaggcug

SEQ ID NO: 3176289 - RNA, 20 nt, Human
gucucacuguugcccaggcu

SEQ ID NO: 3176290 - RNA, 19 nt, Human
gucucacuguugcccaggc

SEQ ID NO: 3176291 - RNA, 18 nt, Human
gucucacuguugcccagg

SEQ ID NO: 3176292 - RNA, 17 nt, Human
gucucacuguugcccag

SEQ ID NO: 3176293 - RNA, 16 nt, Human
gucucacuguugccca

SEQ ID NO: 3176294 - RNA, 23 nt, Human
gucucacuauguugcccaggcag

SEQ ID NO: 3176295 - RNA, 13 nt, Human
gucucacuguugc

SEQ ID NO: 3176296 - RNA, 21 nt, Human
gucucacuauguugcccaggc

SEQ ID NO: 3176297 - RNA, 20 nt, Human
gucucacuauguugcccagg

SEQ ID NO: 3176298 - RNA, 20 nt, Human
gucucggaucaggcucccag

SEQ ID NO: 3176299 - RNA, 23 nt, Human
gucucggaaccugugagcugcac

SEQ ID NO: 3176300 - RNA, 19 nt, Human
gucucggaaccugugagcu

SEQ ID NO: 3176301 - RNA, 19 nt, Human
gucucucacagacaggacc

SEQ ID NO: 3176302 - RNA, 16 nt, Human
gucucucacagacagg

SEQ ID NO: 3176303 - RNA, 14 nt, Human
gucucucacagaca

SEQ ID NO: 3176304 - RNA, 12 nt, Human
gucucucacaga

SEQ ID NO: 3176305 - RNA, 12 nt, Human
gucucugugagg

SEQ ID NO: 3176306 - RNA, 17 nt, Human
gucucugguuccucccc

SEQ ID NO: 3176307 - RNA, 23 nt, Human
gucucucacagacaggaccccug

SEQ ID NO: 3176308 - RNA, 19 nt, Human
gucugaggaauccagaccc

SEQ ID NO: 3176309 - RNA, 18 nt, Human
gucugaggaauccagacc

SEQ ID NO: 3176310 - RNA, 15 nt, Human
gucugacccacugcu

SEQ ID NO: 3176311 - RNA, 11 nt, Human
gucucuucucc

SEQ ID NO: 3176312 - RNA, 14 nt, Human
gucugacccacugc

SEQ ID NO: 3176313 - RNA, 13 nt, Human
gucugacccacug

SEQ ID NO: 3176314 - RNA, 14 nt, Human
gucucuucuccacu

SEQ ID NO: 3176315 - RNA, 16 nt, Human
gucucuucuccacugg

SEQ ID NO: 3176316 - RNA, 15 nt, Human
gucucuucuccacug

SEQ ID NO: 3176317 - RNA, 21 nt, Human
gucugauucccaagcucugcu

SEQ ID NO: 3176318 - RNA, 20 nt, Human
gucugauucccaagcucugc

SEQ ID NO: 3176319 - RNA, 20 nt, Human
gucugcacaccuugaaucug

SEQ ID NO: 3176320 - RNA, 21 nt, Human
gucugaggaauccagacccgg

SEQ ID NO: 3176321 - RNA, 22 nt, Human
gucugaggccguugcugacuua

SEQ ID NO: 3176322 - RNA, 20 nt, Human
gucugagggcuuguaguucu

SEQ ID NO: 3176323 - RNA, 18 nt, Human
gucugaggccguugcuga

SEQ ID NO: 3176324 - RNA, 21 nt, Human
gucugagggcuuguaguucuu

SEQ ID NO: 3176325 - RNA, 21 nt, Human
gucugaguuguuaccccaagc

SEQ ID NO: 3176326 - RNA, 17 nt, Human
gucugagguugggagag

SEQ ID NO: 3176327 - RNA, 19 nt, Human
gucugauucccaagcucug

SEQ ID NO: 3176328 - RNA, 18 nt, Human
gucugauucccaagcucu

SEQ ID NO: 3176329 - RNA, 17 nt, Human
gucugauucccaagcuc

SEQ ID NO: 3176330 - RNA, 14 nt, Human
gucugauauucaaa

SEQ ID NO: 3176331 - RNA, 20 nt, Human
gggcgcgugaggcccguggg

SEQ ID NO: 3176332 - RNA, 16 nt, Human
gggcgcgguggcucac

SEQ ID NO: 3176333 - RNA, 13 nt, Human
gggcucccuuccc

SEQ ID NO: 3176334 - RNA, 14 nt, Human
gggcucccuuccca

SEQ ID NO: 3176335 - RNA, 17 nt, Human
gggcucccuucccaccu

SEQ ID NO: 3176336 - RNA, 18 nt, Human
gggcucccuucccaccuc

SEQ ID NO: 3176337 - RNA, 23 nt, Human
gggcucccuucccaccucucuca

SEQ ID NO: 3176338 - RNA, 18 nt, Human
gggccuggucguuuucaa

SEQ ID NO: 3176339 - RNA, 14 nt, Human
gggccuggcucagg

SEQ ID NO: 3176340 - RNA, 16 nt, Human
gggccuggcucaggug

SEQ ID NO: 3176341 - RNA, 12 nt, Human
gggccuggcuca

SEQ ID NO: 3176342 - RNA, 19 nt, Human
gggccuggccugagcuggg

SEQ ID NO: 3176343 - RNA, 14 nt, Human
gggccuggcccaug

SEQ ID NO: 3176344 - RNA, 10 nt, Human
gggccuggca

SEQ ID NO: 3176345 - RNA, 22 nt, Human
gggccuggcagccgugccuuca

SEQ ID NO: 3176346 - RNA, 22 nt, Human
ggcucccaaaacaccugacagc

SEQ ID NO: 3176347 - RNA, 21 nt, Human
ggcucccacaggcccuuccuc

SEQ ID NO: 3176348 - RNA, 20 nt, Human
ggcucccacaggcccuuccu

SEQ ID NO: 3176349 - RNA, 14 nt, Human
gggcuucaguggca

SEQ ID NO: 3176350 - RNA, 16 nt, Human
gggcugaggugggagg

SEQ ID NO: 3176351 - RNA, 14 nt, Human
gggcugcaccggcu

SEQ ID NO: 3176352 - RNA, 20 nt, Human
gggcugacugggccagggga

SEQ ID NO: 3176353 - RNA, 16 nt, Human
gggcugacugggccag

SEQ ID NO: 3176354 - RNA, 15 nt, Human
gggcugaauguaugu

SEQ ID NO: 3176355 - RNA, 15 nt, Human
gggcucugccuccca

SEQ ID NO: 3176356 - RNA, 16 nt, Human
gggcucugccucccau

SEQ ID NO: 3176357 - RNA, 17 nt, Human
gggcucugccucccauc

SEQ ID NO: 3176358 - RNA, 20 nt, Human
gggcucugccucccaucacc

SEQ ID NO: 3176359 - RNA, 13 nt, Human
gggcucugccucc

SEQ ID NO: 3176360 - RNA, 13 nt, Human
gggcuucauacac

SEQ ID NO: 3176361 - RNA, 19 nt, Human
gggcuucauccuccucaga

SEQ ID NO: 3176362 - RNA, 20 nt, Human
gggcuucaguggcagcugcu

SEQ ID NO: 3176363 - RNA, 19 nt, Human
gggcuucaguggcagcugc

SEQ ID NO: 3176364 - RNA, 18 nt, Human
gggcuucaguggcagcug

SEQ ID NO: 3176365 - RNA, 17 nt, Human
gggcuucaguggcagcu

SEQ ID NO: 3176366 - RNA, 16 nt, Human
gggcuucaguggcagc

SEQ ID NO: 3176367 - RNA, 15 nt, Human
gggcuucaguggcag

SEQ ID NO: 3176368 - RNA, 19 nt, Human
gggcuucauacacaugaga

SEQ ID NO: 3176369 - RNA, 20 nt, Human
gggcuucauccuccucagau

SEQ ID NO: 3176370 - RNA, 18 nt, Human
gggcuuccugaggggaga

SEQ ID NO: 3176371 - RNA, 20 nt, Human
gggcuuggggaccagagcug

SEQ ID NO: 3176372 - RNA, 16 nt, Human
gggcuucugugcccag

SEQ ID NO: 3176373 - RNA, 19 nt, Human
gggcuucugugcaccuggg

SEQ ID NO: 3176374 - RNA, 23 nt, Human
gggcuucugugcaccugggcucu

SEQ ID NO: 3176375 - RNA, 13 nt, Human
ggggauagaugug

SEQ ID NO: 3176376 - RNA, 17 nt, Human
ggggaucacagccucug

SEQ ID NO: 3176377 - RNA, 17 nt, Human
ggggcagagcccugcuc

SEQ ID NO: 3176378 - RNA, 12 nt, Human
ggggcagccucu

SEQ ID NO: 3176379 - RNA, 19 nt, Human
ggggcagccugccuugccc

SEQ ID NO: 3176380 - RNA, 14 nt, Human
ggggcagccugccu

SEQ ID NO: 3176381 - RNA, 13 nt, Human
ggggaguggccac

SEQ ID NO: 3176382 - RNA, 12 nt, Human
ggggagcuggac

SEQ ID NO: 3176383 - RNA, 19 nt, Human
ggggagguuuucuccccca

SEQ ID NO: 3176384 - RNA, 21 nt, Human
gggcuuggggaccagagcugc

SEQ ID NO: 3176385 - RNA, 11 nt, Human
ggggagaaagu

SEQ ID NO: 3176386 - RNA, 14 nt, Human
ggggagcacccuga

SEQ ID NO: 3176387 - RNA, 18 nt, Human
ggggagacuuugauguca

SEQ ID NO: 3176388 - RNA, 11 nt, Human
ggguacaugug

SEQ ID NO: 3176389 - RNA, 18 nt, Human
ggguacccacugcucugg

SEQ ID NO: 3176390 - RNA, 15 nt, Human
ggguacccacugcuc

SEQ ID NO: 3176391 - RNA, 13 nt, Human
ggguacccacugc

SEQ ID NO: 3176392 - RNA, 23 nt, Human
ggguagagcggagaaaggaaggg

SEQ ID NO: 3176393 - RNA, 23 nt, Human
ggguacuuguggacacagcucuu

SEQ ID NO: 3176394 - RNA, 22 nt, Human
ggguacuuguggacacagcucu

SEQ ID NO: 3176395 - RNA, 19 nt, Human
ggguacuuguggacacagc

SEQ ID NO: 3176396 - RNA, 14 nt, Human
ggggucuuaccuug

SEQ ID NO: 3176397 - RNA, 18 nt, Human
ggggugaccuccggccag

SEQ ID NO: 3176398 - RNA, 22 nt, Human
ggggugaccuccggccaggugc

SEQ ID NO: 3176399 - RNA, 23 nt, Human
gggguucccuuuuuuggcugcug

SEQ ID NO: 3176400 - RNA, 22 nt, Human
gggguucuuucuuccucugcug

SEQ ID NO: 3176401 - RNA, 20 nt, Human
gggguucuuucuuccucugc

SEQ ID NO: 3176402 - RNA, 18 nt, Human
gggguuccuucugggcau

SEQ ID NO: 3176403 - RNA, 13 nt, Human
ggggcugggacau

SEQ ID NO: 3176404 - RNA, 16 nt, Human
ggggcugggcagagga

SEQ ID NO: 3176405 - RNA, 17 nt, Human
ggggcugggcagaggaa

SEQ ID NO: 3176406 - RNA, 19 nt, Human
ggggcuucugugcaccugg

SEQ ID NO: 3176407 - RNA, 21 nt, Human
ggggcuucugugcaccugggc

SEQ ID NO: 3176408 - RNA, 22 nt, Human
ggggcuucugugcaccugggcu

SEQ ID NO: 3176409 - RNA, 20 nt, Human
gggggaacgcccacuucccu

SEQ ID NO: 3176410 - RNA, 23 nt, Human
ggggcugcaccggcuggccuggc

SEQ ID NO: 3176411 - RNA, 16 nt, Human
gguccccuccaggagu

SEQ ID NO: 3176412 - RNA, 14 nt, Human
ggucccugguggca

SEQ ID NO: 3176413 - RNA, 22 nt, Human
ggucucacuauguugcccaggc

SEQ ID NO: 3176414 - RNA, 21 nt, Human
gguccgaguguguuucauccu

SEQ ID NO: 3176415 - RNA, 22 nt, Human
ggucccugguggcagcucaccu

SEQ ID NO: 3176416 - RNA, 23 nt, Human
ggugaaggaggcuccaggcagca

SEQ ID NO: 3176417 - RNA, 22 nt, Human
ggugaaggaggcuccaggcagc

SEQ ID NO: 3176418 - RNA, 18 nt, Human
ggugaaggaggcuccagg

SEQ ID NO: 3176419 - RNA, 14 nt, Human
ggugaaggaggcuc

SEQ ID NO: 3176420 - RNA, 16 nt, Human
ggugaacuugguuccc

SEQ ID NO: 3176421 - RNA, 19 nt, Human
ggucugaggaauccagacc

SEQ ID NO: 3176422 - RNA, 12 nt, Human
ggucucacucug

SEQ ID NO: 3176423 - RNA, 21 nt, Human
ggucucacuauguugcccagg

SEQ ID NO: 3176424 - RNA, 19 nt, Human
ggucuccgaaaugcugucu

SEQ ID NO: 3176425 - RNA, 17 nt, Human
ggucuccgaaaugcugu

SEQ ID NO: 3176426 - RNA, 16 nt, Human
ggucugacccacugcu

SEQ ID NO: 3176427 - RNA, 15 nt, Human
ggucugacccacugc

SEQ ID NO: 3176428 - RNA, 19 nt, Human
ggucucgaacuccugaccu

SEQ ID NO: 3176429 - RNA, 19 nt, Human
ggucuccucaggaccaggg

SEQ ID NO: 3176430 - RNA, 15 nt, Human
ggucuccucaggacc

SEQ ID NO: 3176431 - RNA, 12 nt, Human
ggucuccucagg

SEQ ID NO: 3176432 - RNA, 20 nt, Human
ggucucgaacuccugaccuu

SEQ ID NO: 3176433 - RNA, 20 nt, Human
ggugcccagaaugaggcugc

SEQ ID NO: 3176434 - RNA, 22 nt, Human
ggugauagguauaaguggugug

SEQ ID NO: 3176435 - RNA, 22 nt, Human
ggugauaauagaagaguggcag

SEQ ID NO: 3176436 - RNA, 14 nt, Human
ggugauaagggaaa

SEQ ID NO: 3176437 - RNA, 15 nt, Human
ggugauaagggaaaa

SEQ ID NO: 3176438 - RNA, 14 nt, Human
ggugaccucugccu

SEQ ID NO: 3176439 - RNA, 18 nt, Human
ggugaccuccggccaggu

SEQ ID NO: 3176440 - RNA, 20 nt, Human
ggugaccuccggccaggugc

SEQ ID NO: 3176441 - RNA, 16 nt, Human
ggugaccucugccuga

SEQ ID NO: 3176442 - RNA, 21 nt, Human
ggugaccucuagcccugcccg

SEQ ID NO: 3176443 - RNA, 17 nt, Human
ggugaguccuccagaac

SEQ ID NO: 3176444 - RNA, 15 nt, Human
ggugaguccuccaga

SEQ ID NO: 3176445 - RNA, 19 nt, Human
ggugcuacaaaaacacagc

SEQ ID NO: 3176446 - RNA, 15 nt, Human
ggugcgaucuggguu

SEQ ID NO: 3176447 - RNA, 23 nt, Human
ggugcuaucucccccagccccau

SEQ ID NO: 3176448 - RNA, 21 nt, Human
ggugcuaucucccccagcccc

SEQ ID NO: 3176449 - RNA, 22 nt, Human
ggugcuaucucccccagcccca

SEQ ID NO: 3176450 - RNA, 13 nt, Human
gguggcagcugcg

SEQ ID NO: 3176451 - RNA, 12 nt, Human
gguggcagcugc

SEQ ID NO: 3176452 - RNA, 13 nt, Human
gguggcagcucac

SEQ ID NO: 3176453 - RNA, 11 nt, Human
gguggcagcug

SEQ ID NO: 3176454 - RNA, 23 nt, Human
gguggcagcugcgguccacccag

SEQ ID NO: 3176455 - RNA, 15 nt, Human
gguggcagcugcggu

SEQ ID NO: 3176456 - RNA, 19 nt, Human
ggguuccagcaccacacuc

SEQ ID NO: 3176457 - RNA, 22 nt, Human
ggguuccagcaauucuccugcc

SEQ ID NO: 3176458 - RNA, 16 nt, Human
gggugcuguuuugcca

SEQ ID NO: 3176459 - RNA, 22 nt, Human
ggguaccacugaaucuguacag

SEQ ID NO: 3176460 - RNA, 19 nt, Human
ggguuggccccugcccggc

SEQ ID NO: 3176461 - RNA, 14 nt, Human
ggguucuuucuucc

SEQ ID NO: 3176462 - RNA, 16 nt, Human
ggguuggccccugccc

SEQ ID NO: 3176463 - RNA, 15 nt, Human
ggguucuguaaaaug

SEQ ID NO: 3176464 - RNA, 22 nt, Human
ggguucuguaaaauggaaaacu

SEQ ID NO: 3176465 - RNA, 17 nt, Human
ggguucuacccaggugc

SEQ ID NO: 3176466 - RNA, 22 nt, Human
ggguucuacccaggugcuagga

SEQ ID NO: 3176467 - RNA, 23 nt, Human
ggguucccuuuuuuggcugcuga

SEQ ID NO: 3176468 - RNA, 12 nt, Human
gguaccuugcac

SEQ ID NO: 3176469 - RNA, 11 nt, Human
gguaccuugca

SEQ ID NO: 3176470 - RNA, 24 nt, Human
gguaccuugcacacaucaucugua

SEQ ID NO: 3176471 - RNA, 23 nt, Human
gguaccuugcacacaucaucugu

SEQ ID NO: 3176472 - RNA, 18 nt, Human
gguaccgucuacauuuca

SEQ ID NO: 3176473 - RNA, 17 nt, Human
gguacuguaauguuaau

SEQ ID NO: 3176474 - RNA, 21 nt, Human
gguacuuguggacacagcucu

SEQ ID NO: 3176475 - RNA, 22 nt, Human
gguacuuguggacacagcucuu

SEQ ID NO: 3176476 - RNA, 20 nt, Human
gguacuuguggacacagcuc

SEQ ID NO: 3176477 - RNA, 19 nt, Human
ggguuuacagugaagaaag

SEQ ID NO: 3176478 - RNA, 15 nt, Human
ggguugggcuggugu

SEQ ID NO: 3176479 - RNA, 12 nt, Human
ggguuggcuuuu

SEQ ID NO: 3176480 - RNA, 16 nt, Human
gguacccacugcucug

SEQ ID NO: 3176481 - RNA, 20 nt, Human
ggguuucaccauguuggcca

SEQ ID NO: 3176482 - RNA, 17 nt, Human
gguacccacugcucugg

SEQ ID NO: 3176483 - RNA, 23 nt, Human
ggucagcccaaaccaccagaagc

SEQ ID NO: 3176484 - RNA, 22 nt, Human
ggucccaccccacacacgccag

SEQ ID NO: 3176485 - RNA, 11 nt, Human
ggucagagccu

SEQ ID NO: 3176486 - RNA, 14 nt, Human
ggucccacucaguc

SEQ ID NO: 3176487 - RNA, 12 nt, Human
ggucccacucag

SEQ ID NO: 3176488 - RNA, 22 nt, Human
ggucccacucaguccauagcag

SEQ ID NO: 3176489 - RNA, 14 nt, Human
ggucagcucagagc

SEQ ID NO: 3176490 - RNA, 18 nt, Human
ggucccccuuccauggac

SEQ ID NO: 3176491 - RNA, 23 nt, Human
ggucccccuuccauggacuuugu

SEQ ID NO: 3176492 - RNA, 13 nt, Human
ggucccccuucca

SEQ ID NO: 3176493 - RNA, 23 nt, Human
gguccccagcccuuccucugcuc

SEQ ID NO: 3176494 - RNA, 22 nt, Human
gguccccagcccuuccucugcu

SEQ ID NO: 3176495 - RNA, 19 nt, Human
gguccccagcccuuccucu

SEQ ID NO: 3176496 - RNA, 20 nt, Human
gguagaaugaccuuguaaug

SEQ ID NO: 3176497 - RNA, 12 nt, Human
ggucacucuggc

SEQ ID NO: 3176498 - RNA, 17 nt, Human
ggucacagccaggcgcu

SEQ ID NO: 3176499 - RNA, 14 nt, Human
ggucacagccaggc

SEQ ID NO: 3176500 - RNA, 13 nt, Human
ggucacagccagg

SEQ ID NO: 3176501 - RNA, 16 nt, Human
ggucagagccugcagu

SEQ ID NO: 3176502 - RNA, 15 nt, Human
ggucagagccugcag

SEQ ID NO: 3176503 - RNA, 14 nt, Human
ggucagagccugca

SEQ ID NO: 3176504 - RNA, 13 nt, Human
ggucagagccugc

SEQ ID NO: 3176505 - RNA, 16 nt, Human
ggucacucuggcagcu

SEQ ID NO: 3176506 - RNA, 20 nt, Human
ggucacucuggcagcucaga

SEQ ID NO: 3176507 - RNA, 22 nt, Human
ggucacucuggcagcucagaga

SEQ ID NO: 3176508 - RNA, 12 nt, Human
ggucagagccug

SEQ ID NO: 3176509 - RNA, 13 nt, Human
guaauuauuugaa

SEQ ID NO: 3176510 - RNA, 15 nt, Human
guaauuauuugaaug

SEQ ID NO: 3176511 - RNA, 14 nt, Human
guaauuauuugaau

SEQ ID NO: 3176512 - RNA, 22 nt, Human
guaauucuuauuccauauuaga

SEQ ID NO: 3176513 - RNA, 16 nt, Human
guaauucuuauuccau

SEQ ID NO: 3176514 - RNA, 23 nt, Human
guaauuaauaauagauugugaau

SEQ ID NO: 3176515 - RNA, 21 nt, Human
guaauuaaguacuauguauca

SEQ ID NO: 3176516 - RNA, 13 nt, Human
guaauuaaacugu

SEQ ID NO: 3176517 - RNA, 16 nt, Human
guaauuaaacuguuaa

SEQ ID NO: 3176518 - RNA, 22 nt, Human
guaauuaaacuguuaacuuauu

SEQ ID NO: 3176519 - RNA, 20 nt, Human
guaauuaaguacuauguauc

SEQ ID NO: 3176520 - RNA, 17 nt, Human
guaauuaaguacuaugu

SEQ ID NO: 3176521 - RNA, 14 nt, Human
guaauuaaguacua

SEQ ID NO: 3176522 - RNA, 18 nt, Human
guaauguugugaauaauu

SEQ ID NO: 3176523 - RNA, 17 nt, Human
guaauguugugaauaau

SEQ ID NO: 3176524 - RNA, 15 nt, Human
guaauguugugaaua

SEQ ID NO: 3176525 - RNA, 14 nt, Human
guaauguugugaau

SEQ ID NO: 3176526 - RNA, 16 nt, Human
guaaugaaacuuggau

SEQ ID NO: 3176527 - RNA, 15 nt, Human
guaaugaaacuugga

SEQ ID NO: 3176528 - RNA, 17 nt, Human
guaaucuuguugguuca

SEQ ID NO: 3176529 - RNA, 16 nt, Human
guaaucuguauaauac

SEQ ID NO: 3176530 - RNA, 22 nt, Human
guaaucuguauaauacuuugua

SEQ ID NO: 3176531 - RNA, 17 nt, Human
guaaucgaccugccucg

SEQ ID NO: 3176532 - RNA, 15 nt, Human
guaaucguguccccu

SEQ ID NO: 3176533 - RNA, 18 nt, Human
guaaugaugucguuugaa

SEQ ID NO: 3176534 - RNA, 22 nt, Human
guaauggggcagaaaucugagg

SEQ ID NO: 3176535 - RNA, 14 nt, Human
guaauguaacugcu

SEQ ID NO: 3176536 - RNA, 12 nt, Human
guaauguaacug

SEQ ID NO: 3176537 - RNA, 19 nt, Human
guaauguaacugcucuugg

SEQ ID NO: 3176538 - RNA, 19 nt, Human
guaauguaucaaauacauu

SEQ ID NO: 3176539 - RNA, 15 nt, Human
guacagaauuugaau

SEQ ID NO: 3176540 - RNA, 17 nt, Human
guacagaauuugaauua

SEQ ID NO: 3176541 - RNA, 18 nt, Human
guacagaauuugaauuau

SEQ ID NO: 3176542 - RNA, 16 nt, Human
guacagacaacaaacc

SEQ ID NO: 3176543 - RNA, 22 nt, Human
guacacuucaguuaucuugauc

SEQ ID NO: 3176544 - RNA, 12 nt, Human
guacagagccca

SEQ ID NO: 3176545 - RNA, 18 nt, Human
guacagagcccacgcccc

SEQ ID NO: 3176546 - RNA, 22 nt, Human
guacagagcccacgcccccacu

SEQ ID NO: 3176547 - RNA, 20 nt, Human
guacagagccguaaaaacug

SEQ ID NO: 3176548 - RNA, 22 nt, Human
guacagcacuuucuucuuccca

SEQ ID NO: 3176549 - RNA, 15 nt, Human
guacauaauacugaa

SEQ ID NO: 3176550 - RNA, 16 nt, Human
guacauaauacugaac

SEQ ID NO: 3176551 - RNA, 18 nt, Human
guacauaauacugaacca

SEQ ID NO: 3176552 - RNA, 19 nt, Human
guacauaauacugaaccac

SEQ ID NO: 3176553 - RNA, 14 nt, Human
guacauaauacuga

SEQ ID NO: 3176554 - RNA, 15 nt, Human
guacccacugcucug

SEQ ID NO: 3176555 - RNA, 22 nt, Human
guacauauuagcgacaacagau

SEQ ID NO: 3176556 - RNA, 14 nt, Human
guacagguacuuug

SEQ ID NO: 3176557 - RNA, 16 nt, Human
guacagguacuuuguc

SEQ ID NO: 3176558 - RNA, 15 nt, Human
guacagguacuuugu

SEQ ID NO: 3176559 - RNA, 15 nt, Human
guacuucuucuguaa

SEQ ID NO: 3176560 - RNA, 16 nt, Human
guacuucuucuguaau

SEQ ID NO: 3176561 - RNA, 18 nt, Human
guacuucuucuguaauau

SEQ ID NO: 3176562 - RNA, 18 nt, Human
guacuucuugaauauaaa

SEQ ID NO: 3176563 - RNA, 19 nt, Human
guacuucuugaauauaaaa

SEQ ID NO: 3176564 - RNA, 20 nt, Human
guacuucuugaauauaaaaa

SEQ ID NO: 3176565 - RNA, 22 nt, Human
guacuugcccugaccaugcauu

SEQ ID NO: 3176566 - RNA, 23 nt, Human
guacuugcccugaccaugcauuu

SEQ ID NO: 3176567 - RNA, 21 nt, Human
guacuucuccacccugcucuc

SEQ ID NO: 3176568 - RNA, 20 nt, Human
guacuucuccacccugcucu

SEQ ID NO: 3176569 - RNA, 19 nt, Human
guacuucuccacccugcuc

SEQ ID NO: 3176570 - RNA, 18 nt, Human
guacuucuccacccugcu

SEQ ID NO: 3176571 - RNA, 17 nt, Human
guacuucuccacccugc

SEQ ID NO: 3176572 - RNA, 16 nt, Human
guacuucuccacccug

SEQ ID NO: 3176573 - RNA, 20 nt, Human
guacuuguggacacagcucu

SEQ ID NO: 3176574 - RNA, 16 nt, Human
guacuuguggacacag

SEQ ID NO: 3176575 - RNA, 21 nt, Human
guacuuguggacacagcucuu

SEQ ID NO: 3176576 - RNA, 22 nt, Human
guacuuuauagaagaaugcaug

SEQ ID NO: 3176577 - RNA, 15 nt, Human
guacuuuaucaugaa

SEQ ID NO: 3176578 - RNA, 20 nt, Human
guacuuuaucaugaaugcuu

SEQ ID NO: 3176579 - RNA, 23 nt, Human
guacuuugauucacauguuuuca

SEQ ID NO: 3176580 - RNA, 21 nt, Human
guacuuugauucacauguuuu

SEQ ID NO: 3176581 - RNA, 20 nt, Human
guacuuugauucacauguuu

SEQ ID NO: 3176582 - RNA, 17 nt, Human
guacuuugauucacaug

SEQ ID NO: 3176583 - RNA, 23 nt, Human
guacuuugucuaagaaacauugg

SEQ ID NO: 3176584 - RNA, 20 nt, Human
guacuuugucuaagaaacau

SEQ ID NO: 3176585 - RNA, 13 nt, Human
guacuuugauuca

SEQ ID NO: 3176586 - RNA, 16 nt, Human
guacuuugauucacau

SEQ ID NO: 3176587 - RNA, 15 nt, Human
guacuuugauucaca

SEQ ID NO: 3176588 - RNA, 21 nt, Human
guacuuucuguuaaaaugcau

SEQ ID NO: 3176589 - RNA, 19 nt, Human
guacuuucuguuaaaaugc

SEQ ID NO: 3176590 - RNA, 18 nt, Human
guacuuucuguuaaaaug

SEQ ID NO: 3176591 - RNA, 16 nt, Human
guacuuucuguuaaaa

SEQ ID NO: 3176592 - RNA, 15 nt, Human
guacuuucuguuaaa

SEQ ID NO: 3176593 - RNA, 14 nt, Human
guacuuucuguuaa

SEQ ID NO: 3176594 - RNA, 13 nt, Human
guacuuucuguua

SEQ ID NO: 3176595 - RNA, 12 nt, Human
guacuuucuguu

SEQ ID NO: 3176596 - RNA, 11 nt, Human
guacuuucugu

SEQ ID NO: 3176597 - RNA, 14 nt, Human
guacuuuaaaaauu

SEQ ID NO: 3176598 - RNA, 22 nt, Human
guacuuucauauuuuaaacaga

SEQ ID NO: 3176599 - RNA, 15 nt, Human
guagaggagaaacug

SEQ ID NO: 3176600 - RNA, 15 nt, Human
guagaggaaggaugc

SEQ ID NO: 3176601 - RNA, 18 nt, Human
guagagccagggucucac

SEQ ID NO: 3176602 - RNA, 16 nt, Human
guagagcggagaaagg

SEQ ID NO: 3176603 - RNA, 12 nt, Human
guagaaaaauuu

SEQ ID NO: 3176604 - RNA, 17 nt, Human
guagaaaauauguccca

SEQ ID NO: 3176605 - RNA, 19 nt, Human
guacgacgucagauguuua

SEQ ID NO: 3176606 - RNA, 21 nt, Human
guacgacucuuuuccaaacac

SEQ ID NO: 3176607 - RNA, 15 nt, Human
guacgucugacaggc

SEQ ID NO: 3176608 - RNA, 14 nt, Human
guacgucugacagg

SEQ ID NO: 3176609 - RNA, 17 nt, Human
guacgucugacaggcaa

SEQ ID NO: 3176610 - RNA, 20 nt, Human
guacuaaggauacaggcugg

SEQ ID NO: 3176611 - RNA, 15 nt, Human
guacuucuccacccu

SEQ ID NO: 3176612 - RNA, 14 nt, Human
guacuucuccaccc

SEQ ID NO: 3176613 - RNA, 23 nt, Human
guacuaaggaaucuuucugcuuu

SEQ ID NO: 3176614 - RNA, 15 nt, Human
guacuaaggaaucuu

SEQ ID NO: 3176615 - RNA, 16 nt, Human
guaccuggguccccag

SEQ ID NO: 3176616 - RNA, 23 nt, Human
guaccuugcacacaucaucugua

SEQ ID NO: 3176617 - RNA, 17 nt, Human
guaccuugcacacauca

SEQ ID NO: 3176618 - RNA, 15 nt, Human
guaccgcaaugugac

SEQ ID NO: 3176619 - RNA, 16 nt, Human
guacccacugcucugg

SEQ ID NO: 3176620 - RNA, 23 nt, Human
guaaaaaauuuaaaaagcccaac

SEQ ID NO: 3176621 - RNA, 12 nt, Human
guaaaaagaaaa

SEQ ID NO: 3176622 - RNA, 22 nt, Human
guaaaaacugaaguucugccuc

SEQ ID NO: 3176623 - RNA, 15 nt, Human
guaaaaacugaaguu

SEQ ID NO: 3176624 - RNA, 14 nt, Human
guaaaaacugaagu

SEQ ID NO: 3176625 - RNA, 13 nt, Human
guaaaaacugaag

SEQ ID NO: 3176626 - RNA, 13 nt, Human
guaaaaauaaaau

SEQ ID NO: 3176627 - RNA, 18 nt, Human
guaaaaauaaaauacuuu

SEQ ID NO: 3176628 - RNA, 20 nt, Human
guaaaaauaaaauacuuuga

SEQ ID NO: 3176629 - RNA, 14 nt, Human
guaaaaauaaaauu

SEQ ID NO: 3176630 - RNA, 14 nt, Human
guaaaaagaaaaca

SEQ ID NO: 3176631 - RNA, 23 nt, Human
guaaaaccacagcaguugaaaag

SEQ ID NO: 3176632 - RNA, 12 nt, Human
guaaaagaaaaa

SEQ ID NO: 3176633 - RNA, 18 nt, Human
guaaaaccacagcaguug

SEQ ID NO: 3176634 - RNA, 16 nt, Human
guaaaaccacagcagu

SEQ ID NO: 3176635 - RNA, 15 nt, Human
guaaaaccacagcag

SEQ ID NO: 3176636 - RNA, 14 nt, Human
guaaaaccacagca

SEQ ID NO: 3176637 - RNA, 23 nt, Human
gguuuugccauguuggccaggcu

SEQ ID NO: 3176638 - RNA, 19 nt, Human
gguuuuuauuucuccuuuu

SEQ ID NO: 3176639 - RNA, 18 nt, Human
gguuuuuauuucuccuuu

SEQ ID NO: 3176640 - RNA, 17 nt, Human
gguuuuuauuucuccuu

SEQ ID NO: 3176641 - RNA, 21 nt, Human
gguuuugcacucuuguuucuc

SEQ ID NO: 3176642 - RNA, 12 nt, Human
gguuuucuguuu

SEQ ID NO: 3176643 - RNA, 22 nt, Human
gguuuuccgcauucuuuguaca

SEQ ID NO: 3176644 - RNA, 17 nt, Human
gguucuuucuuccucug

SEQ ID NO: 3176645 - RNA, 14 nt, Human
gguugaagcaccaa

SEQ ID NO: 3176646 - RNA, 18 nt, Human
gguucuuucuuccucugc

SEQ ID NO: 3176647 - RNA, 23 nt, Human
gguucaagcgauucuucugcuuc

SEQ ID NO: 3176648 - RNA, 22 nt, Human
gguucaagcgauucuucugcuu

SEQ ID NO: 3176649 - RNA, 20 nt, Human
gguucacugcaaccuccgcc

SEQ ID NO: 3176650 - RNA, 13 nt, Human
gguucaaaugugu

SEQ ID NO: 3176651 - RNA, 17 nt, Human
gguggccucccaacuca

SEQ ID NO: 3176652 - RNA, 21 nt, Human
gguucaagcgauucuucugcu

SEQ ID NO: 3176653 - RNA, 13 nt, Human
gguggccucccaa

SEQ ID NO: 3176654 - RNA, 20 nt, Human
gguggcccgacagccuggca

SEQ ID NO: 3176655 - RNA, 19 nt, Human
gguggcccgacagccuggc

SEQ ID NO: 3176656 - RNA, 18 nt, Human
gguggcccgacagccugg

SEQ ID NO: 3176657 - RNA, 17 nt, Human
gguggcccgacagccug

SEQ ID NO: 3176658 - RNA, 16 nt, Human
gguggcccgacagccu

SEQ ID NO: 3176659 - RNA, 21 nt, Human
gguuuaaaacuaguuagauuc

SEQ ID NO: 3176660 - RNA, 16 nt, Human
gguuuaaaagaaaaaa

SEQ ID NO: 3176661 - RNA, 18 nt, Human
gguuguuagaaaaaugga

SEQ ID NO: 3176662 - RNA, 13 nt, Human
gguuuaagcuguu

SEQ ID NO: 3176663 - RNA, 16 nt, Human
gguuuaaguagauuuc

SEQ ID NO: 3176664 - RNA, 13 nt, Human
gguuggugggggc

SEQ ID NO: 3176665 - RNA, 11 nt, Human
gguugaauaaa

SEQ ID NO: 3176666 - RNA, 13 nt, Human
gguucuuugugua

SEQ ID NO: 3176667 - RNA, 14 nt, Human
gguugacaggaggu

SEQ ID NO: 3176668 - RNA, 14 nt, Human
gguugggcuggugu

SEQ ID NO: 3176669 - RNA, 16 nt, Human
guaaauaaaggaacca

SEQ ID NO: 3176670 - RNA, 14 nt, Human
guaaauaauucuuu

SEQ ID NO: 3176671 - RNA, 15 nt, Human
guaaauaauucuuuu

SEQ ID NO: 3176672 - RNA, 13 nt, Human
guaaauaauucuu

SEQ ID NO: 3176673 - RNA, 19 nt, Human
guaaaagcagcauaaagaa

SEQ ID NO: 3176674 - RNA, 16 nt, Human
guaaaagcauuuugua

SEQ ID NO: 3176675 - RNA, 17 nt, Human
guaaaagcaacaucagc

SEQ ID NO: 3176676 - RNA, 18 nt, Human
guaaaagcaacaucagcu

SEQ ID NO: 3176677 - RNA, 19 nt, Human
guaaaagcaacaucagcuu

SEQ ID NO: 3176678 - RNA, 20 nt, Human
guaaaagcaacaucagcuug

SEQ ID NO: 3176679 - RNA, 13 nt, Human
guaaauagguuuc

SEQ ID NO: 3176680 - RNA, 21 nt, Human
guaaauagguuucuaaaaagu

SEQ ID NO: 3176681 - RNA, 23 nt, Human
guaaauagguuucuaaaaaguca

SEQ ID NO: 3176682 - RNA, 12 nt, Human
guaaauauuaaa

SEQ ID NO: 3176683 - RNA, 20 nt, Human
guaaaucuaacauuauuacu

SEQ ID NO: 3176684 - RNA, 21 nt, Human
guaaaucuaacauuauuacuu

SEQ ID NO: 3176685 - RNA, 19 nt, Human
guaaaucucuucuguguuu

SEQ ID NO: 3176686 - RNA, 18 nt, Human
guaaaucucuucuguguu

SEQ ID NO: 3176687 - RNA, 15 nt, Human
guaaauguaguucau

SEQ ID NO: 3176688 - RNA, 16 nt, Human
guaaaugguaugucau

SEQ ID NO: 3176689 - RNA, 12 nt, Human
guaacuguuacc

SEQ ID NO: 3176690 - RNA, 17 nt, Human
guaacuguuaccauugg

SEQ ID NO: 3176691 - RNA, 13 nt, Human
guaacuguuacca

SEQ ID NO: 3176692 - RNA, 21 nt, Human
guaacuguuaccauuggaaau

SEQ ID NO: 3176693 - RNA, 20 nt, Human
guaacuguuaccauuggaaa

SEQ ID NO: 3176694 - RNA, 17 nt, Human
guaagaucucuuucuaa

SEQ ID NO: 3176695 - RNA, 13 nt, Human
guaagauauuugc

SEQ ID NO: 3176696 - RNA, 14 nt, Human
guaagaguguuuau

SEQ ID NO: 3176697 - RNA, 13 nt, Human
guaagaucacugu

SEQ ID NO: 3176698 - RNA, 18 nt, Human
guaagaucacuguuuaga

SEQ ID NO: 3176699 - RNA, 20 nt, Human
guaagaucacuguuuagauu

SEQ ID NO: 3176700 - RNA, 13 nt, Human
guaagauuguuau

SEQ ID NO: 3176701 - RNA, 21 nt, Human
guaagauuguuauuaaaugua

SEQ ID NO: 3176702 - RNA, 19 nt, Human
guaagagaaaagagagaaa

SEQ ID NO: 3176703 - RNA, 17 nt, Human
guaagaaauacuguaca

SEQ ID NO: 3176704 - RNA, 13 nt, Human
guaagaaauacug

SEQ ID NO: 3176705 - RNA, 12 nt, Human
guaagaaauacu

SEQ ID NO: 3176706 - RNA, 16 nt, Human
guaagaaauacagacu

SEQ ID NO: 3176707 - RNA, 13 nt, Human
guaagaaauacag

SEQ ID NO: 3176708 - RNA, 17 nt, Human
guaagggaaacugccag

SEQ ID NO: 3176709 - RNA, 14 nt, Human
guaaggcaugaagg

SEQ ID NO: 3176710 - RNA, 18 nt, Human
guaagggaaacugccagc

SEQ ID NO: 3176711 - RNA, 22 nt, Human
guaaguauucuuauuuaaugaa

SEQ ID NO: 3176712 - RNA, 18 nt, Human
guaaguauaucucaguuu

SEQ ID NO: 3176713 - RNA, 17 nt, Human
guaaggugcuuggaguu

SEQ ID NO: 3176714 - RNA, 19 nt, Human
guaagguauaucauucuaa

SEQ ID NO: 3176715 - RNA, 20 nt, Human
guaaggaauaccuguccccc

SEQ ID NO: 3176716 - RNA, 21 nt, Human
guaaggaauaccugucccccu

SEQ ID NO: 3176717 - RNA, 23 nt, Human
guaaggaauaccugucccccuga

SEQ ID NO: 3176718 - RNA, 13 nt, Human
guaaggaaugauu

SEQ ID NO: 3176719 - RNA, 18 nt, Human
guaaggaauaccuguccc

SEQ ID NO: 3176720 - RNA, 18 nt, Human
guaagcuguuugguuuua

SEQ ID NO: 3176721 - RNA, 22 nt, Human
guaagcuguuugguuuuaaaau

SEQ ID NO: 3176722 - RNA, 21 nt, Human
guaagcuguuugguuuuaaaa

SEQ ID NO: 3176723 - RNA, 23 nt, Human
guaagcauaagcuuaugcuuaaa

SEQ ID NO: 3176724 - RNA, 21 nt, Human
guaagcggcucaagcccagga

SEQ ID NO: 3176725 - RNA, 16 nt, Human
guaagcggcucaagcc

SEQ ID NO: 3176726 - RNA, 14 nt, Human
guaagcguauggcu

SEQ ID NO: 3176727 - RNA, 22 nt, Human
guaagcggcucaagcccaggag

SEQ ID NO: 3176728 - RNA, 20 nt, Human
guaagcguauggcuuuauuu

SEQ ID NO: 3176729 - RNA, 23 nt, Human
ggaagggacaccaagccuuggcu

SEQ ID NO: 3176730 - RNA, 17 nt, Human
ggaaggcugagaggaga

SEQ ID NO: 3176731 - RNA, 15 nt, Human
ggaaggcccagcacc

SEQ ID NO: 3176732 - RNA, 14 nt, Human
ggaaggcccagcac

SEQ ID NO: 3176733 - RNA, 23 nt, Human
ggaaggggagauaaggguaucug

SEQ ID NO: 3176734 - RNA, 19 nt, Human
ggaacgcccacuucccugg

SEQ ID NO: 3176735 - RNA, 15 nt, Human
ggaaggcagagaaau

SEQ ID NO: 3176736 - RNA, 14 nt, Human
ggaaggcagggagg

SEQ ID NO: 3176737 - RNA, 18 nt, Human
ggaaggcacuucugccug

SEQ ID NO: 3176738 - RNA, 18 nt, Human
ggaaccugugagcugcac

SEQ ID NO: 3176739 - RNA, 13 nt, Human
ggaacgcccacuu

SEQ ID NO: 3176740 - RNA, 13 nt, Human
ggaaccugacccc

SEQ ID NO: 3176741 - RNA, 14 nt, Human
ggaaugauuaauua

SEQ ID NO: 3176742 - RNA, 20 nt, Human
ggaagugacgguuuaauggg

SEQ ID NO: 3176743 - RNA, 19 nt, Human
ggaaguccuuaucuagcug

SEQ ID NO: 3176744 - RNA, 18 nt, Human
ggaaguagcacaggcuga

SEQ ID NO: 3176745 - RNA, 17 nt, Human
ggaaguagcacaggcug

SEQ ID NO: 3176746 - RNA, 12 nt, Human
ggaaguacugga

SEQ ID NO: 3176747 - RNA, 16 nt, Human
ggaaguacuggagaaa

SEQ ID NO: 3176748 - RNA, 18 nt, Human
ggaaguacuggagaaaau

SEQ ID NO: 3176749 - RNA, 15 nt, Human
ggaaguagcacaggc

SEQ ID NO: 3176750 - RNA, 14 nt, Human
ggaaguagcacagg

SEQ ID NO: 3176751 - RNA, 17 nt, Human
ggaaggggggucagaag

SEQ ID NO: 3176752 - RNA, 21 nt, Human
ggaagguaguucaagaaauga

SEQ ID NO: 3176753 - RNA, 20 nt, Human
ggaagguaguucaagaaaug

SEQ ID NO: 3176754 - RNA, 23 nt, Human
ggaauguauaguauuugaaaaca

SEQ ID NO: 3176755 - RNA, 21 nt, Human
ggaauguauaguauuugaaaa

SEQ ID NO: 3176756 - RNA, 16 nt, Human
ggaauguauaguauuu

SEQ ID NO: 3176757 - RNA, 24 nt, Human
ggaaugauuaauuaaaacacaaca

SEQ ID NO: 3176758 - RNA, 12 nt, Human
ggaaugcagugg

SEQ ID NO: 3176759 - RNA, 15 nt, Human
ggaauuauuuuaaaa

SEQ ID NO: 3176760 - RNA, 14 nt, Human
ggaauuauuuuaaa

SEQ ID NO: 3176761 - RNA, 19 nt, Human
ggaauguuugccucugccu

SEQ ID NO: 3176762 - RNA, 17 nt, Human
ggaauuauuuuaaaaga

SEQ ID NO: 3176763 - RNA, 16 nt, Human
ggaauuauuuuaaaag

SEQ ID NO: 3176764 - RNA, 13 nt, Human
ggaauuuuuuugu

SEQ ID NO: 3176765 - RNA, 22 nt, Human
ggacacuaaccacgcuggaccu

SEQ ID NO: 3176766 - RNA, 22 nt, Human
ggacaaccuuggcuuggcccug

SEQ ID NO: 3176767 - RNA, 17 nt, Human
ggacaaccuuggcuugg

SEQ ID NO: 3176768 - RNA, 23 nt, Human
ggaauuggguggggggcuucaua

SEQ ID NO: 3176769 - RNA, 19 nt, Human
ggaauuuggaaaucucuuu

SEQ ID NO: 3176770 - RNA, 23 nt, Human
ggaauuucucccagucauuuaau

SEQ ID NO: 3176771 - RNA, 21 nt, Human
ggagauagccccacaggaggu

SEQ ID NO: 3176772 - RNA, 20 nt, Human
ggagauagccccacaggagg

SEQ ID NO: 3176773 - RNA, 23 nt, Human
ggagauacuuggucacagccagg

SEQ ID NO: 3176774 - RNA, 22 nt, Human
ggagauacuuggucacagccag

SEQ ID NO: 3176775 - RNA, 18 nt, Human
ggagauccuuguguuuau

SEQ ID NO: 3176776 - RNA, 22 nt, Human
ggagaaugucaguauguggaag

SEQ ID NO: 3176777 - RNA, 17 nt, Human
ggagaaugcaccauacu

SEQ ID NO: 3176778 - RNA, 20 nt, Human
ggagaaucauguuucuuuga

SEQ ID NO: 3176779 - RNA, 19 nt, Human
ggagaaucauguuucuuug

SEQ ID NO: 3176780 - RNA, 18 nt, Human
ggagaaucauguuucuuu

SEQ ID NO: 3176781 - RNA, 22 nt, Human
ggagacagagcaaccccuggac

SEQ ID NO: 3176782 - RNA, 22 nt, Human
ggagaaucacaggcugggcugg

SEQ ID NO: 3176783 - RNA, 20 nt, Human
ggagaaugcaccauacucau

SEQ ID NO: 3176784 - RNA, 15 nt, Human
ggagaggagcccugc

SEQ ID NO: 3176785 - RNA, 12 nt, Human
ggagaggagccc

SEQ ID NO: 3176786 - RNA, 16 nt, Human
ggagaggagcccugcc

SEQ ID NO: 3176787 - RNA, 16 nt, Human
ggagagcuuagggucu

SEQ ID NO: 3176788 - RNA, 18 nt, Human
ggagagcuuagggucuca

SEQ ID NO: 3176789 - RNA, 19 nt, Human
ggagagcuuagggucucag

SEQ ID NO: 3176790 - RNA, 20 nt, Human
ggagagcuuagggucucagg

SEQ ID NO: 3176791 - RNA, 15 nt, Human
ggagaaucacuugaa

SEQ ID NO: 3176792 - RNA, 19 nt, Human
ggagaaucacuugaacccg

SEQ ID NO: 3176793 - RNA, 17 nt, Human
ggagaagcggcuggcag

SEQ ID NO: 3176794 - RNA, 18 nt, Human
ggagaagcggcuggcagc

SEQ ID NO: 3176795 - RNA, 22 nt, Human
ggacuguggguuugugggggga

SEQ ID NO: 3176796 - RNA, 20 nt, Human
ggacugugauuugaauccag

SEQ ID NO: 3176797 - RNA, 13 nt, Human
ggacgcucucugg

SEQ ID NO: 3176798 - RNA, 14 nt, Human
ggacgcucucuggc

SEQ ID NO: 3176799 - RNA, 17 nt, Human
ggacugggaacagaacu

SEQ ID NO: 3176800 - RNA, 18 nt, Human
ggacuggccucugcugau

SEQ ID NO: 3176801 - RNA, 20 nt, Human
ggacauugcggacagccacg

SEQ ID NO: 3176802 - RNA, 14 nt, Human
ggacauggacaagg

SEQ ID NO: 3176803 - RNA, 17 nt, Human
ggacagcauugccagua

SEQ ID NO: 3176804 - RNA, 21 nt, Human
ggacauggcuucugaaccugu

SEQ ID NO: 3176805 - RNA, 19 nt, Human
ggacaugggucgcccauga

SEQ ID NO: 3176806 - RNA, 20 nt, Human
ggacaugggucgcccaugag

SEQ ID NO: 3176807 - RNA, 21 nt, Human
ggacaugggucgcccaugaga

SEQ ID NO: 3176808 - RNA, 21 nt, Human
ggacagccacggccaggccag

SEQ ID NO: 3176809 - RNA, 20 nt, Human
ggacagccacggccaggcca

SEQ ID NO: 3176810 - RNA, 19 nt, Human
ggacagccacggccaggcc

SEQ ID NO: 3176811 - RNA, 15 nt, Human
ggacagccacggcca

SEQ ID NO: 3176812 - RNA, 20 nt, Human
ggacagaggggguggccucc

SEQ ID NO: 3176813 - RNA, 17 nt, Human
ggacacucaaaagcugg

SEQ ID NO: 3176814 - RNA, 19 nt, Human
ggacgcuacccgggaaggg

SEQ ID NO: 3176815 - RNA, 20 nt, Human
ggacgcuacccgggaagggg

SEQ ID NO: 3176816 - RNA, 17 nt, Human
ggacgcuacccgggaag

SEQ ID NO: 3176817 - RNA, 17 nt, Human
ggaccuugaacugggua

SEQ ID NO: 3176818 - RNA, 15 nt, Human
ggaccuugaacuggg

SEQ ID NO: 3176819 - RNA, 19 nt, Human
ggaccucaggugagaagca

SEQ ID NO: 3176820 - RNA, 20 nt, Human
ggaccucaggccugggggcu

SEQ ID NO: 3176821 - RNA, 23 nt, Human
ggaccacgucuauuucaucagaa

SEQ ID NO: 3176822 - RNA, 23 nt, Human
ggaccucaggugagaagcagagg

SEQ ID NO: 3176823 - RNA, 13 nt, Human
ggaccagagcugc

SEQ ID NO: 3176824 - RNA, 18 nt, Human
ggaccacaggugcccgcc

SEQ ID NO: 3176825 - RNA, 20 nt, Human
ggaccacaggugcccgccac

SEQ ID NO: 3176826 - RNA, 20 nt, Human
ggaaaagccaagaggcugca

SEQ ID NO: 3176827 - RNA, 11 nt, Human
ggaaaagcuga

SEQ ID NO: 3176828 - RNA, 14 nt, Human
ggaaaagcugcuga

SEQ ID NO: 3176829 - RNA, 18 nt, Human
ggaaaagauaaagaccag

SEQ ID NO: 3176830 - RNA, 22 nt, Human
ggaaaagauaaagaccagaaau

SEQ ID NO: 3176831 - RNA, 17 nt, Human
ggaaaacacccagggaa

SEQ ID NO: 3176832 - RNA, 20 nt, Human
ggaaaagcugcugacagugu

SEQ ID NO: 3176833 - RNA, 18 nt, Human
ggaaaagcugcugacagu

SEQ ID NO: 3176834 - RNA, 15 nt, Human
ggaaaagguugaaua

SEQ ID NO: 3176835 - RNA, 20 nt, Human
ggaaaagguugaauaauaua

SEQ ID NO: 3176836 - RNA, 11 nt, Human
ggaaaaggaag

SEQ ID NO: 3176837 - RNA, 15 nt, Human
ggaaaaggcauauau

SEQ ID NO: 3176838 - RNA, 23 nt, Human
ggaaaaggaagguaguucaagaa

SEQ ID NO: 3176839 - RNA, 19 nt, Human
ggaaaaaugccaucaaaug

SEQ ID NO: 3176840 - RNA, 11 nt, Human
ggaaaaauuca

SEQ ID NO: 3176841 - RNA, 23 nt, Human
gcuuuucacugcuggcugccuua

SEQ ID NO: 3176842 - RNA, 22 nt, Human
gcuuuucacugcuggcugccuu

SEQ ID NO: 3176843 - RNA, 21 nt, Human
gcuuuguuuguugucagcuga

SEQ ID NO: 3176844 - RNA, 14 nt, Human
gcuuuguuuguucu

SEQ ID NO: 3176845 - RNA, 23 nt, Human
gcuuuguugugugccucuagcug

SEQ ID NO: 3176846 - RNA, 22 nt, Human
gcuuuguugugugccucuagcu

SEQ ID NO: 3176847 - RNA, 21 nt, Human
gcuuuguugugugccucuagc

SEQ ID NO: 3176848 - RNA, 19 nt, Human
gcuuuguugugugccucua

SEQ ID NO: 3176849 - RNA, 18 nt, Human
gcuuuguugugugccucu

SEQ ID NO: 3176850 - RNA, 18 nt, Human
gcuuuucacugcuggcug

SEQ ID NO: 3176851 - RNA, 14 nt, Human
gcuuuucacugcug

SEQ ID NO: 3176852 - RNA, 15 nt, Human
gcuuuguuuguucuu

SEQ ID NO: 3176853 - RNA, 12 nt, Human
gcuuuucacugc

SEQ ID NO: 3176854 - RNA, 13 nt, Human
gcuuuucacugcu

SEQ ID NO: 3176855 - RNA, 15 nt, Human
gcuuucaggagcucc

SEQ ID NO: 3176856 - RNA, 18 nt, Human
gcuuugucuacuucaaaa

SEQ ID NO: 3176857 - RNA, 19 nt, Human
gcuuugucuccucuauccu

SEQ ID NO: 3176858 - RNA, 13 nt, Human
gcuuugucuccuc

SEQ ID NO: 3176859 - RNA, 17 nt, Human
gcuuuguuaccuuaaaa

SEQ ID NO: 3176860 - RNA, 19 nt, Human
gcuuuguuaccuuaaaacu

SEQ ID NO: 3176861 - RNA, 17 nt, Human
gcuuuguugugugccuc

SEQ ID NO: 3176862 - RNA, 15 nt, Human
gcuuuguugugugcc

SEQ ID NO: 3176863 - RNA, 15 nt, Human
gcuuuguaugcacuu

SEQ ID NO: 3176864 - RNA, 20 nt, Human
gcuugaggguugggcuggug

SEQ ID NO: 3176865 - RNA, 18 nt, Human
gcuugaggguugggcugg

SEQ ID NO: 3176866 - RNA, 16 nt, Human
gcuuuauuuuuuugaa

SEQ ID NO: 3176867 - RNA, 12 nt, Human
gcuuuagcuuau

SEQ ID NO: 3176868 - RNA, 21 nt, Human
gcuuuagacuugaaaagagac

SEQ ID NO: 3176869 - RNA, 24 nt, Human
gcuuuagacuugaaaagagacagg

SEQ ID NO: 3176870 - RNA, 21 nt, Human
gcuuuaguggccaucauuucu

SEQ ID NO: 3176871 - RNA, 20 nt, Human
gcuuuaggcauaugcuucuu

SEQ ID NO: 3176872 - RNA, 14 nt, Human
gcuuuagacuugaa

SEQ ID NO: 3176873 - RNA, 15 nt, Human
gcuuuagacuugaaa

SEQ ID NO: 3176874 - RNA, 17 nt, Human
gcuuuagacuugaaaag

SEQ ID NO: 3176875 - RNA, 18 nt, Human
gcuuuagacuugaaaaga

SEQ ID NO: 3176876 - RNA, 12 nt, Human
gcuuuagacuug

SEQ ID NO: 3176877 - RNA, 22 nt, Human
ggaaccaaagcgaauuuuaaaa

SEQ ID NO: 3176878 - RNA, 21 nt, Human
ggaaccaaagcgaauuuuaaa

SEQ ID NO: 3176879 - RNA, 16 nt, Human
ggaaaucaaauaugca

SEQ ID NO: 3176880 - RNA, 16 nt, Human
ggaaauaccaguucug

SEQ ID NO: 3176881 - RNA, 23 nt, Human
ggaaauaggcccaaccaccagau

SEQ ID NO: 3176882 - RNA, 17 nt, Human
ggaaaucaaauaugcaa

SEQ ID NO: 3176883 - RNA, 14 nt, Human
ggaaaucaccgaaa

SEQ ID NO: 3176884 - RNA, 21 nt, Human
ggaaaucaccgaaaacguggc

SEQ ID NO: 3176885 - RNA, 18 nt, Human
ggaaaucaaauguaaagu

SEQ ID NO: 3176886 - RNA, 17 nt, Human
ggaaaucaaauguaaag

SEQ ID NO: 3176887 - RNA, 12 nt, Human
ggaaauauuaaa

SEQ ID NO: 3176888 - RNA, 14 nt, Human
ggaaauauuaaaag

SEQ ID NO: 3176889 - RNA, 15 nt, Human
ggaaauauuaaaaga

SEQ ID NO: 3176890 - RNA, 22 nt, Human
ggaaaggcuccaggagcagcca

SEQ ID NO: 3176891 - RNA, 17 nt, Human
ggaaaggcuccaggagc

SEQ ID NO: 3176892 - RNA, 19 nt, Human
ggaaaggcuccaggagcag

SEQ ID NO: 3176893 - RNA, 20 nt, Human
ggaaaggcuccaggagcagc

SEQ ID NO: 3176894 - RNA, 21 nt, Human
ggaaaggcuccaggagcagcc

SEQ ID NO: 3176895 - RNA, 12 nt, Human
ggaaaggcucca

SEQ ID NO: 3176896 - RNA, 13 nt, Human
ggaaaggcuccag

SEQ ID NO: 3176897 - RNA, 14 nt, Human
ggaaaggcuccagg

SEQ ID NO: 3176898 - RNA, 19 nt, Human
ggaaaaucagccugcucca

SEQ ID NO: 3176899 - RNA, 23 nt, Human
ggaaaaucagccugcuccagcug

SEQ ID NO: 3176900 - RNA, 19 nt, Human
ggaaaaugccaugaauuac

SEQ ID NO: 3176901 - RNA, 22 nt, Human
ggaaaauuaguucccauucuuu

SEQ ID NO: 3176902 - RNA, 22 nt, Human
gcuucauacagggaugguguuc

SEQ ID NO: 3176903 - RNA, 11 nt, Human
gcuucauacac

SEQ ID NO: 3176904 - RNA, 11 nt, Human
gcuucauacag

SEQ ID NO: 3176905 - RNA, 18 nt, Human
gcuucaguggcagcugcu

SEQ ID NO: 3176906 - RNA, 17 nt, Human
gcuucaguggcagcugc

SEQ ID NO: 3176907 - RNA, 12 nt, Human
gcuucauccucc

SEQ ID NO: 3176908 - RNA, 15 nt, Human
gcuucauccuccuca

SEQ ID NO: 3176909 - RNA, 16 nt, Human
gcuucauuuccugugu

SEQ ID NO: 3176910 - RNA, 13 nt, Human
gcuucauuuccug

SEQ ID NO: 3176911 - RNA, 12 nt, Human
gcuuauacacuu

SEQ ID NO: 3176912 - RNA, 13 nt, Human
gcuuauaaaacag

SEQ ID NO: 3176913 - RNA, 19 nt, Human
gcuuauaaaacagaguaau

SEQ ID NO: 3176914 - RNA, 12 nt, Human
gcuuauaaaaca

SEQ ID NO: 3176915 - RNA, 13 nt, Human
gcuuaucucaggg

SEQ ID NO: 3176916 - RNA, 19 nt, Human
gcuuaucucaggggugugc

SEQ ID NO: 3176917 - RNA, 15 nt, Human
gcuucaguggcagcu

SEQ ID NO: 3176918 - RNA, 23 nt, Human
gcuuaugauagcaaauggccuca

SEQ ID NO: 3176919 - RNA, 18 nt, Human
gcuuaugcuuaaauucaa

SEQ ID NO: 3176920 - RNA, 16 nt, Human
gcuucaguggcagcug

SEQ ID NO: 3176921 - RNA, 17 nt, Human
gcuuaugagauacuuug

SEQ ID NO: 3176922 - RNA, 18 nt, Human
gcuuaugagauacuuugc

SEQ ID NO: 3176923 - RNA, 22 nt, Human
gcuuauaaaacagaguaaucuu

SEQ ID NO: 3176924 - RNA, 18 nt, Human
gcuuauaaccuaguuaaa

SEQ ID NO: 3176925 - RNA, 22 nt, Human
gcuuauaaccuaguuaaagaaa

SEQ ID NO: 3176926 - RNA, 16 nt, Human
gcuuccagugaggcuc

SEQ ID NO: 3176927 - RNA, 20 nt, Human
gcuuccagcaggagggacag

SEQ ID NO: 3176928 - RNA, 17 nt, Human
gcuucauuuccuguguc

SEQ ID NO: 3176929 - RNA, 15 nt, Human
gcuuccagugaggcu

SEQ ID NO: 3176930 - RNA, 12 nt, Human
gcuuccagcagg

SEQ ID NO: 3176931 - RNA, 14 nt, Human
gcuuccagcaggag

SEQ ID NO: 3176932 - RNA, 13 nt, Human
gcuuccagcagga

SEQ ID NO: 3176933 - RNA, 17 nt, Human
gcuuccagcaggaggga

SEQ ID NO: 3176934 - RNA, 15 nt, Human
gcuuccagcaggagg

SEQ ID NO: 3176935 - RNA, 16 nt, Human
gcuugaggguugggcu

SEQ ID NO: 3176936 - RNA, 15 nt, Human
gcugccaaugggagc

SEQ ID NO: 3176937 - RNA, 16 nt, Human
gcugccaaugggagcu

SEQ ID NO: 3176938 - RNA, 19 nt, Human
gcugccaaugggagcucau

SEQ ID NO: 3176939 - RNA, 14 nt, Human
gcuguucagcuggu

SEQ ID NO: 3176940 - RNA, 13 nt, Human
gcuguucagcugg

SEQ ID NO: 3176941 - RNA, 23 nt, Human
gcuguucuuuaguagcaacuaaa

SEQ ID NO: 3176942 - RNA, 14 nt, Human
gcuguucuuccugg

SEQ ID NO: 3176943 - RNA, 13 nt, Human
gcuguucuuccug

SEQ ID NO: 3176944 - RNA, 12 nt, Human
gcuguucuuccu

SEQ ID NO: 3176945 - RNA, 21 nt, Human
gcugugggcgugagaccugcc

SEQ ID NO: 3176946 - RNA, 22 nt, Human
gcugugggcgugagaccugccc

SEQ ID NO: 3176947 - RNA, 20 nt, Human
gcugugggcgugagaccugc

SEQ ID NO: 3176948 - RNA, 22 nt, Human
gcuguugacucuaguacuguga

SEQ ID NO: 3176949 - RNA, 23 nt, Human
gcuguugaccaggcaccuccccu

SEQ ID NO: 3176950 - RNA, 18 nt, Human
gcuguugaccaggcaccu

SEQ ID NO: 3176951 - RNA, 15 nt, Human
gcuguugaccaggca

SEQ ID NO: 3176952 - RNA, 13 nt, Human
gcuguugaccagg

SEQ ID NO: 3176953 - RNA, 18 nt, Human
gcuuagaggcaugggcuu

SEQ ID NO: 3176954 - RNA, 12 nt, Human
gcuuagaggcau

SEQ ID NO: 3176955 - RNA, 21 nt, Human
gcuuagaggcaugggcuugcu

SEQ ID NO: 3176956 - RNA, 15 nt, Human
gcuuagggucucagg

SEQ ID NO: 3176957 - RNA, 16 nt, Human
gcuuagggucucaggg

SEQ ID NO: 3176958 - RNA, 15 nt, Human
gcuuagucacugaga

SEQ ID NO: 3176959 - RNA, 17 nt, Human
gcuuagucacugagaca

SEQ ID NO: 3176960 - RNA, 21 nt, Human
gcuuagucacugagacagccc

SEQ ID NO: 3176961 - RNA, 19 nt, Human
gcuuagucacugagacagc

SEQ ID NO: 3176962 - RNA, 20 nt, Human
gcuuagucacugagacagcc

SEQ ID NO: 3176963 - RNA, 22 nt, Human
ggcgccucaacucugcugaggg

SEQ ID NO: 3176964 - RNA, 23 nt, Human
ggcgccucaacucugcugagggu

SEQ ID NO: 3176965 - RNA, 13 nt, Human
ggccugucuguga

SEQ ID NO: 3176966 - RNA, 19 nt, Human
ggccugucucggaaccugu

SEQ ID NO: 3176967 - RNA, 22 nt, Human
ggccugucugugaagagcaaga

SEQ ID NO: 3176968 - RNA, 18 nt, Human
ggcgcugccccuggcagc

SEQ ID NO: 3176969 - RNA, 19 nt, Human
ggcgcugccccuggcagcc

SEQ ID NO: 3176970 - RNA, 21 nt, Human
ggcgcugccccuggcagcccc

SEQ ID NO: 3176971 - RNA, 23 nt, Human
ggcgcugccccuggcagccccug

SEQ ID NO: 3176972 - RNA, 18 nt, Human
ggccuguccaacacaucu

SEQ ID NO: 3176973 - RNA, 14 nt, Human
ggccugggggcugg

SEQ ID NO: 3176974 - RNA, 20 nt, Human
ggccugggggcugggcagag

SEQ ID NO: 3176975 - RNA, 14 nt, Human
ggccuggcuugucu

SEQ ID NO: 3176976 - RNA, 23 nt, Human
ggccuggcucccucacucucagg

SEQ ID NO: 3176977 - RNA, 19 nt, Human
ggccuggccugagcuggga

SEQ ID NO: 3176978 - RNA, 14 nt, Human
ggccuggcucccuc

SEQ ID NO: 3176979 - RNA, 22 nt, Human
ggccugaauccaaaagaaaaac

SEQ ID NO: 3176980 - RNA, 16 nt, Human
ggccugaaauccuggu

SEQ ID NO: 3176981 - RNA, 20 nt, Human
ggccugaaauccugguuccu

SEQ ID NO: 3176982 - RNA, 18 nt, Human
ggccugaaccacaggaga

SEQ ID NO: 3176983 - RNA, 12 nt, Human
ggccugaaccac

SEQ ID NO: 3176984 - RNA, 16 nt, Human
ggccugaauccaaaag

SEQ ID NO: 3176985 - RNA, 21 nt, Human
ggccucuuucagugaauuugu

SEQ ID NO: 3176986 - RNA, 16 nt, Human
ggcuccaggccagggg

SEQ ID NO: 3176987 - RNA, 14 nt, Human
ggcuccaggccagg

SEQ ID NO: 3176988 - RNA, 18 nt, Human
ggcuccaggagcagccac

SEQ ID NO: 3176989 - RNA, 14 nt, Human
ggcuccaggcagca

SEQ ID NO: 3176990 - RNA, 13 nt, Human
ggcuccaggcagc

SEQ ID NO: 3176991 - RNA, 18 nt, Human
ggcuccaggccagggggc

SEQ ID NO: 3176992 - RNA, 15 nt, Human
ggcuccaggcuccuu

SEQ ID NO: 3176993 - RNA, 11 nt, Human
ggcuccaggcu

SEQ ID NO: 3176994 - RNA, 16 nt, Human
ggcuccaggcuccuuu

SEQ ID NO: 3176995 - RNA, 13 nt, Human
ggcuccaugccag

SEQ ID NO: 3176996 - RNA, 12 nt, Human
ggcuccaugcca

SEQ ID NO: 3176997 - RNA, 15 nt, Human
ggcuccaguccccag

SEQ ID NO: 3176998 - RNA, 19 nt, Human
ggcucccacaggcccuucc

SEQ ID NO: 3176999 - RNA, 18 nt, Human
ggcucccacaggcccuuc

SEQ ID NO: 3177000 - RNA, 14 nt, Human
ggcuccaugccagc

SEQ ID NO: 3177001 - RNA, 17 nt, Human
ggcucccacaggcccuu

SEQ ID NO: 3177002 - RNA, 19 nt, Human
ggcuccaggagcagccaca

SEQ ID NO: 3177003 - RNA, 12 nt, Human
ggcuccaggagc

SEQ ID NO: 3177004 - RNA, 12 nt, Human
ggcuccagcugg

SEQ ID NO: 3177005 - RNA, 18 nt, Human
ggcucaagcccaggaggg

SEQ ID NO: 3177006 - RNA, 21 nt, Human
ggcucaaguccucuuuucuga

SEQ ID NO: 3177007 - RNA, 15 nt, Human
ggcucaaguccucuu

SEQ ID NO: 3177008 - RNA, 21 nt, Human
ggcuauggggauagaugugug

SEQ ID NO: 3177009 - RNA, 19 nt, Human
ggcuaugggggcacugagg

SEQ ID NO: 3177010 - RNA, 17 nt, Human
ggcucaagcccaggagg

SEQ ID NO: 3177011 - RNA, 12 nt, Human
ggcucaaauuuu

SEQ ID NO: 3177012 - RNA, 23 nt, Human
ggcuagugugguguuuccuggca

SEQ ID NO: 3177013 - RNA, 15 nt, Human
ggcuaguugggcuuc

SEQ ID NO: 3177014 - RNA, 16 nt, Human
ggcuaguugggcuucc

SEQ ID NO: 3177015 - RNA, 15 nt, Human
ggcuagcuaagccaa

SEQ ID NO: 3177016 - RNA, 22 nt, Human
ggcuaggaccccuccauguggg

SEQ ID NO: 3177017 - RNA, 16 nt, Human
ggcuaggaccccucca

SEQ ID NO: 3177018 - RNA, 17 nt, Human
ggccuacaugcuuugug

SEQ ID NO: 3177019 - RNA, 13 nt, Human
ggccuaauaaaac

SEQ ID NO: 3177020 - RNA, 22 nt, Human
ggccuaauaaaacugaugugaa

SEQ ID NO: 3177021 - RNA, 23 nt, Human
ggccuaauaaaacugaugugaaa

SEQ ID NO: 3177022 - RNA, 23 nt, Human
ggccuacaugcuuugugaacaag

SEQ ID NO: 3177023 - RNA, 18 nt, Human
ggccuacaugcuuuguga

SEQ ID NO: 3177024 - RNA, 16 nt, Human
ggccuacaaaucagua

SEQ ID NO: 3177025 - RNA, 12 nt, Human
ggcccugugccu

SEQ ID NO: 3177026 - RNA, 22 nt, Human
ggccucggacuuagcugggaga

SEQ ID NO: 3177027 - RNA, 20 nt, Human
ggccucggacuuagcuggga

SEQ ID NO: 3177028 - RNA, 17 nt, Human
ggccucggacuuagcug

SEQ ID NO: 3177029 - RNA, 13 nt, Human
ggccucugcacuc

SEQ ID NO: 3177030 - RNA, 14 nt, Human
ggccucugcacucc

SEQ ID NO: 3177031 - RNA, 15 nt, Human
ggccucugcacuccc

SEQ ID NO: 3177032 - RNA, 18 nt, Human
ggccucuuaugggcuggg

SEQ ID NO: 3177033 - RNA, 16 nt, Human
ggccucuucucucaga

SEQ ID NO: 3177034 - RNA, 17 nt, Human
ggccucuucucucagac

SEQ ID NO: 3177035 - RNA, 18 nt, Human
ggccucuucucucagacc

SEQ ID NO: 3177036 - RNA, 17 nt, Human
ggccucuuaugggcugg

SEQ ID NO: 3177037 - RNA, 21 nt, Human
ggccucugcaaaggaaauacc

SEQ ID NO: 3177038 - RNA, 13 nt, Human
ggcccugccuccu

SEQ ID NO: 3177039 - RNA, 13 nt, Human
ggcccugcccugg

SEQ ID NO: 3177040 - RNA, 20 nt, Human
ggcccugcccugguuuccug

SEQ ID NO: 3177041 - RNA, 11 nt, Human
ggcccugcccu

SEQ ID NO: 3177042 - RNA, 12 nt, Human
ggcccugcagcu

SEQ ID NO: 3177043 - RNA, 11 nt, Human
ggcccugccca

SEQ ID NO: 3177044 - RNA, 12 nt, Human
ggcccugcccac

SEQ ID NO: 3177045 - RNA, 20 nt, Human
ggcccugcccacaccuccug

SEQ ID NO: 3177046 - RNA, 12 nt, Human
ggcccugcccug

SEQ ID NO: 3177047 - RNA, 13 nt, Human
ggcccuggcagcc

SEQ ID NO: 3177048 - RNA, 14 nt, Human
ggcccuggcagccc

SEQ ID NO: 3177049 - RNA, 13 nt, Human
ggcccuggcuccc

SEQ ID NO: 3177050 - RNA, 22 nt, Human
ggcccuggcucccacaggcccu

SEQ ID NO: 3177051 - RNA, 14 nt, Human
ggcccugccuccuu

SEQ ID NO: 3177052 - RNA, 15 nt, Human
ggcccugccuccuuu

SEQ ID NO: 3177053 - RNA, 13 nt, Human
ggcccugccugcu

SEQ ID NO: 3177054 - RNA, 11 nt, Human
ggcccugccug

SEQ ID NO: 3177055 - RNA, 22 nt, Human
ggcccugcccugguuuccugcc

SEQ ID NO: 3177056 - RNA, 21 nt, Human
ggcccucugcccacucccugc

SEQ ID NO: 3177057 - RNA, 23 nt, Human
ggcccucucugaaggaggccacc

SEQ ID NO: 3177058 - RNA, 19 nt, Human
ggcccucugcccacucccu

SEQ ID NO: 3177059 - RNA, 20 nt, Human
ggcccucugcccacucccug

SEQ ID NO: 3177060 - RNA, 13 nt, Human
ggcccucugccca

SEQ ID NO: 3177061 - RNA, 15 nt, Human
ggcccucugcccacu

SEQ ID NO: 3177062 - RNA, 16 nt, Human
ggcccucugcccacuc

SEQ ID NO: 3177063 - RNA, 17 nt, Human
ggcccucugcccacucc

SEQ ID NO: 3177064 - RNA, 11 nt, Human
ggcccagagag

SEQ ID NO: 3177065 - RNA, 20 nt, Human
ggcccagagagaagagcccc

SEQ ID NO: 3177066 - RNA, 18 nt, Human
ggcccagagagaagagcc

SEQ ID NO: 3177067 - RNA, 21 nt, Human
ggcccucucugaaggaggcca

SEQ ID NO: 3177068 - RNA, 20 nt, Human
ggcccucucugaaggaggcc

SEQ ID NO: 3177069 - RNA, 23 nt, Human
ggcccagagagaagagccccacu

SEQ ID NO: 3177070 - RNA, 22 nt, Human
ggcccagagagaagagccccac

SEQ ID NO: 3177071 - RNA, 22 nt, Human
ggcccaagagucuggggaccag

SEQ ID NO: 3177072 - RNA, 20 nt, Human
ggcccaagagucuggggacc

SEQ ID NO: 3177073 - RNA, 20 nt, Human
ggcccaaccaccagaugaga

SEQ ID NO: 3177074 - RNA, 19 nt, Human
ggcccaacaggggcuccau

SEQ ID NO: 3177075 - RNA, 16 nt, Human
ggaugcauggagauag

SEQ ID NO: 3177076 - RNA, 19 nt, Human
ggaugccaagaaguuuaag

SEQ ID NO: 3177077 - RNA, 19 nt, Human
ggaugcagccucacagucc

SEQ ID NO: 3177078 - RNA, 16 nt, Human
ggaugauugaagaaac

SEQ ID NO: 3177079 - RNA, 17 nt, Human
ggauggaaugauggguc

SEQ ID NO: 3177080 - RNA, 19 nt, Human
ggauuacaagcgugagcca

SEQ ID NO: 3177081 - RNA, 12 nt, Human
ggauccuccagg

SEQ ID NO: 3177082 - RNA, 14 nt, Human
ggauccccuuccua

SEQ ID NO: 3177083 - RNA, 13 nt, Human
ggauccuccaggu

SEQ ID NO: 3177084 - RNA, 15 nt, Human
ggaugauugaagaaa

SEQ ID NO: 3177085 - RNA, 21 nt, Human
ggaugauuggaggggggaggu

SEQ ID NO: 3177086 - RNA, 16 nt, Human
ggaugcagccucacag

SEQ ID NO: 3177087 - RNA, 17 nt, Human
ggaugcagccucacagu

SEQ ID NO: 3177088 - RNA, 22 nt, Human
ggaucccucauccucauaccca

SEQ ID NO: 3177089 - RNA, 13 nt, Human
ggaucccucaucc

SEQ ID NO: 3177090 - RNA, 17 nt, Human
ggaucccucauccucau

SEQ ID NO: 3177091 - RNA, 18 nt, Human
ggaucaaguauuacuaaa

SEQ ID NO: 3177092 - RNA, 13 nt, Human
ggauccccuuccu

SEQ ID NO: 3177093 - RNA, 22 nt, Human
ggaucaaaccccgaccaccugc

SEQ ID NO: 3177094 - RNA, 13 nt, Human
ggauaugaccagu

SEQ ID NO: 3177095 - RNA, 15 nt, Human
ggauaugaaaaauga

SEQ ID NO: 3177096 - RNA, 14 nt, Human
ggauaggggcagag

SEQ ID NO: 3177097 - RNA, 17 nt, Human
ggauaucuguuagaugc

SEQ ID NO: 3177098 - RNA, 22 nt, Human
ggauaucuguuagaugcuacua

SEQ ID NO: 3177099 - RNA, 23 nt, Human
ggagugaguugauagcacagacc

SEQ ID NO: 3177100 - RNA, 12 nt, Human
ggagugcaguga

SEQ ID NO: 3177101 - RNA, 14 nt, Human
ggagugcagugagc

SEQ ID NO: 3177102 - RNA, 17 nt, Human
ggauaccuucuuauuua

SEQ ID NO: 3177103 - RNA, 15 nt, Human
ggauacgugucaaug

SEQ ID NO: 3177104 - RNA, 16 nt, Human
ggcaauauucucugua

SEQ ID NO: 3177105 - RNA, 15 nt, Human
ggcaauauucucugu

SEQ ID NO: 3177106 - RNA, 19 nt, Human
ggcaauaaauuuugaaaag

SEQ ID NO: 3177107 - RNA, 20 nt, Human
ggcaauagaccgagacuccg

SEQ ID NO: 3177108 - RNA, 18 nt, Human
ggcaacccccagccugcu

SEQ ID NO: 3177109 - RNA, 16 nt, Human
ggcaauaaauuuugaa

SEQ ID NO: 3177110 - RNA, 17 nt, Human
ggcaauaaauuuugaaa

SEQ ID NO: 3177111 - RNA, 15 nt, Human
ggcaauaaauuuuga

SEQ ID NO: 3177112 - RNA, 23 nt, Human
ggcaaugcuggcuguuggcuggg

SEQ ID NO: 3177113 - RNA, 15 nt, Human
ggcaaugcuggcugu

SEQ ID NO: 3177114 - RNA, 14 nt, Human
ggcaaugcuggcug

SEQ ID NO: 3177115 - RNA, 20 nt, Human
ggcaauauucucuguacaua

SEQ ID NO: 3177116 - RNA, 20 nt, Human
ggcaaucaauaaacagcagg

SEQ ID NO: 3177117 - RNA, 19 nt, Human
ggcaauauucucuguacau

SEQ ID NO: 3177118 - RNA, 18 nt, Human
ggcaauauucucuguaca

SEQ ID NO: 3177119 - RNA, 22 nt, Human
ggcacccggccccugcugguuc

SEQ ID NO: 3177120 - RNA, 18 nt, Human
ggcaccggggccucggac

SEQ ID NO: 3177121 - RNA, 23 nt, Human
ggcacccaccaucaugucuggcu

SEQ ID NO: 3177122 - RNA, 16 nt, Human
ggcaaugguaguuucu

SEQ ID NO: 3177123 - RNA, 17 nt, Human
ggcaaugguaguuucug

SEQ ID NO: 3177124 - RNA, 18 nt, Human
ggcaaugguaguuucugu

SEQ ID NO: 3177125 - RNA, 20 nt, Human
ggcacccaccaucaugucug

SEQ ID NO: 3177126 - RNA, 17 nt, Human
ggauugggccccugcca

SEQ ID NO: 3177127 - RNA, 18 nt, Human
ggauugggccccugccag

SEQ ID NO: 3177128 - RNA, 17 nt, Human
ggauugcuacuguccua

SEQ ID NO: 3177129 - RNA, 17 nt, Human
ggcaacccccagccugc

SEQ ID NO: 3177130 - RNA, 16 nt, Human
ggcaacccccagccug

SEQ ID NO: 3177131 - RNA, 16 nt, Human
ggauucuuauggacaa

SEQ ID NO: 3177132 - RNA, 14 nt, Human
ggauugauuuuaaa

SEQ ID NO: 3177133 - RNA, 18 nt, Human
ggauugauuuuaaaaugu

SEQ ID NO: 3177134 - RNA, 17 nt, Human
ggauugauuuuaaaaug

SEQ ID NO: 3177135 - RNA, 23 nt, Human
ggauuacaagcgugagccacugc

SEQ ID NO: 3177136 - RNA, 19 nt, Human
ggauuacaggcuccugcca

SEQ ID NO: 3177137 - RNA, 12 nt, Human
ggcagcucagcu

SEQ ID NO: 3177138 - RNA, 13 nt, Human
ggcagcucagaga

SEQ ID NO: 3177139 - RNA, 21 nt, Human
ggcagcucagagaggguggga

SEQ ID NO: 3177140 - RNA, 16 nt, Human
ggcagcuguugucucu

SEQ ID NO: 3177141 - RNA, 17 nt, Human
ggcagcuugaggguugg

SEQ ID NO: 3177142 - RNA, 18 nt, Human
ggcagggucucacucugu

SEQ ID NO: 3177143 - RNA, 22 nt, Human
ggcagcugcuuuugucuauggg

SEQ ID NO: 3177144 - RNA, 12 nt, Human
ggcagcucaccu

SEQ ID NO: 3177145 - RNA, 14 nt, Human
ggcagcucaccucu

SEQ ID NO: 3177146 - RNA, 15 nt, Human
ggcagcuauaggaaa

SEQ ID NO: 3177147 - RNA, 22 nt, Human
ggcaccugucugcuccagcucu

SEQ ID NO: 3177148 - RNA, 21 nt, Human
ggcaccugucugcuccagcuc

SEQ ID NO: 3177149 - RNA, 13 nt, Human
ggcaccugucugc

SEQ ID NO: 3177150 - RNA, 19 nt, Human
ggcacgugguugagugggg

SEQ ID NO: 3177151 - RNA, 19 nt, Human
ggcaugaaaugaacacaaa

SEQ ID NO: 3177152 - RNA, 17 nt, Human
ggcaugaaaugaacaca

SEQ ID NO: 3177153 - RNA, 18 nt, Human
ggcaugacacgaauauug

SEQ ID NO: 3177154 - RNA, 13 nt, Human
ggcauggcagccc

SEQ ID NO: 3177155 - RNA, 18 nt, Human
ggcauggccagguggcca

SEQ ID NO: 3177156 - RNA, 17 nt, Human
ggcauggccagguggcc

SEQ ID NO: 3177157 - RNA, 16 nt, Human
ggcagugggagcugcc

SEQ ID NO: 3177158 - RNA, 21 nt, Human
ggcagugggacagggcauggc

SEQ ID NO: 3177159 - RNA, 14 nt, Human
ggcagugggagcug

SEQ ID NO: 3177160 - RNA, 13 nt, Human
ggcagugggagcu

SEQ ID NO: 3177161 - RNA, 20 nt, Human
ggcagggucucacucugucg

SEQ ID NO: 3177162 - RNA, 19 nt, Human
ggcagggucucacucuguc

SEQ ID NO: 3177163 - RNA, 19 nt, Human
ggcagggugucugcccccu

SEQ ID NO: 3177164 - RNA, 16 nt, Human
ggccaugggccuccug

SEQ ID NO: 3177165 - RNA, 17 nt, Human
ggccaggcugcucucaa

SEQ ID NO: 3177166 - RNA, 14 nt, Human
ggccaggcugcucu

SEQ ID NO: 3177167 - RNA, 15 nt, Human
ggccaggcugcucuu

SEQ ID NO: 3177168 - RNA, 11 nt, Human
ggccaggcugc

SEQ ID NO: 3177169 - RNA, 23 nt, Human
ggccagcugcuugggcuucaucc

SEQ ID NO: 3177170 - RNA, 11 nt, Human
ggccagcuccg

SEQ ID NO: 3177171 - RNA, 18 nt, Human
ggccaggcccucugccca

SEQ ID NO: 3177172 - RNA, 18 nt, Human
ggccaggaaguagcacag

SEQ ID NO: 3177173 - RNA, 22 nt, Human
ggccagccuugaccauucucca

SEQ ID NO: 3177174 - RNA, 17 nt, Human
ggccagcugcuugggcu

SEQ ID NO: 3177175 - RNA, 20 nt, Human
ggccagccuugaccauucuc

SEQ ID NO: 3177176 - RNA, 14 nt, Human
ggcauggcugggaa

SEQ ID NO: 3177177 - RNA, 18 nt, Human
ggcaugggaaugaauguc

SEQ ID NO: 3177178 - RNA, 22 nt, Human
ggcaugggaaugaaugucagug

SEQ ID NO: 3177179 - RNA, 17 nt, Human
ggcauuccccaggaggc

SEQ ID NO: 3177180 - RNA, 18 nt, Human
ggcauuccccaggaggcc

SEQ ID NO: 3177181 - RNA, 19 nt, Human
ggcauuccccaggaggcca

SEQ ID NO: 3177182 - RNA, 16 nt, Human
ggcauuccccaggagg

SEQ ID NO: 3177183 - RNA, 18 nt, Human
ggccacccugugcagaag

SEQ ID NO: 3177184 - RNA, 20 nt, Human
ggccaccacgccuagccuca

SEQ ID NO: 3177185 - RNA, 17 nt, Human
ggccacuccagaccccu

SEQ ID NO: 3177186 - RNA, 17 nt, Human
gcuaugagcuggggaug

SEQ ID NO: 3177187 - RNA, 18 nt, Human
gcucaccagccccagugc

SEQ ID NO: 3177188 - RNA, 19 nt, Human
gcucaccagccccagugcc

SEQ ID NO: 3177189 - RNA, 23 nt, Human
gcucaccagccccagugcccaca

SEQ ID NO: 3177190 - RNA, 20 nt, Human
gcucaccagccccagugccc

SEQ ID NO: 3177191 - RNA, 11 nt, Human
gcuaugacuua

SEQ ID NO: 3177192 - RNA, 18 nt, Human
gcucagcagugagagcag

SEQ ID NO: 3177193 - RNA, 15 nt, Human
gcucagcaaggccac

SEQ ID NO: 3177194 - RNA, 14 nt, Human
gcucagcaaggcca

SEQ ID NO: 3177195 - RNA, 21 nt, Human
gcucagaucccacuuuugcca

SEQ ID NO: 3177196 - RNA, 19 nt, Human
gcucagcaaggccaccucu

SEQ ID NO: 3177197 - RNA, 18 nt, Human
gcucagcaaggccaccuc

SEQ ID NO: 3177198 - RNA, 17 nt, Human
gcucagcaaggccaccu

SEQ ID NO: 3177199 - RNA, 16 nt, Human
gcucagcaaggccacc

SEQ ID NO: 3177200 - RNA, 17 nt, Human
gcucagcaaaagaugcu

SEQ ID NO: 3177201 - RNA, 20 nt, Human
gcucagcaaaagaugcuucu

SEQ ID NO: 3177202 - RNA, 22 nt, Human
gcucagcaaaagaugcuucuca

SEQ ID NO: 3177203 - RNA, 23 nt, Human
gcucagcaaaagaugcuucucac

SEQ ID NO: 3177204 - RNA, 22 nt, Human
gcucagugucuggcugcagagc

SEQ ID NO: 3177205 - RNA, 19 nt, Human
gcucaggugucccugcacu

SEQ ID NO: 3177206 - RNA, 17 nt, Human
gcucaggugucccugca

SEQ ID NO: 3177207 - RNA, 18 nt, Human
gcucaggugucccugcac

SEQ ID NO: 3177208 - RNA, 22 nt, Human
gcucagcggggacagcuccuuc

SEQ ID NO: 3177209 - RNA, 21 nt, Human
gcucagcggggacagcuccuu

SEQ ID NO: 3177210 - RNA, 15 nt, Human
gcucagcggggacag

SEQ ID NO: 3177211 - RNA, 19 nt, Human
gcucagcggggacagcucc

SEQ ID NO: 3177212 - RNA, 20 nt, Human
gcucagcggggacagcuccu

SEQ ID NO: 3177213 - RNA, 23 nt, Human
gcuccaggcuccuuuagcgccca

SEQ ID NO: 3177214 - RNA, 16 nt, Human
gcuccaggcuccuuua

SEQ ID NO: 3177215 - RNA, 11 nt, Human
gcuccagcugu

SEQ ID NO: 3177216 - RNA, 13 nt, Human
gcuccaggcuccu

SEQ ID NO: 3177217 - RNA, 14 nt, Human
gcuccaucuuauuu

SEQ ID NO: 3177218 - RNA, 14 nt, Human
gcuccaucuccacu

SEQ ID NO: 3177219 - RNA, 21 nt, Human
gcuccauacacacgcugccuu

SEQ ID NO: 3177220 - RNA, 20 nt, Human
gcuccauacacacgcugccu

SEQ ID NO: 3177221 - RNA, 17 nt, Human
gcuccauacacacgcug

SEQ ID NO: 3177222 - RNA, 18 nt, Human
gcucccucacucucagga

SEQ ID NO: 3177223 - RNA, 17 nt, Human
gcucccucacucucagg

SEQ ID NO: 3177224 - RNA, 16 nt, Human
gcucccucacucucag

SEQ ID NO: 3177225 - RNA, 15 nt, Human
gcucccucacucuca

SEQ ID NO: 3177226 - RNA, 14 nt, Human
gcucccucacucuc

SEQ ID NO: 3177227 - RNA, 19 nt, Human
gcucccucaaagaggcagu

SEQ ID NO: 3177228 - RNA, 17 nt, Human
gcucccucaaagaggca

SEQ ID NO: 3177229 - RNA, 16 nt, Human
gcucccucaaagaggc

SEQ ID NO: 3177230 - RNA, 12 nt, Human
gcucccugacug

SEQ ID NO: 3177231 - RNA, 20 nt, Human
gcucccuccgggucuuccua

SEQ ID NO: 3177232 - RNA, 16 nt, Human
gcuccaagcucccagg

SEQ ID NO: 3177233 - RNA, 17 nt, Human
gcuccaagcucccaggc

SEQ ID NO: 3177234 - RNA, 18 nt, Human
gcuccaagcucccaggca

SEQ ID NO: 3177235 - RNA, 19 nt, Human
gcuccaagcucccaggcau

SEQ ID NO: 3177236 - RNA, 21 nt, Human
gcuccaagcucccaggcauuc

SEQ ID NO: 3177237 - RNA, 16 nt, Human
gcuccacacacacaaa

SEQ ID NO: 3177238 - RNA, 17 nt, Human
gcuccagcuggccggga

SEQ ID NO: 3177239 - RNA, 23 nt, Human
gcuccagcuggccgggagccuga

SEQ ID NO: 3177240 - RNA, 17 nt, Human
gcuccacacacacaaaa

SEQ ID NO: 3177241 - RNA, 14 nt, Human
gcuccaagcuccca

SEQ ID NO: 3177242 - RNA, 15 nt, Human
gcuccaagcucccag

SEQ ID NO: 3177243 - RNA, 13 nt, Human
gcuccaagcuccc

SEQ ID NO: 3177244 - RNA, 16 nt, Human
gcuccaaaugcagcuu

SEQ ID NO: 3177245 - RNA, 20 nt, Human
gcuccaaccgggaugggagc

SEQ ID NO: 3177246 - RNA, 21 nt, Human
gcuccaacuccaacauccacu

SEQ ID NO: 3177247 - RNA, 13 nt, Human
gcuccaacuccaa

SEQ ID NO: 3177248 - RNA, 17 nt, Human
gccugugaacugaacuc

SEQ ID NO: 3177249 - RNA, 16 nt, Human
gcgguccacccaggag

SEQ ID NO: 3177250 - RNA, 13 nt, Human
gcggggacagcuc

SEQ ID NO: 3177251 - RNA, 15 nt, Human
gcgggcuuccuccug

SEQ ID NO: 3177252 - RNA, 12 nt, Human
gcggggacagcu

SEQ ID NO: 3177253 - RNA, 19 nt, Human
gcgguccacccaggagccc

SEQ ID NO: 3177254 - RNA, 18 nt, Human
gcgguccacccaggagcc

SEQ ID NO: 3177255 - RNA, 16 nt, Human
gcguagcagaguuaaa

SEQ ID NO: 3177256 - RNA, 14 nt, Human
gcgucaucuggucc

SEQ ID NO: 3177257 - RNA, 15 nt, Human
gcgucaucugguccu

SEQ ID NO: 3177258 - RNA, 18 nt, Human
gcguauggcuuuauuuuu

SEQ ID NO: 3177259 - RNA, 19 nt, Human
gcguagugcagcagggcag

SEQ ID NO: 3177260 - RNA, 19 nt, Human
gcguaugcaguguagauuu

SEQ ID NO: 3177261 - RNA, 23 nt, Human
gcgugagccacugcaccgggcca

SEQ ID NO: 3177262 - RNA, 21 nt, Human
gcuaaaguaaacaacucaagg

SEQ ID NO: 3177263 - RNA, 22 nt, Human
gcuaaagguuaccgauuucaaa

SEQ ID NO: 3177264 - RNA, 18 nt, Human
gcgugagccacugcaccg

SEQ ID NO: 3177265 - RNA, 16 nt, Human
gcgugagccacugcac

SEQ ID NO: 3177266 - RNA, 21 nt, Human
gcuaagagggagggagggcuc

SEQ ID NO: 3177267 - RNA, 22 nt, Human
gcuaagagggagggagggcucc

SEQ ID NO: 3177268 - RNA, 23 nt, Human
gcuaaauugauguugaugcaauc

SEQ ID NO: 3177269 - RNA, 21 nt, Human
gcuaaauugauguugaugcaa

SEQ ID NO: 3177270 - RNA, 20 nt, Human
gcuaaauugauguugaugca

SEQ ID NO: 3177271 - RNA, 13 nt, Human
gcuaaaugugaau

SEQ ID NO: 3177272 - RNA, 16 nt, Human
gcuaaaugugaaugau

SEQ ID NO: 3177273 - RNA, 18 nt, Human
gcuaaauugauguugaug

SEQ ID NO: 3177274 - RNA, 17 nt, Human
gcuaaauugauguugau

SEQ ID NO: 3177275 - RNA, 17 nt, Human
gcuaagcaaaaugugau

SEQ ID NO: 3177276 - RNA, 23 nt, Human
gcuaagagggagggagggcucca

SEQ ID NO: 3177277 - RNA, 14 nt, Human
gcuacccgggaagg

SEQ ID NO: 3177278 - RNA, 15 nt, Human
gcuacccgggaaggg

SEQ ID NO: 3177279 - RNA, 22 nt, Human
gcuacuaugauuuaauuugaaa

SEQ ID NO: 3177280 - RNA, 20 nt, Human
gcuacuaugauuuaauuuga

SEQ ID NO: 3177281 - RNA, 21 nt, Human
gcuacccgggaagggggcugg

SEQ ID NO: 3177282 - RNA, 16 nt, Human
gcuacccgugagcccu

SEQ ID NO: 3177283 - RNA, 16 nt, Human
gcuacguuuacucaca

SEQ ID NO: 3177284 - RNA, 16 nt, Human
gcuaucucccccagcc

SEQ ID NO: 3177285 - RNA, 19 nt, Human
gcuagcuaagccaagaggc

SEQ ID NO: 3177286 - RNA, 17 nt, Human
gcuaucucccccagccc

SEQ ID NO: 3177287 - RNA, 18 nt, Human
gcuaucucccccagcccc

SEQ ID NO: 3177288 - RNA, 22 nt, Human
gcuagcagcagggagggcuucu

SEQ ID NO: 3177289 - RNA, 19 nt, Human
gcuaucucccccagcccca

SEQ ID NO: 3177290 - RNA, 20 nt, Human
gcuaucucccccagccccau

SEQ ID NO: 3177291 - RNA, 21 nt, Human
gcuaucucccccagccccauc

SEQ ID NO: 3177292 - RNA, 22 nt, Human
gcuaucucccccagccccaucc

SEQ ID NO: 3177293 - RNA, 23 nt, Human
gcuaucucccccagccccauccu

SEQ ID NO: 3177294 - RNA, 15 nt, Human
gcuaucucccccagc

SEQ ID NO: 3177295 - RNA, 13 nt, Human
gcuaucuucaugu

SEQ ID NO: 3177296 - RNA, 14 nt, Human
gcuaucuucaugua

SEQ ID NO: 3177297 - RNA, 15 nt, Human
gcuaucuucauguaa

SEQ ID NO: 3177298 - RNA, 18 nt, Human
gcuaucuucauguaaauu

SEQ ID NO: 3177299 - RNA, 19 nt, Human
gcuaucuucauguaaauug

SEQ ID NO: 3177300 - RNA, 21 nt, Human
gcuaugaagagcuagagaaau

SEQ ID NO: 3177301 - RNA, 22 nt, Human
gcucuuccuggacaggccaggu

SEQ ID NO: 3177302 - RNA, 23 nt, Human
gcucuucuccuuucacaaccuuc

SEQ ID NO: 3177303 - RNA, 16 nt, Human
gcucuucuccaggcug

SEQ ID NO: 3177304 - RNA, 14 nt, Human
gcucuucuccaggc

SEQ ID NO: 3177305 - RNA, 21 nt, Human
gcucuucuccuuucacaaccu

SEQ ID NO: 3177306 - RNA, 17 nt, Human
gcucuucuccuuucaca

SEQ ID NO: 3177307 - RNA, 13 nt, Human
gcucuucuccuuu

SEQ ID NO: 3177308 - RNA, 19 nt, Human
gcucuuccaggcugggaga

SEQ ID NO: 3177309 - RNA, 18 nt, Human
gcucuuccaggcugggag

SEQ ID NO: 3177310 - RNA, 12 nt, Human
gcucuucuccag

SEQ ID NO: 3177311 - RNA, 22 nt, Human
gcucuuccaggcugggagagcc

SEQ ID NO: 3177312 - RNA, 19 nt, Human
gcucuuccuggacaggcca

SEQ ID NO: 3177313 - RNA, 20 nt, Human
gcucuuucccacccagccug

SEQ ID NO: 3177314 - RNA, 20 nt, Human
gcugacagacacaggcccgg

SEQ ID NO: 3177315 - RNA, 22 nt, Human
gcucuuucccacccagccuggg

SEQ ID NO: 3177316 - RNA, 21 nt, Human
gcugacagacacaggcccggc

SEQ ID NO: 3177317 - RNA, 17 nt, Human
gcugacagacagcccuc

SEQ ID NO: 3177318 - RNA, 19 nt, Human
gcugacagcacuaaacuug

SEQ ID NO: 3177319 - RNA, 16 nt, Human
gcugacuacagggccg

SEQ ID NO: 3177320 - RNA, 22 nt, Human
gcugacuauaaugccucuccuu

SEQ ID NO: 3177321 - RNA, 19 nt, Human
gcugacuguacuccuccca

SEQ ID NO: 3177322 - RNA, 18 nt, Human
gcugacuguacuccuccc

SEQ ID NO: 3177323 - RNA, 13 nt, Human
gcugacuccuggu

SEQ ID NO: 3177324 - RNA, 14 nt, Human
gcugacuccugguc

SEQ ID NO: 3177325 - RNA, 15 nt, Human
gcugacuccuggucc

SEQ ID NO: 3177326 - RNA, 16 nt, Human
gcugacuccugguccu

SEQ ID NO: 3177327 - RNA, 17 nt, Human
gcugacuacagggccgc

SEQ ID NO: 3177328 - RNA, 16 nt, Human
gcugacccaugggcag

SEQ ID NO: 3177329 - RNA, 14 nt, Human
gcugacccaugggc

SEQ ID NO: 3177330 - RNA, 21 nt, Human
gcugacccaugggcaggagac

SEQ ID NO: 3177331 - RNA, 20 nt, Human
gcugacccaugggcaggaga

SEQ ID NO: 3177332 - RNA, 19 nt, Human
gcugacccaugggcaggag

SEQ ID NO: 3177333 - RNA, 18 nt, Human
gcugacccaugggcagga

SEQ ID NO: 3177334 - RNA, 18 nt, Human
gcugauggugcaaugacc

SEQ ID NO: 3177335 - RNA, 21 nt, Human
gcugauggugcaaugaccuuu

SEQ ID NO: 3177336 - RNA, 18 nt, Human
gcugcaguugccagucac

SEQ ID NO: 3177337 - RNA, 20 nt, Human
gcugcaguugccagucaccc

SEQ ID NO: 3177338 - RNA, 21 nt, Human
gcugcaguugccagucacccc

SEQ ID NO: 3177339 - RNA, 17 nt, Human
gcugcaguugccaguca

SEQ ID NO: 3177340 - RNA, 19 nt, Human
gcugagucugaaggcuggg

SEQ ID NO: 3177341 - RNA, 22 nt, Human
gcugagugaggaauggcaguga

SEQ ID NO: 3177342 - RNA, 18 nt, Human
gcugagugcaggcccacc

SEQ ID NO: 3177343 - RNA, 16 nt, Human
gcugagugcaggccca

SEQ ID NO: 3177344 - RNA, 15 nt, Human
gcugagugcaggccc

SEQ ID NO: 3177345 - RNA, 14 nt, Human
gcugagugcaggcc

SEQ ID NO: 3177346 - RNA, 16 nt, Human
gcugagucugaaggcu

SEQ ID NO: 3177347 - RNA, 18 nt, Human
gcugagucugaaggcugg

SEQ ID NO: 3177348 - RNA, 15 nt, Human
gcugagucugaaggc

SEQ ID NO: 3177349 - RNA, 15 nt, Human
gcugaguccgaccug

SEQ ID NO: 3177350 - RNA, 16 nt, Human
gcugacugggccaggg

SEQ ID NO: 3177351 - RNA, 21 nt, Human
gcugagucccaggcugagccu

SEQ ID NO: 3177352 - RNA, 22 nt, Human
gcugagucccaggcugagccuc

SEQ ID NO: 3177353 - RNA, 17 nt, Human
gcugagucccaggcuga

SEQ ID NO: 3177354 - RNA, 21 nt, Human
gcugacuguacuccucccagg

SEQ ID NO: 3177355 - RNA, 15 nt, Human
gcugauggugcaaug

SEQ ID NO: 3177356 - RNA, 16 nt, Human
gcugauggugcaauga

SEQ ID NO: 3177357 - RNA, 22 nt, Human
gcugagugggggaucacagccu

SEQ ID NO: 3177358 - RNA, 23 nt, Human
gcugagugcaggcccacccugcu

SEQ ID NO: 3177359 - RNA, 22 nt, Human
gcugagugcaggcccacccugc

SEQ ID NO: 3177360 - RNA, 21 nt, Human
gcugagugcaggcccacccug

SEQ ID NO: 3177361 - RNA, 20 nt, Human
gcugagugcaggcccacccu

SEQ ID NO: 3177362 - RNA, 23 nt, Human
gcugagugggggaucacagccuc

SEQ ID NO: 3177363 - RNA, 14 nt, Human
gcucucuggccuuc

SEQ ID NO: 3177364 - RNA, 15 nt, Human
gcucucuggccuucg

SEQ ID NO: 3177365 - RNA, 19 nt, Human
gcucucuggccuucggccu

SEQ ID NO: 3177366 - RNA, 20 nt, Human
gcucucuggccuucggccuc

SEQ ID NO: 3177367 - RNA, 23 nt, Human
gcucugcccuugguuaggcauug

SEQ ID NO: 3177368 - RNA, 11 nt, Human
gcucugccucc

SEQ ID NO: 3177369 - RNA, 13 nt, Human
gcucugcccuugg

SEQ ID NO: 3177370 - RNA, 14 nt, Human
gcucugcccuuggu

SEQ ID NO: 3177371 - RNA, 13 nt, Human
gcucugccuccca

SEQ ID NO: 3177372 - RNA, 14 nt, Human
gcucugccucccau

SEQ ID NO: 3177373 - RNA, 15 nt, Human
gcucugccucccauc

SEQ ID NO: 3177374 - RNA, 22 nt, Human
gcucugccucccaucacccgcu

SEQ ID NO: 3177375 - RNA, 14 nt, Human
gcucugcuccucuc

SEQ ID NO: 3177376 - RNA, 13 nt, Human
gcucugcuccucu

SEQ ID NO: 3177377 - RNA, 16 nt, Human
gcucugccuuugcucu

SEQ ID NO: 3177378 - RNA, 16 nt, Human
gcucugccugacagag

SEQ ID NO: 3177379 - RNA, 23 nt, Human
gcucugcugacagacacaggccc

SEQ ID NO: 3177380 - RNA, 20 nt, Human
gcucugcugacagacacagg

SEQ ID NO: 3177381 - RNA, 19 nt, Human
gcucugcugacagacacag

SEQ ID NO: 3177382 - RNA, 18 nt, Human
gcucugcugacagacaca

SEQ ID NO: 3177383 - RNA, 14 nt, Human
gcucugcugacaga

SEQ ID NO: 3177384 - RNA, 13 nt, Human
gcucugcugacag

SEQ ID NO: 3177385 - RNA, 21 nt, Human
gcucugcuccucuccccagca

SEQ ID NO: 3177386 - RNA, 19 nt, Human
gcucugcuccucuccccag

SEQ ID NO: 3177387 - RNA, 22 nt, Human
gcucuggacaggcauguucucu

SEQ ID NO: 3177388 - RNA, 21 nt, Human
gcucuggacaggcauguucuc

SEQ ID NO: 3177389 - RNA, 16 nt, Human
gcucuggacaggcaug

SEQ ID NO: 3177390 - RNA, 15 nt, Human
gcucuggacaggcau

SEQ ID NO: 3177391 - RNA, 14 nt, Human
gcucuggacaggca

SEQ ID NO: 3177392 - RNA, 22 nt, Human
gcucugcugaugacccccccag

SEQ ID NO: 3177393 - RNA, 13 nt, Human
gcucugcucgccu

SEQ ID NO: 3177394 - RNA, 22 nt, Human
gcucugcuccccuaaagccuca

SEQ ID NO: 3177395 - RNA, 23 nt, Human
gcucugcugugggcacaggucag

SEQ ID NO: 3177396 - RNA, 12 nt, Human
gcucucuggccu

SEQ ID NO: 3177397 - RNA, 13 nt, Human
gcucucuggccuu

SEQ ID NO: 3177398 - RNA, 11 nt, Human
gcucucuggcc

SEQ ID NO: 3177399 - RNA, 16 nt, Human
gcucucgcggccucuu

SEQ ID NO: 3177400 - RNA, 17 nt, Human
gcucuccgaccagacac

SEQ ID NO: 3177401 - RNA, 13 nt, Human
gcucuccgaccag

SEQ ID NO: 3177402 - RNA, 19 nt, Human
gcucuccgaccagacaccu

SEQ ID NO: 3177403 - RNA, 20 nt, Human
gcucuccuagguagcccccu

SEQ ID NO: 3177404 - RNA, 15 nt, Human
gcucuccucuugcca

SEQ ID NO: 3177405 - RNA, 22 nt, Human
gcucuccucuugccacugccuc

SEQ ID NO: 3177406 - RNA, 19 nt, Human
gcucuccucuugccacugc

SEQ ID NO: 3177407 - RNA, 21 nt, Human
gcuccuucuguccuacucugu

SEQ ID NO: 3177408 - RNA, 15 nt, Human
gcuccuucuguccua

SEQ ID NO: 3177409 - RNA, 13 nt, Human
gcucccugacugg

SEQ ID NO: 3177410 - RNA, 16 nt, Human
gcucccuucccaccuc

SEQ ID NO: 3177411 - RNA, 18 nt, Human
gcucccuucccaccucuc

SEQ ID NO: 3177412 - RNA, 15 nt, Human
gcucccuucccaccu

SEQ ID NO: 3177413 - RNA, 16 nt, Human
gcucgagcaugccugg

SEQ ID NO: 3177414 - RNA, 18 nt, Human
gcuccuuuuccagagcau

SEQ ID NO: 3177415 - RNA, 16 nt, Human
gcccugggaggcagug

SEQ ID NO: 3177416 - RNA, 21 nt, Human
gcccuggugcugccacacuuc

SEQ ID NO: 3177417 - RNA, 17 nt, Human
gcccuggugcugccaca

SEQ ID NO: 3177418 - RNA, 16 nt, Human
gcccuggugcugccac

SEQ ID NO: 3177419 - RNA, 15 nt, Human
gcccuggugcugcca

SEQ ID NO: 3177420 - RNA, 11 nt, Human
gcccugggagg

SEQ ID NO: 3177421 - RNA, 14 nt, Human
gcccugggaggcag

SEQ ID NO: 3177422 - RNA, 19 nt, Human
gcccuggcucccacaggcc

SEQ ID NO: 3177423 - RNA, 15 nt, Human
gcccuggcucccaca

SEQ ID NO: 3177424 - RNA, 20 nt, Human
gcccuggcucccacaggccc

SEQ ID NO: 3177425 - RNA, 15 nt, Human
gcccuggcaggcagg

SEQ ID NO: 3177426 - RNA, 14 nt, Human
gcccuggcaggcag

SEQ ID NO: 3177427 - RNA, 12 nt, Human
gcccuggcagcc

SEQ ID NO: 3177428 - RNA, 16 nt, Human
gcccuggcaggcaggg

SEQ ID NO: 3177429 - RNA, 16 nt, Human
gcccuggcccaucaug

SEQ ID NO: 3177430 - RNA, 16 nt, Human
gcccuggcccccacau

SEQ ID NO: 3177431 - RNA, 13 nt, Human
gcccuggccccca

SEQ ID NO: 3177432 - RNA, 17 nt, Human
gcccuggcccccacaug

SEQ ID NO: 3177433 - RNA, 14 nt, Human
gcccugguuuccug

SEQ ID NO: 3177434 - RNA, 15 nt, Human
gcccugguuuccugc

SEQ ID NO: 3177435 - RNA, 17 nt, Human
gcccugguuuccugccc

SEQ ID NO: 3177436 - RNA, 18 nt, Human
gcccugguuuccugcccu

SEQ ID NO: 3177437 - RNA, 19 nt, Human
gcccugguuuccugcccug

SEQ ID NO: 3177438 - RNA, 20 nt, Human
gcccugguuuccugcccugg

SEQ ID NO: 3177439 - RNA, 21 nt, Human
gcccugguuuccugcccuggg

SEQ ID NO: 3177440 - RNA, 23 nt, Human
gcccugguuuccugcccugggag

SEQ ID NO: 3177441 - RNA, 18 nt, Human
gcccugucaggaggcaga

SEQ ID NO: 3177442 - RNA, 17 nt, Human
gcccugucaggaggcag

SEQ ID NO: 3177443 - RNA, 15 nt, Human
gcccugucaggaggc

SEQ ID NO: 3177444 - RNA, 23 nt, Human
gcccugguggcagugggagcugc

SEQ ID NO: 3177445 - RNA, 22 nt, Human
gcccugguggcagugggagcug

SEQ ID NO: 3177446 - RNA, 21 nt, Human
gcccugguggcagugggagcu

SEQ ID NO: 3177447 - RNA, 20 nt, Human
gcccugguggcagugggagc

SEQ ID NO: 3177448 - RNA, 19 nt, Human
gcccugguggcagugggag

SEQ ID NO: 3177449 - RNA, 18 nt, Human
gcccugguggcaguggga

SEQ ID NO: 3177450 - RNA, 17 nt, Human
gcccugguggcaguggg

SEQ ID NO: 3177451 - RNA, 14 nt, Human
gcccugguggcagu

SEQ ID NO: 3177452 - RNA, 18 nt, Human
gcccuucucuccagcccc

SEQ ID NO: 3177453 - RNA, 19 nt, Human
gcccuucucuccagccccu

SEQ ID NO: 3177454 - RNA, 19 nt, Human
gcccuuccucuccacugcc

SEQ ID NO: 3177455 - RNA, 18 nt, Human
gcccuuccucuccacugc

SEQ ID NO: 3177456 - RNA, 16 nt, Human
gcccuuccucuccacu

SEQ ID NO: 3177457 - RNA, 17 nt, Human
gcccuuccucuccacug

SEQ ID NO: 3177458 - RNA, 21 nt, Human
gcccuucucuccagccccugg

SEQ ID NO: 3177459 - RNA, 22 nt, Human
gcccuucucuccagccccugga

SEQ ID NO: 3177460 - RNA, 20 nt, Human
gcccuuccucuccacugccu

SEQ ID NO: 3177461 - RNA, 23 nt, Human
gcccuuuacuugucuuucugggg

SEQ ID NO: 3177462 - RNA, 21 nt, Human
gcccuuuacuugucuuucugg

SEQ ID NO: 3177463 - RNA, 17 nt, Human
gcccuuuacuugucuuu

SEQ ID NO: 3177464 - RNA, 20 nt, Human
gcccuuuacuugucuuucug

SEQ ID NO: 3177465 - RNA, 18 nt, Human
gccgagauugcaccacug

SEQ ID NO: 3177466 - RNA, 17 nt, Human
gccgagauugcaccacu

SEQ ID NO: 3177467 - RNA, 18 nt, Human
gccgagaucacgccacug

SEQ ID NO: 3177468 - RNA, 16 nt, Human
gccgagaucacgccac

SEQ ID NO: 3177469 - RNA, 22 nt, Human
gcccuuuguccuccugcugcca

SEQ ID NO: 3177470 - RNA, 18 nt, Human
gcccuuuguccuccugcu

SEQ ID NO: 3177471 - RNA, 18 nt, Human
gcccugaguuccuagcca

SEQ ID NO: 3177472 - RNA, 16 nt, Human
gcccugaguuccuagc

SEQ ID NO: 3177473 - RNA, 19 nt, Human
gcccugcuuugggcugccc

SEQ ID NO: 3177474 - RNA, 21 nt, Human
gcccugcuuugggcugcccug

SEQ ID NO: 3177475 - RNA, 20 nt, Human
gcccugcuuugggcugcccu

SEQ ID NO: 3177476 - RNA, 23 nt, Human
gcccugcuuugggcugcccuggu

SEQ ID NO: 3177477 - RNA, 22 nt, Human
gcccugcuuugggcugcccugg

SEQ ID NO: 3177478 - RNA, 20 nt, Human
gcccucucugaaggaggcca

SEQ ID NO: 3177479 - RNA, 23 nt, Human
gcccucucugaaggaggccaccu

SEQ ID NO: 3177480 - RNA, 22 nt, Human
gcccucucugaaggaggccacc

SEQ ID NO: 3177481 - RNA, 12 nt, Human
gcccucugccca

SEQ ID NO: 3177482 - RNA, 16 nt, Human
gcccugagcuuucugc

SEQ ID NO: 3177483 - RNA, 14 nt, Human
gcccugagcuuucu

SEQ ID NO: 3177484 - RNA, 16 nt, Human
gcccugaggaggccuu

SEQ ID NO: 3177485 - RNA, 18 nt, Human
gcccggcuccaggcuccu

SEQ ID NO: 3177486 - RNA, 17 nt, Human
gcccggcuccaggcucc

SEQ ID NO: 3177487 - RNA, 15 nt, Human
gcagacucuacagag

SEQ ID NO: 3177488 - RNA, 23 nt, Human
gccccucccucuccagcaggccc

SEQ ID NO: 3177489 - RNA, 18 nt, Human
gccccuccucucugcccu

SEQ ID NO: 3177490 - RNA, 15 nt, Human
gccccucccuucaac

SEQ ID NO: 3177491 - RNA, 14 nt, Human
gccccucccuucaa

SEQ ID NO: 3177492 - RNA, 12 nt, Human
gccccucccuuc

SEQ ID NO: 3177493 - RNA, 19 nt, Human
gccccuccucucugcccua

SEQ ID NO: 3177494 - RNA, 21 nt, Human
gccccuguucuggcagaguug

SEQ ID NO: 3177495 - RNA, 17 nt, Human
gccccuguucuggcaga

SEQ ID NO: 3177496 - RNA, 15 nt, Human
gccccugccacccug

SEQ ID NO: 3177497 - RNA, 14 nt, Human
gccccugccacccu

SEQ ID NO: 3177498 - RNA, 13 nt, Human
gccccugccaccc

SEQ ID NO: 3177499 - RNA, 20 nt, Human
gccccucuccccgcaguguu

SEQ ID NO: 3177500 - RNA, 16 nt, Human
gcccggcuccaggcuc

SEQ ID NO: 3177501 - RNA, 15 nt, Human
gcccggcuccaggcu

SEQ ID NO: 3177502 - RNA, 19 nt, Human
gcccgacagccuggcacag

SEQ ID NO: 3177503 - RNA, 17 nt, Human
gcccgacagccuggcac

SEQ ID NO: 3177504 - RNA, 16 nt, Human
gcccgacagccuggca

SEQ ID NO: 3177505 - RNA, 12 nt, Human
gccccuuccccc

SEQ ID NO: 3177506 - RNA, 12 nt, Human
gcccgccaccac

SEQ ID NO: 3177507 - RNA, 23 nt, Human
gccuggccagcagguccccagcu

SEQ ID NO: 3177508 - RNA, 22 nt, Human
gccuggccagaugcaccagccc

SEQ ID NO: 3177509 - RNA, 15 nt, Human
gccuggccagaugca

SEQ ID NO: 3177510 - RNA, 14 nt, Human
gccuggccagaugc

SEQ ID NO: 3177511 - RNA, 15 nt, Human
gccugggcagaagga

SEQ ID NO: 3177512 - RNA, 15 nt, Human
gccuggauggggcug

SEQ ID NO: 3177513 - RNA, 14 nt, Human
gccuggauggggcu

SEQ ID NO: 3177514 - RNA, 13 nt, Human
gccuggccacgcc

SEQ ID NO: 3177515 - RNA, 22 nt, Human
gccuggcagccgugccuucagc

SEQ ID NO: 3177516 - RNA, 16 nt, Human
gccugggcagaaggaa

SEQ ID NO: 3177517 - RNA, 17 nt, Human
gccugggcagaaggaag

SEQ ID NO: 3177518 - RNA, 20 nt, Human
gccugggggcugggcagagg

SEQ ID NO: 3177519 - RNA, 18 nt, Human
gccucugccucugacaca

SEQ ID NO: 3177520 - RNA, 12 nt, Human
gccucugccugu

SEQ ID NO: 3177521 - RNA, 22 nt, Human
gccugaagucacacagugaguc

SEQ ID NO: 3177522 - RNA, 19 nt, Human
gccucugcugauccuccca

SEQ ID NO: 3177523 - RNA, 18 nt, Human
gccucugcugauccuccc

SEQ ID NO: 3177524 - RNA, 13 nt, Human
gccucugccuguc

SEQ ID NO: 3177525 - RNA, 16 nt, Human
gccugacagccagaac

SEQ ID NO: 3177526 - RNA, 17 nt, Human
gccugacagccagaacu

SEQ ID NO: 3177527 - RNA, 22 nt, Human
gccugagugagaggggaggcca

SEQ ID NO: 3177528 - RNA, 19 nt, Human
gccugaugaccaauuuuaa

SEQ ID NO: 3177529 - RNA, 16 nt, Human
gccugcuccagcuguu

SEQ ID NO: 3177530 - RNA, 18 nt, Human
gccugcuccagcuguuca

SEQ ID NO: 3177531 - RNA, 17 nt, Human
gccugcuuugucuccuc

SEQ ID NO: 3177532 - RNA, 12 nt, Human
gccugcagagcu

SEQ ID NO: 3177533 - RNA, 15 nt, Human
gccugcuccagcugu

SEQ ID NO: 3177534 - RNA, 16 nt, Human
gccugauuuguuccuu

SEQ ID NO: 3177535 - RNA, 23 nt, Human
gccugcacuugggggcucagcaa

SEQ ID NO: 3177536 - RNA, 22 nt, Human
gccugcacuugggggcucagca

SEQ ID NO: 3177537 - RNA, 21 nt, Human
gccugcacuugggggcucagc

SEQ ID NO: 3177538 - RNA, 19 nt, Human
gccugcacuugggggcuca

SEQ ID NO: 3177539 - RNA, 24 nt, Human
gccucuccgccccugagcccacug

SEQ ID NO: 3177540 - RNA, 14 nt, Human
gccucuccuuaaau

SEQ ID NO: 3177541 - RNA, 23 nt, Human
gccucuccgccccugagcccacu

SEQ ID NO: 3177542 - RNA, 22 nt, Human
gccucuccgccccugagcccac

SEQ ID NO: 3177543 - RNA, 21 nt, Human
gccucuccgccccugagccca

SEQ ID NO: 3177544 - RNA, 20 nt, Human
gccucuccgccccugagccc

SEQ ID NO: 3177545 - RNA, 19 nt, Human
gccucuccgccccugagcc

SEQ ID NO: 3177546 - RNA, 19 nt, Human
gccucacauuuuuuucuac

SEQ ID NO: 3177547 - RNA, 13 nt, Human
gccucuagcugaa

SEQ ID NO: 3177548 - RNA, 11 nt, Human
gccucuagcug

SEQ ID NO: 3177549 - RNA, 22 nt, Human
gccucggauccccuuccuacca

SEQ ID NO: 3177550 - RNA, 18 nt, Human
gccucggauccccuuccu

SEQ ID NO: 3177551 - RNA, 17 nt, Human
gccucggauccccuucc

SEQ ID NO: 3177552 - RNA, 15 nt, Human
gccucggcuggcucc

SEQ ID NO: 3177553 - RNA, 16 nt, Human
gccucggcuggcuccc

SEQ ID NO: 3177554 - RNA, 17 nt, Human
gccucggcuggcucccc

SEQ ID NO: 3177555 - RNA, 18 nt, Human
gccucggcuggcuccccu

SEQ ID NO: 3177556 - RNA, 19 nt, Human
gccucggcuggcuccccug

SEQ ID NO: 3177557 - RNA, 20 nt, Human
gccucggcuggcuccccugc

SEQ ID NO: 3177558 - RNA, 22 nt, Human
gccucggcuggcuccccugcag

SEQ ID NO: 3177559 - RNA, 15 nt, Human
gccucccgaguagcu

SEQ ID NO: 3177560 - RNA, 23 nt, Human
gccucccgaauagcugggacuac

SEQ ID NO: 3177561 - RNA, 20 nt, Human
gccucggacuuagcugggag

SEQ ID NO: 3177562 - RNA, 21 nt, Human
gccucggacuuagcugggaga

SEQ ID NO: 3177563 - RNA, 21 nt, Human
gccucccaacucaccccagcc

SEQ ID NO: 3177564 - RNA, 15 nt, Human
gccucagugccacua

SEQ ID NO: 3177565 - RNA, 14 nt, Human
gccucccacagugc

SEQ ID NO: 3177566 - RNA, 22 nt, Human
gccucccaacucaccccagccc

SEQ ID NO: 3177567 - RNA, 23 nt, Human
gccucccaacucaccccagcccc

SEQ ID NO: 3177568 - RNA, 21 nt, Human
gccucccacgacugcccggca

SEQ ID NO: 3177569 - RNA, 14 nt, Human
gccucccacgacug

SEQ ID NO: 3177570 - RNA, 16 nt, Human
gccucccacagugcug

SEQ ID NO: 3177571 - RNA, 21 nt, Human
gccucccgaauagcugggacu

SEQ ID NO: 3177572 - RNA, 22 nt, Human
gccuauauuuuuuguuaaauga

SEQ ID NO: 3177573 - RNA, 15 nt, Human
gccuauauuuuccug

SEQ ID NO: 3177574 - RNA, 19 nt, Human
gccuauaagccaaaauuaa

SEQ ID NO: 3177575 - RNA, 22 nt, Human
gccuauaagccaaaauuaaggu

SEQ ID NO: 3177576 - RNA, 12 nt, Human
gccuaauaaaac

SEQ ID NO: 3177577 - RNA, 13 nt, Human
gccuaauaaaacu

SEQ ID NO: 3177578 - RNA, 15 nt, Human
gccuaauaaaacuga

SEQ ID NO: 3177579 - RNA, 16 nt, Human
gccuaauaaaacugau

SEQ ID NO: 3177580 - RNA, 17 nt, Human
gccuaauaaaacugaug

SEQ ID NO: 3177581 - RNA, 18 nt, Human
gccuaauaaaacugaugu

SEQ ID NO: 3177582 - RNA, 19 nt, Human
gccuaauaaaacugaugug

SEQ ID NO: 3177583 - RNA, 21 nt, Human
gccuaauaaaacugaugugaa

SEQ ID NO: 3177584 - RNA, 22 nt, Human
gccuaauaaaacugaugugaaa

SEQ ID NO: 3177585 - RNA, 23 nt, Human
gccuaauaaaacugaugugaaac

SEQ ID NO: 3177586 - RNA, 14 nt, Human
gccuaaggcugaac

SEQ ID NO: 3177587 - RNA, 17 nt, Human
gccuaagugcagccccg

SEQ ID NO: 3177588 - RNA, 16 nt, Human
gccuaaggcugaacuu

SEQ ID NO: 3177589 - RNA, 19 nt, Human
gccgagauagccaaggcca

SEQ ID NO: 3177590 - RNA, 21 nt, Human
gccgagcccuugcccaugcug

SEQ ID NO: 3177591 - RNA, 21 nt, Human
gccucaagugauucuccugcc

SEQ ID NO: 3177592 - RNA, 20 nt, Human
gccucaagugauucuccugc

SEQ ID NO: 3177593 - RNA, 19 nt, Human
gccucaagugauucuccug

SEQ ID NO: 3177594 - RNA, 16 nt, Human
gccucaaccuccuggg

SEQ ID NO: 3177595 - RNA, 14 nt, Human
gccucaaccuccug

SEQ ID NO: 3177596 - RNA, 16 nt, Human
gccuauccuaagagcu

SEQ ID NO: 3177597 - RNA, 21 nt, Human
gccucacaguccuuaccagca

SEQ ID NO: 3177598 - RNA, 22 nt, Human
gccucagccucccaaagugcug

SEQ ID NO: 3177599 - RNA, 23 nt, Human
gccucagccucccaaagugcugg

SEQ ID NO: 3177600 - RNA, 14 nt, Human
gccucagccucccg

SEQ ID NO: 3177601 - RNA, 14 nt, Human
gccucagugccacu

SEQ ID NO: 3177602 - RNA, 12 nt, Human
gccucagugcca

SEQ ID NO: 3177603 - RNA, 15 nt, Human
gccucagucucccuc

SEQ ID NO: 3177604 - RNA, 18 nt, Human
gccucagucucccucccu

SEQ ID NO: 3177605 - RNA, 17 nt, Human
gccucagcuuccccagu

SEQ ID NO: 3177606 - RNA, 16 nt, Human
gccucagcuuccccag

SEQ ID NO: 3177607 - RNA, 18 nt, Human
gagaugaugaaaauauuu

SEQ ID NO: 3177608 - RNA, 17 nt, Human
gagaugaggccgccaug

SEQ ID NO: 3177609 - RNA, 17 nt, Human
gagaugagaggggagag

SEQ ID NO: 3177610 - RNA, 16 nt, Human
gagaugaggaguaaaa

SEQ ID NO: 3177611 - RNA, 19 nt, Human
gagaugaggaguaaaauuc

SEQ ID NO: 3177612 - RNA, 20 nt, Human
gagaugaggaguaaaauuca

SEQ ID NO: 3177613 - RNA, 16 nt, Human
gagauagccaaggcca

SEQ ID NO: 3177614 - RNA, 23 nt, Human
gagaucaaccccuucgcuccugu

SEQ ID NO: 3177615 - RNA, 14 nt, Human
gagauagccaaggc

SEQ ID NO: 3177616 - RNA, 23 nt, Human
gagauacuuggucacagccaggc

SEQ ID NO: 3177617 - RNA, 18 nt, Human
gagaucacgccacugcac

SEQ ID NO: 3177618 - RNA, 19 nt, Human
gagaucacgccacugcacu

SEQ ID NO: 3177619 - RNA, 21 nt, Human
gagcaccuuagacagucccug

SEQ ID NO: 3177620 - RNA, 22 nt, Human
gagcaccuuagacagucccugc

SEQ ID NO: 3177621 - RNA, 15 nt, Human
gagcacuaaggugug

SEQ ID NO: 3177622 - RNA, 19 nt, Human
gagcaccuuagacaguccc

SEQ ID NO: 3177623 - RNA, 19 nt, Human
gagcacaacccccagcucc

SEQ ID NO: 3177624 - RNA, 18 nt, Human
gagcacaacccccagcuc

SEQ ID NO: 3177625 - RNA, 21 nt, Human
gagcacuaaggugugcucuga

SEQ ID NO: 3177626 - RNA, 20 nt, Human
gagcaccuuagacagucccu

SEQ ID NO: 3177627 - RNA, 16 nt, Human
gagcacaaaauucaaa

SEQ ID NO: 3177628 - RNA, 21 nt, Human
gagcacaaaauucaaagcaug

SEQ ID NO: 3177629 - RNA, 22 nt, Human
gagcacaaaauucaaagcaugg

SEQ ID NO: 3177630 - RNA, 11 nt, Human
gagcaagagga

SEQ ID NO: 3177631 - RNA, 18 nt, Human
gagcaagggcagggacag

SEQ ID NO: 3177632 - RNA, 21 nt, Human
gagcaaggaagguaaaaaguu

SEQ ID NO: 3177633 - RNA, 23 nt, Human
gagcaagacgcugugcugcccug

SEQ ID NO: 3177634 - RNA, 15 nt, Human
gagcaagagagcagc

SEQ ID NO: 3177635 - RNA, 14 nt, Human
gagcaagagagcag

SEQ ID NO: 3177636 - RNA, 21 nt, Human
gagcaaccccuggaccccagc

SEQ ID NO: 3177637 - RNA, 18 nt, Human
gagcaacaagaaucuaaa

SEQ ID NO: 3177638 - RNA, 22 nt, Human
gagcaaccccuggaccccagcc

SEQ ID NO: 3177639 - RNA, 19 nt, Human
gagccagggucucacuaug

SEQ ID NO: 3177640 - RNA, 23 nt, Human
gagccagauuucacucuccuugg

SEQ ID NO: 3177641 - RNA, 14 nt, Human
gagccagggucuca

SEQ ID NO: 3177642 - RNA, 18 nt, Human
gagcccugguggcagugg

SEQ ID NO: 3177643 - RNA, 21 nt, Human
gagcccaggagucccacucca

SEQ ID NO: 3177644 - RNA, 13 nt, Human
gagcccacugugc

SEQ ID NO: 3177645 - RNA, 18 nt, Human
gagcccagagucccccca

SEQ ID NO: 3177646 - RNA, 16 nt, Human
gagcccagaguccccc

SEQ ID NO: 3177647 - RNA, 19 nt, Human
gagccaauuuaaagaaaac

SEQ ID NO: 3177648 - RNA, 20 nt, Human
gagccagauuucacucuccu

SEQ ID NO: 3177649 - RNA, 15 nt, Human
gagcauuagauuucu

SEQ ID NO: 3177650 - RNA, 21 nt, Human
gagcauuagauuucucauuug

SEQ ID NO: 3177651 - RNA, 13 nt, Human
gagcauuccaguc

SEQ ID NO: 3177652 - RNA, 23 nt, Human
gagcauuauaaucaccagggcca

SEQ ID NO: 3177653 - RNA, 22 nt, Human
gagcauuauaaucaccagggcc

SEQ ID NO: 3177654 - RNA, 21 nt, Human
gagcauuauaaucaccagggc

SEQ ID NO: 3177655 - RNA, 21 nt, Human
gagcauuggggauguuuuucu

SEQ ID NO: 3177656 - RNA, 12 nt, Human
gagcagagacca

SEQ ID NO: 3177657 - RNA, 16 nt, Human
gagcagagaauucucu

SEQ ID NO: 3177658 - RNA, 16 nt, Human
gagcauuacaggcaag

SEQ ID NO: 3177659 - RNA, 15 nt, Human
gagcauuacaggcaa

SEQ ID NO: 3177660 - RNA, 14 nt, Human
gagcauuacaggca

SEQ ID NO: 3177661 - RNA, 17 nt, Human
gagaaugucaguaugug

SEQ ID NO: 3177662 - RNA, 18 nt, Human
gagacagcucugcauacu

SEQ ID NO: 3177663 - RNA, 20 nt, Human
gagacagcucugcauacuca

SEQ ID NO: 3177664 - RNA, 22 nt, Human
gagaaugcacaaacagaggccg

SEQ ID NO: 3177665 - RNA, 23 nt, Human
gagaaugcacaaacagaggccgc

SEQ ID NO: 3177666 - RNA, 22 nt, Human
gagaaugaacaaagaccaauuu

SEQ ID NO: 3177667 - RNA, 17 nt, Human
gagaaugaacaaagacc

SEQ ID NO: 3177668 - RNA, 18 nt, Human
gagaccaucccugaaggc

SEQ ID NO: 3177669 - RNA, 21 nt, Human
gagaccaucccugaaggcccc

SEQ ID NO: 3177670 - RNA, 14 nt, Human
gagaccaucccuga

SEQ ID NO: 3177671 - RNA, 12 nt, Human
gagaccaucccu

SEQ ID NO: 3177672 - RNA, 22 nt, Human
gagacaggguuuugccauguug

SEQ ID NO: 3177673 - RNA, 13 nt, Human
gagacagugaauu

SEQ ID NO: 3177674 - RNA, 16 nt, Human
gagacagugaauuugg

SEQ ID NO: 3177675 - RNA, 20 nt, Human
gagacaggguuucaccaugu

SEQ ID NO: 3177676 - RNA, 20 nt, Human
gagacucgcgacaaugcaaa

SEQ ID NO: 3177677 - RNA, 21 nt, Human
gagacucgcgacaaugcaaac

SEQ ID NO: 3177678 - RNA, 18 nt, Human
gagacucgcgacaaugca

SEQ ID NO: 3177679 - RNA, 20 nt, Human
gagacuccugcaggcagcca

SEQ ID NO: 3177680 - RNA, 21 nt, Human
gagacuccugcaggcagccag

SEQ ID NO: 3177681 - RNA, 19 nt, Human
gagacuccugcaggcagcc

SEQ ID NO: 3177682 - RNA, 18 nt, Human
gagacuccugcaggcagc

SEQ ID NO: 3177683 - RNA, 13 nt, Human
gagaguggcuccu

SEQ ID NO: 3177684 - RNA, 21 nt, Human
gagauacuuggucacagccag

SEQ ID NO: 3177685 - RNA, 13 nt, Human
gagauacucuggg

SEQ ID NO: 3177686 - RNA, 14 nt, Human
gagaguuuagcugu

SEQ ID NO: 3177687 - RNA, 21 nt, Human
gagaguggcuccucccggugc

SEQ ID NO: 3177688 - RNA, 16 nt, Human
gagaguggcuccuccc

SEQ ID NO: 3177689 - RNA, 14 nt, Human
gagagggugggagu

SEQ ID NO: 3177690 - RNA, 16 nt, Human
gagagggugggagugg

SEQ ID NO: 3177691 - RNA, 23 nt, Human
gagagggugaguccuccagaacu

SEQ ID NO: 3177692 - RNA, 13 nt, Human
gagaggggcacag

SEQ ID NO: 3177693 - RNA, 14 nt, Human
gagaggggaggcca

SEQ ID NO: 3177694 - RNA, 18 nt, Human
gagaggggagagcugaac

SEQ ID NO: 3177695 - RNA, 16 nt, Human
gagaggggaggccaag

SEQ ID NO: 3177696 - RNA, 18 nt, Human
gagaggggaacagacugg

SEQ ID NO: 3177697 - RNA, 19 nt, Human
gagaggggaacagacugga

SEQ ID NO: 3177698 - RNA, 13 nt, Human
gagagaaauauuu

SEQ ID NO: 3177699 - RNA, 11 nt, Human
gagagaaauau

SEQ ID NO: 3177700 - RNA, 19 nt, Human
gagagagcuucuguugcug

SEQ ID NO: 3177701 - RNA, 22 nt, Human
gagagagauguguaauuuuucu

SEQ ID NO: 3177702 - RNA, 14 nt, Human
gagagagcagccag

SEQ ID NO: 3177703 - RNA, 15 nt, Human
gagagagauguguaa

SEQ ID NO: 3177704 - RNA, 16 nt, Human
gagagcccuucauuug

SEQ ID NO: 3177705 - RNA, 18 nt, Human
gagagcccuagaaagcug

SEQ ID NO: 3177706 - RNA, 14 nt, Human
gagagcagccagga

SEQ ID NO: 3177707 - RNA, 19 nt, Human
gagagauguguaauuuuuc

SEQ ID NO: 3177708 - RNA, 18 nt, Human
gagagauguguaauuuuu

SEQ ID NO: 3177709 - RNA, 23 nt, Human
gagaaauguguagcugcaaaaau

SEQ ID NO: 3177710 - RNA, 14 nt, Human
gagaaauucuuguu

SEQ ID NO: 3177711 - RNA, 14 nt, Human
gagaaaugagcuug

SEQ ID NO: 3177712 - RNA, 16 nt, Human
gagaaagguugaagca

SEQ ID NO: 3177713 - RNA, 16 nt, Human
gagaaagcauauugac

SEQ ID NO: 3177714 - RNA, 20 nt, Human
gagaaagcauauugacuuuu

SEQ ID NO: 3177715 - RNA, 14 nt, Human
gagaaaagagagaa

SEQ ID NO: 3177716 - RNA, 20 nt, Human
gagaaaagaaaaaaaaagaa

SEQ ID NO: 3177717 - RNA, 19 nt, Human
gagaaaagaaaaaaaaaga

SEQ ID NO: 3177718 - RNA, 15 nt, Human
gagaaaagaaaaaaa

SEQ ID NO: 3177719 - RNA, 14 nt, Human
gagaaaagaaaaaa

SEQ ID NO: 3177720 - RNA, 13 nt, Human
gagaaaagaaaaa

SEQ ID NO: 3177721 - RNA, 12 nt, Human
gagaaaagaaaa

SEQ ID NO: 3177722 - RNA, 11 nt, Human
gagaaaagaaa

SEQ ID NO: 3177723 - RNA, 10 nt, Human
gagaaaagaa

SEQ ID NO: 3177724 - RNA, 22 nt, Human
gagaacuaaacuaguuuuuccu

SEQ ID NO: 3177725 - RNA, 14 nt, Human
gagaagagaaugca

SEQ ID NO: 3177726 - RNA, 16 nt, Human
gagaacuugcugccuc

SEQ ID NO: 3177727 - RNA, 14 nt, Human
gagaacuugcugcc

SEQ ID NO: 3177728 - RNA, 11 nt, Human
gagaagaaaau

SEQ ID NO: 3177729 - RNA, 21 nt, Human
gagaagagccccacucucaga

SEQ ID NO: 3177730 - RNA, 16 nt, Human
gagaagagaaugcaca

SEQ ID NO: 3177731 - RNA, 18 nt, Human
gagaagaaaauguucuuc

SEQ ID NO: 3177732 - RNA, 16 nt, Human
gagaagcagaggaagg

SEQ ID NO: 3177733 - RNA, 15 nt, Human
gagaagagccccacu

SEQ ID NO: 3177734 - RNA, 11 nt, Human
gagaagagccc

SEQ ID NO: 3177735 - RNA, 23 nt, Human
gacuucugucuucacaacagauu

SEQ ID NO: 3177736 - RNA, 20 nt, Human
gacuucugucuucacaacag

SEQ ID NO: 3177737 - RNA, 24 nt, Human
gacuucuaaguaaaaccacagcag

SEQ ID NO: 3177738 - RNA, 23 nt, Human
gacuucuaaguaaaaccacagca

SEQ ID NO: 3177739 - RNA, 19 nt, Human
gacuucuaaguaaaaccac

SEQ ID NO: 3177740 - RNA, 16 nt, Human
gacuucuaaguaaaac

SEQ ID NO: 3177741 - RNA, 18 nt, Human
gacuucuaaguaaaacca

SEQ ID NO: 3177742 - RNA, 17 nt, Human
gacuucuaaguaaaacc

SEQ ID NO: 3177743 - RNA, 19 nt, Human
gacuuaagcacacuugaca

SEQ ID NO: 3177744 - RNA, 21 nt, Human
gacuuaacauagccaaaaugu

SEQ ID NO: 3177745 - RNA, 23 nt, Human
gacuuaacauagccaaaauguga

SEQ ID NO: 3177746 - RNA, 19 nt, Human
gacuuaaaauauuccugca

SEQ ID NO: 3177747 - RNA, 17 nt, Human
gacuuaacauagccaaa

SEQ ID NO: 3177748 - RNA, 23 nt, Human
gacuuaaagggcccaaugaauua

SEQ ID NO: 3177749 - RNA, 23 nt, Human
gacuucuguuuucaaucucguau

SEQ ID NO: 3177750 - RNA, 18 nt, Human
gacuucuguuuucaaucu

SEQ ID NO: 3177751 - RNA, 14 nt, Human
gacuucuguuuuca

SEQ ID NO: 3177752 - RNA, 17 nt, Human
gacuucuguuuucaauc

SEQ ID NO: 3177753 - RNA, 16 nt, Human
gacuucuguuuucaau

SEQ ID NO: 3177754 - RNA, 11 nt, Human
gacuugaaaag

SEQ ID NO: 3177755 - RNA, 17 nt, Human
gacuugaaaagagacag

SEQ ID NO: 3177756 - RNA, 21 nt, Human
gacuugaaaagagacaggcag

SEQ ID NO: 3177757 - RNA, 22 nt, Human
gacuugaaaagagacaggcagg

SEQ ID NO: 3177758 - RNA, 13 nt, Human
gacuugcauuuuu

SEQ ID NO: 3177759 - RNA, 15 nt, Human
gacuugcauuuuugc

SEQ ID NO: 3177760 - RNA, 18 nt, Human
gacuuguauauucuauuu

SEQ ID NO: 3177761 - RNA, 21 nt, Human
gacuuguauauucuauuuuac

SEQ ID NO: 3177762 - RNA, 9 nt, Human
gagaaaaga

SEQ ID NO: 3177763 - RNA, 19 nt, Human
gacucuaguacugugaauc

SEQ ID NO: 3177764 - RNA, 18 nt, Human
gacucuaguacugugaau

SEQ ID NO: 3177765 - RNA, 17 nt, Human
gacucgcgacaaugcaa

SEQ ID NO: 3177766 - RNA, 23 nt, Human
gacucuaguacugugaauccagu

SEQ ID NO: 3177767 - RNA, 14 nt, Human
gacucuaguauuua

SEQ ID NO: 3177768 - RNA, 15 nt, Human
gacugcccggcaggg

SEQ ID NO: 3177769 - RNA, 13 nt, Human
gacugcccggcag

SEQ ID NO: 3177770 - RNA, 18 nt, Human
gacuggaagcacagcuuc

SEQ ID NO: 3177771 - RNA, 23 nt, Human
gacugggggcagacauggugggg

SEQ ID NO: 3177772 - RNA, 16 nt, Human
gacugggggcagacau

SEQ ID NO: 3177773 - RNA, 16 nt, Human
gacugggccaggggag

SEQ ID NO: 3177774 - RNA, 16 nt, Human
gacuggaagcacagcu

SEQ ID NO: 3177775 - RNA, 15 nt, Human
gacuggaagcacagc

SEQ ID NO: 3177776 - RNA, 14 nt, Human
gacuggaagcacag

SEQ ID NO: 3177777 - RNA, 22 nt, Human
gacugcuccugagcccccagcu

SEQ ID NO: 3177778 - RNA, 15 nt, Human
gacucauucuucugu

SEQ ID NO: 3177779 - RNA, 14 nt, Human
gacucauucuucug

SEQ ID NO: 3177780 - RNA, 21 nt, Human
gacuacaggugugagucacca

SEQ ID NO: 3177781 - RNA, 18 nt, Human
gacuacaggugugaguca

SEQ ID NO: 3177782 - RNA, 22 nt, Human
gaccucaaaugaugugccugcu

SEQ ID NO: 3177783 - RNA, 13 nt, Human
gacuacaggugug

SEQ ID NO: 3177784 - RNA, 16 nt, Human
gaccucaaaugaugug

SEQ ID NO: 3177785 - RNA, 16 nt, Human
gacuccaaagaaaugu

SEQ ID NO: 3177786 - RNA, 15 nt, Human
gacuccaaagaaaug

SEQ ID NO: 3177787 - RNA, 12 nt, Human
gacuccaaagaa

SEQ ID NO: 3177788 - RNA, 11 nt, Human
gacuccaaaga

SEQ ID NO: 3177789 - RNA, 21 nt, Human
gacucauuuuaaaaaauggaa

SEQ ID NO: 3177790 - RNA, 12 nt, Human
gacuccugcagg

SEQ ID NO: 3177791 - RNA, 14 nt, Human
gacuccucugucca

SEQ ID NO: 3177792 - RNA, 11 nt, Human
gacuccucugu

SEQ ID NO: 3177793 - RNA, 13 nt, Human
gacuccugcaggc

SEQ ID NO: 3177794 - RNA, 21 nt, Human
gacuccugcaggcagccaggc

SEQ ID NO: 3177795 - RNA, 23 nt, Human
gacuccugcacacgcuccuuccu

SEQ ID NO: 3177796 - RNA, 13 nt, Human
gacucgcgacaau

SEQ ID NO: 3177797 - RNA, 13 nt, Human
gacuccugguccu

SEQ ID NO: 3177798 - RNA, 18 nt, Human
gaaucuagccagugaaca

SEQ ID NO: 3177799 - RNA, 14 nt, Human
gaaucuacuuaacc

SEQ ID NO: 3177800 - RNA, 17 nt, Human
gaaucuagccagugaac

SEQ ID NO: 3177801 - RNA, 20 nt, Human
gaauccagacccggcugcgu

SEQ ID NO: 3177802 - RNA, 18 nt, Human
gaauccagacccggcugc

SEQ ID NO: 3177803 - RNA, 18 nt, Human
gaaucaguccuagaaugu

SEQ ID NO: 3177804 - RNA, 20 nt, Human
gaaucaguccuagaauguuu

SEQ ID NO: 3177805 - RNA, 17 nt, Human
gaaucauguuucuuuga

SEQ ID NO: 3177806 - RNA, 15 nt, Human
gaaucauguuucuuu

SEQ ID NO: 3177807 - RNA, 14 nt, Human
gaaucauguuucuu

SEQ ID NO: 3177808 - RNA, 13 nt, Human
gaaucauguuucu

SEQ ID NO: 3177809 - RNA, 21 nt, Human
gaaucaugugcgucaguccaa

SEQ ID NO: 3177810 - RNA, 16 nt, Human
gaaugaacaaagacca

SEQ ID NO: 3177811 - RNA, 20 nt, Human
gaaugcacaaacagaggccg

SEQ ID NO: 3177812 - RNA, 23 nt, Human
gaaucuggaccccaucugugaau

SEQ ID NO: 3177813 - RNA, 22 nt, Human
gaaucuggaccccaucugugaa

SEQ ID NO: 3177814 - RNA, 21 nt, Human
gaaugaaagggcccagagagg

SEQ ID NO: 3177815 - RNA, 23 nt, Human
gaaucugagagaugcuguagaca

SEQ ID NO: 3177816 - RNA, 21 nt, Human
gaaucuggaccccaucuguga

SEQ ID NO: 3177817 - RNA, 15 nt, Human
gaaugcuguauaugu

SEQ ID NO: 3177818 - RNA, 20 nt, Human
gaaugcacucagacuguaua

SEQ ID NO: 3177819 - RNA, 13 nt, Human
gaaugcacucaga

SEQ ID NO: 3177820 - RNA, 21 nt, Human
gaaugcaccauacucaugcau

SEQ ID NO: 3177821 - RNA, 21 nt, Human
gaaugcacaaacagaggccgc

SEQ ID NO: 3177822 - RNA, 13 nt, Human
gaauggcauuugc

SEQ ID NO: 3177823 - RNA, 16 nt, Human
gaaugucaguaugugg

SEQ ID NO: 3177824 - RNA, 18 nt, Human
gaaugucaguauguggaa

SEQ ID NO: 3177825 - RNA, 13 nt, Human
gaaugucaguaug

SEQ ID NO: 3177826 - RNA, 22 nt, Human
gaauguauaguauuugaaaaca

SEQ ID NO: 3177827 - RNA, 19 nt, Human
gaauguauaguauuugaaa

SEQ ID NO: 3177828 - RNA, 17 nt, Human
gaauguauaguauuuga

SEQ ID NO: 3177829 - RNA, 15 nt, Human
gaauguauaguauuu

SEQ ID NO: 3177830 - RNA, 22 nt, Human
gaauguaguuugaggaaauuug

SEQ ID NO: 3177831 - RNA, 17 nt, Human
gaauguaguuugaggaa

SEQ ID NO: 3177832 - RNA, 16 nt, Human
gaauguaguuugagga

SEQ ID NO: 3177833 - RNA, 14 nt, Human
gaauguaguuugag

SEQ ID NO: 3177834 - RNA, 22 nt, Human
gaauguaagguauaucauucua

SEQ ID NO: 3177835 - RNA, 18 nt, Human
gaauggcauuugcaauaa

SEQ ID NO: 3177836 - RNA, 19 nt, Human
gaaugucaguauguggaag

SEQ ID NO: 3177837 - RNA, 20 nt, Human
gaauguugcaaugugaaaaa

SEQ ID NO: 3177838 - RNA, 22 nt, Human
gaauguuccugccuccuugaua

SEQ ID NO: 3177839 - RNA, 21 nt, Human
gaauguuccugccuccuugau

SEQ ID NO: 3177840 - RNA, 15 nt, Human
gaauguuucauuugc

SEQ ID NO: 3177841 - RNA, 22 nt, Human
gaauguuucauuugcacaagua

SEQ ID NO: 3177842 - RNA, 14 nt, Human
gaauugaagcagga

SEQ ID NO: 3177843 - RNA, 11 nt, Human
gaauugaaggu

SEQ ID NO: 3177844 - RNA, 16 nt, Human
gaauugacccacaaga

SEQ ID NO: 3177845 - RNA, 21 nt, Human
gaauugacccacaagaaauga

SEQ ID NO: 3177846 - RNA, 15 nt, Human
gaauugccagucuuu

SEQ ID NO: 3177847 - RNA, 18 nt, Human
gaauugccagucuuuugu

SEQ ID NO: 3177848 - RNA, 21 nt, Human
gaauugcccauuguuuuucug

SEQ ID NO: 3177849 - RNA, 20 nt, Human
gaauugcccauuguuuuucu

SEQ ID NO: 3177850 - RNA, 18 nt, Human
gaauugaagguuuuugau

SEQ ID NO: 3177851 - RNA, 21 nt, Human
gaauugaccgacagcuuucca

SEQ ID NO: 3177852 - RNA, 23 nt, Human
gaauugauuuugaggagugguuu

SEQ ID NO: 3177853 - RNA, 19 nt, Human
gacacaggcccggcuccag

SEQ ID NO: 3177854 - RNA, 16 nt, Human
gacacaagccuucggc

SEQ ID NO: 3177855 - RNA, 15 nt, Human
gacacaaacugccaa

SEQ ID NO: 3177856 - RNA, 21 nt, Human
gacacaggcccggcuccaggc

SEQ ID NO: 3177857 - RNA, 20 nt, Human
gacacaggcccggcuccagg

SEQ ID NO: 3177858 - RNA, 22 nt, Human
gacacaacugugugauuaaaag

SEQ ID NO: 3177859 - RNA, 15 nt, Human
gacacauguccaaga

SEQ ID NO: 3177860 - RNA, 20 nt, Human
gacacauguccaagaagccc

SEQ ID NO: 3177861 - RNA, 23 nt, Human
gacacauguccaagaagcccagg

SEQ ID NO: 3177862 - RNA, 23 nt, Human
gacacauuuaagguguaguauua

SEQ ID NO: 3177863 - RNA, 22 nt, Human
gacaagcuguugaccaggcacc

SEQ ID NO: 3177864 - RNA, 21 nt, Human
gacaagcuguugaccaggcac

SEQ ID NO: 3177865 - RNA, 14 nt, Human
gacaagcuggcuua

SEQ ID NO: 3177866 - RNA, 20 nt, Human
gacaagcuggcuuacacugg

SEQ ID NO: 3177867 - RNA, 20 nt, Human
gacaagcuguugaccaggca

SEQ ID NO: 3177868 - RNA, 19 nt, Human
gacaaggauugcuacuguc

SEQ ID NO: 3177869 - RNA, 21 nt, Human
gacaaggaugaucuaggaaga

SEQ ID NO: 3177870 - RNA, 18 nt, Human
gacaaggauugcuacugu

SEQ ID NO: 3177871 - RNA, 12 nt, Human
gacaaugugaaa

SEQ ID NO: 3177872 - RNA, 18 nt, Human
gacaaugugaaaagaaaa

SEQ ID NO: 3177873 - RNA, 22 nt, Human
gacaaugcaaaccaucauugaa

SEQ ID NO: 3177874 - RNA, 19 nt, Human
gacaaugugaaaagaaaaa

SEQ ID NO: 3177875 - RNA, 20 nt, Human
gacaaugugaaaagaaaaau

SEQ ID NO: 3177876 - RNA, 12 nt, Human
gacaauguuuac

SEQ ID NO: 3177877 - RNA, 13 nt, Human
gacaauguuuaca

SEQ ID NO: 3177878 - RNA, 20 nt, Human
gaauuggguggggggcuuca

SEQ ID NO: 3177879 - RNA, 23 nt, Human
gaauuggguggggggcuucauac

SEQ ID NO: 3177880 - RNA, 22 nt, Human
gaauuggguggggggcuucaua

SEQ ID NO: 3177881 - RNA, 23 nt, Human
gaauuguaaaagcaacaucagcu

SEQ ID NO: 3177882 - RNA, 19 nt, Human
gaauuggaaugcacucaga

SEQ ID NO: 3177883 - RNA, 21 nt, Human
gaauuucuucaacucccugcc

SEQ ID NO: 3177884 - RNA, 15 nt, Human
gaauuugaagacuuc

SEQ ID NO: 3177885 - RNA, 21 nt, Human
gaauuugaagacuucaaaaua

SEQ ID NO: 3177886 - RNA, 17 nt, Human
gaauuugugaacagcag

SEQ ID NO: 3177887 - RNA, 20 nt, Human
gacaaccuuggcuuggcccu

SEQ ID NO: 3177888 - RNA, 22 nt, Human
gacaaccuuggcuuggcccugg

SEQ ID NO: 3177889 - RNA, 14 nt, Human
gacaacauuguaag

SEQ ID NO: 3177890 - RNA, 16 nt, Human
gacaacagacuucuga

SEQ ID NO: 3177891 - RNA, 19 nt, Human
gacaacagauuggauuuua

SEQ ID NO: 3177892 - RNA, 15 nt, Human
gacaaccauuaaagu

SEQ ID NO: 3177893 - RNA, 16 nt, Human
gacaaccauuaaaguc

SEQ ID NO: 3177894 - RNA, 18 nt, Human
gacaaccauuaaagucag

SEQ ID NO: 3177895 - RNA, 19 nt, Human
gacaaccauuaaagucaga

SEQ ID NO: 3177896 - RNA, 22 nt, Human
gacaacacucauugaccugagg

SEQ ID NO: 3177897 - RNA, 23 nt, Human
gacaacacucauugaccugaggc

SEQ ID NO: 3177898 - RNA, 14 nt, Human
gacaaauuuuaauu

SEQ ID NO: 3177899 - RNA, 14 nt, Human
gacaaauguuucua

SEQ ID NO: 3177900 - RNA, 15 nt, Human
gacaaaucugucugc

SEQ ID NO: 3177901 - RNA, 14 nt, Human
gacaaaucugucug

SEQ ID NO: 3177902 - RNA, 19 nt, Human
gaccauucuccaccugcca

SEQ ID NO: 3177903 - RNA, 20 nt, Human
gaccauucuccaccugccag

SEQ ID NO: 3177904 - RNA, 21 nt, Human
gaccauucuccaccugccagg

SEQ ID NO: 3177905 - RNA, 22 nt, Human
gaccauucuccaccugccaggg

SEQ ID NO: 3177906 - RNA, 17 nt, Human
gaccauucuccaccugc

SEQ ID NO: 3177907 - RNA, 19 nt, Human
gaccauuuuccugcauugg

SEQ ID NO: 3177908 - RNA, 14 nt, Human
gaccauuuuccugc

SEQ ID NO: 3177909 - RNA, 13 nt, Human
gaccauuuuccug

SEQ ID NO: 3177910 - RNA, 11 nt, Human
gaccauuuucc

SEQ ID NO: 3177911 - RNA, 13 nt, Human
gaccagagcugcc

SEQ ID NO: 3177912 - RNA, 14 nt, Human
gaccagagcugcca

SEQ ID NO: 3177913 - RNA, 15 nt, Human
gaccagagcugccac

SEQ ID NO: 3177914 - RNA, 17 nt, Human
gaccagagcugccaccu

SEQ ID NO: 3177915 - RNA, 18 nt, Human
gaccagagcugccaccug

SEQ ID NO: 3177916 - RNA, 20 nt, Human
gaccagccuccaugcugccu

SEQ ID NO: 3177917 - RNA, 17 nt, Human
gaccagacaagcuguug

SEQ ID NO: 3177918 - RNA, 22 nt, Human
gaccagccuccaugcugccucc

SEQ ID NO: 3177919 - RNA, 21 nt, Human
gaccagccuccaugcugccuc

SEQ ID NO: 3177920 - RNA, 18 nt, Human
gacaugggaaaggggaag

SEQ ID NO: 3177921 - RNA, 14 nt, Human
gaccaccugcccaa

SEQ ID NO: 3177922 - RNA, 13 nt, Human
gaccaccugccca

SEQ ID NO: 3177923 - RNA, 21 nt, Human
gaccacugcagaagacaguau

SEQ ID NO: 3177924 - RNA, 18 nt, Human
gaccacugcagaagacag

SEQ ID NO: 3177925 - RNA, 11 nt, Human
gaccagagcug

SEQ ID NO: 3177926 - RNA, 24 nt, Human
gaccagacaccuugacagggcaca

SEQ ID NO: 3177927 - RNA, 19 nt, Human
gaccacgucuauuucauca

SEQ ID NO: 3177928 - RNA, 20 nt, Human
gacccaaaaggcagaagcaa

SEQ ID NO: 3177929 - RNA, 16 nt, Human
gacccaaaaggcagaa

SEQ ID NO: 3177930 - RNA, 15 nt, Human
gacccacaagaaaug

SEQ ID NO: 3177931 - RNA, 21 nt, Human
gacccccaaccaaguggcucc

SEQ ID NO: 3177932 - RNA, 12 nt, Human
gacccccaacca

SEQ ID NO: 3177933 - RNA, 22 nt, Human
gacccugaggcccagagggccu

SEQ ID NO: 3177934 - RNA, 21 nt, Human
gaccccuccaugugggcuagu

SEQ ID NO: 3177935 - RNA, 18 nt, Human
gaccccuccaugugggcu

SEQ ID NO: 3177936 - RNA, 14 nt, Human
gaccccuccaugug

SEQ ID NO: 3177937 - RNA, 23 nt, Human
gacccugaggcccagagggccug

SEQ ID NO: 3177938 - RNA, 13 nt, Human
gaccccuccaugu

SEQ ID NO: 3177939 - RNA, 23 nt, Human
gacccugccaggcacaggcaggg

SEQ ID NO: 3177940 - RNA, 22 nt, Human
gacccugccaggcacaggcagg

SEQ ID NO: 3177941 - RNA, 21 nt, Human
gacccugccaggcacaggcag

SEQ ID NO: 3177942 - RNA, 20 nt, Human
gacccugccaggcacaggca

SEQ ID NO: 3177943 - RNA, 19 nt, Human
gacccugccaggcacaggc

SEQ ID NO: 3177944 - RNA, 18 nt, Human
gacccugccaggcacagg

SEQ ID NO: 3177945 - RNA, 17 nt, Human
gacccugccaggcacag

SEQ ID NO: 3177946 - RNA, 16 nt, Human
gacccugccaggcaca

SEQ ID NO: 3177947 - RNA, 15 nt, Human
gacccugccaggcac

SEQ ID NO: 3177948 - RNA, 14 nt, Human
gacccugccaggca

SEQ ID NO: 3177949 - RNA, 13 nt, Human
gacccugccaggc

SEQ ID NO: 3177950 - RNA, 12 nt, Human
gacccugccagg

SEQ ID NO: 3177951 - RNA, 15 nt, Human
gaccgugaggccaga

SEQ ID NO: 3177952 - RNA, 19 nt, Human
gaccgaacuguuguauaaa

SEQ ID NO: 3177953 - RNA, 18 nt, Human
gaccgugaggccagagac

SEQ ID NO: 3177954 - RNA, 17 nt, Human
gaccuacuacgcagagg

SEQ ID NO: 3177955 - RNA, 16 nt, Human
gaccgugaggccagag

SEQ ID NO: 3177956 - RNA, 17 nt, Human
gaccgugaggccagaga

SEQ ID NO: 3177957 - RNA, 15 nt, Human
gacccuugugguccc

SEQ ID NO: 3177958 - RNA, 21 nt, Human
gacccuuguggucccacccca

SEQ ID NO: 3177959 - RNA, 19 nt, Human
gacccuuguggucccaccc

SEQ ID NO: 3177960 - RNA, 20 nt, Human
gacccuuguggucccacccc

SEQ ID NO: 3177961 - RNA, 12 nt, Human
gacccugucuca

SEQ ID NO: 3177962 - RNA, 23 nt, Human
gacaccauuaccaaaauaauaaa

SEQ ID NO: 3177963 - RNA, 12 nt, Human
gacacccagaaa

SEQ ID NO: 3177964 - RNA, 21 nt, Human
gacagagagagauacucuggg

SEQ ID NO: 3177965 - RNA, 11 nt, Human
gacaccccacu

SEQ ID NO: 3177966 - RNA, 21 nt, Human
gacagagcaagugagacccug

SEQ ID NO: 3177967 - RNA, 16 nt, Human
gacagaggcagcccca

SEQ ID NO: 3177968 - RNA, 14 nt, Human
gacagaggcagccc

SEQ ID NO: 3177969 - RNA, 12 nt, Human
gacagaggcagc

SEQ ID NO: 3177970 - RNA, 20 nt, Human
gacagagcaaccccuggacc

SEQ ID NO: 3177971 - RNA, 21 nt, Human
gacagaggggguggccuccca

SEQ ID NO: 3177972 - RNA, 22 nt, Human
gacagaggggguggccucccaa

SEQ ID NO: 3177973 - RNA, 19 nt, Human
gacagagugagacucuguc

SEQ ID NO: 3177974 - RNA, 23 nt, Human
gacagaggggguggccucccaac

SEQ ID NO: 3177975 - RNA, 18 nt, Human
gacagaggggguggccuc

SEQ ID NO: 3177976 - RNA, 19 nt, Human
gacagaggggguggccucc

SEQ ID NO: 3177977 - RNA, 15 nt, Human
gacagaggggguggc

SEQ ID NO: 3177978 - RNA, 17 nt, Human
gacagaggcagccccau

SEQ ID NO: 3177979 - RNA, 16 nt, Human
gacagcugccugggau

SEQ ID NO: 3177980 - RNA, 17 nt, Human
gacagcugccugggauc

SEQ ID NO: 3177981 - RNA, 21 nt, Human
gacagccacggccaggccaga

SEQ ID NO: 3177982 - RNA, 20 nt, Human
gacagccacggccaggccag

SEQ ID NO: 3177983 - RNA, 18 nt, Human
gacagcugccugggaucc

SEQ ID NO: 3177984 - RNA, 13 nt, Human
gacagccagaacu

SEQ ID NO: 3177985 - RNA, 19 nt, Human
gacagccacggccaggcca

SEQ ID NO: 3177986 - RNA, 18 nt, Human
gacagccacggccaggcc

SEQ ID NO: 3177987 - RNA, 17 nt, Human
gacagccacggccaggc

SEQ ID NO: 3177988 - RNA, 14 nt, Human
gacagccacggcca

SEQ ID NO: 3177989 - RNA, 22 nt, Human
gacagagugagacucugucuca

SEQ ID NO: 3177990 - RNA, 20 nt, Human
gacagagugagacucugucu

SEQ ID NO: 3177991 - RNA, 13 nt, Human
gacagagggggug

SEQ ID NO: 3177992 - RNA, 13 nt, Human
gacagccacggcc

SEQ ID NO: 3177993 - RNA, 23 nt, Human
gacagggcacaccgggcacucag

SEQ ID NO: 3177994 - RNA, 18 nt, Human
gacagggaggacgcucuc

SEQ ID NO: 3177995 - RNA, 16 nt, Human
gacagggaggugaccc

SEQ ID NO: 3177996 - RNA, 24 nt, Human
gacagggcacaccgggcacucaga

SEQ ID NO: 3177997 - RNA, 14 nt, Human
gacaguuaagagaa

SEQ ID NO: 3177998 - RNA, 17 nt, Human
gacagggaggacgcucu

SEQ ID NO: 3177999 - RNA, 21 nt, Human
gacaggaccccugcaguuccc

SEQ ID NO: 3178000 - RNA, 17 nt, Human
gacaggaccccugcagu

SEQ ID NO: 3178001 - RNA, 14 nt, Human
gacaggaccccugc

SEQ ID NO: 3178002 - RNA, 15 nt, Human
gacaggaccagggau

SEQ ID NO: 3178003 - RNA, 23 nt, Human
gacaggaccagggauuuccauga

SEQ ID NO: 3178004 - RNA, 14 nt, Human
gacaggaccaggga

SEQ ID NO: 3178005 - RNA, 20 nt, Human
gacauagaauuaacacauga

SEQ ID NO: 3178006 - RNA, 18 nt, Human
gacauccccugcuggccg

SEQ ID NO: 3178007 - RNA, 17 nt, Human
gacauccccugcuggcc

SEQ ID NO: 3178008 - RNA, 24 nt, Human
gacauccugucaucugagaaugaa

SEQ ID NO: 3178009 - RNA, 23 nt, Human
gacauccugucaucugagaauga

SEQ ID NO: 3178010 - RNA, 21 nt, Human
gacauccugucaucugagaau

SEQ ID NO: 3178011 - RNA, 20 nt, Human
gacauccugucaucugagaa

SEQ ID NO: 3178012 - RNA, 14 nt, Human
gacaugggaaaggg

SEQ ID NO: 3178013 - RNA, 14 nt, Human
gacaugaucuucuu

SEQ ID NO: 3178014 - RNA, 16 nt, Human
gacaucucugacuuuc

SEQ ID NO: 3178015 - RNA, 15 nt, Human
gauaugaaaaaugag

SEQ ID NO: 3178016 - RNA, 12 nt, Human
gaucacaaauga

SEQ ID NO: 3178017 - RNA, 13 nt, Human
gaucacaaaugac

SEQ ID NO: 3178018 - RNA, 16 nt, Human
gaucacaaaugacuuu

SEQ ID NO: 3178019 - RNA, 20 nt, Human
gaucacaaaugacuuuauua

SEQ ID NO: 3178020 - RNA, 16 nt, Human
gaucacggcucacugc

SEQ ID NO: 3178021 - RNA, 15 nt, Human
gaucacggcucacug

SEQ ID NO: 3178022 - RNA, 18 nt, Human
gaucacggcucacugcag

SEQ ID NO: 3178023 - RNA, 12 nt, Human
gaucacggcuca

SEQ ID NO: 3178024 - RNA, 14 nt, Human
gaucacuuucugaa

SEQ ID NO: 3178025 - RNA, 14 nt, Human
gaucacuguuuaga

SEQ ID NO: 3178026 - RNA, 18 nt, Human
gaucacuguuuagauuug

SEQ ID NO: 3178027 - RNA, 21 nt, Human
gaucacuguuuagauuugcca

SEQ ID NO: 3178028 - RNA, 14 nt, Human
gauagaugugugga

SEQ ID NO: 3178029 - RNA, 19 nt, Human
gauacaggaaaagcugcug

SEQ ID NO: 3178030 - RNA, 22 nt, Human
gauagauguguggacacauugg

SEQ ID NO: 3178031 - RNA, 21 nt, Human
gauacaggaaaagcugcugac

SEQ ID NO: 3178032 - RNA, 22 nt, Human
gauaagaaccuuuugagugccu

SEQ ID NO: 3178033 - RNA, 20 nt, Human
gauacaggaaaagcugcuga

SEQ ID NO: 3178034 - RNA, 11 nt, Human
gauaagaaaac

SEQ ID NO: 3178035 - RNA, 12 nt, Human
gauaagaaaacc

SEQ ID NO: 3178036 - RNA, 22 nt, Human
gauagccaaggccaaaggaagc

SEQ ID NO: 3178037 - RNA, 14 nt, Human
gauagccaaggcca

SEQ ID NO: 3178038 - RNA, 15 nt, Human
gauagcacagacccu

SEQ ID NO: 3178039 - RNA, 16 nt, Human
gauauaacuuuagaaa

SEQ ID NO: 3178040 - RNA, 21 nt, Human
gagugguuuuucuuuucuugg

SEQ ID NO: 3178041 - RNA, 23 nt, Human
gagugggggaucacagccucuga

SEQ ID NO: 3178042 - RNA, 13 nt, Human
gagugggugaaua

SEQ ID NO: 3178043 - RNA, 13 nt, Human
gaguguguaauuu

SEQ ID NO: 3178044 - RNA, 19 nt, Human
gagugugguuucuuuuuga

SEQ ID NO: 3178045 - RNA, 15 nt, Human
gagugugguuucuuu

SEQ ID NO: 3178046 - RNA, 17 nt, Human
gagugugccugaagucc

SEQ ID NO: 3178047 - RNA, 20 nt, Human
gagugugccugaagucccag

SEQ ID NO: 3178048 - RNA, 13 nt, Human
gaguuaaaaugca

SEQ ID NO: 3178049 - RNA, 12 nt, Human
gaguuacagaca

SEQ ID NO: 3178050 - RNA, 13 nt, Human
gaguuaagucuau

SEQ ID NO: 3178051 - RNA, 15 nt, Human
gaguuacagccuggg

SEQ ID NO: 3178052 - RNA, 13 nt, Human
gaguuacagacaa

SEQ ID NO: 3178053 - RNA, 15 nt, Human
gaguuacagacaaag

SEQ ID NO: 3178054 - RNA, 19 nt, Human
gaguucaucuugaauugua

SEQ ID NO: 3178055 - RNA, 14 nt, Human
gaguucaucuugaa

SEQ ID NO: 3178056 - RNA, 20 nt, Human
gaguucauacccuguuacca

SEQ ID NO: 3178057 - RNA, 17 nt, Human
gauaaaucauaaaguca

SEQ ID NO: 3178058 - RNA, 18 nt, Human
gauaaaucauaaagucag

SEQ ID NO: 3178059 - RNA, 19 nt, Human
gauaaaucauaaagucagu

SEQ ID NO: 3178060 - RNA, 20 nt, Human
gauaaaugauucaaaaaguc

SEQ ID NO: 3178061 - RNA, 15 nt, Human
gauaaaugauucaaa

SEQ ID NO: 3178062 - RNA, 15 nt, Human
gaguugaagacagag

SEQ ID NO: 3178063 - RNA, 17 nt, Human
gaguugaagacagagcu

SEQ ID NO: 3178064 - RNA, 21 nt, Human
gaguugaagacagagcuacac

SEQ ID NO: 3178065 - RNA, 14 nt, Human
gaguugaagacaga

SEQ ID NO: 3178066 - RNA, 12 nt, Human
gaguauucuaau

SEQ ID NO: 3178067 - RNA, 20 nt, Human
gaguauucuaauaagcuagu

SEQ ID NO: 3178068 - RNA, 11 nt, Human
gaguauauguc

SEQ ID NO: 3178069 - RNA, 15 nt, Human
gaguauauuauaaua

SEQ ID NO: 3178070 - RNA, 18 nt, Human
gaguaggaagacuuugga

SEQ ID NO: 3178071 - RNA, 19 nt, Human
gaguaggaagacuuuggaa

SEQ ID NO: 3178072 - RNA, 21 nt, Human
gaguagugaagacuccagaaa

SEQ ID NO: 3178073 - RNA, 14 nt, Human
gagucgaggacagg

SEQ ID NO: 3178074 - RNA, 22 nt, Human
gaguccuccagaacucuuccuc

SEQ ID NO: 3178075 - RNA, 21 nt, Human
gaguccuccagaacucuuccu

SEQ ID NO: 3178076 - RNA, 15 nt, Human
gaguccuccagaacu

SEQ ID NO: 3178077 - RNA, 14 nt, Human
gaguccuccagaac

SEQ ID NO: 3178078 - RNA, 22 nt, Human
gaguccgaccuggccugucugu

SEQ ID NO: 3178079 - RNA, 19 nt, Human
gaguccgaaagggacuugg

SEQ ID NO: 3178080 - RNA, 15 nt, Human
gagucgaggacaggg

SEQ ID NO: 3178081 - RNA, 23 nt, Human
gagugaacaaauuuacagagaca

SEQ ID NO: 3178082 - RNA, 17 nt, Human
gagugaagcugggagaa

SEQ ID NO: 3178083 - RNA, 16 nt, Human
gagugacagaggcagc

SEQ ID NO: 3178084 - RNA, 15 nt, Human
gagugacagaggcag

SEQ ID NO: 3178085 - RNA, 14 nt, Human
gagugacagaggca

SEQ ID NO: 3178086 - RNA, 12 nt, Human
gagucugaaggc

SEQ ID NO: 3178087 - RNA, 13 nt, Human
gagucugaaggcu

SEQ ID NO: 3178088 - RNA, 14 nt, Human
gagucugaaggcug

SEQ ID NO: 3178089 - RNA, 19 nt, Human
gagucuagcguagugcagc

SEQ ID NO: 3178090 - RNA, 20 nt, Human
gagucuuacucugccgccca

SEQ ID NO: 3178091 - RNA, 11 nt, Human
gagucuucaug

SEQ ID NO: 3178092 - RNA, 16 nt, Human
gagucuguucugguaa

SEQ ID NO: 3178093 - RNA, 15 nt, Human
gagguugggaggcca

SEQ ID NO: 3178094 - RNA, 17 nt, Human
gagguugggaggccauu

SEQ ID NO: 3178095 - RNA, 18 nt, Human
gagguuuauaguuaaucu

SEQ ID NO: 3178096 - RNA, 16 nt, Human
gagguuucaaaccucc

SEQ ID NO: 3178097 - RNA, 20 nt, Human
gaggucagagccugcaguua

SEQ ID NO: 3178098 - RNA, 17 nt, Human
gaggucagagccugcag

SEQ ID NO: 3178099 - RNA, 20 nt, Human
gaguacuacaguccucccau

SEQ ID NO: 3178100 - RNA, 17 nt, Human
gaguaaucuuguugguu

SEQ ID NO: 3178101 - RNA, 18 nt, Human
gaguaauugcauuugcuu

SEQ ID NO: 3178102 - RNA, 21 nt, Human
gaguacuacaguccucccauc

SEQ ID NO: 3178103 - RNA, 23 nt, Human
gaguacuacaguccucccaucuc

SEQ ID NO: 3178104 - RNA, 13 nt, Human
gaguaggaagacu

SEQ ID NO: 3178105 - RNA, 17 nt, Human
gaguaggaagacuuugg

SEQ ID NO: 3178106 - RNA, 12 nt, Human
gaguaggaagac

SEQ ID NO: 3178107 - RNA, 22 nt, Human
gaguagcugggacuacaggcac

SEQ ID NO: 3178108 - RNA, 19 nt, Human
gaguagcugggacuacagg

SEQ ID NO: 3178109 - RNA, 17 nt, Human
gaguagagguauaauug

SEQ ID NO: 3178110 - RNA, 15 nt, Human
gaguagaauguaguu

SEQ ID NO: 3178111 - RNA, 12 nt, Human
gaguagaaugua

SEQ ID NO: 3178112 - RNA, 22 nt, Human
gaggccucucauuccagaggaa

SEQ ID NO: 3178113 - RNA, 21 nt, Human
gaggccguugcugacuuagaa

SEQ ID NO: 3178114 - RNA, 16 nt, Human
gaggccuucucugaag

SEQ ID NO: 3178115 - RNA, 23 nt, Human
gaggccuccuguggccugccagu

SEQ ID NO: 3178116 - RNA, 20 nt, Human
gaggccuugggcucugcuga

SEQ ID NO: 3178117 - RNA, 19 nt, Human
gaggccuugggcucugcug

SEQ ID NO: 3178118 - RNA, 14 nt, Human
gaggccuucucuga

SEQ ID NO: 3178119 - RNA, 18 nt, Human
gaggccugaaauccuggu

SEQ ID NO: 3178120 - RNA, 22 nt, Human
gaggccugaaauccugguuccu

SEQ ID NO: 3178121 - RNA, 19 nt, Human
gaggccuucucugaaggac

SEQ ID NO: 3178122 - RNA, 18 nt, Human
gaggccuucucugaagga

SEQ ID NO: 3178123 - RNA, 14 nt, Human
gaggcugccucucc

SEQ ID NO: 3178124 - RNA, 16 nt, Human
gaggcugggcucccuu

SEQ ID NO: 3178125 - RNA, 19 nt, Human
gaggcuggaguuggggcag

SEQ ID NO: 3178126 - RNA, 11 nt, Human
gaggcccagag

SEQ ID NO: 3178127 - RNA, 13 nt, Human
gaggcccagaggg

SEQ ID NO: 3178128 - RNA, 14 nt, Human
gaggcccagagggc

SEQ ID NO: 3178129 - RNA, 19 nt, Human
gaggcccagagggccugca

SEQ ID NO: 3178130 - RNA, 15 nt, Human
gaggcccagagggcc

SEQ ID NO: 3178131 - RNA, 16 nt, Human
gaggcccagagggccu

SEQ ID NO: 3178132 - RNA, 21 nt, Human
gaggcccuucucuccagcccc

SEQ ID NO: 3178133 - RNA, 15 nt, Human
gaggcccuucucucc

SEQ ID NO: 3178134 - RNA, 20 nt, Human
gaggcccuucucuccagccc

SEQ ID NO: 3178135 - RNA, 14 nt, Human
gaggcccuucucuc

SEQ ID NO: 3178136 - RNA, 19 nt, Human
gaggccccaauaccccaug

SEQ ID NO: 3178137 - RNA, 9 nt, Human
gaggcaggg

SEQ ID NO: 3178138 - RNA, 20 nt, Human
gaggcagccccauucugccu

SEQ ID NO: 3178139 - RNA, 18 nt, Human
gaggcagccccauucugc

SEQ ID NO: 3178140 - RNA, 19 nt, Human
gaggcagccccauucugcc

SEQ ID NO: 3178141 - RNA, 23 nt, Human
gaggccaugggccuccugugugu

SEQ ID NO: 3178142 - RNA, 21 nt, Human
gaggccaugggccuccugugu

SEQ ID NO: 3178143 - RNA, 20 nt, Human
gaggccaugggccuccugug

SEQ ID NO: 3178144 - RNA, 18 nt, Human
gaggccaugggccuccug

SEQ ID NO: 3178145 - RNA, 17 nt, Human
gaggccaugggccuccu

SEQ ID NO: 3178146 - RNA, 14 nt, Human
gaggccaugggccu

SEQ ID NO: 3178147 - RNA, 16 nt, Human
gaggccauaaaauaag

SEQ ID NO: 3178148 - RNA, 14 nt, Human
gaggccaucuggag

SEQ ID NO: 3178149 - RNA, 12 nt, Human
gaggccaucugg

SEQ ID NO: 3178150 - RNA, 22 nt, Human
gaggccaucuggagagcccaga

SEQ ID NO: 3178151 - RNA, 19 nt, Human
gaggccaucuggagagccc

SEQ ID NO: 3178152 - RNA, 18 nt, Human
gaggccaucuggagagcc

SEQ ID NO: 3178153 - RNA, 16 nt, Human
gaggccaucuggagag

SEQ ID NO: 3178154 - RNA, 22 nt, Human
gagcccuguccugccuaaggcu

SEQ ID NO: 3178155 - RNA, 13 nt, Human
gaggaucucuuga

SEQ ID NO: 3178156 - RNA, 24 nt, Human
gagcccuucggaggaccagggcug

SEQ ID NO: 3178157 - RNA, 16 nt, Human
gaggaucucuugagcc

SEQ ID NO: 3178158 - RNA, 19 nt, Human
gaggaucucuugagccugg

SEQ ID NO: 3178159 - RNA, 22 nt, Human
gaggaucucuugagccugggag

SEQ ID NO: 3178160 - RNA, 17 nt, Human
gaggcaagcugaaauuu

SEQ ID NO: 3178161 - RNA, 16 nt, Human
gaggauugcuugagcu

SEQ ID NO: 3178162 - RNA, 20 nt, Human
gaggauuggcucccaucuuu

SEQ ID NO: 3178163 - RNA, 20 nt, Human
gaggauugcuugagcucagg

SEQ ID NO: 3178164 - RNA, 17 nt, Human
gaggggcugugggcgug

SEQ ID NO: 3178165 - RNA, 13 nt, Human
gaggguaaggcug

SEQ ID NO: 3178166 - RNA, 15 nt, Human
gaggggguggccucc

SEQ ID NO: 3178167 - RNA, 17 nt, Human
gaggggguggccuccca

SEQ ID NO: 3178168 - RNA, 13 nt, Human
gagggggcaaagg

SEQ ID NO: 3178169 - RNA, 20 nt, Human
gaggcugggcucccuuccca

SEQ ID NO: 3178170 - RNA, 19 nt, Human
gagggagggcuccagacac

SEQ ID NO: 3178171 - RNA, 12 nt, Human
gagggagcugag

SEQ ID NO: 3178172 - RNA, 15 nt, Human
gagggagcugagaag

SEQ ID NO: 3178173 - RNA, 16 nt, Human
gagggagcugagaaga

SEQ ID NO: 3178174 - RNA, 17 nt, Human
gagggagcacaaccccc

SEQ ID NO: 3178175 - RNA, 20 nt, Human
gagggagggcuccagacaca

SEQ ID NO: 3178176 - RNA, 16 nt, Human
gagggagggcuccaga

SEQ ID NO: 3178177 - RNA, 20 nt, Human
gagggagggggaaggcaggg

SEQ ID NO: 3178178 - RNA, 16 nt, Human
gagggagugacagagg

SEQ ID NO: 3178179 - RNA, 18 nt, Human
gagggagugacagaggca

SEQ ID NO: 3178180 - RNA, 22 nt, Human
gagggagugacagaggcagccc

SEQ ID NO: 3178181 - RNA, 21 nt, Human
gagggagugacagaggcagcc

SEQ ID NO: 3178182 - RNA, 23 nt, Human
gagggucuugguuccagccugcc

SEQ ID NO: 3178183 - RNA, 13 nt, Human
gagggugaagccu

SEQ ID NO: 3178184 - RNA, 17 nt, Human
gagggucuagaggccug

SEQ ID NO: 3178185 - RNA, 14 nt, Human
gagggucugaggaa

SEQ ID NO: 3178186 - RNA, 13 nt, Human
gagggucugagga

SEQ ID NO: 3178187 - RNA, 22 nt, Human
gaggguccagaaggagggggug

SEQ ID NO: 3178188 - RNA, 19 nt, Human
gaggguaauaaccagacac

SEQ ID NO: 3178189 - RNA, 22 nt, Human
gagggugucccaaaaagaaagg

SEQ ID NO: 3178190 - RNA, 21 nt, Human
gaggguggugaccucugccug

SEQ ID NO: 3178191 - RNA, 15 nt, Human
gagggugggaguggg

SEQ ID NO: 3178192 - RNA, 14 nt, Human
gaggguggugaccu

SEQ ID NO: 3178193 - RNA, 19 nt, Human
gagggugaguccuccagaa

SEQ ID NO: 3178194 - RNA, 12 nt, Human
gaggguggaaua

SEQ ID NO: 3178195 - RNA, 21 nt, Human
gagguagcuuugagguggaag

SEQ ID NO: 3178196 - RNA, 15 nt, Human
gagguauaauugugu

SEQ ID NO: 3178197 - RNA, 17 nt, Human
gaggucaaggcugcagu

SEQ ID NO: 3178198 - RNA, 18 nt, Human
gagguaucuuacuuuccu

SEQ ID NO: 3178199 - RNA, 13 nt, Human
gaggucagagccu

SEQ ID NO: 3178200 - RNA, 12 nt, Human
gaggucagagcc

SEQ ID NO: 3178201 - RNA, 14 nt, Human
gaggguugggcugg

SEQ ID NO: 3178202 - RNA, 15 nt, Human
gaggguugggcuggu

SEQ ID NO: 3178203 - RNA, 16 nt, Human
gaggguucagagagga

SEQ ID NO: 3178204 - RNA, 21 nt, Human
gagguaaggaauaccuguccc

SEQ ID NO: 3178205 - RNA, 23 nt, Human
gaggguuuuuaaaaauaaagcaa

SEQ ID NO: 3178206 - RNA, 22 nt, Human
gaggguuugagagagcagccag

SEQ ID NO: 3178207 - RNA, 24 nt, Human
gagguaaggaauaccugucccccu

SEQ ID NO: 3178208 - RNA, 12 nt, Human
gcaccauaacuu

SEQ ID NO: 3178209 - RNA, 17 nt, Human
gcaccauccccuccggc

SEQ ID NO: 3178210 - RNA, 14 nt, Human
gcaccauccccucc

SEQ ID NO: 3178211 - RNA, 13 nt, Human
gcaccauccccuc

SEQ ID NO: 3178212 - RNA, 13 nt, Human
gcaccauacucau

SEQ ID NO: 3178213 - RNA, 20 nt, Human
gcaccuuagacagucccugc

SEQ ID NO: 3178214 - RNA, 21 nt, Human
gcaccuuagacagucccugcc

SEQ ID NO: 3178215 - RNA, 21 nt, Human
gcaccugucugcuccagcucu

SEQ ID NO: 3178216 - RNA, 18 nt, Human
gcaccugucugcuccagc

SEQ ID NO: 3178217 - RNA, 16 nt, Human
gcaccugucugcucca

SEQ ID NO: 3178218 - RNA, 12 nt, Human
gcaccugucugc

SEQ ID NO: 3178219 - RNA, 15 nt, Human
gcaccugucugcucc

SEQ ID NO: 3178220 - RNA, 14 nt, Human
gcaccugucugcuc

SEQ ID NO: 3178221 - RNA, 19 nt, Human
gcaccuuagacagucccug

SEQ ID NO: 3178222 - RNA, 19 nt, Human
gcaccuucccccuccccca

SEQ ID NO: 3178223 - RNA, 14 nt, Human
gcaccuucccccuc

SEQ ID NO: 3178224 - RNA, 12 nt, Human
gcacagaggccu

SEQ ID NO: 3178225 - RNA, 14 nt, Human
gcacagucagguug

SEQ ID NO: 3178226 - RNA, 13 nt, Human
gcacagugcaucu

SEQ ID NO: 3178227 - RNA, 18 nt, Human
gcacagugcaucucagcc

SEQ ID NO: 3178228 - RNA, 15 nt, Human
gcacagugcaucuca

SEQ ID NO: 3178229 - RNA, 17 nt, Human
gcaccaaaauaagaaaa

SEQ ID NO: 3178230 - RNA, 14 nt, Human
gcacugguggcccg

SEQ ID NO: 3178231 - RNA, 23 nt, Human
gcacugcuuccagugaggcucug

SEQ ID NO: 3178232 - RNA, 22 nt, Human
gcacugcuuccagugaggcucu

SEQ ID NO: 3178233 - RNA, 18 nt, Human
gcacugacuucuaaguaa

SEQ ID NO: 3178234 - RNA, 19 nt, Human
gcacugagagagcgcagcc

SEQ ID NO: 3178235 - RNA, 15 nt, Human
gcacugacuucuaag

SEQ ID NO: 3178236 - RNA, 20 nt, Human
gcacugcugcccagccucca

SEQ ID NO: 3178237 - RNA, 18 nt, Human
gcacugcugcccagccuc

SEQ ID NO: 3178238 - RNA, 15 nt, Human
gcacugcugcccagc

SEQ ID NO: 3178239 - RNA, 14 nt, Human
gcacugcugcccag

SEQ ID NO: 3178240 - RNA, 12 nt, Human
gcacugcugccc

SEQ ID NO: 3178241 - RNA, 21 nt, Human
gcacugagagagcgcagccgc

SEQ ID NO: 3178242 - RNA, 19 nt, Human
gcagacacccuuggagcuc

SEQ ID NO: 3178243 - RNA, 18 nt, Human
gcagacaggaccagggau

SEQ ID NO: 3178244 - RNA, 12 nt, Human
gcagacaggcaa

SEQ ID NO: 3178245 - RNA, 13 nt, Human
gcagacaggcaag

SEQ ID NO: 3178246 - RNA, 18 nt, Human
gcagaaggaagacuucau

SEQ ID NO: 3178247 - RNA, 22 nt, Human
gcagaagggagcuggcuccagc

SEQ ID NO: 3178248 - RNA, 20 nt, Human
gcagaagggagcuggcucca

SEQ ID NO: 3178249 - RNA, 18 nt, Human
gcagaagggagcuggcuc

SEQ ID NO: 3178250 - RNA, 20 nt, Human
gcagaaguaggggaagaaua

SEQ ID NO: 3178251 - RNA, 22 nt, Human
gcaauguagaggggaaaagaga

SEQ ID NO: 3178252 - RNA, 14 nt, Human
gcaaugugauaaaa

SEQ ID NO: 3178253 - RNA, 14 nt, Human
gcaaugugaaaaau

SEQ ID NO: 3178254 - RNA, 17 nt, Human
gcaaugugaaaaaucug

SEQ ID NO: 3178255 - RNA, 15 nt, Human
gcaauguuuugcuuu

SEQ ID NO: 3178256 - RNA, 14 nt, Human
gcaauguuuugcuu

SEQ ID NO: 3178257 - RNA, 17 nt, Human
gcaauguuuugcuuuug

SEQ ID NO: 3178258 - RNA, 21 nt, Human
gcaauuaaacuuccaaagaaa

SEQ ID NO: 3178259 - RNA, 22 nt, Human
gcaauuaaacuuccaaagaaag

SEQ ID NO: 3178260 - RNA, 14 nt, Human
gcaacucaucuuag

SEQ ID NO: 3178261 - RNA, 23 nt, Human
gcaacgaucacaaaugacuuuau

SEQ ID NO: 3178262 - RNA, 16 nt, Human
gcaacgaucacaaaug

SEQ ID NO: 3178263 - RNA, 20 nt, Human
gcaacgaucacaaaugacuu

SEQ ID NO: 3178264 - RNA, 21 nt, Human
gcaacgaucacaaaugacuuu

SEQ ID NO: 3178265 - RNA, 22 nt, Human
gcaacgaucacaaaugacuuua

SEQ ID NO: 3178266 - RNA, 14 nt, Human
gcaacacacaugcu

SEQ ID NO: 3178267 - RNA, 15 nt, Human
gcaauggcagccuug

SEQ ID NO: 3178268 - RNA, 17 nt, Human
gcaaugguaguuucugu

SEQ ID NO: 3178269 - RNA, 19 nt, Human
gcaaugguaguuucugugg

SEQ ID NO: 3178270 - RNA, 14 nt, Human
gcaauucuccugcc

SEQ ID NO: 3178271 - RNA, 15 nt, Human
gcaauucuccugccu

SEQ ID NO: 3178272 - RNA, 16 nt, Human
gcaauucuccugccuc

SEQ ID NO: 3178273 - RNA, 17 nt, Human
gcaauucuccugccuca

SEQ ID NO: 3178274 - RNA, 18 nt, Human
gcaauucuccugccucag

SEQ ID NO: 3178275 - RNA, 19 nt, Human
gcaauucuccugccucagc

SEQ ID NO: 3178276 - RNA, 20 nt, Human
gcaauucuccugccucagcc

SEQ ID NO: 3178277 - RNA, 14 nt, Human
gcacaaacagaggc

SEQ ID NO: 3178278 - RNA, 23 nt, Human
gcacaaaaagauaccuuaaaauu

SEQ ID NO: 3178279 - RNA, 23 nt, Human
gcaauuuuauaaggacuuccuga

SEQ ID NO: 3178280 - RNA, 15 nt, Human
gcacaaacagaggcc

SEQ ID NO: 3178281 - RNA, 16 nt, Human
gcacaaacagaggccg

SEQ ID NO: 3178282 - RNA, 18 nt, Human
gcacaaccuucaagcugc

SEQ ID NO: 3178283 - RNA, 18 nt, Human
gcacaacccccagcuccc

SEQ ID NO: 3178284 - RNA, 17 nt, Human
gcacaacccccagcucc

SEQ ID NO: 3178285 - RNA, 18 nt, Human
gcacaagcuccaagcucc

SEQ ID NO: 3178286 - RNA, 15 nt, Human
gcacaagcuccaagc

SEQ ID NO: 3178287 - RNA, 17 nt, Human
gcacaagcuccaagcuc

SEQ ID NO: 3178288 - RNA, 20 nt, Human
gcacagaaaauggaagacag

SEQ ID NO: 3178289 - RNA, 20 nt, Human
gcacaccgggcacucagaag

SEQ ID NO: 3178290 - RNA, 20 nt, Human
gcacaccuccucccacugcc

SEQ ID NO: 3178291 - RNA, 19 nt, Human
gcacaccuccucccacugc

SEQ ID NO: 3178292 - RNA, 15 nt, Human
gcacaccuccuccca

SEQ ID NO: 3178293 - RNA, 12 nt, Human
gcacacgcugcu

SEQ ID NO: 3178294 - RNA, 22 nt, Human
gcacaccuccucccacugccca

SEQ ID NO: 3178295 - RNA, 21 nt, Human
gcacacgcugcucugccccag

SEQ ID NO: 3178296 - RNA, 18 nt, Human
gcacacgcugcucugccc

SEQ ID NO: 3178297 - RNA, 17 nt, Human
gcacacgcugcucugcc

SEQ ID NO: 3178298 - RNA, 15 nt, Human
gcacacgcugcucug

SEQ ID NO: 3178299 - RNA, 14 nt, Human
gcacacgcugcucu

SEQ ID NO: 3178300 - RNA, 13 nt, Human
gcacacgcugcuc

SEQ ID NO: 3178301 - RNA, 22 nt, Human
gcacagacccugcccugugggc

SEQ ID NO: 3178302 - RNA, 18 nt, Human
gcacagacccugcccugu

SEQ ID NO: 3178303 - RNA, 19 nt, Human
gcacagacccugcccugug

SEQ ID NO: 3178304 - RNA, 20 nt, Human
gcacagacccugcccugugg

SEQ ID NO: 3178305 - RNA, 21 nt, Human
gcacagacccugcccuguggg

SEQ ID NO: 3178306 - RNA, 14 nt, Human
gcacagacccugcc

SEQ ID NO: 3178307 - RNA, 15 nt, Human
gcacagacccugccc

SEQ ID NO: 3178308 - RNA, 16 nt, Human
gcacagacccugcccu

SEQ ID NO: 3178309 - RNA, 17 nt, Human
gcacagacccugcccug

SEQ ID NO: 3178310 - RNA, 21 nt, Human
gcacagaaaauggaagacagc

SEQ ID NO: 3178311 - RNA, 22 nt, Human
gcacagaaaauggaagacagcu

SEQ ID NO: 3178312 - RNA, 23 nt, Human
gcacagaaaauggaagacagcuc

SEQ ID NO: 3178313 - RNA, 23 nt, Human
gauugcaggagucccugccauca

SEQ ID NO: 3178314 - RNA, 19 nt, Human
gauugccggucuugacagc

SEQ ID NO: 3178315 - RNA, 20 nt, Human
gauugauuuuaaaauguaca

SEQ ID NO: 3178316 - RNA, 18 nt, Human
gauugauuuuaaaaugua

SEQ ID NO: 3178317 - RNA, 17 nt, Human
gauugauuuuaaaaugu

SEQ ID NO: 3178318 - RNA, 16 nt, Human
gauugauuuuaaaaug

SEQ ID NO: 3178319 - RNA, 16 nt, Human
gauucucaugccucag

SEQ ID NO: 3178320 - RNA, 18 nt, Human
gauuacaggcuccugcca

SEQ ID NO: 3178321 - RNA, 21 nt, Human
gauuacaggcuccugccacca

SEQ ID NO: 3178322 - RNA, 18 nt, Human
gauucacaccccaccugc

SEQ ID NO: 3178323 - RNA, 17 nt, Human
gauucacaccccaccug

SEQ ID NO: 3178324 - RNA, 16 nt, Human
gauucacaccccaccu

SEQ ID NO: 3178325 - RNA, 18 nt, Human
gauucaaugccucuggcu

SEQ ID NO: 3178326 - RNA, 23 nt, Human
gauuacaggcaugggccaccacg

SEQ ID NO: 3178327 - RNA, 15 nt, Human
gauucucaccagcug

SEQ ID NO: 3178328 - RNA, 17 nt, Human
gauugggccccugccag

SEQ ID NO: 3178329 - RNA, 21 nt, Human
gauugguuucucuucuccccu

SEQ ID NO: 3178330 - RNA, 17 nt, Human
gauugguuucucuucuc

SEQ ID NO: 3178331 - RNA, 16 nt, Human
gauugguuucucuucu

SEQ ID NO: 3178332 - RNA, 15 nt, Human
gauugguuucucuuc

SEQ ID NO: 3178333 - RNA, 12 nt, Human
gauuuaaaucag

SEQ ID NO: 3178334 - RNA, 14 nt, Human
gauuuaaauuuaag

SEQ ID NO: 3178335 - RNA, 14 nt, Human
gauuuccucuugaa

SEQ ID NO: 3178336 - RNA, 21 nt, Human
gauuuccucuugaaccagaac

SEQ ID NO: 3178337 - RNA, 20 nt, Human
gauuucuaguuauuuauucu

SEQ ID NO: 3178338 - RNA, 15 nt, Human
gauuucuaguuauuu

SEQ ID NO: 3178339 - RNA, 16 nt, Human
gauuugagcucagccc

SEQ ID NO: 3178340 - RNA, 13 nt, Human
gauuugaauccag

SEQ ID NO: 3178341 - RNA, 19 nt, Human
gcaaagcggguuauaauga

SEQ ID NO: 3178342 - RNA, 21 nt, Human
gcaaagcacccauuucaaugu

SEQ ID NO: 3178343 - RNA, 14 nt, Human
gcaaaggaaauacc

SEQ ID NO: 3178344 - RNA, 19 nt, Human
gcaaagcuguucuuccugg

SEQ ID NO: 3178345 - RNA, 18 nt, Human
gcaaagcuguucuuccug

SEQ ID NO: 3178346 - RNA, 17 nt, Human
gcaaagcuguucuuccu

SEQ ID NO: 3178347 - RNA, 12 nt, Human
gcaaagcuguuc

SEQ ID NO: 3178348 - RNA, 15 nt, Human
gcaaauguggcuccu

SEQ ID NO: 3178349 - RNA, 23 nt, Human
gcaacaaacugcacaugauuuca

SEQ ID NO: 3178350 - RNA, 22 nt, Human
gcaacaaacugcacaugauuuc

SEQ ID NO: 3178351 - RNA, 21 nt, Human
gcaacaaacugcacaugauuu

SEQ ID NO: 3178352 - RNA, 15 nt, Human
gcaacaaacugcaca

SEQ ID NO: 3178353 - RNA, 14 nt, Human
gcaacaaacugcac

SEQ ID NO: 3178354 - RNA, 14 nt, Human
gcaacaaaauacau

SEQ ID NO: 3178355 - RNA, 23 nt, Human
gcaacaauucucccgggacucug

SEQ ID NO: 3178356 - RNA, 16 nt, Human
gcaacaauuuucagau

SEQ ID NO: 3178357 - RNA, 15 nt, Human
gcaacaauuuucaga

SEQ ID NO: 3178358 - RNA, 14 nt, Human
gcaacaauuuucag

SEQ ID NO: 3178359 - RNA, 12 nt, Human
gcaaaccaucau

SEQ ID NO: 3178360 - RNA, 20 nt, Human
gcaaaccaacaagaauaaag

SEQ ID NO: 3178361 - RNA, 13 nt, Human
gcaaaccaacaag

SEQ ID NO: 3178362 - RNA, 15 nt, Human
gcaaacauuuucucu

SEQ ID NO: 3178363 - RNA, 21 nt, Human
gcaaacauuuucucuuagaaa

SEQ ID NO: 3178364 - RNA, 20 nt, Human
gcaaacauuuucucuuagaa

SEQ ID NO: 3178365 - RNA, 21 nt, Human
gauuuuguguuuauucuugau

SEQ ID NO: 3178366 - RNA, 13 nt, Human
gauuuuguguuua

SEQ ID NO: 3178367 - RNA, 12 nt, Human
gauuuugaucuc

SEQ ID NO: 3178368 - RNA, 21 nt, Human
gauuuugaaauuuuuauuaaa

SEQ ID NO: 3178369 - RNA, 19 nt, Human
gauuuugauccaagcuggu

SEQ ID NO: 3178370 - RNA, 15 nt, Human
gauuuuaguuuuauu

SEQ ID NO: 3178371 - RNA, 22 nt, Human
gauuuuaguuuuauuuucuaaa

SEQ ID NO: 3178372 - RNA, 19 nt, Human
gauuuuaguuuuauuuucu

SEQ ID NO: 3178373 - RNA, 15 nt, Human
gaugggucaguugua

SEQ ID NO: 3178374 - RNA, 21 nt, Human
gaugggucaguuguaucagca

SEQ ID NO: 3178375 - RNA, 19 nt, Human
gaugggugcuuggaggaag

SEQ ID NO: 3178376 - RNA, 14 nt, Human
gaugguaagagaaa

SEQ ID NO: 3178377 - RNA, 15 nt, Human
gaugguaagagaaaa

SEQ ID NO: 3178378 - RNA, 18 nt, Human
gaugguaagagaaaagag

SEQ ID NO: 3178379 - RNA, 22 nt, Human
gaugguaagagaaaagagagaa

SEQ ID NO: 3178380 - RNA, 15 nt, Human
gauggggcugcaccg

SEQ ID NO: 3178381 - RNA, 13 nt, Human
gauggggcugcac

SEQ ID NO: 3178382 - RNA, 20 nt, Human
gaugggaugauugaagaaac

SEQ ID NO: 3178383 - RNA, 24 nt, Human
gauggggcccugccuccuuuguga

SEQ ID NO: 3178384 - RNA, 21 nt, Human
gaugggcaacccccagccugc

SEQ ID NO: 3178385 - RNA, 20 nt, Human
gaugggcaacccccagccug

SEQ ID NO: 3178386 - RNA, 19 nt, Human
gaugggaugauugaagaaa

SEQ ID NO: 3178387 - RNA, 18 nt, Human
gaugcuagaacucccuuu

SEQ ID NO: 3178388 - RNA, 16 nt, Human
gaugccccgucccccu

SEQ ID NO: 3178389 - RNA, 20 nt, Human
gaugcuagaacucccuuuca

SEQ ID NO: 3178390 - RNA, 12 nt, Human
gaugcucuuucc

SEQ ID NO: 3178391 - RNA, 20 nt, Human
gaugcugacuguacuccucc

SEQ ID NO: 3178392 - RNA, 17 nt, Human
gaugcugacuguacucc

SEQ ID NO: 3178393 - RNA, 14 nt, Human
gaugcucuuuccca

SEQ ID NO: 3178394 - RNA, 13 nt, Human
gaugcucuuuccc

SEQ ID NO: 3178395 - RNA, 20 nt, Human
gaucagaccaaacagugcug

SEQ ID NO: 3178396 - RNA, 19 nt, Human
gaugcccaaagaugcagcc

SEQ ID NO: 3178397 - RNA, 20 nt, Human
gaugcccaaagaugcagccg

SEQ ID NO: 3178398 - RNA, 24 nt, Human
gaugguguucaaaaaacuuguaaa

SEQ ID NO: 3178399 - RNA, 17 nt, Human
gauggugcaaugaccuu

SEQ ID NO: 3178400 - RNA, 15 nt, Human
gauggugcaaugacc

SEQ ID NO: 3178401 - RNA, 16 nt, Human
gauggugcaaugaccu

SEQ ID NO: 3178402 - RNA, 12 nt, Human
gauggugcaaug

SEQ ID NO: 3178403 - RNA, 14 nt, Human
gauggugcaaugac

SEQ ID NO: 3178404 - RNA, 19 nt, Human
gaugguaugcacaauucca

SEQ ID NO: 3178405 - RNA, 23 nt, Human
gaugguaucuauagucaagacga

SEQ ID NO: 3178406 - RNA, 19 nt, Human
gaugugggccaccauugca

SEQ ID NO: 3178407 - RNA, 21 nt, Human
gaugguuccccuguucacucu

SEQ ID NO: 3178408 - RNA, 18 nt, Human
gaugguuccccuguucac

SEQ ID NO: 3178409 - RNA, 13 nt, Human
gaugguuccccug

SEQ ID NO: 3178410 - RNA, 13 nt, Human
gauguuuuuaaaa

SEQ ID NO: 3178411 - RNA, 14 nt, Human
gauguugaugcaau

SEQ ID NO: 3178412 - RNA, 23 nt, Human
gauguugaugcaauccuuacaaa

SEQ ID NO: 3178413 - RNA, 21 nt, Human
gauguugaugcaauccuuaca

SEQ ID NO: 3178414 - RNA, 14 nt, Human
gauguuuaaaacac

SEQ ID NO: 3178415 - RNA, 22 nt, Human
gauguuuaaaacaccuucuaua

SEQ ID NO: 3178416 - RNA, 23 nt, Human
gauguuuaaaacaccuucuauag

SEQ ID NO: 3178417 - RNA, 19 nt, Human
gauguugaaaaaguucugc

SEQ ID NO: 3178418 - RNA, 19 nt, Human
gauguugacaucacuggca

SEQ ID NO: 3178419 - RNA, 15 nt, Human
gauguucaccuccug

SEQ ID NO: 3178420 - RNA, 21 nt, Human
gauguuauauuuuucuuaaaa

SEQ ID NO: 3178421 - RNA, 20 nt, Human
gauguuauauuuuucuuaaa

SEQ ID NO: 3178422 - RNA, 16 nt, Human
gauguuauauuuuucu

SEQ ID NO: 3178423 - RNA, 13 nt, Human
gauguuauauuuu

SEQ ID NO: 3178424 - RNA, 17 nt, Human
gauguuaguuuuccuua

SEQ ID NO: 3178425 - RNA, 16 nt, Human
gauguuaguuuuccuu

SEQ ID NO: 3178426 - RNA, 23 nt, Human
gauuacaagcgugagccacugca

SEQ ID NO: 3178427 - RNA, 20 nt, Human
gauuacaggcgugagccacc

SEQ ID NO: 3178428 - RNA, 17 nt, Human
gauuacaggcuccugcc

SEQ ID NO: 3178429 - RNA, 15 nt, Human
gauguuuuuaaaauc

SEQ ID NO: 3178430 - RNA, 15 nt, Human
gauguuuuucuuacc

SEQ ID NO: 3178431 - RNA, 17 nt, Human
gauguuuuuaaaaucuu

SEQ ID NO: 3178432 - RNA, 16 nt, Human
gauguuuuuaaaaucu

SEQ ID NO: 3178433 - RNA, 22 nt, Human
gauuacaagcgugagccacugc

SEQ ID NO: 3178434 - RNA, 20 nt, Human
gauuaaagaugagcuuuguc

SEQ ID NO: 3178435 - RNA, 22 nt, Human
gauuaaaaauaucaaauuaauu

SEQ ID NO: 3178436 - RNA, 22 nt, Human
gauuaaaagguauacuuuagua

SEQ ID NO: 3178437 - RNA, 19 nt, Human
cuuuggcuaugagggccuu

SEQ ID NO: 3178438 - RNA, 19 nt, Human
cuuuggcuauuagagauca

SEQ ID NO: 3178439 - RNA, 14 nt, Human
cuuuguccccaccg

SEQ ID NO: 3178440 - RNA, 22 nt, Human
cuuuguauuguccuauuagugu

SEQ ID NO: 3178441 - RNA, 22 nt, Human
cuuuggccugaugaccaauuuu

SEQ ID NO: 3178442 - RNA, 12 nt, Human
cuuuguauuguc

SEQ ID NO: 3178443 - RNA, 15 nt, Human
cuuuguauuguccua

SEQ ID NO: 3178444 - RNA, 16 nt, Human
cuuuguauuguccuau

SEQ ID NO: 3178445 - RNA, 23 nt, Human
cuuugucuaagaaacauuggaag

SEQ ID NO: 3178446 - RNA, 21 nt, Human
cuuugucuaagaaacauugga

SEQ ID NO: 3178447 - RNA, 23 nt, Human
cuuugucuacuucaaaaguuugu

SEQ ID NO: 3178448 - RNA, 19 nt, Human
cuuugucuccucuauccug

SEQ ID NO: 3178449 - RNA, 20 nt, Human
cuuugucuaagaaacauugg

SEQ ID NO: 3178450 - RNA, 15 nt, Human
cuuuguccccaccgc

SEQ ID NO: 3178451 - RNA, 15 nt, Human
cuuugugaggaagcc

SEQ ID NO: 3178452 - RNA, 15 nt, Human
cuuucuuccucugcu

SEQ ID NO: 3178453 - RNA, 14 nt, Human
cuuucuuccucugc

SEQ ID NO: 3178454 - RNA, 13 nt, Human
cuuucuuccucug

SEQ ID NO: 3178455 - RNA, 12 nt, Human
cuuucuuccucu

SEQ ID NO: 3178456 - RNA, 16 nt, Human
cuuugcagacaggcaa

SEQ ID NO: 3178457 - RNA, 20 nt, Human
cuuugcagacaggcaagcac

SEQ ID NO: 3178458 - RNA, 21 nt, Human
cuuugcaguucccaucuccuu

SEQ ID NO: 3178459 - RNA, 21 nt, Human
cuuucucuucauauucagcuu

SEQ ID NO: 3178460 - RNA, 15 nt, Human
cuuucucugaggaca

SEQ ID NO: 3178461 - RNA, 14 nt, Human
cuuucucugaggac

SEQ ID NO: 3178462 - RNA, 13 nt, Human
cuuuccugaggcu

SEQ ID NO: 3178463 - RNA, 15 nt, Human
cuuuccugaggcugg

SEQ ID NO: 3178464 - RNA, 15 nt, Human
cuuucccuuccucca

SEQ ID NO: 3178465 - RNA, 12 nt, Human
cuuucucugagg

SEQ ID NO: 3178466 - RNA, 11 nt, Human
cuuucuuccuc

SEQ ID NO: 3178467 - RNA, 21 nt, Human
cuuucuuccucauucccucgu

SEQ ID NO: 3178468 - RNA, 17 nt, Human
cuuucuuccucauuccc

SEQ ID NO: 3178469 - RNA, 12 nt, Human
cuuucuuccuca

SEQ ID NO: 3178470 - RNA, 18 nt, Human
cuuucugggguuuuucug

SEQ ID NO: 3178471 - RNA, 17 nt, Human
cuuucugggguuuuucu

SEQ ID NO: 3178472 - RNA, 20 nt, Human
cuuucugggguuuuucuguu

SEQ ID NO: 3178473 - RNA, 19 nt, Human
cuuucugggguuuuucugu

SEQ ID NO: 3178474 - RNA, 20 nt, Human
cuuucugggcaccggggccu

SEQ ID NO: 3178475 - RNA, 19 nt, Human
cuuucuggggccuaauaaa

SEQ ID NO: 3178476 - RNA, 20 nt, Human
cuuucuggggccuaauaaaa

SEQ ID NO: 3178477 - RNA, 22 nt, Human
cuuucuggggccuaauaaaacu

SEQ ID NO: 3178478 - RNA, 23 nt, Human
cuuucuggggccuaauaaaacug

SEQ ID NO: 3178479 - RNA, 15 nt, Human
cuuucccaaaggcau

SEQ ID NO: 3178480 - RNA, 15 nt, Human
cuuuccaucuacccu

SEQ ID NO: 3178481 - RNA, 15 nt, Human
cuuuccaggaaggcu

SEQ ID NO: 3178482 - RNA, 23 nt, Human
cuuuccauauccauagugacuuu

SEQ ID NO: 3178483 - RNA, 16 nt, Human
cuuucccucccuuccu

SEQ ID NO: 3178484 - RNA, 14 nt, Human
cuuucccucccuuc

SEQ ID NO: 3178485 - RNA, 13 nt, Human
cuuucccucccuu

SEQ ID NO: 3178486 - RNA, 11 nt, Human
cuuucccuccc

SEQ ID NO: 3178487 - RNA, 12 nt, Human
cuuuccugaggc

SEQ ID NO: 3178488 - RNA, 16 nt, Human
cuuuccucuuuggucu

SEQ ID NO: 3178489 - RNA, 14 nt, Human
cuuucccuuccucc

SEQ ID NO: 3178490 - RNA, 14 nt, Human
cuuucccuuccagu

SEQ ID NO: 3178491 - RNA, 13 nt, Human
cuuucccuuccag

SEQ ID NO: 3178492 - RNA, 12 nt, Human
cuuucccuucca

SEQ ID NO: 3178493 - RNA, 14 nt, Human
cuuuaucaaugugu

SEQ ID NO: 3178494 - RNA, 20 nt, Human
cuuuaucaaugugucuuucu

SEQ ID NO: 3178495 - RNA, 22 nt, Human
cuuuaucagggaaacuaagauu

SEQ ID NO: 3178496 - RNA, 21 nt, Human
cuuuaucaugaaugcuuuuag

SEQ ID NO: 3178497 - RNA, 22 nt, Human
cuuuaucuaccaacuuucaaga

SEQ ID NO: 3178498 - RNA, 21 nt, Human
cuuuaucuaccaacuuucaag

SEQ ID NO: 3178499 - RNA, 20 nt, Human
cuuuaucuaccaacuuucaa

SEQ ID NO: 3178500 - RNA, 19 nt, Human
cuuuaucuaccaacuuuca

SEQ ID NO: 3178501 - RNA, 15 nt, Human
cuuuaugcacaaaau

SEQ ID NO: 3178502 - RNA, 19 nt, Human
cuuuauaauucuacuuuga

SEQ ID NO: 3178503 - RNA, 13 nt, Human
cuuuauaauucua

SEQ ID NO: 3178504 - RNA, 14 nt, Human
cuuuagcgcccagu

SEQ ID NO: 3178505 - RNA, 18 nt, Human
cuuguuaugguagaaaaa

SEQ ID NO: 3178506 - RNA, 19 nt, Human
cuuguuaugguagaaaaau

SEQ ID NO: 3178507 - RNA, 14 nt, Human
cuuguucaggaaaa

SEQ ID NO: 3178508 - RNA, 19 nt, Human
cuuguucaggaaaagguug

SEQ ID NO: 3178509 - RNA, 16 nt, Human
cuuguuauucaacagc

SEQ ID NO: 3178510 - RNA, 20 nt, Human
cuuuaaaauuacaacuaagu

SEQ ID NO: 3178511 - RNA, 19 nt, Human
cuuuaaaauuacaacuaag

SEQ ID NO: 3178512 - RNA, 17 nt, Human
cuuuaaaauuacaacua

SEQ ID NO: 3178513 - RNA, 12 nt, Human
cuuuaaaauucu

SEQ ID NO: 3178514 - RNA, 22 nt, Human
cuuuaaaccuguagaaucaauu

SEQ ID NO: 3178515 - RNA, 16 nt, Human
cuuuagcaaagaacuc

SEQ ID NO: 3178516 - RNA, 20 nt, Human
cuuuagauagcagccuggcu

SEQ ID NO: 3178517 - RNA, 23 nt, Human
cuuuagauagcagccuggcuccc

SEQ ID NO: 3178518 - RNA, 15 nt, Human
cuugucauuuugguc

SEQ ID NO: 3178519 - RNA, 15 nt, Human
cuuguauauucuauu

SEQ ID NO: 3178520 - RNA, 12 nt, Human
cuuguauaauau

SEQ ID NO: 3178521 - RNA, 22 nt, Human
cuuguaguuuagugugguuuuc

SEQ ID NO: 3178522 - RNA, 15 nt, Human
cuuguaguucuuuaa

SEQ ID NO: 3178523 - RNA, 20 nt, Human
cuuguaguucuuuaaacugu

SEQ ID NO: 3178524 - RNA, 13 nt, Human
cuuguaguucuuu

SEQ ID NO: 3178525 - RNA, 23 nt, Human
cuuggggggcugaggugggagga

SEQ ID NO: 3178526 - RNA, 18 nt, Human
cuugaguuguuuuuguau

SEQ ID NO: 3178527 - RNA, 21 nt, Human
cuugaguuggggccauugcuu

SEQ ID NO: 3178528 - RNA, 19 nt, Human
cuugaguuguuuuuguaua

SEQ ID NO: 3178529 - RNA, 20 nt, Human
cuugaguuguuuuuguauau

SEQ ID NO: 3178530 - RNA, 21 nt, Human
cuugaguuguuuuuguauauu

SEQ ID NO: 3178531 - RNA, 22 nt, Human
cuugaguuguuuuuguauauug

SEQ ID NO: 3178532 - RNA, 22 nt, Human
cuuggggggcugaggugggagg

SEQ ID NO: 3178533 - RNA, 16 nt, Human
cuuguaaauagcucag

SEQ ID NO: 3178534 - RNA, 23 nt, Human
cuugaguuguuuuuguauauugg

SEQ ID NO: 3178535 - RNA, 18 nt, Human
cuuguaaauagcucaggu

SEQ ID NO: 3178536 - RNA, 17 nt, Human
cuuguaaauagcucagg

SEQ ID NO: 3178537 - RNA, 22 nt, Human
cuuuuguucauuucauccuuuc

SEQ ID NO: 3178538 - RNA, 15 nt, Human
cuuuuucuuaaucau

SEQ ID NO: 3178539 - RNA, 12 nt, Human
cuuuuucuuaau

SEQ ID NO: 3178540 - RNA, 13 nt, Human
cuuuuuauuuaua

SEQ ID NO: 3178541 - RNA, 14 nt, Human
cuuuuuauuuauau

SEQ ID NO: 3178542 - RNA, 17 nt, Human
cuuuuuauuuauaugua

SEQ ID NO: 3178543 - RNA, 18 nt, Human
cuuuuuauuuauauguau

SEQ ID NO: 3178544 - RNA, 19 nt, Human
cuuuuuauuuauauguaug

SEQ ID NO: 3178545 - RNA, 18 nt, Human
cuuuguuaguuucuccaa

SEQ ID NO: 3178546 - RNA, 16 nt, Human
cuuuuguucauuucau

SEQ ID NO: 3178547 - RNA, 19 nt, Human
cuuuuguucauuucauccu

SEQ ID NO: 3178548 - RNA, 18 nt, Human
cuuuuguucauuucaucc

SEQ ID NO: 3178549 - RNA, 16 nt, Human
cuuuguuaccuuaaaa

SEQ ID NO: 3178550 - RNA, 19 nt, Human
cuuuguuaccuuaaaacua

SEQ ID NO: 3178551 - RNA, 20 nt, Human
cuuuguuaccuuaaaacuag

SEQ ID NO: 3178552 - RNA, 15 nt, Human
cuuuguuaauuugga

SEQ ID NO: 3178553 - RNA, 13 nt, Human
cuuuguuacacug

SEQ ID NO: 3178554 - RNA, 21 nt, Human
cuuuguuacacuguuauuuuc

SEQ ID NO: 3178555 - RNA, 16 nt, Human
cuuuuugaaaguaauu

SEQ ID NO: 3178556 - RNA, 20 nt, Human
cuuuuuuggcugcugaaggc

SEQ ID NO: 3178557 - RNA, 22 nt, Human
cuuuuuuggcugcugaaggcuc

SEQ ID NO: 3178558 - RNA, 17 nt, Human
cuuuuuuggcugcugaa

SEQ ID NO: 3178559 - RNA, 12 nt, Human
gaaaaaggagga

SEQ ID NO: 3178560 - RNA, 15 nt, Human
gaaaaaggaggaaga

SEQ ID NO: 3178561 - RNA, 16 nt, Human
cuuuuuuggcugcuga

SEQ ID NO: 3178562 - RNA, 13 nt, Human
gaaaauauuuaaa

SEQ ID NO: 3178563 - RNA, 13 nt, Human
gaaaauauucucu

SEQ ID NO: 3178564 - RNA, 19 nt, Human
gaaaauauucucuauuuga

SEQ ID NO: 3178565 - RNA, 20 nt, Human
gaaaauauucucuauuugaa

SEQ ID NO: 3178566 - RNA, 18 nt, Human
gaaaauauuuguaucaca

SEQ ID NO: 3178567 - RNA, 16 nt, Human
gaaaauaaaaaaaaga

SEQ ID NO: 3178568 - RNA, 19 nt, Human
gaaaauaaaaaaagaaaaa

SEQ ID NO: 3178569 - RNA, 22 nt, Human
gaaaauaaaaaaaagaaaaaag

SEQ ID NO: 3178570 - RNA, 21 nt, Human
gaaaauaaaaaaaagaaaaaa

SEQ ID NO: 3178571 - RNA, 19 nt, Human
gaaaauaaaaaaaagaaaa

SEQ ID NO: 3178572 - RNA, 18 nt, Human
gaaaauaaaaaaaagaaa

SEQ ID NO: 3178573 - RNA, 17 nt, Human
gaaaauaaaaaaaagaa

SEQ ID NO: 3178574 - RNA, 17 nt, Human
gaaaaucugaauuggaa

SEQ ID NO: 3178575 - RNA, 20 nt, Human
gaaaaucugaauuggaaugc

SEQ ID NO: 3178576 - RNA, 18 nt, Human
gaaaaucugaauuggaau

SEQ ID NO: 3178577 - RNA, 22 nt, Human
gaaaaucuacacuccagugaga

SEQ ID NO: 3178578 - RNA, 18 nt, Human
gaaaaucagccugcucca

SEQ ID NO: 3178579 - RNA, 20 nt, Human
gaaaaucagccugcuccagc

SEQ ID NO: 3178580 - RNA, 22 nt, Human
gaaaaucagccugcuccagcug

SEQ ID NO: 3178581 - RNA, 16 nt, Human
gaaaagugaauugaag

SEQ ID NO: 3178582 - RNA, 16 nt, Human
gaaaaggccaagaggu

SEQ ID NO: 3178583 - RNA, 22 nt, Human
gaaaagcuuuguuuguucuugu

SEQ ID NO: 3178584 - RNA, 16 nt, Human
gaaaagcuuuguuugu

SEQ ID NO: 3178585 - RNA, 19 nt, Human
gaaaaggaagguaguucaa

SEQ ID NO: 3178586 - RNA, 14 nt, Human
gaaaagcuuuguuu

SEQ ID NO: 3178587 - RNA, 12 nt, Human
gaaaacuaaguu

SEQ ID NO: 3178588 - RNA, 20 nt, Human
gaaaacguggcugcuucaag

SEQ ID NO: 3178589 - RNA, 22 nt, Human
gaaaacguggcugcuucaagga

SEQ ID NO: 3178590 - RNA, 19 nt, Human
gaaaacguggcugcuucaa

SEQ ID NO: 3178591 - RNA, 19 nt, Human
gaaaagcugcugacagugu

SEQ ID NO: 3178592 - RNA, 22 nt, Human
gaaaacacuguucucugcccuc

SEQ ID NO: 3178593 - RNA, 22 nt, Human
gaaaacacuguuaucauuuuuu

SEQ ID NO: 3178594 - RNA, 15 nt, Human
gaaaacacuguuauc

SEQ ID NO: 3178595 - RNA, 17 nt, Human
gaaaacacccagggaac

SEQ ID NO: 3178596 - RNA, 24 nt, Human
gaaaacacuguucucugcccucca

SEQ ID NO: 3178597 - RNA, 20 nt, Human
gaaaacagaaauugguaccu

SEQ ID NO: 3178598 - RNA, 15 nt, Human
gaaaacagaaauugg

SEQ ID NO: 3178599 - RNA, 14 nt, Human
gaaaacagaaauug

SEQ ID NO: 3178600 - RNA, 13 nt, Human
gaaaacagaaauu

SEQ ID NO: 3178601 - RNA, 14 nt, Human
gaaacaauuucugu

SEQ ID NO: 3178602 - RNA, 15 nt, Human
gaaacccagcucugg

SEQ ID NO: 3178603 - RNA, 16 nt, Human
gaaacccagcucuggu

SEQ ID NO: 3178604 - RNA, 18 nt, Human
gaaacccagcucuggucc

SEQ ID NO: 3178605 - RNA, 19 nt, Human
gaaacccagcucuggucca

SEQ ID NO: 3178606 - RNA, 13 nt, Human
gaaacccagcucu

SEQ ID NO: 3178607 - RNA, 14 nt, Human
gaaacccagcucug

SEQ ID NO: 3178608 - RNA, 14 nt, Human
gaaacccugucucu

SEQ ID NO: 3178609 - RNA, 23 nt, Human
gaaacccagcucugguccauaga

SEQ ID NO: 3178610 - RNA, 19 nt, Human
gaaaccccuguaggccuca

SEQ ID NO: 3178611 - RNA, 15 nt, Human
gaaacuccagaugcc

SEQ ID NO: 3178612 - RNA, 18 nt, Human
gaaacuaggucugauauu

SEQ ID NO: 3178613 - RNA, 21 nt, Human
gaaacuagcuguuuaaaguuu

SEQ ID NO: 3178614 - RNA, 13 nt, Human
gaaacuaggucug

SEQ ID NO: 3178615 - RNA, 13 nt, Human
gaaaccugucuga

SEQ ID NO: 3178616 - RNA, 17 nt, Human
gaaacuaagauucuuuu

SEQ ID NO: 3178617 - RNA, 12 nt, Human
gaaacuaauaaa

SEQ ID NO: 3178618 - RNA, 13 nt, Human
gaaacuaauaaaa

SEQ ID NO: 3178619 - RNA, 14 nt, Human
gaaacuaauaaaau

SEQ ID NO: 3178620 - RNA, 15 nt, Human
gaaacuaauaaaaua

SEQ ID NO: 3178621 - RNA, 16 nt, Human
gaaacuaauaaaauau

SEQ ID NO: 3178622 - RNA, 17 nt, Human
gaaacuaauaaaauauu

SEQ ID NO: 3178623 - RNA, 18 nt, Human
gaaacuaauaaaauauuu

SEQ ID NO: 3178624 - RNA, 19 nt, Human
gaaacuaauaaaauauuuu

SEQ ID NO: 3178625 - RNA, 20 nt, Human
gaaacuaauaaaauauuuuc

SEQ ID NO: 3178626 - RNA, 21 nt, Human
gaaacuaauaaaauauuuucu

SEQ ID NO: 3178627 - RNA, 22 nt, Human
gaaacuaauaaaauauuuucug

SEQ ID NO: 3178628 - RNA, 23 nt, Human
gaaacuaauaaaauauuuucugu

SEQ ID NO: 3178629 - RNA, 19 nt, Human
gaaagaggcacccuuccau

SEQ ID NO: 3178630 - RNA, 18 nt, Human
gaaagaggcacccuucca

SEQ ID NO: 3178631 - RNA, 15 nt, Human
gaaagaguaggaaga

SEQ ID NO: 3178632 - RNA, 22 nt, Human
gaaagcagaacagugauuacca

SEQ ID NO: 3178633 - RNA, 14 nt, Human
gaaagcagaacagu

SEQ ID NO: 3178634 - RNA, 22 nt, Human
gaaagaggguaauaaccagaca

SEQ ID NO: 3178635 - RNA, 17 nt, Human
gaaagcagaacagugau

SEQ ID NO: 3178636 - RNA, 15 nt, Human
gaaagaggaaaagaa

SEQ ID NO: 3178637 - RNA, 21 nt, Human
gaaagaggaaugaaguacuca

SEQ ID NO: 3178638 - RNA, 20 nt, Human
gaaagaggcagcuugaaacu

SEQ ID NO: 3178639 - RNA, 16 nt, Human
gaaagaggaaaagaaa

SEQ ID NO: 3178640 - RNA, 19 nt, Human
gaaagacuuuuccaacccu

SEQ ID NO: 3178641 - RNA, 17 nt, Human
gaaagacuguacaaagu

SEQ ID NO: 3178642 - RNA, 17 nt, Human
gaaacucuauggucuua

SEQ ID NO: 3178643 - RNA, 14 nt, Human
gaaagcagggacuu

SEQ ID NO: 3178644 - RNA, 14 nt, Human
gaaagcauauugac

SEQ ID NO: 3178645 - RNA, 18 nt, Human
gaaagcauauugacuuuu

SEQ ID NO: 3178646 - RNA, 18 nt, Human
gaaagcauaaagcucaaa

SEQ ID NO: 3178647 - RNA, 22 nt, Human
gaaagcauaaagcucaaaugaa

SEQ ID NO: 3178648 - RNA, 21 nt, Human
gaaagcccugagcuuucugcu

SEQ ID NO: 3178649 - RNA, 22 nt, Human
gaaagcccugagcuuucugcua

SEQ ID NO: 3178650 - RNA, 17 nt, Human
gaaagcccugagcuuuc

SEQ ID NO: 3178651 - RNA, 15 nt, Human
gaaagcuguguuuau

SEQ ID NO: 3178652 - RNA, 20 nt, Human
gaaagcuguguuuauaugga

SEQ ID NO: 3178653 - RNA, 21 nt, Human
gaaagcugcugugaucccagu

SEQ ID NO: 3178654 - RNA, 19 nt, Human
gaaagccuuaagcugcagg

SEQ ID NO: 3178655 - RNA, 18 nt, Human
gaaagccuuaagcugcag

SEQ ID NO: 3178656 - RNA, 21 nt, Human
gaaagccuuucauuuugcuuu

SEQ ID NO: 3178657 - RNA, 17 nt, Human
gaaagccuuucauuuug

SEQ ID NO: 3178658 - RNA, 14 nt, Human
gaaagccuuucauu

SEQ ID NO: 3178659 - RNA, 23 nt, Human
gaaagccuuucauuuugcuuuaa

SEQ ID NO: 3178660 - RNA, 22 nt, Human
gaaagccuuucauuuugcuuua

SEQ ID NO: 3178661 - RNA, 22 nt, Human
cuucccuucucucucucucaaa

SEQ ID NO: 3178662 - RNA, 20 nt, Human
cuucccugguucaagcgauu

SEQ ID NO: 3178663 - RNA, 19 nt, Human
cuucccgcucagcccuccc

SEQ ID NO: 3178664 - RNA, 14 nt, Human
cuuccccuuccuuc

SEQ ID NO: 3178665 - RNA, 18 nt, Human
cuucccgcucagcccucc

SEQ ID NO: 3178666 - RNA, 23 nt, Human
cuucccgcucagcccucccugcc

SEQ ID NO: 3178667 - RNA, 21 nt, Human
cuucccuugcuaccacggccu

SEQ ID NO: 3178668 - RNA, 13 nt, Human
cuuccuaauucca

SEQ ID NO: 3178669 - RNA, 17 nt, Human
cuuccuaauuccacagc

SEQ ID NO: 3178670 - RNA, 18 nt, Human
cuuccuaauuccacagcu

SEQ ID NO: 3178671 - RNA, 19 nt, Human
cuuccuaauuccacagcug

SEQ ID NO: 3178672 - RNA, 14 nt, Human
cuuccuccaaggac

SEQ ID NO: 3178673 - RNA, 23 nt, Human
cuuccucauucccucgucuuucc

SEQ ID NO: 3178674 - RNA, 13 nt, Human
cuuccuccaaccc

SEQ ID NO: 3178675 - RNA, 14 nt, Human
cuuccuccauccuc

SEQ ID NO: 3178676 - RNA, 23 nt, Human
cuuccuccauccuccuccuuccu

SEQ ID NO: 3178677 - RNA, 17 nt, Human
cuuccuccauccuccuc

SEQ ID NO: 3178678 - RNA, 13 nt, Human
cuuccucccucau

SEQ ID NO: 3178679 - RNA, 15 nt, Human
cuuccaggcugggag

SEQ ID NO: 3178680 - RNA, 16 nt, Human
cuuccaggcugggaga

SEQ ID NO: 3178681 - RNA, 19 nt, Human
cuuccaggcugggagagcc

SEQ ID NO: 3178682 - RNA, 13 nt, Human
cuuccaggcagcc

SEQ ID NO: 3178683 - RNA, 12 nt, Human
cuuccaggcagc

SEQ ID NO: 3178684 - RNA, 14 nt, Human
cuuccagggguggg

SEQ ID NO: 3178685 - RNA, 15 nt, Human
cuuccagggguggga

SEQ ID NO: 3178686 - RNA, 17 nt, Human
cuuccaggggugggaca

SEQ ID NO: 3178687 - RNA, 13 nt, Human
cuucccccucccc

SEQ ID NO: 3178688 - RNA, 16 nt, Human
cuucaguaagccguga

SEQ ID NO: 3178689 - RNA, 23 nt, Human
cuucaguaagccgugauuuucau

SEQ ID NO: 3178690 - RNA, 22 nt, Human
cuucagggcagauuuuaguuuu

SEQ ID NO: 3178691 - RNA, 17 nt, Human
cuucagggcagauuuua

SEQ ID NO: 3178692 - RNA, 15 nt, Human
cuucagggagugagg

SEQ ID NO: 3178693 - RNA, 20 nt, Human
cuucagggagucagcuguuu

SEQ ID NO: 3178694 - RNA, 16 nt, Human
cuucagggcagauuuu

SEQ ID NO: 3178695 - RNA, 15 nt, Human
cuucagggcagauuu

SEQ ID NO: 3178696 - RNA, 19 nt, Human
cuucaggcucuucuccuuu

SEQ ID NO: 3178697 - RNA, 22 nt, Human
cuucaggcucuucuccuuucac

SEQ ID NO: 3178698 - RNA, 18 nt, Human
cuucagggagucagcugu

SEQ ID NO: 3178699 - RNA, 17 nt, Human
cuucagggagucagcug

SEQ ID NO: 3178700 - RNA, 16 nt, Human
cuucaguggcagcugc

SEQ ID NO: 3178701 - RNA, 15 nt, Human
cuucaguggcagcug

SEQ ID NO: 3178702 - RNA, 14 nt, Human
cuucaguggcagcu

SEQ ID NO: 3178703 - RNA, 13 nt, Human
cuucaguggcagc

SEQ ID NO: 3178704 - RNA, 18 nt, Human
cuucagugccuuauggaa

SEQ ID NO: 3178705 - RNA, 22 nt, Human
cuucagugccuuauggaacacu

SEQ ID NO: 3178706 - RNA, 15 nt, Human
cuucaguaagccgug

SEQ ID NO: 3178707 - RNA, 20 nt, Human
cuucauucaacccaccugcg

SEQ ID NO: 3178708 - RNA, 19 nt, Human
cuuccacaagagcccaggc

SEQ ID NO: 3178709 - RNA, 21 nt, Human
cuuccacaagagcccaggccu

SEQ ID NO: 3178710 - RNA, 17 nt, Human
cuuccacaagagcccag

SEQ ID NO: 3178711 - RNA, 12 nt, Human
cuucauuuaaaa

SEQ ID NO: 3178712 - RNA, 16 nt, Human
cuuccacaagagccca

SEQ ID NO: 3178713 - RNA, 18 nt, Human
cuuccaccugcucugcug

SEQ ID NO: 3178714 - RNA, 17 nt, Human
cuuccaccugcucugcu

SEQ ID NO: 3178715 - RNA, 16 nt, Human
cuuccaccugcucugc

SEQ ID NO: 3178716 - RNA, 15 nt, Human
cuuccaccugcucug

SEQ ID NO: 3178717 - RNA, 14 nt, Human
cuuccaccugcucu

SEQ ID NO: 3178718 - RNA, 12 nt, Human
cuuccaggcugg

SEQ ID NO: 3178719 - RNA, 14 nt, Human
cuuccaggcuggga

SEQ ID NO: 3178720 - RNA, 11 nt, Human
cuuccaggcag

SEQ ID NO: 3178721 - RNA, 20 nt, Human
cuuauaucuaaaucugucca

SEQ ID NO: 3178722 - RNA, 17 nt, Human
cuuaucaguuugcuaau

SEQ ID NO: 3178723 - RNA, 20 nt, Human
cuuauccacgagagcgcagc

SEQ ID NO: 3178724 - RNA, 21 nt, Human
cuuauccacgagagcgcagca

SEQ ID NO: 3178725 - RNA, 15 nt, Human
cuuauacauuugaua

SEQ ID NO: 3178726 - RNA, 12 nt, Human
cuuauaaaacag

SEQ ID NO: 3178727 - RNA, 14 nt, Human
cuuauaaaacagag

SEQ ID NO: 3178728 - RNA, 13 nt, Human
cuuaguuugugaa

SEQ ID NO: 3178729 - RNA, 22 nt, Human
cuuaguuugugaauugauuuug

SEQ ID NO: 3178730 - RNA, 14 nt, Human
cuuauagacaacau

SEQ ID NO: 3178731 - RNA, 17 nt, Human
cuuauauaugcacuuaa

SEQ ID NO: 3178732 - RNA, 22 nt, Human
cuuauauaugcacuuaauuugu

SEQ ID NO: 3178733 - RNA, 23 nt, Human
cuuauauaugcacuuaauuuguu

SEQ ID NO: 3178734 - RNA, 20 nt, Human
cuuagugggguuuuauaucc

SEQ ID NO: 3178735 - RNA, 18 nt, Human
cuuagugggguuuuauau

SEQ ID NO: 3178736 - RNA, 12 nt, Human
cuuaguggacag

SEQ ID NO: 3178737 - RNA, 18 nt, Human
cuuagucacugagacagc

SEQ ID NO: 3178738 - RNA, 19 nt, Human
cuuagucacugagacagcc

SEQ ID NO: 3178739 - RNA, 14 nt, Human
cuuagucacugaga

SEQ ID NO: 3178740 - RNA, 13 nt, Human
cuuagauguauau

SEQ ID NO: 3178741 - RNA, 16 nt, Human
cuuagucacugagaca

SEQ ID NO: 3178742 - RNA, 13 nt, Human
cuguucugguaau

SEQ ID NO: 3178743 - RNA, 16 nt, Human
cuguucuggcagaguu

SEQ ID NO: 3178744 - RNA, 18 nt, Human
cuguucugauauuaauuu

SEQ ID NO: 3178745 - RNA, 20 nt, Human
cuguucugauauuaauuuau

SEQ ID NO: 3178746 - RNA, 16 nt, Human
cuguucugcacacagc

SEQ ID NO: 3178747 - RNA, 15 nt, Human
cuuauuucauuucuu

SEQ ID NO: 3178748 - RNA, 18 nt, Human
cuuauuuguauuuuuccu

SEQ ID NO: 3178749 - RNA, 21 nt, Human
cuucaaaaguuuguuugcuua

SEQ ID NO: 3178750 - RNA, 21 nt, Human
cuucaaaauauaaaaugccaa

SEQ ID NO: 3178751 - RNA, 14 nt, Human
cuucaaaauauuga

SEQ ID NO: 3178752 - RNA, 22 nt, Human
cuucaaaauauugagcagaauu

SEQ ID NO: 3178753 - RNA, 17 nt, Human
cuucaaagcaaaugucu

SEQ ID NO: 3178754 - RNA, 13 nt, Human
cuucaaagucuca

SEQ ID NO: 3178755 - RNA, 16 nt, Human
cuucaaagucucaaug

SEQ ID NO: 3178756 - RNA, 20 nt, Human
cuucaaagucucaaugaaau

SEQ ID NO: 3178757 - RNA, 22 nt, Human
cuucaaagucucaaugaaauag

SEQ ID NO: 3178758 - RNA, 14 nt, Human
cuuauuucauuucu

SEQ ID NO: 3178759 - RNA, 23 nt, Human
cuuauuucacuuuaguuuuugaa

SEQ ID NO: 3178760 - RNA, 20 nt, Human
cuuaucucagauauuugcac

SEQ ID NO: 3178761 - RNA, 18 nt, Human
cuuauuuaaugaaagacu

SEQ ID NO: 3178762 - RNA, 17 nt, Human
cuuauuuaaugaaagac

SEQ ID NO: 3178763 - RNA, 15 nt, Human
cuuaucuagcugcau

SEQ ID NO: 3178764 - RNA, 19 nt, Human
cuuaucucagauauuugca

SEQ ID NO: 3178765 - RNA, 15 nt, Human
cuuaucucagauauu

SEQ ID NO: 3178766 - RNA, 20 nt, Human
cuuaucuagcugcauaucuu

SEQ ID NO: 3178767 - RNA, 23 nt, Human
cuucaaucaauaacagccgcucc

SEQ ID NO: 3178768 - RNA, 20 nt, Human
cuucaaucaauaacagccgc

SEQ ID NO: 3178769 - RNA, 23 nt, Human
cuucacagaugggugcuuggagg

SEQ ID NO: 3178770 - RNA, 13 nt, Human
cuucaaggauccu

SEQ ID NO: 3178771 - RNA, 15 nt, Human
cuucaaggauccuga

SEQ ID NO: 3178772 - RNA, 10 nt, Human
cuucaaggau

SEQ ID NO: 3178773 - RNA, 18 nt, Human
cuucaagcugcuuuuugu

SEQ ID NO: 3178774 - RNA, 16 nt, Human
cuucaaccauucccca

SEQ ID NO: 3178775 - RNA, 20 nt, Human
cuucaaccauuccccauggg

SEQ ID NO: 3178776 - RNA, 21 nt, Human
cuucuggugaccuuccaagag

SEQ ID NO: 3178777 - RNA, 14 nt, Human
cuucugguugaugc

SEQ ID NO: 3178778 - RNA, 20 nt, Human
cuucuggugaccuuccaaga

SEQ ID NO: 3178779 - RNA, 18 nt, Human
cuucuggugaccuuccaa

SEQ ID NO: 3178780 - RNA, 16 nt, Human
cuucuggguuccuucc

SEQ ID NO: 3178781 - RNA, 17 nt, Human
cuucuggguuccuuccu

SEQ ID NO: 3178782 - RNA, 23 nt, Human
cuucuggguuccuuccucugagc

SEQ ID NO: 3178783 - RNA, 23 nt, Human
cuucugccugaggggcagccugc

SEQ ID NO: 3178784 - RNA, 22 nt, Human
cuucugucuucacaacagauua

SEQ ID NO: 3178785 - RNA, 21 nt, Human
cuucugucuucacaacagauu

SEQ ID NO: 3178786 - RNA, 18 nt, Human
cuucugucuucacaacag

SEQ ID NO: 3178787 - RNA, 21 nt, Human
cuucuguccuacucuguguca

SEQ ID NO: 3178788 - RNA, 19 nt, Human
cuucuguccuacucugugu

SEQ ID NO: 3178789 - RNA, 18 nt, Human
cuucuguccuacucugug

SEQ ID NO: 3178790 - RNA, 17 nt, Human
cuucuguccuacucugu

SEQ ID NO: 3178791 - RNA, 16 nt, Human
cuucuguccuacucug

SEQ ID NO: 3178792 - RNA, 20 nt, Human
cuucuguacgucugacaggc

SEQ ID NO: 3178793 - RNA, 18 nt, Human
cuucuguacgucugacag

SEQ ID NO: 3178794 - RNA, 15 nt, Human
cuucuguacgucuga

SEQ ID NO: 3178795 - RNA, 14 nt, Human
cuucuguacgucug

SEQ ID NO: 3178796 - RNA, 21 nt, Human
cuucuguacgucugacaggca

SEQ ID NO: 3178797 - RNA, 14 nt, Human
cuucuguaauauuu

SEQ ID NO: 3178798 - RNA, 23 nt, Human
cuucucucucucucaaaauuaua

SEQ ID NO: 3178799 - RNA, 20 nt, Human
cuucugccauuucugagauc

SEQ ID NO: 3178800 - RNA, 13 nt, Human
cuucucugaagga

SEQ ID NO: 3178801 - RNA, 14 nt, Human
cuucucucugcucu

SEQ ID NO: 3178802 - RNA, 13 nt, Human
cuucucucugcuc

SEQ ID NO: 3178803 - RNA, 13 nt, Human
cuucucuccagcc

SEQ ID NO: 3178804 - RNA, 15 nt, Human
cuucucuccagcccc

SEQ ID NO: 3178805 - RNA, 17 nt, Human
cuucucuccagccccug

SEQ ID NO: 3178806 - RNA, 19 nt, Human
cuucucuccagccccugga

SEQ ID NO: 3178807 - RNA, 12 nt, Human
cuucucuccagc

SEQ ID NO: 3178808 - RNA, 20 nt, Human
cuucuccccuuccauuucug

SEQ ID NO: 3178809 - RNA, 19 nt, Human
cuucuccccuuccauuucu

SEQ ID NO: 3178810 - RNA, 14 nt, Human
cuucuccccuucca

SEQ ID NO: 3178811 - RNA, 15 nt, Human
cuucuccccuuccau

SEQ ID NO: 3178812 - RNA, 13 nt, Human
cuucuccaggcug

SEQ ID NO: 3178813 - RNA, 17 nt, Human
cuucucccccauccuac

SEQ ID NO: 3178814 - RNA, 12 nt, Human
cuucuccaggcu

SEQ ID NO: 3178815 - RNA, 17 nt, Human
cuucuccacuggaugga

SEQ ID NO: 3178816 - RNA, 11 nt, Human
cuucuccacuu

SEQ ID NO: 3178817 - RNA, 20 nt, Human
cuucuccacuuucuagccag

SEQ ID NO: 3178818 - RNA, 15 nt, Human
cuucuccacuggaug

SEQ ID NO: 3178819 - RNA, 14 nt, Human
cuucuccacuggau

SEQ ID NO: 3178820 - RNA, 13 nt, Human
cuucuccacugga

SEQ ID NO: 3178821 - RNA, 18 nt, Human
cuuccuggggcccaaaug

SEQ ID NO: 3178822 - RNA, 23 nt, Human
cuuccugggcacacgcugcucug

SEQ ID NO: 3178823 - RNA, 22 nt, Human
cuuccugggcacacgcugcucu

SEQ ID NO: 3178824 - RNA, 21 nt, Human
cuuccugggcacacgcugcuc

SEQ ID NO: 3178825 - RNA, 20 nt, Human
cuuccugggcacacgcugcu

SEQ ID NO: 3178826 - RNA, 21 nt, Human
cuuccugucaagcaaucaaga

SEQ ID NO: 3178827 - RNA, 17 nt, Human
cuuccuggucgaaaguu

SEQ ID NO: 3178828 - RNA, 23 nt, Human
cuuccuggccggugugggggccc

SEQ ID NO: 3178829 - RNA, 19 nt, Human
cuuccugggcacacgcugc

SEQ ID NO: 3178830 - RNA, 18 nt, Human
cuuccugggcacacgcug

SEQ ID NO: 3178831 - RNA, 17 nt, Human
cuucuuuuuuugugaug

SEQ ID NO: 3178832 - RNA, 14 nt, Human
cuugaaaacacugu

SEQ ID NO: 3178833 - RNA, 23 nt, Human
cuugaaaacacuguucucugccc

SEQ ID NO: 3178834 - RNA, 21 nt, Human
cuugaaaagagacaggcaggu

SEQ ID NO: 3178835 - RNA, 15 nt, Human
cuugaaaagagacag

SEQ ID NO: 3178836 - RNA, 18 nt, Human
cuugaaaagagacaggca

SEQ ID NO: 3178837 - RNA, 16 nt, Human
cuugaacauuaaucca

SEQ ID NO: 3178838 - RNA, 23 nt, Human
cuugaacauuaauccacauguuu

SEQ ID NO: 3178839 - RNA, 15 nt, Human
cuucuguccaagcag

SEQ ID NO: 3178840 - RNA, 13 nt, Human
cuucuguggcuca

SEQ ID NO: 3178841 - RNA, 20 nt, Human
cuucugugcccagaauacug

SEQ ID NO: 3178842 - RNA, 21 nt, Human
cuucugugcccagaauacuga

SEQ ID NO: 3178843 - RNA, 14 nt, Human
cuucugugcccaga

SEQ ID NO: 3178844 - RNA, 19 nt, Human
cuucugugcccagaauacu

SEQ ID NO: 3178845 - RNA, 14 nt, Human
cuucugugcaccug

SEQ ID NO: 3178846 - RNA, 15 nt, Human
cuucugugcaccugg

SEQ ID NO: 3178847 - RNA, 17 nt, Human
cuucugugcaccugggc

SEQ ID NO: 3178848 - RNA, 18 nt, Human
cuucugugcaccugggcu

SEQ ID NO: 3178849 - RNA, 21 nt, Human
cuucugugcaccugggcucuc

SEQ ID NO: 3178850 - RNA, 14 nt, Human
cuucuguggguuuc

SEQ ID NO: 3178851 - RNA, 21 nt, Human
cuucuguggguuucuaaagcu

SEQ ID NO: 3178852 - RNA, 13 nt, Human
cuucuguggguuu

SEQ ID NO: 3178853 - RNA, 22 nt, Human
cuucuguggcucacagaacccu

SEQ ID NO: 3178854 - RNA, 15 nt, Human
cuucuguggcucaca

SEQ ID NO: 3178855 - RNA, 17 nt, Human
cuucuguguuugaacug

SEQ ID NO: 3178856 - RNA, 23 nt, Human
cuucugugcccagaauacugaug

SEQ ID NO: 3178857 - RNA, 20 nt, Human
cuugaggguugggcuggugu

SEQ ID NO: 3178858 - RNA, 19 nt, Human
cuugaggguugggcuggug

SEQ ID NO: 3178859 - RNA, 21 nt, Human
cuugaguugauucagcucugc

SEQ ID NO: 3178860 - RNA, 21 nt, Human
cuugaggguugggcugguguc

SEQ ID NO: 3178861 - RNA, 13 nt, Human
cuugagcucagga

SEQ ID NO: 3178862 - RNA, 16 nt, Human
cuugagccugggaggu

SEQ ID NO: 3178863 - RNA, 19 nt, Human
cuugacguauuauuguccu

SEQ ID NO: 3178864 - RNA, 16 nt, Human
cuugaccugcugaagu

SEQ ID NO: 3178865 - RNA, 18 nt, Human
cuugaccucacucagaag

SEQ ID NO: 3178866 - RNA, 17 nt, Human
cuugaccgugaggccag

SEQ ID NO: 3178867 - RNA, 22 nt, Human
cuugaccauucuccaccugcca

SEQ ID NO: 3178868 - RNA, 23 nt, Human
cuugaccauucuccaccugccag

SEQ ID NO: 3178869 - RNA, 18 nt, Human
cuugaccgugaggccaga

SEQ ID NO: 3178870 - RNA, 20 nt, Human
cuugaccgugaggccagaga

SEQ ID NO: 3178871 - RNA, 21 nt, Human
cuugaccgugaggccagagac

SEQ ID NO: 3178872 - RNA, 13 nt, Human
cuugaccucaggu

SEQ ID NO: 3178873 - RNA, 13 nt, Human
cuugaacuccugg

SEQ ID NO: 3178874 - RNA, 13 nt, Human
cuugaacuccuga

SEQ ID NO: 3178875 - RNA, 16 nt, Human
cuugaacuccugaccu

SEQ ID NO: 3178876 - RNA, 14 nt, Human
cuugaaccauaaaa

SEQ ID NO: 3178877 - RNA, 17 nt, Human
cuugaaccauaaaaugu

SEQ ID NO: 3178878 - RNA, 20 nt, Human
cuugaacccgggaggcagag

SEQ ID NO: 3178879 - RNA, 18 nt, Human
cuugaacuccugaccuca

SEQ ID NO: 3178880 - RNA, 22 nt, Human
cugugucuugcaauggcagccu

SEQ ID NO: 3178881 - RNA, 20 nt, Human
cugugucuugcaauggcagc

SEQ ID NO: 3178882 - RNA, 21 nt, Human
cugugucuugcaauggcagcc

SEQ ID NO: 3178883 - RNA, 23 nt, Human
cugugggcgugagaccugccccu

SEQ ID NO: 3178884 - RNA, 21 nt, Human
cuguguguguguauguggggg

SEQ ID NO: 3178885 - RNA, 20 nt, Human
cugugugugcgccuacagga

SEQ ID NO: 3178886 - RNA, 18 nt, Human
cugugugugcgccuacag

SEQ ID NO: 3178887 - RNA, 16 nt, Human
cuguguguuuaugugu

SEQ ID NO: 3178888 - RNA, 17 nt, Human
cuguguguuuaugugug

SEQ ID NO: 3178889 - RNA, 17 nt, Human
cuguguuuacagagaug

SEQ ID NO: 3178890 - RNA, 16 nt, Human
cuguguguugccuggg

SEQ ID NO: 3178891 - RNA, 12 nt, Human
cuguguguuccu

SEQ ID NO: 3178892 - RNA, 13 nt, Human
cuguguguuccug

SEQ ID NO: 3178893 - RNA, 14 nt, Human
cuguguguuccugg

SEQ ID NO: 3178894 - RNA, 15 nt, Human
cuguguguuccuggc

SEQ ID NO: 3178895 - RNA, 23 nt, Human
cuguuaaaagaugaaaauauuug

SEQ ID NO: 3178896 - RNA, 21 nt, Human
cuguuaaaagaugaaaauauu

SEQ ID NO: 3178897 - RNA, 17 nt, Human
cuguuacaaaauguaac

SEQ ID NO: 3178898 - RNA, 23 nt, Human
cuguuaaaaugcaugauugcaga

SEQ ID NO: 3178899 - RNA, 14 nt, Human
cuguuaaaaugcau

SEQ ID NO: 3178900 - RNA, 13 nt, Human
cuguuaaaaugca

SEQ ID NO: 3178901 - RNA, 12 nt, Human
cuguuaaaaugc

SEQ ID NO: 3178902 - RNA, 11 nt, Human
cuguuaaaaug

SEQ ID NO: 3178903 - RNA, 20 nt, Human
cuguuaaaagaugaaaauau

SEQ ID NO: 3178904 - RNA, 19 nt, Human
cuguguuugcuccccuucc

SEQ ID NO: 3178905 - RNA, 14 nt, Human
cuguguuugcuccc

SEQ ID NO: 3178906 - RNA, 22 nt, Human
cuguguuugcuccccuuccccu

SEQ ID NO: 3178907 - RNA, 16 nt, Human
cuguguuuauauggaa

SEQ ID NO: 3178908 - RNA, 22 nt, Human
cuguguuuauauggaagaaagu

SEQ ID NO: 3178909 - RNA, 21 nt, Human
cuguguuuauucaaacugaaa

SEQ ID NO: 3178910 - RNA, 12 nt, Human
cuguguuuauuc

SEQ ID NO: 3178911 - RNA, 19 nt, Human
cuguguuugaacugaaguc

SEQ ID NO: 3178912 - RNA, 13 nt, Human
cuguucucugccc

SEQ ID NO: 3178913 - RNA, 14 nt, Human
cuguucucugcccu

SEQ ID NO: 3178914 - RNA, 15 nt, Human
cuguucucugcccuc

SEQ ID NO: 3178915 - RNA, 16 nt, Human
cuguucucugcccucc

SEQ ID NO: 3178916 - RNA, 17 nt, Human
cuguucucugcccucca

SEQ ID NO: 3178917 - RNA, 18 nt, Human
cuguucucugcccuccaa

SEQ ID NO: 3178918 - RNA, 19 nt, Human
cuguucucugcccuccaag

SEQ ID NO: 3178919 - RNA, 20 nt, Human
cuguucucugcccuccaaga

SEQ ID NO: 3178920 - RNA, 18 nt, Human
cuguucagcugguugagg

SEQ ID NO: 3178921 - RNA, 19 nt, Human
cuguucagcuuuuauuccu

SEQ ID NO: 3178922 - RNA, 17 nt, Human
cuguucagcuuuuauuc

SEQ ID NO: 3178923 - RNA, 13 nt, Human
cuguucagcuuuu

SEQ ID NO: 3178924 - RNA, 20 nt, Human
cuguuacucaaugugugccg

SEQ ID NO: 3178925 - RNA, 20 nt, Human
cuguucagcuuuuauuccug

SEQ ID NO: 3178926 - RNA, 19 nt, Human
cuguucagcugguugaggu

SEQ ID NO: 3178927 - RNA, 21 nt, Human
cuguucagcugguugagguuu

SEQ ID NO: 3178928 - RNA, 18 nt, Human
cuguuacacuuuuuggaa

SEQ ID NO: 3178929 - RNA, 22 nt, Human
cuguuacaaaauguaacuguua

SEQ ID NO: 3178930 - RNA, 19 nt, Human
cuguuacaaaauguaacug

SEQ ID NO: 3178931 - RNA, 18 nt, Human
cuguuacaaaauguaacu

SEQ ID NO: 3178932 - RNA, 19 nt, Human
cuguuacacuuuuuggaag

SEQ ID NO: 3178933 - RNA, 14 nt, Human
cuguuacaguaaug

SEQ ID NO: 3178934 - RNA, 15 nt, Human
cuguuacaguaaugu

SEQ ID NO: 3178935 - RNA, 20 nt, Human
cuguuacaguaaugucauaa

SEQ ID NO: 3178936 - RNA, 16 nt, Human
cuguuaccauuggaaa

SEQ ID NO: 3178937 - RNA, 19 nt, Human
cuguuaccauuggaaauuu

SEQ ID NO: 3178938 - RNA, 17 nt, Human
cuguuaccauuggaaau

SEQ ID NO: 3178939 - RNA, 21 nt, Human
cuguuaccucaacaagaagaa

SEQ ID NO: 3178940 - RNA, 22 nt, Human
cuguuaccucaacaagaagaau

SEQ ID NO: 3178941 - RNA, 22 nt, Human
cuguuaccauuggaaauuucac

SEQ ID NO: 3178942 - RNA, 21 nt, Human
cuguuaccauuggaaauuuca

SEQ ID NO: 3178943 - RNA, 18 nt, Human
cuguucccauucuugcau

SEQ ID NO: 3178944 - RNA, 18 nt, Human
cugucuccauguuugaug

SEQ ID NO: 3178945 - RNA, 19 nt, Human
cugugaggggcucucucau

SEQ ID NO: 3178946 - RNA, 23 nt, Human
cugucucaagagggcacuggugg

SEQ ID NO: 3178947 - RNA, 18 nt, Human
cugugauggggcccugcc

SEQ ID NO: 3178948 - RNA, 17 nt, Human
cugugauggggcccugc

SEQ ID NO: 3178949 - RNA, 20 nt, Human
cugugaguacuacaguccuc

SEQ ID NO: 3178950 - RNA, 21 nt, Human
cugugaguacuacaguccucc

SEQ ID NO: 3178951 - RNA, 23 nt, Human
cugugaguacuacaguccuccca

SEQ ID NO: 3178952 - RNA, 18 nt, Human
cugugccaugugccaggu

SEQ ID NO: 3178953 - RNA, 16 nt, Human
cugugccaugugccag

SEQ ID NO: 3178954 - RNA, 14 nt, Human
cugugccauuuugu

SEQ ID NO: 3178955 - RNA, 19 nt, Human
cugugauggggcccugccu

SEQ ID NO: 3178956 - RNA, 22 nt, Human
cugugaucccaguagaaaauau

SEQ ID NO: 3178957 - RNA, 17 nt, Human
cuguggaugauaaaaca

SEQ ID NO: 3178958 - RNA, 21 nt, Human
cugugggcgugagaccugccc

SEQ ID NO: 3178959 - RNA, 22 nt, Human
cugugggcgugagaccugcccc

SEQ ID NO: 3178960 - RNA, 14 nt, Human
cugugggcccccaa

SEQ ID NO: 3178961 - RNA, 16 nt, Human
cugugccucugggacu

SEQ ID NO: 3178962 - RNA, 14 nt, Human
cugugccucuggga

SEQ ID NO: 3178963 - RNA, 17 nt, Human
cugugccucugccuguc

SEQ ID NO: 3178964 - RNA, 21 nt, Human
cugugcugcccugcccaccug

SEQ ID NO: 3178965 - RNA, 17 nt, Human
cugugccucugggacug

SEQ ID NO: 3178966 - RNA, 22 nt, Human
cugugcugcccugcccaccugg

SEQ ID NO: 3178967 - RNA, 24 nt, Human
cuggggucaggccgggcagagcac

SEQ ID NO: 3178968 - RNA, 21 nt, Human
cuggggucaggccgggcagag

SEQ ID NO: 3178969 - RNA, 22 nt, Human
cuggguaacuagggaagauaau

SEQ ID NO: 3178970 - RNA, 20 nt, Human
cuggguaacuagggaagaua

SEQ ID NO: 3178971 - RNA, 14 nt, Human
cuggguucuaccca

SEQ ID NO: 3178972 - RNA, 15 nt, Human
cuggguucuacccag

SEQ ID NO: 3178973 - RNA, 16 nt, Human
cuggguucuacccagg

SEQ ID NO: 3178974 - RNA, 17 nt, Human
cuggguucuacccaggu

SEQ ID NO: 3178975 - RNA, 20 nt, Human
cugguacaauuucuuuuggu

SEQ ID NO: 3178976 - RNA, 19 nt, Human
cugguacaauuucuuuugg

SEQ ID NO: 3178977 - RNA, 21 nt, Human
cugguacaauuucuuuugguu

SEQ ID NO: 3178978 - RNA, 22 nt, Human
cugggggggauuguaaaauggu

SEQ ID NO: 3178979 - RNA, 18 nt, Human
cugggggcugggcagagg

SEQ ID NO: 3178980 - RNA, 19 nt, Human
cugggggcugggcagagga

SEQ ID NO: 3178981 - RNA, 15 nt, Human
cugggggaagaagcu

SEQ ID NO: 3178982 - RNA, 13 nt, Human
cugggggaugggc

SEQ ID NO: 3178983 - RNA, 18 nt, Human
cugggggaugggccugag

SEQ ID NO: 3178984 - RNA, 16 nt, Human
cugggggaugggccug

SEQ ID NO: 3178985 - RNA, 24 nt, Human
cugggcuucaguggcagcugcuuu

SEQ ID NO: 3178986 - RNA, 23 nt, Human
cugggcuucaguggcagcugcuu

SEQ ID NO: 3178987 - RNA, 13 nt, Human
cugggggaagaag

SEQ ID NO: 3178988 - RNA, 15 nt, Human
cuggggcugcuguga

SEQ ID NO: 3178989 - RNA, 13 nt, Human
cugguuccucccc

SEQ ID NO: 3178990 - RNA, 23 nt, Human
cuguaaucacagcuacuugggag

SEQ ID NO: 3178991 - RNA, 17 nt, Human
cuggugcugcaguaugu

SEQ ID NO: 3178992 - RNA, 16 nt, Human
cugguuccuaggggaa

SEQ ID NO: 3178993 - RNA, 20 nt, Human
cugguuccuaggggaaugag

SEQ ID NO: 3178994 - RNA, 23 nt, Human
cugguuccuaggggaaugagggg

SEQ ID NO: 3178995 - RNA, 12 nt, Human
cugguuccuccc

SEQ ID NO: 3178996 - RNA, 13 nt, Human
cuguacaaaguag

SEQ ID NO: 3178997 - RNA, 14 nt, Human
cuguaauuauuuga

SEQ ID NO: 3178998 - RNA, 15 nt, Human
cuguacaaaguagaa

SEQ ID NO: 3178999 - RNA, 20 nt, Human
cuguaauccuagcacuuugg

SEQ ID NO: 3179000 - RNA, 19 nt, Human
cuguaauccuagcacuuug

SEQ ID NO: 3179001 - RNA, 13 nt, Human
cuguaauauuuac

SEQ ID NO: 3179002 - RNA, 14 nt, Human
cuguaauauuuaca

SEQ ID NO: 3179003 - RNA, 15 nt, Human
cuguaauauuuacaa

SEQ ID NO: 3179004 - RNA, 18 nt, Human
cuguaauauuuacaaugu

SEQ ID NO: 3179005 - RNA, 21 nt, Human
cuguaauauuuacaauguauu

SEQ ID NO: 3179006 - RNA, 22 nt, Human
cuguaauauuuacaauguauua

SEQ ID NO: 3179007 - RNA, 21 nt, Human
cuguaauaacuagaacaaaua

SEQ ID NO: 3179008 - RNA, 17 nt, Human
cuguaaucuuguugaua

SEQ ID NO: 3179009 - RNA, 16 nt, Human
cuguaauguuaauaau

SEQ ID NO: 3179010 - RNA, 13 nt, Human
cugguggcagcug

SEQ ID NO: 3179011 - RNA, 23 nt, Human
cugguggcccgacagccuggcac

SEQ ID NO: 3179012 - RNA, 22 nt, Human
cugguggcccgacagccuggca

SEQ ID NO: 3179013 - RNA, 21 nt, Human
cugguggcccgacagccuggc

SEQ ID NO: 3179014 - RNA, 20 nt, Human
cugguggcccgacagccugg

SEQ ID NO: 3179015 - RNA, 21 nt, Human
cugguggcagcucaccucucc

SEQ ID NO: 3179016 - RNA, 23 nt, Human
cugguggcagcucaccucucccu

SEQ ID NO: 3179017 - RNA, 22 nt, Human
cuggugcugccacacuucaggc

SEQ ID NO: 3179018 - RNA, 20 nt, Human
cuggugcugccacacuucag

SEQ ID NO: 3179019 - RNA, 13 nt, Human
cuggugcugccac

SEQ ID NO: 3179020 - RNA, 12 nt, Human
cuggugcugcca

SEQ ID NO: 3179021 - RNA, 18 nt, Human
cuggucacaggacucugc

SEQ ID NO: 3179022 - RNA, 19 nt, Human
cugguccuaggcuggaagg

SEQ ID NO: 3179023 - RNA, 20 nt, Human
cugguccuaggcuggaagga

SEQ ID NO: 3179024 - RNA, 17 nt, Human
cuguccccgcacugggc

SEQ ID NO: 3179025 - RNA, 18 nt, Human
cuguccccgcacugggcu

SEQ ID NO: 3179026 - RNA, 19 nt, Human
cuguccccgcacugggcuu

SEQ ID NO: 3179027 - RNA, 22 nt, Human
cuguccccgcacugggcuuggg

SEQ ID NO: 3179028 - RNA, 14 nt, Human
cuguccgagcuuug

SEQ ID NO: 3179029 - RNA, 20 nt, Human
cugucccuuacgugaguccu

SEQ ID NO: 3179030 - RNA, 15 nt, Human
cuguccgagcuuuga

SEQ ID NO: 3179031 - RNA, 14 nt, Human
cuguccuacccacc

SEQ ID NO: 3179032 - RNA, 22 nt, Human
cuguccguaguaucagagaugu

SEQ ID NO: 3179033 - RNA, 18 nt, Human
cugucucaaaaaaagaaa

SEQ ID NO: 3179034 - RNA, 22 nt, Human
cugucucaagagggcacuggug

SEQ ID NO: 3179035 - RNA, 16 nt, Human
cugucucaaaaaaaga

SEQ ID NO: 3179036 - RNA, 23 nt, Human
cugucucaaaaaaacacaaaagu

SEQ ID NO: 3179037 - RNA, 17 nt, Human
cugucuagcacuuccuu

SEQ ID NO: 3179038 - RNA, 16 nt, Human
cugucuagcacuuccu

SEQ ID NO: 3179039 - RNA, 23 nt, Human
cugucuagcacuuccuugccagu

SEQ ID NO: 3179040 - RNA, 21 nt, Human
cugucuagcacuuccuugcca

SEQ ID NO: 3179041 - RNA, 20 nt, Human
cugucuagcacuuccuugcc

SEQ ID NO: 3179042 - RNA, 18 nt, Human
cugucuagcacuuccuug

SEQ ID NO: 3179043 - RNA, 22 nt, Human
cuguaucccaugagccucagca

SEQ ID NO: 3179044 - RNA, 23 nt, Human
cuguaucccaugagccucagcau

SEQ ID NO: 3179045 - RNA, 13 nt, Human
cuguaucugugcu

SEQ ID NO: 3179046 - RNA, 23 nt, Human
cuguccaggcacugcugcccagc

SEQ ID NO: 3179047 - RNA, 14 nt, Human
cugucaaggcucag

SEQ ID NO: 3179048 - RNA, 13 nt, Human
cugucaaggcuca

SEQ ID NO: 3179049 - RNA, 23 nt, Human
cugucaaacauuaguacuuuaua

SEQ ID NO: 3179050 - RNA, 22 nt, Human
cugucaaacauuaguacuuuau

SEQ ID NO: 3179051 - RNA, 21 nt, Human
cugucaaacauuaguacuuua

SEQ ID NO: 3179052 - RNA, 20 nt, Human
cugucaaacauuaguacuuu

SEQ ID NO: 3179053 - RNA, 15 nt, Human
cugucaaacauuagu

SEQ ID NO: 3179054 - RNA, 13 nt, Human
cugucaaacauua

SEQ ID NO: 3179055 - RNA, 12 nt, Human
cugucaaacauu

SEQ ID NO: 3179056 - RNA, 16 nt, Human
cuguauacguuucaaa

SEQ ID NO: 3179057 - RNA, 21 nt, Human
cuguauaauacuuuguauaca

SEQ ID NO: 3179058 - RNA, 21 nt, Human
cuguauagacaggagaagaaa

SEQ ID NO: 3179059 - RNA, 12 nt, Human
cuguauauuugu

SEQ ID NO: 3179060 - RNA, 21 nt, Human
cuguauaucaggguacaaaaa

SEQ ID NO: 3179061 - RNA, 15 nt, Human
cuguauauuuguaug

SEQ ID NO: 3179062 - RNA, 16 nt, Human
cuguauauuuguauga

SEQ ID NO: 3179063 - RNA, 19 nt, Human
cuguauauuuguaugauau

SEQ ID NO: 3179064 - RNA, 21 nt, Human
cuguauauuuguaugauauuu

SEQ ID NO: 3179065 - RNA, 13 nt, Human
cuguacagagccc

SEQ ID NO: 3179066 - RNA, 15 nt, Human
cuguacaaugacuuu

SEQ ID NO: 3179067 - RNA, 11 nt, Human
cugcugggcuu

SEQ ID NO: 3179068 - RNA, 23 nt, Human
cugcugguucaggguuggccccu

SEQ ID NO: 3179069 - RNA, 15 nt, Human
cugcugguucagggu

SEQ ID NO: 3179070 - RNA, 13 nt, Human
cugcugguucagg

SEQ ID NO: 3179071 - RNA, 19 nt, Human
cugcuuccagugaggcucu

SEQ ID NO: 3179072 - RNA, 20 nt, Human
cugcuuccagugaggcucug

SEQ ID NO: 3179073 - RNA, 21 nt, Human
cugcuuccagugaggcucugc

SEQ ID NO: 3179074 - RNA, 23 nt, Human
cugcuuccagugaggcucugccc

SEQ ID NO: 3179075 - RNA, 16 nt, Human
cugcuuccagugaggc

SEQ ID NO: 3179076 - RNA, 18 nt, Human
cugcuuccagugaggcuc

SEQ ID NO: 3179077 - RNA, 15 nt, Human
cugcuuccagugagg

SEQ ID NO: 3179078 - RNA, 14 nt, Human
cugcugcuggcugg

SEQ ID NO: 3179079 - RNA, 15 nt, Human
cugcugcuggcuggu

SEQ ID NO: 3179080 - RNA, 17 nt, Human
cugcugcuucauguuug

SEQ ID NO: 3179081 - RNA, 20 nt, Human
cugcuggccggacacccgac

SEQ ID NO: 3179082 - RNA, 18 nt, Human
cugcugaaacaacaaaua

SEQ ID NO: 3179083 - RNA, 21 nt, Human
cugcucuccucuugccacugc

SEQ ID NO: 3179084 - RNA, 18 nt, Human
cugcugaaggaauaaauu

SEQ ID NO: 3179085 - RNA, 17 nt, Human
cugcugaaggaauaaau

SEQ ID NO: 3179086 - RNA, 11 nt, Human
cugcugaaggc

SEQ ID NO: 3179087 - RNA, 14 nt, Human
cugcugcagagcag

SEQ ID NO: 3179088 - RNA, 15 nt, Human
cugcugcagagcagu

SEQ ID NO: 3179089 - RNA, 21 nt, Human
cugcugcagagcaguaaggga

SEQ ID NO: 3179090 - RNA, 15 nt, Human
cugcugcaguugcca

SEQ ID NO: 3179091 - RNA, 16 nt, Human
cugcugccaugaacug

SEQ ID NO: 3179092 - RNA, 18 nt, Human
cugcugccaguaccagcc

SEQ ID NO: 3179093 - RNA, 11 nt, Human
cugcugccagu

SEQ ID NO: 3179094 - RNA, 21 nt, Human
cugcugccaugaacugucaag

SEQ ID NO: 3179095 - RNA, 15 nt, Human
cugcugcccagccuc

SEQ ID NO: 3179096 - RNA, 12 nt, Human
cugcugcccagc

SEQ ID NO: 3179097 - RNA, 22 nt, Human
cugcugcccagccuccaagcuc

SEQ ID NO: 3179098 - RNA, 19 nt, Human
cugcucuccgaccagacac

SEQ ID NO: 3179099 - RNA, 20 nt, Human
cugcucuccucuugccacug

SEQ ID NO: 3179100 - RNA, 14 nt, Human
cugcucuccucuug

SEQ ID NO: 3179101 - RNA, 19 nt, Human
cugcuccagcuguucagcu

SEQ ID NO: 3179102 - RNA, 16 nt, Human
cugcgaggcuaugagu

SEQ ID NO: 3179103 - RNA, 20 nt, Human
cugcuccagcuguucagcug

SEQ ID NO: 3179104 - RNA, 15 nt, Human
cugcuccagcuguuc

SEQ ID NO: 3179105 - RNA, 19 nt, Human
cugcgaccacaagaaggau

SEQ ID NO: 3179106 - RNA, 20 nt, Human
cugccuuggggucagguuga

SEQ ID NO: 3179107 - RNA, 19 nt, Human
cugccuuggggucagguug

SEQ ID NO: 3179108 - RNA, 22 nt, Human
cugccuuggggucagguugaca

SEQ ID NO: 3179109 - RNA, 14 nt, Human
cugccgcagcccug

SEQ ID NO: 3179110 - RNA, 15 nt, Human
cugccgcagcccugc

SEQ ID NO: 3179111 - RNA, 21 nt, Human
cugcccuuucugggcaccggg

SEQ ID NO: 3179112 - RNA, 14 nt, Human
cugcccuuuguccu

SEQ ID NO: 3179113 - RNA, 23 nt, Human
cugcccuuuguccuccugcugcc

SEQ ID NO: 3179114 - RNA, 20 nt, Human
cugcccuuuguccuccugcu

SEQ ID NO: 3179115 - RNA, 18 nt, Human
cugcccuuuguccuccug

SEQ ID NO: 3179116 - RNA, 17 nt, Human
cugccgcagcccugcag

SEQ ID NO: 3179117 - RNA, 18 nt, Human
cugccgcagcccugcaga

SEQ ID NO: 3179118 - RNA, 20 nt, Human
cugcccugcgggucacagga

SEQ ID NO: 3179119 - RNA, 14 nt, Human
cugcccugcuguuu

SEQ ID NO: 3179120 - RNA, 22 nt, Human
cugcccugcugagucccaggcu

SEQ ID NO: 3179121 - RNA, 12 nt, Human
cugcccuccaag

SEQ ID NO: 3179122 - RNA, 14 nt, Human
cucccuucccaccu

SEQ ID NO: 3179123 - RNA, 15 nt, Human
cucccuucccaccuc

SEQ ID NO: 3179124 - RNA, 16 nt, Human
cucccuucccaccucu

SEQ ID NO: 3179125 - RNA, 17 nt, Human
cucccuucccaccucuc

SEQ ID NO: 3179126 - RNA, 15 nt, Human
cugccucuucucuac

SEQ ID NO: 3179127 - RNA, 14 nt, Human
cugccucuucucua

SEQ ID NO: 3179128 - RNA, 17 nt, Human
cugccugcccaggcccc

SEQ ID NO: 3179129 - RNA, 16 nt, Human
cugccugcccaggccc

SEQ ID NO: 3179130 - RNA, 15 nt, Human
cugccugcccaggcc

SEQ ID NO: 3179131 - RNA, 15 nt, Human
cugccugaagucaca

SEQ ID NO: 3179132 - RNA, 21 nt, Human
cugccugggaucccucauccu

SEQ ID NO: 3179133 - RNA, 17 nt, Human
cugccuugcccacuccu

SEQ ID NO: 3179134 - RNA, 20 nt, Human
cugccuugcccacuccugcu

SEQ ID NO: 3179135 - RNA, 18 nt, Human
cugccuugcccacuccug

SEQ ID NO: 3179136 - RNA, 22 nt, Human
cugccuugcccacuccugcucu

SEQ ID NO: 3179137 - RNA, 20 nt, Human
cugccugcccaggccccugc

SEQ ID NO: 3179138 - RNA, 23 nt, Human
cugccucugacacacagcucugu

SEQ ID NO: 3179139 - RNA, 22 nt, Human
cugccucugacacacagcucug

SEQ ID NO: 3179140 - RNA, 14 nt, Human
cugccuaacaaaau

SEQ ID NO: 3179141 - RNA, 20 nt, Human
cugccuaaauccacucugca

SEQ ID NO: 3179142 - RNA, 11 nt, Human
cugccucccau

SEQ ID NO: 3179143 - RNA, 12 nt, Human
cugccucccauc

SEQ ID NO: 3179144 - RNA, 14 nt, Human
cugccucccaucac

SEQ ID NO: 3179145 - RNA, 16 nt, Human
cugccucccaucaccc

SEQ ID NO: 3179146 - RNA, 19 nt, Human
cugccucccaucacccgcu

SEQ ID NO: 3179147 - RNA, 16 nt, Human
cugcuuccuauaauuu

SEQ ID NO: 3179148 - RNA, 14 nt, Human
cugcuuccucagag

SEQ ID NO: 3179149 - RNA, 20 nt, Human
cugcuuccuauaauuuugau

SEQ ID NO: 3179150 - RNA, 12 nt, Human
cuggaccccagc

SEQ ID NO: 3179151 - RNA, 18 nt, Human
cuggaccccaucugugaa

SEQ ID NO: 3179152 - RNA, 17 nt, Human
cuggaccccaucuguga

SEQ ID NO: 3179153 - RNA, 16 nt, Human
cuggaccccagccuca

SEQ ID NO: 3179154 - RNA, 15 nt, Human
cuggaccccagccuc

SEQ ID NO: 3179155 - RNA, 14 nt, Human
cuggaccccagccu

SEQ ID NO: 3179156 - RNA, 13 nt, Human
cuggaccccagcc

SEQ ID NO: 3179157 - RNA, 17 nt, Human
cuggacaggcauguucu

SEQ ID NO: 3179158 - RNA, 14 nt, Human
cuggacaggcaugu

SEQ ID NO: 3179159 - RNA, 23 nt, Human
cuggacaggcauguucucugagg

SEQ ID NO: 3179160 - RNA, 14 nt, Human
cuggacaggccagg

SEQ ID NO: 3179161 - RNA, 20 nt, Human
cuggaccuugaacuggguac

SEQ ID NO: 3179162 - RNA, 17 nt, Human
cuggaccuugaacuggg

SEQ ID NO: 3179163 - RNA, 21 nt, Human
cuggaccuugaacuggguacu

SEQ ID NO: 3179164 - RNA, 19 nt, Human
cuggacuccucuguccagg

SEQ ID NO: 3179165 - RNA, 18 nt, Human
cuggacuccucuguccag

SEQ ID NO: 3179166 - RNA, 17 nt, Human
cuggacuccucugucca

SEQ ID NO: 3179167 - RNA, 14 nt, Human
cuggacuccucugu

SEQ ID NO: 3179168 - RNA, 15 nt, Human
cuggacccuguggau

SEQ ID NO: 3179169 - RNA, 17 nt, Human
cuggaccccagccucaa

SEQ ID NO: 3179170 - RNA, 22 nt, Human
cuggaccccaucugugaauaag

SEQ ID NO: 3179171 - RNA, 20 nt, Human
cuggaccccaucugugaaua

SEQ ID NO: 3179172 - RNA, 19 nt, Human
cuggaccccaucugugaau

SEQ ID NO: 3179173 - RNA, 16 nt, Human
cuggaccuugaacugg

SEQ ID NO: 3179174 - RNA, 12 nt, Human
cuggagguuugu

SEQ ID NO: 3179175 - RNA, 17 nt, Human
cuggagguuuguuuaga

SEQ ID NO: 3179176 - RNA, 17 nt, Human
cuggagugcagugagcc

SEQ ID NO: 3179177 - RNA, 16 nt, Human
cuggagugcagugagc

SEQ ID NO: 3179178 - RNA, 15 nt, Human
cuggagugcagugag

SEQ ID NO: 3179179 - RNA, 14 nt, Human
cuggagugcaguga

SEQ ID NO: 3179180 - RNA, 17 nt, Human
cuggagguacgaaaaga

SEQ ID NO: 3179181 - RNA, 22 nt, Human
cuggagguacgaaaagagggga

SEQ ID NO: 3179182 - RNA, 12 nt, Human
cuggagcucugc

SEQ ID NO: 3179183 - RNA, 13 nt, Human
cuggagcucugcc

SEQ ID NO: 3179184 - RNA, 16 nt, Human
cuggagcucugcccau

SEQ ID NO: 3179185 - RNA, 15 nt, Human
cuggacucccucaag

SEQ ID NO: 3179186 - RNA, 21 nt, Human
cuggccaguggcuggaucugu

SEQ ID NO: 3179187 - RNA, 15 nt, Human
cuggcccacugcauc

SEQ ID NO: 3179188 - RNA, 14 nt, Human
cuggccagaugcac

SEQ ID NO: 3179189 - RNA, 22 nt, Human
cuggcacaguuuucugagaaag

SEQ ID NO: 3179190 - RNA, 21 nt, Human
cuggcacaguuuucugagaaa

SEQ ID NO: 3179191 - RNA, 20 nt, Human
cuggcacaguuuucugagaa

SEQ ID NO: 3179192 - RNA, 20 nt, Human
cuggagugcagugagccgag

SEQ ID NO: 3179193 - RNA, 19 nt, Human
cuggcacccggccccugcu

SEQ ID NO: 3179194 - RNA, 21 nt, Human
cuggcacccggccccugcugg

SEQ ID NO: 3179195 - RNA, 20 nt, Human
cuggcacccggccccugcug

SEQ ID NO: 3179196 - RNA, 19 nt, Human
cuggcacugcuuccaguga

SEQ ID NO: 3179197 - RNA, 20 nt, Human
cuggcacugcuuccagugag

SEQ ID NO: 3179198 - RNA, 23 nt, Human
cuggcacugcuuccagugaggcu

SEQ ID NO: 3179199 - RNA, 18 nt, Human
cuggcacugcuuccagug

SEQ ID NO: 3179200 - RNA, 14 nt, Human
cuggcacuuggaga

SEQ ID NO: 3179201 - RNA, 21 nt, Human
cuggcacuuggagacuuguau

SEQ ID NO: 3179202 - RNA, 23 nt, Human
cuggcugcagagcagugggccug

SEQ ID NO: 3179203 - RNA, 20 nt, Human
cuggcucuuccaggcuggga

SEQ ID NO: 3179204 - RNA, 24 nt, Human
cuggcucuuccaggcugggagagc

SEQ ID NO: 3179205 - RNA, 21 nt, Human
cuggcucuuccaggcugggag

SEQ ID NO: 3179206 - RNA, 22 nt, Human
cuggcucuuccaggcugggaga

SEQ ID NO: 3179207 - RNA, 23 nt, Human
cuggccuucggccuccauccuga

SEQ ID NO: 3179208 - RNA, 20 nt, Human
cuggccuugggauccaggcc

SEQ ID NO: 3179209 - RNA, 19 nt, Human
cuggccuugggauccaggc

SEQ ID NO: 3179210 - RNA, 15 nt, Human
cuggccuuguggucc

SEQ ID NO: 3179211 - RNA, 22 nt, Human
cuggccuugggauccaggcccc

SEQ ID NO: 3179212 - RNA, 15 nt, Human
cuggcgugcaguggu

SEQ ID NO: 3179213 - RNA, 14 nt, Human
cuggcgugcagugg

SEQ ID NO: 3179214 - RNA, 22 nt, Human
cuggccuucggccuccauccug

SEQ ID NO: 3179215 - RNA, 18 nt, Human
cuggccugucugugaaga

SEQ ID NO: 3179216 - RNA, 13 nt, Human
cuggccugucugu

SEQ ID NO: 3179217 - RNA, 18 nt, Human
cuggccuggggucaggcc

SEQ ID NO: 3179218 - RNA, 16 nt, Human
cuggccuggggucagg

SEQ ID NO: 3179219 - RNA, 24 nt, Human
cuggccuggccccucagggucccu

SEQ ID NO: 3179220 - RNA, 19 nt, Human
cuggccuggccccucaggg

SEQ ID NO: 3179221 - RNA, 18 nt, Human
cuggccucugcacucccc

SEQ ID NO: 3179222 - RNA, 20 nt, Human
cuggccucugcacuccccug

SEQ ID NO: 3179223 - RNA, 21 nt, Human
cuggccucugcacuccccugc

SEQ ID NO: 3179224 - RNA, 16 nt, Human
cuggccucugcacucc

SEQ ID NO: 3179225 - RNA, 13 nt, Human
cuggcccaucaug

SEQ ID NO: 3179226 - RNA, 17 nt, Human
cuggccccacaccagcc

SEQ ID NO: 3179227 - RNA, 12 nt, Human
cuggccccacac

SEQ ID NO: 3179228 - RNA, 21 nt, Human
cuggcccauguauggccagga

SEQ ID NO: 3179229 - RNA, 19 nt, Human
cuggcccauguauggccag

SEQ ID NO: 3179230 - RNA, 20 nt, Human
ccauuuuuuauauuucaagu

SEQ ID NO: 3179231 - RNA, 13 nt, Human
cccaacacgggua

SEQ ID NO: 3179232 - RNA, 14 nt, Human
ccauuuuuuauauu

SEQ ID NO: 3179233 - RNA, 17 nt, Human
ccauuuuuuauauuuca

SEQ ID NO: 3179234 - RNA, 16 nt, Human
ccauuuuuuauauuuc

SEQ ID NO: 3179235 - RNA, 14 nt, Human
ccauuuuuacaagu

SEQ ID NO: 3179236 - RNA, 23 nt, Human
ccauuuuucccaggcaaauaaaa

SEQ ID NO: 3179237 - RNA, 20 nt, Human
ccauuuugcugucccuuuuc

SEQ ID NO: 3179238 - RNA, 13 nt, Human
ccauuuuccugca

SEQ ID NO: 3179239 - RNA, 21 nt, Human
ccauuuuguauuuuacuaaua

SEQ ID NO: 3179240 - RNA, 12 nt, Human
cccaagggccug

SEQ ID NO: 3179241 - RNA, 14 nt, Human
cccaagggccuggc

SEQ ID NO: 3179242 - RNA, 16 nt, Human
cccaagggccuggccu

SEQ ID NO: 3179243 - RNA, 22 nt, Human
cccaagguucugggugcaggag

SEQ ID NO: 3179244 - RNA, 21 nt, Human
cccaagguucugggugcagga

SEQ ID NO: 3179245 - RNA, 13 nt, Human
cccacaggaucag

SEQ ID NO: 3179246 - RNA, 17 nt, Human
cccacaggaucagucug

SEQ ID NO: 3179247 - RNA, 19 nt, Human
cccacauagugaugguucc

SEQ ID NO: 3179248 - RNA, 18 nt, Human
cccacaggcccuuccucu

SEQ ID NO: 3179249 - RNA, 16 nt, Human
cccacaggcccuuccu

SEQ ID NO: 3179250 - RNA, 23 nt, Human
cccacaguauauuuuauuucaau

SEQ ID NO: 3179251 - RNA, 16 nt, Human
cccagaaugaggcugc

SEQ ID NO: 3179252 - RNA, 14 nt, Human
cccagaauacugau

SEQ ID NO: 3179253 - RNA, 14 nt, Human
cccagaagugcaga

SEQ ID NO: 3179254 - RNA, 22 nt, Human
cccagaauaaacuggcagcuca

SEQ ID NO: 3179255 - RNA, 24 nt, Human
cccagaauaaacuggcagcucagc

SEQ ID NO: 3179256 - RNA, 21 nt, Human
cccacgcuggagugcagugag

SEQ ID NO: 3179257 - RNA, 21 nt, Human
cccacgcugacuacagggccg

SEQ ID NO: 3179258 - RNA, 15 nt, Human
cccaccuuggcugca

SEQ ID NO: 3179259 - RNA, 14 nt, Human
cccaccuuggcugc

SEQ ID NO: 3179260 - RNA, 22 nt, Human
cccaccuuggcucaaguccucu

SEQ ID NO: 3179261 - RNA, 15 nt, Human
cccaccuuggcucaa

SEQ ID NO: 3179262 - RNA, 15 nt, Human
cccacgcccccacug

SEQ ID NO: 3179263 - RNA, 14 nt, Human
cccacgcugacuac

SEQ ID NO: 3179264 - RNA, 20 nt, Human
cccacgcugacuacagggcc

SEQ ID NO: 3179265 - RNA, 19 nt, Human
cccacgcugacuacagggc

SEQ ID NO: 3179266 - RNA, 16 nt, Human
cccacgcugacuacag

SEQ ID NO: 3179267 - RNA, 17 nt, Human
cccacgcccccacuggu

SEQ ID NO: 3179268 - RNA, 19 nt, Human
cccacgcccccacugguga

SEQ ID NO: 3179269 - RNA, 14 nt, Human
cccaccucucucac

SEQ ID NO: 3179270 - RNA, 17 nt, Human
cccaccucucucacucc

SEQ ID NO: 3179271 - RNA, 13 nt, Human
cccaccucucuca

SEQ ID NO: 3179272 - RNA, 21 nt, Human
cccaccucagccucccaaagu

SEQ ID NO: 3179273 - RNA, 12 nt, Human
cccaccuuggcu

SEQ ID NO: 3179274 - RNA, 15 nt, Human
cccaccucagccucc

SEQ ID NO: 3179275 - RNA, 14 nt, Human
cccaccucagccuc

SEQ ID NO: 3179276 - RNA, 12 nt, Human
cccaccucagcc

SEQ ID NO: 3179277 - RNA, 22 nt, Human
cccacauccggggccagcuccg

SEQ ID NO: 3179278 - RNA, 19 nt, Human
cccacauggugauguugac

SEQ ID NO: 3179279 - RNA, 18 nt, Human
cccacaugccaggggccu

SEQ ID NO: 3179280 - RNA, 12 nt, Human
cccacaugccag

SEQ ID NO: 3179281 - RNA, 13 nt, Human
ccauuugcuccuu

SEQ ID NO: 3179282 - RNA, 11 nt, Human
ccauuuuccug

SEQ ID NO: 3179283 - RNA, 18 nt, Human
ccauuuggagggccuggg

SEQ ID NO: 3179284 - RNA, 15 nt, Human
ccauucugccugccc

SEQ ID NO: 3179285 - RNA, 13 nt, Human
ccauuucugccuu

SEQ ID NO: 3179286 - RNA, 14 nt, Human
ccauuucugccuuu

SEQ ID NO: 3179287 - RNA, 20 nt, Human
ccauucguacauaauacuga

SEQ ID NO: 3179288 - RNA, 21 nt, Human
ccauuauuaucaaguagacua

SEQ ID NO: 3179289 - RNA, 21 nt, Human
ccauucguacauaauacugaa

SEQ ID NO: 3179290 - RNA, 18 nt, Human
ccauguuuuguuuacggu

SEQ ID NO: 3179291 - RNA, 12 nt, Human
ccauuaauuuaa

SEQ ID NO: 3179292 - RNA, 15 nt, Human
ccauuaauuuaaaug

SEQ ID NO: 3179293 - RNA, 14 nt, Human
ccauuaccaaaaua

SEQ ID NO: 3179294 - RNA, 14 nt, Human
ccauuaacugcuuc

SEQ ID NO: 3179295 - RNA, 14 nt, Human
ccauuaaagucaga

SEQ ID NO: 3179296 - RNA, 19 nt, Human
ccauuaaagucagaaguuu

SEQ ID NO: 3179297 - RNA, 18 nt, Human
ccauuaaaauaugcacua

SEQ ID NO: 3179298 - RNA, 14 nt, Human
ccaucucugcucca

SEQ ID NO: 3179299 - RNA, 13 nt, Human
ccaucucugcucc

SEQ ID NO: 3179300 - RNA, 15 nt, Human
ccaucugugaauaag

SEQ ID NO: 3179301 - RNA, 14 nt, Human
ccaucugugaauaa

SEQ ID NO: 3179302 - RNA, 16 nt, Human
ccaucugguuuucucu

SEQ ID NO: 3179303 - RNA, 12 nt, Human
ccaucugugaau

SEQ ID NO: 3179304 - RNA, 15 nt, Human
ccaggcccucugccc

SEQ ID NO: 3179305 - RNA, 23 nt, Human
ccaggcugggagagccuuccagg

SEQ ID NO: 3179306 - RNA, 22 nt, Human
ccaggcuuagucacugagacag

SEQ ID NO: 3179307 - RNA, 23 nt, Human
ccaggcuuagucacugagacagc

SEQ ID NO: 3179308 - RNA, 21 nt, Human
ccaggcuuagucacugagaca

SEQ ID NO: 3179309 - RNA, 16 nt, Human
ccaggccacuggcccc

SEQ ID NO: 3179310 - RNA, 21 nt, Human
ccaggccacaagacccuugug

SEQ ID NO: 3179311 - RNA, 20 nt, Human
ccaggaggccagccuugacc

SEQ ID NO: 3179312 - RNA, 15 nt, Human
ccaggaggccagccu

SEQ ID NO: 3179313 - RNA, 18 nt, Human
ccaggaggccagccuuga

SEQ ID NO: 3179314 - RNA, 14 nt, Human
ccaggaggccagcc

SEQ ID NO: 3179315 - RNA, 23 nt, Human
ccaggccacuggccccugagauc

SEQ ID NO: 3179316 - RNA, 13 nt, Human
ccaggcccucugc

SEQ ID NO: 3179317 - RNA, 14 nt, Human
ccaggcccucugcc

SEQ ID NO: 3179318 - RNA, 16 nt, Human
ccaggccccugccacc

SEQ ID NO: 3179319 - RNA, 15 nt, Human
ccaggccccugccac

SEQ ID NO: 3179320 - RNA, 14 nt, Human
ccaggccccugcca

SEQ ID NO: 3179321 - RNA, 16 nt, Human
ccagggcccgggaagc

SEQ ID NO: 3179322 - RNA, 23 nt, Human
ccagguuuuguuccgcccagugg

SEQ ID NO: 3179323 - RNA, 20 nt, Human
ccagguuuuguuccgcccag

SEQ ID NO: 3179324 - RNA, 23 nt, Human
ccagguuuugcacucuuguuucu

SEQ ID NO: 3179325 - RNA, 23 nt, Human
ccagugaccuggaaggcccagca

SEQ ID NO: 3179326 - RNA, 20 nt, Human
ccagugaccuggaaggccca

SEQ ID NO: 3179327 - RNA, 12 nt, Human
ccagugaccugg

SEQ ID NO: 3179328 - RNA, 15 nt, Human
ccaguggcagggcac

SEQ ID NO: 3179329 - RNA, 18 nt, Human
ccaguggcagggcacagg

SEQ ID NO: 3179330 - RNA, 16 nt, Human
ccaguggcagggcaca

SEQ ID NO: 3179331 - RNA, 18 nt, Human
ccaguggcuauggccugu

SEQ ID NO: 3179332 - RNA, 14 nt, Human
ccaguggcagggca

SEQ ID NO: 3179333 - RNA, 22 nt, Human
ccaguggcggaagugaccgcac

SEQ ID NO: 3179334 - RNA, 23 nt, Human
ccaguggcagggcacagggccug

SEQ ID NO: 3179335 - RNA, 22 nt, Human
ccaguggcagggcacagggccu

SEQ ID NO: 3179336 - RNA, 21 nt, Human
ccaguggcagggcacagggcc

SEQ ID NO: 3179337 - RNA, 20 nt, Human
ccaguggcagggcacagggc

SEQ ID NO: 3179338 - RNA, 19 nt, Human
ccaguggcagggcacaggg

SEQ ID NO: 3179339 - RNA, 12 nt, Human
ccaggugccagu

SEQ ID NO: 3179340 - RNA, 21 nt, Human
ccaggugcuaggaacacuccu

SEQ ID NO: 3179341 - RNA, 21 nt, Human
ccagguggccacuccagaccc

SEQ ID NO: 3179342 - RNA, 16 nt, Human
ccagguggccacucca

SEQ ID NO: 3179343 - RNA, 17 nt, Human
ccagguagaacgccagg

SEQ ID NO: 3179344 - RNA, 19 nt, Human
ccagguuuaaguagauuuc

SEQ ID NO: 3179345 - RNA, 22 nt, Human
ccagguuuaaguagauuucaug

SEQ ID NO: 3179346 - RNA, 18 nt, Human
ccagguuuugcacucuug

SEQ ID NO: 3179347 - RNA, 13 nt, Human
ccagguuuaagcu

SEQ ID NO: 3179348 - RNA, 16 nt, Human
ccagguuucuaugugu

SEQ ID NO: 3179349 - RNA, 20 nt, Human
ccagguggagguggcauccc

SEQ ID NO: 3179350 - RNA, 17 nt, Human
ccagguugucacugaga

SEQ ID NO: 3179351 - RNA, 16 nt, Human
ccauccugaggcucca

SEQ ID NO: 3179352 - RNA, 20 nt, Human
ccauccugaggcuccacuug

SEQ ID NO: 3179353 - RNA, 13 nt, Human
ccaucuacccucc

SEQ ID NO: 3179354 - RNA, 18 nt, Human
ccauccugaggcuccacu

SEQ ID NO: 3179355 - RNA, 14 nt, Human
ccaucauugaaauc

SEQ ID NO: 3179356 - RNA, 16 nt, Human
ccaucauugaaaucuu

SEQ ID NO: 3179357 - RNA, 14 nt, Human
ccaucucacacaug

SEQ ID NO: 3179358 - RNA, 15 nt, Human
ccaucucacacauga

SEQ ID NO: 3179359 - RNA, 17 nt, Human
ccaucucacacaugagc

SEQ ID NO: 3179360 - RNA, 18 nt, Human
ccaucucacacaugagca

SEQ ID NO: 3179361 - RNA, 20 nt, Human
ccaucucacacaugagcauc

SEQ ID NO: 3179362 - RNA, 21 nt, Human
ccaucucacacaugagcauca

SEQ ID NO: 3179363 - RNA, 15 nt, Human
ccaucucuccuccuu

SEQ ID NO: 3179364 - RNA, 21 nt, Human
ccaucuaggggagccuugauu

SEQ ID NO: 3179365 - RNA, 23 nt, Human
ccagugugacaaggauugcuacu

SEQ ID NO: 3179366 - RNA, 14 nt, Human
ccagugugacaagg

SEQ ID NO: 3179367 - RNA, 13 nt, Human
ccauaugccuggg

SEQ ID NO: 3179368 - RNA, 12 nt, Human
ccaucaagccac

SEQ ID NO: 3179369 - RNA, 22 nt, Human
ccauauuaaguaagucucaagg

SEQ ID NO: 3179370 - RNA, 15 nt, Human
ccauaugccugggca

SEQ ID NO: 3179371 - RNA, 16 nt, Human
ccaucaagccaccaac

SEQ ID NO: 3179372 - RNA, 13 nt, Human
ccaucaagccacc

SEQ ID NO: 3179373 - RNA, 14 nt, Human
ccaucaagccacca

SEQ ID NO: 3179374 - RNA, 12 nt, Human
ccaucauugaaa

SEQ ID NO: 3179375 - RNA, 13 nt, Human
ccaucaugucugg

SEQ ID NO: 3179376 - RNA, 12 nt, Human
ccaucaugucug

SEQ ID NO: 3179377 - RNA, 19 nt, Human
ccaucauggggggagcacc

SEQ ID NO: 3179378 - RNA, 22 nt, Human
ccaucauggggggagcacccug

SEQ ID NO: 3179379 - RNA, 23 nt, Human
ccaucauggggggagcacccuga

SEQ ID NO: 3179380 - RNA, 18 nt, Human
ccagcccugaguuccuag

SEQ ID NO: 3179381 - RNA, 14 nt, Human
ccagcccugaguuc

SEQ ID NO: 3179382 - RNA, 17 nt, Human
ccagcccauuugggcag

SEQ ID NO: 3179383 - RNA, 22 nt, Human
ccagcccauuugggcagagagg

SEQ ID NO: 3179384 - RNA, 18 nt, Human
ccagcccauuugggcaga

SEQ ID NO: 3179385 - RNA, 20 nt, Human
ccagccgagauagccaaggc

SEQ ID NO: 3179386 - RNA, 22 nt, Human
ccagccgagauagccaaggcca

SEQ ID NO: 3179387 - RNA, 17 nt, Human
ccagccgagauagccaa

SEQ ID NO: 3179388 - RNA, 19 nt, Human
ccagccgccaugcuccugg

SEQ ID NO: 3179389 - RNA, 19 nt, Human
ccagcaggcucucaggcca

SEQ ID NO: 3179390 - RNA, 20 nt, Human
ccagcaggcucucaggccag

SEQ ID NO: 3179391 - RNA, 21 nt, Human
ccagcaggcucucaggccagc

SEQ ID NO: 3179392 - RNA, 23 nt, Human
ccagcaggcucucaggccagcug

SEQ ID NO: 3179393 - RNA, 17 nt, Human
ccagcccacuucugcca

SEQ ID NO: 3179394 - RNA, 16 nt, Human
ccagcccacuucugcc

SEQ ID NO: 3179395 - RNA, 17 nt, Human
ccagcccaccccauggc

SEQ ID NO: 3179396 - RNA, 15 nt, Human
ccagcccaccccaug

SEQ ID NO: 3179397 - RNA, 18 nt, Human
ccagcccaccccauggcc

SEQ ID NO: 3179398 - RNA, 13 nt, Human
ccagcccacgcug

SEQ ID NO: 3179399 - RNA, 16 nt, Human
ccagcccagaggccga

SEQ ID NO: 3179400 - RNA, 13 nt, Human
ccagcccagaggc

SEQ ID NO: 3179401 - RNA, 21 nt, Human
ccagcccacgcugacuacagg

SEQ ID NO: 3179402 - RNA, 10 nt, Human
ccagccugcc

SEQ ID NO: 3179403 - RNA, 19 nt, Human
ccagccugagcgacaguga

SEQ ID NO: 3179404 - RNA, 21 nt, Human
ccagccugggauaggggcaga

SEQ ID NO: 3179405 - RNA, 20 nt, Human
ccagccuggcugggacuggg

SEQ ID NO: 3179406 - RNA, 13 nt, Human
ccagccuggguga

SEQ ID NO: 3179407 - RNA, 21 nt, Human
ccagccuggaaaccugucuga

SEQ ID NO: 3179408 - RNA, 20 nt, Human
ccagccuggaaaccugucug

SEQ ID NO: 3179409 - RNA, 23 nt, Human
ccagccuugaccauucuccaccu

SEQ ID NO: 3179410 - RNA, 22 nt, Human
ccagccuugaccauucuccacc

SEQ ID NO: 3179411 - RNA, 18 nt, Human
ccagauuucacucuccuu

SEQ ID NO: 3179412 - RNA, 19 nt, Human
ccagauuucacucuccuug

SEQ ID NO: 3179413 - RNA, 15 nt, Human
ccagauuucacucuc

SEQ ID NO: 3179414 - RNA, 22 nt, Human
ccagauugcaacaggcugggcu

SEQ ID NO: 3179415 - RNA, 23 nt, Human
ccagauugcaacaggcugggcuu

SEQ ID NO: 3179416 - RNA, 14 nt, Human
ccagagcccaccuu

SEQ ID NO: 3179417 - RNA, 16 nt, Human
ccagauugcaacaggc

SEQ ID NO: 3179418 - RNA, 14 nt, Human
ccagauugcaacag

SEQ ID NO: 3179419 - RNA, 17 nt, Human
ccagcaggcucucaggc

SEQ ID NO: 3179420 - RNA, 18 nt, Human
ccagcaggcucucaggcc

SEQ ID NO: 3179421 - RNA, 16 nt, Human
ccagcaggcucucagg

SEQ ID NO: 3179422 - RNA, 17 nt, Human
ccagcaccaucucuccu

SEQ ID NO: 3179423 - RNA, 18 nt, Human
ccagcaccaucucuccuc

SEQ ID NO: 3179424 - RNA, 20 nt, Human
ccagcaccacccuccuuccc

SEQ ID NO: 3179425 - RNA, 13 nt, Human
ccagcaccacccu

SEQ ID NO: 3179426 - RNA, 16 nt, Human
ccagcaagugagagcu

SEQ ID NO: 3179427 - RNA, 21 nt, Human
ccagcaauucuccugccucag

SEQ ID NO: 3179428 - RNA, 23 nt, Human
ccagcacaaccuucaagcugcuu

SEQ ID NO: 3179429 - RNA, 13 nt, Human
ccagcacacuccc

SEQ ID NO: 3179430 - RNA, 12 nt, Human
ccagcacacucc

SEQ ID NO: 3179431 - RNA, 17 nt, Human
ccagcacacucccgaga

SEQ ID NO: 3179432 - RNA, 16 nt, Human
ccagcacacucccgag

SEQ ID NO: 3179433 - RNA, 15 nt, Human
ccagcacacucccga

SEQ ID NO: 3179434 - RNA, 14 nt, Human
ccagcacacucccg

SEQ ID NO: 3179435 - RNA, 19 nt, Human
ccagcaagugagagcuggg

SEQ ID NO: 3179436 - RNA, 18 nt, Human
ccagcaagugagagcugg

SEQ ID NO: 3179437 - RNA, 17 nt, Human
ccagcaagugagagcug

SEQ ID NO: 3179438 - RNA, 24 nt, Human
ccagauuuuuuacagcugccugca

SEQ ID NO: 3179439 - RNA, 18 nt, Human
ccagaaacgccacauccc

SEQ ID NO: 3179440 - RNA, 21 nt, Human
ccagaaacacccacaggcaug

SEQ ID NO: 3179441 - RNA, 15 nt, Human
ccagaagcccagaau

SEQ ID NO: 3179442 - RNA, 17 nt, Human
ccagaacuuagccuuua

SEQ ID NO: 3179443 - RNA, 24 nt, Human
ccagaacucuuccuccaaggacag

SEQ ID NO: 3179444 - RNA, 15 nt, Human
ccagaacucuuccuc

SEQ ID NO: 3179445 - RNA, 14 nt, Human
ccagaacucuuccu

SEQ ID NO: 3179446 - RNA, 15 nt, Human
ccagaacucuguguc

SEQ ID NO: 3179447 - RNA, 20 nt, Human
ccagaacucugccugcccuu

SEQ ID NO: 3179448 - RNA, 19 nt, Human
ccagaacucugccugcccu

SEQ ID NO: 3179449 - RNA, 17 nt, Human
ccagaacucugccugcc

SEQ ID NO: 3179450 - RNA, 16 nt, Human
ccagaacucugccugc

SEQ ID NO: 3179451 - RNA, 16 nt, Human
ccacugugccaugugc

SEQ ID NO: 3179452 - RNA, 15 nt, Human
ccacugugccaugug

SEQ ID NO: 3179453 - RNA, 19 nt, Human
ccacugugccaugugccag

SEQ ID NO: 3179454 - RNA, 19 nt, Human
ccacugugcguggggcucc

SEQ ID NO: 3179455 - RNA, 15 nt, Human
ccacugguucuucuu

SEQ ID NO: 3179456 - RNA, 21 nt, Human
ccacugggguggccugacucc

SEQ ID NO: 3179457 - RNA, 23 nt, Human
ccacuggugacaugucuuuucuu

SEQ ID NO: 3179458 - RNA, 14 nt, Human
ccacugugaagaga

SEQ ID NO: 3179459 - RNA, 15 nt, Human
ccacugugaagagaa

SEQ ID NO: 3179460 - RNA, 15 nt, Human
ccacugcucugguua

SEQ ID NO: 3179461 - RNA, 13 nt, Human
ccacugcucuggu

SEQ ID NO: 3179462 - RNA, 12 nt, Human
ccacugcucugg

SEQ ID NO: 3179463 - RNA, 11 nt, Human
ccacugcucug

SEQ ID NO: 3179464 - RNA, 20 nt, Human
ccacugcuuuuggucugugu

SEQ ID NO: 3179465 - RNA, 21 nt, Human
ccacugccuucgauacaccgg

SEQ ID NO: 3179466 - RNA, 22 nt, Human
ccacugcuuuuggucuguguga

SEQ ID NO: 3179467 - RNA, 14 nt, Human
ccacugcuuaccua

SEQ ID NO: 3179468 - RNA, 21 nt, Human
ccacugcaucguuucaucuuc

SEQ ID NO: 3179469 - RNA, 23 nt, Human
ccacugcaucguuucaucuucca

SEQ ID NO: 3179470 - RNA, 14 nt, Human
ccaccuucccaugc

SEQ ID NO: 3179471 - RNA, 21 nt, Human
ccaccuucucacauggaauga

SEQ ID NO: 3179472 - RNA, 13 nt, Human
ccacugccucuuc

SEQ ID NO: 3179473 - RNA, 16 nt, Human
ccacugccucuuccuc

SEQ ID NO: 3179474 - RNA, 15 nt, Human
ccagaaugaggcugc

SEQ ID NO: 3179475 - RNA, 11 nt, Human
ccagaaugaag

SEQ ID NO: 3179476 - RNA, 22 nt, Human
ccagaauaaacuggcagcucag

SEQ ID NO: 3179477 - RNA, 13 nt, Human
ccagaagucaaca

SEQ ID NO: 3179478 - RNA, 12 nt, Human
ccagaauacuga

SEQ ID NO: 3179479 - RNA, 15 nt, Human
ccagaauacugaugg

SEQ ID NO: 3179480 - RNA, 21 nt, Human
ccagaauacugauggaauuuu

SEQ ID NO: 3179481 - RNA, 23 nt, Human
ccagaauacugauggaauuuuuu

SEQ ID NO: 3179482 - RNA, 23 nt, Human
ccagaaggagggggugaccuccg

SEQ ID NO: 3179483 - RNA, 17 nt, Human
ccagaaguagcuuugca

SEQ ID NO: 3179484 - RNA, 16 nt, Human
ccagaaguagcuuugc

SEQ ID NO: 3179485 - RNA, 15 nt, Human
ccagaaguagcuuug

SEQ ID NO: 3179486 - RNA, 18 nt, Human
ccagaccccuggcuuuuc

SEQ ID NO: 3179487 - RNA, 24 nt, Human
ccagaccccuggcuuuucacugcu

SEQ ID NO: 3179488 - RNA, 14 nt, Human
ccagacaucaacag

SEQ ID NO: 3179489 - RNA, 17 nt, Human
ccagacacauguccaag

SEQ ID NO: 3179490 - RNA, 20 nt, Human
ccagacacauguccaagaag

SEQ ID NO: 3179491 - RNA, 22 nt, Human
ccagacacauguccaagaagcc

SEQ ID NO: 3179492 - RNA, 15 nt, Human
ccagacccggcugcg

SEQ ID NO: 3179493 - RNA, 14 nt, Human
ccagacccggcugc

SEQ ID NO: 3179494 - RNA, 16 nt, Human
ccagagaguggcuccu

SEQ ID NO: 3179495 - RNA, 15 nt, Human
ccagagaguggcucc

SEQ ID NO: 3179496 - RNA, 14 nt, Human
ccagagaguggcuc

SEQ ID NO: 3179497 - RNA, 22 nt, Human
ccagagaguggcuccucccggu

SEQ ID NO: 3179498 - RNA, 18 nt, Human
ccagagaguggcuccucc

SEQ ID NO: 3179499 - RNA, 19 nt, Human
ccacccccaggaccccuga

SEQ ID NO: 3179500 - RNA, 18 nt, Human
ccacccccaggaccccug

SEQ ID NO: 3179501 - RNA, 16 nt, Human
ccacccccaggacccc

SEQ ID NO: 3179502 - RNA, 19 nt, Human
ccacccccacccaagggcc

SEQ ID NO: 3179503 - RNA, 19 nt, Human
ccaccccucaacaccucug

SEQ ID NO: 3179504 - RNA, 18 nt, Human
ccacccugaaagcccuga

SEQ ID NO: 3179505 - RNA, 14 nt, Human
ccacccuccuuccc

SEQ ID NO: 3179506 - RNA, 14 nt, Human
ccacccuccuuuca

SEQ ID NO: 3179507 - RNA, 18 nt, Human
ccaccuccuaaaaggccc

SEQ ID NO: 3179508 - RNA, 21 nt, Human
ccaccuccuaaaaggcccaga

SEQ ID NO: 3179509 - RNA, 20 nt, Human
ccaccuccuaaaaggcccag

SEQ ID NO: 3179510 - RNA, 23 nt, Human
ccaccuccuaaaaggcccagaga

SEQ ID NO: 3179511 - RNA, 22 nt, Human
ccaccuccuaaaaggcccagag

SEQ ID NO: 3179512 - RNA, 12 nt, Human
ccacccugcucu

SEQ ID NO: 3179513 - RNA, 11 nt, Human
ccacccugcuc

SEQ ID NO: 3179514 - RNA, 14 nt, Human
ccaccucucucacu

SEQ ID NO: 3179515 - RNA, 16 nt, Human
ccaccucucucacucc

SEQ ID NO: 3179516 - RNA, 19 nt, Human
ccaccucucucacuccuug

SEQ ID NO: 3179517 - RNA, 20 nt, Human
ccaccucucucacuccuuga

SEQ ID NO: 3179518 - RNA, 13 nt, Human
ccaccuggccucu

SEQ ID NO: 3179519 - RNA, 17 nt, Human
ccaccuggcccucucug

SEQ ID NO: 3179520 - RNA, 12 nt, Human
ccaccuggcccu

SEQ ID NO: 3179521 - RNA, 18 nt, Human
ccaccuggccucugcacu

SEQ ID NO: 3179522 - RNA, 20 nt, Human
ccaccuggccucugcacucc

SEQ ID NO: 3179523 - RNA, 18 nt, Human
ccaccuggcccucucuga

SEQ ID NO: 3179524 - RNA, 13 nt, Human
ccaccugccaggg

SEQ ID NO: 3179525 - RNA, 14 nt, Human
ccaccugccaggga

SEQ ID NO: 3179526 - RNA, 17 nt, Human
ccaccucuuccuggccg

SEQ ID NO: 3179527 - RNA, 13 nt, Human
ccaccucuuccug

SEQ ID NO: 3179528 - RNA, 12 nt, Human
ccaccugccagg

SEQ ID NO: 3179529 - RNA, 15 nt, Human
ccaccugcucugcug

SEQ ID NO: 3179530 - RNA, 15 nt, Human
ccaccugccagggac

SEQ ID NO: 3179531 - RNA, 17 nt, Human
cccagaaugaggcugcu

SEQ ID NO: 3179532 - RNA, 17 nt, Human
cccagagagaagagccc

SEQ ID NO: 3179533 - RNA, 19 nt, Human
cccaucucuacaaaaagca

SEQ ID NO: 3179534 - RNA, 14 nt, Human
cccaguugggugga

SEQ ID NO: 3179535 - RNA, 16 nt, Human
cccaucugccagauca

SEQ ID NO: 3179536 - RNA, 14 nt, Human
cccaucucuucugg

SEQ ID NO: 3179537 - RNA, 22 nt, Human
cccaugagccucagcauccugg

SEQ ID NO: 3179538 - RNA, 19 nt, Human
cccaugagagcgcagcccg

SEQ ID NO: 3179539 - RNA, 20 nt, Human
cccaugagagcgcagcccgc

SEQ ID NO: 3179540 - RNA, 14 nt, Human
cccaugagccucag

SEQ ID NO: 3179541 - RNA, 17 nt, Human
cccauggaaaaaugcca

SEQ ID NO: 3179542 - RNA, 18 nt, Human
cccaugcugcccugugag

SEQ ID NO: 3179543 - RNA, 18 nt, Human
cccaugcugggcucccgu

SEQ ID NO: 3179544 - RNA, 16 nt, Human
ccccaauaccccaugg

SEQ ID NO: 3179545 - RNA, 16 nt, Human
ccccaauaucuugcuu

SEQ ID NO: 3179546 - RNA, 19 nt, Human
ccccaauaccccauggacc

SEQ ID NO: 3179547 - RNA, 21 nt, Human
ccccacccaagggccuggccu

SEQ ID NO: 3179548 - RNA, 15 nt, Human
ccccaccgcagacag

SEQ ID NO: 3179549 - RNA, 19 nt, Human
ccccaccgcagacaggacc

SEQ ID NO: 3179550 - RNA, 11 nt, Human
ccccaccugcg

SEQ ID NO: 3179551 - RNA, 20 nt, Human
ccccaccuggcccucucuga

SEQ ID NO: 3179552 - RNA, 14 nt, Human
ccccaccuggcccu

SEQ ID NO: 3179553 - RNA, 17 nt, Human
ccccaccugcgcuucac

SEQ ID NO: 3179554 - RNA, 14 nt, Human
ccccaccugcgcuu

SEQ ID NO: 3179555 - RNA, 14 nt, Human
ccccacuggugaca

SEQ ID NO: 3179556 - RNA, 20 nt, Human
ccccacucucagaggcccca

SEQ ID NO: 3179557 - RNA, 17 nt, Human
ccccacucucagaggcc

SEQ ID NO: 3179558 - RNA, 15 nt, Human
ccccagaacucugcc

SEQ ID NO: 3179559 - RNA, 17 nt, Human
ccccagaacucugccug

SEQ ID NO: 3179560 - RNA, 11 nt, Human
ccccacucuca

SEQ ID NO: 3179561 - RNA, 16 nt, Human
ccccacucucagaggc

SEQ ID NO: 3179562 - RNA, 14 nt, Human
ccccacucucagag

SEQ ID NO: 3179563 - RNA, 13 nt, Human
ccccacucucaga

SEQ ID NO: 3179564 - RNA, 12 nt, Human
ccccacucucag

SEQ ID NO: 3179565 - RNA, 15 nt, Human
ccccacucccagcau

SEQ ID NO: 3179566 - RNA, 13 nt, Human
ccccacucccagc

SEQ ID NO: 3179567 - RNA, 13 nt, Human
ccccugccugccc

SEQ ID NO: 3179568 - RNA, 19 nt, Human
ccccugcccggcugcggaa

SEQ ID NO: 3179569 - RNA, 17 nt, Human
ccccugcccggcugcgg

SEQ ID NO: 3179570 - RNA, 18 nt, Human
ccccugccccugcuacug

SEQ ID NO: 3179571 - RNA, 13 nt, Human
ccccucugcccug

SEQ ID NO: 3179572 - RNA, 12 nt, Human
ccccucugcccu

SEQ ID NO: 3179573 - RNA, 20 nt, Human
ccccugcugguucaggguug

SEQ ID NO: 3179574 - RNA, 15 nt, Human
ccccugcugguucag

SEQ ID NO: 3179575 - RNA, 13 nt, Human
ccccugcugguuc

SEQ ID NO: 3179576 - RNA, 11 nt, Human
ccccugcuggu

SEQ ID NO: 3179577 - RNA, 14 nt, Human
ccccugcugggugu

SEQ ID NO: 3179578 - RNA, 17 nt, Human
ccccugcuggguguggc

SEQ ID NO: 3179579 - RNA, 19 nt, Human
ccccugccugcccugucag

SEQ ID NO: 3179580 - RNA, 15 nt, Human
ccccugcuacugcca

SEQ ID NO: 3179581 - RNA, 18 nt, Human
ccccuggaugcagccuca

SEQ ID NO: 3179582 - RNA, 19 nt, Human
ccccuggaugcagccucac

SEQ ID NO: 3179583 - RNA, 15 nt, Human
ccccuggaugcagcc

SEQ ID NO: 3179584 - RNA, 19 nt, Human
ccccuggaccccagccuca

SEQ ID NO: 3179585 - RNA, 18 nt, Human
ccccuggaccccagccuc

SEQ ID NO: 3179586 - RNA, 16 nt, Human
ccccuggaccccagcc

SEQ ID NO: 3179587 - RNA, 14 nt, Human
ccccuggaccccag

SEQ ID NO: 3179588 - RNA, 11 nt, Human
ccccuggaccc

SEQ ID NO: 3179589 - RNA, 23 nt, Human
ccccuggaagcagugcccaggug

SEQ ID NO: 3179590 - RNA, 21 nt, Human
ccccuggaagcagugcccagg

SEQ ID NO: 3179591 - RNA, 20 nt, Human
ccccuggaagcagugcccag

SEQ ID NO: 3179592 - RNA, 19 nt, Human
ccccuggaagcagugccca

SEQ ID NO: 3179593 - RNA, 18 nt, Human
ccccuggaagcagugccc

SEQ ID NO: 3179594 - RNA, 17 nt, Human
ccccuggaagcagugcc

SEQ ID NO: 3179595 - RNA, 12 nt, Human
ccccuggugguu

SEQ ID NO: 3179596 - RNA, 15 nt, Human
ccccuggucuuugag

SEQ ID NO: 3179597 - RNA, 20 nt, Human
ccccuggcuccaggccaggg

SEQ ID NO: 3179598 - RNA, 15 nt, Human
ccccuggccuuggga

SEQ ID NO: 3179599 - RNA, 11 nt, Human
ccccuggccuu

SEQ ID NO: 3179600 - RNA, 18 nt, Human
ccccuggcuuuucacugc

SEQ ID NO: 3179601 - RNA, 16 nt, Human
ccccuggggugcaggc

SEQ ID NO: 3179602 - RNA, 20 nt, Human
ccccuggcuuuucacugcug

SEQ ID NO: 3179603 - RNA, 15 nt, Human
ccccuguucacucua

SEQ ID NO: 3179604 - RNA, 13 nt, Human
ccccuuccaugga

SEQ ID NO: 3179605 - RNA, 20 nt, Human
ccccuuccauggacuuuguu

SEQ ID NO: 3179606 - RNA, 22 nt, Human
cccgaauagcugggacuacagg

SEQ ID NO: 3179607 - RNA, 14 nt, Human
cccgacagccuggc

SEQ ID NO: 3179608 - RNA, 11 nt, Human
ccccuucccau

SEQ ID NO: 3179609 - RNA, 17 nt, Human
ccccuuccauuucugcc

SEQ ID NO: 3179610 - RNA, 22 nt, Human
cccgcuaagagggagggagggc

SEQ ID NO: 3179611 - RNA, 23 nt, Human
cccgcuaagagggagggagggcu

SEQ ID NO: 3179612 - RNA, 20 nt, Human
cccgcccaggcuuagucacu

SEQ ID NO: 3179613 - RNA, 19 nt, Human
cccgcccaaaccuuucccc

SEQ ID NO: 3179614 - RNA, 17 nt, Human
cccgacaccggccagug

SEQ ID NO: 3179615 - RNA, 18 nt, Human
cccgacagccuggcacag

SEQ ID NO: 3179616 - RNA, 15 nt, Human
cccgacagccuggca

SEQ ID NO: 3179617 - RNA, 12 nt, Human
cccgacuccagu

SEQ ID NO: 3179618 - RNA, 18 nt, Human
cccgagacggcacugaga

SEQ ID NO: 3179619 - RNA, 14 nt, Human
ccccauccucugua

SEQ ID NO: 3179620 - RNA, 13 nt, Human
cccccacccaagg

SEQ ID NO: 3179621 - RNA, 24 nt, Human
cccccacccaagggccuggccuga

SEQ ID NO: 3179622 - RNA, 16 nt, Human
cccccacauggugaug

SEQ ID NO: 3179623 - RNA, 15 nt, Human
cccccacuggugaca

SEQ ID NO: 3179624 - RNA, 11 nt, Human
cccccacuggu

SEQ ID NO: 3179625 - RNA, 13 nt, Human
cccccacugguga

SEQ ID NO: 3179626 - RNA, 19 nt, Human
cccccacugaaucccugua

SEQ ID NO: 3179627 - RNA, 11 nt, Human
ccccagggcac

SEQ ID NO: 3179628 - RNA, 22 nt, Human
ccccaggugguuauggagaggg

SEQ ID NO: 3179629 - RNA, 17 nt, Human
ccccaguccccuucccg

SEQ ID NO: 3179630 - RNA, 17 nt, Human
ccccaguagcugggacc

SEQ ID NO: 3179631 - RNA, 22 nt, Human
ccccauaauuuuuuuuuuccuu

SEQ ID NO: 3179632 - RNA, 20 nt, Human
ccccagugcccacaggauca

SEQ ID NO: 3179633 - RNA, 16 nt, Human
ccccagugcccacagg

SEQ ID NO: 3179634 - RNA, 15 nt, Human
ccccagugcccacag

SEQ ID NO: 3179635 - RNA, 14 nt, Human
ccccagugcccaca

SEQ ID NO: 3179636 - RNA, 13 nt, Human
ccccuccaccugc

SEQ ID NO: 3179637 - RNA, 22 nt, Human
ccccucagggucccugguggca

SEQ ID NO: 3179638 - RNA, 20 nt, Human
ccccucauagcccucacccu

SEQ ID NO: 3179639 - RNA, 23 nt, Human
ccccuccaaucccaccaacccuc

SEQ ID NO: 3179640 - RNA, 12 nt, Human
ccccuccaugug

SEQ ID NO: 3179641 - RNA, 15 nt, Human
ccccucccucuccag

SEQ ID NO: 3179642 - RNA, 14 nt, Human
ccccucccucucca

SEQ ID NO: 3179643 - RNA, 15 nt, Human
ccccucccuucaacc

SEQ ID NO: 3179644 - RNA, 15 nt, Human
ccccuccucucugcc

SEQ ID NO: 3179645 - RNA, 17 nt, Human
ccccuccucucugcccu

SEQ ID NO: 3179646 - RNA, 22 nt, Human
ccccuccuccuggacuccugca

SEQ ID NO: 3179647 - RNA, 18 nt, Human
ccccuccuccuggacucc

SEQ ID NO: 3179648 - RNA, 15 nt, Human
ccccucggagaagag

SEQ ID NO: 3179649 - RNA, 14 nt, Human
ccccucgcccaguc

SEQ ID NO: 3179650 - RNA, 23 nt, Human
ccccucgcccagucccagcagcc

SEQ ID NO: 3179651 - RNA, 22 nt, Human
ccccucgcccagucccagcagc

SEQ ID NO: 3179652 - RNA, 15 nt, Human
ccccucaacaccucu

SEQ ID NO: 3179653 - RNA, 16 nt, Human
ccccucaacaccucug

SEQ ID NO: 3179654 - RNA, 23 nt, Human
ccccucaacucuccuccagaguc

SEQ ID NO: 3179655 - RNA, 12 nt, Human
cccccagccugc

SEQ ID NO: 3179656 - RNA, 19 nt, Human
cccccucccccagccacuc

SEQ ID NO: 3179657 - RNA, 18 nt, Human
cccccucccccagccacu

SEQ ID NO: 3179658 - RNA, 22 nt, Human
cccccgucuaaccacagcuccu

SEQ ID NO: 3179659 - RNA, 12 nt, Human
cccccagcuccc

SEQ ID NO: 3179660 - RNA, 19 nt, Human
cccccugacaacacucauu

SEQ ID NO: 3179661 - RNA, 18 nt, Human
cccccugcaaagcccagc

SEQ ID NO: 3179662 - RNA, 19 nt, Human
cccccugcaaagcccagcu

SEQ ID NO: 3179663 - RNA, 21 nt, Human
cccccugcaaagcccagcuug

SEQ ID NO: 3179664 - RNA, 14 nt, Human
cccccucuucccug

SEQ ID NO: 3179665 - RNA, 17 nt, Human
cccccugacaacacuca

SEQ ID NO: 3179666 - RNA, 21 nt, Human
cccccucuggcuccagcuggc

SEQ ID NO: 3179667 - RNA, 12 nt, Human
cccccucuggcu

SEQ ID NO: 3179668 - RNA, 19 nt, Human
cccccucuggcuccagcug

SEQ ID NO: 3179669 - RNA, 11 nt, Human
ccguggcuucc

SEQ ID NO: 3179670 - RNA, 16 nt, Human
ccgugaggccagagac

SEQ ID NO: 3179671 - RNA, 18 nt, Human
ccuacaggagugagcacu

SEQ ID NO: 3179672 - RNA, 17 nt, Human
ccguugcugacuuagaa

SEQ ID NO: 3179673 - RNA, 14 nt, Human
ccguugcugacuua

SEQ ID NO: 3179674 - RNA, 15 nt, Human
ccguugcugacuuag

SEQ ID NO: 3179675 - RNA, 12 nt, Human
ccuaacccuggc

SEQ ID NO: 3179676 - RNA, 19 nt, Human
ccuaacccagaaaaucuga

SEQ ID NO: 3179677 - RNA, 18 nt, Human
ccuaaccagggccagaag

SEQ ID NO: 3179678 - RNA, 18 nt, Human
ccuaggugacagagugag

SEQ ID NO: 3179679 - RNA, 23 nt, Human
ccuaggcauuugcugaauacaga

SEQ ID NO: 3179680 - RNA, 13 nt, Human
ccuacucuucucu

SEQ ID NO: 3179681 - RNA, 19 nt, Human
ccuacucuucucucugcuc

SEQ ID NO: 3179682 - RNA, 18 nt, Human
ccuacucuucucucugcu

SEQ ID NO: 3179683 - RNA, 16 nt, Human
ccuacuccugucuucu

SEQ ID NO: 3179684 - RNA, 15 nt, Human
ccuacuccugucuuc

SEQ ID NO: 3179685 - RNA, 22 nt, Human
ccuacuccugucuucugcuuug

SEQ ID NO: 3179686 - RNA, 20 nt, Human
ccuacuccugucuucugcuu

SEQ ID NO: 3179687 - RNA, 19 nt, Human
ccuacuccugucuucugcu

SEQ ID NO: 3179688 - RNA, 18 nt, Human
ccuacuccugucuucugc

SEQ ID NO: 3179689 - RNA, 21 nt, Human
ccuacucuucucucugcucug

SEQ ID NO: 3179690 - RNA, 20 nt, Human
ccuacucuucucucugcucu

SEQ ID NO: 3179691 - RNA, 17 nt, Human
ccuaccgagucucuucu

SEQ ID NO: 3179692 - RNA, 16 nt, Human
ccuaccgagucucuuc

SEQ ID NO: 3179693 - RNA, 20 nt, Human
ccuaccgagucucuucucca

SEQ ID NO: 3179694 - RNA, 19 nt, Human
ccuaccgagucucuucucc

SEQ ID NO: 3179695 - RNA, 14 nt, Human
ccguggcuucccgc

SEQ ID NO: 3179696 - RNA, 15 nt, Human
ccgagauugcaccac

SEQ ID NO: 3179697 - RNA, 19 nt, Human
ccgagauugcaccacugca

SEQ ID NO: 3179698 - RNA, 21 nt, Human
ccgagauugcaccacugcacu

SEQ ID NO: 3179699 - RNA, 14 nt, Human
ccgacuagacacac

SEQ ID NO: 3179700 - RNA, 22 nt, Human
ccgaccugaggacauggcuucu

SEQ ID NO: 3179701 - RNA, 18 nt, Human
ccgaccuggccugucugu

SEQ ID NO: 3179702 - RNA, 17 nt, Human
ccgacuagacacacaaa

SEQ ID NO: 3179703 - RNA, 16 nt, Human
ccgacuagacacacaa

SEQ ID NO: 3179704 - RNA, 20 nt, Human
ccgacuagacacacaaagca

SEQ ID NO: 3179705 - RNA, 22 nt, Human
ccgccggcaauaaaagcccagg

SEQ ID NO: 3179706 - RNA, 21 nt, Human
ccgccggcaauaaaagcccag

SEQ ID NO: 3179707 - RNA, 20 nt, Human
ccgccggcaauaaaagccca

SEQ ID NO: 3179708 - RNA, 23 nt, Human
ccgcacugggcuuggggaccaga

SEQ ID NO: 3179709 - RNA, 19 nt, Human
ccgcacugggcuuggggac

SEQ ID NO: 3179710 - RNA, 20 nt, Human
ccgagucucuucuccacugg

SEQ ID NO: 3179711 - RNA, 19 nt, Human
ccgagucucuucuccacug

SEQ ID NO: 3179712 - RNA, 14 nt, Human
ccgaguagcuggga

SEQ ID NO: 3179713 - RNA, 18 nt, Human
ccgagucucuucuccacu

SEQ ID NO: 3179714 - RNA, 16 nt, Human
ccgagucucuucucca

SEQ ID NO: 3179715 - RNA, 20 nt, Human
ccgaguagcugagauuauag

SEQ ID NO: 3179716 - RNA, 14 nt, Human
ccgagucucuucuc

SEQ ID NO: 3179717 - RNA, 19 nt, Human
ccgagcuuugaaaauucag

SEQ ID NO: 3179718 - RNA, 18 nt, Human
ccgugaggccagagacac

SEQ ID NO: 3179719 - RNA, 18 nt, Human
ccgggcucugccucccau

SEQ ID NO: 3179720 - RNA, 13 nt, Human
ccgggcucugccu

SEQ ID NO: 3179721 - RNA, 14 nt, Human
ccgggcucugccuc

SEQ ID NO: 3179722 - RNA, 15 nt, Human
ccgggcucugccucc

SEQ ID NO: 3179723 - RNA, 13 nt, Human
ccgggccacagag

SEQ ID NO: 3179724 - RNA, 22 nt, Human
ccgggcacucagaagacacuga

SEQ ID NO: 3179725 - RNA, 20 nt, Human
ccgggcacucagaagacacu

SEQ ID NO: 3179726 - RNA, 20 nt, Human
ccgggcagagcacagcgggg

SEQ ID NO: 3179727 - RNA, 13 nt, Human
ccgggcagagcac

SEQ ID NO: 3179728 - RNA, 21 nt, Human
ccggcuccaggcuccuuuagc

SEQ ID NO: 3179729 - RNA, 16 nt, Human
ccggcuccaggcuccu

SEQ ID NO: 3179730 - RNA, 15 nt, Human
ccggcuccaggcucc

SEQ ID NO: 3179731 - RNA, 17 nt, Human
ccgccuccuacagccca

SEQ ID NO: 3179732 - RNA, 12 nt, Human
ccgccucuuccc

SEQ ID NO: 3179733 - RNA, 11 nt, Human
ccgcuggggcc

SEQ ID NO: 3179734 - RNA, 14 nt, Human
ccggaggggccugg

SEQ ID NO: 3179735 - RNA, 16 nt, Human
ccggaggggccuggca

SEQ ID NO: 3179736 - RNA, 15 nt, Human
ccggaggggccuggc

SEQ ID NO: 3179737 - RNA, 16 nt, Human
cccugccucuccgccc

SEQ ID NO: 3179738 - RNA, 14 nt, Human
cccugccucuccgc

SEQ ID NO: 3179739 - RNA, 13 nt, Human
cccugccucuccg

SEQ ID NO: 3179740 - RNA, 23 nt, Human
cccugccucuccgccccugagcc

SEQ ID NO: 3179741 - RNA, 22 nt, Human
cccugccucuccgccccugagc

SEQ ID NO: 3179742 - RNA, 21 nt, Human
cccugccucuccgccccugag

SEQ ID NO: 3179743 - RNA, 13 nt, Human
cccugcucacugc

SEQ ID NO: 3179744 - RNA, 22 nt, Human
cccugcuacugccaaccucgcu

SEQ ID NO: 3179745 - RNA, 11 nt, Human
cccugcucccu

SEQ ID NO: 3179746 - RNA, 10 nt, Human
cccugcuccc

SEQ ID NO: 3179747 - RNA, 19 nt, Human
cccugcgggucacaggagg

SEQ ID NO: 3179748 - RNA, 21 nt, Human
cccugcgggucacaggaggga

SEQ ID NO: 3179749 - RNA, 21 nt, Human
cccugcucuccgaccagacac

SEQ ID NO: 3179750 - RNA, 23 nt, Human
cccugcucccuccgggucuuccu

SEQ ID NO: 3179751 - RNA, 22 nt, Human
cccugcucuccgaccagacacc

SEQ ID NO: 3179752 - RNA, 21 nt, Human
cccugcugagucccaggcuga

SEQ ID NO: 3179753 - RNA, 23 nt, Human
cccugcugagucccaggcugagc

SEQ ID NO: 3179754 - RNA, 11 nt, Human
cccugccuccu

SEQ ID NO: 3179755 - RNA, 21 nt, Human
cccugcccugugggcccccaa

SEQ ID NO: 3179756 - RNA, 22 nt, Human
cccugcaguuccccuggaagca

SEQ ID NO: 3179757 - RNA, 21 nt, Human
cccugcaguuccccuggaagc

SEQ ID NO: 3179758 - RNA, 17 nt, Human
cccugcaguuccccugg

SEQ ID NO: 3179759 - RNA, 17 nt, Human
cccugaggcaggucccc

SEQ ID NO: 3179760 - RNA, 20 nt, Human
cccugaggcagguccccaga

SEQ ID NO: 3179761 - RNA, 18 nt, Human
cccugaggcaggucccca

SEQ ID NO: 3179762 - RNA, 12 nt, Human
cccugaggccca

SEQ ID NO: 3179763 - RNA, 21 nt, Human
cccugaggcagguccccagac

SEQ ID NO: 3179764 - RNA, 20 nt, Human
cccugcagagggcacagaaa

SEQ ID NO: 3179765 - RNA, 13 nt, Human
cccugcagcccug

SEQ ID NO: 3179766 - RNA, 14 nt, Human
cccugcagcccugg

SEQ ID NO: 3179767 - RNA, 15 nt, Human
cccugcagcccuggc

SEQ ID NO: 3179768 - RNA, 18 nt, Human
cccugcagcccuggccca

SEQ ID NO: 3179769 - RNA, 21 nt, Human
cccugcagcucucaugcugcc

SEQ ID NO: 3179770 - RNA, 13 nt, Human
cccugcagcucuc

SEQ ID NO: 3179771 - RNA, 14 nt, Human
cccuucaaccauuc

SEQ ID NO: 3179772 - RNA, 18 nt, Human
cccuucaaccauucccca

SEQ ID NO: 3179773 - RNA, 12 nt, Human
cccuuccaugga

SEQ ID NO: 3179774 - RNA, 20 nt, Human
cccuuccaugucgccucugc

SEQ ID NO: 3179775 - RNA, 20 nt, Human
cccuuccauuucugccuuuu

SEQ ID NO: 3179776 - RNA, 18 nt, Human
cccuuccauuucugccuu

SEQ ID NO: 3179777 - RNA, 23 nt, Human
cccuuccaucugauuccagcaca

SEQ ID NO: 3179778 - RNA, 17 nt, Human
cccuuccaucugauucc

SEQ ID NO: 3179779 - RNA, 17 nt, Human
cccuuccaccugcucug

SEQ ID NO: 3179780 - RNA, 16 nt, Human
cccuuccaccugcucu

SEQ ID NO: 3179781 - RNA, 19 nt, Human
cccuuccaccugcucugcu

SEQ ID NO: 3179782 - RNA, 18 nt, Human
cccuuccaguuuauucca

SEQ ID NO: 3179783 - RNA, 15 nt, Human
cccuuacgugagucc

SEQ ID NO: 3179784 - RNA, 17 nt, Human
cccuuacgugaguccug

SEQ ID NO: 3179785 - RNA, 14 nt, Human
cccuuagcagggaa

SEQ ID NO: 3179786 - RNA, 20 nt, Human
cccuuagaaguuuguuguga

SEQ ID NO: 3179787 - RNA, 23 nt, Human
cccuuaagaaugaguuucuuaga

SEQ ID NO: 3179788 - RNA, 23 nt, Human
cccuuagcagggaaacagcuaau

SEQ ID NO: 3179789 - RNA, 19 nt, Human
cccuugcccaugcugggcu

SEQ ID NO: 3179790 - RNA, 21 nt, Human
cccuugccagcugcugagccg

SEQ ID NO: 3179791 - RNA, 14 nt, Human
cccuugccagcugc

SEQ ID NO: 3179792 - RNA, 13 nt, Human
cccuugccagcug

SEQ ID NO: 3179793 - RNA, 20 nt, Human
cccuugccagcugcugagcc

SEQ ID NO: 3179794 - RNA, 18 nt, Human
cccuugccagcugcugag

SEQ ID NO: 3179795 - RNA, 22 nt, Human
cccuugccgucuaccugagggg

SEQ ID NO: 3179796 - RNA, 22 nt, Human
cccuugcuaccacggccuccuu

SEQ ID NO: 3179797 - RNA, 14 nt, Human
cccuuccccuuccu

SEQ ID NO: 3179798 - RNA, 18 nt, Human
cccuuccccuuccuucuu

SEQ ID NO: 3179799 - RNA, 15 nt, Human
cccuuccccuuccuu

SEQ ID NO: 3179800 - RNA, 20 nt, Human
cccuuaccugccaggaagcc

SEQ ID NO: 3179801 - RNA, 23 nt, Human
cccuuaccugccaggaagccagc

SEQ ID NO: 3179802 - RNA, 17 nt, Human
cccuuaccugccaggaa

SEQ ID NO: 3179803 - RNA, 19 nt, Human
cccuuaccucggugccuuc

SEQ ID NO: 3179804 - RNA, 19 nt, Human
cccuguuuguuucugaaag

SEQ ID NO: 3179805 - RNA, 16 nt, Human
cccuguuuguuucuga

SEQ ID NO: 3179806 - RNA, 13 nt, Human
cccuguucuggca

SEQ ID NO: 3179807 - RNA, 14 nt, Human
cccuguucuggcag

SEQ ID NO: 3179808 - RNA, 14 nt, Human
cccuguaggccuca

SEQ ID NO: 3179809 - RNA, 15 nt, Human
cccuggugcugccac

SEQ ID NO: 3179810 - RNA, 15 nt, Human
cccuguaggccucag

SEQ ID NO: 3179811 - RNA, 15 nt, Human
cccugucaaacauua

SEQ ID NO: 3179812 - RNA, 20 nt, Human
cccugguggcagcucaccuc

SEQ ID NO: 3179813 - RNA, 14 nt, Human
cccugucaggaggc

SEQ ID NO: 3179814 - RNA, 21 nt, Human
cccuggugaccagcaccaucu

SEQ ID NO: 3179815 - RNA, 14 nt, Human
cccuggugcugcca

SEQ ID NO: 3179816 - RNA, 13 nt, Human
cccuggugcugcc

SEQ ID NO: 3179817 - RNA, 21 nt, Human
cccugguggcagcucaccucu

SEQ ID NO: 3179818 - RNA, 13 nt, Human
cccugguggcagu

SEQ ID NO: 3179819 - RNA, 21 nt, Human
cccuguagagugggagcugag

SEQ ID NO: 3179820 - RNA, 14 nt, Human
cccugguggcagug

SEQ ID NO: 3179821 - RNA, 18 nt, Human
cccugcuuggcccagggg

SEQ ID NO: 3179822 - RNA, 16 nt, Human
cccugcuuggcccagg

SEQ ID NO: 3179823 - RNA, 14 nt, Human
cccugcuuggccca

SEQ ID NO: 3179824 - RNA, 13 nt, Human
cccugcuguuuau

SEQ ID NO: 3179825 - RNA, 14 nt, Human
cccugcuguuuauc

SEQ ID NO: 3179826 - RNA, 19 nt, Human
cccugcugucauugcuucu

SEQ ID NO: 3179827 - RNA, 20 nt, Human
cccugcugucauugcuucuu

SEQ ID NO: 3179828 - RNA, 14 nt, Human
cccgcucagcccuc

SEQ ID NO: 3179829 - RNA, 13 nt, Human
cccgcucagcccu

SEQ ID NO: 3179830 - RNA, 12 nt, Human
cccgcucagccc

SEQ ID NO: 3179831 - RNA, 23 nt, Human
cccucccucuuucccucccuucc

SEQ ID NO: 3179832 - RNA, 17 nt, Human
cccucccggcccugccu

SEQ ID NO: 3179833 - RNA, 14 nt, Human
cccucccugccccu

SEQ ID NO: 3179834 - RNA, 21 nt, Human
cccucgucuuucccaaaggca

SEQ ID NO: 3179835 - RNA, 11 nt, Human
cccucugccca

SEQ ID NO: 3179836 - RNA, 15 nt, Human
cccucugcccacucc

SEQ ID NO: 3179837 - RNA, 18 nt, Human
cccucugcccacucccug

SEQ ID NO: 3179838 - RNA, 19 nt, Human
cccucugcccacucccugc

SEQ ID NO: 3179839 - RNA, 12 nt, Human
cccucugcccug

SEQ ID NO: 3179840 - RNA, 13 nt, Human
cccucugcccugc

SEQ ID NO: 3179841 - RNA, 14 nt, Human
cccucugcccugcg

SEQ ID NO: 3179842 - RNA, 13 nt, Human
cccucuccagcag

SEQ ID NO: 3179843 - RNA, 12 nt, Human
cccucuuucccu

SEQ ID NO: 3179844 - RNA, 16 nt, Human
cccucuucuucucaag

SEQ ID NO: 3179845 - RNA, 20 nt, Human
cccucuuucccucccuuccu

SEQ ID NO: 3179846 - RNA, 17 nt, Human
cccucuuucccucccuu

SEQ ID NO: 3179847 - RNA, 22 nt, Human
cccucuggcuccagcuggccgg

SEQ ID NO: 3179848 - RNA, 16 nt, Human
cccucuggcuccagcu

SEQ ID NO: 3179849 - RNA, 17 nt, Human
cccucuggcuccagcug

SEQ ID NO: 3179850 - RNA, 12 nt, Human
cccucuggcucc

SEQ ID NO: 3179851 - RNA, 20 nt, Human
cccucuguucugcacacagc

SEQ ID NO: 3179852 - RNA, 21 nt, Human
cccucuguucugcacacagca

SEQ ID NO: 3179853 - RNA, 22 nt, Human
cccucuucccugguaagaaaaa

SEQ ID NO: 3179854 - RNA, 14 nt, Human
cccucuucccuggu

SEQ ID NO: 3179855 - RNA, 16 nt, Human
cgagacggcacugaga

SEQ ID NO: 3179856 - RNA, 22 nt, Human
cgaaugaaaauaacugaauuug

SEQ ID NO: 3179857 - RNA, 15 nt, Human
cgaauauugcugaug

SEQ ID NO: 3179858 - RNA, 17 nt, Human
cgaauauugcugauggu

SEQ ID NO: 3179859 - RNA, 15 nt, Human
cgaaucucaaaauua

SEQ ID NO: 3179860 - RNA, 17 nt, Human
cgaaucauuuguucaaa

SEQ ID NO: 3179861 - RNA, 14 nt, Human
cgaaucauuuguuc

SEQ ID NO: 3179862 - RNA, 17 nt, Human
cgaauauugagcaauau

SEQ ID NO: 3179863 - RNA, 12 nt, Human
cgaauauugcug

SEQ ID NO: 3179864 - RNA, 14 nt, Human
cgaauauugcugau

SEQ ID NO: 3179865 - RNA, 11 nt, Human
cgaauauugcu

SEQ ID NO: 3179866 - RNA, 16 nt, Human
cgaauagcugggacua

SEQ ID NO: 3179867 - RNA, 15 nt, Human
cgaauagcugggacu

SEQ ID NO: 3179868 - RNA, 18 nt, Human
cgaaaugcugucuuucuu

SEQ ID NO: 3179869 - RNA, 18 nt, Human
cgaagauuucauccagaa

SEQ ID NO: 3179870 - RNA, 23 nt, Human
cgaacauguuuuucuucucccuc

SEQ ID NO: 3179871 - RNA, 21 nt, Human
cgaacauguuuuucuucuccc

SEQ ID NO: 3179872 - RNA, 17 nt, Human
ccuuuuuuggcugcuga

SEQ ID NO: 3179873 - RNA, 18 nt, Human
ccuuuuuuggcugcugaa

SEQ ID NO: 3179874 - RNA, 20 nt, Human
ccuuuuuuggcugcugaagg

SEQ ID NO: 3179875 - RNA, 22 nt, Human
ccuuuuuuggcugcugaaggcu

SEQ ID NO: 3179876 - RNA, 23 nt, Human
cgaaagggacuuggaagcuccgc

SEQ ID NO: 3179877 - RNA, 21 nt, Human
cgaaaggucaccucacucagc

SEQ ID NO: 3179878 - RNA, 18 nt, Human
cgaaaggucaccucacuc

SEQ ID NO: 3179879 - RNA, 16 nt, Human
cgaaaggucaccucac

SEQ ID NO: 3179880 - RNA, 15 nt, Human
cgaaaggucaccuca

SEQ ID NO: 3179881 - RNA, 16 nt, Human
cgaaaguuaguaggau

SEQ ID NO: 3179882 - RNA, 23 nt, Human
cgaaaggucaccucacucagcac

SEQ ID NO: 3179883 - RNA, 13 nt, Human
cgaaaugcugucu

SEQ ID NO: 3179884 - RNA, 22 nt, Human
cgaaaucccugcucacugcagc

SEQ ID NO: 3179885 - RNA, 16 nt, Human
cgaaaucccugcucac

SEQ ID NO: 3179886 - RNA, 15 nt, Human
cgaaaucccugcuca

SEQ ID NO: 3179887 - RNA, 14 nt, Human
ccuuugucccagaa

SEQ ID NO: 3179888 - RNA, 14 nt, Human
ccuuuguccccacc

SEQ ID NO: 3179889 - RNA, 16 nt, Human
ccuuuguccccaccgc

SEQ ID NO: 3179890 - RNA, 18 nt, Human
ccuuuguccccaccgcag

SEQ ID NO: 3179891 - RNA, 22 nt, Human
ccuuuguauucugucuucaucc

SEQ ID NO: 3179892 - RNA, 14 nt, Human
ccuuuguauucugu

SEQ ID NO: 3179893 - RNA, 20 nt, Human
ccuugugaucacuuucugaa

SEQ ID NO: 3179894 - RNA, 18 nt, Human
ccuugugaucacuuucug

SEQ ID NO: 3179895 - RNA, 20 nt, Human
ccuugugggugugagcagca

SEQ ID NO: 3179896 - RNA, 11 nt, Human
ccuuguggucc

SEQ ID NO: 3179897 - RNA, 13 nt, Human
ccuugugguccaa

SEQ ID NO: 3179898 - RNA, 16 nt, Human
ccuugugguccaaaua

SEQ ID NO: 3179899 - RNA, 17 nt, Human
ccuugugguccaaauag

SEQ ID NO: 3179900 - RNA, 21 nt, Human
ccuuugggugcuguuuugcca

SEQ ID NO: 3179901 - RNA, 19 nt, Human
ccuuugggugcuguuuugc

SEQ ID NO: 3179902 - RNA, 16 nt, Human
ccuuugggugcuguuu

SEQ ID NO: 3179903 - RNA, 21 nt, Human
ccuuuguaaauugucagaugc

SEQ ID NO: 3179904 - RNA, 15 nt, Human
ccuuuuuuggcugcu

SEQ ID NO: 3179905 - RNA, 14 nt, Human
ccuuuuuuccuuuc

SEQ ID NO: 3179906 - RNA, 16 nt, Human
ccuuuuuuccuuucca

SEQ ID NO: 3179907 - RNA, 18 nt, Human
ccuuuuuuccuuuccacc

SEQ ID NO: 3179908 - RNA, 15 nt, Human
ccuuuuuuauaucuu

SEQ ID NO: 3179909 - RNA, 22 nt, Human
ccuuuuuuauaucuuggcaggu

SEQ ID NO: 3179910 - RNA, 20 nt, Human
ccuuuguugaacuguuagaa

SEQ ID NO: 3179911 - RNA, 17 nt, Human
ccuuuguugaacuguua

SEQ ID NO: 3179912 - RNA, 15 nt, Human
ccuuugugaggaagc

SEQ ID NO: 3179913 - RNA, 16 nt, Human
ccuuugugaggaagcc

SEQ ID NO: 3179914 - RNA, 17 nt, Human
ccuuugugaggaagccg

SEQ ID NO: 3179915 - RNA, 23 nt, Human
ccuuugugaggaagccgcugggg

SEQ ID NO: 3179916 - RNA, 22 nt, Human
ccuuuguccccaccgcagacag

SEQ ID NO: 3179917 - RNA, 23 nt, Human
ccuuuguccccaccgcagacagg

SEQ ID NO: 3179918 - RNA, 14 nt, Human
ccuuugugaggaag

SEQ ID NO: 3179919 - RNA, 21 nt, Human
ccuuuguccuccugcugccag

SEQ ID NO: 3179920 - RNA, 16 nt, Human
ccuuuguccuccugcu

SEQ ID NO: 3179921 - RNA, 13 nt, Human
ccuuuguccuccu

SEQ ID NO: 3179922 - RNA, 20 nt, Human
ccuguggaugauaaaacaca

SEQ ID NO: 3179923 - RNA, 16 nt, Human
ccuguggccugccagu

SEQ ID NO: 3179924 - RNA, 20 nt, Human
ccugugggcccccaaaugga

SEQ ID NO: 3179925 - RNA, 17 nt, Human
ccugugccuuuugccau

SEQ ID NO: 3179926 - RNA, 19 nt, Human
ccugugccucugggacugg

SEQ ID NO: 3179927 - RNA, 20 nt, Human
ccugugccucugggacugga

SEQ ID NO: 3179928 - RNA, 11 nt, Human
ccuucauuuaa

SEQ ID NO: 3179929 - RNA, 16 nt, Human
ccuucggccuccaucc

SEQ ID NO: 3179930 - RNA, 17 nt, Human
ccuucggccuccauccu

SEQ ID NO: 3179931 - RNA, 23 nt, Human
ccuuccugggcacacgcugcucu

SEQ ID NO: 3179932 - RNA, 22 nt, Human
ccuuccugggcacacgcugcuc

SEQ ID NO: 3179933 - RNA, 21 nt, Human
ccuuccugggcacacgcugcu

SEQ ID NO: 3179934 - RNA, 17 nt, Human
ccuuccugggcacacgc

SEQ ID NO: 3179935 - RNA, 18 nt, Human
ccuucggccuccauccug

SEQ ID NO: 3179936 - RNA, 15 nt, Human
ccuucgguacccacc

SEQ ID NO: 3179937 - RNA, 17 nt, Human
ccuuccauggacuuugu

SEQ ID NO: 3179938 - RNA, 16 nt, Human
ccuuccaucugauucc

SEQ ID NO: 3179939 - RNA, 18 nt, Human
ccuuccaugucgccucug

SEQ ID NO: 3179940 - RNA, 13 nt, Human
ccuuccugggcac

SEQ ID NO: 3179941 - RNA, 22 nt, Human
ccuuccaggggugggacacccu

SEQ ID NO: 3179942 - RNA, 13 nt, Human
ccuuccaggggug

SEQ ID NO: 3179943 - RNA, 12 nt, Human
ccuucucuccag

SEQ ID NO: 3179944 - RNA, 13 nt, Human
ccuucucuccagc

SEQ ID NO: 3179945 - RNA, 15 nt, Human
ccuucucuccagccc

SEQ ID NO: 3179946 - RNA, 16 nt, Human
ccuucucuccagcccc

SEQ ID NO: 3179947 - RNA, 22 nt, Human
ccuucucacauggaaugagggu

SEQ ID NO: 3179948 - RNA, 20 nt, Human
ccuucgugacaauguuuaca

SEQ ID NO: 3179949 - RNA, 19 nt, Human
ccuucgugacaauguuuac

SEQ ID NO: 3179950 - RNA, 17 nt, Human
ccuucgguacccaccac

SEQ ID NO: 3179951 - RNA, 21 nt, Human
ccuuguaauguaacugcucuu

SEQ ID NO: 3179952 - RNA, 18 nt, Human
ccuuguauaauauugaaa

SEQ ID NO: 3179953 - RNA, 18 nt, Human
ccuuguaauguaacugcu

SEQ ID NO: 3179954 - RNA, 16 nt, Human
ccuuguaauguaacug

SEQ ID NO: 3179955 - RNA, 15 nt, Human
ccuuguaauguaacu

SEQ ID NO: 3179956 - RNA, 17 nt, Human
ccuugguuccuggggca

SEQ ID NO: 3179957 - RNA, 12 nt, Human
ccuugguuccug

SEQ ID NO: 3179958 - RNA, 13 nt, Human
ccuugguuggaag

SEQ ID NO: 3179959 - RNA, 19 nt, Human
ccuuggugucgggcaugac

SEQ ID NO: 3179960 - RNA, 20 nt, Human
ccuuggugucgggcaugaca

SEQ ID NO: 3179961 - RNA, 19 nt, Human
ccuuggggacaaccuuggc

SEQ ID NO: 3179962 - RNA, 14 nt, Human
ccuuggggagcagg

SEQ ID NO: 3179963 - RNA, 16 nt, Human
ccuugggcucugcuga

SEQ ID NO: 3179964 - RNA, 18 nt, Human
ccuuggcuuggcccuggc

SEQ ID NO: 3179965 - RNA, 16 nt, Human
ccuuggcuuggcccug

SEQ ID NO: 3179966 - RNA, 15 nt, Human
ccuugggcucugcug

SEQ ID NO: 3179967 - RNA, 16 nt, Human
ccuuggcugcagggag

SEQ ID NO: 3179968 - RNA, 14 nt, Human
ccuuggcugcaggg

SEQ ID NO: 3179969 - RNA, 15 nt, Human
ccuuggacucauuuu

SEQ ID NO: 3179970 - RNA, 15 nt, Human
ccuuggauugucccc

SEQ ID NO: 3179971 - RNA, 22 nt, Human
ccuuggcucaaguccucuuuuc

SEQ ID NO: 3179972 - RNA, 17 nt, Human
ccuucucuccagccccu

SEQ ID NO: 3179973 - RNA, 18 nt, Human
ccuucucuccagccccug

SEQ ID NO: 3179974 - RNA, 21 nt, Human
ccuugacagggcacaccgggc

SEQ ID NO: 3179975 - RNA, 18 nt, Human
ccuugacagggcacaccg

SEQ ID NO: 3179976 - RNA, 23 nt, Human
ccuugacauuguagagcuucugg

SEQ ID NO: 3179977 - RNA, 19 nt, Human
ccuucucuccagccccugg

SEQ ID NO: 3179978 - RNA, 19 nt, Human
cgcgguggcucacgccugu

SEQ ID NO: 3179979 - RNA, 14 nt, Human
cgcgacaaugcaaa

SEQ ID NO: 3179980 - RNA, 18 nt, Human
cgccuuucagcaggcagc

SEQ ID NO: 3179981 - RNA, 17 nt, Human
cgcuacccgggaagggg

SEQ ID NO: 3179982 - RNA, 18 nt, Human
cgcuaacuugcuuaaaug

SEQ ID NO: 3179983 - RNA, 20 nt, Human
cgcuaacuugcuuaaaugug

SEQ ID NO: 3179984 - RNA, 19 nt, Human
cgcuaacuugcuuaaaugu

SEQ ID NO: 3179985 - RNA, 18 nt, Human
cgcuacccgggaaggggg

SEQ ID NO: 3179986 - RNA, 21 nt, Human
cgcuacccgggaagggggcug

SEQ ID NO: 3179987 - RNA, 24 nt, Human
cgcuacccgggaagggggcuggga

SEQ ID NO: 3179988 - RNA, 12 nt, Human
cgcccagucugg

SEQ ID NO: 3179989 - RNA, 13 nt, Human
cgccccuuccccc

SEQ ID NO: 3179990 - RNA, 21 nt, Human
cgcccagucuggaaugcagug

SEQ ID NO: 3179991 - RNA, 18 nt, Human
cgcccggcuaauuuuugu

SEQ ID NO: 3179992 - RNA, 19 nt, Human
cgcccagucuggaaugcag

SEQ ID NO: 3179993 - RNA, 13 nt, Human
cgcccagucugga

SEQ ID NO: 3179994 - RNA, 18 nt, Human
cgcccaacuaauuuuugu

SEQ ID NO: 3179995 - RNA, 18 nt, Human
cgcagcccugcagagggc

SEQ ID NO: 3179996 - RNA, 19 nt, Human
cgcagcccugcagagggca

SEQ ID NO: 3179997 - RNA, 24 nt, Human
cgcagcccugcuuugggcugcccu

SEQ ID NO: 3179998 - RNA, 15 nt, Human
cgcagcccugcuuug

SEQ ID NO: 3179999 - RNA, 13 nt, Human
cgcagcccugcuu

SEQ ID NO: 3180000 - RNA, 18 nt, Human
cgcagcauccgaccaggu

SEQ ID NO: 3180001 - RNA, 20 nt, Human
cgcccaaaccuuucccccau

SEQ ID NO: 3180002 - RNA, 20 nt, Human
cggacagccacggccaggcc

SEQ ID NO: 3180003 - RNA, 14 nt, Human
cggaauaguuggcu

SEQ ID NO: 3180004 - RNA, 17 nt, Human
cggaauaguuggcuagg

SEQ ID NO: 3180005 - RNA, 16 nt, Human
cggaauaguuggcuag

SEQ ID NO: 3180006 - RNA, 16 nt, Human
cgcuuucuacccagcg

SEQ ID NO: 3180007 - RNA, 14 nt, Human
cgcuuucuacccag

SEQ ID NO: 3180008 - RNA, 22 nt, Human
cggacagccacggccaggccag

SEQ ID NO: 3180009 - RNA, 21 nt, Human
cggacagccacggccaggcca

SEQ ID NO: 3180010 - RNA, 16 nt, Human
cggacuuagcugggag

SEQ ID NO: 3180011 - RNA, 15 nt, Human
cggagaaaggaaggg

SEQ ID NO: 3180012 - RNA, 17 nt, Human
cggacuuagcugggaga

SEQ ID NO: 3180013 - RNA, 13 nt, Human
cgcugugcugccc

SEQ ID NO: 3180014 - RNA, 14 nt, Human
cgcugugcugcccu

SEQ ID NO: 3180015 - RNA, 11 nt, Human
cgcugugcugc

SEQ ID NO: 3180016 - RNA, 21 nt, Human
cgcuaacuugcuuaaauguga

SEQ ID NO: 3180017 - RNA, 16 nt, Human
cgcucccuugaccugc

SEQ ID NO: 3180018 - RNA, 20 nt, Human
cgcuccgggacguggcaccu

SEQ ID NO: 3180019 - RNA, 21 nt, Human
cgcugugcugcccugcccacc

SEQ ID NO: 3180020 - RNA, 23 nt, Human
cgcugugcugcccugcccaccug

SEQ ID NO: 3180021 - RNA, 19 nt, Human
cgcugugcugcccugccca

SEQ ID NO: 3180022 - RNA, 18 nt, Human
cgcugugcugcccugccc

SEQ ID NO: 3180023 - RNA, 11 nt, Human
cgcuucacagg

SEQ ID NO: 3180024 - RNA, 22 nt, Human
cgcuucccugguucaagcgauu

SEQ ID NO: 3180025 - RNA, 20 nt, Human
cgcuucccugguucaagcga

SEQ ID NO: 3180026 - RNA, 19 nt, Human
cgggaagggggcugggaca

SEQ ID NO: 3180027 - RNA, 20 nt, Human
cgggaagggggcugggacau

SEQ ID NO: 3180028 - RNA, 16 nt, Human
cgggaagggggcuggg

SEQ ID NO: 3180029 - RNA, 23 nt, Human
cggcuggcagcccaccccucaac

SEQ ID NO: 3180030 - RNA, 13 nt, Human
cggcuggccuggc

SEQ ID NO: 3180031 - RNA, 14 nt, Human
cggcuggcagccca

SEQ ID NO: 3180032 - RNA, 13 nt, Human
cggccucuucucu

SEQ ID NO: 3180033 - RNA, 17 nt, Human
cggccucuucucucaga

SEQ ID NO: 3180034 - RNA, 18 nt, Human
cggccucuucucucagac

SEQ ID NO: 3180035 - RNA, 19 nt, Human
cggccucuucucucagacc

SEQ ID NO: 3180036 - RNA, 11 nt, Human
cggccaggcca

SEQ ID NO: 3180037 - RNA, 17 nt, Human
cggaucaggcucccagg

SEQ ID NO: 3180038 - RNA, 16 nt, Human
cggaucaggcucccag

SEQ ID NO: 3180039 - RNA, 14 nt, Human
cggaucagcugagc

SEQ ID NO: 3180040 - RNA, 14 nt, Human
cggauccccuuccu

SEQ ID NO: 3180041 - RNA, 20 nt, Human
cggccaggccagagggagug

SEQ ID NO: 3180042 - RNA, 12 nt, Human
cggccaggccag

SEQ ID NO: 3180043 - RNA, 16 nt, Human
cgaggacagggaggug

SEQ ID NO: 3180044 - RNA, 19 nt, Human
cgagcccugguggcagugg

SEQ ID NO: 3180045 - RNA, 12 nt, Human
cgagagcgcagc

SEQ ID NO: 3180046 - RNA, 14 nt, Human
cgaggacagggagg

SEQ ID NO: 3180047 - RNA, 21 nt, Human
cgagccuuuucacccuucuac

SEQ ID NO: 3180048 - RNA, 18 nt, Human
cgagcccugguggcagug

SEQ ID NO: 3180049 - RNA, 22 nt, Human
cgagcccuugcccaugcugggc

SEQ ID NO: 3180050 - RNA, 13 nt, Human
cgcacugggcuug

SEQ ID NO: 3180051 - RNA, 18 nt, Human
cgauggauauauguuuuu

SEQ ID NO: 3180052 - RNA, 15 nt, Human
cgaugcagacagggg

SEQ ID NO: 3180053 - RNA, 19 nt, Human
cgaugcaaacauuggaaga

SEQ ID NO: 3180054 - RNA, 23 nt, Human
cgaugcagacagggggccagaac

SEQ ID NO: 3180055 - RNA, 19 nt, Human
cgcagcauauucaggaagc

SEQ ID NO: 3180056 - RNA, 20 nt, Human
cgcagcauauucaggaagcu

SEQ ID NO: 3180057 - RNA, 15 nt, Human
cgcagcccugcagag

SEQ ID NO: 3180058 - RNA, 17 nt, Human
cgcagcccugcagaggg

SEQ ID NO: 3180059 - RNA, 17 nt, Human
cgcacugggcuugggga

SEQ ID NO: 3180060 - RNA, 13 nt, Human
cgcacucuggcag

SEQ ID NO: 3180061 - RNA, 19 nt, Human
cgcagagggaauuuuuccc

SEQ ID NO: 3180062 - RNA, 15 nt, Human
ccucuuccaggcccc

SEQ ID NO: 3180063 - RNA, 16 nt, Human
ccuaugaccauaaaau

SEQ ID NO: 3180064 - RNA, 12 nt, Human
ccugaaaauauc

SEQ ID NO: 3180065 - RNA, 11 nt, Human
ccucuuccuga

SEQ ID NO: 3180066 - RNA, 14 nt, Human
ccucuuccuggccg

SEQ ID NO: 3180067 - RNA, 19 nt, Human
ccugaagagaagggcaggg

SEQ ID NO: 3180068 - RNA, 19 nt, Human
ccugaaaugugugugaugu

SEQ ID NO: 3180069 - RNA, 21 nt, Human
ccugaagacucauucuucugu

SEQ ID NO: 3180070 - RNA, 15 nt, Human
ccugaaauccugguu

SEQ ID NO: 3180071 - RNA, 17 nt, Human
ccugaaauccugguucc

SEQ ID NO: 3180072 - RNA, 12 nt, Human
ccugaaaugugu

SEQ ID NO: 3180073 - RNA, 18 nt, Human
ccugaaaugugugugaug

SEQ ID NO: 3180074 - RNA, 17 nt, Human
ccugaaaugugugugau

SEQ ID NO: 3180075 - RNA, 18 nt, Human
ccugaaagcccugagcuu

SEQ ID NO: 3180076 - RNA, 13 nt, Human
ccugaaagcccug

SEQ ID NO: 3180077 - RNA, 14 nt, Human
ccugaaagcccuga

SEQ ID NO: 3180078 - RNA, 22 nt, Human
ccugaaggccccgcccaggcuu

SEQ ID NO: 3180079 - RNA, 16 nt, Human
ccugaagggguuuucu

SEQ ID NO: 3180080 - RNA, 20 nt, Human
ccugaaggccccgcccaggc

SEQ ID NO: 3180081 - RNA, 21 nt, Human
ccugaaggccccgcccaggcu

SEQ ID NO: 3180082 - RNA, 18 nt, Human
ccugaaggccccgcccag

SEQ ID NO: 3180083 - RNA, 19 nt, Human
ccugaaggccccgcccagg

SEQ ID NO: 3180084 - RNA, 14 nt, Human
ccugaaggccccgc

SEQ ID NO: 3180085 - RNA, 15 nt, Human
ccugagcugggauga

SEQ ID NO: 3180086 - RNA, 15 nt, Human
ccugcacugacucug

SEQ ID NO: 3180087 - RNA, 18 nt, Human
ccugcacugacucuggaa

SEQ ID NO: 3180088 - RNA, 16 nt, Human
ccugcacugacucugg

SEQ ID NO: 3180089 - RNA, 21 nt, Human
ccugcacacgcuccuuccucu

SEQ ID NO: 3180090 - RNA, 23 nt, Human
ccugcacaaagcccuuccauguc

SEQ ID NO: 3180091 - RNA, 15 nt, Human
ccugcaaagcccagc

SEQ ID NO: 3180092 - RNA, 16 nt, Human
ccugcaaagcccagcu

SEQ ID NO: 3180093 - RNA, 14 nt, Human
ccugcaaagcccag

SEQ ID NO: 3180094 - RNA, 17 nt, Human
ccugcaaagcccagcuu

SEQ ID NO: 3180095 - RNA, 18 nt, Human
ccugcaaagcccagcuug

SEQ ID NO: 3180096 - RNA, 20 nt, Human
ccugcacaaagcccuuccau

SEQ ID NO: 3180097 - RNA, 22 nt, Human
ccugcacaaagcccuuccaugu

SEQ ID NO: 3180098 - RNA, 21 nt, Human
ccugaucccugaucccuucca

SEQ ID NO: 3180099 - RNA, 22 nt, Human
ccugaucccuuccaccugcucu

SEQ ID NO: 3180100 - RNA, 19 nt, Human
ccugaucccuuccaccugc

SEQ ID NO: 3180101 - RNA, 23 nt, Human
ccugaucccuuccaccugcucug

SEQ ID NO: 3180102 - RNA, 13 nt, Human
ccugccacccugg

SEQ ID NO: 3180103 - RNA, 12 nt, Human
ccugccacccug

SEQ ID NO: 3180104 - RNA, 14 nt, Human
ccugccacccuggg

SEQ ID NO: 3180105 - RNA, 22 nt, Human
ccugccacccuggggagaaagu

SEQ ID NO: 3180106 - RNA, 16 nt, Human
ccugccacccugggga

SEQ ID NO: 3180107 - RNA, 19 nt, Human
ccugccaauggacuaacuu

SEQ ID NO: 3180108 - RNA, 15 nt, Human
ccugccaccacgccc

SEQ ID NO: 3180109 - RNA, 19 nt, Human
ccugccaccacgcccggcu

SEQ ID NO: 3180110 - RNA, 23 nt, Human
ccugcauuugugaaaugauggug

SEQ ID NO: 3180111 - RNA, 13 nt, Human
ccugaggcuccac

SEQ ID NO: 3180112 - RNA, 14 nt, Human
ccugaggcuccacu

SEQ ID NO: 3180113 - RNA, 13 nt, Human
ccugaggcugggc

SEQ ID NO: 3180114 - RNA, 14 nt, Human
ccugaggcugggcu

SEQ ID NO: 3180115 - RNA, 15 nt, Human
ccugaggcugggcuc

SEQ ID NO: 3180116 - RNA, 12 nt, Human
ccugagcuggga

SEQ ID NO: 3180117 - RNA, 15 nt, Human
ccugaggcccagagg

SEQ ID NO: 3180118 - RNA, 16 nt, Human
ccugaggcccagaggg

SEQ ID NO: 3180119 - RNA, 17 nt, Human
ccugaggcccagagggc

SEQ ID NO: 3180120 - RNA, 15 nt, Human
ccugagccagauuuc

SEQ ID NO: 3180121 - RNA, 12 nt, Human
ccugagccagau

SEQ ID NO: 3180122 - RNA, 16 nt, Human
ccugagccagauuuca

SEQ ID NO: 3180123 - RNA, 18 nt, Human
ccugagccagauuucacu

SEQ ID NO: 3180124 - RNA, 19 nt, Human
ccugaagucacacagugag

SEQ ID NO: 3180125 - RNA, 20 nt, Human
ccugaagucacacagugagu

SEQ ID NO: 3180126 - RNA, 22 nt, Human
ccugaagucuuuguacagacaa

SEQ ID NO: 3180127 - RNA, 20 nt, Human
ccugaaguuauguguaugug

SEQ ID NO: 3180128 - RNA, 17 nt, Human
ccugaagggguuuucuu

SEQ ID NO: 3180129 - RNA, 19 nt, Human
ccugaaguaagcaaagacu

SEQ ID NO: 3180130 - RNA, 13 nt, Human
ccugagcccccag

SEQ ID NO: 3180131 - RNA, 15 nt, Human
ccugagcccccagcu

SEQ ID NO: 3180132 - RNA, 14 nt, Human
ccugagcccccagc

SEQ ID NO: 3180133 - RNA, 18 nt, Human
ccugagcccccagcuucc

SEQ ID NO: 3180134 - RNA, 21 nt, Human
ccugcccuuuguccuccugcu

SEQ ID NO: 3180135 - RNA, 19 nt, Human
ccugcccuuuguccuccug

SEQ ID NO: 3180136 - RNA, 15 nt, Human
ccugcccugugggcc

SEQ ID NO: 3180137 - RNA, 19 nt, Human
ccugcccuuaccugccagg

SEQ ID NO: 3180138 - RNA, 21 nt, Human
ccugcccuuaccugccaggaa

SEQ ID NO: 3180139 - RNA, 22 nt, Human
ccugcccuuaccugccaggaag

SEQ ID NO: 3180140 - RNA, 14 nt, Human
ccugccuguugggc

SEQ ID NO: 3180141 - RNA, 22 nt, Human
ccugccuguucccauucuugca

SEQ ID NO: 3180142 - RNA, 11 nt, Human
ccugccucagc

SEQ ID NO: 3180143 - RNA, 12 nt, Human
ccugccucagcc

SEQ ID NO: 3180144 - RNA, 14 nt, Human
ccugccucagccuc

SEQ ID NO: 3180145 - RNA, 13 nt, Human
ccugccucagccu

SEQ ID NO: 3180146 - RNA, 12 nt, Human
ccugcccugugg

SEQ ID NO: 3180147 - RNA, 14 nt, Human
ccugcccugugggc

SEQ ID NO: 3180148 - RNA, 11 nt, Human
ccugcccugug

SEQ ID NO: 3180149 - RNA, 23 nt, Human
ccugcccugguuuccugcccugg

SEQ ID NO: 3180150 - RNA, 21 nt, Human
ccugcccugucaggaggcaga

SEQ ID NO: 3180151 - RNA, 18 nt, Human
ccugcccugucaggaggc

SEQ ID NO: 3180152 - RNA, 19 nt, Human
ccugcccugguuuccugcc

SEQ ID NO: 3180153 - RNA, 20 nt, Human
ccugcccugguuuccugccc

SEQ ID NO: 3180154 - RNA, 21 nt, Human
ccugcccugguuuccugcccu

SEQ ID NO: 3180155 - RNA, 22 nt, Human
ccugcccugguuuccugcccug

SEQ ID NO: 3180156 - RNA, 20 nt, Human
ccugcccugggaggcaguga

SEQ ID NO: 3180157 - RNA, 22 nt, Human
ccugcccugggaggcagugaug

SEQ ID NO: 3180158 - RNA, 14 nt, Human
ccugcccugguuuc

SEQ ID NO: 3180159 - RNA, 10 nt, Human
ccugcccugg

SEQ ID NO: 3180160 - RNA, 12 nt, Human
ccugcccuggga

SEQ ID NO: 3180161 - RNA, 14 nt, Human
ccugcccugggagg

SEQ ID NO: 3180162 - RNA, 15 nt, Human
ccugcccugggaggc

SEQ ID NO: 3180163 - RNA, 17 nt, Human
ccugccccugagcccau

SEQ ID NO: 3180164 - RNA, 19 nt, Human
ccugccccuccucucugcc

SEQ ID NO: 3180165 - RNA, 20 nt, Human
ccugccccuccucucugccc

SEQ ID NO: 3180166 - RNA, 21 nt, Human
ccugccccuccucucugcccu

SEQ ID NO: 3180167 - RNA, 22 nt, Human
ccugccccuccucucugcccua

SEQ ID NO: 3180168 - RNA, 14 nt, Human
ccugccccucccuu

SEQ ID NO: 3180169 - RNA, 18 nt, Human
ccugccccuccucucugc

SEQ ID NO: 3180170 - RNA, 18 nt, Human
ccugccccucccuucaac

SEQ ID NO: 3180171 - RNA, 16 nt, Human
ccugccccucccuuca

SEQ ID NO: 3180172 - RNA, 15 nt, Human
ccugccccucccuuc

SEQ ID NO: 3180173 - RNA, 16 nt, Human
ccugcccggcugcgga

SEQ ID NO: 3180174 - RNA, 14 nt, Human
ccugcccggcugcg

SEQ ID NO: 3180175 - RNA, 16 nt, Human
ccugccccugcuacug

SEQ ID NO: 3180176 - RNA, 20 nt, Human
ccugcccggauggagcgggg

SEQ ID NO: 3180177 - RNA, 12 nt, Human
ccugccaggcau

SEQ ID NO: 3180178 - RNA, 21 nt, Human
ccugccaggcacaggcagggc

SEQ ID NO: 3180179 - RNA, 20 nt, Human
ccugccaggcacaggcaggg

SEQ ID NO: 3180180 - RNA, 19 nt, Human
ccugccaggcacaggcagg

SEQ ID NO: 3180181 - RNA, 18 nt, Human
ccugccaggcacaggcag

SEQ ID NO: 3180182 - RNA, 16 nt, Human
ccugccaggcacaggc

SEQ ID NO: 3180183 - RNA, 15 nt, Human
ccugccaggcacagg

SEQ ID NO: 3180184 - RNA, 14 nt, Human
ccugccaggcacag

SEQ ID NO: 3180185 - RNA, 13 nt, Human
ccugccaggcaca

SEQ ID NO: 3180186 - RNA, 22 nt, Human
ccugccagggacagagggggug

SEQ ID NO: 3180187 - RNA, 23 nt, Human
ccugccaggcacaggcagggcag

SEQ ID NO: 3180188 - RNA, 22 nt, Human
ccugccaggcacaggcagggca

SEQ ID NO: 3180189 - RNA, 14 nt, Human
ccugccccccagcc

SEQ ID NO: 3180190 - RNA, 22 nt, Human
ccugccuguugggccaggagcc

SEQ ID NO: 3180191 - RNA, 20 nt, Human
ccugguccucacacucaccc

SEQ ID NO: 3180192 - RNA, 19 nt, Human
ccugguccuaggcuggaag

SEQ ID NO: 3180193 - RNA, 24 nt, Human
ccugguccuaggcuggaaggagga

SEQ ID NO: 3180194 - RNA, 16 nt, Human
ccuggucgccuuccac

SEQ ID NO: 3180195 - RNA, 21 nt, Human
ccuggucgccuuccaccucug

SEQ ID NO: 3180196 - RNA, 19 nt, Human
ccuggguuagacugccagc

SEQ ID NO: 3180197 - RNA, 17 nt, Human
ccuggguuagacugcca

SEQ ID NO: 3180198 - RNA, 22 nt, Human
ccuggguuagacugccagcucu

SEQ ID NO: 3180199 - RNA, 21 nt, Human
ccuggguuagacugccagcuc

SEQ ID NO: 3180200 - RNA, 20 nt, Human
ccuggguuagacugccagcu

SEQ ID NO: 3180201 - RNA, 18 nt, Human
ccugguggcagcugcggu

SEQ ID NO: 3180202 - RNA, 17 nt, Human
ccugguggcagcugcgg

SEQ ID NO: 3180203 - RNA, 16 nt, Human
ccugguggcagcugcg

SEQ ID NO: 3180204 - RNA, 15 nt, Human
ccugguggcagcugc

SEQ ID NO: 3180205 - RNA, 19 nt, Human
ccugguggcagcucaccuc

SEQ ID NO: 3180206 - RNA, 21 nt, Human
ccugguggcagcucaccucuc

SEQ ID NO: 3180207 - RNA, 22 nt, Human
ccugguggcagcucaccucucc

SEQ ID NO: 3180208 - RNA, 14 nt, Human
ccugguggcagcug

SEQ ID NO: 3180209 - RNA, 12 nt, Human
ccugucccccug

SEQ ID NO: 3180210 - RNA, 13 nt, Human
ccugucccccuga

SEQ ID NO: 3180211 - RNA, 14 nt, Human
ccugucccccugac

SEQ ID NO: 3180212 - RNA, 15 nt, Human
ccugucccccugaca

SEQ ID NO: 3180213 - RNA, 21 nt, Human
ccugucaucugagaaugaaca

SEQ ID NO: 3180214 - RNA, 16 nt, Human
ccugucaggaggcaga

SEQ ID NO: 3180215 - RNA, 13 nt, Human
ccugucaggaggc

SEQ ID NO: 3180216 - RNA, 13 nt, Human
ccuguagcccuaa

SEQ ID NO: 3180217 - RNA, 15 nt, Human
ccuguagagugggag

SEQ ID NO: 3180218 - RNA, 16 nt, Human
ccuguagagugggagc

SEQ ID NO: 3180219 - RNA, 14 nt, Human
ccugguggcagugg

SEQ ID NO: 3180220 - RNA, 13 nt, Human
ccugguggcagug

SEQ ID NO: 3180221 - RNA, 13 nt, Human
ccuggucuuugag

SEQ ID NO: 3180222 - RNA, 20 nt, Human
ccuggucuuugagcucccac

SEQ ID NO: 3180223 - RNA, 19 nt, Human
ccugggggcugggcagagg

SEQ ID NO: 3180224 - RNA, 20 nt, Human
ccugggggcugggcagagga

SEQ ID NO: 3180225 - RNA, 21 nt, Human
ccugggggcugggcagaggaa

SEQ ID NO: 3180226 - RNA, 18 nt, Human
ccugggggcugggcagag

SEQ ID NO: 3180227 - RNA, 20 nt, Human
ccuggggucaggccgggcag

SEQ ID NO: 3180228 - RNA, 22 nt, Human
ccuggggucaggccgggcagag

SEQ ID NO: 3180229 - RNA, 14 nt, Human
ccuggggugcaggc

SEQ ID NO: 3180230 - RNA, 15 nt, Human
ccugggcagaaggaa

SEQ ID NO: 3180231 - RNA, 18 nt, Human
ccugggagugagcugguu

SEQ ID NO: 3180232 - RNA, 16 nt, Human
ccugggcagaaggaag

SEQ ID NO: 3180233 - RNA, 22 nt, Human
ccugggaggucaaggcugcagu

SEQ ID NO: 3180234 - RNA, 16 nt, Human
ccugggagugagcugg

SEQ ID NO: 3180235 - RNA, 16 nt, Human
ccuggcccacugcauc

SEQ ID NO: 3180236 - RNA, 11 nt, Human
ccuggcucccc

SEQ ID NO: 3180237 - RNA, 13 nt, Human
ccuggcuccccug

SEQ ID NO: 3180238 - RNA, 14 nt, Human
ccuggcuccccugg

SEQ ID NO: 3180239 - RNA, 15 nt, Human
ccuggcuccccuggg

SEQ ID NO: 3180240 - RNA, 16 nt, Human
ccuggcuccccugggg

SEQ ID NO: 3180241 - RNA, 12 nt, Human
ccuggcucccuc

SEQ ID NO: 3180242 - RNA, 14 nt, Human
ccuggcucccucac

SEQ ID NO: 3180243 - RNA, 22 nt, Human
ccuggcucccucacucucagga

SEQ ID NO: 3180244 - RNA, 21 nt, Human
ccuggcucccucacucucagg

SEQ ID NO: 3180245 - RNA, 20 nt, Human
ccuggcucccucacucucag

SEQ ID NO: 3180246 - RNA, 19 nt, Human
ccuggcucccucacucuca

SEQ ID NO: 3180247 - RNA, 21 nt, Human
ccuggcccauguauggccagg

SEQ ID NO: 3180248 - RNA, 15 nt, Human
ccuggcccauguaug

SEQ ID NO: 3180249 - RNA, 13 nt, Human
ccuggcccaugua

SEQ ID NO: 3180250 - RNA, 19 nt, Human
ccugggacagggagcagcc

SEQ ID NO: 3180251 - RNA, 16 nt, Human
ccuggcuuuucacugc

SEQ ID NO: 3180252 - RNA, 17 nt, Human
ccuggcuuuucacugcu

SEQ ID NO: 3180253 - RNA, 19 nt, Human
ccugggaaagagauuuaaa

SEQ ID NO: 3180254 - RNA, 13 nt, Human
ccuggcacugcuu

SEQ ID NO: 3180255 - RNA, 16 nt, Human
ccuggcacugcuucca

SEQ ID NO: 3180256 - RNA, 13 nt, Human
ccuggcaggcagg

SEQ ID NO: 3180257 - RNA, 12 nt, Human
ccuggcaggcag

SEQ ID NO: 3180258 - RNA, 23 nt, Human
ccuggcaggcaggggcccugcag

SEQ ID NO: 3180259 - RNA, 21 nt, Human
ccuggcaggcaggggcccugc

SEQ ID NO: 3180260 - RNA, 15 nt, Human
ccuggcaggcagggg

SEQ ID NO: 3180261 - RNA, 14 nt, Human
ccuggcaggcaggg

SEQ ID NO: 3180262 - RNA, 13 nt, Human
ccuggcaugggaa

SEQ ID NO: 3180263 - RNA, 21 nt, Human
ccuggcagguuguuagaaaaa

SEQ ID NO: 3180264 - RNA, 23 nt, Human
ccuggcaugggaaugaaugucag

SEQ ID NO: 3180265 - RNA, 20 nt, Human
ccuggccagaugcaccagcc

SEQ ID NO: 3180266 - RNA, 23 nt, Human
ccuggccagaugcaccagcccuu

SEQ ID NO: 3180267 - RNA, 21 nt, Human
ccuggccagaugcaccagccc

SEQ ID NO: 3180268 - RNA, 13 nt, Human
ccuggcccacugc

SEQ ID NO: 3180269 - RNA, 14 nt, Human
ccuggcccacugca

SEQ ID NO: 3180270 - RNA, 13 nt, Human
ccuggccacgccc

SEQ ID NO: 3180271 - RNA, 12 nt, Human
ccuggcacugcu

SEQ ID NO: 3180272 - RNA, 22 nt, Human
ccuggcacuauaauguaagcuc

SEQ ID NO: 3180273 - RNA, 18 nt, Human
ccuggcacccggccccug

SEQ ID NO: 3180274 - RNA, 20 nt, Human
ccuggcacccggccccugcu

SEQ ID NO: 3180275 - RNA, 19 nt, Human
ccuggcacccggccccugc

SEQ ID NO: 3180276 - RNA, 16 nt, Human
ccuggagaacuagaga

SEQ ID NO: 3180277 - RNA, 13 nt, Human
ccuggagaacuag

SEQ ID NO: 3180278 - RNA, 12 nt, Human
ccuggagaacua

SEQ ID NO: 3180279 - RNA, 18 nt, Human
ccugccuguugggccagg

SEQ ID NO: 3180280 - RNA, 19 nt, Human
ccugccuguugggccagga

SEQ ID NO: 3180281 - RNA, 20 nt, Human
ccugccuguugggccaggag

SEQ ID NO: 3180282 - RNA, 21 nt, Human
ccugcuaauuccccagauugc

SEQ ID NO: 3180283 - RNA, 17 nt, Human
ccugcuaauuccccaga

SEQ ID NO: 3180284 - RNA, 13 nt, Human
ccugcuacugcca

SEQ ID NO: 3180285 - RNA, 21 nt, Human
ccugcuacugccaaccucgcu

SEQ ID NO: 3180286 - RNA, 18 nt, Human
ccugcuacugccaaccuc

SEQ ID NO: 3180287 - RNA, 15 nt, Human
ccugcuacugccaac

SEQ ID NO: 3180288 - RNA, 14 nt, Human
cuccacucuccucu

SEQ ID NO: 3180289 - RNA, 13 nt, Human
cuccacugccuuc

SEQ ID NO: 3180290 - RNA, 13 nt, Human
cuccacuggaugg

SEQ ID NO: 3180291 - RNA, 16 nt, Human
cuccacugccuucgau

SEQ ID NO: 3180292 - RNA, 15 nt, Human
cuccacugccuucga

SEQ ID NO: 3180293 - RNA, 14 nt, Human
cuccacugccuucg

SEQ ID NO: 3180294 - RNA, 18 nt, Human
cuccaaggugauguugua

SEQ ID NO: 3180295 - RNA, 20 nt, Human
cuccaaggccaggccuuggg

SEQ ID NO: 3180296 - RNA, 19 nt, Human
cuccaaggccaggccuugg

SEQ ID NO: 3180297 - RNA, 14 nt, Human
cuccaaggccaggc

SEQ ID NO: 3180298 - RNA, 16 nt, Human
cuccagagucagaagu

SEQ ID NO: 3180299 - RNA, 21 nt, Human
cuccagagcugcggugucucc

SEQ ID NO: 3180300 - RNA, 14 nt, Human
cuccacuggaugga

SEQ ID NO: 3180301 - RNA, 21 nt, Human
cuccagaccccuggcuuuuca

SEQ ID NO: 3180302 - RNA, 13 nt, Human
cuccagccccugg

SEQ ID NO: 3180303 - RNA, 14 nt, Human
cuccagccccugga

SEQ ID NO: 3180304 - RNA, 11 nt, Human
cuccagccccu

SEQ ID NO: 3180305 - RNA, 18 nt, Human
cuccagcucaccagcccc

SEQ ID NO: 3180306 - RNA, 16 nt, Human
cuccagcucaccagcc

SEQ ID NO: 3180307 - RNA, 15 nt, Human
cuccagcucaccagc

SEQ ID NO: 3180308 - RNA, 14 nt, Human
cuccagcucaccag

SEQ ID NO: 3180309 - RNA, 17 nt, Human
cucaguucucuucacuc

SEQ ID NO: 3180310 - RNA, 16 nt, Human
cucaguucucuucacu

SEQ ID NO: 3180311 - RNA, 14 nt, Human
cucaguuuuucuua

SEQ ID NO: 3180312 - RNA, 12 nt, Human
cucaguuuuucu

SEQ ID NO: 3180313 - RNA, 15 nt, Human
cucaguuuuuuuccu

SEQ ID NO: 3180314 - RNA, 17 nt, Human
cucauugaccugaggcc

SEQ ID NO: 3180315 - RNA, 18 nt, Human
cucauucugaauuaauua

SEQ ID NO: 3180316 - RNA, 19 nt, Human
cucauugaccugaggcccu

SEQ ID NO: 3180317 - RNA, 21 nt, Human
cucauugaccugaggcccuuc

SEQ ID NO: 3180318 - RNA, 13 nt, Human
cucauuuugcuug

SEQ ID NO: 3180319 - RNA, 17 nt, Human
cuccaagcucccaggca

SEQ ID NO: 3180320 - RNA, 17 nt, Human
cuccaaggacagaaggc

SEQ ID NO: 3180321 - RNA, 20 nt, Human
cuccaaggacagaaggcucc

SEQ ID NO: 3180322 - RNA, 18 nt, Human
cucauuugucacacacuu

SEQ ID NO: 3180323 - RNA, 21 nt, Human
cucauuugucacacacuuugg

SEQ ID NO: 3180324 - RNA, 18 nt, Human
cucauuuuaaugauuguu

SEQ ID NO: 3180325 - RNA, 21 nt, Human
cucauuuuaaugauuguuuaa

SEQ ID NO: 3180326 - RNA, 20 nt, Human
cucauuuuaaugauuguuua

SEQ ID NO: 3180327 - RNA, 20 nt, Human
cuccccagccagccuggcug

SEQ ID NO: 3180328 - RNA, 18 nt, Human
cuccccagccagccuggc

SEQ ID NO: 3180329 - RNA, 17 nt, Human
cuccccagccagccugg

SEQ ID NO: 3180330 - RNA, 16 nt, Human
cuccccagccagccug

SEQ ID NO: 3180331 - RNA, 15 nt, Human
cuccccagccagccu

SEQ ID NO: 3180332 - RNA, 14 nt, Human
cuccccucggagaa

SEQ ID NO: 3180333 - RNA, 14 nt, Human
cuccccugcugggu

SEQ ID NO: 3180334 - RNA, 21 nt, Human
cuccccugcuggguguggcgc

SEQ ID NO: 3180335 - RNA, 23 nt, Human
cuccccugcuggguguggcgcag

SEQ ID NO: 3180336 - RNA, 15 nt, Human
cuccccugcagcccu

SEQ ID NO: 3180337 - RNA, 18 nt, Human
cuccccugcagcccuggc

SEQ ID NO: 3180338 - RNA, 21 nt, Human
cucccuggcagcacaggaaaa

SEQ ID NO: 3180339 - RNA, 21 nt, Human
cucccuucaaccauuccccau

SEQ ID NO: 3180340 - RNA, 15 nt, Human
cucccuucauccuuc

SEQ ID NO: 3180341 - RNA, 23 nt, Human
cucccuucaaccauuccccaugg

SEQ ID NO: 3180342 - RNA, 22 nt, Human
cucccuucaaccauuccccaug

SEQ ID NO: 3180343 - RNA, 19 nt, Human
cucccgaauagcugggacu

SEQ ID NO: 3180344 - RNA, 14 nt, Human
cuccccuggacucc

SEQ ID NO: 3180345 - RNA, 18 nt, Human
cuccccuggggugcaggc

SEQ ID NO: 3180346 - RNA, 12 nt, Human
cuccccuggacu

SEQ ID NO: 3180347 - RNA, 23 nt, Human
cucccgaauagcugggacuacag

SEQ ID NO: 3180348 - RNA, 20 nt, Human
cucccgaauagcugggacua

SEQ ID NO: 3180349 - RNA, 22 nt, Human
cucccucaagccagacucugcc

SEQ ID NO: 3180350 - RNA, 14 nt, Human
cucccucacucuca

SEQ ID NO: 3180351 - RNA, 18 nt, Human
cucccucacucucaggaa

SEQ ID NO: 3180352 - RNA, 17 nt, Human
cucccucacucucagga

SEQ ID NO: 3180353 - RNA, 16 nt, Human
cucccucacucucagg

SEQ ID NO: 3180354 - RNA, 15 nt, Human
cucccucacucucag

SEQ ID NO: 3180355 - RNA, 14 nt, Human
cuccccugugccag

SEQ ID NO: 3180356 - RNA, 20 nt, Human
cucccgagacggcacugaga

SEQ ID NO: 3180357 - RNA, 22 nt, Human
cuccagcucuggcauggcuagg

SEQ ID NO: 3180358 - RNA, 16 nt, Human
cuccagcucuggcaug

SEQ ID NO: 3180359 - RNA, 22 nt, Human
cuccagcuggccgggagccuga

SEQ ID NO: 3180360 - RNA, 23 nt, Human
cuccagcuggccgggagccugau

SEQ ID NO: 3180361 - RNA, 17 nt, Human
cuccaugcugccuccag

SEQ ID NO: 3180362 - RNA, 16 nt, Human
cuccaugcugccucca

SEQ ID NO: 3180363 - RNA, 15 nt, Human
cuccaugcugccucc

SEQ ID NO: 3180364 - RNA, 14 nt, Human
cuccaugcugccuc

SEQ ID NO: 3180365 - RNA, 13 nt, Human
cuccaugcugccu

SEQ ID NO: 3180366 - RNA, 22 nt, Human
cucccaaaagcuagaacacugc

SEQ ID NO: 3180367 - RNA, 16 nt, Human
cucccaaaagcuagaa

SEQ ID NO: 3180368 - RNA, 22 nt, Human
cuccauuuuggugucuuucucu

SEQ ID NO: 3180369 - RNA, 21 nt, Human
cuccauuuuggugucuuucuc

SEQ ID NO: 3180370 - RNA, 16 nt, Human
cuccauuucacuggcu

SEQ ID NO: 3180371 - RNA, 23 nt, Human
cucccaaagugcugggauuacag

SEQ ID NO: 3180372 - RNA, 16 nt, Human
cucccaaagugcuggg

SEQ ID NO: 3180373 - RNA, 14 nt, Human
cucccaacucaccc

SEQ ID NO: 3180374 - RNA, 15 nt, Human
cucccaacucacccc

SEQ ID NO: 3180375 - RNA, 15 nt, Human
cucccacaaaggaga

SEQ ID NO: 3180376 - RNA, 16 nt, Human
cucccaucacuucccu

SEQ ID NO: 3180377 - RNA, 14 nt, Human
cucccaucacccgc

SEQ ID NO: 3180378 - RNA, 22 nt, Human
cucccagggagcaagggcaggg

SEQ ID NO: 3180379 - RNA, 22 nt, Human
cucccaggcgccccuucccccu

SEQ ID NO: 3180380 - RNA, 20 nt, Human
cucccaggcgccccuucccc

SEQ ID NO: 3180381 - RNA, 20 nt, Human
cucccagggagcaagggcag

SEQ ID NO: 3180382 - RNA, 19 nt, Human
cucccaggcgccccuuccc

SEQ ID NO: 3180383 - RNA, 17 nt, Human
cucccaggcgccccuuc

SEQ ID NO: 3180384 - RNA, 12 nt, Human
cucaggaccagg

SEQ ID NO: 3180385 - RNA, 23 nt, Human
cucaggaaaugcugacccauggg

SEQ ID NO: 3180386 - RNA, 22 nt, Human
cucaggaaaugcugacccaugg

SEQ ID NO: 3180387 - RNA, 21 nt, Human
cucaggaaaugcugacccaug

SEQ ID NO: 3180388 - RNA, 20 nt, Human
cucaggaaaugcugacccau

SEQ ID NO: 3180389 - RNA, 22 nt, Human
cucaggaaaucaaauaugcaaa

SEQ ID NO: 3180390 - RNA, 19 nt, Human
cucaggaaaugcugaccca

SEQ ID NO: 3180391 - RNA, 15 nt, Human
cucaggaaaugcuga

SEQ ID NO: 3180392 - RNA, 19 nt, Human
cucagcuuccccaguagcu

SEQ ID NO: 3180393 - RNA, 18 nt, Human
cucagcuuccccaguagc

SEQ ID NO: 3180394 - RNA, 14 nt, Human
cucagcuuccccag

SEQ ID NO: 3180395 - RNA, 19 nt, Human
cucagcugucaaggcucag

SEQ ID NO: 3180396 - RNA, 18 nt, Human
cucagcugucaaggcuca

SEQ ID NO: 3180397 - RNA, 19 nt, Human
cucagcuguucagauugga

SEQ ID NO: 3180398 - RNA, 22 nt, Human
cucagcuguucagauuggacau

SEQ ID NO: 3180399 - RNA, 18 nt, Human
cucaggcaggugggaugg

SEQ ID NO: 3180400 - RNA, 15 nt, Human
cucaggcagguggga

SEQ ID NO: 3180401 - RNA, 18 nt, Human
cucagggccuggcucagg

SEQ ID NO: 3180402 - RNA, 19 nt, Human
cucagggccuggcucaggu

SEQ ID NO: 3180403 - RNA, 20 nt, Human
cucagggccuggcucaggug

SEQ ID NO: 3180404 - RNA, 23 nt, Human
cucaggugauccacccaccucag

SEQ ID NO: 3180405 - RNA, 22 nt, Human
cucaggugauccacccaccuca

SEQ ID NO: 3180406 - RNA, 19 nt, Human
cucagguggggucacucug

SEQ ID NO: 3180407 - RNA, 20 nt, Human
cucagguggggucacucugg

SEQ ID NO: 3180408 - RNA, 21 nt, Human
cucagguggggucacucuggc

SEQ ID NO: 3180409 - RNA, 20 nt, Human
cucagggucccugguggcag

SEQ ID NO: 3180410 - RNA, 21 nt, Human
cucagggucccugguggcagc

SEQ ID NO: 3180411 - RNA, 22 nt, Human
cucagggucccugguggcagcu

SEQ ID NO: 3180412 - RNA, 24 nt, Human
cucagggucccugguggcagcuca

SEQ ID NO: 3180413 - RNA, 18 nt, Human
cucagggucccugguggc

SEQ ID NO: 3180414 - RNA, 22 nt, Human
cucagguaaucgaccugccucg

SEQ ID NO: 3180415 - RNA, 24 nt, Human
cucagguaaucgaccugccucggc

SEQ ID NO: 3180416 - RNA, 20 nt, Human
cucagguaaucgaccugccu

SEQ ID NO: 3180417 - RNA, 14 nt, Human
cucaggguguccca

SEQ ID NO: 3180418 - RNA, 21 nt, Human
cucagcccacauagugauggu

SEQ ID NO: 3180419 - RNA, 22 nt, Human
cucagcauuaccucuuuggaaa

SEQ ID NO: 3180420 - RNA, 20 nt, Human
cucagcauuaccucuuugga

SEQ ID NO: 3180421 - RNA, 19 nt, Human
cucagcauuaccucuuugg

SEQ ID NO: 3180422 - RNA, 15 nt, Human
cucagcauuaccucu

SEQ ID NO: 3180423 - RNA, 21 nt, Human
cucagcccucccugccccucc

SEQ ID NO: 3180424 - RNA, 20 nt, Human
cucagcccucccugccccuc

SEQ ID NO: 3180425 - RNA, 19 nt, Human
cucagcccucccugccccu

SEQ ID NO: 3180426 - RNA, 14 nt, Human
cucagcccucccug

SEQ ID NO: 3180427 - RNA, 16 nt, Human
cucagcaggggagggu

SEQ ID NO: 3180428 - RNA, 19 nt, Human
cucagcaaaagaugcuucu

SEQ ID NO: 3180429 - RNA, 20 nt, Human
cucagcaaaagaugcuucuc

SEQ ID NO: 3180430 - RNA, 22 nt, Human
cucagcauccuggcacccggcc

SEQ ID NO: 3180431 - RNA, 21 nt, Human
cucagcauccuggcacccggc

SEQ ID NO: 3180432 - RNA, 13 nt, Human
cucagcauccugg

SEQ ID NO: 3180433 - RNA, 17 nt, Human
cucagcagugagagcag

SEQ ID NO: 3180434 - RNA, 21 nt, Human
cucagcggggacagcuccuuc

SEQ ID NO: 3180435 - RNA, 20 nt, Human
cucagcggggacagcuccuu

SEQ ID NO: 3180436 - RNA, 19 nt, Human
cucagcggggacagcuccu

SEQ ID NO: 3180437 - RNA, 18 nt, Human
cucagcggggacagcucc

SEQ ID NO: 3180438 - RNA, 16 nt, Human
cucagcggggacagcu

SEQ ID NO: 3180439 - RNA, 15 nt, Human
cucagcggggacagc

SEQ ID NO: 3180440 - RNA, 14 nt, Human
cucagcggggacag

SEQ ID NO: 3180441 - RNA, 23 nt, Human
cucagcggggacagcuccuucug

SEQ ID NO: 3180442 - RNA, 13 nt, Human
cucagcggggaca

SEQ ID NO: 3180443 - RNA, 15 nt, Human
cucagcucccaaggc

SEQ ID NO: 3180444 - RNA, 19 nt, Human
cucagcucccaaggcucug

SEQ ID NO: 3180445 - RNA, 18 nt, Human
cucagaggacccuuucca

SEQ ID NO: 3180446 - RNA, 12 nt, Human
cucagaggcccc

SEQ ID NO: 3180447 - RNA, 19 nt, Human
cucagaggacccuuuccag

SEQ ID NO: 3180448 - RNA, 23 nt, Human
cucagaggccccaauaccccaug

SEQ ID NO: 3180449 - RNA, 22 nt, Human
cucagaggccccaauaccccau

SEQ ID NO: 3180450 - RNA, 21 nt, Human
cucagaggccccaauacccca

SEQ ID NO: 3180451 - RNA, 13 nt, Human
cucagaggcccca

SEQ ID NO: 3180452 - RNA, 16 nt, Human
cucagaucuucugugg

SEQ ID NO: 3180453 - RNA, 13 nt, Human
cucagauguuaaa

SEQ ID NO: 3180454 - RNA, 14 nt, Human
cucagauguuaaaa

SEQ ID NO: 3180455 - RNA, 16 nt, Human
cucagauguuaaaaua

SEQ ID NO: 3180456 - RNA, 17 nt, Human
cucagauguuaaaauaa

SEQ ID NO: 3180457 - RNA, 19 nt, Human
cucagauguuaaaauaaau

SEQ ID NO: 3180458 - RNA, 23 nt, Human
cucagauguuaaaauaaaugguu

SEQ ID NO: 3180459 - RNA, 18 nt, Human
cucacuguugcccaggcu

SEQ ID NO: 3180460 - RNA, 17 nt, Human
cucacuguugcccaggc

SEQ ID NO: 3180461 - RNA, 16 nt, Human
cucacuguugcccagg

SEQ ID NO: 3180462 - RNA, 23 nt, Human
cucagagagggugggagugggcc

SEQ ID NO: 3180463 - RNA, 15 nt, Human
cucagagccaccccu

SEQ ID NO: 3180464 - RNA, 19 nt, Human
cucagagagggugggagug

SEQ ID NO: 3180465 - RNA, 18 nt, Human
cucagagagggugggagu

SEQ ID NO: 3180466 - RNA, 23 nt, Human
cucacugcuaagaauauuugaau

SEQ ID NO: 3180467 - RNA, 22 nt, Human
cucacugcuaagaauauuugaa

SEQ ID NO: 3180468 - RNA, 21 nt, Human
cucacugcuaagaauauuuga

SEQ ID NO: 3180469 - RNA, 20 nt, Human
cucacugcuaagaauauuug

SEQ ID NO: 3180470 - RNA, 14 nt, Human
cucacugcagccuc

SEQ ID NO: 3180471 - RNA, 20 nt, Human
cucacugcauccuccgccuc

SEQ ID NO: 3180472 - RNA, 13 nt, Human
cucacugccuccc

SEQ ID NO: 3180473 - RNA, 14 nt, Human
cucacugccucccc

SEQ ID NO: 3180474 - RNA, 16 nt, Human
cucacugcagccucaa

SEQ ID NO: 3180475 - RNA, 15 nt, Human
cucacugcagccuca

SEQ ID NO: 3180476 - RNA, 23 nt, Human
cucacagacaggaccccugcagu

SEQ ID NO: 3180477 - RNA, 22 nt, Human
cucacagacaggaccccugcag

SEQ ID NO: 3180478 - RNA, 20 nt, Human
cucacagacaggaccccugc

SEQ ID NO: 3180479 - RNA, 20 nt, Human
cucacuguggugucuguguu

SEQ ID NO: 3180480 - RNA, 15 nt, Human
cucacuguugcccag

SEQ ID NO: 3180481 - RNA, 14 nt, Human
cucacuguugccca

SEQ ID NO: 3180482 - RNA, 15 nt, Human
cuacugggagccuac

SEQ ID NO: 3180483 - RNA, 14 nt, Human
cuacugggagccua

SEQ ID NO: 3180484 - RNA, 21 nt, Human
cuacuggcagcugauacguuu

SEQ ID NO: 3180485 - RNA, 14 nt, Human
cuacuggauucuua

SEQ ID NO: 3180486 - RNA, 15 nt, Human
cuacuggauucuuau

SEQ ID NO: 3180487 - RNA, 16 nt, Human
cuacuggauucuuauu

SEQ ID NO: 3180488 - RNA, 16 nt, Human
cuacugcauuuaggga

SEQ ID NO: 3180489 - RNA, 17 nt, Human
cuacugcauuuagggag

SEQ ID NO: 3180490 - RNA, 19 nt, Human
cuacugcauuuagggagua

SEQ ID NO: 3180491 - RNA, 23 nt, Human
cuacugccaaccucgcuccaacu

SEQ ID NO: 3180492 - RNA, 22 nt, Human
cuacugccaaccucgcuccaac

SEQ ID NO: 3180493 - RNA, 19 nt, Human
cuacugccaaccucgcucc

SEQ ID NO: 3180494 - RNA, 14 nt, Human
cuacugccaaccuc

SEQ ID NO: 3180495 - RNA, 18 nt, Human
cuacugggagccuaccca

SEQ ID NO: 3180496 - RNA, 19 nt, Human
cuacugguccucuuaacug

SEQ ID NO: 3180497 - RNA, 17 nt, Human
cuacuggguguagacug

SEQ ID NO: 3180498 - RNA, 19 nt, Human
cuacuguccuacccacccu

SEQ ID NO: 3180499 - RNA, 22 nt, Human
cuacucuggagguuuguuuaga

SEQ ID NO: 3180500 - RNA, 22 nt, Human
cuacucuagagaaguggacugg

SEQ ID NO: 3180501 - RNA, 22 nt, Human
cuacuccugucuucugcuuugu

SEQ ID NO: 3180502 - RNA, 21 nt, Human
cuacuccugucuucugcuuug

SEQ ID NO: 3180503 - RNA, 20 nt, Human
cuacuccugucuucugcuuu

SEQ ID NO: 3180504 - RNA, 19 nt, Human
cuacuccugucuucugcuu

SEQ ID NO: 3180505 - RNA, 12 nt, Human
cuacucuguguc

SEQ ID NO: 3180506 - RNA, 14 nt, Human
cuacugaggugcua

SEQ ID NO: 3180507 - RNA, 14 nt, Human
cuaccuaacccaga

SEQ ID NO: 3180508 - RNA, 19 nt, Human
cuaccgagucucuucucca

SEQ ID NO: 3180509 - RNA, 17 nt, Human
cuaccgagucucuucuc

SEQ ID NO: 3180510 - RNA, 22 nt, Human
cuaccgagucucuucuccacug

SEQ ID NO: 3180511 - RNA, 21 nt, Human
cuaccgagucucuucuccacu

SEQ ID NO: 3180512 - RNA, 23 nt, Human
cuaccgagucucuucuccacugg

SEQ ID NO: 3180513 - RNA, 16 nt, Human
cuacucgaguuacaga

SEQ ID NO: 3180514 - RNA, 19 nt, Human
cuacucgaguuacagacaa

SEQ ID NO: 3180515 - RNA, 15 nt, Human
cuacucgaguuacag

SEQ ID NO: 3180516 - RNA, 17 nt, Human
cuacuccugucuucugc

SEQ ID NO: 3180517 - RNA, 16 nt, Human
cuacuccugucuucug

SEQ ID NO: 3180518 - RNA, 14 nt, Human
cuacuccugucuuc

SEQ ID NO: 3180519 - RNA, 13 nt, Human
cuacuccugucuu

SEQ ID NO: 3180520 - RNA, 16 nt, Human
cuacucauuuuaauga

SEQ ID NO: 3180521 - RNA, 12 nt, Human
cuacucauuuua

SEQ ID NO: 3180522 - RNA, 16 nt, Human
cuagaguagagguaua

SEQ ID NO: 3180523 - RNA, 20 nt, Human
cuagaguagagguauaauug

SEQ ID NO: 3180524 - RNA, 23 nt, Human
cuagaggccuuuaguuauaaagg

SEQ ID NO: 3180525 - RNA, 15 nt, Human
cuagagauauuuugu

SEQ ID NO: 3180526 - RNA, 17 nt, Human
cuagagauauuuuguaa

SEQ ID NO: 3180527 - RNA, 18 nt, Human
cuagagauauuuuguaaa

SEQ ID NO: 3180528 - RNA, 19 nt, Human
cuagagauauuuuguaaaa

SEQ ID NO: 3180529 - RNA, 20 nt, Human
cuagagagugugauguucac

SEQ ID NO: 3180530 - RNA, 21 nt, Human
cuagagaaguggacuggagga

SEQ ID NO: 3180531 - RNA, 23 nt, Human
cuagagaaguggacuggaggagc

SEQ ID NO: 3180532 - RNA, 22 nt, Human
cuagagaaguggacuggaggag

SEQ ID NO: 3180533 - RNA, 22 nt, Human
cuagaggccugaaauccugguu

SEQ ID NO: 3180534 - RNA, 18 nt, Human
cuagacugccacaaggaa

SEQ ID NO: 3180535 - RNA, 16 nt, Human
cuagagaaauucuugu

SEQ ID NO: 3180536 - RNA, 18 nt, Human
cuagagaaauucuuguua

SEQ ID NO: 3180537 - RNA, 18 nt, Human
cuagacucccaagcugga

SEQ ID NO: 3180538 - RNA, 20 nt, Human
cuacuguccuacccacccuc

SEQ ID NO: 3180539 - RNA, 23 nt, Human
cuacuguucagcuuuuauuccug

SEQ ID NO: 3180540 - RNA, 18 nt, Human
cuacuguuuaagugaauu

SEQ ID NO: 3180541 - RNA, 15 nt, Human
cuacuuuuuaacaga

SEQ ID NO: 3180542 - RNA, 16 nt, Human
cuacuuagcacuucag

SEQ ID NO: 3180543 - RNA, 17 nt, Human
cuacuuagcaugucccu

SEQ ID NO: 3180544 - RNA, 19 nt, Human
cuacuuagcacuucagggc

SEQ ID NO: 3180545 - RNA, 22 nt, Human
cuagcguagugcagcagggcag

SEQ ID NO: 3180546 - RNA, 20 nt, Human
cuagcguagugcagcagggc

SEQ ID NO: 3180547 - RNA, 19 nt, Human
cuagcguagugcagcaggg

SEQ ID NO: 3180548 - RNA, 16 nt, Human
cuagcguagugcagca

SEQ ID NO: 3180549 - RNA, 23 nt, Human
cuagccuuagaagucacacagua

SEQ ID NO: 3180550 - RNA, 22 nt, Human
cuagccuuagaagucacacagu

SEQ ID NO: 3180551 - RNA, 19 nt, Human
cuagccugugccucuggga

SEQ ID NO: 3180552 - RNA, 21 nt, Human
cuagccugugccucugggacu

SEQ ID NO: 3180553 - RNA, 22 nt, Human
cuagccugugccucugggacug

SEQ ID NO: 3180554 - RNA, 21 nt, Human
cuagccuuagaagucacacag

SEQ ID NO: 3180555 - RNA, 14 nt, Human
cuagcuuuuuaauu

SEQ ID NO: 3180556 - RNA, 11 nt, Human
cuaggaaaaaa

SEQ ID NO: 3180557 - RNA, 19 nt, Human
cuaggaaaagaaaucuaua

SEQ ID NO: 3180558 - RNA, 14 nt, Human
cuaggaaaagaaau

SEQ ID NO: 3180559 - RNA, 21 nt, Human
cuagcuggagaggagcccugc

SEQ ID NO: 3180560 - RNA, 19 nt, Human
cuagcuggagaggagcccu

SEQ ID NO: 3180561 - RNA, 18 nt, Human
cuagcuggagaggagccc

SEQ ID NO: 3180562 - RNA, 13 nt, Human
cuagcuggagagg

SEQ ID NO: 3180563 - RNA, 23 nt, Human
cuagcuggagaggagcccugccu

SEQ ID NO: 3180564 - RNA, 22 nt, Human
cuagcuggagaggagcccugcc

SEQ ID NO: 3180565 - RNA, 18 nt, Human
cuagcuaugcuguaucug

SEQ ID NO: 3180566 - RNA, 19 nt, Human
cuagcuaugcuguaucugu

SEQ ID NO: 3180567 - RNA, 21 nt, Human
cuagcuaugcuguaucugugc

SEQ ID NO: 3180568 - RNA, 10 nt, Human
cuagcugaau

SEQ ID NO: 3180569 - RNA, 13 nt, Human
cucacacucaccc

SEQ ID NO: 3180570 - RNA, 22 nt, Human
cucaaguccccgucugccuggc

SEQ ID NO: 3180571 - RNA, 23 nt, Human
cucacacggacacucaaaagcug

SEQ ID NO: 3180572 - RNA, 17 nt, Human
cucacagaacccuugga

SEQ ID NO: 3180573 - RNA, 12 nt, Human
cucacagacagg

SEQ ID NO: 3180574 - RNA, 18 nt, Human
cucacagacaggaccccu

SEQ ID NO: 3180575 - RNA, 16 nt, Human
cucacagacaggaccc

SEQ ID NO: 3180576 - RNA, 15 nt, Human
cucacagacaggacc

SEQ ID NO: 3180577 - RNA, 13 nt, Human
cucacagacagga

SEQ ID NO: 3180578 - RNA, 14 nt, Human
cucacacuccuuua

SEQ ID NO: 3180579 - RNA, 16 nt, Human
cucaacucuccuccag

SEQ ID NO: 3180580 - RNA, 18 nt, Human
cucaacucuccuccagag

SEQ ID NO: 3180581 - RNA, 16 nt, Human
cucaagcccaggaggg

SEQ ID NO: 3180582 - RNA, 15 nt, Human
cucaagcccaggagg

SEQ ID NO: 3180583 - RNA, 19 nt, Human
cucaagccagacucugcca

SEQ ID NO: 3180584 - RNA, 21 nt, Human
cucaagccaccagaugugaca

SEQ ID NO: 3180585 - RNA, 13 nt, Human
cucaagccaccag

SEQ ID NO: 3180586 - RNA, 18 nt, Human
cuauuucaacuucaggaa

SEQ ID NO: 3180587 - RNA, 11 nt, Human
cuauuucuuga

SEQ ID NO: 3180588 - RNA, 22 nt, Human
cucaacaugucuccuacugagg

SEQ ID NO: 3180589 - RNA, 14 nt, Human
cucaacucuccucc

SEQ ID NO: 3180590 - RNA, 20 nt, Human
cucaaccaaaugguacaaaa

SEQ ID NO: 3180591 - RNA, 14 nt, Human
cucaaccaaauggu

SEQ ID NO: 3180592 - RNA, 18 nt, Human
cuauuguuagucucuuga

SEQ ID NO: 3180593 - RNA, 11 nt, Human
cuauugguaaa

SEQ ID NO: 3180594 - RNA, 22 nt, Human
cuauuuaugugauccuuuugga

SEQ ID NO: 3180595 - RNA, 13 nt, Human
cuauuuaaagaaa

SEQ ID NO: 3180596 - RNA, 21 nt, Human
cuauuuaaagaaauauguauu

SEQ ID NO: 3180597 - RNA, 16 nt, Human
cuauugcugcuugagg

SEQ ID NO: 3180598 - RNA, 19 nt, Human
cuauuggggaacucauugu

SEQ ID NO: 3180599 - RNA, 19 nt, Human
cuauggggauagaugugug

SEQ ID NO: 3180600 - RNA, 20 nt, Human
cuauggggauagaugugugg

SEQ ID NO: 3180601 - RNA, 21 nt, Human
cuauggggauagaugugugga

SEQ ID NO: 3180602 - RNA, 18 nt, Human
cuauguagugccgcucuu

SEQ ID NO: 3180603 - RNA, 17 nt, Human
cuauucaguaauaacuc

SEQ ID NO: 3180604 - RNA, 13 nt, Human
cuauguaucaaug

SEQ ID NO: 3180605 - RNA, 18 nt, Human
cuauuaguguuauaugaa

SEQ ID NO: 3180606 - RNA, 19 nt, Human
cuauuaguguuauaugaac

SEQ ID NO: 3180607 - RNA, 17 nt, Human
cuauuaguguuauauga

SEQ ID NO: 3180608 - RNA, 23 nt, Human
cuauucaguaauaacucuacccu

SEQ ID NO: 3180609 - RNA, 16 nt, Human
cuauugagucuucaug

SEQ ID NO: 3180610 - RNA, 17 nt, Human
cuauugagucuucaugu

SEQ ID NO: 3180611 - RNA, 20 nt, Human
cuaugaagagcuagagaaau

SEQ ID NO: 3180612 - RNA, 20 nt, Human
cuaugauguuaguuuuccuu

SEQ ID NO: 3180613 - RNA, 14 nt, Human
cuaugcaaaaagcu

SEQ ID NO: 3180614 - RNA, 19 nt, Human
cuaugauuuggaaaauaaa

SEQ ID NO: 3180615 - RNA, 15 nt, Human
cuaugauuuggaaaa

SEQ ID NO: 3180616 - RNA, 20 nt, Human
cuaugauuuaauuugaaaua

SEQ ID NO: 3180617 - RNA, 19 nt, Human
cuaugauuuaauuugaaau

SEQ ID NO: 3180618 - RNA, 22 nt, Human
cuauauacaucacguuaaagua

SEQ ID NO: 3180619 - RNA, 22 nt, Human
cuauagcuguucuaauggauua

SEQ ID NO: 3180620 - RNA, 12 nt, Human
cuauauaaaaua

SEQ ID NO: 3180621 - RNA, 14 nt, Human
cuauauaaaauaac

SEQ ID NO: 3180622 - RNA, 17 nt, Human
cuauauaaaauaacuaa

SEQ ID NO: 3180623 - RNA, 22 nt, Human
cuauauaaaauaacuaaaaugu

SEQ ID NO: 3180624 - RNA, 13 nt, Human
cuauaguuacugu

SEQ ID NO: 3180625 - RNA, 16 nt, Human
cuauaguuacuguccu

SEQ ID NO: 3180626 - RNA, 18 nt, Human
cuauaguuacuguccugu

SEQ ID NO: 3180627 - RNA, 18 nt, Human
cuauaauuauuauucaga

SEQ ID NO: 3180628 - RNA, 14 nt, Human
cuauaaugugaaau

SEQ ID NO: 3180629 - RNA, 17 nt, Human
cuauaaugugaaaugua

SEQ ID NO: 3180630 - RNA, 21 nt, Human
cuauaaugugaaauguaacug

SEQ ID NO: 3180631 - RNA, 22 nt, Human
cuauaaugugaaauguaacugu

SEQ ID NO: 3180632 - RNA, 20 nt, Human
cuaggaacacuccuucacag

SEQ ID NO: 3180633 - RNA, 15 nt, Human
cuaggaagacuuugg

SEQ ID NO: 3180634 - RNA, 17 nt, Human
cuaggaagacuuuggaa

SEQ ID NO: 3180635 - RNA, 21 nt, Human
cuauagccuaggugacagagu

SEQ ID NO: 3180636 - RNA, 20 nt, Human
cuauagccuaggugacagag

SEQ ID NO: 3180637 - RNA, 18 nt, Human
cuauagccuaggugacag

SEQ ID NO: 3180638 - RNA, 19 nt, Human
cuauagccuaggugacaga

SEQ ID NO: 3180639 - RNA, 21 nt, Human
cuauaccauuuccguaauucu

SEQ ID NO: 3180640 - RNA, 22 nt, Human
cuaagcuauucaguaauaacuc

SEQ ID NO: 3180641 - RNA, 18 nt, Human
cuaagauguguucuuauu

SEQ ID NO: 3180642 - RNA, 20 nt, Human
cuaagauguguucuuauuuu

SEQ ID NO: 3180643 - RNA, 20 nt, Human
cuaagauguuauauuuuucu

SEQ ID NO: 3180644 - RNA, 19 nt, Human
cuaagauguuauauuuuuc

SEQ ID NO: 3180645 - RNA, 14 nt, Human
cuaagauguuauau

SEQ ID NO: 3180646 - RNA, 13 nt, Human
cuaagauguuaua

SEQ ID NO: 3180647 - RNA, 21 nt, Human
cuaaggacaagguaaggaggg

SEQ ID NO: 3180648 - RNA, 18 nt, Human
cuaauaaucauuggauuc

SEQ ID NO: 3180649 - RNA, 17 nt, Human
cuaauaagcuaguugaa

SEQ ID NO: 3180650 - RNA, 22 nt, Human
cuaauaagcuaguugaauacuu

SEQ ID NO: 3180651 - RNA, 21 nt, Human
cuaauacagccccuuuucccu

SEQ ID NO: 3180652 - RNA, 17 nt, Human
cuaauaacaugugaaaa

SEQ ID NO: 3180653 - RNA, 19 nt, Human
cuaaguaaaaccacagcag

SEQ ID NO: 3180654 - RNA, 18 nt, Human
cuaaguaaaaccacagca

SEQ ID NO: 3180655 - RNA, 14 nt, Human
cuaaguaaaaccac

SEQ ID NO: 3180656 - RNA, 19 nt, Human
cuaauagcuacaucuacuu

SEQ ID NO: 3180657 - RNA, 16 nt, Human
cuaauauccacuuguc

SEQ ID NO: 3180658 - RNA, 23 nt, Human
cuacacgguucaaaccugugaag

SEQ ID NO: 3180659 - RNA, 14 nt, Human
cuaauuccacagcu

SEQ ID NO: 3180660 - RNA, 15 nt, Human
cuaauuccacagcug

SEQ ID NO: 3180661 - RNA, 16 nt, Human
cuaauuccacagcugc

SEQ ID NO: 3180662 - RNA, 21 nt, Human
cuacacaggggaaaagaggag

SEQ ID NO: 3180663 - RNA, 13 nt, Human
cuacacaggacag

SEQ ID NO: 3180664 - RNA, 21 nt, Human
cuacacauauaaauugucuua

SEQ ID NO: 3180665 - RNA, 22 nt, Human
cuacacaggacagggguuccuu

SEQ ID NO: 3180666 - RNA, 15 nt, Human
cuacacaggacaggg

SEQ ID NO: 3180667 - RNA, 22 nt, Human
cuaauuauacccccugcaaagc

SEQ ID NO: 3180668 - RNA, 17 nt, Human
cuaauuaauuucaguaa

SEQ ID NO: 3180669 - RNA, 15 nt, Human
cuaauuaauuucagu

SEQ ID NO: 3180670 - RNA, 14 nt, Human
cuaauuaauuucag

SEQ ID NO: 3180671 - RNA, 13 nt, Human
cuaaugggacacu

SEQ ID NO: 3180672 - RNA, 12 nt, Human
cuaaugggacac

SEQ ID NO: 3180673 - RNA, 22 nt, Human
cuaaugcgcaggcuggcccugc

SEQ ID NO: 3180674 - RNA, 23 nt, Human
cuaaugcgcaggcuggcccugcc

SEQ ID NO: 3180675 - RNA, 21 nt, Human
cuaauggauuauaaucagaau

SEQ ID NO: 3180676 - RNA, 22 nt, Human
cuaauauccacuuguccaugug

SEQ ID NO: 3180677 - RNA, 21 nt, Human
cuaaucagcauucucacuccu

SEQ ID NO: 3180678 - RNA, 20 nt, Human
cuaaucagcauucucacucc

SEQ ID NO: 3180679 - RNA, 15 nt, Human
cuaaugcgcaggcug

SEQ ID NO: 3180680 - RNA, 16 nt, Human
cuaaugcgcaggcugg

SEQ ID NO: 3180681 - RNA, 19 nt, Human
cuaaugcgcaggcuggccc

SEQ ID NO: 3180682 - RNA, 20 nt, Human
cuaaugcgcaggcuggcccu

SEQ ID NO: 3180683 - RNA, 15 nt, Human
cgggacguggcaccu

SEQ ID NO: 3180684 - RNA, 21 nt, Human
cgggaggauguucugggacac

SEQ ID NO: 3180685 - RNA, 23 nt, Human
cgggaggauguucugggacacag

SEQ ID NO: 3180686 - RNA, 20 nt, Human
cguuuguuccccaagacauu

SEQ ID NO: 3180687 - RNA, 19 nt, Human
cguuugauuugucacugcu

SEQ ID NO: 3180688 - RNA, 20 nt, Human
cgggaggcagagguugcagu

SEQ ID NO: 3180689 - RNA, 18 nt, Human
cuaaaauaauuuuguaau

SEQ ID NO: 3180690 - RNA, 17 nt, Human
cuaaaauaauuuuguaa

SEQ ID NO: 3180691 - RNA, 15 nt, Human
cuaaaauaauuuugu

SEQ ID NO: 3180692 - RNA, 14 nt, Human
cuaaaauaagaaua

SEQ ID NO: 3180693 - RNA, 14 nt, Human
cuaaaaauaaagca

SEQ ID NO: 3180694 - RNA, 13 nt, Human
cuaaaaauaaagc

SEQ ID NO: 3180695 - RNA, 23 nt, Human
cuaaaaauaacuguaauuauuug

SEQ ID NO: 3180696 - RNA, 22 nt, Human
cuaaaaauaacuguaauuauuu

SEQ ID NO: 3180697 - RNA, 17 nt, Human
cuaaaaauaacuguaau

SEQ ID NO: 3180698 - RNA, 15 nt, Human
cuaaaaauaaagcac

SEQ ID NO: 3180699 - RNA, 13 nt, Human
cguuuuaaggacu

SEQ ID NO: 3180700 - RNA, 16 nt, Human
cguuuuaaggacugac

SEQ ID NO: 3180701 - RNA, 23 nt, Human
cguuuuaaggacugacugaggca

SEQ ID NO: 3180702 - RNA, 20 nt, Human
cuaaaaaagcugaaucagac

SEQ ID NO: 3180703 - RNA, 18 nt, Human
cuaaaaagucagauguuu

SEQ ID NO: 3180704 - RNA, 13 nt, Human
cuaaaauguaucu

SEQ ID NO: 3180705 - RNA, 17 nt, Human
cuaaacuaggcuccuuc

SEQ ID NO: 3180706 - RNA, 16 nt, Human
cuaaacuaguuuuucc

SEQ ID NO: 3180707 - RNA, 15 nt, Human
cuaaacuaggcuccu

SEQ ID NO: 3180708 - RNA, 12 nt, Human
cuaaacugcccc

SEQ ID NO: 3180709 - RNA, 13 nt, Human
cuaaacugccccc

SEQ ID NO: 3180710 - RNA, 16 nt, Human
cuaaacucugaauaag

SEQ ID NO: 3180711 - RNA, 22 nt, Human
cuaaaauauuuaugaagaaaau

SEQ ID NO: 3180712 - RNA, 21 nt, Human
cuaaaauauuuaugaagaaaa

SEQ ID NO: 3180713 - RNA, 20 nt, Human
cuaaaauauuuaugaagaaa

SEQ ID NO: 3180714 - RNA, 16 nt, Human
cuaaaauauuuaugaa

SEQ ID NO: 3180715 - RNA, 15 nt, Human
cuaaaauauuuauga

SEQ ID NO: 3180716 - RNA, 10 nt, Human
cuaaaauauu

SEQ ID NO: 3180717 - RNA, 22 nt, Human
cuaaaauaucuggguggcuuaa

SEQ ID NO: 3180718 - RNA, 22 nt, Human
cuaaaugaaaaucgugacaaca

SEQ ID NO: 3180719 - RNA, 21 nt, Human
cuaaacugcccccucugcccu

SEQ ID NO: 3180720 - RNA, 18 nt, Human
cuaaauaaguuauaaaga

SEQ ID NO: 3180721 - RNA, 23 nt, Human
cuaacaaacagauucuuuuaugu

SEQ ID NO: 3180722 - RNA, 20 nt, Human
cuaacaacauuguagccuca

SEQ ID NO: 3180723 - RNA, 14 nt, Human
cuaaauuuuaaagc

SEQ ID NO: 3180724 - RNA, 16 nt, Human
cuaaauuuuaaagcca

SEQ ID NO: 3180725 - RNA, 17 nt, Human
cuaaauuuuaaagccau

SEQ ID NO: 3180726 - RNA, 19 nt, Human
cuaaauugacacuuaaaaa

SEQ ID NO: 3180727 - RNA, 16 nt, Human
cuaaauucaugcugcu

SEQ ID NO: 3180728 - RNA, 21 nt, Human
cuaacagcaguuucagguaga

SEQ ID NO: 3180729 - RNA, 15 nt, Human
cuaaccacagcuccu

SEQ ID NO: 3180730 - RNA, 14 nt, Human
cuaaccacgcugga

SEQ ID NO: 3180731 - RNA, 12 nt, Human
cuaaccacgcug

SEQ ID NO: 3180732 - RNA, 23 nt, Human
cuaagagggagggagggcuccag

SEQ ID NO: 3180733 - RNA, 21 nt, Human
cuaagaucgguuaacaaauaa

SEQ ID NO: 3180734 - RNA, 20 nt, Human
cuaagaucgguuaacaaaua

SEQ ID NO: 3180735 - RNA, 18 nt, Human
cuaagauauacuuguuuu

SEQ ID NO: 3180736 - RNA, 18 nt, Human
cuaagaucgguuaacaaa

SEQ ID NO: 3180737 - RNA, 17 nt, Human
cuaagaucgguuaacaa

SEQ ID NO: 3180738 - RNA, 23 nt, Human
cuaagauauacuuguuuuuguaa

SEQ ID NO: 3180739 - RNA, 22 nt, Human
cuaagauauacuuguuuuugua

SEQ ID NO: 3180740 - RNA, 15 nt, Human
cuaagagggagggag

SEQ ID NO: 3180741 - RNA, 22 nt, Human
cuaagagggagggagggcucca

SEQ ID NO: 3180742 - RNA, 13 nt, Human
cuaagagggaggg

SEQ ID NO: 3180743 - RNA, 18 nt, Human
cuaagaggaaaguacauu

SEQ ID NO: 3180744 - RNA, 12 nt, Human
cuaaccagggcc

SEQ ID NO: 3180745 - RNA, 22 nt, Human
cuacauuauaaaugucucuuua

SEQ ID NO: 3180746 - RNA, 17 nt, Human
cuacaugcuuugugaac

SEQ ID NO: 3180747 - RNA, 22 nt, Human
cuacauggggucuggguggggg

SEQ ID NO: 3180748 - RNA, 19 nt, Human
cuacaugcuuguugacaga

SEQ ID NO: 3180749 - RNA, 14 nt, Human
cuacauuuccgcca

SEQ ID NO: 3180750 - RNA, 18 nt, Human
cuaccauccccuguagag

SEQ ID NO: 3180751 - RNA, 21 nt, Human
cuaccacggccuccuuuccgu

SEQ ID NO: 3180752 - RNA, 19 nt, Human
cuaccacggccuccuuucc

SEQ ID NO: 3180753 - RNA, 18 nt, Human
cuaccacggccuccuuuc

SEQ ID NO: 3180754 - RNA, 23 nt, Human
cuaccaacuuucaagaacuuguu

SEQ ID NO: 3180755 - RNA, 15 nt, Human
cuaccaaaggacacu

SEQ ID NO: 3180756 - RNA, 16 nt, Human
cuaccaacuuuacugu

SEQ ID NO: 3180757 - RNA, 14 nt, Human
cuaccaacuuucaa

SEQ ID NO: 3180758 - RNA, 13 nt, Human
cuaccaacuuuca

SEQ ID NO: 3180759 - RNA, 17 nt, Human
cuacccagcgagcccug

SEQ ID NO: 3180760 - RNA, 15 nt, Human
cuacccagcgagccc

SEQ ID NO: 3180761 - RNA, 12 nt, Human
cuacccaggugc

SEQ ID NO: 3180762 - RNA, 13 nt, Human
cuacccaggugcu

SEQ ID NO: 3180763 - RNA, 18 nt, Human
cuacccagcgagcccugg

SEQ ID NO: 3180764 - RNA, 17 nt, Human
cuacccucuuagaaaaa

SEQ ID NO: 3180765 - RNA, 13 nt, Human
cuacacugugcug

SEQ ID NO: 3180766 - RNA, 14 nt, Human
cuacacugugcuga

SEQ ID NO: 3180767 - RNA, 17 nt, Human
cuacacugugcugaguc

SEQ ID NO: 3180768 - RNA, 17 nt, Human
cuacagaggccaugggc

SEQ ID NO: 3180769 - RNA, 20 nt, Human
cuacagaggccaugggccuc

SEQ ID NO: 3180770 - RNA, 18 nt, Human
cuacagaggccaugggcc

SEQ ID NO: 3180771 - RNA, 22 nt, Human
cuacagaggccaugggccuccu

SEQ ID NO: 3180772 - RNA, 19 nt, Human
cuacagcuugaccgugagg

SEQ ID NO: 3180773 - RNA, 22 nt, Human
cuacagcuugaccgugaggcca

SEQ ID NO: 3180774 - RNA, 23 nt, Human
cuacagcuugaccgugaggccag

SEQ ID NO: 3180775 - RNA, 19 nt, Human
cuacagcuaaucagcauuc

SEQ ID NO: 3180776 - RNA, 18 nt, Human
cuacagcuaaucagcauu

SEQ ID NO: 3180777 - RNA, 19 nt, Human
cuacagcucccccagcucc

SEQ ID NO: 3180778 - RNA, 14 nt, Human
cuacagcuccccca

SEQ ID NO: 3180779 - RNA, 22 nt, Human
cuacagcuaaucagcauucuca

SEQ ID NO: 3180780 - RNA, 21 nt, Human
cuacagcuaaucagcauucuc

SEQ ID NO: 3180781 - RNA, 16 nt, Human
cuacaggagugagcac

SEQ ID NO: 3180782 - RNA, 15 nt, Human
cuacaggagugagca

SEQ ID NO: 3180783 - RNA, 14 nt, Human
cuacaggagugagc

SEQ ID NO: 3180784 - RNA, 17 nt, Human
cuacaggcacccaccau

SEQ ID NO: 3180785 - RNA, 15 nt, Human
cuacaggcacccacc

SEQ ID NO: 3180786 - RNA, 11 nt, Human
cuacagggccg

SEQ ID NO: 3180787 - RNA, 20 nt, Human
cuacauggaguauaugucaa

SEQ ID NO: 3180788 - RNA, 18 nt, Human
cuacauggaguauauguc

SEQ ID NO: 3180789 - RNA, 13 nt, Human
cuacaguccuccc

SEQ ID NO: 3180790 - RNA, 14 nt, Human
cuacaggugugagu

SEQ ID NO: 3180791 - RNA, 16 nt, Human
cuacaggugugaguca

SEQ ID NO: 3180792 - RNA, 18 nt, Human
cuacagucaagauagaaa

SEQ ID NO: 3180793 - RNA, 11 nt, Human
aaaaacagcuu

SEQ ID NO: 3180794 - RNA, 14 nt, Human
aaaaacacaaaagu

SEQ ID NO: 3180795 - RNA, 12 nt, Human
aaaaaauuuguc

SEQ ID NO: 3180796 - RNA, 11 nt, Human
aaaaacaaaag

SEQ ID NO: 3180797 - RNA, 15 nt, Human
aaaaacaaauaauau

SEQ ID NO: 3180798 - RNA, 12 nt, Human
aaaaacaaagag

SEQ ID NO: 3180799 - RNA, 13 nt, Human
aaaaacugaaguu

SEQ ID NO: 3180800 - RNA, 15 nt, Human
aaaaacugauuuuuu

SEQ ID NO: 3180801 - RNA, 22 nt, Human
aaaaacuucauguaauuuuauu

SEQ ID NO: 3180802 - RNA, 23 nt, Human
aaaaacuucauguaauuuuauuu

SEQ ID NO: 3180803 - RNA, 18 nt, Human
aaaaacuuucuacucauu

SEQ ID NO: 3180804 - RNA, 19 nt, Human
aaaaacuuucuacucauuu

SEQ ID NO: 3180805 - RNA, 19 nt, Human
aaaaacauucuaucuacug

SEQ ID NO: 3180806 - RNA, 23 nt, Human
aaaaacauucuaucuacugauuu

SEQ ID NO: 3180807 - RNA, 13 nt, Human
aaaaacugauuuu

SEQ ID NO: 3180808 - RNA, 12 nt, Human
aaaaagaggcua

SEQ ID NO: 3180809 - RNA, 19 nt, Human
aaaaauucaauaguaauau

SEQ ID NO: 3180810 - RNA, 18 nt, Human
aaaaauucaauaguaaua

SEQ ID NO: 3180811 - RNA, 17 nt, Human
aaaaauucaauaguaau

SEQ ID NO: 3180812 - RNA, 15 nt, Human
aaaaauucaauagua

SEQ ID NO: 3180813 - RNA, 17 nt, Human
aaaaagauaccuuaaaa

SEQ ID NO: 3180814 - RNA, 16 nt, Human
aaaacaaauaauaucu

SEQ ID NO: 3180815 - RNA, 13 nt, Human
aaaacaaauaaua

SEQ ID NO: 3180816 - RNA, 13 nt, Human
aaaacaaaaccaa

SEQ ID NO: 3180817 - RNA, 13 nt, Human
aaaacaaaaggca

SEQ ID NO: 3180818 - RNA, 15 nt, Human
aaaacaaaaagaugu

SEQ ID NO: 3180819 - RNA, 11 nt, Human
aaaacaaaaag

SEQ ID NO: 3180820 - RNA, 21 nt, Human
aaaaauuuacuacaauaugua

SEQ ID NO: 3180821 - RNA, 11 nt, Human
aaaaauuuaaa

SEQ ID NO: 3180822 - RNA, 15 nt, Human
aaaaauuuaaaagua

SEQ ID NO: 3180823 - RNA, 11 nt, Human
aaaaauuucac

SEQ ID NO: 3180824 - RNA, 13 nt, Human
aaaaauuucacga

SEQ ID NO: 3180825 - RNA, 23 nt, Human
aaaaauuugucugaaacauuuca

SEQ ID NO: 3180826 - RNA, 16 nt, Human
aaaaauuuguuuaaag

SEQ ID NO: 3180827 - RNA, 14 nt, Human
aaaaauuuguuuaa

SEQ ID NO: 3180828 - RNA, 10 nt, Human
aaaacaaaaa

SEQ ID NO: 3180829 - RNA, 17 nt, Human
aaaacaauaggaugggc

SEQ ID NO: 3180830 - RNA, 18 nt, Human
aaaacaauaggaugggcu

SEQ ID NO: 3180831 - RNA, 19 nt, Human
aaaacaaugguaacauuuu

SEQ ID NO: 3180832 - RNA, 13 nt, Human
aaaacacagcaag

SEQ ID NO: 3180833 - RNA, 12 nt, Human
aaaacacagcaa

SEQ ID NO: 3180834 - RNA, 18 nt, Human
aaaacacagcaaggguga

SEQ ID NO: 3180835 - RNA, 23 nt, Human
auguuugagcaguggccuacaaa

SEQ ID NO: 3180836 - RNA, 14 nt, Human
auguucuuccaguu

SEQ ID NO: 3180837 - RNA, 21 nt, Human
auguuucuuugaucaugaaua

SEQ ID NO: 3180838 - RNA, 13 nt, Human
auguuucuuugau

SEQ ID NO: 3180839 - RNA, 13 nt, Human
auguucuuccagu

SEQ ID NO: 3180840 - RNA, 11 nt, Human
auguucuucca

SEQ ID NO: 3180841 - RNA, 22 nt, Human
auguucugacccugcuucaaau

SEQ ID NO: 3180842 - RNA, 20 nt, Human
auguucuuaguggauguucu

SEQ ID NO: 3180843 - RNA, 17 nt, Human
auguucucugaggacac

SEQ ID NO: 3180844 - RNA, 12 nt, Human
augugucuuuau

SEQ ID NO: 3180845 - RNA, 14 nt, Human
augugucuuucuaa

SEQ ID NO: 3180846 - RNA, 19 nt, Human
augugucuuucuaagaaau

SEQ ID NO: 3180847 - RNA, 19 nt, Human
augugucugccacauuaac

SEQ ID NO: 3180848 - RNA, 18 nt, Human
auguucucugaggacacu

SEQ ID NO: 3180849 - RNA, 15 nt, Human
auguguccauuuccu

SEQ ID NO: 3180850 - RNA, 19 nt, Human
auguguaugugaguauucu

SEQ ID NO: 3180851 - RNA, 12 nt, Human
auguguauguga

SEQ ID NO: 3180852 - RNA, 12 nt, Human
auguguaauuuu

SEQ ID NO: 3180853 - RNA, 18 nt, Human
auguguaauuuuucugua

SEQ ID NO: 3180854 - RNA, 15 nt, Human
auguguaauuuuucu

SEQ ID NO: 3180855 - RNA, 20 nt, Human
auguguaauuuuucuguaua

SEQ ID NO: 3180856 - RNA, 19 nt, Human
auguguaauuuuucuguau

SEQ ID NO: 3180857 - RNA, 22 nt, Human
auguguaauuuuucuguauaga

SEQ ID NO: 3180858 - RNA, 18 nt, Human
auguuuuaagaggcaggg

SEQ ID NO: 3180859 - RNA, 16 nt, Human
auguuuuaagaggcag

SEQ ID NO: 3180860 - RNA, 15 nt, Human
auuaaaguuucaaaa

SEQ ID NO: 3180861 - RNA, 14 nt, Human
auuaaaguuucaaa

SEQ ID NO: 3180862 - RNA, 13 nt, Human
auuaaaguuucaa

SEQ ID NO: 3180863 - RNA, 12 nt, Human
auuaaaguuuca

SEQ ID NO: 3180864 - RNA, 14 nt, Human
auuaaaugcccagc

SEQ ID NO: 3180865 - RNA, 15 nt, Human
auuaaaugcccagcc

SEQ ID NO: 3180866 - RNA, 23 nt, Human
auuaaaguuucaaaaaucugaag

SEQ ID NO: 3180867 - RNA, 21 nt, Human
auuaaaguuucaaaaaucuga

SEQ ID NO: 3180868 - RNA, 20 nt, Human
auuaaaguuucaaaaaucug

SEQ ID NO: 3180869 - RNA, 19 nt, Human
auuaaaguuucaaaaaucu

SEQ ID NO: 3180870 - RNA, 18 nt, Human
auuaaaguuucaaaaauc

SEQ ID NO: 3180871 - RNA, 16 nt, Human
auuaaaguuucaaaaa

SEQ ID NO: 3180872 - RNA, 16 nt, Human
auuaaaugcccagccc

SEQ ID NO: 3180873 - RNA, 11 nt, Human
auuaaauuaug

SEQ ID NO: 3180874 - RNA, 16 nt, Human
augugggggucugugu

SEQ ID NO: 3180875 - RNA, 20 nt, Human
augugggcuaguugggcuuc

SEQ ID NO: 3180876 - RNA, 17 nt, Human
augugggggucugugug

SEQ ID NO: 3180877 - RNA, 18 nt, Human
augugggggucugugugu

SEQ ID NO: 3180878 - RNA, 23 nt, Human
auguggucguuagagacagagcg

SEQ ID NO: 3180879 - RNA, 19 nt, Human
auguggucguuagagacag

SEQ ID NO: 3180880 - RNA, 21 nt, Human
augugguuaauuuugcauauc

SEQ ID NO: 3180881 - RNA, 14 nt, Human
auguguaaguauuc

SEQ ID NO: 3180882 - RNA, 23 nt, Human
auggugacuuuugaaaagaggug

SEQ ID NO: 3180883 - RNA, 16 nt, Human
auggugaacugucauu

SEQ ID NO: 3180884 - RNA, 18 nt, Human
auggucuuauauuuacaa

SEQ ID NO: 3180885 - RNA, 16 nt, Human
auggucuaauguuuaa

SEQ ID NO: 3180886 - RNA, 14 nt, Human
auggucuaauguuu

SEQ ID NO: 3180887 - RNA, 13 nt, Human
auguaagguauau

SEQ ID NO: 3180888 - RNA, 22 nt, Human
auguaagguauaucauucuaaa

SEQ ID NO: 3180889 - RNA, 22 nt, Human
auguaagggaaacugccagcaa

SEQ ID NO: 3180890 - RNA, 21 nt, Human
auguaagggaaacugccagca

SEQ ID NO: 3180891 - RNA, 20 nt, Human
auguaagggaaacugccagc

SEQ ID NO: 3180892 - RNA, 17 nt, Human
auguaagcucuacugag

SEQ ID NO: 3180893 - RNA, 16 nt, Human
augucacaggcagguc

SEQ ID NO: 3180894 - RNA, 14 nt, Human
augucacaggcagg

SEQ ID NO: 3180895 - RNA, 15 nt, Human
augucacaggcaggu

SEQ ID NO: 3180896 - RNA, 13 nt, Human
augucagcaguug

SEQ ID NO: 3180897 - RNA, 16 nt, Human
augucagcaguugcug

SEQ ID NO: 3180898 - RNA, 16 nt, Human
augucaauaacaguau

SEQ ID NO: 3180899 - RNA, 14 nt, Human
augucaaaugugaa

SEQ ID NO: 3180900 - RNA, 23 nt, Human
augucaaccagguccagaugugc

SEQ ID NO: 3180901 - RNA, 23 nt, Human
augucaaauauuuagauguaauu

SEQ ID NO: 3180902 - RNA, 19 nt, Human
augucaaauauuuagaugu

SEQ ID NO: 3180903 - RNA, 13 nt, Human
augccuuuguaac

SEQ ID NO: 3180904 - RNA, 21 nt, Human
augccuggauggggcugcacc

SEQ ID NO: 3180905 - RNA, 23 nt, Human
augccuggauggggcugcaccgg

SEQ ID NO: 3180906 - RNA, 14 nt, Human
augccugguggcag

SEQ ID NO: 3180907 - RNA, 17 nt, Human
augccuggugagcauua

SEQ ID NO: 3180908 - RNA, 17 nt, Human
augccugggcagaagga

SEQ ID NO: 3180909 - RNA, 17 nt, Human
augccugguggcagcug

SEQ ID NO: 3180910 - RNA, 16 nt, Human
augccugguggcagcu

SEQ ID NO: 3180911 - RNA, 15 nt, Human
augccugguggcagc

SEQ ID NO: 3180912 - RNA, 21 nt, Human
augcaugcuuuccauauuuuu

SEQ ID NO: 3180913 - RNA, 20 nt, Human
augcaugcuuuccauauuuu

SEQ ID NO: 3180914 - RNA, 19 nt, Human
augcaugcuuuccauauuu

SEQ ID NO: 3180915 - RNA, 20 nt, Human
augcaugauugcagaauugu

SEQ ID NO: 3180916 - RNA, 15 nt, Human
augcaugcuuuccau

SEQ ID NO: 3180917 - RNA, 17 nt, Human
augcaugcuuuccauau

SEQ ID NO: 3180918 - RNA, 16 nt, Human
augcaugcuuuccaua

SEQ ID NO: 3180919 - RNA, 14 nt, Human
augcacagcuaaca

SEQ ID NO: 3180920 - RNA, 21 nt, Human
augcacagcuaacauggaagu

SEQ ID NO: 3180921 - RNA, 16 nt, Human
augcaauccuuacaaa

SEQ ID NO: 3180922 - RNA, 15 nt, Human
augcaauccuuacaa

SEQ ID NO: 3180923 - RNA, 21 nt, Human
augcaauccuuacaaaugauu

SEQ ID NO: 3180924 - RNA, 19 nt, Human
augcaauccuuacaaauga

SEQ ID NO: 3180925 - RNA, 18 nt, Human
augcaauccuuacaaaug

SEQ ID NO: 3180926 - RNA, 17 nt, Human
augcaauccuuacaaau

SEQ ID NO: 3180927 - RNA, 16 nt, Human
augaugugugaaaacu

SEQ ID NO: 3180928 - RNA, 23 nt, Human
augauguauguugaagccuuugu

SEQ ID NO: 3180929 - RNA, 18 nt, Human
augaugugccugcuucag

SEQ ID NO: 3180930 - RNA, 14 nt, Human
augaugugccugcu

SEQ ID NO: 3180931 - RNA, 18 nt, Human
auggagcuauuuuaaacc

SEQ ID NO: 3180932 - RNA, 16 nt, Human
auggaugaacugaaag

SEQ ID NO: 3180933 - RNA, 20 nt, Human
auggaucgauauuaauguau

SEQ ID NO: 3180934 - RNA, 18 nt, Human
auggauuauaaucagaau

SEQ ID NO: 3180935 - RNA, 16 nt, Human
auggauucaguuucua

SEQ ID NO: 3180936 - RNA, 19 nt, Human
auggauucaguuucuaaaa

SEQ ID NO: 3180937 - RNA, 23 nt, Human
auggcugccaaugggagcucaug

SEQ ID NO: 3180938 - RNA, 17 nt, Human
auggcugcauaguauuc

SEQ ID NO: 3180939 - RNA, 15 nt, Human
augggaaugaauguc

SEQ ID NO: 3180940 - RNA, 22 nt, Human
augggaauauaauauugucucu

SEQ ID NO: 3180941 - RNA, 22 nt, Human
augcuucuucagagacuccugc

SEQ ID NO: 3180942 - RNA, 12 nt, Human
augcuucuuuaa

SEQ ID NO: 3180943 - RNA, 14 nt, Human
augcuucuuuaaaa

SEQ ID NO: 3180944 - RNA, 18 nt, Human
augcuugcggcaaaagga

SEQ ID NO: 3180945 - RNA, 20 nt, Human
augcuugcggcaaaaggaaa

SEQ ID NO: 3180946 - RNA, 22 nt, Human
augcuugcggcaaaaggaaagc

SEQ ID NO: 3180947 - RNA, 23 nt, Human
augcuugcggcaaaaggaaagcu

SEQ ID NO: 3180948 - RNA, 19 nt, Human
augcuugcauauauuucau

SEQ ID NO: 3180949 - RNA, 19 nt, Human
auggaaaugggcagagcag

SEQ ID NO: 3180950 - RNA, 20 nt, Human
auggaaaugggcagagcaga

SEQ ID NO: 3180951 - RNA, 13 nt, Human
auggaaauguuua

SEQ ID NO: 3180952 - RNA, 15 nt, Human
auggaaaacuuaguu

SEQ ID NO: 3180953 - RNA, 16 nt, Human
auggaaaacuuaguuu

SEQ ID NO: 3180954 - RNA, 17 nt, Human
auggaaaacuuaguuug

SEQ ID NO: 3180955 - RNA, 21 nt, Human
auggaaaacuuaguuugugaa

SEQ ID NO: 3180956 - RNA, 18 nt, Human
auggaaaugcaaacuggg

SEQ ID NO: 3180957 - RNA, 15 nt, Human
augcuuugugaacaa

SEQ ID NO: 3180958 - RNA, 14 nt, Human
augcuuuucucaaa

SEQ ID NO: 3180959 - RNA, 13 nt, Human
auggaaaaauaaa

SEQ ID NO: 3180960 - RNA, 17 nt, Human
auggaaaaauaaaacug

SEQ ID NO: 3180961 - RNA, 14 nt, Human
auggaaaaaugcca

SEQ ID NO: 3180962 - RNA, 22 nt, Human
auggaaaaaugccaucaaauga

SEQ ID NO: 3180963 - RNA, 19 nt, Human
auccuuuuagucugcauau

SEQ ID NO: 3180964 - RNA, 17 nt, Human
auccuuuuagucugcau

SEQ ID NO: 3180965 - RNA, 13 nt, Human
aucgaugcagugc

SEQ ID NO: 3180966 - RNA, 12 nt, Human
auccuuuucugu

SEQ ID NO: 3180967 - RNA, 16 nt, Human
auccuuuucuguguuu

SEQ ID NO: 3180968 - RNA, 21 nt, Human
aucgagugccgcaucucacag

SEQ ID NO: 3180969 - RNA, 22 nt, Human
aucgagugccgcaucucacagc

SEQ ID NO: 3180970 - RNA, 13 nt, Human
auccuccaggugc

SEQ ID NO: 3180971 - RNA, 14 nt, Human
auccuccaggugca

SEQ ID NO: 3180972 - RNA, 19 nt, Human
auccuccaggugcacaagc

SEQ ID NO: 3180973 - RNA, 22 nt, Human
auccuccaggugcacaagcucc

SEQ ID NO: 3180974 - RNA, 11 nt, Human
auccuccucag

SEQ ID NO: 3180975 - RNA, 12 nt, Human
auccucccaggc

SEQ ID NO: 3180976 - RNA, 15 nt, Human
auccuccccuggacu

SEQ ID NO: 3180977 - RNA, 22 nt, Human
auccuccccuggacucccgugu

SEQ ID NO: 3180978 - RNA, 16 nt, Human
auccuccccuggacuc

SEQ ID NO: 3180979 - RNA, 16 nt, Human
auccacccaccucagc

SEQ ID NO: 3180980 - RNA, 20 nt, Human
auccacccaccucagccucc

SEQ ID NO: 3180981 - RNA, 18 nt, Human
auccacccaccucagccu

SEQ ID NO: 3180982 - RNA, 16 nt, Human
auccacccauguuauc

SEQ ID NO: 3180983 - RNA, 18 nt, Human
auccucauacccaccccc

SEQ ID NO: 3180984 - RNA, 17 nt, Human
auccucauacccacccc

SEQ ID NO: 3180985 - RNA, 19 nt, Human
auccucauacccaccccca

SEQ ID NO: 3180986 - RNA, 22 nt, Human
auccucauacccacccccaccc

SEQ ID NO: 3180987 - RNA, 14 nt, Human
aucccggcugcccu

SEQ ID NO: 3180988 - RNA, 17 nt, Human
aucgcacucuggcagca

SEQ ID NO: 3180989 - RNA, 20 nt, Human
aucgcacucuggcagcaccg

SEQ ID NO: 3180990 - RNA, 12 nt, Human
aucaccugcccu

SEQ ID NO: 3180991 - RNA, 13 nt, Human
aucaccugcccug

SEQ ID NO: 3180992 - RNA, 11 nt, Human
aucagccuggg

SEQ ID NO: 3180993 - RNA, 20 nt, Human
aucagccugggcaaugugau

SEQ ID NO: 3180994 - RNA, 21 nt, Human
aucagccugggcaaugugaua

SEQ ID NO: 3180995 - RNA, 12 nt, Human
aucagcugcuac

SEQ ID NO: 3180996 - RNA, 20 nt, Human
aucagcccaaucccugaucc

SEQ ID NO: 3180997 - RNA, 23 nt, Human
aucagcugcuacuacuccuguag

SEQ ID NO: 3180998 - RNA, 13 nt, Human
aucagcugcuacu

SEQ ID NO: 3180999 - RNA, 20 nt, Human
aucagccugcuccagcuguu

SEQ ID NO: 3181000 - RNA, 19 nt, Human
aucauggagguuugaagau

SEQ ID NO: 3181001 - RNA, 15 nt, Human
aucaucuugaacauu

SEQ ID NO: 3181002 - RNA, 21 nt, Human
aucaucuugaacauuaaucca

SEQ ID NO: 3181003 - RNA, 16 nt, Human
aucaucuguaagcugu

SEQ ID NO: 3181004 - RNA, 14 nt, Human
aucaucuguaagcu

SEQ ID NO: 3181005 - RNA, 17 nt, Human
aucaucuguaagcuguu

SEQ ID NO: 3181006 - RNA, 24 nt, Human
aucauggggggagcacccugaggg

SEQ ID NO: 3181007 - RNA, 12 nt, Human
augacccagugg

SEQ ID NO: 3181008 - RNA, 16 nt, Human
augacccccccagcuu

SEQ ID NO: 3181009 - RNA, 13 nt, Human
augacccccccag

SEQ ID NO: 3181010 - RNA, 14 nt, Human
augaccccugccca

SEQ ID NO: 3181011 - RNA, 12 nt, Human
augacuccagaa

SEQ ID NO: 3181012 - RNA, 16 nt, Human
augacuccagaauuuc

SEQ ID NO: 3181013 - RNA, 17 nt, Human
augacuccagaauuucc

SEQ ID NO: 3181014 - RNA, 12 nt, Human
augagccuggca

SEQ ID NO: 3181015 - RNA, 15 nt, Human
augaaaauuguguua

SEQ ID NO: 3181016 - RNA, 18 nt, Human
augaaaauaacugaauuu

SEQ ID NO: 3181017 - RNA, 19 nt, Human
augaaaauaacugaauuug

SEQ ID NO: 3181018 - RNA, 22 nt, Human
augaaaauaacugaauuuggag

SEQ ID NO: 3181019 - RNA, 23 nt, Human
augaaaagcuuuguuuguucuug

SEQ ID NO: 3181020 - RNA, 18 nt, Human
augaaaaggugauuguca

SEQ ID NO: 3181021 - RNA, 18 nt, Human
augaaaagcuuuguuugu

SEQ ID NO: 3181022 - RNA, 13 nt, Human
augagccuggcaa

SEQ ID NO: 3181023 - RNA, 14 nt, Human
augagccuggcaag

SEQ ID NO: 3181024 - RNA, 18 nt, Human
augacucuugacucuugc

SEQ ID NO: 3181025 - RNA, 14 nt, Human
augacucuuuauug

SEQ ID NO: 3181026 - RNA, 14 nt, Human
aucuuaucucagau

SEQ ID NO: 3181027 - RNA, 13 nt, Human
aucuuauuaaagu

SEQ ID NO: 3181028 - RNA, 21 nt, Human
aucuuaucucagauauuugca

SEQ ID NO: 3181029 - RNA, 20 nt, Human
aucuuaucucagauauuugc

SEQ ID NO: 3181030 - RNA, 19 nt, Human
aucuuaucucagauauuug

SEQ ID NO: 3181031 - RNA, 18 nt, Human
aucuuaucucagauauuu

SEQ ID NO: 3181032 - RNA, 14 nt, Human
aucuucauguaaau

SEQ ID NO: 3181033 - RNA, 18 nt, Human
aucuucauguaaauugac

SEQ ID NO: 3181034 - RNA, 15 nt, Human
aucuucauuaccaau

SEQ ID NO: 3181035 - RNA, 23 nt, Human
aucuucaucugagagaggcuaaa

SEQ ID NO: 3181036 - RNA, 19 nt, Human
aucuuccaacucaaacucu

SEQ ID NO: 3181037 - RNA, 17 nt, Human
aucugggccagaauuuc

SEQ ID NO: 3181038 - RNA, 15 nt, Human
aucugggccagaauu

SEQ ID NO: 3181039 - RNA, 19 nt, Human
aucuggaccccaucuguga

SEQ ID NO: 3181040 - RNA, 21 nt, Human
aucuggaagagcuaggcaggg

SEQ ID NO: 3181041 - RNA, 13 nt, Human
aucuggaagagcu

SEQ ID NO: 3181042 - RNA, 10 nt, Human
aucuggaagu

SEQ ID NO: 3181043 - RNA, 21 nt, Human
aucuggaauugguuuagccca

SEQ ID NO: 3181044 - RNA, 22 nt, Human
aucucucgugauugauaagaac

SEQ ID NO: 3181045 - RNA, 17 nt, Human
aucucuauuccccaccc

SEQ ID NO: 3181046 - RNA, 17 nt, Human
aucucuauuauuggaaa

SEQ ID NO: 3181047 - RNA, 16 nt, Human
aucugcugcagagcag

SEQ ID NO: 3181048 - RNA, 17 nt, Human
aucugcugcagagcagu

SEQ ID NO: 3181049 - RNA, 22 nt, Human
aucugcugucuuuucuuugcca

SEQ ID NO: 3181050 - RNA, 21 nt, Human
aucugcugucuuuucuuugcc

SEQ ID NO: 3181051 - RNA, 13 nt, Human
aucugcugucuuu

SEQ ID NO: 3181052 - RNA, 12 nt, Human
aucugcugucuu

SEQ ID NO: 3181053 - RNA, 17 nt, Human
aucuugaagacuuuucu

SEQ ID NO: 3181054 - RNA, 17 nt, Human
aucuucuuuauaauucu

SEQ ID NO: 3181055 - RNA, 20 nt, Human
aguuguaucagcacgugugg

SEQ ID NO: 3181056 - RNA, 23 nt, Human
aguuguaucagcacguguggccu

SEQ ID NO: 3181057 - RNA, 22 nt, Human
aguuguaggcgaaucauuuguu

SEQ ID NO: 3181058 - RNA, 21 nt, Human
aguuguaggcgaaucauuugu

SEQ ID NO: 3181059 - RNA, 14 nt, Human
aguuguagacaaag

SEQ ID NO: 3181060 - RNA, 16 nt, Human
aguuguagacaaagua

SEQ ID NO: 3181061 - RNA, 18 nt, Human
aguuguagacaaaguaca

SEQ ID NO: 3181062 - RNA, 23 nt, Human
aguuguagacaaaguacauucug

SEQ ID NO: 3181063 - RNA, 17 nt, Human
aguuguaugaucugugc

SEQ ID NO: 3181064 - RNA, 15 nt, Human
aguuguaugaucugu

SEQ ID NO: 3181065 - RNA, 18 nt, Human
aguuguaugaucugugcc

SEQ ID NO: 3181066 - RNA, 19 nt, Human
aguuguaccgcaaugugac

SEQ ID NO: 3181067 - RNA, 23 nt, Human
aguuguacuuuaaaaauuuacua

SEQ ID NO: 3181068 - RNA, 20 nt, Human
aguuguacuuuaaaaauuua

SEQ ID NO: 3181069 - RNA, 19 nt, Human
aguuguacuuuaaaaauuu

SEQ ID NO: 3181070 - RNA, 13 nt, Human
aguuguacuuuaa

SEQ ID NO: 3181071 - RNA, 18 nt, Human
aguuguaccgcaauguga

SEQ ID NO: 3181072 - RNA, 17 nt, Human
aguuacagacaaagcgu

SEQ ID NO: 3181073 - RNA, 18 nt, Human
aguuacagacaaagcgug

SEQ ID NO: 3181074 - RNA, 21 nt, Human
aguuacauauguauacaugug

SEQ ID NO: 3181075 - RNA, 20 nt, Human
aguuacauauguauacaugu

SEQ ID NO: 3181076 - RNA, 22 nt, Human
aguugaauguugcaaugugaaa

SEQ ID NO: 3181077 - RNA, 16 nt, Human
agugucuuuccacucc

SEQ ID NO: 3181078 - RNA, 14 nt, Human
agugugaaauauau

SEQ ID NO: 3181079 - RNA, 16 nt, Human
agugugaaauauauua

SEQ ID NO: 3181080 - RNA, 21 nt, Human
agugucuuaauuaaaagaaua

SEQ ID NO: 3181081 - RNA, 19 nt, Human
agugauucucaugccucag

SEQ ID NO: 3181082 - RNA, 18 nt, Human
agugauucucaugccuca

SEQ ID NO: 3181083 - RNA, 18 nt, Human
agugauuaccagggacug

SEQ ID NO: 3181084 - RNA, 15 nt, Human
agugauuaccaggga

SEQ ID NO: 3181085 - RNA, 23 nt, Human
agugugacaaggauugcuacugu

SEQ ID NO: 3181086 - RNA, 13 nt, Human
agugugaauacug

SEQ ID NO: 3181087 - RNA, 14 nt, Human
agugugaauacugc

SEQ ID NO: 3181088 - RNA, 16 nt, Human
agugugaauacugcuu

SEQ ID NO: 3181089 - RNA, 14 nt, Human
agugugaauauaaa

SEQ ID NO: 3181090 - RNA, 18 nt, Human
agugugaauauaaaugug

SEQ ID NO: 3181091 - RNA, 21 nt, Human
agugugaauauaaaugugugu

SEQ ID NO: 3181092 - RNA, 11 nt, Human
aguccaagcau

SEQ ID NO: 3181093 - RNA, 23 nt, Human
aguccaagggguccccuccagga

SEQ ID NO: 3181094 - RNA, 22 nt, Human
aguccaagggguccccuccagg

SEQ ID NO: 3181095 - RNA, 21 nt, Human
aguccaagggguccccuccag

SEQ ID NO: 3181096 - RNA, 16 nt, Human
agucauuaaauuacua

SEQ ID NO: 3181097 - RNA, 17 nt, Human
agucauuaaauuacuau

SEQ ID NO: 3181098 - RNA, 18 nt, Human
agucauuaaauuacuaua

SEQ ID NO: 3181099 - RNA, 23 nt, Human
agucauuaaauuacuauagcaaa

SEQ ID NO: 3181100 - RNA, 21 nt, Human
agucaacuacacaaagcaggc

SEQ ID NO: 3181101 - RNA, 17 nt, Human
agucaagauagaaaggg

SEQ ID NO: 3181102 - RNA, 19 nt, Human
agucaagacgaacauguag

SEQ ID NO: 3181103 - RNA, 18 nt, Human
agucaaggguaggguggg

SEQ ID NO: 3181104 - RNA, 16 nt, Human
agucaagugaaaaagg

SEQ ID NO: 3181105 - RNA, 20 nt, Human
agucaagugaaaaaggagga

SEQ ID NO: 3181106 - RNA, 20 nt, Human
agugauauucuuuguuaauu

SEQ ID NO: 3181107 - RNA, 12 nt, Human
agugauauucuu

SEQ ID NO: 3181108 - RNA, 19 nt, Human
agugauauucuuuguuaau

SEQ ID NO: 3181109 - RNA, 18 nt, Human
agugauauucuuuguuaa

SEQ ID NO: 3181110 - RNA, 17 nt, Human
agugauauucuuuguua

SEQ ID NO: 3181111 - RNA, 15 nt, Human
agugauauucuuugu

SEQ ID NO: 3181112 - RNA, 20 nt, Human
auaauuaaccaagguagaau

SEQ ID NO: 3181113 - RNA, 14 nt, Human
auaaguauuuggaa

SEQ ID NO: 3181114 - RNA, 16 nt, Human
auaaguauuuggaauu

SEQ ID NO: 3181115 - RNA, 15 nt, Human
auaaguggugugugu

SEQ ID NO: 3181116 - RNA, 17 nt, Human
auaacagccgcuccaga

SEQ ID NO: 3181117 - RNA, 16 nt, Human
auaacagccgcuccag

SEQ ID NO: 3181118 - RNA, 22 nt, Human
auaacagggauugauuuuaaaa

SEQ ID NO: 3181119 - RNA, 21 nt, Human
auaacagggauugauuuuaaa

SEQ ID NO: 3181120 - RNA, 20 nt, Human
auaacagggauugauuuuaa

SEQ ID NO: 3181121 - RNA, 19 nt, Human
auaacagggauugauuuua

SEQ ID NO: 3181122 - RNA, 17 nt, Human
auaacacugugaagagc

SEQ ID NO: 3181123 - RNA, 21 nt, Human
auaacacucuaggauguauau

SEQ ID NO: 3181124 - RNA, 23 nt, Human
auaacacucuaggauguauauuu

SEQ ID NO: 3181125 - RNA, 16 nt, Human
auaacacugugaagag

SEQ ID NO: 3181126 - RNA, 18 nt, Human
auaacaccaccauucaca

SEQ ID NO: 3181127 - RNA, 19 nt, Human
auaacaccaccauucacaa

SEQ ID NO: 3181128 - RNA, 14 nt, Human
auaauuacuauguc

SEQ ID NO: 3181129 - RNA, 19 nt, Human
auaauuagauccauuaauu

SEQ ID NO: 3181130 - RNA, 21 nt, Human
auaauuagauccauuaauuua

SEQ ID NO: 3181131 - RNA, 22 nt, Human
auaauuagauccauuaauuuaa

SEQ ID NO: 3181132 - RNA, 22 nt, Human
auaauuacagugccuaaaauaa

SEQ ID NO: 3181133 - RNA, 21 nt, Human
auaauuaaccaagguagaaug

SEQ ID NO: 3181134 - RNA, 18 nt, Human
auacaauuuuuauuucuu

SEQ ID NO: 3181135 - RNA, 16 nt, Human
auacacaaaaucaaau

SEQ ID NO: 3181136 - RNA, 14 nt, Human
auacacaaaaucaa

SEQ ID NO: 3181137 - RNA, 21 nt, Human
auacccccugcaaagcccagc

SEQ ID NO: 3181138 - RNA, 22 nt, Human
auacccccugcaaagcccagcu

SEQ ID NO: 3181139 - RNA, 18 nt, Human
auacacaaaaucaaauaa

SEQ ID NO: 3181140 - RNA, 12 nt, Human
auaccugucccc

SEQ ID NO: 3181141 - RNA, 21 nt, Human
auacuuaaauguuauguauau

SEQ ID NO: 3181142 - RNA, 20 nt, Human
auacuuaaauguuauguaua

SEQ ID NO: 3181143 - RNA, 17 nt, Human
auacuuaaauguuaugu

SEQ ID NO: 3181144 - RNA, 14 nt, Human
auacuuaaauguua

SEQ ID NO: 3181145 - RNA, 15 nt, Human
auaguaugguggcug

SEQ ID NO: 3181146 - RNA, 20 nt, Human
auaguaugcacuauauacau

SEQ ID NO: 3181147 - RNA, 13 nt, Human
auauacucauuag

SEQ ID NO: 3181148 - RNA, 15 nt, Human
auauacucauuagaa

SEQ ID NO: 3181149 - RNA, 19 nt, Human
auauacucauuagaauuac

SEQ ID NO: 3181150 - RNA, 23 nt, Human
auauacauuuuuagccuguguca

SEQ ID NO: 3181151 - RNA, 20 nt, Human
auauagcauuuaugguaauc

SEQ ID NO: 3181152 - RNA, 18 nt, Human
auauagcauuuaugguaa

SEQ ID NO: 3181153 - RNA, 18 nt, Human
auauacauacugcaucuu

SEQ ID NO: 3181154 - RNA, 16 nt, Human
auauacauguuuaugu

SEQ ID NO: 3181155 - RNA, 15 nt, Human
auauacauguuuaug

SEQ ID NO: 3181156 - RNA, 21 nt, Human
auauacauguuuauguaaaca

SEQ ID NO: 3181157 - RNA, 18 nt, Human
auauacauguuuauguaa

SEQ ID NO: 3181158 - RNA, 14 nt, Human
auauaccaaauuaa

SEQ ID NO: 3181159 - RNA, 16 nt, Human
auauaccaaauuaaaa

SEQ ID NO: 3181160 - RNA, 19 nt, Human
auauaccaaauuaaaaaaa

SEQ ID NO: 3181161 - RNA, 20 nt, Human
auauaccacucuuuaccuuu

SEQ ID NO: 3181162 - RNA, 22 nt, Human
auauaccacucuuuaccuuuau

SEQ ID NO: 3181163 - RNA, 15 nt, Human
auaugcauauauaua

SEQ ID NO: 3181164 - RNA, 14 nt, Human
auaugccuuguaua

SEQ ID NO: 3181165 - RNA, 15 nt, Human
auaugccugcucuuu

SEQ ID NO: 3181166 - RNA, 22 nt, Human
auaugccugggcagaaggaaga

SEQ ID NO: 3181167 - RNA, 19 nt, Human
auaugcauauauauaugug

SEQ ID NO: 3181168 - RNA, 18 nt, Human
auaugcauauauauaugu

SEQ ID NO: 3181169 - RNA, 14 nt, Human
auaugccugcucuu

SEQ ID NO: 3181170 - RNA, 22 nt, Human
auaugcauauauauaugugugu

SEQ ID NO: 3181171 - RNA, 19 nt, Human
auaugcuuauacacuuaca

SEQ ID NO: 3181172 - RNA, 16 nt, Human
auaugcuuauacacuu

SEQ ID NO: 3181173 - RNA, 14 nt, Human
auaugcuuauacac

SEQ ID NO: 3181174 - RNA, 21 nt, Human
auauuagacuucuguuuucaa

SEQ ID NO: 3181175 - RNA, 20 nt, Human
auauuagacuucuguuuuca

SEQ ID NO: 3181176 - RNA, 16 nt, Human
auauuagacuucuguu

SEQ ID NO: 3181177 - RNA, 15 nt, Human
auauuagacuucugu

SEQ ID NO: 3181178 - RNA, 14 nt, Human
auauggaagaaagu

SEQ ID NO: 3181179 - RNA, 15 nt, Human
auauggaagaaagua

SEQ ID NO: 3181180 - RNA, 16 nt, Human
auauggaagaaaguaa

SEQ ID NO: 3181181 - RNA, 19 nt, Human
auaugcuuguaacuaaaau

SEQ ID NO: 3181182 - RNA, 15 nt, Human
auaugcuucuuuaaa

SEQ ID NO: 3181183 - RNA, 13 nt, Human
auaugcuucuuua

SEQ ID NO: 3181184 - RNA, 21 nt, Human
auauccacuuguccaugugaa

SEQ ID NO: 3181185 - RNA, 17 nt, Human
auauccauagugacuuu

SEQ ID NO: 3181186 - RNA, 18 nt, Human
auauccccuauuuaacag

SEQ ID NO: 3181187 - RNA, 14 nt, Human
auaucacucauuaa

SEQ ID NO: 3181188 - RNA, 15 nt, Human
auaucacucauuaau

SEQ ID NO: 3181189 - RNA, 16 nt, Human
auaucacucauuaauu

SEQ ID NO: 3181190 - RNA, 17 nt, Human
auaucacucauuaauua

SEQ ID NO: 3181191 - RNA, 19 nt, Human
auaucaccaggacuguuac

SEQ ID NO: 3181192 - RNA, 15 nt, Human
auaucaauuuaaaaa

SEQ ID NO: 3181193 - RNA, 14 nt, Human
auauucaggaagcu

SEQ ID NO: 3181194 - RNA, 16 nt, Human
auauucaggaagcuca

SEQ ID NO: 3181195 - RNA, 20 nt, Human
auauuuagauguaauuuugu

SEQ ID NO: 3181196 - RNA, 22 nt, Human
auauuuagauguaauuuugugu

SEQ ID NO: 3181197 - RNA, 13 nt, Human
auauucaggaagc

SEQ ID NO: 3181198 - RNA, 19 nt, Human
auauuaguauuaucuuguu

SEQ ID NO: 3181199 - RNA, 22 nt, Human
auauuagcgacaacagauugga

SEQ ID NO: 3181200 - RNA, 19 nt, Human
auauuagcgacaacagauu

SEQ ID NO: 3181201 - RNA, 22 nt, Human
auauuagacuucuguuuucaau

SEQ ID NO: 3181202 - RNA, 13 nt, Human
auauuagaucaaa

SEQ ID NO: 3181203 - RNA, 15 nt, Human
auauuuauuaaauuu

SEQ ID NO: 3181204 - RNA, 13 nt, Human
auauuuauuuuua

SEQ ID NO: 3181205 - RNA, 18 nt, Human
auauuucaaguacacuga

SEQ ID NO: 3181206 - RNA, 17 nt, Human
auauuucaaguacacug

SEQ ID NO: 3181207 - RNA, 20 nt, Human
auauuucagaaauacagaua

SEQ ID NO: 3181208 - RNA, 15 nt, Human
auauuucagaaauac

SEQ ID NO: 3181209 - RNA, 14 nt, Human
auauuucagaaaua

SEQ ID NO: 3181210 - RNA, 12 nt, Human
auauuucagaaa

SEQ ID NO: 3181211 - RNA, 19 nt, Human
auauuucaaguacacugaa

SEQ ID NO: 3181212 - RNA, 16 nt, Human
agguaccgucuacauu

SEQ ID NO: 3181213 - RNA, 17 nt, Human
agguaaggaauaccugu

SEQ ID NO: 3181214 - RNA, 18 nt, Human
agguaaucgaccugccuc

SEQ ID NO: 3181215 - RNA, 17 nt, Human
agguaaucgaccugccu

SEQ ID NO: 3181216 - RNA, 16 nt, Human
agguggaagagggcug

SEQ ID NO: 3181217 - RNA, 14 nt, Human
aggucgaggcagga

SEQ ID NO: 3181218 - RNA, 20 nt, Human
aggucgcuugggaauuuuau

SEQ ID NO: 3181219 - RNA, 14 nt, Human
agguccuuuagaaa

SEQ ID NO: 3181220 - RNA, 19 nt, Human
agguccugcucagcaguga

SEQ ID NO: 3181221 - RNA, 16 nt, Human
aggugcugccauccag

SEQ ID NO: 3181222 - RNA, 15 nt, Human
agguccuuuagaaac

SEQ ID NO: 3181223 - RNA, 17 nt, Human
aggugcugccauccagg

SEQ ID NO: 3181224 - RNA, 22 nt, Human
agguggcaucagugucuuucca

SEQ ID NO: 3181225 - RNA, 23 nt, Human
agguggcaucagugucuuuccac

SEQ ID NO: 3181226 - RNA, 17 nt, Human
agguggcaggugagcaa

SEQ ID NO: 3181227 - RNA, 15 nt, Human
agguuaauaaaguaa

SEQ ID NO: 3181228 - RNA, 14 nt, Human
agguuaauguucau

SEQ ID NO: 3181229 - RNA, 13 nt, Human
agguucagcuugu

SEQ ID NO: 3181230 - RNA, 18 nt, Human
agguuccacagaggacac

SEQ ID NO: 3181231 - RNA, 18 nt, Human
aggcugcagccaggccac

SEQ ID NO: 3181232 - RNA, 14 nt, Human
aggcugagugcagg

SEQ ID NO: 3181233 - RNA, 17 nt, Human
aggcugagugcaggccc

SEQ ID NO: 3181234 - RNA, 15 nt, Human
aggcugagugcaggc

SEQ ID NO: 3181235 - RNA, 24 nt, Human
aggcugagugcaggcccacccugc

SEQ ID NO: 3181236 - RNA, 23 nt, Human
aggcugagugcaggcccacccug

SEQ ID NO: 3181237 - RNA, 21 nt, Human
aggcugagugcaggcccaccc

SEQ ID NO: 3181238 - RNA, 20 nt, Human
aggcugagugcaggcccacc

SEQ ID NO: 3181239 - RNA, 19 nt, Human
aggcugagugcaggcccac

SEQ ID NO: 3181240 - RNA, 18 nt, Human
aggcugagugcaggccca

SEQ ID NO: 3181241 - RNA, 20 nt, Human
aggcugaacuuguuuucugg

SEQ ID NO: 3181242 - RNA, 21 nt, Human
aggcugaacuuguuuucuggg

SEQ ID NO: 3181243 - RNA, 14 nt, Human
aggcucuucuccuu

SEQ ID NO: 3181244 - RNA, 21 nt, Human
aggcuauggggauagaugugu

SEQ ID NO: 3181245 - RNA, 22 nt, Human
aggcuauggggauagaugugug

SEQ ID NO: 3181246 - RNA, 19 nt, Human
aggcuauggggauagaugu

SEQ ID NO: 3181247 - RNA, 16 nt, Human
aggcuaugagugggau

SEQ ID NO: 3181248 - RNA, 23 nt, Human
aggcuagugugguguuuccuggc

SEQ ID NO: 3181249 - RNA, 16 nt, Human
aggcugucuguuguau

SEQ ID NO: 3181250 - RNA, 18 nt, Human
aggcugccucucccauca

SEQ ID NO: 3181251 - RNA, 12 nt, Human
agggacagaggg

SEQ ID NO: 3181252 - RNA, 13 nt, Human
agggacagagggg

SEQ ID NO: 3181253 - RNA, 21 nt, Human
agggacgcuacccgggaaggg

SEQ ID NO: 3181254 - RNA, 17 nt, Human
agggacgcuacccggga

SEQ ID NO: 3181255 - RNA, 15 nt, Human
aggggcacagggucu

SEQ ID NO: 3181256 - RNA, 13 nt, Human
aggggcagccugc

SEQ ID NO: 3181257 - RNA, 15 nt, Human
aggggcagaggaggc

SEQ ID NO: 3181258 - RNA, 12 nt, Human
aggggcccugca

SEQ ID NO: 3181259 - RNA, 18 nt, Human
aggggcagccugccuugc

SEQ ID NO: 3181260 - RNA, 14 nt, Human
aggggcagccugcc

SEQ ID NO: 3181261 - RNA, 21 nt, Human
aggggauagagagagaccacu

SEQ ID NO: 3181262 - RNA, 16 nt, Human
aggggauagagagaga

SEQ ID NO: 3181263 - RNA, 21 nt, Human
agggcggggugucugucuucc

SEQ ID NO: 3181264 - RNA, 22 nt, Human
agggcggggugucugucuuccu

SEQ ID NO: 3181265 - RNA, 23 nt, Human
agggcggggugucugucuuccuu

SEQ ID NO: 3181266 - RNA, 15 nt, Human
aggggauuacaguuc

SEQ ID NO: 3181267 - RNA, 17 nt, Human
aggggaugugugugugc

SEQ ID NO: 3181268 - RNA, 19 nt, Human
agggcgggaggauguucug

SEQ ID NO: 3181269 - RNA, 14 nt, Human
agggccuggccuga

SEQ ID NO: 3181270 - RNA, 17 nt, Human
agggcacagggccuggc

SEQ ID NO: 3181271 - RNA, 16 nt, Human
agggcacagggccugg

SEQ ID NO: 3181272 - RNA, 15 nt, Human
agggccuggccugag

SEQ ID NO: 3181273 - RNA, 13 nt, Human
agggcacagggcc

SEQ ID NO: 3181274 - RNA, 15 nt, Human
agggcacagggccug

SEQ ID NO: 3181275 - RNA, 14 nt, Human
agggcacagggccu

SEQ ID NO: 3181276 - RNA, 16 nt, Human
agggccuggccugagc

SEQ ID NO: 3181277 - RNA, 17 nt, Human
agggccuggccugagcu

SEQ ID NO: 3181278 - RNA, 22 nt, Human
agggcacagaaaauggaagaca

SEQ ID NO: 3181279 - RNA, 21 nt, Human
agggcacaccgggcacucaga

SEQ ID NO: 3181280 - RNA, 20 nt, Human
agggcacaccgggcacucag

SEQ ID NO: 3181281 - RNA, 17 nt, Human
agggcacaccgggcacu

SEQ ID NO: 3181282 - RNA, 18 nt, Human
aggagaggggcacagggu

SEQ ID NO: 3181283 - RNA, 14 nt, Human
aggagaggggcaca

SEQ ID NO: 3181284 - RNA, 16 nt, Human
aggagaggggcacagg

SEQ ID NO: 3181285 - RNA, 15 nt, Human
aggagagcuagcagc

SEQ ID NO: 3181286 - RNA, 20 nt, Human
aggaccccugcaguuccccu

SEQ ID NO: 3181287 - RNA, 16 nt, Human
aggagaacuugcugcc

SEQ ID NO: 3181288 - RNA, 15 nt, Human
aggagaacuugcugc

SEQ ID NO: 3181289 - RNA, 13 nt, Human
aggagaagaaaau

SEQ ID NO: 3181290 - RNA, 19 nt, Human
aggagaacuugcugccucg

SEQ ID NO: 3181291 - RNA, 18 nt, Human
aggagaacuugcugccuc

SEQ ID NO: 3181292 - RNA, 17 nt, Human
aggagaacuugcugccu

SEQ ID NO: 3181293 - RNA, 14 nt, Human
aggaccucagguga

SEQ ID NO: 3181294 - RNA, 20 nt, Human
aggaccucaggugagaagca

SEQ ID NO: 3181295 - RNA, 17 nt, Human
aggacccggaggggccu

SEQ ID NO: 3181296 - RNA, 20 nt, Human
aggaccccuccaugugggcu

SEQ ID NO: 3181297 - RNA, 18 nt, Human
aggaccagcccacgcuga

SEQ ID NO: 3181298 - RNA, 14 nt, Human
aggaccagcccacg

SEQ ID NO: 3181299 - RNA, 13 nt, Human
aggaccagcccac

SEQ ID NO: 3181300 - RNA, 12 nt, Human
aggaccagccca

SEQ ID NO: 3181301 - RNA, 18 nt, Human
aggaccagcacacucccg

SEQ ID NO: 3181302 - RNA, 14 nt, Human
aggauguugaaaaa

SEQ ID NO: 3181303 - RNA, 20 nt, Human
aggauguucugggacacagu

SEQ ID NO: 3181304 - RNA, 18 nt, Human
aggauguucugggacaca

SEQ ID NO: 3181305 - RNA, 19 nt, Human
aggauucacaccccaccug

SEQ ID NO: 3181306 - RNA, 18 nt, Human
aggauucacaccccaccu

SEQ ID NO: 3181307 - RNA, 17 nt, Human
aggauucacaccccacc

SEQ ID NO: 3181308 - RNA, 17 nt, Human
aggaggggauagagaga

SEQ ID NO: 3181309 - RNA, 20 nt, Human
aggagaggugauaaugaaug

SEQ ID NO: 3181310 - RNA, 12 nt, Human
aggauucuuccu

SEQ ID NO: 3181311 - RNA, 22 nt, Human
aggauucacaccccaccugcgc

SEQ ID NO: 3181312 - RNA, 21 nt, Human
aggauucacaccccaccugcg

SEQ ID NO: 3181313 - RNA, 20 nt, Human
aggauucacaccccaccugc

SEQ ID NO: 3181314 - RNA, 20 nt, Human
aggauucucaccagcugugu

SEQ ID NO: 3181315 - RNA, 18 nt, Human
aggauucucaccagcugu

SEQ ID NO: 3181316 - RNA, 22 nt, Human
aggauucucaccagcugugucc

SEQ ID NO: 3181317 - RNA, 17 nt, Human
aggcagaaggaagcagg

SEQ ID NO: 3181318 - RNA, 22 nt, Human
aggcacugcugcccagccucca

SEQ ID NO: 3181319 - RNA, 16 nt, Human
aggcacugcugcccag

SEQ ID NO: 3181320 - RNA, 14 nt, Human
aggcacugcugccc

SEQ ID NO: 3181321 - RNA, 20 nt, Human
aggaaauggcuguggagugu

SEQ ID NO: 3181322 - RNA, 21 nt, Human
aggaaaugcugacccaugggc

SEQ ID NO: 3181323 - RNA, 23 nt, Human
aggaaaugcugacccaugggcag

SEQ ID NO: 3181324 - RNA, 22 nt, Human
aggaaaugcugacccaugggca

SEQ ID NO: 3181325 - RNA, 22 nt, Human
aggaacguaaucguguccccua

SEQ ID NO: 3181326 - RNA, 13 nt, Human
aggaaaaauaugu

SEQ ID NO: 3181327 - RNA, 17 nt, Human
aggaaaaauaugugaag

SEQ ID NO: 3181328 - RNA, 16 nt, Human
aggaaaaauaugugaa

SEQ ID NO: 3181329 - RNA, 15 nt, Human
aggaaaaauauguga

SEQ ID NO: 3181330 - RNA, 14 nt, Human
aggaaaaauaugug

SEQ ID NO: 3181331 - RNA, 15 nt, Human
aggaaauccagggug

SEQ ID NO: 3181332 - RNA, 17 nt, Human
aggaaauccaggguggu

SEQ ID NO: 3181333 - RNA, 14 nt, Human
agcuuuucauugcu

SEQ ID NO: 3181334 - RNA, 13 nt, Human
agcuuuucccuuc

SEQ ID NO: 3181335 - RNA, 23 nt, Human
agcuucuguugcugccucaugcu

SEQ ID NO: 3181336 - RNA, 16 nt, Human
agcuuuucccuucuuu

SEQ ID NO: 3181337 - RNA, 13 nt, Human
aggaaaaacugau

SEQ ID NO: 3181338 - RNA, 15 nt, Human
aggaaaaacugauuu

SEQ ID NO: 3181339 - RNA, 19 nt, Human
agcuucagucauuaaauua

SEQ ID NO: 3181340 - RNA, 21 nt, Human
agcuucuguugcugccucaug

SEQ ID NO: 3181341 - RNA, 22 nt, Human
agcuucuguugcugccucaugc

SEQ ID NO: 3181342 - RNA, 20 nt, Human
agcuucuguugcugccucau

SEQ ID NO: 3181343 - RNA, 23 nt, Human
agcuucacuucugacucuucccc

SEQ ID NO: 3181344 - RNA, 14 nt, Human
agcuucacuucuga

SEQ ID NO: 3181345 - RNA, 13 nt, Human
agcuucacuucug

SEQ ID NO: 3181346 - RNA, 17 nt, Human
agcuguaaggcaugaag

SEQ ID NO: 3181347 - RNA, 13 nt, Human
agcuguaaggcau

SEQ ID NO: 3181348 - RNA, 19 nt, Human
agcuguaaggcaugaagga

SEQ ID NO: 3181349 - RNA, 18 nt, Human
agcuguaaggcaugaagg

SEQ ID NO: 3181350 - RNA, 19 nt, Human
agcuguacuucuugaauau

SEQ ID NO: 3181351 - RNA, 20 nt, Human
agcuguacuucuugaauaua

SEQ ID NO: 3181352 - RNA, 19 nt, Human
agcuggucccacucagucc

SEQ ID NO: 3181353 - RNA, 21 nt, Human
agcuggucccacucaguccau

SEQ ID NO: 3181354 - RNA, 22 nt, Human
agcugggugucaagagggucug

SEQ ID NO: 3181355 - RNA, 17 nt, Human
agcugggugucaagagg

SEQ ID NO: 3181356 - RNA, 21 nt, Human
agcugaauugagccuaaaaau

SEQ ID NO: 3181357 - RNA, 20 nt, Human
agcugaauugagccuaaaaa

SEQ ID NO: 3181358 - RNA, 15 nt, Human
agcugaauugagccu

SEQ ID NO: 3181359 - RNA, 13 nt, Human
agaccaucccuga

SEQ ID NO: 3181360 - RNA, 16 nt, Human
agaccagugcuuagca

SEQ ID NO: 3181361 - RNA, 14 nt, Human
agaccaucccugaa

SEQ ID NO: 3181362 - RNA, 17 nt, Human
agaccaucccugaaggc

SEQ ID NO: 3181363 - RNA, 18 nt, Human
agaccaucccugaaggcc

SEQ ID NO: 3181364 - RNA, 21 nt, Human
agaccaucccugaaggccccg

SEQ ID NO: 3181365 - RNA, 16 nt, Human
agacagcccgggcucu

SEQ ID NO: 3181366 - RNA, 17 nt, Human
agacagcccgggcucug

SEQ ID NO: 3181367 - RNA, 18 nt, Human
agacagcccgggcucugc

SEQ ID NO: 3181368 - RNA, 20 nt, Human
agacagcccgggcucugccu

SEQ ID NO: 3181369 - RNA, 22 nt, Human
agaccaauuuuuugugugugaa

SEQ ID NO: 3181370 - RNA, 18 nt, Human
agacgggggcagagaggg

SEQ ID NO: 3181371 - RNA, 18 nt, Human
agacggagucccaccuug

SEQ ID NO: 3181372 - RNA, 18 nt, Human
agacgggaggccuggccu

SEQ ID NO: 3181373 - RNA, 19 nt, Human
agacggagucccaccuugg

SEQ ID NO: 3181374 - RNA, 15 nt, Human
agacuacuguucagc

SEQ ID NO: 3181375 - RNA, 22 nt, Human
agacuacuguucagcuuuuauu

SEQ ID NO: 3181376 - RNA, 22 nt, Human
agacuaagaucgguuaacaaau

SEQ ID NO: 3181377 - RNA, 21 nt, Human
agacuaagaucgguuaacaaa

SEQ ID NO: 3181378 - RNA, 15 nt, Human
agacaaucuucuguu

SEQ ID NO: 3181379 - RNA, 14 nt, Human
agacaaucuucugu

SEQ ID NO: 3181380 - RNA, 13 nt, Human
agacaaucuucug

SEQ ID NO: 3181381 - RNA, 19 nt, Human
agagaaagcauauugacuu

SEQ ID NO: 3181382 - RNA, 10 nt, Human
agagaagaga

SEQ ID NO: 3181383 - RNA, 21 nt, Human
agagaagagauugugguuuca

SEQ ID NO: 3181384 - RNA, 21 nt, Human
agagaagauggauaugaccag

SEQ ID NO: 3181385 - RNA, 21 nt, Human
agagaagagccccacucucag

SEQ ID NO: 3181386 - RNA, 18 nt, Human
agagaagagccccacucu

SEQ ID NO: 3181387 - RNA, 16 nt, Human
agagaagagccccacu

SEQ ID NO: 3181388 - RNA, 15 nt, Human
agagaagagccccac

SEQ ID NO: 3181389 - RNA, 14 nt, Human
agagaagagcccca

SEQ ID NO: 3181390 - RNA, 13 nt, Human
agagaagagcccc

SEQ ID NO: 3181391 - RNA, 20 nt, Human
agagagcuucuguugcugcc

SEQ ID NO: 3181392 - RNA, 23 nt, Human
agagagcuucuguugcugccuca

SEQ ID NO: 3181393 - RNA, 16 nt, Human
agagagcuucuguugc

SEQ ID NO: 3181394 - RNA, 23 nt, Human
agagaggguggugaccucugccu

SEQ ID NO: 3181395 - RNA, 16 nt, Human
agagaguggcuccucc

SEQ ID NO: 3181396 - RNA, 14 nt, Human
agagaguggcuccu

SEQ ID NO: 3181397 - RNA, 13 nt, Human
agagccccacucu

SEQ ID NO: 3181398 - RNA, 23 nt, Human
agagccccacucucagaggcccc

SEQ ID NO: 3181399 - RNA, 22 nt, Human
agagccccacucucagaggccc

SEQ ID NO: 3181400 - RNA, 21 nt, Human
agagccccacucucagaggcc

SEQ ID NO: 3181401 - RNA, 20 nt, Human
agagccccacucucagaggc

SEQ ID NO: 3181402 - RNA, 17 nt, Human
agagccccacucucaga

SEQ ID NO: 3181403 - RNA, 16 nt, Human
agagccccacucucag

SEQ ID NO: 3181404 - RNA, 15 nt, Human
agagccccacucuca

SEQ ID NO: 3181405 - RNA, 14 nt, Human
agagcccugcuccc

SEQ ID NO: 3181406 - RNA, 13 nt, Human
agagcccugcucc

SEQ ID NO: 3181407 - RNA, 18 nt, Human
agagcccugcucccuccg

SEQ ID NO: 3181408 - RNA, 16 nt, Human
agagcccugcucccuc

SEQ ID NO: 3181409 - RNA, 13 nt, Human
agagccuuaaaac

SEQ ID NO: 3181410 - RNA, 15 nt, Human
agagccuuaaaacau

SEQ ID NO: 3181411 - RNA, 16 nt, Human
agagccuuaaaacauc

SEQ ID NO: 3181412 - RNA, 14 nt, Human
agagccuuaaaaca

SEQ ID NO: 3181413 - RNA, 11 nt, Human
agacugaucuc

SEQ ID NO: 3181414 - RNA, 13 nt, Human
agaggggaggcca

SEQ ID NO: 3181415 - RNA, 18 nt, Human
agaggggagagcugaaca

SEQ ID NO: 3181416 - RNA, 15 nt, Human
agaggggaggccaag

SEQ ID NO: 3181417 - RNA, 23 nt, Human
agaggguggugaccucugccuga

SEQ ID NO: 3181418 - RNA, 22 nt, Human
agauacuuggggggcugaggug

SEQ ID NO: 3181419 - RNA, 13 nt, Human
agauagccaaggc

SEQ ID NO: 3181420 - RNA, 16 nt, Human
agauagcagccuggcu

SEQ ID NO: 3181421 - RNA, 23 nt, Human
agauagcagccuggcuccccugg

SEQ ID NO: 3181422 - RNA, 20 nt, Human
agauacuuuguauuguccua

SEQ ID NO: 3181423 - RNA, 22 nt, Human
agauacuuuguauuguccuauu

SEQ ID NO: 3181424 - RNA, 20 nt, Human
agauagaaagggugcugcca

SEQ ID NO: 3181425 - RNA, 12 nt, Human
agauacuuugua

SEQ ID NO: 3181426 - RNA, 13 nt, Human
agauacuuuguau

SEQ ID NO: 3181427 - RNA, 15 nt, Human
agauacuuuguauug

SEQ ID NO: 3181428 - RNA, 16 nt, Human
agauacuuuguauugu

SEQ ID NO: 3181429 - RNA, 11 nt, Human
agauacuuugu

SEQ ID NO: 3181430 - RNA, 22 nt, Human
agauacuuggucacagccaggc

SEQ ID NO: 3181431 - RNA, 14 nt, Human
agauacuuugcauu

SEQ ID NO: 3181432 - RNA, 16 nt, Human
agauacuuugcauugu

SEQ ID NO: 3181433 - RNA, 19 nt, Human
agauacuuugcauugucug

SEQ ID NO: 3181434 - RNA, 21 nt, Human
agauacuuggucacagccagg

SEQ ID NO: 3181435 - RNA, 16 nt, Human
agaggggaaaagagau

SEQ ID NO: 3181436 - RNA, 19 nt, Human
agaggauuaguaagaucuc

SEQ ID NO: 3181437 - RNA, 19 nt, Human
agaggauggcccaggguga

SEQ ID NO: 3181438 - RNA, 22 nt, Human
agaggauuuugcgucagagaaa

SEQ ID NO: 3181439 - RNA, 14 nt, Human
agaggauuuugcgu

SEQ ID NO: 3181440 - RNA, 22 nt, Human
agaggauuggcucccaucuuuu

SEQ ID NO: 3181441 - RNA, 18 nt, Human
agaggggaaaagagauga

SEQ ID NO: 3181442 - RNA, 19 nt, Human
agaggggaaaagcugaaca

SEQ ID NO: 3181443 - RNA, 18 nt, Human
agaggggaaaagcugaac

SEQ ID NO: 3181444 - RNA, 22 nt, Human
agaggggaacagacuggaagca

SEQ ID NO: 3181445 - RNA, 16 nt, Human
agaggggaagagacuu

SEQ ID NO: 3181446 - RNA, 13 nt, Human
agaggagaggggc

SEQ ID NO: 3181447 - RNA, 13 nt, Human
agaggagcccugc

SEQ ID NO: 3181448 - RNA, 12 nt, Human
agaggagcccug

SEQ ID NO: 3181449 - RNA, 23 nt, Human
agaggagcccugccucuccgccc

SEQ ID NO: 3181450 - RNA, 15 nt, Human
agaggagcccugccu

SEQ ID NO: 3181451 - RNA, 14 nt, Human
agaggagcccugcc

SEQ ID NO: 3181452 - RNA, 15 nt, Human
agauagccaaggcca

SEQ ID NO: 3181453 - RNA, 16 nt, Human
agauagccaaggccaa

SEQ ID NO: 3181454 - RNA, 21 nt, Human
agauaguaugcacuauauaca

SEQ ID NO: 3181455 - RNA, 21 nt, Human
agauaguccauaauguucugc

SEQ ID NO: 3181456 - RNA, 20 nt, Human
agauaguccauaauguucug

SEQ ID NO: 3181457 - RNA, 23 nt, Human
agauaguccauaauguucugcua

SEQ ID NO: 3181458 - RNA, 21 nt, Human
agauagucuuggaagcuguuu

SEQ ID NO: 3181459 - RNA, 23 nt, Human
agaugagaggggagagcugaaca

SEQ ID NO: 3181460 - RNA, 21 nt, Human
agaugagaacagauaaagauu

SEQ ID NO: 3181461 - RNA, 13 nt, Human
agaugagaauuag

SEQ ID NO: 3181462 - RNA, 17 nt, Human
agaugagaacagauaaa

SEQ ID NO: 3181463 - RNA, 20 nt, Human
agaugaccccugcccagauc

SEQ ID NO: 3181464 - RNA, 23 nt, Human
agaugaccccugcccagaucagc

SEQ ID NO: 3181465 - RNA, 22 nt, Human
agauggcugugccucugccugu

SEQ ID NO: 3181466 - RNA, 23 nt, Human
agauggcugugccucugccuguc

SEQ ID NO: 3181467 - RNA, 14 nt, Human
agaugagcacuucu

SEQ ID NO: 3181468 - RNA, 16 nt, Human
agaugagcuuucuuuu

SEQ ID NO: 3181469 - RNA, 20 nt, Human
agaugagcuuucuuuuuaaa

SEQ ID NO: 3181470 - RNA, 19 nt, Human
agaugagcacuucuaaguu

SEQ ID NO: 3181471 - RNA, 18 nt, Human
agaugaggaguaaaauuc

SEQ ID NO: 3181472 - RNA, 20 nt, Human
agaugaggaguaaaauucag

SEQ ID NO: 3181473 - RNA, 22 nt, Human
agaucuguuuugugguuuggaa

SEQ ID NO: 3181474 - RNA, 23 nt, Human
agaucuguuuugugguuuggaau

SEQ ID NO: 3181475 - RNA, 13 nt, Human
agccagaggucug

SEQ ID NO: 3181476 - RNA, 22 nt, Human
agccagauuucacucuccuugg

SEQ ID NO: 3181477 - RNA, 18 nt, Human
agccagaggagagaggac

SEQ ID NO: 3181478 - RNA, 20 nt, Human
agccagaggagagaggaccc

SEQ ID NO: 3181479 - RNA, 23 nt, Human
agccaaggccaaaggaagcacau

SEQ ID NO: 3181480 - RNA, 17 nt, Human
agcaugccaauuucucu

SEQ ID NO: 3181481 - RNA, 22 nt, Human
agccaaggccaaaggaagcaca

SEQ ID NO: 3181482 - RNA, 20 nt, Human
agccaaggccaaaggaagca

SEQ ID NO: 3181483 - RNA, 17 nt, Human
agccauucugacucaua

SEQ ID NO: 3181484 - RNA, 12 nt, Human
agcaugccugga

SEQ ID NO: 3181485 - RNA, 20 nt, Human
agcaugagagggaugaggca

SEQ ID NO: 3181486 - RNA, 23 nt, Human
agcaugaggcagcacgugcacaa

SEQ ID NO: 3181487 - RNA, 18 nt, Human
agcaugagguaucuaagg

SEQ ID NO: 3181488 - RNA, 20 nt, Human
agcaugauuuauacucauuu

SEQ ID NO: 3181489 - RNA, 20 nt, Human
agccaaagcuaggccuggcc

SEQ ID NO: 3181490 - RNA, 19 nt, Human
agccaaagcuaggccuggc

SEQ ID NO: 3181491 - RNA, 18 nt, Human
agccaaagcuaggccugg

SEQ ID NO: 3181492 - RNA, 16 nt, Human
agcaugaacagugcac

SEQ ID NO: 3181493 - RNA, 17 nt, Human
agcaugaaaaugugugu

SEQ ID NO: 3181494 - RNA, 21 nt, Human
agcagugauauucuuuguuaa

SEQ ID NO: 3181495 - RNA, 16 nt, Human
agcaguugcugguaaa

SEQ ID NO: 3181496 - RNA, 17 nt, Human
agcaguugcugguaaaa

SEQ ID NO: 3181497 - RNA, 20 nt, Human
agcaguugcugguaaaauga

SEQ ID NO: 3181498 - RNA, 21 nt, Human
agcaguugcugguaaaaugaa

SEQ ID NO: 3181499 - RNA, 22 nt, Human
agcaguugcugguaaaaugaag

SEQ ID NO: 3181500 - RNA, 23 nt, Human
agcaguugcugguaaaaugaaga

SEQ ID NO: 3181501 - RNA, 13 nt, Human
agcaguuucaaua

SEQ ID NO: 3181502 - RNA, 12 nt, Human
agcaguuucaau

SEQ ID NO: 3181503 - RNA, 21 nt, Human
agaugggagaaucacuugaac

SEQ ID NO: 3181504 - RNA, 13 nt, Human
agauguaauuuug

SEQ ID NO: 3181505 - RNA, 14 nt, Human
agauguagaggaga

SEQ ID NO: 3181506 - RNA, 19 nt, Human
agauguaauuuuguguaag

SEQ ID NO: 3181507 - RNA, 17 nt, Human
agauguaauuuugugua

SEQ ID NO: 3181508 - RNA, 15 nt, Human
agauguaauuuugug

SEQ ID NO: 3181509 - RNA, 14 nt, Human
agauguaauuuugu

SEQ ID NO: 3181510 - RNA, 15 nt, Human
agauguacuauaaca

SEQ ID NO: 3181511 - RNA, 22 nt, Human
agauguacuauaacauagaauu

SEQ ID NO: 3181512 - RNA, 21 nt, Human
agcaguugaaaagacuccaaa

SEQ ID NO: 3181513 - RNA, 23 nt, Human
agcaguugaaaagacuccaaaga

SEQ ID NO: 3181514 - RNA, 16 nt, Human
agcagugagagcagau

SEQ ID NO: 3181515 - RNA, 19 nt, Human
agcagugauauucuuuguu

SEQ ID NO: 3181516 - RNA, 15 nt, Human
agcagugauauucuu

SEQ ID NO: 3181517 - RNA, 13 nt, Human
agcagucugccug

SEQ ID NO: 3181518 - RNA, 19 nt, Human
agcagucuuaugcuuccag

SEQ ID NO: 3181519 - RNA, 15 nt, Human
agcagucugccugga

SEQ ID NO: 3181520 - RNA, 22 nt, Human
agcagucuuaugcuuccagaaa

SEQ ID NO: 3181521 - RNA, 20 nt, Human
agcagucuuaugcuuccaga

SEQ ID NO: 3181522 - RNA, 14 nt, Human
agcagccaggagag

SEQ ID NO: 3181523 - RNA, 15 nt, Human
agcagccacauuccu

SEQ ID NO: 3181524 - RNA, 12 nt, Human
agcagccagcca

SEQ ID NO: 3181525 - RNA, 21 nt, Human
agcagccagccaaacacacag

SEQ ID NO: 3181526 - RNA, 19 nt, Human
agcacuaaggugugcucug

SEQ ID NO: 3181527 - RNA, 21 nt, Human
agcagccacauuccugaugcu

SEQ ID NO: 3181528 - RNA, 19 nt, Human
agcacuaaacuuggugcuu

SEQ ID NO: 3181529 - RNA, 11 nt, Human
agcccaaccuc

SEQ ID NO: 3181530 - RNA, 16 nt, Human
agcccaaccucuuccu

SEQ ID NO: 3181531 - RNA, 15 nt, Human
agcccaaccucuucc

SEQ ID NO: 3181532 - RNA, 19 nt, Human
agccccacucucagaggcc

SEQ ID NO: 3181533 - RNA, 17 nt, Human
agccccacucucagagg

SEQ ID NO: 3181534 - RNA, 16 nt, Human
agccccacucucagag

SEQ ID NO: 3181535 - RNA, 15 nt, Human
agccccacucucaga

SEQ ID NO: 3181536 - RNA, 14 nt, Human
agccccacucucag

SEQ ID NO: 3181537 - RNA, 22 nt, Human
agccccacucucagaggcccca

SEQ ID NO: 3181538 - RNA, 21 nt, Human
agccccacucucagaggcccc

SEQ ID NO: 3181539 - RNA, 20 nt, Human
agccgagaucacgccacugc

SEQ ID NO: 3181540 - RNA, 19 nt, Human
agccgagaucacgccacug

SEQ ID NO: 3181541 - RNA, 15 nt, Human
agcccugagcuuucu

SEQ ID NO: 3181542 - RNA, 17 nt, Human
agcccugaggaggccuu

SEQ ID NO: 3181543 - RNA, 20 nt, Human
agccccaucccaaacccuuc

SEQ ID NO: 3181544 - RNA, 16 nt, Human
agccccagugcccaca

SEQ ID NO: 3181545 - RNA, 23 nt, Human
agccccauaauuuuuuuuuuccu

SEQ ID NO: 3181546 - RNA, 21 nt, Human
agccgggcgugguggugagug

SEQ ID NO: 3181547 - RNA, 19 nt, Human
agccucccaaagugcuggg

SEQ ID NO: 3181548 - RNA, 18 nt, Human
agccucccaaagugcugg

SEQ ID NO: 3181549 - RNA, 16 nt, Human
agccguaaaaacugaa

SEQ ID NO: 3181550 - RNA, 20 nt, Human
agccguaaaaacugaaguuc

SEQ ID NO: 3181551 - RNA, 17 nt, Human
agccguaaaaacugaag

SEQ ID NO: 3181552 - RNA, 14 nt, Human
agccgcuggggcca

SEQ ID NO: 3181553 - RNA, 22 nt, Human
agccgcuggggccaguuggucc

SEQ ID NO: 3181554 - RNA, 18 nt, Human
agccgagaucacgccacu

SEQ ID NO: 3181555 - RNA, 22 nt, Human
agcccugagguuugaaucugac

SEQ ID NO: 3181556 - RNA, 18 nt, Human
agcccugaggaggccuug

SEQ ID NO: 3181557 - RNA, 20 nt, Human
agccgagauugcaccacugc

SEQ ID NO: 3181558 - RNA, 19 nt, Human
agccgagauugcaccacug

SEQ ID NO: 3181559 - RNA, 21 nt, Human
agccgagaucacgccacugca

SEQ ID NO: 3181560 - RNA, 17 nt, Human
agccucccgaguagcug

SEQ ID NO: 3181561 - RNA, 22 nt, Human
agccucccgaauagcugggacu

SEQ ID NO: 3181562 - RNA, 20 nt, Human
agccucccgaauagcuggga

SEQ ID NO: 3181563 - RNA, 19 nt, Human
agccucccgaauagcuggg

SEQ ID NO: 3181564 - RNA, 18 nt, Human
agccucccgaauagcugg

SEQ ID NO: 3181565 - RNA, 17 nt, Human
agccucccaaagugcug

SEQ ID NO: 3181566 - RNA, 22 nt, Human
agccucccgaguagcugggacu

SEQ ID NO: 3181567 - RNA, 13 nt, Human
agccucccuccgc

SEQ ID NO: 3181568 - RNA, 18 nt, Human
accccgaccaccugccca

SEQ ID NO: 3181569 - RNA, 22 nt, Human
accccgcaagcaccauccccuc

SEQ ID NO: 3181570 - RNA, 15 nt, Human
accccggccaccugc

SEQ ID NO: 3181571 - RNA, 22 nt, Human
accccuaaagagauacuuugau

SEQ ID NO: 3181572 - RNA, 16 nt, Human
acccaaguccaagcau

SEQ ID NO: 3181573 - RNA, 23 nt, Human
acccaagggccuggccugagcug

SEQ ID NO: 3181574 - RNA, 13 nt, Human
acccaagggccug

SEQ ID NO: 3181575 - RNA, 16 nt, Human
acccaagggccuggcc

SEQ ID NO: 3181576 - RNA, 16 nt, Human
acccaugaaagaaaac

SEQ ID NO: 3181577 - RNA, 17 nt, Human
acccaugcugcccugug

SEQ ID NO: 3181578 - RNA, 18 nt, Human
acccaugcugcccuguga

SEQ ID NO: 3181579 - RNA, 22 nt, Human
acccaugaaagaaaacuuuuau

SEQ ID NO: 3181580 - RNA, 19 nt, Human
acccaugcugcccugugag

SEQ ID NO: 3181581 - RNA, 16 nt, Human
acccaugcugcccugu

SEQ ID NO: 3181582 - RNA, 18 nt, Human
acccauggaaaaaugcca

SEQ ID NO: 3181583 - RNA, 13 nt, Human
acccaugggcagg

SEQ ID NO: 3181584 - RNA, 14 nt, Human
accaucaugucugg

SEQ ID NO: 3181585 - RNA, 18 nt, Human
accaucccugaaggcccc

SEQ ID NO: 3181586 - RNA, 16 nt, Human
accaucccugaaggcc

SEQ ID NO: 3181587 - RNA, 17 nt, Human
accaucaugucuggcua

SEQ ID NO: 3181588 - RNA, 16 nt, Human
accaucaugucuggcu

SEQ ID NO: 3181589 - RNA, 21 nt, Human
accaucccugaaggccccgcc

SEQ ID NO: 3181590 - RNA, 22 nt, Human
accaucccugaaggccccgccc

SEQ ID NO: 3181591 - RNA, 15 nt, Human
acccaagcaggaggc

SEQ ID NO: 3181592 - RNA, 15 nt, Human
acccaagcuccaacc

SEQ ID NO: 3181593 - RNA, 18 nt, Human
acagguuugggaccccug

SEQ ID NO: 3181594 - RNA, 15 nt, Human
acagguuugggaccc

SEQ ID NO: 3181595 - RNA, 18 nt, Human
acagguuuuaaaagccuu

SEQ ID NO: 3181596 - RNA, 11 nt, Human
acauaaacauc

SEQ ID NO: 3181597 - RNA, 12 nt, Human
acauaaacauca

SEQ ID NO: 3181598 - RNA, 16 nt, Human
acauaaaccauuuuug

SEQ ID NO: 3181599 - RNA, 21 nt, Human
acauaaaccauuuuuguuacu

SEQ ID NO: 3181600 - RNA, 22 nt, Human
acauaaaccauuuuuguuacuc

SEQ ID NO: 3181601 - RNA, 19 nt, Human
acauccacagucuccccca

SEQ ID NO: 3181602 - RNA, 15 nt, Human
acauccacagucucc

SEQ ID NO: 3181603 - RNA, 13 nt, Human
acauccacucucu

SEQ ID NO: 3181604 - RNA, 22 nt, Human
acauccacucucucuuguucuu

SEQ ID NO: 3181605 - RNA, 19 nt, Human
acauccacucucucuuguu

SEQ ID NO: 3181606 - RNA, 21 nt, Human
acaucccaccccauccuccag

SEQ ID NO: 3181607 - RNA, 20 nt, Human
acaucccaccccauccucca

SEQ ID NO: 3181608 - RNA, 23 nt, Human
acauccugucaucugagaaugaa

SEQ ID NO: 3181609 - RNA, 20 nt, Human
acauccugucaucugagaau

SEQ ID NO: 3181610 - RNA, 22 nt, Human
acauccugucaucugagaauga

SEQ ID NO: 3181611 - RNA, 13 nt, Human
acauguuacaaca

SEQ ID NO: 3181612 - RNA, 19 nt, Human
acauguuacuggauaaauu

SEQ ID NO: 3181613 - RNA, 21 nt, Human
acauguuacuggauaaauugu

SEQ ID NO: 3181614 - RNA, 22 nt, Human
acauguuacuggauaaauuguu

SEQ ID NO: 3181615 - RNA, 11 nt, Human
acauguuacug

SEQ ID NO: 3181616 - RNA, 21 nt, Human
acauguuuuucuucucccuca

SEQ ID NO: 3181617 - RNA, 20 nt, Human
acaugcacagcuaacaugga

SEQ ID NO: 3181618 - RNA, 15 nt, Human
acaugcacacucaug

SEQ ID NO: 3181619 - RNA, 19 nt, Human
acauguuuuucuucucccu

SEQ ID NO: 3181620 - RNA, 23 nt, Human
acauuaaaaaaaaucaucauuau

SEQ ID NO: 3181621 - RNA, 18 nt, Human
accaagccuggucagccc

SEQ ID NO: 3181622 - RNA, 20 nt, Human
accaagccuggucagcccaa

SEQ ID NO: 3181623 - RNA, 19 nt, Human
accaagccuggucagccca

SEQ ID NO: 3181624 - RNA, 20 nt, Human
accaacugugaugucacuga

SEQ ID NO: 3181625 - RNA, 13 nt, Human
accaacuuucaag

SEQ ID NO: 3181626 - RNA, 12 nt, Human
accaacuuucaa

SEQ ID NO: 3181627 - RNA, 20 nt, Human
accaacuuucaagaacuugu

SEQ ID NO: 3181628 - RNA, 15 nt, Human
accaacuuucaagaa

SEQ ID NO: 3181629 - RNA, 14 nt, Human
accaacuuucaaga

SEQ ID NO: 3181630 - RNA, 14 nt, Human
accacgcccggcua

SEQ ID NO: 3181631 - RNA, 20 nt, Human
accacgcccggcuaauuuuu

SEQ ID NO: 3181632 - RNA, 13 nt, Human
accagcagccugg

SEQ ID NO: 3181633 - RNA, 14 nt, Human
accagcagccugga

SEQ ID NO: 3181634 - RNA, 17 nt, Human
accagcagccuggaccc

SEQ ID NO: 3181635 - RNA, 18 nt, Human
accagcagucugccugga

SEQ ID NO: 3181636 - RNA, 21 nt, Human
accaacgucugugccauuuug

SEQ ID NO: 3181637 - RNA, 19 nt, Human
acauuugguaauguuuuua

SEQ ID NO: 3181638 - RNA, 17 nt, Human
acauuugguaauguuuu

SEQ ID NO: 3181639 - RNA, 15 nt, Human
accaacugucacugu

SEQ ID NO: 3181640 - RNA, 14 nt, Human
acauuugguaaugu

SEQ ID NO: 3181641 - RNA, 22 nt, Human
acaacuuucacuauaaugugaa

SEQ ID NO: 3181642 - RNA, 15 nt, Human
acaaguaauuucagu

SEQ ID NO: 3181643 - RNA, 16 nt, Human
acaaguaauuucagug

SEQ ID NO: 3181644 - RNA, 11 nt, Human
acaaguacugg

SEQ ID NO: 3181645 - RNA, 18 nt, Human
acaaguacugguaagauu

SEQ ID NO: 3181646 - RNA, 16 nt, Human
acaaguaguucuguau

SEQ ID NO: 3181647 - RNA, 23 nt, Human
acaaguaguucuguauuugaaag

SEQ ID NO: 3181648 - RNA, 21 nt, Human
acaaguaguucuguauuugaa

SEQ ID NO: 3181649 - RNA, 22 nt, Human
acaaguaguucuguauuugaaa

SEQ ID NO: 3181650 - RNA, 17 nt, Human
acaaguaguucuguauu

SEQ ID NO: 3181651 - RNA, 18 nt, Human
acaaguaguucuguauuu

SEQ ID NO: 3181652 - RNA, 19 nt, Human
acaaguaguucuguauuug

SEQ ID NO: 3181653 - RNA, 20 nt, Human
acaaguaguucuguauuuga

SEQ ID NO: 3181654 - RNA, 23 nt, Human
acaaguaugaauaaagacaccua

SEQ ID NO: 3181655 - RNA, 21 nt, Human
acaaguaugaauaaagacacc

SEQ ID NO: 3181656 - RNA, 17 nt, Human
acaagucccuguaauug

SEQ ID NO: 3181657 - RNA, 16 nt, Human
acaagucccuguaauu

SEQ ID NO: 3181658 - RNA, 21 nt, Human
aauuuuauaaggacuuccuga

SEQ ID NO: 3181659 - RNA, 15 nt, Human
aauuuuagaaauauu

SEQ ID NO: 3181660 - RNA, 16 nt, Human
aauuuuagaaauauuc

SEQ ID NO: 3181661 - RNA, 17 nt, Human
aauuuuagaaauauuca

SEQ ID NO: 3181662 - RNA, 13 nt, Human
aauuauaauguau

SEQ ID NO: 3181663 - RNA, 12 nt, Human
aauuauaaugua

SEQ ID NO: 3181664 - RNA, 20 nt, Human
aauuauaaacucauuuugcu

SEQ ID NO: 3181665 - RNA, 16 nt, Human
aauuuugauaguggga

SEQ ID NO: 3181666 - RNA, 20 nt, Human
aauuuugaaaaguaauauuu

SEQ ID NO: 3181667 - RNA, 21 nt, Human
aauuuugaaaaguaauauuua

SEQ ID NO: 3181668 - RNA, 13 nt, Human
aauuuugaaaagu

SEQ ID NO: 3181669 - RNA, 12 nt, Human
aauuuucuuuca

SEQ ID NO: 3181670 - RNA, 22 nt, Human
aauuuugaaaaguaauauuuau

SEQ ID NO: 3181671 - RNA, 12 nt, Human
aauuuugacacu

SEQ ID NO: 3181672 - RNA, 13 nt, Human
acaaaauguaacu

SEQ ID NO: 3181673 - RNA, 12 nt, Human
acaaaauguaac

SEQ ID NO: 3181674 - RNA, 20 nt, Human
acaaaauguaacuguuacca

SEQ ID NO: 3181675 - RNA, 17 nt, Human
acaaaauguaacuguua

SEQ ID NO: 3181676 - RNA, 16 nt, Human
acaaaauguaacuguu

SEQ ID NO: 3181677 - RNA, 14 nt, Human
acaaaauguaacug

SEQ ID NO: 3181678 - RNA, 23 nt, Human
acaaaauguaacuguuaccauug

SEQ ID NO: 3181679 - RNA, 18 nt, Human
acaacuaugauuuggaaa

SEQ ID NO: 3181680 - RNA, 20 nt, Human
acaaagagcguugaaguuga

SEQ ID NO: 3181681 - RNA, 15 nt, Human
acaaacgggcucagc

SEQ ID NO: 3181682 - RNA, 21 nt, Human
acaaaccuguuucugcagcca

SEQ ID NO: 3181683 - RNA, 22 nt, Human
acaauuuucagauuugcacaaa

SEQ ID NO: 3181684 - RNA, 21 nt, Human
acaauuuucagauuugcacaa

SEQ ID NO: 3181685 - RNA, 20 nt, Human
acaauuuucagauuugcaca

SEQ ID NO: 3181686 - RNA, 19 nt, Human
acaauuuucagauuugcac

SEQ ID NO: 3181687 - RNA, 18 nt, Human
acaauuuucagauuugca

SEQ ID NO: 3181688 - RNA, 17 nt, Human
acaauuuucagauuugc

SEQ ID NO: 3181689 - RNA, 16 nt, Human
acaauuuucagauuug

SEQ ID NO: 3181690 - RNA, 15 nt, Human
acaauuuucagauuu

SEQ ID NO: 3181691 - RNA, 14 nt, Human
acaauuuucagauu

SEQ ID NO: 3181692 - RNA, 13 nt, Human
acaauuuucagau

SEQ ID NO: 3181693 - RNA, 18 nt, Human
acacaaacgggcucagca

SEQ ID NO: 3181694 - RNA, 16 nt, Human
acaauguuuuaacaag

SEQ ID NO: 3181695 - RNA, 13 nt, Human
acaauguuuacaa

SEQ ID NO: 3181696 - RNA, 16 nt, Human
acaauuacuuuagaaa

SEQ ID NO: 3181697 - RNA, 13 nt, Human
acaauuucugugu

SEQ ID NO: 3181698 - RNA, 16 nt, Human
acaauuucuuuugguu

SEQ ID NO: 3181699 - RNA, 13 nt, Human
acaauuucuuuug

SEQ ID NO: 3181700 - RNA, 20 nt, Human
acaaugugacuuugaaaaua

SEQ ID NO: 3181701 - RNA, 17 nt, Human
acaaugugacuuugaaa

SEQ ID NO: 3181702 - RNA, 12 nt, Human
acaccagagccc

SEQ ID NO: 3181703 - RNA, 16 nt, Human
acacgcuccuuccucu

SEQ ID NO: 3181704 - RNA, 17 nt, Human
acacgcuccuuccucug

SEQ ID NO: 3181705 - RNA, 19 nt, Human
acacgcuccuuccucugag

SEQ ID NO: 3181706 - RNA, 22 nt, Human
acacgcugcucugccccagcuu

SEQ ID NO: 3181707 - RNA, 18 nt, Human
acacgcugcucugcccca

SEQ ID NO: 3181708 - RNA, 17 nt, Human
acacgcugcucugcccc

SEQ ID NO: 3181709 - RNA, 12 nt, Human
acacgcugccuu

SEQ ID NO: 3181710 - RNA, 23 nt, Human
acacgcugcucugccccagcuug

SEQ ID NO: 3181711 - RNA, 12 nt, Human
acacagcucugu

SEQ ID NO: 3181712 - RNA, 11 nt, Human
acacagcucug

SEQ ID NO: 3181713 - RNA, 22 nt, Human
acaccaaucuuacuuuguaaau

SEQ ID NO: 3181714 - RNA, 23 nt, Human
acaccaaucuuacuuuguaaauu

SEQ ID NO: 3181715 - RNA, 20 nt, Human
acaccaaucuuacuuuguaa

SEQ ID NO: 3181716 - RNA, 18 nt, Human
acaccaaucuuacuuugu

SEQ ID NO: 3181717 - RNA, 23 nt, Human
acacagaaggggacugccaccuc

SEQ ID NO: 3181718 - RNA, 14 nt, Human
acacuaaccacgcu

SEQ ID NO: 3181719 - RNA, 15 nt, Human
acacggacacucaaa

SEQ ID NO: 3181720 - RNA, 21 nt, Human
acacuaaauguuaaagaugua

SEQ ID NO: 3181721 - RNA, 20 nt, Human
acacuaaauguuaaagaugu

SEQ ID NO: 3181722 - RNA, 19 nt, Human
acacuaaauguuaaagaug

SEQ ID NO: 3181723 - RNA, 18 nt, Human
acacuaaauguuaaagau

SEQ ID NO: 3181724 - RNA, 12 nt, Human
acacuaaauguu

SEQ ID NO: 3181725 - RNA, 15 nt, Human
acacuaaauguuaaa

SEQ ID NO: 3181726 - RNA, 13 nt, Human
acacuaaauguua

SEQ ID NO: 3181727 - RNA, 23 nt, Human
acacggagcggauugcaaagcaa

SEQ ID NO: 3181728 - RNA, 15 nt, Human
acaggggcaggagga

SEQ ID NO: 3181729 - RNA, 16 nt, Human
acagggggccagaaca

SEQ ID NO: 3181730 - RNA, 21 nt, Human
acagggguuccuucugggcau

SEQ ID NO: 3181731 - RNA, 16 nt, Human
acagggguuccuucug

SEQ ID NO: 3181732 - RNA, 13 nt, Human
acagggguuccuu

SEQ ID NO: 3181733 - RNA, 12 nt, Human
acagggguuccu

SEQ ID NO: 3181734 - RNA, 16 nt, Human
acaggcaagcaccucc

SEQ ID NO: 3181735 - RNA, 15 nt, Human
acaggcaagcaccuc

SEQ ID NO: 3181736 - RNA, 18 nt, Human
acaggcaagcaccuccug

SEQ ID NO: 3181737 - RNA, 21 nt, Human
acagcugcucaauaaaguaca

SEQ ID NO: 3181738 - RNA, 15 nt, Human
acagguacuuugucu

SEQ ID NO: 3181739 - RNA, 15 nt, Human
acagguaccaguucu

SEQ ID NO: 3181740 - RNA, 14 nt, Human
acagguacuuuguc

SEQ ID NO: 3181741 - RNA, 17 nt, Human
acagguaccaguucuuu

SEQ ID NO: 3181742 - RNA, 21 nt, Human
acagggucucuagugcuguga

SEQ ID NO: 3181743 - RNA, 19 nt, Human
acagggucucuagugcugu

SEQ ID NO: 3181744 - RNA, 23 nt, Human
acaggugugaaccaccacaccca

SEQ ID NO: 3181745 - RNA, 20 nt, Human
acaggugugaaccaccacac

SEQ ID NO: 3181746 - RNA, 22 nt, Human
acaggugugagccaccacgccc

SEQ ID NO: 3181747 - RNA, 21 nt, Human
acaggugugagccaccacgcc

SEQ ID NO: 3181748 - RNA, 20 nt, Human
acagcucugcauacucauua

SEQ ID NO: 3181749 - RNA, 15 nt, Human
acagcuccuuuucca

SEQ ID NO: 3181750 - RNA, 21 nt, Human
acagcuccuuuuccagagcau

SEQ ID NO: 3181751 - RNA, 20 nt, Human
acagcuccuuuuccagagca

SEQ ID NO: 3181752 - RNA, 23 nt, Human
acagcuccuucuguccuacucug

SEQ ID NO: 3181753 - RNA, 14 nt, Human
acagcugccuggga

SEQ ID NO: 3181754 - RNA, 13 nt, Human
acagcugccuggg

SEQ ID NO: 3181755 - RNA, 23 nt, Human
acagcugccugggaucccucauc

SEQ ID NO: 3181756 - RNA, 14 nt, Human
acagcuccuucugu

SEQ ID NO: 3181757 - RNA, 13 nt, Human
acagcuccuucug

SEQ ID NO: 3181758 - RNA, 12 nt, Human
acagcuccuucu

SEQ ID NO: 3181759 - RNA, 21 nt, Human
acagaggggguggccucccaa

SEQ ID NO: 3181760 - RNA, 16 nt, Human
acagaagugacugaug

SEQ ID NO: 3181761 - RNA, 14 nt, Human
acagagucucacug

SEQ ID NO: 3181762 - RNA, 12 nt, Human
acagagucucac

SEQ ID NO: 3181763 - RNA, 22 nt, Human
acagaggggguggccucccaac

SEQ ID NO: 3181764 - RNA, 15 nt, Human
acagaguaaucuugu

SEQ ID NO: 3181765 - RNA, 15 nt, Human
acagcaguugaaaag

SEQ ID NO: 3181766 - RNA, 19 nt, Human
acagagucucacuguugcc

SEQ ID NO: 3181767 - RNA, 17 nt, Human
acagagucucacuguug

SEQ ID NO: 3181768 - RNA, 22 nt, Human
acagcagucuuaugcuuccaga

SEQ ID NO: 3181769 - RNA, 20 nt, Human
acagcagucuuaugcuucca

SEQ ID NO: 3181770 - RNA, 16 nt, Human
acagccagacuggcac

SEQ ID NO: 3181771 - RNA, 20 nt, Human
acagccagaacucugugucc

SEQ ID NO: 3181772 - RNA, 14 nt, Human
acagccacucagaa

SEQ ID NO: 3181773 - RNA, 15 nt, Human
acagccagacuggca

SEQ ID NO: 3181774 - RNA, 13 nt, Human
acagccagacugg

SEQ ID NO: 3181775 - RNA, 19 nt, Human
acagccacggccaggccag

SEQ ID NO: 3181776 - RNA, 12 nt, Human
acagccacucag

SEQ ID NO: 3181777 - RNA, 23 nt, Human
acagcauuuguguguuacaaugu

SEQ ID NO: 3181778 - RNA, 14 nt, Human
acagcauguguuaa

SEQ ID NO: 3181779 - RNA, 16 nt, Human
acagcauguguuaauc

SEQ ID NO: 3181780 - RNA, 21 nt, Human
acagcauguguuaaucuuaau

SEQ ID NO: 3181781 - RNA, 17 nt, Human
acagcauuuguguguua

SEQ ID NO: 3181782 - RNA, 15 nt, Human
acagccaugauucuu

SEQ ID NO: 3181783 - RNA, 20 nt, Human
acagccauaggcccuuucag

SEQ ID NO: 3181784 - RNA, 15 nt, Human
acacugauccagccc

SEQ ID NO: 3181785 - RNA, 19 nt, Human
acacugagagccuuuuuga

SEQ ID NO: 3181786 - RNA, 17 nt, Human
acacugaagucaguucu

SEQ ID NO: 3181787 - RNA, 22 nt, Human
acacugaauuuuuaugugugau

SEQ ID NO: 3181788 - RNA, 21 nt, Human
acacugaauuuuuauguguga

SEQ ID NO: 3181789 - RNA, 20 nt, Human
acacugaauuuuuaugugug

SEQ ID NO: 3181790 - RNA, 16 nt, Human
acacugaauuuuuaug

SEQ ID NO: 3181791 - RNA, 16 nt, Human
acacugccugccuuaa

SEQ ID NO: 3181792 - RNA, 20 nt, Human
acacugccugccuuaaguga

SEQ ID NO: 3181793 - RNA, 15 nt, Human
acacugccugccuua

SEQ ID NO: 3181794 - RNA, 22 nt, Human
acacugugaagagcuggacucc

SEQ ID NO: 3181795 - RNA, 21 nt, Human
acacugugacaucucuauucc

SEQ ID NO: 3181796 - RNA, 16 nt, Human
acacugugacaucucu

SEQ ID NO: 3181797 - RNA, 23 nt, Human
acagaaauugguaccuugcacac

SEQ ID NO: 3181798 - RNA, 21 nt, Human
acagaacacauaauucaggaa

SEQ ID NO: 3181799 - RNA, 15 nt, Human
acgcugugcugcccu

SEQ ID NO: 3181800 - RNA, 16 nt, Human
acgcugugcugcccug

SEQ ID NO: 3181801 - RNA, 17 nt, Human
acgcugugcugcccugc

SEQ ID NO: 3181802 - RNA, 18 nt, Human
acgcugugcugcccugcc

SEQ ID NO: 3181803 - RNA, 11 nt, Human
acguggcugcu

SEQ ID NO: 3181804 - RNA, 19 nt, Human
acgugcacaaauucaugug

SEQ ID NO: 3181805 - RNA, 21 nt, Human
acuaagaggaaaguacauuuu

SEQ ID NO: 3181806 - RNA, 20 nt, Human
acuaagaggaaaguacauuu

SEQ ID NO: 3181807 - RNA, 22 nt, Human
acuaagaucgguuaacaaauaa

SEQ ID NO: 3181808 - RNA, 21 nt, Human
acuaagaucgguuaacaaaua

SEQ ID NO: 3181809 - RNA, 20 nt, Human
acuaagaucgguuaacaaau

SEQ ID NO: 3181810 - RNA, 19 nt, Human
acuaagaucgguuaacaaa

SEQ ID NO: 3181811 - RNA, 17 nt, Human
acuaagaucgguuaaca

SEQ ID NO: 3181812 - RNA, 13 nt, Human
acguggcugcuuc

SEQ ID NO: 3181813 - RNA, 14 nt, Human
acguggcugcuuca

SEQ ID NO: 3181814 - RNA, 15 nt, Human
acguggcugcuucaa

SEQ ID NO: 3181815 - RNA, 12 nt, Human
acuaauaaaaua

SEQ ID NO: 3181816 - RNA, 13 nt, Human
acuaauaaaauau

SEQ ID NO: 3181817 - RNA, 14 nt, Human
acuaauaaaauauu

SEQ ID NO: 3181818 - RNA, 15 nt, Human
acuaauaaaauauuu

SEQ ID NO: 3181819 - RNA, 16 nt, Human
acuaauaaaauauuuu

SEQ ID NO: 3181820 - RNA, 17 nt, Human
acuaauaaaauauuuuc

SEQ ID NO: 3181821 - RNA, 18 nt, Human
acuaauaaaauauuuucu

SEQ ID NO: 3181822 - RNA, 19 nt, Human
acuaauaaaauauuuucug

SEQ ID NO: 3181823 - RNA, 20 nt, Human
acuaauaaaauauuuucugu

SEQ ID NO: 3181824 - RNA, 21 nt, Human
acuaauaaaauauuuucugug

SEQ ID NO: 3181825 - RNA, 22 nt, Human
acuaauaaaauauuuucugugu

SEQ ID NO: 3181826 - RNA, 23 nt, Human
acuaauaaaauauuuucugugug

SEQ ID NO: 3181827 - RNA, 13 nt, Human
acuaagauucuuu

SEQ ID NO: 3181828 - RNA, 17 nt, Human
acuaagauucuuuuaaa

SEQ ID NO: 3181829 - RNA, 21 nt, Human
acuaagauucuuuuaaauuag

SEQ ID NO: 3181830 - RNA, 18 nt, Human
acgccacugcacuauagc

SEQ ID NO: 3181831 - RNA, 14 nt, Human
acgauuuaauuuau

SEQ ID NO: 3181832 - RNA, 13 nt, Human
acgauuuaauuua

SEQ ID NO: 3181833 - RNA, 19 nt, Human
acgauucauuuuugaaacu

SEQ ID NO: 3181834 - RNA, 20 nt, Human
acgauucauuuuugaaacug

SEQ ID NO: 3181835 - RNA, 14 nt, Human
acgauccuucaaag

SEQ ID NO: 3181836 - RNA, 15 nt, Human
acgauccuucaaagu

SEQ ID NO: 3181837 - RNA, 16 nt, Human
acgauccuucaaaguc

SEQ ID NO: 3181838 - RNA, 19 nt, Human
acgaucacaaaugacuuua

SEQ ID NO: 3181839 - RNA, 12 nt, Human
accuuggcugca

SEQ ID NO: 3181840 - RNA, 14 nt, Human
accuuggcucaagu

SEQ ID NO: 3181841 - RNA, 12 nt, Human
accuuggcucaa

SEQ ID NO: 3181842 - RNA, 20 nt, Human
accugccccuccucucugcc

SEQ ID NO: 3181843 - RNA, 20 nt, Human
accuguaaugacaggccugu

SEQ ID NO: 3181844 - RNA, 15 nt, Human
accuguaaugacagg

SEQ ID NO: 3181845 - RNA, 16 nt, Human
accuuucaauaggaaa

SEQ ID NO: 3181846 - RNA, 12 nt, Human
accuuuauucug

SEQ ID NO: 3181847 - RNA, 13 nt, Human
accuuuauucugg

SEQ ID NO: 3181848 - RNA, 15 nt, Human
accuuguaauguaac

SEQ ID NO: 3181849 - RNA, 18 nt, Human
accuugucauuuuggucu

SEQ ID NO: 3181850 - RNA, 22 nt, Human
accuuguaauguaacugcucuu

SEQ ID NO: 3181851 - RNA, 17 nt, Human
accuuguaauguaacug

SEQ ID NO: 3181852 - RNA, 16 nt, Human
accuuguaauguaacu

SEQ ID NO: 3181853 - RNA, 17 nt, Human
accuuucaauaggaaaa

SEQ ID NO: 3181854 - RNA, 21 nt, Human
accuuucaauaggaaaaacug

SEQ ID NO: 3181855 - RNA, 23 nt, Human
accuuucaauaggaaaaacugau

SEQ ID NO: 3181856 - RNA, 16 nt, Human
accucugcacaagcug

SEQ ID NO: 3181857 - RNA, 18 nt, Human
accucugcacaagcugca

SEQ ID NO: 3181858 - RNA, 21 nt, Human
accucugcacaagcugcaccc

SEQ ID NO: 3181859 - RNA, 23 nt, Human
accugccccucaacucuccucca

SEQ ID NO: 3181860 - RNA, 14 nt, Human
accugccccuccuc

SEQ ID NO: 3181861 - RNA, 18 nt, Human
accugccccuccucucug

SEQ ID NO: 3181862 - RNA, 20 nt, Human
accugccccucaacucuccu

SEQ ID NO: 3181863 - RNA, 21 nt, Human
accugcccaaccugcucuccu

SEQ ID NO: 3181864 - RNA, 17 nt, Human
accucuuccuggccggu

SEQ ID NO: 3181865 - RNA, 13 nt, Human
accugcccaaccu

SEQ ID NO: 3181866 - RNA, 13 nt, Human
acuccccugcugg

SEQ ID NO: 3181867 - RNA, 17 nt, Human
acuccccugcugggugu

SEQ ID NO: 3181868 - RNA, 19 nt, Human
acuccccgccguacaguuc

SEQ ID NO: 3181869 - RNA, 21 nt, Human
acuccccagccagccuggcug

SEQ ID NO: 3181870 - RNA, 17 nt, Human
acuccccagccagccug

SEQ ID NO: 3181871 - RNA, 14 nt, Human
acucccccaggugg

SEQ ID NO: 3181872 - RNA, 16 nt, Human
acucaggcccaaagcc

SEQ ID NO: 3181873 - RNA, 17 nt, Human
acucaggcccaaagccu

SEQ ID NO: 3181874 - RNA, 13 nt, Human
acucagucuuuaa

SEQ ID NO: 3181875 - RNA, 14 nt, Human
acucaguggggagg

SEQ ID NO: 3181876 - RNA, 17 nt, Human
acucaaacucuuaaaac

SEQ ID NO: 3181877 - RNA, 16 nt, Human
acucaaacucuuaaaa

SEQ ID NO: 3181878 - RNA, 18 nt, Human
acucaaaagcugggcagg

SEQ ID NO: 3181879 - RNA, 14 nt, Human
acuaguuuuuccua

SEQ ID NO: 3181880 - RNA, 21 nt, Human
acuaguuuuuccuaucauguu

SEQ ID NO: 3181881 - RNA, 23 nt, Human
acuauaacauagaauugcaaucu

SEQ ID NO: 3181882 - RNA, 19 nt, Human
acuauaacauagaauugca

SEQ ID NO: 3181883 - RNA, 22 nt, Human
acucagcaccacucaagaccaa

SEQ ID NO: 3181884 - RNA, 21 nt, Human
acucagcaccacucaagacca

SEQ ID NO: 3181885 - RNA, 17 nt, Human
acucagcaccacucaag

SEQ ID NO: 3181886 - RNA, 14 nt, Human
acucagcaccacuc

SEQ ID NO: 3181887 - RNA, 19 nt, Human
acucaaagcaaaagugcug

SEQ ID NO: 3181888 - RNA, 23 nt, Human
acuagccaacggccccagcuucu

SEQ ID NO: 3181889 - RNA, 21 nt, Human
acuagccaacggccccagcuu

SEQ ID NO: 3181890 - RNA, 15 nt, Human
acuaggguccugggg

SEQ ID NO: 3181891 - RNA, 16 nt, Human
acuaggguccugggga

SEQ ID NO: 3181892 - RNA, 16 nt, Human
acuaggcauuuguaaa

SEQ ID NO: 3181893 - RNA, 23 nt, Human
acuaggcauuuguaaauauuaaa

SEQ ID NO: 3181894 - RNA, 15 nt, Human
acuaggaaggcacuu

SEQ ID NO: 3181895 - RNA, 21 nt, Human
acucuacccucuuagaaaaac

SEQ ID NO: 3181896 - RNA, 13 nt, Human
acucuacccucuu

SEQ ID NO: 3181897 - RNA, 18 nt, Human
acucuacccucuuagaaa

SEQ ID NO: 3181898 - RNA, 16 nt, Human
acucugugucaggugg

SEQ ID NO: 3181899 - RNA, 11 nt, Human
acucuuaaaac

SEQ ID NO: 3181900 - RNA, 18 nt, Human
acucuuaaaacccaagug

SEQ ID NO: 3181901 - RNA, 20 nt, Human
acucuggcagcucagagagg

SEQ ID NO: 3181902 - RNA, 22 nt, Human
acucuauaagcaaauugcuuuu

SEQ ID NO: 3181903 - RNA, 11 nt, Human
acucugggaac

SEQ ID NO: 3181904 - RNA, 22 nt, Human
acucugggaacuucuuugcagu

SEQ ID NO: 3181905 - RNA, 12 nt, Human
acucccuuucaa

SEQ ID NO: 3181906 - RNA, 13 nt, Human
acucccuuucaac

SEQ ID NO: 3181907 - RNA, 21 nt, Human
acucccgagacggcacugaga

SEQ ID NO: 3181908 - RNA, 22 nt, Human
acucccguguaggaaccugcac

SEQ ID NO: 3181909 - RNA, 18 nt, Human
acuucugccauauucugu

SEQ ID NO: 3181910 - RNA, 12 nt, Human
acuucugccaga

SEQ ID NO: 3181911 - RNA, 19 nt, Human
acuucugccagauguccua

SEQ ID NO: 3181912 - RNA, 16 nt, Human
acuucugacucuuccc

SEQ ID NO: 3181913 - RNA, 18 nt, Human
acuucugacucuucccca

SEQ ID NO: 3181914 - RNA, 17 nt, Human
acuucuuucccuuccuc

SEQ ID NO: 3181915 - RNA, 12 nt, Human
acuucuuucccu

SEQ ID NO: 3181916 - RNA, 14 nt, Human
acuucuuugcaguu

SEQ ID NO: 3181917 - RNA, 19 nt, Human
acuucuuucccuuccucca

SEQ ID NO: 3181918 - RNA, 18 nt, Human
acuucuuucccuuccucc

SEQ ID NO: 3181919 - RNA, 21 nt, Human
acuucuuugcaguucccaucu

SEQ ID NO: 3181920 - RNA, 15 nt, Human
acuuggucugugaga

SEQ ID NO: 3181921 - RNA, 14 nt, Human
acuuggucugugag

SEQ ID NO: 3181922 - RNA, 13 nt, Human
acuuggucuguga

SEQ ID NO: 3181923 - RNA, 18 nt, Human
acuuguaaaugugguaaa

SEQ ID NO: 3181924 - RNA, 20 nt, Human
acuuguaaaugugguaaaga

SEQ ID NO: 3181925 - RNA, 13 nt, Human
acuguuuagauuu

SEQ ID NO: 3181926 - RNA, 16 nt, Human
acuguuuaagacacuu

SEQ ID NO: 3181927 - RNA, 13 nt, Human
acuguuguauaaa

SEQ ID NO: 3181928 - RNA, 19 nt, Human
acuguuguauaaauuuauu

SEQ ID NO: 3181929 - RNA, 15 nt, Human
acuguuguauaaauu

SEQ ID NO: 3181930 - RNA, 19 nt, Human
acuguuuagauuugccaua

SEQ ID NO: 3181931 - RNA, 20 nt, Human
acuguuuagauuugccauag

SEQ ID NO: 3181932 - RNA, 22 nt, Human
acuguuuguuccagaaucugua

SEQ ID NO: 3181933 - RNA, 12 nt, Human
acuggaacucuc

SEQ ID NO: 3181934 - RNA, 14 nt, Human
acuggaagcacagc

SEQ ID NO: 3181935 - RNA, 15 nt, Human
acuggaagcacagcu

SEQ ID NO: 3181936 - RNA, 20 nt, Human
acugcccccucugcccugcg

SEQ ID NO: 3181937 - RNA, 19 nt, Human
acugcccccucugcccugc

SEQ ID NO: 3181938 - RNA, 18 nt, Human
acugcccccucugcccug

SEQ ID NO: 3181939 - RNA, 23 nt, Human
acugccaccuccccuugccagcu

SEQ ID NO: 3181940 - RNA, 11 nt, Human
acugccaccuc

SEQ ID NO: 3181941 - RNA, 13 nt, Human
acugccaccuccc

SEQ ID NO: 3181942 - RNA, 12 nt, Human
acugccaccucc

SEQ ID NO: 3181943 - RNA, 15 nt, Human
acugaagucaguucu

SEQ ID NO: 3181944 - RNA, 21 nt, Human
acugaaggccacuugaguugg

SEQ ID NO: 3181945 - RNA, 13 nt, Human
acugaaggccacu

SEQ ID NO: 3181946 - RNA, 14 nt, Human
acugcauuuaggga

SEQ ID NO: 3181947 - RNA, 19 nt, Human
acugcauuuagggaguauu

SEQ ID NO: 3181948 - RNA, 12 nt, Human
acugcauuugug

SEQ ID NO: 3181949 - RNA, 18 nt, Human
acugccaaccucgcucca

SEQ ID NO: 3181950 - RNA, 14 nt, Human
acugccaaccucgc

SEQ ID NO: 3181951 - RNA, 16 nt, Human
acugcauuuagggagu

SEQ ID NO: 3181952 - RNA, 20 nt, Human
acugccacaaggaagaaauu

SEQ ID NO: 3181953 - RNA, 18 nt, Human
acugccacaaggaagaaa

SEQ ID NO: 3181954 - RNA, 17 nt, Human
acugccacaaggaagaa

SEQ ID NO: 3181955 - RNA, 15 nt, Human
acugccacaaggaag

SEQ ID NO: 3181956 - RNA, 17 nt, Human
acugccaacugaucugu

SEQ ID NO: 3181957 - RNA, 19 nt, Human
acugccaacugaucuguua

SEQ ID NO: 3181958 - RNA, 12 nt, Human
acugucuucagu

SEQ ID NO: 3181959 - RNA, 12 nt, Human
acugucugucug

SEQ ID NO: 3181960 - RNA, 16 nt, Human
acugugcaguugcugu

SEQ ID NO: 3181961 - RNA, 13 nt, Human
acugugauuugaa

SEQ ID NO: 3181962 - RNA, 16 nt, Human
acugguaagauuguua

SEQ ID NO: 3181963 - RNA, 17 nt, Human
acugguaagauuguuau

SEQ ID NO: 3181964 - RNA, 18 nt, Human
acugguaagauuguuauu

SEQ ID NO: 3181965 - RNA, 20 nt, Human
acugguggcccgacagccug

SEQ ID NO: 3181966 - RNA, 22 nt, Human
acugguggcccgacagccuggc

SEQ ID NO: 3181967 - RNA, 21 nt, Human
acugguggcccgacagccugg

SEQ ID NO: 3181968 - RNA, 23 nt, Human
acugguggcccgacagccuggca

SEQ ID NO: 3181969 - RNA, 17 nt, Human
acuguccuguugauuaa

SEQ ID NO: 3181970 - RNA, 22 nt, Human
acuguccuguugauuaauuucu

SEQ ID NO: 3181971 - RNA, 24 nt, Human
acugucuagcacuuccuugccagu

SEQ ID NO: 3181972 - RNA, 21 nt, Human
acugucuagcacuuccuugcc

SEQ ID NO: 3181973 - RNA, 19 nt, Human
acugucuagcacuuccuug

SEQ ID NO: 3181974 - RNA, 18 nt, Human
acugucuagcacuuccuu

SEQ ID NO: 3181975 - RNA, 17 nt, Human
acugucuagcacuuccu

SEQ ID NO: 3181976 - RNA, 11 nt, Human
agaaaauauuc

SEQ ID NO: 3181977 - RNA, 14 nt, Human
agaaaauauucucu

SEQ ID NO: 3181978 - RNA, 16 nt, Human
agaaaauguucuucca

SEQ ID NO: 3181979 - RNA, 22 nt, Human
agaaaauggacguguuaugacu

SEQ ID NO: 3181980 - RNA, 23 nt, Human
agaaaauggacguguuaugacuc

SEQ ID NO: 3181981 - RNA, 15 nt, Human
agaaacaaacaaaag

SEQ ID NO: 3181982 - RNA, 23 nt, Human
agaaaauggaagacagcucuuau

SEQ ID NO: 3181983 - RNA, 22 nt, Human
agaaaauaugucccagaaaugu

SEQ ID NO: 3181984 - RNA, 14 nt, Human
agaaaauauguauu

SEQ ID NO: 3181985 - RNA, 15 nt, Human
agaaaauggacgugu

SEQ ID NO: 3181986 - RNA, 20 nt, Human
agaaaauggacguguuauga

SEQ ID NO: 3181987 - RNA, 23 nt, Human
acuuuucuaaacuaggcuccuuc

SEQ ID NO: 3181988 - RNA, 22 nt, Human
acuuuuccuugcauacaaacaa

SEQ ID NO: 3181989 - RNA, 21 nt, Human
acuuuuccuugcauacaaaca

SEQ ID NO: 3181990 - RNA, 18 nt, Human
acuuuuccuugcauacaa

SEQ ID NO: 3181991 - RNA, 15 nt, Human
acuuuuccuugcaua

SEQ ID NO: 3181992 - RNA, 14 nt, Human
acuuuuccuugcau

SEQ ID NO: 3181993 - RNA, 13 nt, Human
acuuuuccucuua

SEQ ID NO: 3181994 - RNA, 20 nt, Human
acuuuuccucuuagaagaau

SEQ ID NO: 3181995 - RNA, 12 nt, Human
agaaaagugaau

SEQ ID NO: 3181996 - RNA, 14 nt, Human
agaaaagugaauug

SEQ ID NO: 3181997 - RNA, 15 nt, Human
agaaaagugaauuga

SEQ ID NO: 3181998 - RNA, 19 nt, Human
agaaaagugaauugaaguu

SEQ ID NO: 3181999 - RNA, 21 nt, Human
agaaaaggugauaaaaucaua

SEQ ID NO: 3182000 - RNA, 16 nt, Human
agaaaaggugauaaaa

SEQ ID NO: 3182001 - RNA, 13 nt, Human
agaaaaggucuug

SEQ ID NO: 3182002 - RNA, 22 nt, Human
agaaaauaaaaaaaagaaaaaa

SEQ ID NO: 3182003 - RNA, 21 nt, Human
agaaaauaaaaaaaagaaaaa

SEQ ID NO: 3182004 - RNA, 16 nt, Human
agaaaauaaaaaaaag

SEQ ID NO: 3182005 - RNA, 20 nt, Human
agaaaauaaaaaaaagaaaa

SEQ ID NO: 3182006 - RNA, 19 nt, Human
agaaaauaaaaaaaagaaa

SEQ ID NO: 3182007 - RNA, 18 nt, Human
agaaaauaaaaaaaagaa

SEQ ID NO: 3182008 - RNA, 17 nt, Human
agaaaauaaaaaaaaga

SEQ ID NO: 3182009 - RNA, 20 nt, Human
acuuuagguuuuuuuaauga

SEQ ID NO: 3182010 - RNA, 22 nt, Human
acuuucauauuuuaaacagagg

SEQ ID NO: 3182011 - RNA, 12 nt, Human
acuuuauaaauu

SEQ ID NO: 3182012 - RNA, 13 nt, Human
acuuuauaaauuu

SEQ ID NO: 3182013 - RNA, 14 nt, Human
acuuuauaaauuuc

SEQ ID NO: 3182014 - RNA, 17 nt, Human
acuuuagugcuacagaa

SEQ ID NO: 3182015 - RNA, 23 nt, Human
acuuuccuucauucaacccaccu

SEQ ID NO: 3182016 - RNA, 19 nt, Human
acuuuccaauucuccuuua

SEQ ID NO: 3182017 - RNA, 18 nt, Human
acuuuccaauucuccuuu

SEQ ID NO: 3182018 - RNA, 17 nt, Human
acuuuccaauucuccuu

SEQ ID NO: 3182019 - RNA, 20 nt, Human
acuuuguucuggcucuucca

SEQ ID NO: 3182020 - RNA, 17 nt, Human
acuuucuacucauuuua

SEQ ID NO: 3182021 - RNA, 23 nt, Human
acuuuguucuggcucuuccaggc

SEQ ID NO: 3182022 - RNA, 19 nt, Human
acuuucuacucauuuuaau

SEQ ID NO: 3182023 - RNA, 14 nt, Human
agaaauaaaccuua

SEQ ID NO: 3182024 - RNA, 16 nt, Human
agaaauaaaccuuaau

SEQ ID NO: 3182025 - RNA, 17 nt, Human
agaaauaaaccuuaaua

SEQ ID NO: 3182026 - RNA, 23 nt, Human
agaaauaaaccuuaauauuucuu

SEQ ID NO: 3182027 - RNA, 18 nt, Human
agaaauaaaguuucuguu

SEQ ID NO: 3182028 - RNA, 15 nt, Human
agaaauaaaguuucu

SEQ ID NO: 3182029 - RNA, 23 nt, Human
agaaaggaggggauagagagaga

SEQ ID NO: 3182030 - RNA, 20 nt, Human
agaaaggaggggauagagag

SEQ ID NO: 3182031 - RNA, 16 nt, Human
agaaaggaccugcaaa

SEQ ID NO: 3182032 - RNA, 13 nt, Human
aauuaaagaaaua

SEQ ID NO: 3182033 - RNA, 18 nt, Human
aauguuugccucugccuc

SEQ ID NO: 3182034 - RNA, 16 nt, Human
aauguuugccucugcc

SEQ ID NO: 3182035 - RNA, 19 nt, Human
aauguuugccucugccucu

SEQ ID NO: 3182036 - RNA, 16 nt, Human
aauguuuuaacaagaa

SEQ ID NO: 3182037 - RNA, 14 nt, Human
aauguuuucagcua

SEQ ID NO: 3182038 - RNA, 18 nt, Human
aauuaaaacacaacaucu

SEQ ID NO: 3182039 - RNA, 16 nt, Human
aauuaaacuuccaaag

SEQ ID NO: 3182040 - RNA, 21 nt, Human
aauuaaacuuccaaagaaagu

SEQ ID NO: 3182041 - RNA, 22 nt, Human
aauuaaacuuccaaagaaaguu

SEQ ID NO: 3182042 - RNA, 17 nt, Human
aauguuuuguaaacuuu

SEQ ID NO: 3182043 - RNA, 15 nt, Human
aauguuuuguaaacu

SEQ ID NO: 3182044 - RNA, 13 nt, Human
aauguuuuguaaa

SEQ ID NO: 3182045 - RNA, 14 nt, Human
aauguuuuguaaac

SEQ ID NO: 3182046 - RNA, 14 nt, Human
aauguuuugcuuuu

SEQ ID NO: 3182047 - RNA, 22 nt, Human
aauguuuuuaagaugaucaucu

SEQ ID NO: 3182048 - RNA, 23 nt, Human
aauguuuuguaaacuuugaaaua

SEQ ID NO: 3182049 - RNA, 22 nt, Human
aauguuuuguaaacuuugaaau

SEQ ID NO: 3182050 - RNA, 21 nt, Human
aauguuuuguaaacuuugaaa

SEQ ID NO: 3182051 - RNA, 20 nt, Human
aauguuuuguaaacuuugaa

SEQ ID NO: 3182052 - RNA, 19 nt, Human
aauguuuuguaaacuuuga

SEQ ID NO: 3182053 - RNA, 18 nt, Human
aauguuuuguaaacuuug

SEQ ID NO: 3182054 - RNA, 16 nt, Human
aaugucaguaugugga

SEQ ID NO: 3182055 - RNA, 22 nt, Human
aaugucaguauguggaagugug

SEQ ID NO: 3182056 - RNA, 13 nt, Human
aaugucaguguga

SEQ ID NO: 3182057 - RNA, 15 nt, Human
aaugucagugugacu

SEQ ID NO: 3182058 - RNA, 16 nt, Human
aaugucagugugacug

SEQ ID NO: 3182059 - RNA, 22 nt, Human
aauggugaacugucauuacaga

SEQ ID NO: 3182060 - RNA, 22 nt, Human
aauggucuuucuaaugugugaa

SEQ ID NO: 3182061 - RNA, 12 nt, Human
aauggugauuuu

SEQ ID NO: 3182062 - RNA, 15 nt, Human
aauggugauuuuaaa

SEQ ID NO: 3182063 - RNA, 19 nt, Human
aauggugcauuguauagau

SEQ ID NO: 3182064 - RNA, 13 nt, Human
aauggugauuuua

SEQ ID NO: 3182065 - RNA, 20 nt, Human
aaugucucuuuaaugucaca

SEQ ID NO: 3182066 - RNA, 17 nt, Human
aaugucagugugacuga

SEQ ID NO: 3182067 - RNA, 21 nt, Human
aaugucagugugacugaucuc

SEQ ID NO: 3182068 - RNA, 22 nt, Human
aaugucuaguuguaacaccaug

SEQ ID NO: 3182069 - RNA, 15 nt, Human
aaugggcagagcaga

SEQ ID NO: 3182070 - RNA, 13 nt, Human
aaugggcagagca

SEQ ID NO: 3182071 - RNA, 14 nt, Human
aaugguaguuucug

SEQ ID NO: 3182072 - RNA, 17 nt, Human
aaugguaguuucugugg

SEQ ID NO: 3182073 - RNA, 18 nt, Human
aaugguaguuucuguggu

SEQ ID NO: 3182074 - RNA, 20 nt, Human
aaugguaguuucugugguug

SEQ ID NO: 3182075 - RNA, 12 nt, Human
aaugguaguuuc

SEQ ID NO: 3182076 - RNA, 13 nt, Human
aaugguaguuucu

SEQ ID NO: 3182077 - RNA, 20 nt, Human
aaugguacuccacauauuuc

SEQ ID NO: 3182078 - RNA, 22 nt, Human
aaugguacaaaaccacagugua

SEQ ID NO: 3182079 - RNA, 20 nt, Human
aaugguaacauuuuucaaua

SEQ ID NO: 3182080 - RNA, 18 nt, Human
aauccaggguggugguga

SEQ ID NO: 3182081 - RNA, 21 nt, Human
aaugaugauccuaggcauuug

SEQ ID NO: 3182082 - RNA, 17 nt, Human
aaugaagaauuuaaaga

SEQ ID NO: 3182083 - RNA, 18 nt, Human
aaugaagaauuuaaagaa

SEQ ID NO: 3182084 - RNA, 20 nt, Human
aaugaagagcuguugauggg

SEQ ID NO: 3182085 - RNA, 13 nt, Human
aaugaagaauuua

SEQ ID NO: 3182086 - RNA, 14 nt, Human
aaugaagaauuuaa

SEQ ID NO: 3182087 - RNA, 15 nt, Human
aaugaagaauuuaaa

SEQ ID NO: 3182088 - RNA, 16 nt, Human
aaugaagaauuuaaag

SEQ ID NO: 3182089 - RNA, 15 nt, Human
aaugaagaauucaga

SEQ ID NO: 3182090 - RNA, 23 nt, Human
aaugaaccacaucuugcucugcu

SEQ ID NO: 3182091 - RNA, 17 nt, Human
aaugaaccacaucuugc

SEQ ID NO: 3182092 - RNA, 16 nt, Human
aaugaaccacaucuug

SEQ ID NO: 3182093 - RNA, 22 nt, Human
aaucuggaccccaucugugaau

SEQ ID NO: 3182094 - RNA, 14 nt, Human
aaugaacauuaaca

SEQ ID NO: 3182095 - RNA, 22 nt, Human
aaucugcuuuuuaaagaaugcu

SEQ ID NO: 3182096 - RNA, 21 nt, Human
aaucuggaccccaucugugaa

SEQ ID NO: 3182097 - RNA, 23 nt, Human
aaucugcaaagcauguuuugcau

SEQ ID NO: 3182098 - RNA, 21 nt, Human
aaucugcaaagcauguuuugc

SEQ ID NO: 3182099 - RNA, 19 nt, Human
aaucugcaaagcauguuuu

SEQ ID NO: 3182100 - RNA, 16 nt, Human
aaucugcaaagcaugu

SEQ ID NO: 3182101 - RNA, 19 nt, Human
aaugaugccaugaggaaca

SEQ ID NO: 3182102 - RNA, 19 nt, Human
aauauuauuuguguuuccu

SEQ ID NO: 3182103 - RNA, 20 nt, Human
aauauuauuuguguuuccua

SEQ ID NO: 3182104 - RNA, 16 nt, Human
aaucaacuaguauuug

SEQ ID NO: 3182105 - RNA, 21 nt, Human
aaucaacauggcuacuugcuu

SEQ ID NO: 3182106 - RNA, 20 nt, Human
aaucaaccaccuauuuuuga

SEQ ID NO: 3182107 - RNA, 13 nt, Human
aauaugggagaaa

SEQ ID NO: 3182108 - RNA, 18 nt, Human
aauauggucuuuugguua

SEQ ID NO: 3182109 - RNA, 18 nt, Human
aauauguacauuucuaag

SEQ ID NO: 3182110 - RNA, 16 nt, Human
aauauguacauuucua

SEQ ID NO: 3182111 - RNA, 15 nt, Human
aauauguacauuucu

SEQ ID NO: 3182112 - RNA, 14 nt, Human
aauauguacauuuc

SEQ ID NO: 3182113 - RNA, 19 nt, Human
aauauguacauuucuaagu

SEQ ID NO: 3182114 - RNA, 16 nt, Human
aauauguauuaacacu

SEQ ID NO: 3182115 - RNA, 21 nt, Human
aauauguauucuguaaaagaa

SEQ ID NO: 3182116 - RNA, 14 nt, Human
aaucaagaaacaaa

SEQ ID NO: 3182117 - RNA, 12 nt, Human
aaucaauuuaag

SEQ ID NO: 3182118 - RNA, 13 nt, Human
aaucacaggcugg

SEQ ID NO: 3182119 - RNA, 12 nt, Human
aaucacaggcug

SEQ ID NO: 3182120 - RNA, 21 nt, Human
aaucacaggcugggcugggca

SEQ ID NO: 3182121 - RNA, 14 nt, Human
aauauacaaaacuu

SEQ ID NO: 3182122 - RNA, 14 nt, Human
aauauaauauuguc

SEQ ID NO: 3182123 - RNA, 13 nt, Human
aauauaauauugu

SEQ ID NO: 3182124 - RNA, 17 nt, Human
aauauaauacacaaaau

SEQ ID NO: 3182125 - RNA, 18 nt, Human
aaguaugcauuauuaaau

SEQ ID NO: 3182126 - RNA, 20 nt, Human
aaguaugcauuauuaaauug

SEQ ID NO: 3182127 - RNA, 21 nt, Human
aaguaugcauuauuaaauugu

SEQ ID NO: 3182128 - RNA, 22 nt, Human
aaguaugcauuauuaaauugua

SEQ ID NO: 3182129 - RNA, 11 nt, Human
aaguacuucuu

SEQ ID NO: 3182130 - RNA, 12 nt, Human
aaguauauuaaa

SEQ ID NO: 3182131 - RNA, 14 nt, Human
aaguauauuaaaca

SEQ ID NO: 3182132 - RNA, 16 nt, Human
aaguagaacuuuguau

SEQ ID NO: 3182133 - RNA, 15 nt, Human
aaguagaacuuugua

SEQ ID NO: 3182134 - RNA, 11 nt, Human
aaggugggagg

SEQ ID NO: 3182135 - RNA, 16 nt, Human
aaggugcuuggaguuu

SEQ ID NO: 3182136 - RNA, 16 nt, Human
aagguuaauaaaguaa

SEQ ID NO: 3182137 - RNA, 15 nt, Human
aagguuaauaaagua

SEQ ID NO: 3182138 - RNA, 13 nt, Human
aagguguuugaaa

SEQ ID NO: 3182139 - RNA, 20 nt, Human
aagguguuugaaaauaguuu

SEQ ID NO: 3182140 - RNA, 21 nt, Human
aagguguuugaaaauaguuua

SEQ ID NO: 3182141 - RNA, 15 nt, Human
aagguguuugaaaau

SEQ ID NO: 3182142 - RNA, 20 nt, Human
aagguuaauguucaucaucc

SEQ ID NO: 3182143 - RNA, 13 nt, Human
aagguugaauaau

SEQ ID NO: 3182144 - RNA, 17 nt, Human
aagguugaauaauauau

SEQ ID NO: 3182145 - RNA, 18 nt, Human
aagguuuaaaacuaguua

SEQ ID NO: 3182146 - RNA, 16 nt, Human
aagucuuagauguaua

SEQ ID NO: 3182147 - RNA, 18 nt, Human
aauaaacuggcagcucag

SEQ ID NO: 3182148 - RNA, 17 nt, Human
aauaagugccaggaugg

SEQ ID NO: 3182149 - RNA, 23 nt, Human
aauaaaauuaaagcugaaaacug

SEQ ID NO: 3182150 - RNA, 18 nt, Human
aauaaaauucccuaaagc

SEQ ID NO: 3182151 - RNA, 19 nt, Human
aauaaaauucccuaaagcc

SEQ ID NO: 3182152 - RNA, 19 nt, Human
aagugcuuauuacauuuua

SEQ ID NO: 3182153 - RNA, 14 nt, Human
aagugguuuuaaua

SEQ ID NO: 3182154 - RNA, 22 nt, Human
aaguuguaggcauaaagucagg

SEQ ID NO: 3182155 - RNA, 22 nt, Human
aaguuguaugaucugugccuuu

SEQ ID NO: 3182156 - RNA, 16 nt, Human
aauaaugccuuuguaa

SEQ ID NO: 3182157 - RNA, 18 nt, Human
aauaaugccuuuguaacc

SEQ ID NO: 3182158 - RNA, 22 nt, Human
aauaaugccuuuguaaccacaa

SEQ ID NO: 3182159 - RNA, 13 nt, Human
aauaaucauugga

SEQ ID NO: 3182160 - RNA, 20 nt, Human
aauaauaaagaauagcuuua

SEQ ID NO: 3182161 - RNA, 13 nt, Human
aauaaucaagagc

SEQ ID NO: 3182162 - RNA, 15 nt, Human
aauaaucaagagccu

SEQ ID NO: 3182163 - RNA, 11 nt, Human
aauaaucaaga

SEQ ID NO: 3182164 - RNA, 13 nt, Human
aauaauaaaauca

SEQ ID NO: 3182165 - RNA, 12 nt, Human
aauaauaaagaa

SEQ ID NO: 3182166 - RNA, 17 nt, Human
aauaauaaaaaauuuca

SEQ ID NO: 3182167 - RNA, 19 nt, Human
aauaauccugcaaaguaca

SEQ ID NO: 3182168 - RNA, 14 nt, Human
aauaauccugcaaa

SEQ ID NO: 3182169 - RNA, 14 nt, Human
aauaaucucauugg

SEQ ID NO: 3182170 - RNA, 15 nt, Human
aauaaugagaaaugu

SEQ ID NO: 3182171 - RNA, 22 nt, Human
aagugcugggauuacaggugug

SEQ ID NO: 3182172 - RNA, 21 nt, Human
aagaaauuagggcucuaauuu

SEQ ID NO: 3182173 - RNA, 13 nt, Human
aagaaauuaacuu

SEQ ID NO: 3182174 - RNA, 17 nt, Human
aagauugucauuaguga

SEQ ID NO: 3182175 - RNA, 17 nt, Human
aagauugugugguguuu

SEQ ID NO: 3182176 - RNA, 19 nt, Human
aagauuguuauuaaaugua

SEQ ID NO: 3182177 - RNA, 20 nt, Human
aagauuguuauuaaauguag

SEQ ID NO: 3182178 - RNA, 19 nt, Human
aagauuguuuaucuagaug

SEQ ID NO: 3182179 - RNA, 15 nt, Human
aagauuguuuaucua

SEQ ID NO: 3182180 - RNA, 13 nt, Human
aagauuguuuauc

SEQ ID NO: 3182181 - RNA, 23 nt, Human
aagauuggucucccauaugcaga

SEQ ID NO: 3182182 - RNA, 22 nt, Human
aagauuguuuaucuagauguaa

SEQ ID NO: 3182183 - RNA, 20 nt, Human
aagauuguuuaucuagaugu

SEQ ID NO: 3182184 - RNA, 21 nt, Human
aagcaggcuugcccaguacau

SEQ ID NO: 3182185 - RNA, 23 nt, Human
aagccagacucugccaaaaccaa

SEQ ID NO: 3182186 - RNA, 14 nt, Human
aagcagaggaagga

SEQ ID NO: 3182187 - RNA, 21 nt, Human
aagcagaauuggaaaagacua

SEQ ID NO: 3182188 - RNA, 19 nt, Human
aagcagaauuggaaaagac

SEQ ID NO: 3182189 - RNA, 16 nt, Human
aagcagaauuggaaaa

SEQ ID NO: 3182190 - RNA, 23 nt, Human
aagcaggcgcaagggaggcccag

SEQ ID NO: 3182191 - RNA, 11 nt, Human
aagcaggaggc

SEQ ID NO: 3182192 - RNA, 18 nt, Human
aagccauaauuguucuua

SEQ ID NO: 3182193 - RNA, 16 nt, Human
aagccaugagaauguu

SEQ ID NO: 3182194 - RNA, 14 nt, Human
aagccaugagaaug

SEQ ID NO: 3182195 - RNA, 21 nt, Human
aagcgugagccacugcaccgg

SEQ ID NO: 3182196 - RNA, 12 nt, Human
aagcguggugga

SEQ ID NO: 3182197 - RNA, 22 nt, Human
aagcugcacccucaggcaggug

SEQ ID NO: 3182198 - RNA, 21 nt, Human
aagcugcacccucaggcaggu

SEQ ID NO: 3182199 - RNA, 20 nt, Human
aagcugcacccucaggcagg

SEQ ID NO: 3182200 - RNA, 17 nt, Human
aagcuaagguuuagaua

SEQ ID NO: 3182201 - RNA, 22 nt, Human
aagcuaacagcaguuucaggua

SEQ ID NO: 3182202 - RNA, 21 nt, Human
aagcuaacagcaguuucaggu

SEQ ID NO: 3182203 - RNA, 18 nt, Human
aaggacauugcggacagc

SEQ ID NO: 3182204 - RNA, 13 nt, Human
aagcugggcaggu

SEQ ID NO: 3182205 - RNA, 18 nt, Human
aagcuggcuuacacuggc

SEQ ID NO: 3182206 - RNA, 11 nt, Human
aagcugggcag

SEQ ID NO: 3182207 - RNA, 15 nt, Human
aaggacuaggguccu

SEQ ID NO: 3182208 - RNA, 18 nt, Human
aaggacccggaggggccu

SEQ ID NO: 3182209 - RNA, 18 nt, Human
aaggacuaggguccuggg

SEQ ID NO: 3182210 - RNA, 20 nt, Human
aaggacuaggguccugggga

SEQ ID NO: 3182211 - RNA, 12 nt, Human
aaggacugacug

SEQ ID NO: 3182212 - RNA, 19 nt, Human
aaggacugacugaggcagu

SEQ ID NO: 3182213 - RNA, 16 nt, Human
aaggauuuguguuuua

SEQ ID NO: 3182214 - RNA, 14 nt, Human
aaggcaaaaacaaa

SEQ ID NO: 3182215 - RNA, 17 nt, Human
aaggcaaggcugucaau

SEQ ID NO: 3182216 - RNA, 18 nt, Human
aaggcaaggcugucaauu

SEQ ID NO: 3182217 - RNA, 16 nt, Human
aaggcaaggcugucaa

SEQ ID NO: 3182218 - RNA, 21 nt, Human
aacaucauagaaacugucuag

SEQ ID NO: 3182219 - RNA, 22 nt, Human
aacaucagguuaggcaguauaa

SEQ ID NO: 3182220 - RNA, 21 nt, Human
aacaucagguuaggcaguaua

SEQ ID NO: 3182221 - RNA, 14 nt, Human
aacaucagcuugac

SEQ ID NO: 3182222 - RNA, 16 nt, Human
aacaugguuuaaaaga

SEQ ID NO: 3182223 - RNA, 20 nt, Human
aacaugguuuaaaagaaaaa

SEQ ID NO: 3182224 - RNA, 13 nt, Human
aacaucauuccuu

SEQ ID NO: 3182225 - RNA, 17 nt, Human
aacaugagguucucucu

SEQ ID NO: 3182226 - RNA, 14 nt, Human
aacaucaacaucuu

SEQ ID NO: 3182227 - RNA, 13 nt, Human
aacagcucgacuu

SEQ ID NO: 3182228 - RNA, 19 nt, Human
aaccacugcaauaucuucg

SEQ ID NO: 3182229 - RNA, 17 nt, Human
aaccacugaaucuggac

SEQ ID NO: 3182230 - RNA, 13 nt, Human
aaccacugaaucu

SEQ ID NO: 3182231 - RNA, 11 nt, Human
aaccacugaau

SEQ ID NO: 3182232 - RNA, 21 nt, Human
aacauguaauuaaguacuaug

SEQ ID NO: 3182233 - RNA, 14 nt, Human
aacauguaauuaag

SEQ ID NO: 3182234 - RNA, 21 nt, Human
aaccagucuuucaacucauug

SEQ ID NO: 3182235 - RNA, 14 nt, Human
aacccuggugacca

SEQ ID NO: 3182236 - RNA, 23 nt, Human
aacccugucaaacauuaguacuu

SEQ ID NO: 3182237 - RNA, 19 nt, Human
aacccugucaaacauuagu

SEQ ID NO: 3182238 - RNA, 17 nt, Human
aacccugucaaacauua

SEQ ID NO: 3182239 - RNA, 15 nt, Human
aaauugauguugaug

SEQ ID NO: 3182240 - RNA, 14 nt, Human
aaauugauguugau

SEQ ID NO: 3182241 - RNA, 13 nt, Human
aaauugauguuga

SEQ ID NO: 3182242 - RNA, 12 nt, Human
aaauugauguug

SEQ ID NO: 3182243 - RNA, 18 nt, Human
aaauugauguugaugcaa

SEQ ID NO: 3182244 - RNA, 23 nt, Human
aaauuggaguuggaguagaaugu

SEQ ID NO: 3182245 - RNA, 18 nt, Human
aaauugcauuuccugaca

SEQ ID NO: 3182246 - RNA, 13 nt, Human
aaauugcuuuuga

SEQ ID NO: 3182247 - RNA, 12 nt, Human
aaauugcuuuuu

SEQ ID NO: 3182248 - RNA, 18 nt, Human
aacaaaauacauucuuuu

SEQ ID NO: 3182249 - RNA, 15 nt, Human
aacaaaauuauuugu

SEQ ID NO: 3182250 - RNA, 22 nt, Human
aacaaacugcacaugauuucac

SEQ ID NO: 3182251 - RNA, 21 nt, Human
aacaaacugcacaugauuuca

SEQ ID NO: 3182252 - RNA, 24 nt, Human
aacaaacugcacaugauuucacaa

SEQ ID NO: 3182253 - RNA, 13 nt, Human
aacaaaaagaugu

SEQ ID NO: 3182254 - RNA, 17 nt, Human
aacaaaauacauucuuu

SEQ ID NO: 3182255 - RNA, 14 nt, Human
aacaaaauacauuc

SEQ ID NO: 3182256 - RNA, 13 nt, Human
aacaaaauacauu

SEQ ID NO: 3182257 - RNA, 11 nt, Human
aacaaaaggca

SEQ ID NO: 3182258 - RNA, 21 nt, Human
aacaaaaccaaaaguuauuaa

SEQ ID NO: 3182259 - RNA, 15 nt, Human
aacacgagcaggcua

SEQ ID NO: 3182260 - RNA, 18 nt, Human
aacaccugacagccccuc

SEQ ID NO: 3182261 - RNA, 15 nt, Human
aacaccugacagccc

SEQ ID NO: 3182262 - RNA, 19 nt, Human
aacaccucugcacaagcug

SEQ ID NO: 3182263 - RNA, 17 nt, Human
aacaccaaaaaauaucu

SEQ ID NO: 3182264 - RNA, 16 nt, Human
aacaccaaaaaauauc

SEQ ID NO: 3182265 - RNA, 15 nt, Human
aacaccaaaaaauau

SEQ ID NO: 3182266 - RNA, 22 nt, Human
aacaccaaaaaaauccagaaac

SEQ ID NO: 3182267 - RNA, 23 nt, Human
aacaagaauaaaggcagcuguug

SEQ ID NO: 3182268 - RNA, 14 nt, Human
aacaagaagaauuu

SEQ ID NO: 3182269 - RNA, 17 nt, Human
aacaagaagaauuugaa

SEQ ID NO: 3182270 - RNA, 15 nt, Human
aacaacuuuuuuuuc

SEQ ID NO: 3182271 - RNA, 14 nt, Human
aacaaagaccaauu

SEQ ID NO: 3182272 - RNA, 21 nt, Human
aacaaagaccaauuuuuugug

SEQ ID NO: 3182273 - RNA, 16 nt, Human
aacaaagaccaauuuu

SEQ ID NO: 3182274 - RNA, 22 nt, Human
aacaaagcauuugacuuucugu

SEQ ID NO: 3182275 - RNA, 19 nt, Human
aacaccuucuauagcauca

SEQ ID NO: 3182276 - RNA, 16 nt, Human
aacuuugagaucuaaa

SEQ ID NO: 3182277 - RNA, 16 nt, Human
aacuuugaaauauaug

SEQ ID NO: 3182278 - RNA, 13 nt, Human
aacuuuguauagu

SEQ ID NO: 3182279 - RNA, 14 nt, Human
aacuuuguauaguu

SEQ ID NO: 3182280 - RNA, 15 nt, Human
aacuuuguauaguua

SEQ ID NO: 3182281 - RNA, 20 nt, Human
aacuuuguauaguuauguaa

SEQ ID NO: 3182282 - RNA, 21 nt, Human
aacuuuguauaguuauguaaa

SEQ ID NO: 3182283 - RNA, 22 nt, Human
aacuuuguauaguuauguaaau

SEQ ID NO: 3182284 - RNA, 20 nt, Human
aacuuuguuaggccaaagac

SEQ ID NO: 3182285 - RNA, 11 nt, Human
aacuuugaaau

SEQ ID NO: 3182286 - RNA, 14 nt, Human
aacuuugaaauaua

SEQ ID NO: 3182287 - RNA, 13 nt, Human
aacuuugaaauau

SEQ ID NO: 3182288 - RNA, 21 nt, Human
aacuuucuuaauauuuuuaca

SEQ ID NO: 3182289 - RNA, 16 nt, Human
aacuuuuuuuucuuuu

SEQ ID NO: 3182290 - RNA, 18 nt, Human
aacuuuuuuuucuuuuuu

SEQ ID NO: 3182291 - RNA, 17 nt, Human
aacuuuuuuuucuuuuu

SEQ ID NO: 3182292 - RNA, 21 nt, Human
aagaaaaaaaaaaagaaagaa

SEQ ID NO: 3182293 - RNA, 20 nt, Human
aagaaaaaaaaaaagaaaga

SEQ ID NO: 3182294 - RNA, 18 nt, Human
aagaaaaaaaaaaaagcc

SEQ ID NO: 3182295 - RNA, 14 nt, Human
aagaaauguaaggg

SEQ ID NO: 3182296 - RNA, 13 nt, Human
aagaaauguaagg

SEQ ID NO: 3182297 - RNA, 14 nt, Human
aagaaaucuauaga

SEQ ID NO: 3182298 - RNA, 13 nt, Human
aagaaaugaagag

SEQ ID NO: 3182299 - RNA, 12 nt, Human
aagaaaugaaga

SEQ ID NO: 3182300 - RNA, 20 nt, Human
aagaaaucuauagaaagugu

SEQ ID NO: 3182301 - RNA, 16 nt, Human
aagaaaucuauagaaa

SEQ ID NO: 3182302 - RNA, 14 nt, Human
aacugaccagccuc

SEQ ID NO: 3182303 - RNA, 17 nt, Human
aacugauuuuuuuuucc

SEQ ID NO: 3182304 - RNA, 13 nt, Human
aacugaucuguua

SEQ ID NO: 3182305 - RNA, 15 nt, Human
aacugaucuguuaua

SEQ ID NO: 3182306 - RNA, 13 nt, Human
aacugaugugaaa

SEQ ID NO: 3182307 - RNA, 14 nt, Human
aacugaugugaaac

SEQ ID NO: 3182308 - RNA, 15 nt, Human
aacugaugugaaacu

SEQ ID NO: 3182309 - RNA, 18 nt, Human
aacugauuaguaagucuu

SEQ ID NO: 3182310 - RNA, 19 nt, Human
aacugauuuuuuuuuccuu

SEQ ID NO: 3182311 - RNA, 15 nt, Human
aacuuaguuugugaa

SEQ ID NO: 3182312 - RNA, 16 nt, Human
aacuuaguuugugaau

SEQ ID NO: 3182313 - RNA, 23 nt, Human
aacuuaguuugugaauugauuuu

SEQ ID NO: 3182314 - RNA, 14 nt, Human
aacuuauucaaaga

SEQ ID NO: 3182315 - RNA, 22 nt, Human
aacuuauucaaagagaaaacau

SEQ ID NO: 3182316 - RNA, 16 nt, Human
aacuuaguuuugcaua

SEQ ID NO: 3182317 - RNA, 12 nt, Human
aacuuaguuuug

SEQ ID NO: 3182318 - RNA, 21 nt, Human
aacuuauauuguaagaaauac

SEQ ID NO: 3182319 - RNA, 20 nt, Human
aacuuauauuguaagaaaua

SEQ ID NO: 3182320 - RNA, 19 nt, Human
aacuuauauuguaagaaau

SEQ ID NO: 3182321 - RNA, 15 nt, Human
aacuuauauuguaag

SEQ ID NO: 3182322 - RNA, 12 nt, Human
aacucaccccag

SEQ ID NO: 3182323 - RNA, 23 nt, Human
aacucaaggauaccuucuuauuu

SEQ ID NO: 3182324 - RNA, 15 nt, Human
aacucaccugccccu

SEQ ID NO: 3182325 - RNA, 16 nt, Human
aacucaccugccccuc

SEQ ID NO: 3182326 - RNA, 23 nt, Human
aacugaacucugacaacagacuu

SEQ ID NO: 3182327 - RNA, 19 nt, Human
aacugaacucugacaacag

SEQ ID NO: 3182328 - RNA, 20 nt, Human
aacugaacucugacaacaga

SEQ ID NO: 3182329 - RNA, 14 nt, Human
aacugaacucugac

SEQ ID NO: 3182330 - RNA, 16 nt, Human
aacugaacucugacaa

SEQ ID NO: 3182331 - RNA, 16 nt, Human
aaauaguaaaaauaaa

SEQ ID NO: 3182332 - RNA, 13 nt, Human
aaauaguaaaaau

SEQ ID NO: 3182333 - RNA, 14 nt, Human
aaauagacaaaaag

SEQ ID NO: 3182334 - RNA, 18 nt, Human
aaauagacaaaaaguaua

SEQ ID NO: 3182335 - RNA, 19 nt, Human
aaauagacaaaaaguauau

SEQ ID NO: 3182336 - RNA, 19 nt, Human
aaauagagaugagcuuucu

SEQ ID NO: 3182337 - RNA, 17 nt, Human
aaauagacagcaugaga

SEQ ID NO: 3182338 - RNA, 19 nt, Human
aaauacuuaacuacuguuu

SEQ ID NO: 3182339 - RNA, 20 nt, Human
aaauacuuaaauguuaugua

SEQ ID NO: 3182340 - RNA, 19 nt, Human
aaauacuuaaauguuaugu

SEQ ID NO: 3182341 - RNA, 18 nt, Human
aaauacuuaaauguuaug

SEQ ID NO: 3182342 - RNA, 16 nt, Human
aaauacuuaaauguua

SEQ ID NO: 3182343 - RNA, 15 nt, Human
aaauacuuaaauguu

SEQ ID NO: 3182344 - RNA, 22 nt, Human
aaauauuuuaauuuuuaaaugc

SEQ ID NO: 3182345 - RNA, 21 nt, Human
aaauauuuuaauuuuuaaaug

SEQ ID NO: 3182346 - RNA, 20 nt, Human
aaauauuuuaauuuuuaaau

SEQ ID NO: 3182347 - RNA, 22 nt, Human
aaauaguaggcaagauggcaca

SEQ ID NO: 3182348 - RNA, 13 nt, Human
aaauaguaggcaa

SEQ ID NO: 3182349 - RNA, 23 nt, Human
aaauaguaggcaagauggcacag

SEQ ID NO: 3182350 - RNA, 23 nt, Human
aaauacuguagauaauuaaccaa

SEQ ID NO: 3182351 - RNA, 20 nt, Human
aaauacuguagauaauuaac

SEQ ID NO: 3182352 - RNA, 18 nt, Human
aaauacuguagauaauua

SEQ ID NO: 3182353 - RNA, 17 nt, Human
aaauacuguagauaauu

SEQ ID NO: 3182354 - RNA, 16 nt, Human
aaauacuguagauaau

SEQ ID NO: 3182355 - RNA, 15 nt, Human
aaauacuguagauaa

SEQ ID NO: 3182356 - RNA, 13 nt, Human
aaauacuuaaaug

SEQ ID NO: 3182357 - RNA, 22 nt, Human
aaauacuguuuuuaacaacuau

SEQ ID NO: 3182358 - RNA, 14 nt, Human
aaauacuguagaua

SEQ ID NO: 3182359 - RNA, 11 nt, Human
aaauacuguag

SEQ ID NO: 3182360 - RNA, 15 nt, Human
aaauacuguacaaug

SEQ ID NO: 3182361 - RNA, 16 nt, Human
aaaucaaauaugcaaa

SEQ ID NO: 3182362 - RNA, 13 nt, Human
aaauauuuucugu

SEQ ID NO: 3182363 - RNA, 14 nt, Human
aaauauuuucugug

SEQ ID NO: 3182364 - RNA, 15 nt, Human
aaauauuuucugugu

SEQ ID NO: 3182365 - RNA, 16 nt, Human
aaauauuuucugugug

SEQ ID NO: 3182366 - RNA, 17 nt, Human
aaauauuuucugugugu

SEQ ID NO: 3182367 - RNA, 18 nt, Human
aaauauuuucuguguguu

SEQ ID NO: 3182368 - RNA, 19 nt, Human
aaauauuuucuguguguuc

SEQ ID NO: 3182369 - RNA, 20 nt, Human
aaauauuuucuguguguucc

SEQ ID NO: 3182370 - RNA, 21 nt, Human
aaauauuuucuguguguuccu

SEQ ID NO: 3182371 - RNA, 22 nt, Human
aaauauuuucuguguguuccug

SEQ ID NO: 3182372 - RNA, 23 nt, Human
aaauauuuucuguguguuccugg

SEQ ID NO: 3182373 - RNA, 19 nt, Human
aaaucaaauaugcaaagca

SEQ ID NO: 3182374 - RNA, 18 nt, Human
aaaucaaauaugcaaagc

SEQ ID NO: 3182375 - RNA, 22 nt, Human
aaaucuuauuaaaguuucaaaa

SEQ ID NO: 3182376 - RNA, 21 nt, Human
aaaucuuauuaaaguuucaaa

SEQ ID NO: 3182377 - RNA, 20 nt, Human
aaaucuuauuaaaguuucaa

SEQ ID NO: 3182378 - RNA, 19 nt, Human
aaaucuuauuaaaguuuca

SEQ ID NO: 3182379 - RNA, 22 nt, Human
aaaucaaauguaaaguuuaauu

SEQ ID NO: 3182380 - RNA, 16 nt, Human
aaaucaaauguaaagu

SEQ ID NO: 3182381 - RNA, 23 nt, Human
aaaucuuccuggucgaaaguuag

SEQ ID NO: 3182382 - RNA, 21 nt, Human
aaauggacguguuaugacucc

SEQ ID NO: 3182383 - RNA, 22 nt, Human
aaauggacguguuaugacucca

SEQ ID NO: 3182384 - RNA, 20 nt, Human
aaauggacguguuaugacuc

SEQ ID NO: 3182385 - RNA, 14 nt, Human
aaauggaaacagag

SEQ ID NO: 3182386 - RNA, 16 nt, Human
aaauggaaaugggcag

SEQ ID NO: 3182387 - RNA, 18 nt, Human
aaauggaagacagcucuu

SEQ ID NO: 3182388 - RNA, 18 nt, Human
aaaucuuuccauauccau

SEQ ID NO: 3182389 - RNA, 13 nt, Human
aaagggaaauuga

SEQ ID NO: 3182390 - RNA, 17 nt, Human
aaaggcuugcagaacuu

SEQ ID NO: 3182391 - RNA, 17 nt, Human
aaaggcuuauaaaacag

SEQ ID NO: 3182392 - RNA, 14 nt, Human
aaaggcuuauaaaa

SEQ ID NO: 3182393 - RNA, 18 nt, Human
aaagucuguugauuaaag

SEQ ID NO: 3182394 - RNA, 20 nt, Human
aaagucuguugauuaaagau

SEQ ID NO: 3182395 - RNA, 19 nt, Human
aaagucuguugauuaaaga

SEQ ID NO: 3182396 - RNA, 14 nt, Human
aaagucuuuuaaaa

SEQ ID NO: 3182397 - RNA, 13 nt, Human
aaagucuuuuaaa

SEQ ID NO: 3182398 - RNA, 21 nt, Human
aaagucuuuuaaaaaguauug

SEQ ID NO: 3182399 - RNA, 20 nt, Human
aaagucuuuuaaaaaguauu

SEQ ID NO: 3182400 - RNA, 16 nt, Human
aaagucuuuuaaaaag

SEQ ID NO: 3182401 - RNA, 15 nt, Human
aaagucuuuuaaaaa

SEQ ID NO: 3182402 - RNA, 18 nt, Human
aaagucuugaauguugaa

SEQ ID NO: 3182403 - RNA, 13 nt, Human
aaauaaaggaacc

SEQ ID NO: 3182404 - RNA, 21 nt, Human
aaauaaacuuucuuaauauuu

SEQ ID NO: 3182405 - RNA, 13 nt, Human
aaauaaacuuucu

SEQ ID NO: 3182406 - RNA, 22 nt, Human
aaauaaaauuaaagcugaaaac

SEQ ID NO: 3182407 - RNA, 12 nt, Human
aaauaaaauucc

SEQ ID NO: 3182408 - RNA, 11 nt, Human
aaagugcuggg

SEQ ID NO: 3182409 - RNA, 20 nt, Human
aaagugcugcagggcuuuaa

SEQ ID NO: 3182410 - RNA, 19 nt, Human
aaagugagaaaacugugac

SEQ ID NO: 3182411 - RNA, 19 nt, Human
aaagugaggccacugaaga

SEQ ID NO: 3182412 - RNA, 20 nt, Human
aaagugaggccacugaagag

SEQ ID NO: 3182413 - RNA, 22 nt, Human
aaagugcugcagggcuuuaaaa

SEQ ID NO: 3182414 - RNA, 21 nt, Human
aaagugcugcagggcuuuaaa

SEQ ID NO: 3182415 - RNA, 19 nt, Human
aaauaaaaggacugugauu

SEQ ID NO: 3182416 - RNA, 13 nt, Human
aaauaaaauacuu

SEQ ID NO: 3182417 - RNA, 20 nt, Human
aaauaacaacuuuuuuuucu

SEQ ID NO: 3182418 - RNA, 19 nt, Human
aaacugccagcaacgcagg

SEQ ID NO: 3182419 - RNA, 11 nt, Human
aaacugcauuu

SEQ ID NO: 3182420 - RNA, 12 nt, Human
aaacugcauuug

SEQ ID NO: 3182421 - RNA, 14 nt, Human
aaacugcauuugug

SEQ ID NO: 3182422 - RNA, 20 nt, Human
aaacugccaguuuuguuucc

SEQ ID NO: 3182423 - RNA, 13 nt, Human
aaagaaaaauauu

SEQ ID NO: 3182424 - RNA, 10 nt, Human
aaagaaagaa

SEQ ID NO: 3182425 - RNA, 21 nt, Human
aaagaaaauaaaaaaaagaaa

SEQ ID NO: 3182426 - RNA, 14 nt, Human
aaagaaaacaaaac

SEQ ID NO: 3182427 - RNA, 18 nt, Human
aaagaaaaauauuuaaug

SEQ ID NO: 3182428 - RNA, 14 nt, Human
aaagaaaacaaaaa

SEQ ID NO: 3182429 - RNA, 19 nt, Human
aaagaaaacaaaaaacgaa

SEQ ID NO: 3182430 - RNA, 12 nt, Human
aaagaaaauaaa

SEQ ID NO: 3182431 - RNA, 15 nt, Human
aaacugccagcaacg

SEQ ID NO: 3182432 - RNA, 14 nt, Human
aaacugccagcaac

SEQ ID NO: 3182433 - RNA, 16 nt, Human
aaagauaccuuaaaau

SEQ ID NO: 3182434 - RNA, 22 nt, Human
aaagauaccuuaaaauuugaaa

SEQ ID NO: 3182435 - RNA, 21 nt, Human
aaagauaccuuaaaauuugaa

SEQ ID NO: 3182436 - RNA, 20 nt, Human
aaagauaccuuaaaauuuga

SEQ ID NO: 3182437 - RNA, 19 nt, Human
aaagauaccuuaaaauuug

SEQ ID NO: 3182438 - RNA, 18 nt, Human
aaagauaccuuaaaauuu

SEQ ID NO: 3182439 - RNA, 17 nt, Human
aaagauaccuuaaaauu

SEQ ID NO: 3182440 - RNA, 15 nt, Human
aaagaaauguaaggg

SEQ ID NO: 3182441 - RNA, 22 nt, Human
aaagaaauuagggcucuaauuu

SEQ ID NO: 3182442 - RNA, 11 nt, Human
aaagagguuuu

SEQ ID NO: 3182443 - RNA, 13 nt, Human
aaagaaauaauuu

SEQ ID NO: 3182444 - RNA, 12 nt, Human
aaagaaauaauu

SEQ ID NO: 3182445 - RNA, 12 nt, Human
aaagaaaggaaa

SEQ ID NO: 3182446 - RNA, 17 nt, Human
aaagaaaggguucugua

SEQ ID NO: 3182447 - RNA, 16 nt, Human
aaagaaagaggaaaag

SEQ ID NO: 3182448 - RNA, 15 nt, Human
aaagaaagaggaaaa

SEQ ID NO: 3182449 - RNA, 17 nt, Human
aaagaugaaaauauuug

SEQ ID NO: 3182450 - RNA, 16 nt, Human
aaagaugaaaauauuu

SEQ ID NO: 3182451 - RNA, 13 nt, Human
aaagaugaaaaua

SEQ ID NO: 3182452 - RNA, 18 nt, Human
aaacacuguucucugccc

SEQ ID NO: 3182453 - RNA, 16 nt, Human
aaacacugaaaagaag

SEQ ID NO: 3182454 - RNA, 22 nt, Human
aaaauugcuuuugagagaacau

SEQ ID NO: 3182455 - RNA, 22 nt, Human
aaaauugccuuucuguguuuau

SEQ ID NO: 3182456 - RNA, 12 nt, Human
aaaauugccuuu

SEQ ID NO: 3182457 - RNA, 15 nt, Human
aaaauucaaagcaug

SEQ ID NO: 3182458 - RNA, 21 nt, Human
aaaauucaaagcauggacauu

SEQ ID NO: 3182459 - RNA, 22 nt, Human
aaaauucaaagcauggacauuu

SEQ ID NO: 3182460 - RNA, 13 nt, Human
aaaauucagugga

SEQ ID NO: 3182461 - RNA, 19 nt, Human
aaacacuguucucugcccu

SEQ ID NO: 3182462 - RNA, 22 nt, Human
aaacacuguucucugcccucca

SEQ ID NO: 3182463 - RNA, 22 nt, Human
aaacagacuuguauauucuauu

SEQ ID NO: 3182464 - RNA, 18 nt, Human
aaacacuucauugaaaau

SEQ ID NO: 3182465 - RNA, 23 nt, Human
aaacacuguuuguuccagaaucu

SEQ ID NO: 3182466 - RNA, 14 nt, Human
aaacagaugcucug

SEQ ID NO: 3182467 - RNA, 17 nt, Human
aaacagaguaaucuugu

SEQ ID NO: 3182468 - RNA, 18 nt, Human
aaacagaguaaucuuguu

SEQ ID NO: 3182469 - RNA, 16 nt, Human
aaacagaggaccagca

SEQ ID NO: 3182470 - RNA, 13 nt, Human
aaacagaggacca

SEQ ID NO: 3182471 - RNA, 17 nt, Human
aaacagauuuggaaaga

SEQ ID NO: 3182472 - RNA, 21 nt, Human
ggagggugacgggggugaacu

SEQ ID NO: 3182473 - RNA, 19 nt, Human
ggagggucuagaggccuga

SEQ ID NO: 3182474 - RNA, 22 nt, Human
ggagguaaggaauaccuguccc

SEQ ID NO: 3182475 - RNA, 22 nt, Human
ggaggugggauccuccaggugc

SEQ ID NO: 3182476 - RNA, 23 nt, Human
ggaggugggauccuccaggugca

SEQ ID NO: 3182477 - RNA, 14 nt, Human
ggagguggcauccc

SEQ ID NO: 3182478 - RNA, 13 nt, Human
ggagggggcaaag

SEQ ID NO: 3182479 - RNA, 13 nt, Human
ggaggggggaggu

SEQ ID NO: 3182480 - RNA, 14 nt, Human
ggaggggggaggug

SEQ ID NO: 3182481 - RNA, 16 nt, Human
ggaggcuccaggcagc

SEQ ID NO: 3182482 - RNA, 15 nt, Human
ggaggcuccaggcag

SEQ ID NO: 3182483 - RNA, 13 nt, Human
ggauuguccccga

SEQ ID NO: 3182484 - RNA, 14 nt, Human
ggaugaaaaaauaa

SEQ ID NO: 3182485 - RNA, 16 nt, Human
ggauuguccccgaccc

SEQ ID NO: 3182486 - RNA, 20 nt, Human
ggauuguccccgacccuugc

SEQ ID NO: 3182487 - RNA, 15 nt, Human
ggauuguaaaauggu

SEQ ID NO: 3182488 - RNA, 17 nt, Human
ggaucucuuaagacagc

SEQ ID NO: 3182489 - RNA, 18 nt, Human
ggaucucuuaagacagca

SEQ ID NO: 3182490 - RNA, 20 nt, Human
ggauccugcacugacucugg

SEQ ID NO: 3182491 - RNA, 16 nt, Human
ggaguucaucuugaau

SEQ ID NO: 3182492 - RNA, 20 nt, Human
ggaguucauucauauuacaa

SEQ ID NO: 3182493 - RNA, 19 nt, Human
ggaguucauucauauuaca

SEQ ID NO: 3182494 - RNA, 15 nt, Human
ggauccugagccaga

SEQ ID NO: 3182495 - RNA, 16 nt, Human
ggauccugagccagau

SEQ ID NO: 3182496 - RNA, 18 nt, Human
ggauccugagccagauuu

SEQ ID NO: 3182497 - RNA, 19 nt, Human
ggauccugagccagauuuc

SEQ ID NO: 3182498 - RNA, 20 nt, Human
ggauccugagccagauuuca

SEQ ID NO: 3182499 - RNA, 23 nt, Human
ggauccugagccagauuucacuc

SEQ ID NO: 3182500 - RNA, 11 nt, Human
ggaguguguaa

SEQ ID NO: 3182501 - RNA, 22 nt, Human
ggaguguguaauuuaaaauugu

SEQ ID NO: 3182502 - RNA, 17 nt, Human
ggagugggucuggagga

SEQ ID NO: 3182503 - RNA, 15 nt, Human
ggaguggccacagaa

SEQ ID NO: 3182504 - RNA, 16 nt, Human
ggaguggccacagaaa

SEQ ID NO: 3182505 - RNA, 12 nt, Human
ggagugggccca

SEQ ID NO: 3182506 - RNA, 22 nt, Human
ggagugggcccaaugcacuuug

SEQ ID NO: 3182507 - RNA, 14 nt, Human
ggcauuugcugaau

SEQ ID NO: 3182508 - RNA, 15 nt, Human
ggcauuugcaauaaa

SEQ ID NO: 3182509 - RNA, 19 nt, Human
ggcauuuguaaauauuaaa

SEQ ID NO: 3182510 - RNA, 22 nt, Human
ggcauuuguaaauauuaaacca

SEQ ID NO: 3182511 - RNA, 17 nt, Human
ggcaucaucaauaaaac

SEQ ID NO: 3182512 - RNA, 20 nt, Human
ggcaucaucaauaaaacagu

SEQ ID NO: 3182513 - RNA, 20 nt, Human
ggcaucgcaauguaagacuc

SEQ ID NO: 3182514 - RNA, 12 nt, Human
ggcaucauucca

SEQ ID NO: 3182515 - RNA, 15 nt, Human
ggcauccacuucaca

SEQ ID NO: 3182516 - RNA, 17 nt, Human
ggccagagacacaagcc

SEQ ID NO: 3182517 - RNA, 22 nt, Human
ggccaagaguggccccaccugg

SEQ ID NO: 3182518 - RNA, 21 nt, Human
ggccaagaguggccccaccug

SEQ ID NO: 3182519 - RNA, 20 nt, Human
ggccaagaguggccccaccu

SEQ ID NO: 3182520 - RNA, 18 nt, Human
ggccagagacacaagccu

SEQ ID NO: 3182521 - RNA, 19 nt, Human
ggccagagggagugacaga

SEQ ID NO: 3182522 - RNA, 17 nt, Human
ggccagagggagugaca

SEQ ID NO: 3182523 - RNA, 13 nt, Human
ggccaaaggaagc

SEQ ID NO: 3182524 - RNA, 14 nt, Human
ggccaaaggaagca

SEQ ID NO: 3182525 - RNA, 16 nt, Human
ggccaaaggaagcaca

SEQ ID NO: 3182526 - RNA, 19 nt, Human
ggccaaaggaagcacaugc

SEQ ID NO: 3182527 - RNA, 23 nt, Human
ggcauuuguuucuuucucugagg

SEQ ID NO: 3182528 - RNA, 17 nt, Human
ggcauuuguuucuuucu

SEQ ID NO: 3182529 - RNA, 19 nt, Human
ggccaagaguggccccacc

SEQ ID NO: 3182530 - RNA, 17 nt, Human
ggccaagaguggcccca

SEQ ID NO: 3182531 - RNA, 14 nt, Human
ggccaagaguggcc

SEQ ID NO: 3182532 - RNA, 23 nt, Human
ggccaagagguuuggcuccugcc

SEQ ID NO: 3182533 - RNA, 18 nt, Human
ggcaggaggaucacuuga

SEQ ID NO: 3182534 - RNA, 20 nt, Human
ggcaggggcccugcagcucu

SEQ ID NO: 3182535 - RNA, 19 nt, Human
ggcaggggcccugcagcuc

SEQ ID NO: 3182536 - RNA, 21 nt, Human
ggcaggggcccugcagcucuc

SEQ ID NO: 3182537 - RNA, 16 nt, Human
ggcaggggaggccauc

SEQ ID NO: 3182538 - RNA, 20 nt, Human
ggcaggggaggccaucugga

SEQ ID NO: 3182539 - RNA, 19 nt, Human
ggcaggggaggccaucugg

SEQ ID NO: 3182540 - RNA, 16 nt, Human
ggcagggcaggaccag

SEQ ID NO: 3182541 - RNA, 15 nt, Human
ggcagggcaggacca

SEQ ID NO: 3182542 - RNA, 23 nt, Human
ggcagggcacagggccuggccca

SEQ ID NO: 3182543 - RNA, 22 nt, Human
ggcagggcacagggccuggccc

SEQ ID NO: 3182544 - RNA, 19 nt, Human
ggcagggcacagggccugg

SEQ ID NO: 3182545 - RNA, 18 nt, Human
ggcagggcacagggccug

SEQ ID NO: 3182546 - RNA, 19 nt, Human
ggcagggagggccugggcc

SEQ ID NO: 3182547 - RNA, 20 nt, Human
ggcagggagggccugggccc

SEQ ID NO: 3182548 - RNA, 16 nt, Human
ggcagggacagggccg

SEQ ID NO: 3182549 - RNA, 17 nt, Human
ggcagggcacagggccu

SEQ ID NO: 3182550 - RNA, 16 nt, Human
ggcagggcacagggcc

SEQ ID NO: 3182551 - RNA, 15 nt, Human
ggcagggcacagggc

SEQ ID NO: 3182552 - RNA, 14 nt, Human
ggcagggcacaggg

SEQ ID NO: 3182553 - RNA, 17 nt, Human
ggcagggagggccuggg

SEQ ID NO: 3182554 - RNA, 18 nt, Human
ggcagggagggccugggc

SEQ ID NO: 3182555 - RNA, 10 nt, Human
ggcagggagg

SEQ ID NO: 3182556 - RNA, 20 nt, Human
ggcacugcuuccagugaggc

SEQ ID NO: 3182557 - RNA, 13 nt, Human
ggcagccaggcca

SEQ ID NO: 3182558 - RNA, 22 nt, Human
ggcagccccauucugccugccc

SEQ ID NO: 3182559 - RNA, 23 nt, Human
ggcagccucugggcccacauccg

SEQ ID NO: 3182560 - RNA, 16 nt, Human
ggcagccucuucaaaa

SEQ ID NO: 3182561 - RNA, 14 nt, Human
ggcagccugagagu

SEQ ID NO: 3182562 - RNA, 13 nt, Human
ggcagccugagag

SEQ ID NO: 3182563 - RNA, 23 nt, Human
ggcagccugccuugcccacuccu

SEQ ID NO: 3182564 - RNA, 19 nt, Human
ggcagccugccuugcccac

SEQ ID NO: 3182565 - RNA, 21 nt, Human
ggcagccccauucugccugcc

SEQ ID NO: 3182566 - RNA, 20 nt, Human
ggcagccccauucugccugc

SEQ ID NO: 3182567 - RNA, 16 nt, Human
ggcagccccauucugc

SEQ ID NO: 3182568 - RNA, 15 nt, Human
ggcaaaaaggcagga

SEQ ID NO: 3182569 - RNA, 13 nt, Human
ggcaaaaacaaag

SEQ ID NO: 3182570 - RNA, 11 nt, Human
ggcaaaaacaa

SEQ ID NO: 3182571 - RNA, 18 nt, Human
ggcacaccgggcacucag

SEQ ID NO: 3182572 - RNA, 16 nt, Human
ggcacaccuccuccca

SEQ ID NO: 3182573 - RNA, 22 nt, Human
ggcacaccuccucccacugccc

SEQ ID NO: 3182574 - RNA, 21 nt, Human
ggcacaccuccucccacugcc

SEQ ID NO: 3182575 - RNA, 20 nt, Human
ggcacaccuccucccacugc

SEQ ID NO: 3182576 - RNA, 17 nt, Human
ggcacaccuccucccac

SEQ ID NO: 3182577 - RNA, 16 nt, Human
ggcacugcuuccagug

SEQ ID NO: 3182578 - RNA, 11 nt, Human
ggcacugcucu

SEQ ID NO: 3182579 - RNA, 22 nt, Human
ggcacacgcugcucugccccag

SEQ ID NO: 3182580 - RNA, 21 nt, Human
ggcacacgcugcucugcccca

SEQ ID NO: 3182581 - RNA, 20 nt, Human
ggcacacgcugcucugcccc

SEQ ID NO: 3182582 - RNA, 18 nt, Human
ggcacacgcugcucugcc

SEQ ID NO: 3182583 - RNA, 21 nt, Human
aaaaaguuguaugaucugugc

SEQ ID NO: 3182584 - RNA, 23 nt, Human
aaaaaguuguaugaucugugccu

SEQ ID NO: 3182585 - RNA, 14 nt, Human
aaaaaggaggaaga

SEQ ID NO: 3182586 - RNA, 12 nt, Human
aaaaaggcagga

SEQ ID NO: 3182587 - RNA, 13 nt, Human
aaaaauacaaaaa

SEQ ID NO: 3182588 - RNA, 14 nt, Human
aaaaauaaaacugu

SEQ ID NO: 3182589 - RNA, 12 nt, Human
aaaaauaaaaua

SEQ ID NO: 3182590 - RNA, 17 nt, Human
aaaaauacaauuuuuau

SEQ ID NO: 3182591 - RNA, 22 nt, Human
ggcuggguucuacccaggugcu

SEQ ID NO: 3182592 - RNA, 14 nt, Human
ggcuggguuggagg

SEQ ID NO: 3182593 - RNA, 11 nt, Human
aaaaaacucuu

SEQ ID NO: 3182594 - RNA, 9 nt, Human
aaaaaagaa

SEQ ID NO: 3182595 - RNA, 14 nt, Human
aaaaagcaguucuu

SEQ ID NO: 3182596 - RNA, 22 nt, Human
aaaaaacugcugacuguuuucu

SEQ ID NO: 3182597 - RNA, 13 nt, Human
aaaaaaaugcuga

SEQ ID NO: 3182598 - RNA, 12 nt, Human
aaaaaaaguugu

SEQ ID NO: 3182599 - RNA, 12 nt, Human
aaaaaaauacaa

SEQ ID NO: 3182600 - RNA, 12 nt, Human
aaaaaaacucuu

SEQ ID NO: 3182601 - RNA, 13 nt, Human
aaaaaaacauucu

SEQ ID NO: 3182602 - RNA, 13 nt, Human
aaaaaaacacaaa

SEQ ID NO: 3182603 - RNA, 10 nt, Human
aaaaaaagaa

SEQ ID NO: 3182604 - RNA, 9 nt, Human
aaaaaaaga

SEQ ID NO: 3182605 - RNA, 11 nt, Human
aaaaaaagaaa

SEQ ID NO: 3182606 - RNA, 14 nt, Human
ggcuggccuggccc

SEQ ID NO: 3182607 - RNA, 15 nt, Human
ggcuggccuggcccc

SEQ ID NO: 3182608 - RNA, 13 nt, Human
ggcuggccuggcc

SEQ ID NO: 3182609 - RNA, 17 nt, Human
ggcuggcccugcccugg

SEQ ID NO: 3182610 - RNA, 20 nt, Human
ggcucuugaacugagcuugg

SEQ ID NO: 3182611 - RNA, 19 nt, Human
ggcucuugaacugagcuug

SEQ ID NO: 3182612 - RNA, 18 nt, Human
ggcucuugaacugagcuu

SEQ ID NO: 3182613 - RNA, 23 nt, Human
ggcucuucuccuuucacaaccuu

SEQ ID NO: 3182614 - RNA, 14 nt, Human
ggcucuacacauau

SEQ ID NO: 3182615 - RNA, 12 nt, Human
ggcucuacacau

SEQ ID NO: 3182616 - RNA, 13 nt, Human
ggcucuaauuucc

SEQ ID NO: 3182617 - RNA, 14 nt, Human
ggcucuuccaggcu

SEQ ID NO: 3182618 - RNA, 15 nt, Human
ggcucuuccaggcug

SEQ ID NO: 3182619 - RNA, 17 nt, Human
ggcucuuccaggcuggg

SEQ ID NO: 3182620 - RNA, 18 nt, Human
ggcucuuccaggcuggga

SEQ ID NO: 3182621 - RNA, 21 nt, Human
ggcucccgccuccaaccccuc

SEQ ID NO: 3182622 - RNA, 15 nt, Human
ggcucccgccuccaa

SEQ ID NO: 3182623 - RNA, 20 nt, Human
ggcucccgccuccaaccccu

SEQ ID NO: 3182624 - RNA, 17 nt, Human
ggcucccgccuccaacc

SEQ ID NO: 3182625 - RNA, 19 nt, Human
ggcucccucacucucagga

SEQ ID NO: 3182626 - RNA, 18 nt, Human
ggcucccucacucucagg

SEQ ID NO: 3182627 - RNA, 17 nt, Human
ggcucccucacucucag

SEQ ID NO: 3182628 - RNA, 16 nt, Human
ggcucccucacucuca

SEQ ID NO: 3182629 - RNA, 15 nt, Human
ggcucccucacucuc

SEQ ID NO: 3182630 - RNA, 22 nt, Human
ggcucccguguaucuggacacu

SEQ ID NO: 3182631 - RNA, 13 nt, Human
ggcucccuuccca

SEQ ID NO: 3182632 - RNA, 16 nt, Human
ggcugacugggccagg

SEQ ID NO: 3182633 - RNA, 14 nt, Human
ggcugacugggcca

SEQ ID NO: 3182634 - RNA, 10 nt, Human
ggcugcccuu

SEQ ID NO: 3182635 - RNA, 11 nt, Human
ggcugcccuuu

SEQ ID NO: 3182636 - RNA, 22 nt, Human
ggcugcccuggugcugccacac

SEQ ID NO: 3182637 - RNA, 14 nt, Human
ggcugcccuuucug

SEQ ID NO: 3182638 - RNA, 18 nt, Human
ggcugcccuuucugggca

SEQ ID NO: 3182639 - RNA, 15 nt, Human
ggcucacugcagccu

SEQ ID NO: 3182640 - RNA, 14 nt, Human
ggcucacugcagcc

SEQ ID NO: 3182641 - RNA, 13 nt, Human
ggcucacugcagc

SEQ ID NO: 3182642 - RNA, 13 nt, Human
ggcuccccugggg

SEQ ID NO: 3182643 - RNA, 18 nt, Human
ggcuaaaauguuuucagc

SEQ ID NO: 3182644 - RNA, 21 nt, Human
ggcuaaaaaagcugaaucaga

SEQ ID NO: 3182645 - RNA, 22 nt, Human
ggcuaaaaaagcugaaucagac

SEQ ID NO: 3182646 - RNA, 14 nt, Human
ggcgugagaccugc

SEQ ID NO: 3182647 - RNA, 16 nt, Human
ggcgugagaccugccc

SEQ ID NO: 3182648 - RNA, 17 nt, Human
ggcgugagaccugcccc

SEQ ID NO: 3182649 - RNA, 18 nt, Human
ggcgugagaccugccccu

SEQ ID NO: 3182650 - RNA, 18 nt, Human
ggccuucggccuccaucc

SEQ ID NO: 3182651 - RNA, 16 nt, Human
ggccuucggccuccau

SEQ ID NO: 3182652 - RNA, 18 nt, Human
ggcgaggacgacuucugc

SEQ ID NO: 3182653 - RNA, 15 nt, Human
ggcuacuugcuuuga

SEQ ID NO: 3182654 - RNA, 17 nt, Human
ggcuacccgugagcccu

SEQ ID NO: 3182655 - RNA, 22 nt, Human
ggcuacaccuuagccugcccuc

SEQ ID NO: 3182656 - RNA, 23 nt, Human
ggcuacaccuuagccugcccucc

SEQ ID NO: 3182657 - RNA, 16 nt, Human
ggcuaauguacugcau

SEQ ID NO: 3182658 - RNA, 20 nt, Human
ggcuaagugauccucccacc

SEQ ID NO: 3182659 - RNA, 18 nt, Human
ggcuaauuuuuguuuugu

SEQ ID NO: 3182660 - RNA, 16 nt, Human
ggccugcaagggagug

SEQ ID NO: 3182661 - RNA, 15 nt, Human
ggccuggccagaugc

SEQ ID NO: 3182662 - RNA, 12 nt, Human
ggccuggccaga

SEQ ID NO: 3182663 - RNA, 15 nt, Human
ggccuggcagccgug

SEQ ID NO: 3182664 - RNA, 14 nt, Human
ggccuggcagccgu

SEQ ID NO: 3182665 - RNA, 17 nt, Human
ggccuucagggagugag

SEQ ID NO: 3182666 - RNA, 11 nt, Human
ggccugccugu

SEQ ID NO: 3182667 - RNA, 23 nt, Human
ggcccguggggccggggcuucug

SEQ ID NO: 3182668 - RNA, 16 nt, Human
ggccagaugcaccagc

SEQ ID NO: 3182669 - RNA, 15 nt, Human
ggccagaugcaccag

SEQ ID NO: 3182670 - RNA, 18 nt, Human
ggccucccaacucacccc

SEQ ID NO: 3182671 - RNA, 19 nt, Human
ggccucccaacucacccca

SEQ ID NO: 3182672 - RNA, 17 nt, Human
ggccucccaacucaccc

SEQ ID NO: 3182673 - RNA, 13 nt, Human
ggccucagugcca

SEQ ID NO: 3182674 - RNA, 20 nt, Human
ggccucccaacucaccccag

SEQ ID NO: 3182675 - RNA, 22 nt, Human
ggccucccaacucaccccagcc

SEQ ID NO: 3182676 - RNA, 23 nt, Human
ggccucccaacucaccccagccc

SEQ ID NO: 3182677 - RNA, 16 nt, Human
ggccgcgggggcaggg

SEQ ID NO: 3182678 - RNA, 23 nt, Human
ggccgccggcaauaaaagcccag

SEQ ID NO: 3182679 - RNA, 22 nt, Human
ggccgccggcaauaaaagccca

SEQ ID NO: 3182680 - RNA, 20 nt, Human
gguuccuuccucugagccuu

SEQ ID NO: 3182681 - RNA, 16 nt, Human
gguuccuucugggcau

SEQ ID NO: 3182682 - RNA, 22 nt, Human
gguucccuuuuuuggcugcuga

SEQ ID NO: 3182683 - RNA, 23 nt, Human
gguucccuuugacgccaucccag

SEQ ID NO: 3182684 - RNA, 22 nt, Human
gguucccuuugacgccauccca

SEQ ID NO: 3182685 - RNA, 16 nt, Human
gguuccagccugccac

SEQ ID NO: 3182686 - RNA, 15 nt, Human
gguuccagccugcca

SEQ ID NO: 3182687 - RNA, 14 nt, Human
gguuccagccugcc

SEQ ID NO: 3182688 - RNA, 13 nt, Human
gguguuugaaaau

SEQ ID NO: 3182689 - RNA, 14 nt, Human
gguguuugaaaaua

SEQ ID NO: 3182690 - RNA, 17 nt, Human
gguucccauuugcuccu

SEQ ID NO: 3182691 - RNA, 20 nt, Human
gguguuugaaaauaguuuau

SEQ ID NO: 3182692 - RNA, 17 nt, Human
gguguuuccuggcacug

SEQ ID NO: 3182693 - RNA, 19 nt, Human
gguguuuccuggcacugcu

SEQ ID NO: 3182694 - RNA, 18 nt, Human
gguggggggcuucauaca

SEQ ID NO: 3182695 - RNA, 16 nt, Human
gguggggggcuucaua

SEQ ID NO: 3182696 - RNA, 13 nt, Human
ggugggggccucg

SEQ ID NO: 3182697 - RNA, 22 nt, Human
ggugggcuugucauagccagug

SEQ ID NO: 3182698 - RNA, 19 nt, Human
ggugggggggcagagcccu

SEQ ID NO: 3182699 - RNA, 15 nt, Human
ggugggggggcagag

SEQ ID NO: 3182700 - RNA, 12 nt, Human
gguguggagaag

SEQ ID NO: 3182701 - RNA, 14 nt, Human
gguguggagaagcg

SEQ ID NO: 3182702 - RNA, 23 nt, Human
gguguggagaagcggcuggcagc

SEQ ID NO: 3182703 - RNA, 11 nt, Human
gguguggggga

SEQ ID NO: 3182704 - RNA, 13 nt, Human
ggugugggggaag

SEQ ID NO: 3182705 - RNA, 15 nt, Human
ggugugggggccccg

SEQ ID NO: 3182706 - RNA, 23 nt, Human
ggugugggggccccgucucaggu

SEQ ID NO: 3182707 - RNA, 22 nt, Human
gguuuguuuagaagaagugugu

SEQ ID NO: 3182708 - RNA, 20 nt, Human
gguuuuaaaauacuguagau

SEQ ID NO: 3182709 - RNA, 12 nt, Human
gguuuuaaaaua

SEQ ID NO: 3182710 - RNA, 19 nt, Human
gguuugguuuuguuuuuug

SEQ ID NO: 3182711 - RNA, 16 nt, Human
gguuuguggggggagg

SEQ ID NO: 3182712 - RNA, 17 nt, Human
gguuuguggggggaggc

SEQ ID NO: 3182713 - RNA, 14 nt, Human
gguuuggugcuuuu

SEQ ID NO: 3182714 - RNA, 19 nt, Human
gguuuuauuguuuaaaauc

SEQ ID NO: 3182715 - RNA, 11 nt, Human
gguuuuaugau

SEQ ID NO: 3182716 - RNA, 17 nt, Human
gguuuuauuuauuucuu

SEQ ID NO: 3182717 - RNA, 14 nt, Human
gguuugggaccccu

SEQ ID NO: 3182718 - RNA, 22 nt, Human
gguuucuaaagcugccagccga

SEQ ID NO: 3182719 - RNA, 16 nt, Human
gguuucuaaagcugcc

SEQ ID NO: 3182720 - RNA, 16 nt, Human
gguuuccugcccuggg

SEQ ID NO: 3182721 - RNA, 19 nt, Human
gguuuccugcccugggagg

SEQ ID NO: 3182722 - RNA, 18 nt, Human
gguuuccaacaauucagc

SEQ ID NO: 3182723 - RNA, 13 nt, Human
gguuuccugcccu

SEQ ID NO: 3182724 - RNA, 15 nt, Human
gguuuccugcccugg

SEQ ID NO: 3182725 - RNA, 12 nt, Human
gguuuccugccc

SEQ ID NO: 3182726 - RNA, 20 nt, Human
gguuuccaacaauucagcau

SEQ ID NO: 3182727 - RNA, 15 nt, Human
aaaguagaacuuugu

SEQ ID NO: 3182728 - RNA, 18 nt, Human
aaaguaauauuuauuaaa

SEQ ID NO: 3182729 - RNA, 15 nt, Human
aaaguaauauuuauu

SEQ ID NO: 3182730 - RNA, 21 nt, Human
aaaguaaggugcuuggaguuu

SEQ ID NO: 3182731 - RNA, 22 nt, Human
aaaguagaagucuuagauguau

SEQ ID NO: 3182732 - RNA, 20 nt, Human
aaaguagaagucuuagaugu

SEQ ID NO: 3182733 - RNA, 23 nt, Human
aaaguagaacuuuguauaguuau

SEQ ID NO: 3182734 - RNA, 16 nt, Human
aaaguagaacuuugua

SEQ ID NO: 3182735 - RNA, 17 nt, Human
aaaguagaacuuuguau

SEQ ID NO: 3182736 - RNA, 18 nt, Human
aaaguagaacuuuguaua

SEQ ID NO: 3182737 - RNA, 21 nt, Human
aaaguagaacuuuguauaguu

SEQ ID NO: 3182738 - RNA, 14 nt, Human
aaaguaugcauuau

SEQ ID NO: 3182739 - RNA, 18 nt, Human
aaaguaugcauuauuaaa

SEQ ID NO: 3182740 - RNA, 19 nt, Human
aaaguaugcauuauuaaau

SEQ ID NO: 3182741 - RNA, 20 nt, Human
aaaguaugcauuauuaaauu

SEQ ID NO: 3182742 - RNA, 21 nt, Human
aaagugggcccucauacacaa

SEQ ID NO: 3182743 - RNA, 19 nt, Human
aaaguaaaagcagcauaaa

SEQ ID NO: 3182744 - RNA, 14 nt, Human
aaaguaaaaugucu

SEQ ID NO: 3182745 - RNA, 15 nt, Human
aaaguaaaagcagca

SEQ ID NO: 3182746 - RNA, 12 nt, Human
aaaguaaaagag

SEQ ID NO: 3182747 - RNA, 16 nt, Human
aaagguuuauuuuucu

SEQ ID NO: 3182748 - RNA, 21 nt, Human
aaagguuuauuuuucuguuac

SEQ ID NO: 3182749 - RNA, 12 nt, Human
gguggcuggguu

SEQ ID NO: 3182750 - RNA, 18 nt, Human
gguggcuggguuggaggg

SEQ ID NO: 3182751 - RNA, 17 nt, Human
ggugggacacccuguga

SEQ ID NO: 3182752 - RNA, 13 nt, Human
ggugggacacccu

SEQ ID NO: 3182753 - RNA, 16 nt, Human
ggugggacacccugug

SEQ ID NO: 3182754 - RNA, 19 nt, Human
gguggggaccucaggccug

SEQ ID NO: 3182755 - RNA, 13 nt, Human
aaaggugugcugu

SEQ ID NO: 3182756 - RNA, 16 nt, Human
aaagguucuuugugua

SEQ ID NO: 3182757 - RNA, 16 nt, Human
aaagguugaauaauau

SEQ ID NO: 3182758 - RNA, 17 nt, Human
aaagguugaauaauaua

SEQ ID NO: 3182759 - RNA, 19 nt, Human
aaagguugaauaauauaug

SEQ ID NO: 3182760 - RNA, 15 nt, Human
aaaggugauugucac

SEQ ID NO: 3182761 - RNA, 17 nt, Human
aaaggugauaaaaucau

SEQ ID NO: 3182762 - RNA, 14 nt, Human
aaaggugauaaaau

SEQ ID NO: 3182763 - RNA, 18 nt, Human
aaaggugauaaaaucaua

SEQ ID NO: 3182764 - RNA, 13 nt, Human
aaaggugauaaaa

SEQ ID NO: 3182765 - RNA, 20 nt, Human
aaagggauggcaagaugugg

SEQ ID NO: 3182766 - RNA, 17 nt, Human
aaagcuguucuuccugg

SEQ ID NO: 3182767 - RNA, 16 nt, Human
aaagcuguucuuccug

SEQ ID NO: 3182768 - RNA, 14 nt, Human
aaagcuguucuucc

SEQ ID NO: 3182769 - RNA, 19 nt, Human
aaagggcccaaugaauuau

SEQ ID NO: 3182770 - RNA, 20 nt, Human
aaagggcccagagagggugg

SEQ ID NO: 3182771 - RNA, 14 nt, Human
aaagcuguguuuau

SEQ ID NO: 3182772 - RNA, 13 nt, Human
aaagcuguucuuc

SEQ ID NO: 3182773 - RNA, 12 nt, Human
aaagcugccagc

SEQ ID NO: 3182774 - RNA, 13 nt, Human
aaagcugccagcc

SEQ ID NO: 3182775 - RNA, 23 nt, Human
aaagcugaacacauuucuuuuua

SEQ ID NO: 3182776 - RNA, 19 nt, Human
aaagcuagaacacugccaa

SEQ ID NO: 3182777 - RNA, 15 nt, Human
aaagcugaaaacugc

SEQ ID NO: 3182778 - RNA, 13 nt, Human
aaagcagugcaug

SEQ ID NO: 3182779 - RNA, 16 nt, Human
aaagcuaggccuggcc

SEQ ID NO: 3182780 - RNA, 14 nt, Human
aaagcuaggccugg

SEQ ID NO: 3182781 - RNA, 16 nt, Human
aaagcagaacagugau

SEQ ID NO: 3182782 - RNA, 14 nt, Human
gguggagaaaggag

SEQ ID NO: 3182783 - RNA, 14 nt, Human
gguggcaccagcag

SEQ ID NO: 3182784 - RNA, 20 nt, Human
gguggcaccagcagccugga

SEQ ID NO: 3182785 - RNA, 12 nt, Human
aaacuuuaugcu

SEQ ID NO: 3182786 - RNA, 19 nt, Human
aaacuuuaugcuaagugaa

SEQ ID NO: 3182787 - RNA, 21 nt, Human
ggugcugccauccagguucag

SEQ ID NO: 3182788 - RNA, 22 nt, Human
ggugcugcuaauucuuugcaaa

SEQ ID NO: 3182789 - RNA, 20 nt, Human
ggugcugcuaauucuuugca

SEQ ID NO: 3182790 - RNA, 12 nt, Human
guaauauuuaca

SEQ ID NO: 3182791 - RNA, 17 nt, Human
guaauauuuacaaugua

SEQ ID NO: 3182792 - RNA, 18 nt, Human
guaauauuuacaauguau

SEQ ID NO: 3182793 - RNA, 19 nt, Human
guaauauuuacaauguauu

SEQ ID NO: 3182794 - RNA, 21 nt, Human
guaauauuuacaauguauuaa

SEQ ID NO: 3182795 - RNA, 23 nt, Human
guaauauuuacaauguauuaagc

SEQ ID NO: 3182796 - RNA, 13 nt, Human
guaauauuuauua

SEQ ID NO: 3182797 - RNA, 14 nt, Human
guaauauuuauuaa

SEQ ID NO: 3182798 - RNA, 15 nt, Human
guaauauuuauuaaa

SEQ ID NO: 3182799 - RNA, 16 nt, Human
guaauauuuauuaaau

SEQ ID NO: 3182800 - RNA, 17 nt, Human
guaauauuuauuaaauu

SEQ ID NO: 3182801 - RNA, 18 nt, Human
guaauauuuauuaaauuu

SEQ ID NO: 3182802 - RNA, 21 nt, Human
guaauauuuauuaaauuuuuu

SEQ ID NO: 3182803 - RNA, 19 nt, Human
guaauaagggaaaaaucaa

SEQ ID NO: 3182804 - RNA, 18 nt, Human
guaauaagggaaaaauca

SEQ ID NO: 3182805 - RNA, 16 nt, Human
guaauaauaaagaaua

SEQ ID NO: 3182806 - RNA, 12 nt, Human
guaauaauaaag

SEQ ID NO: 3182807 - RNA, 18 nt, Human
guaaguuaauguauauaa

SEQ ID NO: 3182808 - RNA, 14 nt, Human
guaacuauguuuua

SEQ ID NO: 3182809 - RNA, 18 nt, Human
guaacgugugcuguguuu

SEQ ID NO: 3182810 - RNA, 22 nt, Human
guaacuaaaauaauuuuguaau

SEQ ID NO: 3182811 - RNA, 20 nt, Human
guaacuaaaauaauuuugua

SEQ ID NO: 3182812 - RNA, 15 nt, Human
guaacuaaaauaauu

SEQ ID NO: 3182813 - RNA, 13 nt, Human
guaacuaaaauaa

SEQ ID NO: 3182814 - RNA, 22 nt, Human
guacaaaaaauucagugaugug

SEQ ID NO: 3182815 - RNA, 22 nt, Human
guacaaccuguucugcuuuccu

SEQ ID NO: 3182816 - RNA, 22 nt, Human
guacaaguaguucuguauuuga

SEQ ID NO: 3182817 - RNA, 17 nt, Human
guacaaguaguucugua

SEQ ID NO: 3182818 - RNA, 21 nt, Human
guacaaguaguucuguauuug

SEQ ID NO: 3182819 - RNA, 15 nt, Human
guacaagaucucagg

SEQ ID NO: 3182820 - RNA, 13 nt, Human
guacaaguaguuc

SEQ ID NO: 3182821 - RNA, 14 nt, Human
guacaaguaguucu

SEQ ID NO: 3182822 - RNA, 15 nt, Human
guacaaguaguucug

SEQ ID NO: 3182823 - RNA, 16 nt, Human
guacaaguaguucugu

SEQ ID NO: 3182824 - RNA, 23 nt, Human
guaauccuagcacuuugggaggc

SEQ ID NO: 3182825 - RNA, 15 nt, Human
guaaucgaccugccu

SEQ ID NO: 3182826 - RNA, 12 nt, Human
guaaucauauua

SEQ ID NO: 3182827 - RNA, 15 nt, Human
guaaucauauuagac

SEQ ID NO: 3182828 - RNA, 11 nt, Human
guaaacacugu

SEQ ID NO: 3182829 - RNA, 15 nt, Human
guaaacacucagcug

SEQ ID NO: 3182830 - RNA, 13 nt, Human
guaaaauuuuagg

SEQ ID NO: 3182831 - RNA, 12 nt, Human
aaauaauuauuu

SEQ ID NO: 3182832 - RNA, 20 nt, Human
aaauaauuauuuauuacaua

SEQ ID NO: 3182833 - RNA, 13 nt, Human
aaauaauucuuuu

SEQ ID NO: 3182834 - RNA, 14 nt, Human
aaauaauucuuuuu

SEQ ID NO: 3182835 - RNA, 18 nt, Human
aaauaauucuuuuuuauu

SEQ ID NO: 3182836 - RNA, 19 nt, Human
aaauaauucuuuuuuauua

SEQ ID NO: 3182837 - RNA, 20 nt, Human
aaaguguucuguuacaaaau

SEQ ID NO: 3182838 - RNA, 22 nt, Human
aaaguuaacaggcaaacauuuu

SEQ ID NO: 3182839 - RNA, 12 nt, Human
aaaguuaacauu

SEQ ID NO: 3182840 - RNA, 15 nt, Human
aaaguuaacauuaau

SEQ ID NO: 3182841 - RNA, 20 nt, Human
aaaguuaaacgugaugugcu

SEQ ID NO: 3182842 - RNA, 12 nt, Human
aaaguuaaaagu

SEQ ID NO: 3182843 - RNA, 16 nt, Human
guaacaagccacccca

SEQ ID NO: 3182844 - RNA, 19 nt, Human
guaacaggaaaauuuuaaa

SEQ ID NO: 3182845 - RNA, 15 nt, Human
guaacauuuuucaau

SEQ ID NO: 3182846 - RNA, 17 nt, Human
guaacauucuauuucaa

SEQ ID NO: 3182847 - RNA, 15 nt, Human
guaaagggcaaauaa

SEQ ID NO: 3182848 - RNA, 18 nt, Human
guaaagggcaaauaauga

SEQ ID NO: 3182849 - RNA, 23 nt, Human
guaaagguuuauuuuucuguuac

SEQ ID NO: 3182850 - RNA, 23 nt, Human
aaaucagccugcuccagcuguuc

SEQ ID NO: 3182851 - RNA, 19 nt, Human
aaaucagccugcuccagcu

SEQ ID NO: 3182852 - RNA, 21 nt, Human
aaaucagccugcuccagcugu

SEQ ID NO: 3182853 - RNA, 21 nt, Human
aaauauugaaaggcaaacauu

SEQ ID NO: 3182854 - RNA, 21 nt, Human
aaauauugagcagaauucauu

SEQ ID NO: 3182855 - RNA, 15 nt, Human
aaauauucucuauuu

SEQ ID NO: 3182856 - RNA, 23 nt, Human
aaauauucuucuauaaaugaauc

SEQ ID NO: 3182857 - RNA, 20 nt, Human
aaauauuccugcauuuguga

SEQ ID NO: 3182858 - RNA, 22 nt, Human
aaauauuaaaaagucuuuuaaa

SEQ ID NO: 3182859 - RNA, 13 nt, Human
aaauauuaaaaga

SEQ ID NO: 3182860 - RNA, 18 nt, Human
aaauauuaaaagaaaggg

SEQ ID NO: 3182861 - RNA, 15 nt, Human
aaauauuccugcauu

SEQ ID NO: 3182862 - RNA, 12 nt, Human
aaauauuaaaaa

SEQ ID NO: 3182863 - RNA, 17 nt, Human
aaauauuaaaaagucuu

SEQ ID NO: 3182864 - RNA, 14 nt, Human
aaauauuaaaaagu

SEQ ID NO: 3182865 - RNA, 20 nt, Human
aaauaugugaaggaccuuca

SEQ ID NO: 3182866 - RNA, 15 nt, Human
aaauaugugaaggac

SEQ ID NO: 3182867 - RNA, 12 nt, Human
aaauaugugaag

SEQ ID NO: 3182868 - RNA, 18 nt, Human
aaauaugucccagaaaug

SEQ ID NO: 3182869 - RNA, 19 nt, Human
aaauauggucuuuugguua

SEQ ID NO: 3182870 - RNA, 13 nt, Human
aaauauguauuaa

SEQ ID NO: 3182871 - RNA, 12 nt, Human
aaauauguauua

SEQ ID NO: 3182872 - RNA, 21 nt, Human
aaauaugcacuaagucucuuu

SEQ ID NO: 3182873 - RNA, 19 nt, Human
aaauaugcacuaagucucu

SEQ ID NO: 3182874 - RNA, 16 nt, Human
aaauaugcacuaaguc

SEQ ID NO: 3182875 - RNA, 13 nt, Human
aaauaugcacuaa

SEQ ID NO: 3182876 - RNA, 17 nt, Human
aaauaugcaaagcacug

SEQ ID NO: 3182877 - RNA, 16 nt, Human
aaauaugcaaagcacu

SEQ ID NO: 3182878 - RNA, 15 nt, Human
aaauaugcaaagcac

SEQ ID NO: 3182879 - RNA, 13 nt, Human
aaauaugcaaagc

SEQ ID NO: 3182880 - RNA, 15 nt, Human
aaauaucugugaaau

SEQ ID NO: 3182881 - RNA, 21 nt, Human
aaauaucugugaaauaucauc

SEQ ID NO: 3182882 - RNA, 21 nt, Human
aaauaucuaguaauauauuua

SEQ ID NO: 3182883 - RNA, 23 nt, Human
aaauaucuguaagaguguuuaua

SEQ ID NO: 3182884 - RNA, 23 nt, Human
aaauaucugaaaauguaugugua

SEQ ID NO: 3182885 - RNA, 22 nt, Human
aaauaucugaaaauguaugugu

SEQ ID NO: 3182886 - RNA, 21 nt, Human
aaauaucugaaaauguaugug

SEQ ID NO: 3182887 - RNA, 19 nt, Human
aaauaucugaaaauguaug

SEQ ID NO: 3182888 - RNA, 18 nt, Human
aaauaucugaaaauguau

SEQ ID NO: 3182889 - RNA, 17 nt, Human
aaauaucugaaaaugua

SEQ ID NO: 3182890 - RNA, 14 nt, Human
aaauaucugaaaau

SEQ ID NO: 3182891 - RNA, 12 nt, Human
aaauaucugaaa

SEQ ID NO: 3182892 - RNA, 18 nt, Human
aaauauauuacuuaacug

SEQ ID NO: 3182893 - RNA, 19 nt, Human
aaauauauuacuuaacugu

SEQ ID NO: 3182894 - RNA, 20 nt, Human
aaauauauggucuaauguuu

SEQ ID NO: 3182895 - RNA, 22 nt, Human
aaauauauggucuaauguuuaa

SEQ ID NO: 3182896 - RNA, 21 nt, Human
aaauauauggucuaauguuua

SEQ ID NO: 3182897 - RNA, 12 nt, Human
aaauaucaaauu

SEQ ID NO: 3182898 - RNA, 13 nt, Human
aaauaucaaauua

SEQ ID NO: 3182899 - RNA, 16 nt, Human
aaauaucaaauuaauu

SEQ ID NO: 3182900 - RNA, 20 nt, Human
aaauaucaaauuaauugugu

SEQ ID NO: 3182901 - RNA, 23 nt, Human
aaauaucaaauuaauugugugaa

SEQ ID NO: 3182902 - RNA, 21 nt, Human
aaauaucauauaaauauugag

SEQ ID NO: 3182903 - RNA, 20 nt, Human
aaauaucuaguaauauauuu

SEQ ID NO: 3182904 - RNA, 19 nt, Human
aaauaucuaguaauauauu

SEQ ID NO: 3182905 - RNA, 16 nt, Human
aaauaucucuauuuaa

SEQ ID NO: 3182906 - RNA, 17 nt, Human
aaauaucucuauuuaau

SEQ ID NO: 3182907 - RNA, 15 nt, Human
aaauaucucugaguu

SEQ ID NO: 3182908 - RNA, 21 nt, Human
aaauaccaugccauuuaaagc

SEQ ID NO: 3182909 - RNA, 22 nt, Human
guacaaugugacuuugaaaaua

SEQ ID NO: 3182910 - RNA, 16 nt, Human
guacacacacauacac

SEQ ID NO: 3182911 - RNA, 21 nt, Human
guacaaugacuuuauugcauc

SEQ ID NO: 3182912 - RNA, 20 nt, Human
guacaaugacuuuauugcau

SEQ ID NO: 3182913 - RNA, 17 nt, Human
aaauaccauuauuauca

SEQ ID NO: 3182914 - RNA, 15 nt, Human
aaauaccauuauuau

SEQ ID NO: 3182915 - RNA, 18 nt, Human
gguaacuagggaagauaa

SEQ ID NO: 3182916 - RNA, 12 nt, Human
gguaaaaugaag

SEQ ID NO: 3182917 - RNA, 14 nt, Human
gguaaaaugaagaa

SEQ ID NO: 3182918 - RNA, 20 nt, Human
gguaaaaugaagaauuuaaa

SEQ ID NO: 3182919 - RNA, 13 nt, Human
gguaaaaugaaga

SEQ ID NO: 3182920 - RNA, 13 nt, Human
gguaaaauuuugu

SEQ ID NO: 3182921 - RNA, 13 nt, Human
gggugucccagac

SEQ ID NO: 3182922 - RNA, 17 nt, Human
gggugucccagaccccg

SEQ ID NO: 3182923 - RNA, 12 nt, Human
ggguggugaccu

SEQ ID NO: 3182924 - RNA, 15 nt, Human
gggugguggugauag

SEQ ID NO: 3182925 - RNA, 20 nt, Human
ggguuuuauuguuuaaaauc

SEQ ID NO: 3182926 - RNA, 20 nt, Human
ggguuuugccauguuggcca

SEQ ID NO: 3182927 - RNA, 23 nt, Human
ggguuuugccauguuggccaggc

SEQ ID NO: 3182928 - RNA, 12 nt, Human
ggguuuucucuc

SEQ ID NO: 3182929 - RNA, 10 nt, Human
ggguuuuucu

SEQ ID NO: 3182930 - RNA, 20 nt, Human
aaacuuagcaucuaauuuca

SEQ ID NO: 3182931 - RNA, 15 nt, Human
aaacuuaguuuguga

SEQ ID NO: 3182932 - RNA, 16 nt, Human
aaacuuaguuugugaa

SEQ ID NO: 3182933 - RNA, 15 nt, Human
gggugggacacccug

SEQ ID NO: 3182934 - RNA, 18 nt, Human
gggugggacacccuguga

SEQ ID NO: 3182935 - RNA, 14 nt, Human
ggguggccucccaa

SEQ ID NO: 3182936 - RNA, 18 nt, Human
ggguggcgcuagaggcca

SEQ ID NO: 3182937 - RNA, 19 nt, Human
aaacuguuaauaguucagg

SEQ ID NO: 3182938 - RNA, 20 nt, Human
aaacuguuuuagaccuauaa

SEQ ID NO: 3182939 - RNA, 20 nt, Human
aaacguggcugcuucaagga

SEQ ID NO: 3182940 - RNA, 16 nt, Human
aaacguguauguuuuu

SEQ ID NO: 3182941 - RNA, 20 nt, Human
aaacguguauguuuuucagu

SEQ ID NO: 3182942 - RNA, 18 nt, Human
aaacguguauguuuuuca

SEQ ID NO: 3182943 - RNA, 21 nt, Human
aaacguggcugcuucaaggau

SEQ ID NO: 3182944 - RNA, 18 nt, Human
gguaggaacugcugggcu

SEQ ID NO: 3182945 - RNA, 21 nt, Human
gguaggaauauuauauuugga

SEQ ID NO: 3182946 - RNA, 14 nt, Human
gguagggcucugac

SEQ ID NO: 3182947 - RNA, 16 nt, Human
gguaggaacugcuggg

SEQ ID NO: 3182948 - RNA, 20 nt, Human
gguaaggaauaccugucccc

SEQ ID NO: 3182949 - RNA, 12 nt, Human
gguaagaaaaag

SEQ ID NO: 3182950 - RNA, 15 nt, Human
gguaagauuguuauu

SEQ ID NO: 3182951 - RNA, 18 nt, Human
gguaagauuguuauuaaa

SEQ ID NO: 3182952 - RNA, 21 nt, Human
gguaagaaaaagcaaaaggca

SEQ ID NO: 3182953 - RNA, 14 nt, Human
gguaucaggugcug

SEQ ID NO: 3182954 - RNA, 14 nt, Human
gguaucaaaauuac

SEQ ID NO: 3182955 - RNA, 19 nt, Human
gguauaauugugugauauu

SEQ ID NO: 3182956 - RNA, 17 nt, Human
gguauaucauucuaaag

SEQ ID NO: 3182957 - RNA, 21 nt, Human
gguauauccuuuucuguguuu

SEQ ID NO: 3182958 - RNA, 19 nt, Human
gguauauccuuuucugugu

SEQ ID NO: 3182959 - RNA, 20 nt, Human
gguaggguaagugagagagg

SEQ ID NO: 3182960 - RNA, 11 nt, Human
gguaggguggg

SEQ ID NO: 3182961 - RNA, 23 nt, Human
gguagggugggccuucagggagu

SEQ ID NO: 3182962 - RNA, 22 nt, Human
aaacuugauguguuaucucuua

SEQ ID NO: 3182963 - RNA, 16 nt, Human
aaacuuuagguuuuuu

SEQ ID NO: 3182964 - RNA, 24 nt, Human
aaacuuuagguuuuuuuaaugaua

SEQ ID NO: 3182965 - RNA, 20 nt, Human
gguccaggccuacuccuguc

SEQ ID NO: 3182966 - RNA, 22 nt, Human
gguccaggccuacuccugucuu

SEQ ID NO: 3182967 - RNA, 22 nt, Human
ggucauauguuugcuuguauuu

SEQ ID NO: 3182968 - RNA, 19 nt, Human
gguaucaggugcugccauc

SEQ ID NO: 3182969 - RNA, 19 nt, Human
aaaccaccagaagcccaga

SEQ ID NO: 3182970 - RNA, 14 nt, Human
aaaccaccagaagc

SEQ ID NO: 3182971 - RNA, 20 nt, Human
aaacauuuucucuuagaaaa

SEQ ID NO: 3182972 - RNA, 19 nt, Human
aaacauuuucucuuagaaa

SEQ ID NO: 3182973 - RNA, 18 nt, Human
aaaccaccagaagcccag

SEQ ID NO: 3182974 - RNA, 15 nt, Human
aaaccaccagaagcc

SEQ ID NO: 3182975 - RNA, 16 nt, Human
aaaccuguagaaucaa

SEQ ID NO: 3182976 - RNA, 17 nt, Human
aaaccaggcuuucuaga

SEQ ID NO: 3182977 - RNA, 22 nt, Human
aaaccugugucucugagaguag

SEQ ID NO: 3182978 - RNA, 12 nt, Human
aaaccugugaag

SEQ ID NO: 3182979 - RNA, 12 nt, Human
aaaccugucuga

SEQ ID NO: 3182980 - RNA, 18 nt, Human
aaaccugggauuauauau

SEQ ID NO: 3182981 - RNA, 13 nt, Human
aaaccuuaauauu

SEQ ID NO: 3182982 - RNA, 14 nt, Human
aaaccuuaauauuu

SEQ ID NO: 3182983 - RNA, 15 nt, Human
aaaccuuaauauuuc

SEQ ID NO: 3182984 - RNA, 19 nt, Human
aaaccuuaauauuucuuca

SEQ ID NO: 3182985 - RNA, 21 nt, Human
aaaccuuaauauuucuucaaa

SEQ ID NO: 3182986 - RNA, 23 nt, Human
aaaccuuaauauuucuucaaaua

SEQ ID NO: 3182987 - RNA, 17 nt, Human
aaaccuucacuuaggaa

SEQ ID NO: 3182988 - RNA, 19 nt, Human
aaacgacaaaucugucugc

SEQ ID NO: 3182989 - RNA, 18 nt, Human
aaacgacaaaucugucug

SEQ ID NO: 3182990 - RNA, 21 nt, Human
gggucaucuguaccucugccu

SEQ ID NO: 3182991 - RNA, 20 nt, Human
gggucagguugacaggaggu

SEQ ID NO: 3182992 - RNA, 19 nt, Human
gggucagguugacaggagg

SEQ ID NO: 3182993 - RNA, 18 nt, Human
gggucauucauggccugg

SEQ ID NO: 3182994 - RNA, 18 nt, Human
gggucagguugacaggag

SEQ ID NO: 3182995 - RNA, 14 nt, Human
gggucacucuggca

SEQ ID NO: 3182996 - RNA, 20 nt, Human
gggucacucuggcagcucag

SEQ ID NO: 3182997 - RNA, 18 nt, Human
gggguccccuccaggagu

SEQ ID NO: 3182998 - RNA, 19 nt, Human
aaacauuuugucauauaag

SEQ ID NO: 3182999 - RNA, 18 nt, Human
aaacauuucauaauuugu

SEQ ID NO: 3183000 - RNA, 21 nt, Human
aaacauuucauaauuuguuuc

SEQ ID NO: 3183001 - RNA, 22 nt, Human
aaacauuucauaauuuguuucc

SEQ ID NO: 3183002 - RNA, 23 nt, Human
aaacauuucauaauuuguuucca

SEQ ID NO: 3183003 - RNA, 16 nt, Human
gggggcucagcaaggc

SEQ ID NO: 3183004 - RNA, 20 nt, Human
gggggcucagcaaggccacc

SEQ ID NO: 3183005 - RNA, 20 nt, Human
gggggcucaguucuggacug

SEQ ID NO: 3183006 - RNA, 19 nt, Human
gggggcucagcaaggccac

SEQ ID NO: 3183007 - RNA, 11 nt, Human
gggggcuggga

SEQ ID NO: 3183008 - RNA, 17 nt, Human
gggggaucacagccucu

SEQ ID NO: 3183009 - RNA, 15 nt, Human
gggggcugggcagag

SEQ ID NO: 3183010 - RNA, 13 nt, Human
ggggguggccucc

SEQ ID NO: 3183011 - RNA, 22 nt, Human
ggggucaggccgggcagagcac

SEQ ID NO: 3183012 - RNA, 21 nt, Human
ggggucacucuggcagcucag

SEQ ID NO: 3183013 - RNA, 19 nt, Human
ggggccaguuggucccccu

SEQ ID NO: 3183014 - RNA, 14 nt, Human
ggggaccagagcug

SEQ ID NO: 3183015 - RNA, 18 nt, Human
ggggccauauucuuccug

SEQ ID NO: 3183016 - RNA, 20 nt, Human
ggggccccgucucaggucug

SEQ ID NO: 3183017 - RNA, 16 nt, Human
ggggccccgucucagg

SEQ ID NO: 3183018 - RNA, 20 nt, Human
ggggcccaaaugcuggcugg

SEQ ID NO: 3183019 - RNA, 18 nt, Human
aaaauguauguguaagua

SEQ ID NO: 3183020 - RNA, 18 nt, Human
aaaauguaacuguuacca

SEQ ID NO: 3183021 - RNA, 16 nt, Human
aaaauguaacuguuac

SEQ ID NO: 3183022 - RNA, 15 nt, Human
aaaauguaacuguua

SEQ ID NO: 3183023 - RNA, 13 nt, Human
aaaauguaacugu

SEQ ID NO: 3183024 - RNA, 12 nt, Human
aaaauguaacug

SEQ ID NO: 3183025 - RNA, 12 nt, Human
ggggaccagagc

SEQ ID NO: 3183026 - RNA, 13 nt, Human
ggggaccagagcu

SEQ ID NO: 3183027 - RNA, 23 nt, Human
aaaauguccaguaagaucacugu

SEQ ID NO: 3183028 - RNA, 23 nt, Human
aaaaugucaaaaguagaacuuug

SEQ ID NO: 3183029 - RNA, 21 nt, Human
aaaaugucaaaaguagaacuu

SEQ ID NO: 3183030 - RNA, 22 nt, Human
aaaaugucaaaaguagaacuuu

SEQ ID NO: 3183031 - RNA, 14 nt, Human
aaaaugucaaaagu

SEQ ID NO: 3183032 - RNA, 15 nt, Human
aaaaugucaaaagua

SEQ ID NO: 3183033 - RNA, 19 nt, Human
aaaaugacaccaucuuuua

SEQ ID NO: 3183034 - RNA, 15 nt, Human
aaaaucugcuguuaa

SEQ ID NO: 3183035 - RNA, 17 nt, Human
aaaaucugcuguuaacu

SEQ ID NO: 3183036 - RNA, 14 nt, Human
aaaaucugaagauu

SEQ ID NO: 3183037 - RNA, 13 nt, Human
aaaaucugaagau

SEQ ID NO: 3183038 - RNA, 22 nt, Human
aaaaucugaagauuguuuaucu

SEQ ID NO: 3183039 - RNA, 18 nt, Human
aaaaucugaagauuguuu

SEQ ID NO: 3183040 - RNA, 16 nt, Human
aaaaucugaagauugu

SEQ ID NO: 3183041 - RNA, 15 nt, Human
aaaaucugaagauug

SEQ ID NO: 3183042 - RNA, 12 nt, Human
aaaauauuuucu

SEQ ID NO: 3183043 - RNA, 11 nt, Human
aaaaucuccua

SEQ ID NO: 3183044 - RNA, 14 nt, Human
aaaaucuccuaaau

SEQ ID NO: 3183045 - RNA, 19 nt, Human
aaaaucucucauuugugug

SEQ ID NO: 3183046 - RNA, 21 nt, Human
aaaaugcuguauuagucacag

SEQ ID NO: 3183047 - RNA, 23 nt, Human
aaaaugcuguauuagucacagag

SEQ ID NO: 3183048 - RNA, 17 nt, Human
aaaaugcaaaaaaucuu

SEQ ID NO: 3183049 - RNA, 16 nt, Human
aaaaugcaaaaaaucu

SEQ ID NO: 3183050 - RNA, 17 nt, Human
aaaaugccaucaaauga

SEQ ID NO: 3183051 - RNA, 16 nt, Human
aaaaugccaugaauua

SEQ ID NO: 3183052 - RNA, 16 nt, Human
aaaaugcauguaauca

SEQ ID NO: 3183053 - RNA, 16 nt, Human
aaaaugcaugauugca

SEQ ID NO: 3183054 - RNA, 17 nt, Human
aaaauagagaugagcuu

SEQ ID NO: 3183055 - RNA, 21 nt, Human
aaaauagagaugagcuuucuu

SEQ ID NO: 3183056 - RNA, 15 nt, Human
aaaauacuuugaguu

SEQ ID NO: 3183057 - RNA, 18 nt, Human
aaaauacuuugaguuuug

SEQ ID NO: 3183058 - RNA, 12 nt, Human
aaaauacuucuu

SEQ ID NO: 3183059 - RNA, 20 nt, Human
aaaauacuuaaauguuaugu

SEQ ID NO: 3183060 - RNA, 15 nt, Human
aaaauacuuaaaugu

SEQ ID NO: 3183061 - RNA, 14 nt, Human
aaaauacuuaaaug

SEQ ID NO: 3183062 - RNA, 15 nt, Human
aaaauacuguagaua

SEQ ID NO: 3183063 - RNA, 11 nt, Human
aaaauacugua

SEQ ID NO: 3183064 - RNA, 13 nt, Human
aaaauaucaaauu

SEQ ID NO: 3183065 - RNA, 19 nt, Human
aaaauaucuaguaauauau

SEQ ID NO: 3183066 - RNA, 15 nt, Human
aaaauauuccugcau

SEQ ID NO: 3183067 - RNA, 14 nt, Human
aaaauauucucuau

SEQ ID NO: 3183068 - RNA, 21 nt, Human
aaaauauugagcagaauucau

SEQ ID NO: 3183069 - RNA, 22 nt, Human
aaaauaugaccacacuccagcu

SEQ ID NO: 3183070 - RNA, 14 nt, Human
aaaauauuuaaagg

SEQ ID NO: 3183071 - RNA, 14 nt, Human
aaaauaugcacuaa

SEQ ID NO: 3183072 - RNA, 12 nt, Human
aaaauaugcacu

SEQ ID NO: 3183073 - RNA, 20 nt, Human
aaaauauuuaugaagaaaau

SEQ ID NO: 3183074 - RNA, 14 nt, Human
aaaauauuuaaugu

SEQ ID NO: 3183075 - RNA, 14 nt, Human
aaaauauuuaugaa

SEQ ID NO: 3183076 - RNA, 17 nt, Human
aaaauauuuaugaagaa

SEQ ID NO: 3183077 - RNA, 15 nt, Human
aaaauauuuaugaag

SEQ ID NO: 3183078 - RNA, 13 nt, Human
aaaauauuuucug

SEQ ID NO: 3183079 - RNA, 14 nt, Human
aaaauauuuucugu

SEQ ID NO: 3183080 - RNA, 15 nt, Human
aaaauauuuucugug

SEQ ID NO: 3183081 - RNA, 16 nt, Human
aaaauauuuucugugu

SEQ ID NO: 3183082 - RNA, 17 nt, Human
aaaauauuuucugugug

SEQ ID NO: 3183083 - RNA, 18 nt, Human
aaaauauuuucugugugu

SEQ ID NO: 3183084 - RNA, 19 nt, Human
aaaauauuuucuguguguu

SEQ ID NO: 3183085 - RNA, 20 nt, Human
aaaauauuuucuguguguuc

SEQ ID NO: 3183086 - RNA, 21 nt, Human
aaaauauuuucuguguguucc

SEQ ID NO: 3183087 - RNA, 22 nt, Human
aaaauauuuucuguguguuccu

SEQ ID NO: 3183088 - RNA, 23 nt, Human
aaaauauuuucuguguguuccug

SEQ ID NO: 3183089 - RNA, 16 nt, Human
aaaauauuuuccugcc

SEQ ID NO: 3183090 - RNA, 14 nt, Human
aaaauaauuauuua

SEQ ID NO: 3183091 - RNA, 19 nt, Human
aaaauaauuauuuauuaca

SEQ ID NO: 3183092 - RNA, 22 nt, Human
aaaauaagaaaagauguagauu

SEQ ID NO: 3183093 - RNA, 12 nt, Human
aaaauaagaaaa

SEQ ID NO: 3183094 - RNA, 15 nt, Human
aaaauaagaaaagau

SEQ ID NO: 3183095 - RNA, 14 nt, Human
aaaauaagaaaaga

SEQ ID NO: 3183096 - RNA, 15 nt, Human
aaaauaacuguaauu

SEQ ID NO: 3183097 - RNA, 18 nt, Human
aaaauaacuuagacucua

SEQ ID NO: 3183098 - RNA, 14 nt, Human
aaaauaacuguaau

SEQ ID NO: 3183099 - RNA, 13 nt, Human
aaaauaacuguaa

SEQ ID NO: 3183100 - RNA, 17 nt, Human
aaaauaaccuaauuaau

SEQ ID NO: 3183101 - RNA, 18 nt, Human
aaaauaaccuaauuaaua

SEQ ID NO: 3183102 - RNA, 12 nt, Human
aaaauaacugua

SEQ ID NO: 3183103 - RNA, 17 nt, Human
aaaauaacuaaaaugua

SEQ ID NO: 3183104 - RNA, 15 nt, Human
aaaauaacugaauuu

SEQ ID NO: 3183105 - RNA, 14 nt, Human
aaaauacacacuca

SEQ ID NO: 3183106 - RNA, 14 nt, Human
aaaauaauuuugua

SEQ ID NO: 3183107 - RNA, 13 nt, Human
aaaauaauuuugu

SEQ ID NO: 3183108 - RNA, 14 nt, Human
aaaauacucuuuuu

SEQ ID NO: 3183109 - RNA, 22 nt, Human
aaaauacugacuccaaccauuc

SEQ ID NO: 3183110 - RNA, 15 nt, Human
aaaauacaauuuuua

SEQ ID NO: 3183111 - RNA, 16 nt, Human
aaaauacaauuuuuau

SEQ ID NO: 3183112 - RNA, 12 nt, Human
aaaauacauucu

SEQ ID NO: 3183113 - RNA, 16 nt, Human
aaaagguuaauaaagu

SEQ ID NO: 3183114 - RNA, 11 nt, Human
aaaaggcccag

SEQ ID NO: 3183115 - RNA, 18 nt, Human
aaaaggugauaaaaucau

SEQ ID NO: 3183116 - RNA, 17 nt, Human
aaaagguuaauaaagua

SEQ ID NO: 3183117 - RNA, 13 nt, Human
aaaagguugaaua

SEQ ID NO: 3183118 - RNA, 11 nt, Human
aaaaggcagga

SEQ ID NO: 3183119 - RNA, 19 nt, Human
aaaagguaugcaaucaaau

SEQ ID NO: 3183120 - RNA, 22 nt, Human
aaaaggagccaauuuaaagaaa

SEQ ID NO: 3183121 - RNA, 21 nt, Human
aaaaggaagguaguucaagaa

SEQ ID NO: 3183122 - RNA, 14 nt, Human
gggccucagugcca

SEQ ID NO: 3183123 - RNA, 13 nt, Human
gggccucagugcc

SEQ ID NO: 3183124 - RNA, 22 nt, Human
gggccucggacuuagcugggag

SEQ ID NO: 3183125 - RNA, 22 nt, Human
gggccucgguguggagaagcgg

SEQ ID NO: 3183126 - RNA, 18 nt, Human
gggccucuuaugggcugg

SEQ ID NO: 3183127 - RNA, 21 nt, Human
gggcggugagaggggaacaga

SEQ ID NO: 3183128 - RNA, 18 nt, Human
gggcgugagaccugcccc

SEQ ID NO: 3183129 - RNA, 19 nt, Human
gggcgugagaccugccccu

SEQ ID NO: 3183130 - RNA, 12 nt, Human
gggccaggagcc

SEQ ID NO: 3183131 - RNA, 13 nt, Human
gggccaggagccu

SEQ ID NO: 3183132 - RNA, 14 nt, Human
gggccaggagccuc

SEQ ID NO: 3183133 - RNA, 19 nt, Human
gggccauugaacucugaga

SEQ ID NO: 3183134 - RNA, 14 nt, Human
gggccgccuguccu

SEQ ID NO: 3183135 - RNA, 17 nt, Human
gggccggggcuucugug

SEQ ID NO: 3183136 - RNA, 16 nt, Human
aaaaugguuuaaaugg

SEQ ID NO: 3183137 - RNA, 18 nt, Human
aaaaugguuuaaaugguc

SEQ ID NO: 3183138 - RNA, 13 nt, Human
aaaaugguaucaa

SEQ ID NO: 3183139 - RNA, 18 nt, Human
aaaaugguaucaaaauua

SEQ ID NO: 3183140 - RNA, 24 nt, Human
aaaaugguaucaaaauuacauaua

SEQ ID NO: 3183141 - RNA, 14 nt, Human
aaaaugggagaucu

SEQ ID NO: 3183142 - RNA, 21 nt, Human
gggcugggggaugggccugag

SEQ ID NO: 3183143 - RNA, 19 nt, Human
gggcugggggaugggccug

SEQ ID NO: 3183144 - RNA, 17 nt, Human
gggcuggguucuaccca

SEQ ID NO: 3183145 - RNA, 22 nt, Human
gggcugggcccacccaagcagg

SEQ ID NO: 3183146 - RNA, 12 nt, Human
gggcugggcaga

SEQ ID NO: 3183147 - RNA, 15 nt, Human
gggcugggcagagga

SEQ ID NO: 3183148 - RNA, 20 nt, Human
gggcugcaccggcuggccug

SEQ ID NO: 3183149 - RNA, 21 nt, Human
gggcugcaccggcuggccugg

SEQ ID NO: 3183150 - RNA, 21 nt, Human
gggcugcccuggugcugccac

SEQ ID NO: 3183151 - RNA, 20 nt, Human
gggcucagcaaggccaccuc

SEQ ID NO: 3183152 - RNA, 19 nt, Human
gggcucagcaaggccaccu

SEQ ID NO: 3183153 - RNA, 13 nt, Human
gggcucagcaagg

SEQ ID NO: 3183154 - RNA, 18 nt, Human
gggcucagcaaggccacc

SEQ ID NO: 3183155 - RNA, 17 nt, Human
gggcucagcaaggccac

SEQ ID NO: 3183156 - RNA, 16 nt, Human
gggcucagcaaggcca

SEQ ID NO: 3183157 - RNA, 15 nt, Human
gggcucagcaaggcc

SEQ ID NO: 3183158 - RNA, 19 nt, Human
gggcucagcggggacagcu

SEQ ID NO: 3183159 - RNA, 17 nt, Human
gggcucagcggggacag

SEQ ID NO: 3183160 - RNA, 15 nt, Human
gggcuaguugggcuu

SEQ ID NO: 3183161 - RNA, 20 nt, Human
gggcuaggaaauccagggug

SEQ ID NO: 3183162 - RNA, 18 nt, Human
gggcucagcaaaagaugc

SEQ ID NO: 3183163 - RNA, 22 nt, Human
gggcucagcaaaagaugcuucu

SEQ ID NO: 3183164 - RNA, 21 nt, Human
gggcucagcaaggccaccucu

SEQ ID NO: 3183165 - RNA, 21 nt, Human
gggcucagcggggacagcucc

SEQ ID NO: 3183166 - RNA, 10 nt, Human
gggcuccaga

SEQ ID NO: 3183167 - RNA, 13 nt, Human
gggcuccagacac

SEQ ID NO: 3183168 - RNA, 19 nt, Human
gggcucccgccuccaaccc

SEQ ID NO: 3183169 - RNA, 17 nt, Human
gggcugcaccggcuggc

SEQ ID NO: 3183170 - RNA, 19 nt, Human
gggcugcaccggcuggccu

SEQ ID NO: 3183171 - RNA, 18 nt, Human
gggcucaguucuggacug

SEQ ID NO: 3183172 - RNA, 18 nt, Human
gggcucccgccuccaacc

SEQ ID NO: 3183173 - RNA, 13 nt, Human
gggcucccgccuc

SEQ ID NO: 3183174 - RNA, 16 nt, Human
gcggcuggacuuggag

SEQ ID NO: 3183175 - RNA, 15 nt, Human
gcggcuggcagccca

SEQ ID NO: 3183176 - RNA, 17 nt, Human
gcguucaccagugaccu

SEQ ID NO: 3183177 - RNA, 15 nt, Human
gcguguucucagagg

SEQ ID NO: 3183178 - RNA, 15 nt, Human
gcggcuggacuugga

SEQ ID NO: 3183179 - RNA, 18 nt, Human
gcggcucaagcccaggag

SEQ ID NO: 3183180 - RNA, 16 nt, Human
gcggccuuuggcuuca

SEQ ID NO: 3183181 - RNA, 14 nt, Human
gcggcaaaaggaaa

SEQ ID NO: 3183182 - RNA, 16 nt, Human
gcggcaaaaggaaagc

SEQ ID NO: 3183183 - RNA, 22 nt, Human
gcggcaaucaauaaacagcagg

SEQ ID NO: 3183184 - RNA, 22 nt, Human
gccugggcaauaaagugagacc

SEQ ID NO: 3183185 - RNA, 15 nt, Human
gccugggcaauaaag

SEQ ID NO: 3183186 - RNA, 19 nt, Human
gccugugccucugggacug

SEQ ID NO: 3183187 - RNA, 23 nt, Human
gccugggaucccucauccucaua

SEQ ID NO: 3183188 - RNA, 21 nt, Human
gccugggaucccucauccuca

SEQ ID NO: 3183189 - RNA, 11 nt, Human
gccugggcaga

SEQ ID NO: 3183190 - RNA, 22 nt, Human
gccuggcucccucacucucagg

SEQ ID NO: 3183191 - RNA, 21 nt, Human
gccuggcucccucacucucag

SEQ ID NO: 3183192 - RNA, 19 nt, Human
gccuggcucccucacucuc

SEQ ID NO: 3183193 - RNA, 16 nt, Human
gccuggcucccucacu

SEQ ID NO: 3183194 - RNA, 12 nt, Human
gccuggcucccu

SEQ ID NO: 3183195 - RNA, 13 nt, Human
gccuggcuccccu

SEQ ID NO: 3183196 - RNA, 14 nt, Human
gccuggcuccccug

SEQ ID NO: 3183197 - RNA, 15 nt, Human
gccuggcuccccugg

SEQ ID NO: 3183198 - RNA, 16 nt, Human
gccuggcuccccuggg

SEQ ID NO: 3183199 - RNA, 17 nt, Human
gccuggcuccccugggg

SEQ ID NO: 3183200 - RNA, 23 nt, Human
gccuggcucccucacucucagga

SEQ ID NO: 3183201 - RNA, 23 nt, Human
gccuucggccuccauccugaggc

SEQ ID NO: 3183202 - RNA, 18 nt, Human
gccuucgguacccaccac

SEQ ID NO: 3183203 - RNA, 19 nt, Human
gccuucgguacccaccaca

SEQ ID NO: 3183204 - RNA, 16 nt, Human
gccuucucugaaggac

SEQ ID NO: 3183205 - RNA, 15 nt, Human
gccuucucugaagga

SEQ ID NO: 3183206 - RNA, 16 nt, Human
gccuguucagcuccag

SEQ ID NO: 3183207 - RNA, 14 nt, Human
gccuguucagcucc

SEQ ID NO: 3183208 - RNA, 15 nt, Human
gccuguucagcucca

SEQ ID NO: 3183209 - RNA, 16 nt, Human
gccuucugaugaaaug

SEQ ID NO: 3183210 - RNA, 17 nt, Human
gccuucugaugaaaugu

SEQ ID NO: 3183211 - RNA, 21 nt, Human
gccuugaccauucuccaccug

SEQ ID NO: 3183212 - RNA, 22 nt, Human
gccuugaccauucuccaccugc

SEQ ID NO: 3183213 - RNA, 17 nt, Human
gcgauucuucugcuuca

SEQ ID NO: 3183214 - RNA, 22 nt, Human
gcgauucuucugcuucagccuc

SEQ ID NO: 3183215 - RNA, 23 nt, Human
gccuugaccauucuccaccugcc

SEQ ID NO: 3183216 - RNA, 20 nt, Human
gccuugauucccuuguuauu

SEQ ID NO: 3183217 - RNA, 23 nt, Human
gcgauucuucugcuucagccucc

SEQ ID NO: 3183218 - RNA, 20 nt, Human
gcgcagcauauucaggaagc

SEQ ID NO: 3183219 - RNA, 21 nt, Human
gcgcagcauauucaggaagcu

SEQ ID NO: 3183220 - RNA, 14 nt, Human
gcgcaggcuggccc

SEQ ID NO: 3183221 - RNA, 16 nt, Human
gcgcagcccgcggcaa

SEQ ID NO: 3183222 - RNA, 17 nt, Human
gcgcagcauccgaccag

SEQ ID NO: 3183223 - RNA, 15 nt, Human
gcgcaggcuggcccu

SEQ ID NO: 3183224 - RNA, 16 nt, Human
gcgcaggcuggcccug

SEQ ID NO: 3183225 - RNA, 22 nt, Human
gcuaagugauccucccaccuca

SEQ ID NO: 3183226 - RNA, 18 nt, Human
gcuaagugauccucccac

SEQ ID NO: 3183227 - RNA, 19 nt, Human
gcuaaguaaaucucuucug

SEQ ID NO: 3183228 - RNA, 18 nt, Human
gcuaaguaaaucucuucu

SEQ ID NO: 3183229 - RNA, 19 nt, Human
gcuaguguucuuucucuuu

SEQ ID NO: 3183230 - RNA, 13 nt, Human
gcuaguugaauac

SEQ ID NO: 3183231 - RNA, 15 nt, Human
gcuaguugaauacuu

SEQ ID NO: 3183232 - RNA, 16 nt, Human
gcuaguugaauacuug

SEQ ID NO: 3183233 - RNA, 18 nt, Human
gcuaguugaauacuugaa

SEQ ID NO: 3183234 - RNA, 16 nt, Human
gcuaguugggcuuccu

SEQ ID NO: 3183235 - RNA, 14 nt, Human
gcuaguugggcuuc

SEQ ID NO: 3183236 - RNA, 12 nt, Human
gcuauuaaaaaa

SEQ ID NO: 3183237 - RNA, 15 nt, Human
gcuauuaaaaaaguc

SEQ ID NO: 3183238 - RNA, 16 nt, Human
gcuauuaaaaaagucu

SEQ ID NO: 3183239 - RNA, 23 nt, Human
gcuauuacgaaguucaagaucaa

SEQ ID NO: 3183240 - RNA, 19 nt, Human
gcuauuaacaauuaauugu

SEQ ID NO: 3183241 - RNA, 12 nt, Human
gcuauuaauauu

SEQ ID NO: 3183242 - RNA, 15 nt, Human
gcuauuaauauuugu

SEQ ID NO: 3183243 - RNA, 19 nt, Human
gcuaguugaauacuugaac

SEQ ID NO: 3183244 - RNA, 22 nt, Human
gcuaguugaauacuugaaccau

SEQ ID NO: 3183245 - RNA, 16 nt, Human
gcuaggaaugaaaucu

SEQ ID NO: 3183246 - RNA, 18 nt, Human
gcuaggaauauagauuaa

SEQ ID NO: 3183247 - RNA, 20 nt, Human
gcuaggaccccuccaugugg

SEQ ID NO: 3183248 - RNA, 20 nt, Human
gcucagggccuggcucaggu

SEQ ID NO: 3183249 - RNA, 21 nt, Human
gcucacugcuaagaauauuug

SEQ ID NO: 3183250 - RNA, 17 nt, Human
gcucacuguggugucug

SEQ ID NO: 3183251 - RNA, 19 nt, Human
gcucacuguggugucugug

SEQ ID NO: 3183252 - RNA, 18 nt, Human
gcucacuguggugucugu

SEQ ID NO: 3183253 - RNA, 15 nt, Human
gcucaaaugaaaugu

SEQ ID NO: 3183254 - RNA, 22 nt, Human
gcucagagagggugggaguggg

SEQ ID NO: 3183255 - RNA, 17 nt, Human
gcucagaaccacagcaa

SEQ ID NO: 3183256 - RNA, 15 nt, Human
gcucagaaccacagc

SEQ ID NO: 3183257 - RNA, 18 nt, Human
gcucagggccuggcucag

SEQ ID NO: 3183258 - RNA, 19 nt, Human
gcucagggccuggcucagg

SEQ ID NO: 3183259 - RNA, 13 nt, Human
gcucaggaguuug

SEQ ID NO: 3183260 - RNA, 17 nt, Human
gcucagggccuggcuca

SEQ ID NO: 3183261 - RNA, 17 nt, Human
gccuacaggagugagca

SEQ ID NO: 3183262 - RNA, 19 nt, Human
gccucaugucaaauauuua

SEQ ID NO: 3183263 - RNA, 22 nt, Human
gccucauguccacugguucuuc

SEQ ID NO: 3183264 - RNA, 19 nt, Human
gccucaugcuaagacucag

SEQ ID NO: 3183265 - RNA, 13 nt, Human
gccuccauccuga

SEQ ID NO: 3183266 - RNA, 14 nt, Human
gccuccauccugag

SEQ ID NO: 3183267 - RNA, 20 nt, Human
gccuccugacacaccugcag

SEQ ID NO: 3183268 - RNA, 21 nt, Human
gccuccugacacaccugcagc

SEQ ID NO: 3183269 - RNA, 23 nt, Human
gccuccugacacaccugcagccu

SEQ ID NO: 3183270 - RNA, 12 nt, Human
gccuccauccug

SEQ ID NO: 3183271 - RNA, 19 nt, Human
gccuccugaguagcuggga

SEQ ID NO: 3183272 - RNA, 22 nt, Human
gccuccuuugugaggaagccgc

SEQ ID NO: 3183273 - RNA, 13 nt, Human
gccucgaacuggc

SEQ ID NO: 3183274 - RNA, 16 nt, Human
gccucgaacuggcugc

SEQ ID NO: 3183275 - RNA, 14 nt, Human
gccucugggacugg

SEQ ID NO: 3183276 - RNA, 16 nt, Human
gccccuggcagccccu

SEQ ID NO: 3183277 - RNA, 17 nt, Human
gccccuggcagccccug

SEQ ID NO: 3183278 - RNA, 16 nt, Human
gccgcuccagagucag

SEQ ID NO: 3183279 - RNA, 13 nt, Human
gccgcuccagagu

SEQ ID NO: 3183280 - RNA, 12 nt, Human
gccgcuccagag

SEQ ID NO: 3183281 - RNA, 22 nt, Human
gccggacacccgacuccagucc

SEQ ID NO: 3183282 - RNA, 16 nt, Human
gccuacaggagugagc

SEQ ID NO: 3183283 - RNA, 16 nt, Human
gccuacaaaucaguaa

SEQ ID NO: 3183284 - RNA, 17 nt, Human
gccuacaaaucaguaau

SEQ ID NO: 3183285 - RNA, 23 nt, Human
gccggcaauaaaagcccaggagc

SEQ ID NO: 3183286 - RNA, 22 nt, Human
gccggcaauaaaagcccaggag

SEQ ID NO: 3183287 - RNA, 21 nt, Human
gccggcaauaaaagcccagga

SEQ ID NO: 3183288 - RNA, 20 nt, Human
gccggcaauaaaagcccagg

SEQ ID NO: 3183289 - RNA, 19 nt, Human
gccggcaauaaaagcccag

SEQ ID NO: 3183290 - RNA, 18 nt, Human
gccggcaauaaaagccca

SEQ ID NO: 3183291 - RNA, 15 nt, Human
gcccuuccucuccac

SEQ ID NO: 3183292 - RNA, 14 nt, Human
gcccuuccucucca

SEQ ID NO: 3183293 - RNA, 11 nt, Human
gccgcuccaga

SEQ ID NO: 3183294 - RNA, 13 nt, Human
gccgcuagguaga

SEQ ID NO: 3183295 - RNA, 23 nt, Human
gccgcuagguagagucugagggc

SEQ ID NO: 3183296 - RNA, 21 nt, Human
gcccuuccaugucgccucugc

SEQ ID NO: 3183297 - RNA, 12 nt, Human
gcccuuccaugu

SEQ ID NO: 3183298 - RNA, 22 nt, Human
gcccuuccaugucgccucugca

SEQ ID NO: 3183299 - RNA, 12 nt, Human
gcccuuccucuc

SEQ ID NO: 3183300 - RNA, 16 nt, Human
gcccugugggccccca

SEQ ID NO: 3183301 - RNA, 17 nt, Human
gcccugugggcccccaa

SEQ ID NO: 3183302 - RNA, 21 nt, Human
gcccuuaccugccaggaagcc

SEQ ID NO: 3183303 - RNA, 22 nt, Human
gcccuuaccugccaggaagcca

SEQ ID NO: 3183304 - RNA, 23 nt, Human
gcccuuaccugccaggaagccag

SEQ ID NO: 3183305 - RNA, 14 nt, Human
gcccugcccaccug

SEQ ID NO: 3183306 - RNA, 13 nt, Human
gcccugcccacac

SEQ ID NO: 3183307 - RNA, 20 nt, Human
gcccugcccacaccuccugg

SEQ ID NO: 3183308 - RNA, 20 nt, Human
gcccugcgggucacaggagg

SEQ ID NO: 3183309 - RNA, 11 nt, Human
gcccacuggcc

SEQ ID NO: 3183310 - RNA, 21 nt, Human
gcccacgcuggagugcaguga

SEQ ID NO: 3183311 - RNA, 19 nt, Human
gcccacgcuggagugcagu

SEQ ID NO: 3183312 - RNA, 23 nt, Human
gcccacgcuggagugcagugagc

SEQ ID NO: 3183313 - RNA, 15 nt, Human
gccauugcuuaccuu

SEQ ID NO: 3183314 - RNA, 24 nt, Human
gcccaggaaaggcuccaggagcag

SEQ ID NO: 3183315 - RNA, 21 nt, Human
gcccaggaaaggcuccaggag

SEQ ID NO: 3183316 - RNA, 15 nt, Human
gcccacuucccuggg

SEQ ID NO: 3183317 - RNA, 11 nt, Human
gcccacuuccc

SEQ ID NO: 3183318 - RNA, 16 nt, Human
gcccacuucccugggu

SEQ ID NO: 3183319 - RNA, 22 nt, Human
gcccaggaaaggcuccaggagc

SEQ ID NO: 3183320 - RNA, 23 nt, Human
gcccaggaaaggcuccaggagca

SEQ ID NO: 3183321 - RNA, 13 nt, Human
gcccacuucugcc

SEQ ID NO: 3183322 - RNA, 23 nt, Human
gcccacugugcguggggcucccg

SEQ ID NO: 3183323 - RNA, 16 nt, Human
gcccacugugcguggg

SEQ ID NO: 3183324 - RNA, 17 nt, Human
gccauugacuucuuccc

SEQ ID NO: 3183325 - RNA, 15 nt, Human
gcccacgcccccacu

SEQ ID NO: 3183326 - RNA, 16 nt, Human
gcccacgcccccacug

SEQ ID NO: 3183327 - RNA, 17 nt, Human
gcccacgcccccacugg

SEQ ID NO: 3183328 - RNA, 21 nt, Human
gcccacgcccccacuggugac

SEQ ID NO: 3183329 - RNA, 19 nt, Human
gcauuuaggccaugggaca

SEQ ID NO: 3183330 - RNA, 18 nt, Human
gcauuuacuuuguguuca

SEQ ID NO: 3183331 - RNA, 18 nt, Human
gcauuuagggaguauucu

SEQ ID NO: 3183332 - RNA, 17 nt, Human
gcccaggagaaugcugc

SEQ ID NO: 3183333 - RNA, 18 nt, Human
gcccaggauauauuuuau

SEQ ID NO: 3183334 - RNA, 16 nt, Human
gcccaggauauauuuu

SEQ ID NO: 3183335 - RNA, 11 nt, Human
gcccaggcagg

SEQ ID NO: 3183336 - RNA, 16 nt, Human
gcccaggcaggucuug

SEQ ID NO: 3183337 - RNA, 12 nt, Human
gcccaggccccu

SEQ ID NO: 3183338 - RNA, 11 nt, Human
gcccaggcccc

SEQ ID NO: 3183339 - RNA, 21 nt, Human
gcccaggccccugccacccug

SEQ ID NO: 3183340 - RNA, 20 nt, Human
gcccaggccccugccacccu

SEQ ID NO: 3183341 - RNA, 18 nt, Human
gcccaggccccugccacc

SEQ ID NO: 3183342 - RNA, 20 nt, Human
gccccaaaacucuccucugc

SEQ ID NO: 3183343 - RNA, 11 nt, Human
gccccaaaagg

SEQ ID NO: 3183344 - RNA, 21 nt, Human
gccccaaaacucuccucugcu

SEQ ID NO: 3183345 - RNA, 19 nt, Human
gccccaaaacucuccucug

SEQ ID NO: 3183346 - RNA, 14 nt, Human
gccccaacccuucu

SEQ ID NO: 3183347 - RNA, 15 nt, Human
gccccaacccuucuu

SEQ ID NO: 3183348 - RNA, 16 nt, Human
gccccaacccuucuuc

SEQ ID NO: 3183349 - RNA, 17 nt, Human
gccccaacccuucuuca

SEQ ID NO: 3183350 - RNA, 22 nt, Human
gccccaaauugucaccugcuuc

SEQ ID NO: 3183351 - RNA, 12 nt, Human
gcccccacuggu

SEQ ID NO: 3183352 - RNA, 12 nt, Human
gccccuggcagc

SEQ ID NO: 3183353 - RNA, 15 nt, Human
gccccuggcagcccc

SEQ ID NO: 3183354 - RNA, 16 nt, Human
gccccugcugguucag

SEQ ID NO: 3183355 - RNA, 15 nt, Human
gccccugcugguuca

SEQ ID NO: 3183356 - RNA, 12 nt, Human
gccccugcuggu

SEQ ID NO: 3183357 - RNA, 14 nt, Human
gcccccucugcccu

SEQ ID NO: 3183358 - RNA, 17 nt, Human
gcccccucuucccuggu

SEQ ID NO: 3183359 - RNA, 17 nt, Human
gcccccucugcccugcg

SEQ ID NO: 3183360 - RNA, 15 nt, Human
gcccccucugcccug

SEQ ID NO: 3183361 - RNA, 16 nt, Human
gcccccucugcccugc

SEQ ID NO: 3183362 - RNA, 12 nt, Human
gcccccagcuuc

SEQ ID NO: 3183363 - RNA, 19 nt, Human
gcccccagcuuccagcagg

SEQ ID NO: 3183364 - RNA, 18 nt, Human
gcccccagcuuccagcag

SEQ ID NO: 3183365 - RNA, 14 nt, Human
gcuuuggaaguuuu

SEQ ID NO: 3183366 - RNA, 16 nt, Human
gcuuugccaugugcuu

SEQ ID NO: 3183367 - RNA, 22 nt, Human
gcuguuuacuugaauaguauug

SEQ ID NO: 3183368 - RNA, 12 nt, Human
gcuguuuggaaa

SEQ ID NO: 3183369 - RNA, 14 nt, Human
gcuguuuggaaaag

SEQ ID NO: 3183370 - RNA, 19 nt, Human
gcuguuuaucccuuaagaa

SEQ ID NO: 3183371 - RNA, 16 nt, Human
gcuucuucagagacuc

SEQ ID NO: 3183372 - RNA, 17 nt, Human
gcuguuuggguuuccaa

SEQ ID NO: 3183373 - RNA, 13 nt, Human
gcuuaagaaaaaa

SEQ ID NO: 3183374 - RNA, 12 nt, Human
gcuuaagaaaaa

SEQ ID NO: 3183375 - RNA, 19 nt, Human
gcuucuucagagacuccug

SEQ ID NO: 3183376 - RNA, 21 nt, Human
gcuucuucagagacuccugca

SEQ ID NO: 3183377 - RNA, 16 nt, Human
gcuugaccgugaggcc

SEQ ID NO: 3183378 - RNA, 17 nt, Human
gcuugaccgugaggcca

SEQ ID NO: 3183379 - RNA, 18 nt, Human
gcuugaccgugaggccag

SEQ ID NO: 3183380 - RNA, 19 nt, Human
gcuugaccgugaggccaga

SEQ ID NO: 3183381 - RNA, 23 nt, Human
gcuugggcuucauccuccucaga

SEQ ID NO: 3183382 - RNA, 16 nt, Human
gcuuggggaccagagc

SEQ ID NO: 3183383 - RNA, 22 nt, Human
gcuuucuacccagcgagcccug

SEQ ID NO: 3183384 - RNA, 19 nt, Human
gcuuucuacccagcgagcc

SEQ ID NO: 3183385 - RNA, 13 nt, Human
gcuuucuacccag

SEQ ID NO: 3183386 - RNA, 18 nt, Human
gcuuuccuguuucucagu

SEQ ID NO: 3183387 - RNA, 18 nt, Human
gcuuuccugugccaggug

SEQ ID NO: 3183388 - RNA, 17 nt, Human
gcuuuccugugccaggu

SEQ ID NO: 3183389 - RNA, 14 nt, Human
gcuuuccugugcca

SEQ ID NO: 3183390 - RNA, 13 nt, Human
gcuuugcacuuuu

SEQ ID NO: 3183391 - RNA, 17 nt, Human
gcuuggggaccagagcu

SEQ ID NO: 3183392 - RNA, 18 nt, Human
gcuuggggaccagagcug

SEQ ID NO: 3183393 - RNA, 20 nt, Human
gcuuggggaccagagcugcc

SEQ ID NO: 3183394 - RNA, 21 nt, Human
gcuuggggaccagagcugcca

SEQ ID NO: 3183395 - RNA, 22 nt, Human
gcuuggggaccagagcugccac

SEQ ID NO: 3183396 - RNA, 19 nt, Human
gcuugggcuucauccuccu

SEQ ID NO: 3183397 - RNA, 16 nt, Human
gcuuuccucuuccuga

SEQ ID NO: 3183398 - RNA, 13 nt, Human
gcuuuccugugcc

SEQ ID NO: 3183399 - RNA, 17 nt, Human
gcuuuucuuucuaccaa

SEQ ID NO: 3183400 - RNA, 15 nt, Human
gcuuuuccugggaca

SEQ ID NO: 3183401 - RNA, 22 nt, Human
gcuuuuccucaaagggagagag

SEQ ID NO: 3183402 - RNA, 19 nt, Human
ggaaacuauguguuuuucu

SEQ ID NO: 3183403 - RNA, 23 nt, Human
ggaaacuauguguuuuucucaua

SEQ ID NO: 3183404 - RNA, 13 nt, Human
gcuuuuuuugaaa

SEQ ID NO: 3183405 - RNA, 13 nt, Human
ggaaacugccagc

SEQ ID NO: 3183406 - RNA, 15 nt, Human
ggaaacccagcucug

SEQ ID NO: 3183407 - RNA, 20 nt, Human
ggaaacagcuaaugggacac

SEQ ID NO: 3183408 - RNA, 17 nt, Human
ggaaacagaggaccagc

SEQ ID NO: 3183409 - RNA, 20 nt, Human
gcuuuuuuugaaacuuugag

SEQ ID NO: 3183410 - RNA, 16 nt, Human
gcuuuuguuuugcuuu

SEQ ID NO: 3183411 - RNA, 21 nt, Human
gcuuuuuuugaaacuuugaga

SEQ ID NO: 3183412 - RNA, 20 nt, Human
gcuuuuuuuuuuuaauuuug

SEQ ID NO: 3183413 - RNA, 14 nt, Human
gcuuuuguuuugcu

SEQ ID NO: 3183414 - RNA, 15 nt, Human
gcuuuuuaauauuga

SEQ ID NO: 3183415 - RNA, 19 nt, Human
ggaaagcaaaggagauugg

SEQ ID NO: 3183416 - RNA, 16 nt, Human
ggaaagaguaggaaga

SEQ ID NO: 3183417 - RNA, 17 nt, Human
ggaaagaguaggaagac

SEQ ID NO: 3183418 - RNA, 20 nt, Human
ggaaagacuuuuccaacccu

SEQ ID NO: 3183419 - RNA, 14 nt, Human
ggaaagaggcucug

SEQ ID NO: 3183420 - RNA, 21 nt, Human
ggaaacuugauuugagauuuu

SEQ ID NO: 3183421 - RNA, 21 nt, Human
ggaaagcacagaggccuccug

SEQ ID NO: 3183422 - RNA, 14 nt, Human
ggaaagcacagagg

SEQ ID NO: 3183423 - RNA, 12 nt, Human
ggaaagcacaga

SEQ ID NO: 3183424 - RNA, 21 nt, Human
ggaagccagcaggcucucagg

SEQ ID NO: 3183425 - RNA, 18 nt, Human
ggaagccgcuggggccag

SEQ ID NO: 3183426 - RNA, 15 nt, Human
ggaagccgcuggggc

SEQ ID NO: 3183427 - RNA, 22 nt, Human
ggaagccagcaggcucucaggc

SEQ ID NO: 3183428 - RNA, 23 nt, Human
ggaagccagcaggcucucaggcc

SEQ ID NO: 3183429 - RNA, 23 nt, Human
ggaaaucaccgaaaacguggcug

SEQ ID NO: 3183430 - RNA, 16 nt, Human
ggaaauccaggguggu

SEQ ID NO: 3183431 - RNA, 19 nt, Human
ggaaugaaugucaguguga

SEQ ID NO: 3183432 - RNA, 21 nt, Human
ggaauauuauauuuggaugca

SEQ ID NO: 3183433 - RNA, 12 nt, Human
ggacacagcucu

SEQ ID NO: 3183434 - RNA, 12 nt, Human
ggaaugaggggg

SEQ ID NO: 3183435 - RNA, 17 nt, Human
ggaaugagggggcucag

SEQ ID NO: 3183436 - RNA, 21 nt, Human
ggacaccauuaccaaaauaau

SEQ ID NO: 3183437 - RNA, 12 nt, Human
ggacacccugug

SEQ ID NO: 3183438 - RNA, 21 nt, Human
ggacacagcucuucuccaggc

SEQ ID NO: 3183439 - RNA, 13 nt, Human
ggacacagcucuu

SEQ ID NO: 3183440 - RNA, 16 nt, Human
ggaagcucagggccug

SEQ ID NO: 3183441 - RNA, 17 nt, Human
ggaagcucagggccugg

SEQ ID NO: 3183442 - RNA, 21 nt, Human
ggaagcucagggccuggcuca

SEQ ID NO: 3183443 - RNA, 15 nt, Human
ggaauaccugucccc

SEQ ID NO: 3183444 - RNA, 15 nt, Human
ggaagcucagggccu

SEQ ID NO: 3183445 - RNA, 16 nt, Human
ggaauaccuguccccc

SEQ ID NO: 3183446 - RNA, 19 nt, Human
ggaauaccugucccccuga

SEQ ID NO: 3183447 - RNA, 17 nt, Human
ggaauaugggagaaaua

SEQ ID NO: 3183448 - RNA, 15 nt, Human
ggaauauuaaaaaac

SEQ ID NO: 3183449 - RNA, 19 nt, Human
ggaauauuauauuuggaug

SEQ ID NO: 3183450 - RNA, 15 nt, Human
ggaauauuauauuug

SEQ ID NO: 3183451 - RNA, 13 nt, Human
ggacacccuguga

SEQ ID NO: 3183452 - RNA, 23 nt, Human
ggacacccugugauggggcccug

SEQ ID NO: 3183453 - RNA, 17 nt, Human
ggacagggaggugaccc

SEQ ID NO: 3183454 - RNA, 23 nt, Human
ggacaggcauguucucugaggac

SEQ ID NO: 3183455 - RNA, 17 nt, Human
ggacaggggcaggagga

SEQ ID NO: 3183456 - RNA, 18 nt, Human
ggacaguauuugugggga

SEQ ID NO: 3183457 - RNA, 22 nt, Human
ggacagggcauggccagguggc

SEQ ID NO: 3183458 - RNA, 15 nt, Human
ggacagggcauggcc

SEQ ID NO: 3183459 - RNA, 19 nt, Human
ggacaguauuuguggggag

SEQ ID NO: 3183460 - RNA, 15 nt, Human
ggacagggguuccuu

SEQ ID NO: 3183461 - RNA, 13 nt, Human
ggacauggacaag

SEQ ID NO: 3183462 - RNA, 21 nt, Human
ggacauccugucaucugagaa

SEQ ID NO: 3183463 - RNA, 20 nt, Human
ggacauccccugcuggccgg

SEQ ID NO: 3183464 - RNA, 19 nt, Human
ggacauaacugacuuaguu

SEQ ID NO: 3183465 - RNA, 14 nt, Human
ggacauccccugcu

SEQ ID NO: 3183466 - RNA, 22 nt, Human
ggacaguggagugcaaaaggcu

SEQ ID NO: 3183467 - RNA, 17 nt, Human
gcuguaucccaugagcc

SEQ ID NO: 3183468 - RNA, 15 nt, Human
gcugugcugcccugc

SEQ ID NO: 3183469 - RNA, 16 nt, Human
gcugugcugcccugcc

SEQ ID NO: 3183470 - RNA, 15 nt, Human
gcuguuggcuggggg

SEQ ID NO: 3183471 - RNA, 20 nt, Human
gcuguuggcugggggccuca

SEQ ID NO: 3183472 - RNA, 16 nt, Human
gcuguuggcugggggc

SEQ ID NO: 3183473 - RNA, 14 nt, Human
gcuguuggcugggg

SEQ ID NO: 3183474 - RNA, 16 nt, Human
gcuguugucucuucuc

SEQ ID NO: 3183475 - RNA, 17 nt, Human
gcuguugucucuucucc

SEQ ID NO: 3183476 - RNA, 16 nt, Human
gcugugcucuggacag

SEQ ID NO: 3183477 - RNA, 15 nt, Human
gcugugcucuggaca

SEQ ID NO: 3183478 - RNA, 14 nt, Human
gcugugcugcccug

SEQ ID NO: 3183479 - RNA, 13 nt, Human
gcugugcucugga

SEQ ID NO: 3183480 - RNA, 15 nt, Human
gcugugccucugccu

SEQ ID NO: 3183481 - RNA, 14 nt, Human
gcugugccucugcc

SEQ ID NO: 3183482 - RNA, 16 nt, Human
gcugugccucugccug

SEQ ID NO: 3183483 - RNA, 22 nt, Human
gcugggguggggaccucaggcc

SEQ ID NO: 3183484 - RNA, 18 nt, Human
gcuggguucuacccaggu

SEQ ID NO: 3183485 - RNA, 17 nt, Human
gcuggguucuacccagg

SEQ ID NO: 3183486 - RNA, 20 nt, Human
gcuggguucuacccaggugc

SEQ ID NO: 3183487 - RNA, 21 nt, Human
gcuggguucuacccaggugcu

SEQ ID NO: 3183488 - RNA, 23 nt, Human
gcugguaaaaugaagaauuuaaa

SEQ ID NO: 3183489 - RNA, 16 nt, Human
gcugguaaaaugaaga

SEQ ID NO: 3183490 - RNA, 18 nt, Human
gcugguaaaaugaagaau

SEQ ID NO: 3183491 - RNA, 14 nt, Human
gcugguaaaaugaa

SEQ ID NO: 3183492 - RNA, 20 nt, Human
gcugggcccacccaagcagg

SEQ ID NO: 3183493 - RNA, 17 nt, Human
gcugggguggggaccuc

SEQ ID NO: 3183494 - RNA, 19 nt, Human
gcugggguggggaccucag

SEQ ID NO: 3183495 - RNA, 20 nt, Human
gcugggaauaagugccagga

SEQ ID NO: 3183496 - RNA, 14 nt, Human
gcugggcagguugg

SEQ ID NO: 3183497 - RNA, 23 nt, Human
gcuggcuguuggcugggggccuc

SEQ ID NO: 3183498 - RNA, 20 nt, Human
gcuggcuguuggcugggggc

SEQ ID NO: 3183499 - RNA, 17 nt, Human
gcuggcuguuggcuggg

SEQ ID NO: 3183500 - RNA, 14 nt, Human
gcugggaaagcaua

SEQ ID NO: 3183501 - RNA, 13 nt, Human
gcuggacuuggag

SEQ ID NO: 3183502 - RNA, 14 nt, Human
gcuggcgugcagug

SEQ ID NO: 3183503 - RNA, 15 nt, Human
gcuggagaggagccc

SEQ ID NO: 3183504 - RNA, 14 nt, Human
gcuggagaaaaaua

SEQ ID NO: 3183505 - RNA, 19 nt, Human
gcuggcuguuggcuggggg

SEQ ID NO: 3183506 - RNA, 18 nt, Human
gcuggcuguuggcugggg

SEQ ID NO: 3183507 - RNA, 11 nt, Human
gcuggcugccu

SEQ ID NO: 3183508 - RNA, 20 nt, Human
gcuggcugccuuagaaccuu

SEQ ID NO: 3183509 - RNA, 14 nt, Human
gcuggcugccuuag

SEQ ID NO: 3183510 - RNA, 18 nt, Human
gcuggcgugcaguggugc

SEQ ID NO: 3183511 - RNA, 15 nt, Human
gcuggcgugcagugg

SEQ ID NO: 3183512 - RNA, 16 nt, Human
gcuggagaggagcccu

SEQ ID NO: 3183513 - RNA, 17 nt, Human
gcuggagaggagcccug

SEQ ID NO: 3183514 - RNA, 13 nt, Human
gcugcugaaacaa

SEQ ID NO: 3183515 - RNA, 23 nt, Human
gcugcaaaggguaucaggugcug

SEQ ID NO: 3183516 - RNA, 16 nt, Human
gcugcacccucaggca

SEQ ID NO: 3183517 - RNA, 18 nt, Human
gcugcacccucaggcagg

SEQ ID NO: 3183518 - RNA, 19 nt, Human
gcugcacccucaggcaggu

SEQ ID NO: 3183519 - RNA, 13 nt, Human
gcugcaccggcug

SEQ ID NO: 3183520 - RNA, 15 nt, Human
gcugcagccaggcca

SEQ ID NO: 3183521 - RNA, 22 nt, Human
gcugcagauacuacugaccaga

SEQ ID NO: 3183522 - RNA, 20 nt, Human
gcugcagauaaguggccuug

SEQ ID NO: 3183523 - RNA, 23 nt, Human
gcugcagccaggccacuggcccc

SEQ ID NO: 3183524 - RNA, 17 nt, Human
gcugccuaggauucaca

SEQ ID NO: 3183525 - RNA, 17 nt, Human
gcugccccuggcagccc

SEQ ID NO: 3183526 - RNA, 20 nt, Human
gcugccccuggcagccccug

SEQ ID NO: 3183527 - RNA, 18 nt, Human
gcugccccuggcagcccc

SEQ ID NO: 3183528 - RNA, 19 nt, Human
gcugccccuggcagccccu

SEQ ID NO: 3183529 - RNA, 23 nt, Human
gcugcucuugaacuccugaccuc

SEQ ID NO: 3183530 - RNA, 17 nt, Human
gcugccuguucagcucc

SEQ ID NO: 3183531 - RNA, 13 nt, Human
gcugccuguucag

SEQ ID NO: 3183532 - RNA, 12 nt, Human
gcugccuguuca

SEQ ID NO: 3183533 - RNA, 21 nt, Human
gcugccugggaucccucaucc

SEQ ID NO: 3183534 - RNA, 16 nt, Human
gcugccucucccauca

SEQ ID NO: 3183535 - RNA, 19 nt, Human
gcugccucggauccccuuc

SEQ ID NO: 3183536 - RNA, 21 nt, Human
gcugccucggauccccuuccu

SEQ ID NO: 3183537 - RNA, 20 nt, Human
gcugccucggauccccuucc

SEQ ID NO: 3183538 - RNA, 22 nt, Human
gcugccucggauccccuuccua

SEQ ID NO: 3183539 - RNA, 20 nt, Human
gcugccugggaucccucauc

SEQ ID NO: 3183540 - RNA, 16 nt, Human
gcugccugaaaaucaa

SEQ ID NO: 3183541 - RNA, 13 nt, Human
gcugccucaugcu

SEQ ID NO: 3183542 - RNA, 21 nt, Human
gcugagcacccagcucugucu

SEQ ID NO: 3183543 - RNA, 16 nt, Human
gcugagaggagagaga

SEQ ID NO: 3183544 - RNA, 18 nt, Human
gcugagggugagugggug

SEQ ID NO: 3183545 - RNA, 23 nt, Human
gcugagggugagugggugaauaa

SEQ ID NO: 3183546 - RNA, 14 nt, Human
gcugaggugggagg

SEQ ID NO: 3183547 - RNA, 14 nt, Human
gaacaaggcaaggc

SEQ ID NO: 3183548 - RNA, 15 nt, Human
gaacaaggcaaggcu

SEQ ID NO: 3183549 - RNA, 17 nt, Human
gaacaaggcaaggcugu

SEQ ID NO: 3183550 - RNA, 18 nt, Human
gaacaaggcaaggcuguc

SEQ ID NO: 3183551 - RNA, 21 nt, Human
gaacaaggcaaggcugucaau

SEQ ID NO: 3183552 - RNA, 22 nt, Human
gaaacugucuagcacuuccuug

SEQ ID NO: 3183553 - RNA, 11 nt, Human
gaaacuuggau

SEQ ID NO: 3183554 - RNA, 17 nt, Human
gaaagaacuaucuucau

SEQ ID NO: 3183555 - RNA, 21 nt, Human
gaaagaacuaucuucaucuga

SEQ ID NO: 3183556 - RNA, 20 nt, Human
gaaagaacuaucuucaucug

SEQ ID NO: 3183557 - RNA, 22 nt, Human
gaaacuuguucuuccaaagcag

SEQ ID NO: 3183558 - RNA, 16 nt, Human
gaaacuuguucuucca

SEQ ID NO: 3183559 - RNA, 16 nt, Human
gaaagaacuaucuuca

SEQ ID NO: 3183560 - RNA, 18 nt, Human
gaaagaaguggggacaga

SEQ ID NO: 3183561 - RNA, 15 nt, Human
gaaagaauguaaagc

SEQ ID NO: 3183562 - RNA, 14 nt, Human
gaaagaauguaaag

SEQ ID NO: 3183563 - RNA, 22 nt, Human
gaaauauuuuaauuuuuaaaug

SEQ ID NO: 3183564 - RNA, 16 nt, Human
gaaaucaaauaugcaa

SEQ ID NO: 3183565 - RNA, 21 nt, Human
gaaaucaaauaugcaaagcac

SEQ ID NO: 3183566 - RNA, 12 nt, Human
gaaaucaaagug

SEQ ID NO: 3183567 - RNA, 23 nt, Human
gaaauauuuuaauuuuuaaaugc

SEQ ID NO: 3183568 - RNA, 14 nt, Human
gaaaucaaagugcu

SEQ ID NO: 3183569 - RNA, 16 nt, Human
gaaaucaaagugcuau

SEQ ID NO: 3183570 - RNA, 13 nt, Human
gaaauauuuuaau

SEQ ID NO: 3183571 - RNA, 21 nt, Human
gaaaguacuucuccacccugc

SEQ ID NO: 3183572 - RNA, 19 nt, Human
gaaaguaaauaaaaggacu

SEQ ID NO: 3183573 - RNA, 20 nt, Human
gaaaguacauuuuuugaaau

SEQ ID NO: 3183574 - RNA, 13 nt, Human
gaaaguacauuuu

SEQ ID NO: 3183575 - RNA, 17 nt, Human
gaaaggcuccaggagca

SEQ ID NO: 3183576 - RNA, 18 nt, Human
gaaaggcuccaggagcag

SEQ ID NO: 3183577 - RNA, 19 nt, Human
gaaaggcuccaggagcagc

SEQ ID NO: 3183578 - RNA, 16 nt, Human
gaaaggcuccaggagc

SEQ ID NO: 3183579 - RNA, 18 nt, Human
gaaagacuaucuaaaugu

SEQ ID NO: 3183580 - RNA, 15 nt, Human
gaacaacauauacaa

SEQ ID NO: 3183581 - RNA, 23 nt, Human
gaacaaauuuacagagacagaaa

SEQ ID NO: 3183582 - RNA, 19 nt, Human
gaaauuuuucauauuuuaa

SEQ ID NO: 3183583 - RNA, 17 nt, Human
gaaauuuuucauauuuu

SEQ ID NO: 3183584 - RNA, 16 nt, Human
gaaauuuuucauauuu

SEQ ID NO: 3183585 - RNA, 15 nt, Human
gaaauuuuucauauu

SEQ ID NO: 3183586 - RNA, 13 nt, Human
gaaauuuuucaua

SEQ ID NO: 3183587 - RNA, 17 nt, Human
gaacaaauuuacagaga

SEQ ID NO: 3183588 - RNA, 18 nt, Human
gaacaaauuuacagagac

SEQ ID NO: 3183589 - RNA, 19 nt, Human
gaaauuuuuauuaaauuau

SEQ ID NO: 3183590 - RNA, 12 nt, Human
gaaauuuuucau

SEQ ID NO: 3183591 - RNA, 18 nt, Human
gaaaugaaagcagggacu

SEQ ID NO: 3183592 - RNA, 15 nt, Human
gaaaugaacacaaau

SEQ ID NO: 3183593 - RNA, 14 nt, Human
gaaaugaacacaaa

SEQ ID NO: 3183594 - RNA, 18 nt, Human
gaaauuuuuauuaaauua

SEQ ID NO: 3183595 - RNA, 18 nt, Human
gaaaugaagagcuguuga

SEQ ID NO: 3183596 - RNA, 13 nt, Human
gaaaugaagagcu

SEQ ID NO: 3183597 - RNA, 17 nt, Human
gaaaugaacacaaauua

SEQ ID NO: 3183598 - RNA, 23 nt, Human
gaaaucaaauaugcaaagcacug

SEQ ID NO: 3183599 - RNA, 17 nt, Human
gaaaucaaagugcuauu

SEQ ID NO: 3183600 - RNA, 16 nt, Human
gaaaucaaauguaaag

SEQ ID NO: 3183601 - RNA, 23 nt, Human
gaaaucaauaauuuguggugauu

SEQ ID NO: 3183602 - RNA, 19 nt, Human
gaaaucaauaguugaauua

SEQ ID NO: 3183603 - RNA, 17 nt, Human
gaaaucaaauguaaagu

SEQ ID NO: 3183604 - RNA, 17 nt, Human
gaaaugaaagcagggac

SEQ ID NO: 3183605 - RNA, 17 nt, Human
gaaaucaccgaaaacgu

SEQ ID NO: 3183606 - RNA, 22 nt, Human
cuuuuauuccugcccugcuguu

SEQ ID NO: 3183607 - RNA, 14 nt, Human
cuuuugucccagaa

SEQ ID NO: 3183608 - RNA, 17 nt, Human
cuuuugucuaugggacu

SEQ ID NO: 3183609 - RNA, 16 nt, Human
cuuuuggucuguguga

SEQ ID NO: 3183610 - RNA, 15 nt, Human
cuuuuggucugugug

SEQ ID NO: 3183611 - RNA, 22 nt, Human
cuuuugcucgaugcagacaggg

SEQ ID NO: 3183612 - RNA, 20 nt, Human
cuuuugcuugccaaaguaca

SEQ ID NO: 3183613 - RNA, 18 nt, Human
cuuuugcuuuaauuccau

SEQ ID NO: 3183614 - RNA, 14 nt, Human
cuuuugcuuuaauu

SEQ ID NO: 3183615 - RNA, 19 nt, Human
gaaaaaauauuuuccugcc

SEQ ID NO: 3183616 - RNA, 18 nt, Human
gaaaaaaaaagaaaaaag

SEQ ID NO: 3183617 - RNA, 17 nt, Human
gaaaaaaaaagaaaaaa

SEQ ID NO: 3183618 - RNA, 16 nt, Human
gaaaaaaaaagaaaaa

SEQ ID NO: 3183619 - RNA, 15 nt, Human
gaaaaaaaaagaaaa

SEQ ID NO: 3183620 - RNA, 15 nt, Human
gaaaaaaaaaaaagc

SEQ ID NO: 3183621 - RNA, 17 nt, Human
gaaaaaaaaaaagaaag

SEQ ID NO: 3183622 - RNA, 19 nt, Human
gaaaaaaaaaaugcugaac

SEQ ID NO: 3183623 - RNA, 18 nt, Human
gaaaaaaaaaaugcugaa

SEQ ID NO: 3183624 - RNA, 19 nt, Human
gaaaaaaaaaaagaaagaa

SEQ ID NO: 3183625 - RNA, 20 nt, Human
gaaaaaaaaaaugcugaaca

SEQ ID NO: 3183626 - RNA, 13 nt, Human
gaaaaaaaaagaa

SEQ ID NO: 3183627 - RNA, 12 nt, Human
gaaaaaaaaaga

SEQ ID NO: 3183628 - RNA, 13 nt, Human
cuuuuuuugaaac

SEQ ID NO: 3183629 - RNA, 22 nt, Human
cuuuuuuugagcgacaucucug

SEQ ID NO: 3183630 - RNA, 20 nt, Human
cuuuuguuacucuugggaca

SEQ ID NO: 3183631 - RNA, 18 nt, Human
cuuuuguuacucuuggga

SEQ ID NO: 3183632 - RNA, 23 nt, Human
cuuuuuuuugacagcuuccuguc

SEQ ID NO: 3183633 - RNA, 22 nt, Human
cuuuuuuuugacagcuuccugu

SEQ ID NO: 3183634 - RNA, 13 nt, Human
cuuuuguccugca

SEQ ID NO: 3183635 - RNA, 21 nt, Human
cuuuuguccugcaucaucuug

SEQ ID NO: 3183636 - RNA, 14 nt, Human
cuuuuguguuccaa

SEQ ID NO: 3183637 - RNA, 18 nt, Human
gaaaauuaggauuucaug

SEQ ID NO: 3183638 - RNA, 18 nt, Human
gaaaagagacaggcaggu

SEQ ID NO: 3183639 - RNA, 13 nt, Human
gaaaagagagaaa

SEQ ID NO: 3183640 - RNA, 21 nt, Human
gaaaagacuccaaagaaaugu

SEQ ID NO: 3183641 - RNA, 13 nt, Human
gaaaagagacagg

SEQ ID NO: 3183642 - RNA, 17 nt, Human
gaaaagagacaggcagg

SEQ ID NO: 3183643 - RNA, 18 nt, Human
gaaaagacuccaaagaaa

SEQ ID NO: 3183644 - RNA, 20 nt, Human
gaaaagacuccaaagaaaug

SEQ ID NO: 3183645 - RNA, 14 nt, Human
gaaaaaauuuaaaa

SEQ ID NO: 3183646 - RNA, 12 nt, Human
gaaaacuuaguu

SEQ ID NO: 3183647 - RNA, 13 nt, Human
gaaaacuuaguuu

SEQ ID NO: 3183648 - RNA, 13 nt, Human
gaaaacucuauuu

SEQ ID NO: 3183649 - RNA, 19 nt, Human
gaaaacugcaacuuguaaa

SEQ ID NO: 3183650 - RNA, 14 nt, Human
gaaaauuuuaaaaa

SEQ ID NO: 3183651 - RNA, 23 nt, Human
gaaacaaacaaaagcugaacaca

SEQ ID NO: 3183652 - RNA, 12 nt, Human
cuugauucauaa

SEQ ID NO: 3183653 - RNA, 15 nt, Human
cuugauggauuuuca

SEQ ID NO: 3183654 - RNA, 18 nt, Human
cuugccgucuaccugagg

SEQ ID NO: 3183655 - RNA, 19 nt, Human
cuugauucauaaugacuua

SEQ ID NO: 3183656 - RNA, 17 nt, Human
cuugauucccuuguuau

SEQ ID NO: 3183657 - RNA, 22 nt, Human
cuugauucguagauuuaauaac

SEQ ID NO: 3183658 - RNA, 13 nt, Human
cuugauuggaagg

SEQ ID NO: 3183659 - RNA, 12 nt, Human
cuugauuggaag

SEQ ID NO: 3183660 - RNA, 16 nt, Human
cuuggcccuggcagcc

SEQ ID NO: 3183661 - RNA, 13 nt, Human
cuuggcccuggca

SEQ ID NO: 3183662 - RNA, 15 nt, Human
cuuggcccagggggc

SEQ ID NO: 3183663 - RNA, 23 nt, Human
cuuggcccagggggcuuccugag

SEQ ID NO: 3183664 - RNA, 22 nt, Human
cuuggcccagggggcuuccuga

SEQ ID NO: 3183665 - RNA, 21 nt, Human
cuuggcccagggggcuuccug

SEQ ID NO: 3183666 - RNA, 18 nt, Human
cuuggcccagggggcuuc

SEQ ID NO: 3183667 - RNA, 20 nt, Human
cuuggcgcugccccuggcag

SEQ ID NO: 3183668 - RNA, 23 nt, Human
cuuggcgcugccccuggcagccc

SEQ ID NO: 3183669 - RNA, 21 nt, Human
cuuggcgcugccccuggcagc

SEQ ID NO: 3183670 - RNA, 22 nt, Human
cuuggcgcugccccuggcagcc

SEQ ID NO: 3183671 - RNA, 14 nt, Human
cuuggauugucccc

SEQ ID NO: 3183672 - RNA, 18 nt, Human
cuuggauuguccccgacc

SEQ ID NO: 3183673 - RNA, 20 nt, Human
cuuggauuguccccgacccu

SEQ ID NO: 3183674 - RNA, 15 nt, Human
cuuggauuguccccg

SEQ ID NO: 3183675 - RNA, 20 nt, Human
cuugccucagcuuccccagu

SEQ ID NO: 3183676 - RNA, 17 nt, Human
cuuucaauaggaaaaac

SEQ ID NO: 3183677 - RNA, 16 nt, Human
cuuucacaaccuucug

SEQ ID NO: 3183678 - RNA, 20 nt, Human
cuuuaaugucacaggcaggu

SEQ ID NO: 3183679 - RNA, 19 nt, Human
cuuuaaugucacaggcagg

SEQ ID NO: 3183680 - RNA, 18 nt, Human
cuuuaaugucacaggcag

SEQ ID NO: 3183681 - RNA, 17 nt, Human
cuuuaaugucacaggca

SEQ ID NO: 3183682 - RNA, 14 nt, Human
cuuucaauaggaaa

SEQ ID NO: 3183683 - RNA, 15 nt, Human
cuuucaauaggaaaa

SEQ ID NO: 3183684 - RNA, 22 nt, Human
cuuuaaugucacaggcaggucc

SEQ ID NO: 3183685 - RNA, 21 nt, Human
cuugucuuuggacccugaggc

SEQ ID NO: 3183686 - RNA, 22 nt, Human
cuugucuuuggacccugaggcc

SEQ ID NO: 3183687 - RNA, 18 nt, Human
cuuuaacuuaguuuugca

SEQ ID NO: 3183688 - RNA, 21 nt, Human
cuugucuuccuauuucagaag

SEQ ID NO: 3183689 - RNA, 19 nt, Human
cuugucuuccuauuucaga

SEQ ID NO: 3183690 - RNA, 16 nt, Human
cuugugaaaauaauug

SEQ ID NO: 3183691 - RNA, 15 nt, Human
cuugugaaaauaauu

SEQ ID NO: 3183692 - RNA, 22 nt, Human
cuuuaaugauaugcuuguaacu

SEQ ID NO: 3183693 - RNA, 21 nt, Human
cuuuaaugauaugcuuguaac

SEQ ID NO: 3183694 - RNA, 16 nt, Human
cuuuaaugauaugcuu

SEQ ID NO: 3183695 - RNA, 20 nt, Human
cuugguuccagccugccacu

SEQ ID NO: 3183696 - RNA, 20 nt, Human
cuugguucccauuugcuccu

SEQ ID NO: 3183697 - RNA, 19 nt, Human
cuugguuccagccugccac

SEQ ID NO: 3183698 - RNA, 17 nt, Human
cuugguuccagccugcc

SEQ ID NO: 3183699 - RNA, 16 nt, Human
cuugguucccauuugc

SEQ ID NO: 3183700 - RNA, 23 nt, Human
cuuggucucagugucaaugcagc

SEQ ID NO: 3183701 - RNA, 22 nt, Human
cuugguccugcugcaguugcca

SEQ ID NO: 3183702 - RNA, 20 nt, Human
cuuggugucgggcaugacac

SEQ ID NO: 3183703 - RNA, 13 nt, Human
cuugguuauauuu

SEQ ID NO: 3183704 - RNA, 13 nt, Human
cuugguuccuggg

SEQ ID NO: 3183705 - RNA, 19 nt, Human
cuugguuccuggggcaucc

SEQ ID NO: 3183706 - RNA, 18 nt, Human
cuugguuccuggggcauc

SEQ ID NO: 3183707 - RNA, 17 nt, Human
cuugguuccuggggcau

SEQ ID NO: 3183708 - RNA, 16 nt, Human
cuugguuccuggggca

SEQ ID NO: 3183709 - RNA, 15 nt, Human
cuugguuccuggggc

SEQ ID NO: 3183710 - RNA, 19 nt, Human
cuugucuuuggacccugag

SEQ ID NO: 3183711 - RNA, 21 nt, Human
cuugucuguagcgucuguaua

SEQ ID NO: 3183712 - RNA, 17 nt, Human
cuugucuuccuauuuca

SEQ ID NO: 3183713 - RNA, 20 nt, Human
cuugucuuuggacccugagg

SEQ ID NO: 3183714 - RNA, 13 nt, Human
cuugucuguagau

SEQ ID NO: 3183715 - RNA, 16 nt, Human
cuugguccugcugcag

SEQ ID NO: 3183716 - RNA, 17 nt, Human
cuugguccugcugcagu

SEQ ID NO: 3183717 - RNA, 18 nt, Human
cuugguccugcugcaguu

SEQ ID NO: 3183718 - RNA, 20 nt, Human
cuugguccugcugcaguugc

SEQ ID NO: 3183719 - RNA, 15 nt, Human
cuugguccugcugca

SEQ ID NO: 3183720 - RNA, 18 nt, Human
cuucccacaaagaauaua

SEQ ID NO: 3183721 - RNA, 23 nt, Human
cuucccaaaugugugcccagcuu

SEQ ID NO: 3183722 - RNA, 17 nt, Human
cuucccaacuugccuuu

SEQ ID NO: 3183723 - RNA, 20 nt, Human
cuucccaaaugugugcccag

SEQ ID NO: 3183724 - RNA, 15 nt, Human
cuuccauuucugccu

SEQ ID NO: 3183725 - RNA, 20 nt, Human
cuuccauuucugccuuuugu

SEQ ID NO: 3183726 - RNA, 16 nt, Human
cuuccauuucugccuu

SEQ ID NO: 3183727 - RNA, 19 nt, Human
cuuacauaaacaucagguu

SEQ ID NO: 3183728 - RNA, 20 nt, Human
cuuacauaaaccauuuuugu

SEQ ID NO: 3183729 - RNA, 17 nt, Human
cuuacauaaacaucagg

SEQ ID NO: 3183730 - RNA, 14 nt, Human
cuuacaggugauua

SEQ ID NO: 3183731 - RNA, 15 nt, Human
cuuaaauauagcagu

SEQ ID NO: 3183732 - RNA, 21 nt, Human
cuuccaucugauuccagcaca

SEQ ID NO: 3183733 - RNA, 20 nt, Human
cuuacauuagcaguuugcuu

SEQ ID NO: 3183734 - RNA, 22 nt, Human
cuucuugaauggcaauguuuug

SEQ ID NO: 3183735 - RNA, 13 nt, Human
cuucuugaauaua

SEQ ID NO: 3183736 - RNA, 16 nt, Human
cuucuugaauauaaaa

SEQ ID NO: 3183737 - RNA, 19 nt, Human
cuucuugaauauaaaaaau

SEQ ID NO: 3183738 - RNA, 13 nt, Human
cuucuugaaaucc

SEQ ID NO: 3183739 - RNA, 12 nt, Human
cuucuucuguaa

SEQ ID NO: 3183740 - RNA, 13 nt, Human
cuucuucuguaau

SEQ ID NO: 3183741 - RNA, 15 nt, Human
cuucuucuguaauau

SEQ ID NO: 3183742 - RNA, 17 nt, Human
cuucuucuguaauauuu

SEQ ID NO: 3183743 - RNA, 18 nt, Human
cuucuucuguaauauuua

SEQ ID NO: 3183744 - RNA, 22 nt, Human
cuucuucuguaauauuuacaau

SEQ ID NO: 3183745 - RNA, 19 nt, Human
cuucuucuguccaagcaga

SEQ ID NO: 3183746 - RNA, 13 nt, Human
cuucuucugucca

SEQ ID NO: 3183747 - RNA, 21 nt, Human
cuucuucuguccaagcagauu

SEQ ID NO: 3183748 - RNA, 18 nt, Human
cuucugacccaugcugcc

SEQ ID NO: 3183749 - RNA, 16 nt, Human
cuucugacccaugcug

SEQ ID NO: 3183750 - RNA, 17 nt, Human
cuucugacccaugcugc

SEQ ID NO: 3183751 - RNA, 16 nt, Human
cuucuuauacauuuga

SEQ ID NO: 3183752 - RNA, 13 nt, Human
cuucuuauacauu

SEQ ID NO: 3183753 - RNA, 15 nt, Human
cuuccucccucauuc

SEQ ID NO: 3183754 - RNA, 11 nt, Human
cuuccucugcu

SEQ ID NO: 3183755 - RNA, 21 nt, Human
cuuccucuccacugccuucga

SEQ ID NO: 3183756 - RNA, 19 nt, Human
cuuccucuccacugccuuc

SEQ ID NO: 3183757 - RNA, 17 nt, Human
cuuccucuccacugccu

SEQ ID NO: 3183758 - RNA, 16 nt, Human
cuuccucuccacugcc

SEQ ID NO: 3183759 - RNA, 13 nt, Human
cuuccucugcuga

SEQ ID NO: 3183760 - RNA, 12 nt, Human
cuuccucugcug

SEQ ID NO: 3183761 - RNA, 16 nt, Human
cuuccucugcuaaauu

SEQ ID NO: 3183762 - RNA, 14 nt, Human
cuuccucugcuaaa

SEQ ID NO: 3183763 - RNA, 15 nt, Human
cuuccucugcucccc

SEQ ID NO: 3183764 - RNA, 14 nt, Human
cuuccucugcuccc

SEQ ID NO: 3183765 - RNA, 13 nt, Human
cuuccucugcucc

SEQ ID NO: 3183766 - RNA, 12 nt, Human
cuuccucugcuc

SEQ ID NO: 3183767 - RNA, 14 nt, Human
cuuccucccucccu

SEQ ID NO: 3183768 - RNA, 15 nt, Human
cuuccucuccacugc

SEQ ID NO: 3183769 - RNA, 13 nt, Human
cuuccucccuccc

SEQ ID NO: 3183770 - RNA, 12 nt, Human
cuuccucccucc

SEQ ID NO: 3183771 - RNA, 17 nt, Human
cuucuaccucuuggcug

SEQ ID NO: 3183772 - RNA, 16 nt, Human
cuucuauagcaucacu

SEQ ID NO: 3183773 - RNA, 18 nt, Human
cuucuauagcaucacuua

SEQ ID NO: 3183774 - RNA, 12 nt, Human
cuucucugccca

SEQ ID NO: 3183775 - RNA, 19 nt, Human
cuucucugcccagcuuuuc

SEQ ID NO: 3183776 - RNA, 15 nt, Human
cuucugacccaugcu

SEQ ID NO: 3183777 - RNA, 22 nt, Human
cuucugaacuuggcgcugcccc

SEQ ID NO: 3183778 - RNA, 19 nt, Human
cuucugaacuuggcgcugc

SEQ ID NO: 3183779 - RNA, 24 nt, Human
cugccuccucuucaacugaccagc

SEQ ID NO: 3183780 - RNA, 14 nt, Human
cugccuccuuugug

SEQ ID NO: 3183781 - RNA, 19 nt, Human
cugccuccuugauauuugu

SEQ ID NO: 3183782 - RNA, 17 nt, Human
cugccuccuuugugagg

SEQ ID NO: 3183783 - RNA, 21 nt, Human
cugccuccuuugugaggaagc

SEQ ID NO: 3183784 - RNA, 23 nt, Human
cugccuccuuugugaggaagccg

SEQ ID NO: 3183785 - RNA, 14 nt, Human
cugccucgaacugg

SEQ ID NO: 3183786 - RNA, 20 nt, Human
cugccucgaacuggcugcaa

SEQ ID NO: 3183787 - RNA, 19 nt, Human
cugccucgaacuggcugca

SEQ ID NO: 3183788 - RNA, 20 nt, Human
cugccucggauccccuuccu

SEQ ID NO: 3183789 - RNA, 11 nt, Human
cugcugagggu

SEQ ID NO: 3183790 - RNA, 13 nt, Human
cugcugagccgca

SEQ ID NO: 3183791 - RNA, 15 nt, Human
cugcugagccgcaga

SEQ ID NO: 3183792 - RNA, 14 nt, Human
cugcugagccgcag

SEQ ID NO: 3183793 - RNA, 18 nt, Human
cugcugagccgcagagaa

SEQ ID NO: 3183794 - RNA, 20 nt, Human
cugcugagacugcugaguga

SEQ ID NO: 3183795 - RNA, 17 nt, Human
cugcuacugccaaccuc

SEQ ID NO: 3183796 - RNA, 15 nt, Human
cugcuacugccaacc

SEQ ID NO: 3183797 - RNA, 14 nt, Human
cugcuaccuugccc

SEQ ID NO: 3183798 - RNA, 17 nt, Human
cugcuaccuugccccaa

SEQ ID NO: 3183799 - RNA, 12 nt, Human
cugcuacugcca

SEQ ID NO: 3183800 - RNA, 19 nt, Human
cugccuguucccauucuug

SEQ ID NO: 3183801 - RNA, 15 nt, Human
cugccuguucccauu

SEQ ID NO: 3183802 - RNA, 23 nt, Human
cugccuguucagcuccagcucac

SEQ ID NO: 3183803 - RNA, 20 nt, Human
cugccuguucagcuccagcu

SEQ ID NO: 3183804 - RNA, 24 nt, Human
cugcugaaggcucgagcaugccug

SEQ ID NO: 3183805 - RNA, 23 nt, Human
cugcugaaggcucgagcaugccu

SEQ ID NO: 3183806 - RNA, 18 nt, Human
cugcugaaggcucgagca

SEQ ID NO: 3183807 - RNA, 17 nt, Human
cugcuaucaaagagguu

SEQ ID NO: 3183808 - RNA, 19 nt, Human
cugcuauuuuccuguucua

SEQ ID NO: 3183809 - RNA, 19 nt, Human
cugcccuuaccugccagga

SEQ ID NO: 3183810 - RNA, 20 nt, Human
cugcccugguuuccugcccu

SEQ ID NO: 3183811 - RNA, 17 nt, Human
cugcccuuaccugccag

SEQ ID NO: 3183812 - RNA, 12 nt, Human
cugcccuguggg

SEQ ID NO: 3183813 - RNA, 11 nt, Human
cugcccugugg

SEQ ID NO: 3183814 - RNA, 22 nt, Human
cugcccuuaccugccaggaagc

SEQ ID NO: 3183815 - RNA, 23 nt, Human
cugcccuuaccugccaggaagcc

SEQ ID NO: 3183816 - RNA, 24 nt, Human
cugcccugugaguacuacaguccu

SEQ ID NO: 3183817 - RNA, 13 nt, Human
cugcccugugagu

SEQ ID NO: 3183818 - RNA, 18 nt, Human
cugcccugguuuccugcc

SEQ ID NO: 3183819 - RNA, 19 nt, Human
cugcccugguuuccugccc

SEQ ID NO: 3183820 - RNA, 17 nt, Human
cugcccugguuuccugc

SEQ ID NO: 3183821 - RNA, 23 nt, Human
cugcccuggugcugccacacuuc

SEQ ID NO: 3183822 - RNA, 15 nt, Human
cugcccuggugcugc

SEQ ID NO: 3183823 - RNA, 14 nt, Human
cugcccuggugcug

SEQ ID NO: 3183824 - RNA, 13 nt, Human
cugcccuggugcu

SEQ ID NO: 3183825 - RNA, 12 nt, Human
cugcccuggugc

SEQ ID NO: 3183826 - RNA, 19 nt, Human
cugcccccucugcccugcg

SEQ ID NO: 3183827 - RNA, 19 nt, Human
cuggauccaucaggccacu

SEQ ID NO: 3183828 - RNA, 20 nt, Human
cuggaucuccauucucucag

SEQ ID NO: 3183829 - RNA, 16 nt, Human
cuggaugcagccucac

SEQ ID NO: 3183830 - RNA, 17 nt, Human
cuggaugcagccucaca

SEQ ID NO: 3183831 - RNA, 18 nt, Human
cuggaugcagccucacag

SEQ ID NO: 3183832 - RNA, 15 nt, Human
cuggaugcagccuca

SEQ ID NO: 3183833 - RNA, 19 nt, Human
cugcuucaaggauccugag

SEQ ID NO: 3183834 - RNA, 13 nt, Human
cugcuucaaggau

SEQ ID NO: 3183835 - RNA, 14 nt, Human
cugcuucaaggauc

SEQ ID NO: 3183836 - RNA, 16 nt, Human
cugcuucaaggauccu

SEQ ID NO: 3183837 - RNA, 16 nt, Human
cuggaaaccugucuga

SEQ ID NO: 3183838 - RNA, 14 nt, Human
cugcuuccagugag

SEQ ID NO: 3183839 - RNA, 23 nt, Human
cugcuucagccucccgaguagcu

SEQ ID NO: 3183840 - RNA, 14 nt, Human
cuggagaaaaugga

SEQ ID NO: 3183841 - RNA, 15 nt, Human
cuggagaacuagaga

SEQ ID NO: 3183842 - RNA, 14 nt, Human
cuggagaacuagag

SEQ ID NO: 3183843 - RNA, 12 nt, Human
cuggaucaguaa

SEQ ID NO: 3183844 - RNA, 13 nt, Human
cuggaucaguaaa

SEQ ID NO: 3183845 - RNA, 14 nt, Human
cuggaucaguaaaa

SEQ ID NO: 3183846 - RNA, 23 nt, Human
cuggaucaguaaaauuauacugu

SEQ ID NO: 3183847 - RNA, 17 nt, Human
cuggauccaucaggcca

SEQ ID NO: 3183848 - RNA, 21 nt, Human
cuggagaaaauggacguguua

SEQ ID NO: 3183849 - RNA, 23 nt, Human
cuggacucuaaagucuguugauu

SEQ ID NO: 3183850 - RNA, 23 nt, Human
cuggacuccucuguccaggcacu

SEQ ID NO: 3183851 - RNA, 22 nt, Human
cuggacuccucuguccaggcac

SEQ ID NO: 3183852 - RNA, 20 nt, Human
cuggacuccucuguccaggc

SEQ ID NO: 3183853 - RNA, 19 nt, Human
cuggcagaguugaagacag

SEQ ID NO: 3183854 - RNA, 20 nt, Human
cuggcagaguugaagacaga

SEQ ID NO: 3183855 - RNA, 21 nt, Human
cuggcagaguugaagacagag

SEQ ID NO: 3183856 - RNA, 13 nt, Human
cuggcagccccug

SEQ ID NO: 3183857 - RNA, 15 nt, Human
cuggcagcaccgccu

SEQ ID NO: 3183858 - RNA, 22 nt, Human
cuggcagaguugaagacagagc

SEQ ID NO: 3183859 - RNA, 23 nt, Human
cuggcagccccuguucuggcaga

SEQ ID NO: 3183860 - RNA, 13 nt, Human
cuggcagccgugc

SEQ ID NO: 3183861 - RNA, 18 nt, Human
cuggcagcccgcaucagc

SEQ ID NO: 3183862 - RNA, 13 nt, Human
cuggcagcccgca

SEQ ID NO: 3183863 - RNA, 20 nt, Human
cuggcagcaccgccucuucc

SEQ ID NO: 3183864 - RNA, 19 nt, Human
cuggcagcaccgccucuuc

SEQ ID NO: 3183865 - RNA, 23 nt, Human
cuggcccuaugcuuccggccucc

SEQ ID NO: 3183866 - RNA, 15 nt, Human
cuggcagcucagaga

SEQ ID NO: 3183867 - RNA, 19 nt, Human
cuggcagcccgcaucagcu

SEQ ID NO: 3183868 - RNA, 17 nt, Human
cuggcagcucagagagg

SEQ ID NO: 3183869 - RNA, 19 nt, Human
cuggcagcucagagagggu

SEQ ID NO: 3183870 - RNA, 16 nt, Human
cuggcagcucagagag

SEQ ID NO: 3183871 - RNA, 18 nt, Human
cuggcagccgugccuuca

SEQ ID NO: 3183872 - RNA, 17 nt, Human
cuggcagccgugccuuc

SEQ ID NO: 3183873 - RNA, 18 nt, Human
cuggcucccacaggcccu

SEQ ID NO: 3183874 - RNA, 19 nt, Human
cuggcucccacaggcccuu

SEQ ID NO: 3183875 - RNA, 22 nt, Human
cuggcucccacaggcccuuccu

SEQ ID NO: 3183876 - RNA, 14 nt, Human
cuggcucccucacu

SEQ ID NO: 3183877 - RNA, 13 nt, Human
cuggcucccucac

SEQ ID NO: 3183878 - RNA, 13 nt, Human
cuggcuccccugc

SEQ ID NO: 3183879 - RNA, 15 nt, Human
cuggcuccccugcag

SEQ ID NO: 3183880 - RNA, 16 nt, Human
cuggcuccccugcagc

SEQ ID NO: 3183881 - RNA, 17 nt, Human
cuggcuccccugcagcc

SEQ ID NO: 3183882 - RNA, 19 nt, Human
cuggcuccccugcagcccu

SEQ ID NO: 3183883 - RNA, 21 nt, Human
cuggcuccccugcagcccugg

SEQ ID NO: 3183884 - RNA, 13 nt, Human
cuggcuccccugg

SEQ ID NO: 3183885 - RNA, 14 nt, Human
cuggcuccccuggg

SEQ ID NO: 3183886 - RNA, 15 nt, Human
cuggcuccccugggg

SEQ ID NO: 3183887 - RNA, 16 nt, Human
cuggcuccccuggggu

SEQ ID NO: 3183888 - RNA, 16 nt, Human
cuggcccucucugaag

SEQ ID NO: 3183889 - RNA, 15 nt, Human
cuggcccucucugaa

SEQ ID NO: 3183890 - RNA, 17 nt, Human
cugggacuacaggugug

SEQ ID NO: 3183891 - RNA, 21 nt, Human
cugggacuacaggcacccacc

SEQ ID NO: 3183892 - RNA, 17 nt, Human
cugggacuacaggcacc

SEQ ID NO: 3183893 - RNA, 16 nt, Human
cugggacuacaggcac

SEQ ID NO: 3183894 - RNA, 14 nt, Human
cuggcucuuccagg

SEQ ID NO: 3183895 - RNA, 15 nt, Human
cuggcucuuccaggc

SEQ ID NO: 3183896 - RNA, 13 nt, Human
cuggcucuuccag

SEQ ID NO: 3183897 - RNA, 21 nt, Human
cuggcucccucacucucagga

SEQ ID NO: 3183898 - RNA, 20 nt, Human
cuggcucccucacucucagg

SEQ ID NO: 3183899 - RNA, 18 nt, Human
cuggcucccucacucuca

SEQ ID NO: 3183900 - RNA, 18 nt, Human
cuguugcccaggcuggcg

SEQ ID NO: 3183901 - RNA, 12 nt, Human
cuguuggccagu

SEQ ID NO: 3183902 - RNA, 21 nt, Human
cuguugcugauuuuauucuug

SEQ ID NO: 3183903 - RNA, 16 nt, Human
cuguugcugauuuuau

SEQ ID NO: 3183904 - RNA, 22 nt, Human
cuguugcugauuuuauucuuga

SEQ ID NO: 3183905 - RNA, 15 nt, Human
cuguugcugauuuua

SEQ ID NO: 3183906 - RNA, 14 nt, Human
cuguugcugauuuu

SEQ ID NO: 3183907 - RNA, 18 nt, Human
cuguugucucuucuccuu

SEQ ID NO: 3183908 - RNA, 17 nt, Human
cuguugucucuucuccu

SEQ ID NO: 3183909 - RNA, 15 nt, Human
cuguugucucuucuc

SEQ ID NO: 3183910 - RNA, 14 nt, Human
cuguugucucuucu

SEQ ID NO: 3183911 - RNA, 13 nt, Human
cuuaaaaaugguu

SEQ ID NO: 3183912 - RNA, 20 nt, Human
cuuaaaaaugguuuaaaugg

SEQ ID NO: 3183913 - RNA, 12 nt, Human
cuuaaaaauggu

SEQ ID NO: 3183914 - RNA, 21 nt, Human
cuuaaaagcuaucuucaugua

SEQ ID NO: 3183915 - RNA, 22 nt, Human
cuuaaaagcuaucuucauguaa

SEQ ID NO: 3183916 - RNA, 24 nt, Human
cuuaaaagcuaucuucauguaaau

SEQ ID NO: 3183917 - RNA, 23 nt, Human
cuuaaaauaaaacacuguuuccc

SEQ ID NO: 3183918 - RNA, 18 nt, Human
cuuaaaagaggaaaauga

SEQ ID NO: 3183919 - RNA, 12 nt, Human
cuuaaaacuagg

SEQ ID NO: 3183920 - RNA, 21 nt, Human
cuuaaaacuaggcauuuguaa

SEQ ID NO: 3183921 - RNA, 22 nt, Human
cuuaaaacuaggcauuuguaaa

SEQ ID NO: 3183922 - RNA, 23 nt, Human
cuuaaaacuaggcauuuguaaau

SEQ ID NO: 3183923 - RNA, 19 nt, Human
cuguuaucccugccugguc

SEQ ID NO: 3183924 - RNA, 21 nt, Human
cuguuaucauuuuuuccuguu

SEQ ID NO: 3183925 - RNA, 20 nt, Human
cuguuaucauuuuuuccugu

SEQ ID NO: 3183926 - RNA, 19 nt, Human
cuguuaucauuuuuuccug

SEQ ID NO: 3183927 - RNA, 19 nt, Human
cuguucacagccagacugg

SEQ ID NO: 3183928 - RNA, 12 nt, Human
cuguucacagcc

SEQ ID NO: 3183929 - RNA, 22 nt, Human
cuguucacagccagacuggcac

SEQ ID NO: 3183930 - RNA, 15 nt, Human
cuguucagcuccagc

SEQ ID NO: 3183931 - RNA, 14 nt, Human
cuguucagcuccag

SEQ ID NO: 3183932 - RNA, 12 nt, Human
cuguucagcugg

SEQ ID NO: 3183933 - RNA, 22 nt, Human
cuguucagcuccagcucaccag

SEQ ID NO: 3183934 - RNA, 19 nt, Human
cuguucagcuccagcucac

SEQ ID NO: 3183935 - RNA, 18 nt, Human
cuguucagcuccagcuca

SEQ ID NO: 3183936 - RNA, 16 nt, Human
cuguucagcuccagcu

SEQ ID NO: 3183937 - RNA, 21 nt, Human
cuguuauagguccuuuagaaa

SEQ ID NO: 3183938 - RNA, 18 nt, Human
cuguuauagguccuuuag

SEQ ID NO: 3183939 - RNA, 13 nt, Human
cuguuacugucuu

SEQ ID NO: 3183940 - RNA, 20 nt, Human
cuguuagaugcuacuaagaa

SEQ ID NO: 3183941 - RNA, 17 nt, Human
cuguuacugucuucagu

SEQ ID NO: 3183942 - RNA, 20 nt, Human
cugugucaguuuauguuuug

SEQ ID NO: 3183943 - RNA, 19 nt, Human
cugugucaguuuauguuuu

SEQ ID NO: 3183944 - RNA, 22 nt, Human
cugugucagguggggcagcuug

SEQ ID NO: 3183945 - RNA, 16 nt, Human
cugugucaguuuaugu

SEQ ID NO: 3183946 - RNA, 15 nt, Human
cugugucaguuuaug

SEQ ID NO: 3183947 - RNA, 22 nt, Human
cuguguauauuugauuuauuaa

SEQ ID NO: 3183948 - RNA, 18 nt, Human
cuguguauauuugauuua

SEQ ID NO: 3183949 - RNA, 20 nt, Human
cuguguauauuugauuuauu

SEQ ID NO: 3183950 - RNA, 12 nt, Human
cuguguauauuu

SEQ ID NO: 3183951 - RNA, 15 nt, Human
cuguguauauuugau

SEQ ID NO: 3183952 - RNA, 16 nt, Human
cuguguauauuugauu

SEQ ID NO: 3183953 - RNA, 18 nt, Human
cugugcucuggacaggca

SEQ ID NO: 3183954 - RNA, 16 nt, Human
cugugaacugaacucu

SEQ ID NO: 3183955 - RNA, 13 nt, Human
cugugaacugaac

SEQ ID NO: 3183956 - RNA, 15 nt, Human
cugugaacugaacuc

SEQ ID NO: 3183957 - RNA, 21 nt, Human
cugugagaugcuagaacuccc

SEQ ID NO: 3183958 - RNA, 17 nt, Human
cugugaauccagugaaa

SEQ ID NO: 3183959 - RNA, 23 nt, Human
cugugagaugcuagaacucccuu

SEQ ID NO: 3183960 - RNA, 13 nt, Human
cugugagaugugu

SEQ ID NO: 3183961 - RNA, 15 nt, Human
cugugcucuggacag

SEQ ID NO: 3183962 - RNA, 17 nt, Human
cugugcucuggacaggc

SEQ ID NO: 3183963 - RNA, 23 nt, Human
cuggugaccuuccaagagccuga

SEQ ID NO: 3183964 - RNA, 22 nt, Human
cuggugaccuuccaagagccug

SEQ ID NO: 3183965 - RNA, 22 nt, Human
cuggugacaugucuuuucuugc

SEQ ID NO: 3183966 - RNA, 21 nt, Human
cuggucucgaacuccugaccu

SEQ ID NO: 3183967 - RNA, 16 nt, Human
cuguacuucuugaaua

SEQ ID NO: 3183968 - RNA, 17 nt, Human
cuguacuucuugaauau

SEQ ID NO: 3183969 - RNA, 15 nt, Human
cuguagagugggagc

SEQ ID NO: 3183970 - RNA, 17 nt, Human
cuguagauaauuaacca

SEQ ID NO: 3183971 - RNA, 16 nt, Human
cuguagauaauuaacc

SEQ ID NO: 3183972 - RNA, 17 nt, Human
cuguaaaucuaacauua

SEQ ID NO: 3183973 - RNA, 20 nt, Human
cuguaaaucuaacauuauua

SEQ ID NO: 3183974 - RNA, 20 nt, Human
cugguuuuuggauuaaauua

SEQ ID NO: 3183975 - RNA, 22 nt, Human
cugucuaaugaaaccugugucu

SEQ ID NO: 3183976 - RNA, 15 nt, Human
cugucguuaaaaaca

SEQ ID NO: 3183977 - RNA, 16 nt, Human
cuguccuguugauuaa

SEQ ID NO: 3183978 - RNA, 20 nt, Human
cuguccuguugauuaauuuc

SEQ ID NO: 3183979 - RNA, 19 nt, Human
cugucauugcuucuucuga

SEQ ID NO: 3183980 - RNA, 15 nt, Human
cugucaggaggcaga

SEQ ID NO: 3183981 - RNA, 12 nt, Human
cugucaggaggc

SEQ ID NO: 3183982 - RNA, 20 nt, Human
cugucagggcaguacaaugu

SEQ ID NO: 3183983 - RNA, 21 nt, Human
cuguagccuauuuuuuuagau

SEQ ID NO: 3183984 - RNA, 14 nt, Human
cugucauuugagca

SEQ ID NO: 3183985 - RNA, 22 nt, Human
cugucaucugagaaugaacaaa

SEQ ID NO: 3183986 - RNA, 14 nt, Human
cuguccugggagug

SEQ ID NO: 3183987 - RNA, 13 nt, Human
cuguccugggagu

SEQ ID NO: 3183988 - RNA, 20 nt, Human
cuguccugggagugagcugg

SEQ ID NO: 3183989 - RNA, 14 nt, Human
cugucauugcuucu

SEQ ID NO: 3183990 - RNA, 18 nt, Human
cugucauugcuucuucug

SEQ ID NO: 3183991 - RNA, 16 nt, Human
cugucauugcuucuuc

SEQ ID NO: 3183992 - RNA, 23 nt, Human
gacauugcggacagccacggcca

SEQ ID NO: 3183993 - RNA, 17 nt, Human
gacauugcggacagcca

SEQ ID NO: 3183994 - RNA, 12 nt, Human
gacauuugucau

SEQ ID NO: 3183995 - RNA, 16 nt, Human
gacauuugucauuuuc

SEQ ID NO: 3183996 - RNA, 15 nt, Human
gacauuugucauuuu

SEQ ID NO: 3183997 - RNA, 13 nt, Human
gacauuuguuugg

SEQ ID NO: 3183998 - RNA, 20 nt, Human
gacauuugucauuuucauua

SEQ ID NO: 3183999 - RNA, 19 nt, Human
gacauuugucauuuucauu

SEQ ID NO: 3184000 - RNA, 17 nt, Human
gacauuugucauuuuca

SEQ ID NO: 3184001 - RNA, 20 nt, Human
gacacuuccgucacauccca

SEQ ID NO: 3184002 - RNA, 20 nt, Human
gacacuggugccaugucagc

SEQ ID NO: 3184003 - RNA, 14 nt, Human
gacagcccgggcuc

SEQ ID NO: 3184004 - RNA, 17 nt, Human
gacacuuuucauaucau

SEQ ID NO: 3184005 - RNA, 21 nt, Human
gacacuuuucauaucauuucu

SEQ ID NO: 3184006 - RNA, 18 nt, Human
gacagcuccuucuguccu

SEQ ID NO: 3184007 - RNA, 17 nt, Human
gacagcuccuucugucc

SEQ ID NO: 3184008 - RNA, 16 nt, Human
gacagcccgggcucug

SEQ ID NO: 3184009 - RNA, 16 nt, Human
gacagcuccuucuguc

SEQ ID NO: 3184010 - RNA, 14 nt, Human
gacagucccugcca

SEQ ID NO: 3184011 - RNA, 15 nt, Human
gacagucccugccaa

SEQ ID NO: 3184012 - RNA, 16 nt, Human
gacagucccugccaau

SEQ ID NO: 3184013 - RNA, 20 nt, Human
gacagucccugccaauggac

SEQ ID NO: 3184014 - RNA, 12 nt, Human
gacagucccugc

SEQ ID NO: 3184015 - RNA, 11 nt, Human
gacagcucuua

SEQ ID NO: 3184016 - RNA, 12 nt, Human
gacagcucugca

SEQ ID NO: 3184017 - RNA, 19 nt, Human
gacagcuccuucuguccua

SEQ ID NO: 3184018 - RNA, 10 nt, Human
gacagcucuu

SEQ ID NO: 3184019 - RNA, 15 nt, Human
gacagccccucccuc

SEQ ID NO: 3184020 - RNA, 24 nt, Human
gacagcccgauccuccccuggacu

SEQ ID NO: 3184021 - RNA, 19 nt, Human
gacagcccgauccuccccu

SEQ ID NO: 3184022 - RNA, 17 nt, Human
gacagccccucccuccu

SEQ ID NO: 3184023 - RNA, 19 nt, Human
gacccggaggggccuggca

SEQ ID NO: 3184024 - RNA, 18 nt, Human
gacccggaggggccuggc

SEQ ID NO: 3184025 - RNA, 20 nt, Human
gacccggaggggccuggcag

SEQ ID NO: 3184026 - RNA, 17 nt, Human
gacccggaggggccugg

SEQ ID NO: 3184027 - RNA, 20 nt, Human
gaccccugcaguuccccugg

SEQ ID NO: 3184028 - RNA, 23 nt, Human
gaccccugcccagaucagccaga

SEQ ID NO: 3184029 - RNA, 12 nt, Human
gaccccugccca

SEQ ID NO: 3184030 - RNA, 16 nt, Human
gaccccugagcuugca

SEQ ID NO: 3184031 - RNA, 15 nt, Human
gacccuccaaggcca

SEQ ID NO: 3184032 - RNA, 13 nt, Human
gacccuccaaggc

SEQ ID NO: 3184033 - RNA, 11 nt, Human
gacccuccaag

SEQ ID NO: 3184034 - RNA, 14 nt, Human
gaccucaggccugg

SEQ ID NO: 3184035 - RNA, 13 nt, Human
gaccucaggccug

SEQ ID NO: 3184036 - RNA, 20 nt, Human
gacccugaaaugugugugau

SEQ ID NO: 3184037 - RNA, 16 nt, Human
gacccugaaaugugug

SEQ ID NO: 3184038 - RNA, 15 nt, Human
gacccugaaaugugu

SEQ ID NO: 3184039 - RNA, 14 nt, Human
gacccugaaaugug

SEQ ID NO: 3184040 - RNA, 13 nt, Human
gacccugaaaugu

SEQ ID NO: 3184041 - RNA, 18 nt, Human
gaccucaggugagaagca

SEQ ID NO: 3184042 - RNA, 19 nt, Human
gaccucaggugagaagcag

SEQ ID NO: 3184043 - RNA, 19 nt, Human
gaccucaggccugggggcu

SEQ ID NO: 3184044 - RNA, 22 nt, Human
gaccucagguaaucgaccugcc

SEQ ID NO: 3184045 - RNA, 23 nt, Human
gaccucagguaaucgaccugccu

SEQ ID NO: 3184046 - RNA, 21 nt, Human
gaccucaggugauccacccac

SEQ ID NO: 3184047 - RNA, 20 nt, Human
gaccucaggugauccaccca

SEQ ID NO: 3184048 - RNA, 21 nt, Human
gaccucaggugagaagcagag

SEQ ID NO: 3184049 - RNA, 19 nt, Human
gaccucaggugauccaccc

SEQ ID NO: 3184050 - RNA, 14 nt, Human
gacgcucucuggcc

SEQ ID NO: 3184051 - RNA, 23 nt, Human
gacgcuacccgggaagggggcug

SEQ ID NO: 3184052 - RNA, 22 nt, Human
gacgcuacccgggaagggggcu

SEQ ID NO: 3184053 - RNA, 19 nt, Human
gacgcuacccgggaagggg

SEQ ID NO: 3184054 - RNA, 16 nt, Human
gacgcugugcugcccu

SEQ ID NO: 3184055 - RNA, 17 nt, Human
gacgcugugcugcccug

SEQ ID NO: 3184056 - RNA, 18 nt, Human
gacgcugugcugcccugc

SEQ ID NO: 3184057 - RNA, 15 nt, Human
gacgcugugcugccc

SEQ ID NO: 3184058 - RNA, 22 nt, Human
gaccuccggccaggugccuccu

SEQ ID NO: 3184059 - RNA, 12 nt, Human
gacgccauccca

SEQ ID NO: 3184060 - RNA, 13 nt, Human
gacgccaucccag

SEQ ID NO: 3184061 - RNA, 19 nt, Human
gacgccaucccagccccaa

SEQ ID NO: 3184062 - RNA, 21 nt, Human
gacgccaucccagccccaaug

SEQ ID NO: 3184063 - RNA, 20 nt, Human
gaauauacucauuagaauua

SEQ ID NO: 3184064 - RNA, 17 nt, Human
gaauauagauuaaauca

SEQ ID NO: 3184065 - RNA, 12 nt, Human
gaauauugcuga

SEQ ID NO: 3184066 - RNA, 13 nt, Human
gaauauugcugau

SEQ ID NO: 3184067 - RNA, 11 nt, Human
gaauauugcug

SEQ ID NO: 3184068 - RNA, 12 nt, Human
gaauauugagca

SEQ ID NO: 3184069 - RNA, 20 nt, Human
gaauauugagcaauauguca

SEQ ID NO: 3184070 - RNA, 20 nt, Human
gaauaugaaagucuuauuaa

SEQ ID NO: 3184071 - RNA, 17 nt, Human
gaauaugggagaaauag

SEQ ID NO: 3184072 - RNA, 19 nt, Human
gaauaugauuaaaaauauc

SEQ ID NO: 3184073 - RNA, 21 nt, Human
gaauaugauuaaaaauaucaa

SEQ ID NO: 3184074 - RNA, 20 nt, Human
gaauauugcugauggugcaa

SEQ ID NO: 3184075 - RNA, 19 nt, Human
gaauauugccauuaugcuu

SEQ ID NO: 3184076 - RNA, 24 nt, Human
gaauauugcugauggugcaaugac

SEQ ID NO: 3184077 - RNA, 22 nt, Human
gaauauugcugauggugcaaug

SEQ ID NO: 3184078 - RNA, 23 nt, Human
gaauauugcugauggugcaauga

SEQ ID NO: 3184079 - RNA, 14 nt, Human
gaaugaauggcuaa

SEQ ID NO: 3184080 - RNA, 18 nt, Human
gaauuauuuuaaaagaua

SEQ ID NO: 3184081 - RNA, 16 nt, Human
gaauuauuuuaaaaga

SEQ ID NO: 3184082 - RNA, 13 nt, Human
gaauuauuuuaaa

SEQ ID NO: 3184083 - RNA, 23 nt, Human
gaauuacuaacuucuaaaacugu

SEQ ID NO: 3184084 - RNA, 18 nt, Human
gaauuacuaacuucuaaa

SEQ ID NO: 3184085 - RNA, 14 nt, Human
gaauuacuaacuuc

SEQ ID NO: 3184086 - RNA, 16 nt, Human
gaauuacuaacuucua

SEQ ID NO: 3184087 - RNA, 15 nt, Human
gaauuacuaacuucu

SEQ ID NO: 3184088 - RNA, 14 nt, Human
gaauuauuucuguc

SEQ ID NO: 3184089 - RNA, 21 nt, Human
gaauuauuucugucacaguaa

SEQ ID NO: 3184090 - RNA, 17 nt, Human
gacaaacugccaguuuu

SEQ ID NO: 3184091 - RNA, 20 nt, Human
gacaaacugccaguuuuguu

SEQ ID NO: 3184092 - RNA, 13 nt, Human
gaauuuuuuugua

SEQ ID NO: 3184093 - RNA, 15 nt, Human
gacaaagucaagcca

SEQ ID NO: 3184094 - RNA, 14 nt, Human
gacaaauaguaggc

SEQ ID NO: 3184095 - RNA, 21 nt, Human
gacaaauaguaggcaagaugg

SEQ ID NO: 3184096 - RNA, 17 nt, Human
gacaaauaguaggcaag

SEQ ID NO: 3184097 - RNA, 15 nt, Human
gacaaauaguaggca

SEQ ID NO: 3184098 - RNA, 20 nt, Human
gacacagcucuucuccaggc

SEQ ID NO: 3184099 - RNA, 19 nt, Human
gacacagcucuucuccagg

SEQ ID NO: 3184100 - RNA, 12 nt, Human
gacacagcucuu

SEQ ID NO: 3184101 - RNA, 21 nt, Human
gacacagcucuucuccaggcu

SEQ ID NO: 3184102 - RNA, 17 nt, Human
gacacagcucuucucca

SEQ ID NO: 3184103 - RNA, 14 nt, Human
gaauuaccauuugu

SEQ ID NO: 3184104 - RNA, 18 nt, Human
gaauuaccauuuguuaau

SEQ ID NO: 3184105 - RNA, 23 nt, Human
gaauuacaauuacuccuuuuauu

SEQ ID NO: 3184106 - RNA, 17 nt, Human
gaauuaauuaauuugga

SEQ ID NO: 3184107 - RNA, 18 nt, Human
gaauuaauuaauuuggag

SEQ ID NO: 3184108 - RNA, 14 nt, Human
gaauuaacacauga

SEQ ID NO: 3184109 - RNA, 15 nt, Human
gaauuaacacaugau

SEQ ID NO: 3184110 - RNA, 19 nt, Human
gaauguuugccucugccuc

SEQ ID NO: 3184111 - RNA, 18 nt, Human
gaauguuugccucugccu

SEQ ID NO: 3184112 - RNA, 20 nt, Human
gaauguuuuagcacagcguu

SEQ ID NO: 3184113 - RNA, 17 nt, Human
gaauguuuuagcacagc

SEQ ID NO: 3184114 - RNA, 15 nt, Human
gaaugaauggcuaag

SEQ ID NO: 3184115 - RNA, 21 nt, Human
gaaugaagguuuuuguaaaga

SEQ ID NO: 3184116 - RNA, 18 nt, Human
gaaugaguuucuuagacu

SEQ ID NO: 3184117 - RNA, 16 nt, Human
gaaugaguuucuuaga

SEQ ID NO: 3184118 - RNA, 14 nt, Human
gaaugaguuucuua

SEQ ID NO: 3184119 - RNA, 14 nt, Human
gaaugauuaauuaa

SEQ ID NO: 3184120 - RNA, 20 nt, Human
gaaugaugauccuaggcauu

SEQ ID NO: 3184121 - RNA, 14 nt, Human
gaaugaugccauga

SEQ ID NO: 3184122 - RNA, 18 nt, Human
gaaugcacaaacagaggc

SEQ ID NO: 3184123 - RNA, 21 nt, Human
gaaugaugguuuccaauuuca

SEQ ID NO: 3184124 - RNA, 17 nt, Human
gaauguuugccucugcc

SEQ ID NO: 3184125 - RNA, 16 nt, Human
gaauguuugccucugc

SEQ ID NO: 3184126 - RNA, 19 nt, Human
gaaugcacaaacagaggcc

SEQ ID NO: 3184127 - RNA, 15 nt, Human
gaauguuugccucug

SEQ ID NO: 3184128 - RNA, 22 nt, Human
gagcuguucacagccagacugg

SEQ ID NO: 3184129 - RNA, 18 nt, Human
gagcuguugaugggauga

SEQ ID NO: 3184130 - RNA, 19 nt, Human
gagcuggcuccagccugga

SEQ ID NO: 3184131 - RNA, 20 nt, Human
gagcuguucacagccagacu

SEQ ID NO: 3184132 - RNA, 17 nt, Human
gagcuguucacagccag

SEQ ID NO: 3184133 - RNA, 14 nt, Human
gagcuggcuccagc

SEQ ID NO: 3184134 - RNA, 14 nt, Human
gagcccugguggca

SEQ ID NO: 3184135 - RNA, 13 nt, Human
gagcccugguggc

SEQ ID NO: 3184136 - RNA, 14 nt, Human
gagcccugcucccu

SEQ ID NO: 3184137 - RNA, 18 nt, Human
gagcccugccucuccgcc

SEQ ID NO: 3184138 - RNA, 22 nt, Human
gagcccugccucuccgccccug

SEQ ID NO: 3184139 - RNA, 14 nt, Human
gagccccgaggccu

SEQ ID NO: 3184140 - RNA, 13 nt, Human
gagccccgaggcc

SEQ ID NO: 3184141 - RNA, 17 nt, Human
gagccccgaggccuucu

SEQ ID NO: 3184142 - RNA, 21 nt, Human
gagcagggcucagcggggaca

SEQ ID NO: 3184143 - RNA, 16 nt, Human
gagcaguaucaugaag

SEQ ID NO: 3184144 - RNA, 14 nt, Human
gagcaucaggccag

SEQ ID NO: 3184145 - RNA, 17 nt, Human
gagcaguaucaugaagc

SEQ ID NO: 3184146 - RNA, 13 nt, Human
gagcaugccugga

SEQ ID NO: 3184147 - RNA, 18 nt, Human
gagcccauuuggagggcc

SEQ ID NO: 3184148 - RNA, 15 nt, Human
gagcaucaggccagg

SEQ ID NO: 3184149 - RNA, 16 nt, Human
gagcaucaggccaggc

SEQ ID NO: 3184150 - RNA, 13 nt, Human
gagcaucaggcca

SEQ ID NO: 3184151 - RNA, 17 nt, Human
gagggccugcaagggag

SEQ ID NO: 3184152 - RNA, 21 nt, Human
gagggccugcaagggagugag

SEQ ID NO: 3184153 - RNA, 14 nt, Human
gagggccugcaagg

SEQ ID NO: 3184154 - RNA, 12 nt, Human
gagggccugggc

SEQ ID NO: 3184155 - RNA, 20 nt, Human
gaggggagacuuugauguca

SEQ ID NO: 3184156 - RNA, 17 nt, Human
gaggggagccaggaggg

SEQ ID NO: 3184157 - RNA, 14 nt, Human
gaggggagccagga

SEQ ID NO: 3184158 - RNA, 17 nt, Human
gaggggauggggcuggg

SEQ ID NO: 3184159 - RNA, 23 nt, Human
gaggggaugugugugugcagagc

SEQ ID NO: 3184160 - RNA, 21 nt, Human
gaggggaugugugugugcaga

SEQ ID NO: 3184161 - RNA, 12 nt, Human
gaggcugacucc

SEQ ID NO: 3184162 - RNA, 15 nt, Human
gaggcugacuccugg

SEQ ID NO: 3184163 - RNA, 16 nt, Human
gaggcugacuccuggu

SEQ ID NO: 3184164 - RNA, 19 nt, Human
gaggcugacuccugguccu

SEQ ID NO: 3184165 - RNA, 18 nt, Human
gaggcugagaugggagaa

SEQ ID NO: 3184166 - RNA, 17 nt, Human
gaggcuccacuuggucu

SEQ ID NO: 3184167 - RNA, 22 nt, Human
gaggccaagaguggccccaccu

SEQ ID NO: 3184168 - RNA, 21 nt, Human
gaggccaagaguggccccacc

SEQ ID NO: 3184169 - RNA, 20 nt, Human
gaggccaagaguggccccac

SEQ ID NO: 3184170 - RNA, 19 nt, Human
gaggccaagaguggcccca

SEQ ID NO: 3184171 - RNA, 15 nt, Human
gaggcuccacuuggu

SEQ ID NO: 3184172 - RNA, 12 nt, Human
gaggcuccacuu

SEQ ID NO: 3184173 - RNA, 17 nt, Human
gaggccaaacaggcccu

SEQ ID NO: 3184174 - RNA, 18 nt, Human
gaggccaaacaggcccuc

SEQ ID NO: 3184175 - RNA, 17 nt, Human
gaggccaagaguggccc

SEQ ID NO: 3184176 - RNA, 16 nt, Human
gaggccaagaguggcc

SEQ ID NO: 3184177 - RNA, 22 nt, Human
gaggcaugugaugagaggaaau

SEQ ID NO: 3184178 - RNA, 20 nt, Human
gaggcaugugaugagaggaa

SEQ ID NO: 3184179 - RNA, 21 nt, Human
gaggcaugugaugagaggaaa

SEQ ID NO: 3184180 - RNA, 22 nt, Human
gaggacaguauuuguggggagg

SEQ ID NO: 3184181 - RNA, 23 nt, Human
gaggacagggaggugaccccagg

SEQ ID NO: 3184182 - RNA, 16 nt, Human
gaggacauggcuucug

SEQ ID NO: 3184183 - RNA, 21 nt, Human
gaggacgcucucuggccuucg

SEQ ID NO: 3184184 - RNA, 20 nt, Human
gaggacgcucucuggccuuc

SEQ ID NO: 3184185 - RNA, 13 nt, Human
gaggaccagggcu

SEQ ID NO: 3184186 - RNA, 14 nt, Human
gaggaccagcacac

SEQ ID NO: 3184187 - RNA, 13 nt, Human
gaggaccagcaca

SEQ ID NO: 3184188 - RNA, 16 nt, Human
gaggacuuuucuuugu

SEQ ID NO: 3184189 - RNA, 23 nt, Human
gaggacuuuucuuuguggcuucc

SEQ ID NO: 3184190 - RNA, 20 nt, Human
gaggacuuuucuuuguggcu

SEQ ID NO: 3184191 - RNA, 12 nt, Human
gaggagaaacug

SEQ ID NO: 3184192 - RNA, 14 nt, Human
gaggagaaacugga

SEQ ID NO: 3184193 - RNA, 16 nt, Human
gaggagaacuugcugc

SEQ ID NO: 3184194 - RNA, 14 nt, Human
gaggagaagaaaau

SEQ ID NO: 3184195 - RNA, 18 nt, Human
gaggagaacuugcugccu

SEQ ID NO: 3184196 - RNA, 14 nt, Human
gaggagagaggacc

SEQ ID NO: 3184197 - RNA, 15 nt, Human
gaggagagaggaccc

SEQ ID NO: 3184198 - RNA, 12 nt, Human
gaggagagagga

SEQ ID NO: 3184199 - RNA, 20 nt, Human
gaggcagggucucacucugu

SEQ ID NO: 3184200 - RNA, 19 nt, Human
gaggcagggucucacucug

SEQ ID NO: 3184201 - RNA, 17 nt, Human
gaggcaucgcaauguaa

SEQ ID NO: 3184202 - RNA, 18 nt, Human
gaggcagggucucacucu

SEQ ID NO: 3184203 - RNA, 17 nt, Human
gagaaaaccccuuccca

SEQ ID NO: 3184204 - RNA, 20 nt, Human
gagaaaacaucucaucaugu

SEQ ID NO: 3184205 - RNA, 22 nt, Human
gacuuuucaaguauuuaagccu

SEQ ID NO: 3184206 - RNA, 19 nt, Human
gacuuuuccaacccucauc

SEQ ID NO: 3184207 - RNA, 14 nt, Human
gacuuuuccaaccc

SEQ ID NO: 3184208 - RNA, 18 nt, Human
gacuuuuauuuccaguga

SEQ ID NO: 3184209 - RNA, 19 nt, Human
gacuuuucaaguauuuaag

SEQ ID NO: 3184210 - RNA, 14 nt, Human
gacuuuucaaguau

SEQ ID NO: 3184211 - RNA, 23 nt, Human
gagaaggacccggaggggccugg

SEQ ID NO: 3184212 - RNA, 21 nt, Human
gagaagggcagaguuacuuga

SEQ ID NO: 3184213 - RNA, 20 nt, Human
gagaccgugaagauacuuug

SEQ ID NO: 3184214 - RNA, 22 nt, Human
gagaccgugaagauacuuugua

SEQ ID NO: 3184215 - RNA, 14 nt, Human
gagacggaguccca

SEQ ID NO: 3184216 - RNA, 13 nt, Human
gagaccugccccu

SEQ ID NO: 3184217 - RNA, 19 nt, Human
gagacggagucccaccuug

SEQ ID NO: 3184218 - RNA, 16 nt, Human
gagacggagucccacc

SEQ ID NO: 3184219 - RNA, 18 nt, Human
gagacgggggcagagagg

SEQ ID NO: 3184220 - RNA, 21 nt, Human
gagacccugucucaaaaaaag

SEQ ID NO: 3184221 - RNA, 11 nt, Human
gagaaugaaca

SEQ ID NO: 3184222 - RNA, 17 nt, Human
gagaaucucaacauguc

SEQ ID NO: 3184223 - RNA, 13 nt, Human
gagaaugaacaaa

SEQ ID NO: 3184224 - RNA, 23 nt, Human
gagaaugaaagggcccagagagg

SEQ ID NO: 3184225 - RNA, 15 nt, Human
gagaaugaaagggcc

SEQ ID NO: 3184226 - RNA, 14 nt, Human
gagaaucacaggcu

SEQ ID NO: 3184227 - RNA, 15 nt, Human
gagaaucacaggcug

SEQ ID NO: 3184228 - RNA, 21 nt, Human
gagauugugccccugcacucc

SEQ ID NO: 3184229 - RNA, 14 nt, Human
gagauuggaaggaa

SEQ ID NO: 3184230 - RNA, 16 nt, Human
gagauuggaucaagua

SEQ ID NO: 3184231 - RNA, 19 nt, Human
gagauuggaucaaguauua

SEQ ID NO: 3184232 - RNA, 21 nt, Human
gagauuggaucaaguauuacu

SEQ ID NO: 3184233 - RNA, 23 nt, Human
gagauugcuguguguugccuggg

SEQ ID NO: 3184234 - RNA, 20 nt, Human
gagaugcuagaacucccuuu

SEQ ID NO: 3184235 - RNA, 16 nt, Human
gagaugcuagaacucc

SEQ ID NO: 3184236 - RNA, 21 nt, Human
gagauugcaccacugcacucc

SEQ ID NO: 3184237 - RNA, 15 nt, Human
gagauuauguucuuu

SEQ ID NO: 3184238 - RNA, 23 nt, Human
gagauuauuuacaagaagaacuc

SEQ ID NO: 3184239 - RNA, 17 nt, Human
gagauguguaauuuuuc

SEQ ID NO: 3184240 - RNA, 20 nt, Human
gagauguguaauuuuucugu

SEQ ID NO: 3184241 - RNA, 16 nt, Human
gagauguguaucagug

SEQ ID NO: 3184242 - RNA, 17 nt, Human
gagauguguaucagugu

SEQ ID NO: 3184243 - RNA, 13 nt, Human
gagacuccugcag

SEQ ID NO: 3184244 - RNA, 14 nt, Human
gagagccuuccagg

SEQ ID NO: 3184245 - RNA, 15 nt, Human
gagagccuuccaggg

SEQ ID NO: 3184246 - RNA, 16 nt, Human
gagagccuuccagggg

SEQ ID NO: 3184247 - RNA, 18 nt, Human
gagagccuuccaggggug

SEQ ID NO: 3184248 - RNA, 20 nt, Human
gagagccuuccagggguggg

SEQ ID NO: 3184249 - RNA, 14 nt, Human
gagagcgcagcccg

SEQ ID NO: 3184250 - RNA, 15 nt, Human
gagagcuagcagcag

SEQ ID NO: 3184251 - RNA, 21 nt, Human
gagagcuagcagcagggaggg

SEQ ID NO: 3184252 - RNA, 13 nt, Human
gagagcugggugu

SEQ ID NO: 3184253 - RNA, 23 nt, Human
gagagcuauggacagcauugcca

SEQ ID NO: 3184254 - RNA, 15 nt, Human
gagaggacccccuga

SEQ ID NO: 3184255 - RNA, 19 nt, Human
gagagcuuagggucucagg

SEQ ID NO: 3184256 - RNA, 20 nt, Human
gagagcugggugucaagagg

SEQ ID NO: 3184257 - RNA, 12 nt, Human
gagaggaaauca

SEQ ID NO: 3184258 - RNA, 22 nt, Human
gagagcuucuguugcugccuca

SEQ ID NO: 3184259 - RNA, 15 nt, Human
gagaggagcccugcc

SEQ ID NO: 3184260 - RNA, 13 nt, Human
gagaggccgggac

SEQ ID NO: 3184261 - RNA, 16 nt, Human
gagaggcuaaaauguu

SEQ ID NO: 3184262 - RNA, 22 nt, Human
gagaggcuaaaauguuuucagc

SEQ ID NO: 3184263 - RNA, 21 nt, Human
gagaggcuaaaauguuuucag

SEQ ID NO: 3184264 - RNA, 20 nt, Human
gagaggcuaaaauguuuuca

SEQ ID NO: 3184265 - RNA, 21 nt, Human
gagaggcugugguuuggggga

SEQ ID NO: 3184266 - RNA, 13 nt, Human
gagaggcuguggu

SEQ ID NO: 3184267 - RNA, 16 nt, Human
gaucugcugcagagca

SEQ ID NO: 3184268 - RNA, 17 nt, Human
gaucugcugcagagcag

SEQ ID NO: 3184269 - RNA, 18 nt, Human
gaucugcugcagagcagu

SEQ ID NO: 3184270 - RNA, 12 nt, Human
gaucucugcagg

SEQ ID NO: 3184271 - RNA, 23 nt, Human
gaucucugcaggaaauggcugug

SEQ ID NO: 3184272 - RNA, 18 nt, Human
gaucucuugagccuggga

SEQ ID NO: 3184273 - RNA, 19 nt, Human
gaucucuugagccugggag

SEQ ID NO: 3184274 - RNA, 20 nt, Human
gaucucuuucuaaagacagg

SEQ ID NO: 3184275 - RNA, 12 nt, Human
gaucucuuaaga

SEQ ID NO: 3184276 - RNA, 17 nt, Human
gaucugaugcaagcaag

SEQ ID NO: 3184277 - RNA, 23 nt, Human
gauccagcccugaguuccuagcc

SEQ ID NO: 3184278 - RNA, 15 nt, Human
gaucccaguagaaaa

SEQ ID NO: 3184279 - RNA, 21 nt, Human
gaugcuucuucagagacuccu

SEQ ID NO: 3184280 - RNA, 23 nt, Human
gaugcuucucacugccaugccag

SEQ ID NO: 3184281 - RNA, 14 nt, Human
gaugauuuccaagc

SEQ ID NO: 3184282 - RNA, 17 nt, Human
gaugcuucuucagagac

SEQ ID NO: 3184283 - RNA, 20 nt, Human
gaugcuucuucagagacucc

SEQ ID NO: 3184284 - RNA, 22 nt, Human
gaugauuggaggggggaggugg

SEQ ID NO: 3184285 - RNA, 12 nt, Human
gaugauuucaga

SEQ ID NO: 3184286 - RNA, 19 nt, Human
gaugauugaagaaacagcu

SEQ ID NO: 3184287 - RNA, 13 nt, Human
gaugauccuaggc

SEQ ID NO: 3184288 - RNA, 15 nt, Human
gaugauugaagaaac

SEQ ID NO: 3184289 - RNA, 22 nt, Human
gauacuuggucacagccaggcg

SEQ ID NO: 3184290 - RNA, 18 nt, Human
gauacuuugauauuuuca

SEQ ID NO: 3184291 - RNA, 16 nt, Human
gauacuuuguauuguc

SEQ ID NO: 3184292 - RNA, 19 nt, Human
gauacuuuguauuguccua

SEQ ID NO: 3184293 - RNA, 23 nt, Human
gauacuuuguauuguccuauuag

SEQ ID NO: 3184294 - RNA, 18 nt, Human
gauauuugcaguuuuuca

SEQ ID NO: 3184295 - RNA, 20 nt, Human
gauauuugcaguuuuucauu

SEQ ID NO: 3184296 - RNA, 11 nt, Human
gauauuucaga

SEQ ID NO: 3184297 - RNA, 17 nt, Human
gauauuucagaaauaca

SEQ ID NO: 3184298 - RNA, 16 nt, Human
gauauuucagaaauac

SEQ ID NO: 3184299 - RNA, 19 nt, Human
gauauuuucaacgcagccc

SEQ ID NO: 3184300 - RNA, 20 nt, Human
gauauuuuauuuugaaaugg

SEQ ID NO: 3184301 - RNA, 20 nt, Human
gauauuuguauuuauucuuu

SEQ ID NO: 3184302 - RNA, 20 nt, Human
gaucaaaagguuaauaaagu

SEQ ID NO: 3184303 - RNA, 23 nt, Human
gauauuuucaacgcagcccugcu

SEQ ID NO: 3184304 - RNA, 22 nt, Human
gauauuuucaacgcagcccugc

SEQ ID NO: 3184305 - RNA, 21 nt, Human
gauauuuucaacgcagcccug

SEQ ID NO: 3184306 - RNA, 23 nt, Human
gaucaaaagguuaauaaaguaau

SEQ ID NO: 3184307 - RNA, 20 nt, Human
gaucaaaaaggcuuauaaaa

SEQ ID NO: 3184308 - RNA, 23 nt, Human
gaucaaaaaggcuuauaaaacag

SEQ ID NO: 3184309 - RNA, 14 nt, Human
gaucaaaaaggcuu

SEQ ID NO: 3184310 - RNA, 22 nt, Human
gaucaaaccccgaccaccugcc

SEQ ID NO: 3184311 - RNA, 16 nt, Human
gaucaaauaguugcau

SEQ ID NO: 3184312 - RNA, 19 nt, Human
gauccacccaccucagccu

SEQ ID NO: 3184313 - RNA, 18 nt, Human
gauccacccaccucagcc

SEQ ID NO: 3184314 - RNA, 21 nt, Human
gauccaagcuggucccacuca

SEQ ID NO: 3184315 - RNA, 21 nt, Human
gauccacccaccucagccucc

SEQ ID NO: 3184316 - RNA, 20 nt, Human
gauccacccaccucagccuc

SEQ ID NO: 3184317 - RNA, 22 nt, Human
gauccacccaccucagccuccc

SEQ ID NO: 3184318 - RNA, 19 nt, Human
gauccaagcuggucccacu

SEQ ID NO: 3184319 - RNA, 17 nt, Human
gauccaagcugguccca

SEQ ID NO: 3184320 - RNA, 16 nt, Human
gauccaagcugguccc

SEQ ID NO: 3184321 - RNA, 12 nt, Human
gauccaagcugg

SEQ ID NO: 3184322 - RNA, 13 nt, Human
gauacugccuccc

SEQ ID NO: 3184323 - RNA, 17 nt, Human
gauacugccucccccag

SEQ ID NO: 3184324 - RNA, 23 nt, Human
gauacaggaaaagcugcugacag

SEQ ID NO: 3184325 - RNA, 20 nt, Human
gcaaccuccgccucuugggu

SEQ ID NO: 3184326 - RNA, 20 nt, Human
gcaaccuucgccaccugggu

SEQ ID NO: 3184327 - RNA, 19 nt, Human
gcaaccuccgccucuuggg

SEQ ID NO: 3184328 - RNA, 16 nt, Human
gcaacccccagccugc

SEQ ID NO: 3184329 - RNA, 15 nt, Human
gcaacccccagccug

SEQ ID NO: 3184330 - RNA, 14 nt, Human
gcaacccccagccu

SEQ ID NO: 3184331 - RNA, 18 nt, Human
gcaaccauauagaaagcu

SEQ ID NO: 3184332 - RNA, 14 nt, Human
gcaaccauuugaaa

SEQ ID NO: 3184333 - RNA, 15 nt, Human
gcaaccaaacuccca

SEQ ID NO: 3184334 - RNA, 13 nt, Human
gcaaaauuccuga

SEQ ID NO: 3184335 - RNA, 13 nt, Human
gcaacaggcuggg

SEQ ID NO: 3184336 - RNA, 15 nt, Human
gcaacaggcugggcu

SEQ ID NO: 3184337 - RNA, 14 nt, Human
gcaacaggcugggc

SEQ ID NO: 3184338 - RNA, 15 nt, Human
gcaaaaucaagagau

SEQ ID NO: 3184339 - RNA, 21 nt, Human
gcaaaauacaugaugauuuca

SEQ ID NO: 3184340 - RNA, 18 nt, Human
gcaaaauacaugaugauu

SEQ ID NO: 3184341 - RNA, 23 nt, Human
gcaaaagugcugcagggcuuuaa

SEQ ID NO: 3184342 - RNA, 19 nt, Human
gcaacaggcugggcuucag

SEQ ID NO: 3184343 - RNA, 16 nt, Human
gcaacaggcugggcuu

SEQ ID NO: 3184344 - RNA, 16 nt, Human
gcaaccaccaccaacc

SEQ ID NO: 3184345 - RNA, 18 nt, Human
gcaaccaccaccaaccac

SEQ ID NO: 3184346 - RNA, 13 nt, Human
gcaaccaccacca

SEQ ID NO: 3184347 - RNA, 15 nt, Human
gcaaccaaaaagaaa

SEQ ID NO: 3184348 - RNA, 15 nt, Human
gcaagugagagcugg

SEQ ID NO: 3184349 - RNA, 16 nt, Human
gcaagugagagcuggg

SEQ ID NO: 3184350 - RNA, 13 nt, Human
gauggaaugaugg

SEQ ID NO: 3184351 - RNA, 13 nt, Human
gauggaauuuuuu

SEQ ID NO: 3184352 - RNA, 15 nt, Human
gauucuucugcuuca

SEQ ID NO: 3184353 - RNA, 13 nt, Human
gauucuucugcuu

SEQ ID NO: 3184354 - RNA, 12 nt, Human
gauucuucugcu

SEQ ID NO: 3184355 - RNA, 21 nt, Human
gauuuuuuuuuccuucagugc

SEQ ID NO: 3184356 - RNA, 15 nt, Human
gcaaaaaauaaugac

SEQ ID NO: 3184357 - RNA, 19 nt, Human
gauuucacaaauauuaaaa

SEQ ID NO: 3184358 - RNA, 13 nt, Human
gauuucacaaaua

SEQ ID NO: 3184359 - RNA, 15 nt, Human
gauuucacaaauauu

SEQ ID NO: 3184360 - RNA, 14 nt, Human
gauuucacaaauau

SEQ ID NO: 3184361 - RNA, 14 nt, Human
gcaaaaaggcagga

SEQ ID NO: 3184362 - RNA, 22 nt, Human
gcaaaaaaucuuaauacuguua

SEQ ID NO: 3184363 - RNA, 12 nt, Human
gcaaaaaaucuu

SEQ ID NO: 3184364 - RNA, 22 nt, Human
gcaaaagaugcuucucacugcc

SEQ ID NO: 3184365 - RNA, 11 nt, Human
gcaaaaggaaa

SEQ ID NO: 3184366 - RNA, 13 nt, Human
gcaaaaauaauca

SEQ ID NO: 3184367 - RNA, 17 nt, Human
gcaaaagaugcuucuca

SEQ ID NO: 3184368 - RNA, 16 nt, Human
gauuuuuuuuuccuuc

SEQ ID NO: 3184369 - RNA, 12 nt, Human
gauuucacucuc

SEQ ID NO: 3184370 - RNA, 17 nt, Human
gauuuuuuuuuccuuca

SEQ ID NO: 3184371 - RNA, 18 nt, Human
gauuuuuuuuuccuucag

SEQ ID NO: 3184372 - RNA, 11 nt, Human
gauuucacucu

SEQ ID NO: 3184373 - RNA, 21 nt, Human
gauuuauuuuguaugaaauau

SEQ ID NO: 3184374 - RNA, 22 nt, Human
gauuuauuucaucauauuauac

SEQ ID NO: 3184375 - RNA, 18 nt, Human
gauuuauuucaucauauu

SEQ ID NO: 3184376 - RNA, 16 nt, Human
gauuuaauuugaaaua

SEQ ID NO: 3184377 - RNA, 20 nt, Human
gauuuauuaacuuaauaauc

SEQ ID NO: 3184378 - RNA, 12 nt, Human
gcagcucccuca

SEQ ID NO: 3184379 - RNA, 20 nt, Human
gcagcuccuuccuagccuug

SEQ ID NO: 3184380 - RNA, 20 nt, Human
gcagccaggccacuggcccc

SEQ ID NO: 3184381 - RNA, 16 nt, Human
gcagccaggccacaag

SEQ ID NO: 3184382 - RNA, 21 nt, Human
gcagccagccaaacacacaga

SEQ ID NO: 3184383 - RNA, 19 nt, Human
gcagagcugcgggcugggu

SEQ ID NO: 3184384 - RNA, 17 nt, Human
gcagagcugcgggcugg

SEQ ID NO: 3184385 - RNA, 19 nt, Human
gcagaacugcagucacugc

SEQ ID NO: 3184386 - RNA, 18 nt, Human
gcagaacagugauuacca

SEQ ID NO: 3184387 - RNA, 22 nt, Human
gcagaacagugauuaccaggga

SEQ ID NO: 3184388 - RNA, 13 nt, Human
gcagaggaaagca

SEQ ID NO: 3184389 - RNA, 14 nt, Human
gcagaggaaagcaa

SEQ ID NO: 3184390 - RNA, 18 nt, Human
gcagaggaaagcaaagga

SEQ ID NO: 3184391 - RNA, 20 nt, Human
gcagaggaaagcaaaggaga

SEQ ID NO: 3184392 - RNA, 21 nt, Human
gcagaggaaagcaaaggagau

SEQ ID NO: 3184393 - RNA, 22 nt, Human
gcagaggagaacuugcugccuc

SEQ ID NO: 3184394 - RNA, 21 nt, Human
gcagaggagaacuugcugccu

SEQ ID NO: 3184395 - RNA, 19 nt, Human
gcagaggagaacuugcugc

SEQ ID NO: 3184396 - RNA, 14 nt, Human
gcagagggcacaga

SEQ ID NO: 3184397 - RNA, 17 nt, Human
gcagcauaaagaauuug

SEQ ID NO: 3184398 - RNA, 17 nt, Human
gcagcauauucaggaag

SEQ ID NO: 3184399 - RNA, 18 nt, Human
gcagcauauucaggaagc

SEQ ID NO: 3184400 - RNA, 19 nt, Human
gcagcauauucaggaagcu

SEQ ID NO: 3184401 - RNA, 23 nt, Human
gcagcauauucaggaagcucagg

SEQ ID NO: 3184402 - RNA, 18 nt, Human
gcaagugagagcugggug

SEQ ID NO: 3184403 - RNA, 20 nt, Human
gcacucagaagacacugaug

SEQ ID NO: 3184404 - RNA, 17 nt, Human
gcacucagaagacacug

SEQ ID NO: 3184405 - RNA, 12 nt, Human
gcagaacaguga

SEQ ID NO: 3184406 - RNA, 13 nt, Human
gcagaacagugau

SEQ ID NO: 3184407 - RNA, 20 nt, Human
gcagaaagcaaaauuauguu

SEQ ID NO: 3184408 - RNA, 22 nt, Human
gcacuuuguucuggcucuucca

SEQ ID NO: 3184409 - RNA, 16 nt, Human
gcacuuuuuaaaaaac

SEQ ID NO: 3184410 - RNA, 23 nt, Human
gcacuuuucuaaacuaggcuccu

SEQ ID NO: 3184411 - RNA, 22 nt, Human
gcacuuuuucuuaaucauuuuu

SEQ ID NO: 3184412 - RNA, 12 nt, Human
gcacuccccugc

SEQ ID NO: 3184413 - RNA, 15 nt, Human
gcacuccccugcugg

SEQ ID NO: 3184414 - RNA, 18 nt, Human
gcacuuuguucuggcucu

SEQ ID NO: 3184415 - RNA, 19 nt, Human
gcacuuuguucuggcucuu

SEQ ID NO: 3184416 - RNA, 13 nt, Human
gcacuccccugcu

SEQ ID NO: 3184417 - RNA, 14 nt, Human
gcacuccccugcug

SEQ ID NO: 3184418 - RNA, 14 nt, Human
gcacuccagccugg

SEQ ID NO: 3184419 - RNA, 13 nt, Human
gcagugaugucac

SEQ ID NO: 3184420 - RNA, 15 nt, Human
gcaguugcccagccu

SEQ ID NO: 3184421 - RNA, 17 nt, Human
gcagugauauucuuugu

SEQ ID NO: 3184422 - RNA, 18 nt, Human
gcagugauauucuuuguu

SEQ ID NO: 3184423 - RNA, 18 nt, Human
gcaguugcugguaaaaug

SEQ ID NO: 3184424 - RNA, 19 nt, Human
gcaguugcugguaaaauga

SEQ ID NO: 3184425 - RNA, 23 nt, Human
gcaguugcccagccucuuucccu

SEQ ID NO: 3184426 - RNA, 16 nt, Human
gcaguugcccagccuc

SEQ ID NO: 3184427 - RNA, 13 nt, Human
gcaguuguuaagu

SEQ ID NO: 3184428 - RNA, 23 nt, Human
gcaguugcugguaaaaugaagaa

SEQ ID NO: 3184429 - RNA, 22 nt, Human
gcagucuuaugcuuccagaaac

SEQ ID NO: 3184430 - RNA, 21 nt, Human
gcagucuuaugcuuccagaaa

SEQ ID NO: 3184431 - RNA, 19 nt, Human
gcagucuuaugcuuccaga

SEQ ID NO: 3184432 - RNA, 18 nt, Human
gcagucuuaugcuuccag

SEQ ID NO: 3184433 - RNA, 17 nt, Human
gcagucuuaugcuucca

SEQ ID NO: 3184434 - RNA, 14 nt, Human
gcagucugccugga

SEQ ID NO: 3184435 - RNA, 12 nt, Human
gcagucugccug

SEQ ID NO: 3184436 - RNA, 14 nt, Human
gcagugagagcaga

SEQ ID NO: 3184437 - RNA, 18 nt, Human
gcagcugaaauugaaaag

SEQ ID NO: 3184438 - RNA, 12 nt, Human
gcagcugaaauu

SEQ ID NO: 3184439 - RNA, 23 nt, Human
gcagcucuuccuggacaggccag

SEQ ID NO: 3184440 - RNA, 14 nt, Human
gcagcucuuccugg

SEQ ID NO: 3184441 - RNA, 13 nt, Human
gcagcucuuccug

SEQ ID NO: 3184442 - RNA, 12 nt, Human
gcagcucuuccu

SEQ ID NO: 3184443 - RNA, 13 nt, Human
gcauccuggcacc

SEQ ID NO: 3184444 - RNA, 17 nt, Human
gcauccuccgccucccg

SEQ ID NO: 3184445 - RNA, 21 nt, Human
gcauggcugccaaugggagcu

SEQ ID NO: 3184446 - RNA, 15 nt, Human
gcaugguccauucuc

SEQ ID NO: 3184447 - RNA, 22 nt, Human
gcaugguccauucucaagggac

SEQ ID NO: 3184448 - RNA, 13 nt, Human
gcauggugguugg

SEQ ID NO: 3184449 - RNA, 22 nt, Human
gcauggugguugggacccagug

SEQ ID NO: 3184450 - RNA, 20 nt, Human
gcauggugguugggacccag

SEQ ID NO: 3184451 - RNA, 16 nt, Human
gcauugugggaagggg

SEQ ID NO: 3184452 - RNA, 18 nt, Human
gcauugugggaaggggag

SEQ ID NO: 3184453 - RNA, 15 nt, Human
gcauuuacuuugugu

SEQ ID NO: 3184454 - RNA, 14 nt, Human
gcauuuaagaauug

SEQ ID NO: 3184455 - RNA, 23 nt, Human
gcauuuaagaauugccagucuuu

SEQ ID NO: 3184456 - RNA, 13 nt, Human
gcauugugggaag

SEQ ID NO: 3184457 - RNA, 15 nt, Human
gcauugugggaaggg

SEQ ID NO: 3184458 - RNA, 21 nt, Human
gcaugugaugagaggaaauca

SEQ ID NO: 3184459 - RNA, 18 nt, Human
gcaugugaugagaggaaa

SEQ ID NO: 3184460 - RNA, 19 nt, Human
gcaugugaugagaggaaau

SEQ ID NO: 3184461 - RNA, 22 nt, Human
gcauguaaaagccuaggucuau

SEQ ID NO: 3184462 - RNA, 14 nt, Human
gcauccaguaucuu

SEQ ID NO: 3184463 - RNA, 17 nt, Human
gcauccaguaucuugaa

SEQ ID NO: 3184464 - RNA, 18 nt, Human
gcauccaguaucuugaag

SEQ ID NO: 3184465 - RNA, 23 nt, Human
gcauccauggggucucucacaga

SEQ ID NO: 3184466 - RNA, 22 nt, Human
gcauccauggggucucucacag

SEQ ID NO: 3184467 - RNA, 21 nt, Human
gcauccauggggucucucaca

SEQ ID NO: 3184468 - RNA, 12 nt, Human
gcauccaugggg

SEQ ID NO: 3184469 - RNA, 11 nt, Human
gcauccauggg

SEQ ID NO: 3184470 - RNA, 14 nt, Human
gcauccgaccaggu

SEQ ID NO: 3184471 - RNA, 16 nt, Human
gcauccgaccagguug

SEQ ID NO: 3184472 - RNA, 18 nt, Human
cugagaucucugcaggaa

SEQ ID NO: 3184473 - RNA, 17 nt, Human
cugagaucucugcagga

SEQ ID NO: 3184474 - RNA, 16 nt, Human
cugagaucucugcagg

SEQ ID NO: 3184475 - RNA, 21 nt, Human
cugagaucaaaacgguuuuac

SEQ ID NO: 3184476 - RNA, 14 nt, Human
cugagcuuucugcu

SEQ ID NO: 3184477 - RNA, 20 nt, Human
cugagaugccuggugagcau

SEQ ID NO: 3184478 - RNA, 21 nt, Human
cugagaugagaggggagagcu

SEQ ID NO: 3184479 - RNA, 15 nt, Human
cugagcuuucugcua

SEQ ID NO: 3184480 - RNA, 14 nt, Human
cugaggaauccaga

SEQ ID NO: 3184481 - RNA, 20 nt, Human
cugaggaauccagacccggc

SEQ ID NO: 3184482 - RNA, 17 nt, Human
cugaggaauccagaccc

SEQ ID NO: 3184483 - RNA, 20 nt, Human
cugaggacacuaaccacgcu

SEQ ID NO: 3184484 - RNA, 23 nt, Human
cugaggacacuaaccacgcugga

SEQ ID NO: 3184485 - RNA, 23 nt, Human
cugaggacaagagaaaaaagcca

SEQ ID NO: 3184486 - RNA, 22 nt, Human
cugaggugaugaagacagcccg

SEQ ID NO: 3184487 - RNA, 14 nt, Human
cugaggaccagcca

SEQ ID NO: 3184488 - RNA, 22 nt, Human
cugaggacuuaaaauauuccug

SEQ ID NO: 3184489 - RNA, 19 nt, Human
cugaggacauggcuucuga

SEQ ID NO: 3184490 - RNA, 23 nt, Human
cugaggaggccuugggcucugcu

SEQ ID NO: 3184491 - RNA, 15 nt, Human
cugaguagcugggau

SEQ ID NO: 3184492 - RNA, 20 nt, Human
cugaguagcugggauuacag

SEQ ID NO: 3184493 - RNA, 14 nt, Human
cugaguagcuggga

SEQ ID NO: 3184494 - RNA, 18 nt, Human
cugaguagcucugccuuu

SEQ ID NO: 3184495 - RNA, 17 nt, Human
cugaguagcucugccuu

SEQ ID NO: 3184496 - RNA, 12 nt, Human
cugagaggccac

SEQ ID NO: 3184497 - RNA, 14 nt, Human
cugagaggcugucu

SEQ ID NO: 3184498 - RNA, 22 nt, Human
cugagaggacuuuucuuugugg

SEQ ID NO: 3184499 - RNA, 21 nt, Human
cugagaggacuuuucuuugug

SEQ ID NO: 3184500 - RNA, 17 nt, Human
cugagaguagagucacu

SEQ ID NO: 3184501 - RNA, 15 nt, Human
cugagagucuagagg

SEQ ID NO: 3184502 - RNA, 22 nt, Human
cugagacucgcgacaaugcaaa

SEQ ID NO: 3184503 - RNA, 21 nt, Human
cugagagaggcuaaaauguuu

SEQ ID NO: 3184504 - RNA, 20 nt, Human
cugagagaggcuaaaauguu

SEQ ID NO: 3184505 - RNA, 19 nt, Human
cugagagaggcuaaaaugu

SEQ ID NO: 3184506 - RNA, 16 nt, Human
cugagagagcgcagcc

SEQ ID NO: 3184507 - RNA, 17 nt, Human
cugagagcccagaaaag

SEQ ID NO: 3184508 - RNA, 11 nt, Human
cugagagcaaa

SEQ ID NO: 3184509 - RNA, 23 nt, Human
cugagagaggcuaaaauguuuuc

SEQ ID NO: 3184510 - RNA, 23 nt, Human
cugagacagcccgggcucugccu

SEQ ID NO: 3184511 - RNA, 22 nt, Human
cugagacagcccgggcucugcc

SEQ ID NO: 3184512 - RNA, 21 nt, Human
cugagacucgcgacaaugcaa

SEQ ID NO: 3184513 - RNA, 20 nt, Human
cugagacucgcgacaaugca

SEQ ID NO: 3184514 - RNA, 16 nt, Human
cugagacagugaauuu

SEQ ID NO: 3184515 - RNA, 21 nt, Human
cugacccaugcugcccuguga

SEQ ID NO: 3184516 - RNA, 22 nt, Human
cugacccaugcugcccugugag

SEQ ID NO: 3184517 - RNA, 20 nt, Human
cugacccaugcugcccugug

SEQ ID NO: 3184518 - RNA, 17 nt, Human
cugacccaugggcagga

SEQ ID NO: 3184519 - RNA, 13 nt, Human
cugacccaugggc

SEQ ID NO: 3184520 - RNA, 19 nt, Human
cugacccaugggcaggaga

SEQ ID NO: 3184521 - RNA, 18 nt, Human
cugacaaccauuaaaguc

SEQ ID NO: 3184522 - RNA, 19 nt, Human
cugacaaccauuaaaguca

SEQ ID NO: 3184523 - RNA, 20 nt, Human
cugacaaccauuaaagucag

SEQ ID NO: 3184524 - RNA, 22 nt, Human
cugacaaccauuaaagucagaa

SEQ ID NO: 3184525 - RNA, 17 nt, Human
cugacaauacuguaugu

SEQ ID NO: 3184526 - RNA, 15 nt, Human
cugacaacagacuuc

SEQ ID NO: 3184527 - RNA, 18 nt, Human
cugacaacagacuucuga

SEQ ID NO: 3184528 - RNA, 19 nt, Human
cugacaacagacuucugaa

SEQ ID NO: 3184529 - RNA, 21 nt, Human
cugaaggacauugcggacagc

SEQ ID NO: 3184530 - RNA, 23 nt, Human
cugaaggacauugcggacagcca

SEQ ID NO: 3184531 - RNA, 18 nt, Human
cugaaggccccgcccagg

SEQ ID NO: 3184532 - RNA, 13 nt, Human
cugaaggaggcca

SEQ ID NO: 3184533 - RNA, 19 nt, Human
cugaaggccccgcccaggc

SEQ ID NO: 3184534 - RNA, 21 nt, Human
cugaaggccccgcccaggcuu

SEQ ID NO: 3184535 - RNA, 22 nt, Human
cugacaacacucauugaccuga

SEQ ID NO: 3184536 - RNA, 23 nt, Human
cugacaacacucauugaccugag

SEQ ID NO: 3184537 - RNA, 20 nt, Human
cugaauuuuuaugugugauu

SEQ ID NO: 3184538 - RNA, 18 nt, Human
cugaauuuuuauguguga

SEQ ID NO: 3184539 - RNA, 14 nt, Human
cugacaaauuuuaa

SEQ ID NO: 3184540 - RNA, 17 nt, Human
cugacaaauuuuaauua

SEQ ID NO: 3184541 - RNA, 16 nt, Human
cugaauuuuuaugugu

SEQ ID NO: 3184542 - RNA, 11 nt, Human
cucuuuuccua

SEQ ID NO: 3184543 - RNA, 13 nt, Human
cucuuuuguuguu

SEQ ID NO: 3184544 - RNA, 17 nt, Human
cucuuuuguuguuucuu

SEQ ID NO: 3184545 - RNA, 21 nt, Human
cucuuuugcuugccaaaguac

SEQ ID NO: 3184546 - RNA, 13 nt, Human
cugaaacauuuca

SEQ ID NO: 3184547 - RNA, 15 nt, Human
cugaaacaacaaaua

SEQ ID NO: 3184548 - RNA, 20 nt, Human
cugaaaauugccuuucugug

SEQ ID NO: 3184549 - RNA, 19 nt, Human
cugaaaauugccuuucugu

SEQ ID NO: 3184550 - RNA, 15 nt, Human
cugaaaauugccuuu

SEQ ID NO: 3184551 - RNA, 16 nt, Human
cucuugagccugggag

SEQ ID NO: 3184552 - RNA, 18 nt, Human
cucugcuccucuccccag

SEQ ID NO: 3184553 - RNA, 13 nt, Human
cucugcuccucuc

SEQ ID NO: 3184554 - RNA, 21 nt, Human
cucugcacuccccugcugggu

SEQ ID NO: 3184555 - RNA, 20 nt, Human
cucugcacuccccugcuggg

SEQ ID NO: 3184556 - RNA, 18 nt, Human
cucugcacuccccugcug

SEQ ID NO: 3184557 - RNA, 12 nt, Human
cucuguccaggc

SEQ ID NO: 3184558 - RNA, 16 nt, Human
cucuggugcugcagua

SEQ ID NO: 3184559 - RNA, 22 nt, Human
cucugguacaauuucuuuuggu

SEQ ID NO: 3184560 - RNA, 20 nt, Human
cucugguacaauuucuuuug

SEQ ID NO: 3184561 - RNA, 17 nt, Human
cucugguacaauuucuu

SEQ ID NO: 3184562 - RNA, 13 nt, Human
cucugcucuugca

SEQ ID NO: 3184563 - RNA, 16 nt, Human
cucugcucccccuuuu

SEQ ID NO: 3184564 - RNA, 14 nt, Human
cucugguccauaga

SEQ ID NO: 3184565 - RNA, 16 nt, Human
cucugcugacagacac

SEQ ID NO: 3184566 - RNA, 14 nt, Human
cucugcugacagac

SEQ ID NO: 3184567 - RNA, 13 nt, Human
cucugcugacaga

SEQ ID NO: 3184568 - RNA, 13 nt, Human
cucugcucccccu

SEQ ID NO: 3184569 - RNA, 12 nt, Human
cucugcuccccc

SEQ ID NO: 3184570 - RNA, 13 nt, Human
cucuuauugccca

SEQ ID NO: 3184571 - RNA, 16 nt, Human
cucuuagcccaugcug

SEQ ID NO: 3184572 - RNA, 20 nt, Human
cucuuauugcccacgcugga

SEQ ID NO: 3184573 - RNA, 19 nt, Human
cucuuauugcccacgcugg

SEQ ID NO: 3184574 - RNA, 15 nt, Human
cucuuauugcccacg

SEQ ID NO: 3184575 - RNA, 14 nt, Human
cucuuauugcccac

SEQ ID NO: 3184576 - RNA, 14 nt, Human
cucuucaaucucuu

SEQ ID NO: 3184577 - RNA, 17 nt, Human
cucuucaacugaccagc

SEQ ID NO: 3184578 - RNA, 16 nt, Human
cucuucaacugaccag

SEQ ID NO: 3184579 - RNA, 20 nt, Human
cucuucaacugaccagccuc

SEQ ID NO: 3184580 - RNA, 13 nt, Human
cucuucagcacaa

SEQ ID NO: 3184581 - RNA, 23 nt, Human
cucguguuauuuuaaucucagaa

SEQ ID NO: 3184582 - RNA, 20 nt, Human
cucucacagacaggaccccu

SEQ ID NO: 3184583 - RNA, 18 nt, Human
cucucacagacaggaccc

SEQ ID NO: 3184584 - RNA, 22 nt, Human
cucucaauuuuugguugaauaa

SEQ ID NO: 3184585 - RNA, 17 nt, Human
cucucacagacaggacc

SEQ ID NO: 3184586 - RNA, 14 nt, Human
cucucacagacagg

SEQ ID NO: 3184587 - RNA, 19 nt, Human
cucucaauuuuugguugaa

SEQ ID NO: 3184588 - RNA, 14 nt, Human
cucucaauuuuugg

SEQ ID NO: 3184589 - RNA, 13 nt, Human
cucucaauuuuug

SEQ ID NO: 3184590 - RNA, 19 nt, Human
cucucaaugcuguuugggu

SEQ ID NO: 3184591 - RNA, 23 nt, Human
cucucaccuugguuccuggggca

SEQ ID NO: 3184592 - RNA, 18 nt, Human
cucucaccuugguuccug

SEQ ID NO: 3184593 - RNA, 19 nt, Human
cucucaggaaaugcugacc

SEQ ID NO: 3184594 - RNA, 21 nt, Human
cucucaggaaaugcugaccca

SEQ ID NO: 3184595 - RNA, 20 nt, Human
cucucaggaaaugcugaccc

SEQ ID NO: 3184596 - RNA, 16 nt, Human
cucuauccugggcuuu

SEQ ID NO: 3184597 - RNA, 15 nt, Human
cucuauccugggcuu

SEQ ID NO: 3184598 - RNA, 15 nt, Human
cucuaucaccaagga

SEQ ID NO: 3184599 - RNA, 19 nt, Human
cucuaaaauauuuaugaag

SEQ ID NO: 3184600 - RNA, 11 nt, Human
cucuaaaauau

SEQ ID NO: 3184601 - RNA, 21 nt, Human
cucuaaaauauuuaugaagaa

SEQ ID NO: 3184602 - RNA, 14 nt, Human
cucgaacuggcugc

SEQ ID NO: 3184603 - RNA, 13 nt, Human
cucgaacuggcug

SEQ ID NO: 3184604 - RNA, 15 nt, Human
cucgaacuggcugca

SEQ ID NO: 3184605 - RNA, 22 nt, Human
cuccuggggguucuuucuuccu

SEQ ID NO: 3184606 - RNA, 20 nt, Human
cuccuggggguucuuucuuc

SEQ ID NO: 3184607 - RNA, 18 nt, Human
cuccuggggguucuuucu

SEQ ID NO: 3184608 - RNA, 14 nt, Human
cuccuggggguucu

SEQ ID NO: 3184609 - RNA, 23 nt, Human
cuccuggggguucuuucuuccuc

SEQ ID NO: 3184610 - RNA, 17 nt, Human
cucgaacuccugaccuu

SEQ ID NO: 3184611 - RNA, 12 nt, Human
cuccuacagccc

SEQ ID NO: 3184612 - RNA, 21 nt, Human
cuccucuccugacaauacugu

SEQ ID NO: 3184613 - RNA, 19 nt, Human
cuccuaaaaggcccagaga

SEQ ID NO: 3184614 - RNA, 18 nt, Human
cuccuaaaaggcccagag

SEQ ID NO: 3184615 - RNA, 17 nt, Human
cuccuaaaaggcccaga

SEQ ID NO: 3184616 - RNA, 13 nt, Human
cuccucucugccc

SEQ ID NO: 3184617 - RNA, 14 nt, Human
cuccucucugcccu

SEQ ID NO: 3184618 - RNA, 15 nt, Human
cuccucucugcccua

SEQ ID NO: 3184619 - RNA, 18 nt, Human
cuccucugcugcuggcug

SEQ ID NO: 3184620 - RNA, 15 nt, Human
cuccucugcugcugg

SEQ ID NO: 3184621 - RNA, 19 nt, Human
cuccucucugcccuaaugc

SEQ ID NO: 3184622 - RNA, 16 nt, Human
cuccucugcugcuggc

SEQ ID NO: 3184623 - RNA, 16 nt, Human
cuccuaaaaggcccag

SEQ ID NO: 3184624 - RNA, 23 nt, Human
cuccucuucaacugaccagccuc

SEQ ID NO: 3184625 - RNA, 18 nt, Human
cuccucuucaacugacca

SEQ ID NO: 3184626 - RNA, 12 nt, Human
cuccuggacucc

SEQ ID NO: 3184627 - RNA, 15 nt, Human
cuccuggacuccugc

SEQ ID NO: 3184628 - RNA, 16 nt, Human
cuccuggcccacugca

SEQ ID NO: 3184629 - RNA, 18 nt, Human
cuccuggcccacugcauc

SEQ ID NO: 3184630 - RNA, 15 nt, Human
cucccccagccccau

SEQ ID NO: 3184631 - RNA, 20 nt, Human
cucccccagccccauccucu

SEQ ID NO: 3184632 - RNA, 13 nt, Human
cucccccagccac

SEQ ID NO: 3184633 - RNA, 22 nt, Human
cucccccagccccauccucugu

SEQ ID NO: 3184634 - RNA, 16 nt, Human
cucccccagccacucc

SEQ ID NO: 3184635 - RNA, 14 nt, Human
cucccccagccacu

SEQ ID NO: 3184636 - RNA, 12 nt, Human
cucccccauccu

SEQ ID NO: 3184637 - RNA, 13 nt, Human
cucccccauccua

SEQ ID NO: 3184638 - RNA, 13 nt, Human
cucccccaucucu

SEQ ID NO: 3184639 - RNA, 12 nt, Human
cucaugccucag

SEQ ID NO: 3184640 - RNA, 18 nt, Human
cuccaacuccaacaucca

SEQ ID NO: 3184641 - RNA, 12 nt, Human
cuccaacuccaa

SEQ ID NO: 3184642 - RNA, 14 nt, Human
cucaugugauuuac

SEQ ID NO: 3184643 - RNA, 13 nt, Human
cuccaagcaggac

SEQ ID NO: 3184644 - RNA, 14 nt, Human
cuccaagcaggaca

SEQ ID NO: 3184645 - RNA, 22 nt, Human
cuccaagcaggacauggacaag

SEQ ID NO: 3184646 - RNA, 24 nt, Human
cuccaagcaggacauggacaagga

SEQ ID NO: 3184647 - RNA, 22 nt, Human
cuccaagaccuucuccuucacc

SEQ ID NO: 3184648 - RNA, 21 nt, Human
cuccaagaccuucuccuucac

SEQ ID NO: 3184649 - RNA, 23 nt, Human
cuccaagcccaguucagcuuggg

SEQ ID NO: 3184650 - RNA, 16 nt, Human
cuccaagccagcaagc

SEQ ID NO: 3184651 - RNA, 15 nt, Human
cuccaagccagcaag

SEQ ID NO: 3184652 - RNA, 13 nt, Human
cuccaagccagca

SEQ ID NO: 3184653 - RNA, 19 nt, Human
cuccaagcuccaucuccac

SEQ ID NO: 3184654 - RNA, 18 nt, Human
cuccaagcuccaucucca

SEQ ID NO: 3184655 - RNA, 14 nt, Human
cuccaagcuccauc

SEQ ID NO: 3184656 - RNA, 13 nt, Human
cuccaagcuccca

SEQ ID NO: 3184657 - RNA, 14 nt, Human
cuccaagcucccag

SEQ ID NO: 3184658 - RNA, 15 nt, Human
cuccaagcucccagg

SEQ ID NO: 3184659 - RNA, 16 nt, Human
cuccaagcucccaggc

SEQ ID NO: 3184660 - RNA, 13 nt, Human
cuccacuuggucu

SEQ ID NO: 3184661 - RNA, 15 nt, Human
cuccacuuggucugu

SEQ ID NO: 3184662 - RNA, 16 nt, Human
cuccacuggauggagg

SEQ ID NO: 3184663 - RNA, 16 nt, Human
cuccacuuggucugug

SEQ ID NO: 3184664 - RNA, 17 nt, Human
cuccacuuggucuguga

SEQ ID NO: 3184665 - RNA, 21 nt, Human
cuccacuuggucugugagaug

SEQ ID NO: 3184666 - RNA, 22 nt, Human
cuccacuuggucugugagaugc

SEQ ID NO: 3184667 - RNA, 13 nt, Human
cucagucucccuc

SEQ ID NO: 3184668 - RNA, 22 nt, Human
cucagguugucugaagucacug

SEQ ID NO: 3184669 - RNA, 15 nt, Human
cucagguuuguuuug

SEQ ID NO: 3184670 - RNA, 15 nt, Human
cucagucucccuccc

SEQ ID NO: 3184671 - RNA, 16 nt, Human
cucagucucccucccu

SEQ ID NO: 3184672 - RNA, 17 nt, Human
cucagucucccucccuu

SEQ ID NO: 3184673 - RNA, 14 nt, Human
cucagucucacauu

SEQ ID NO: 3184674 - RNA, 21 nt, Human
cucaucuggaguucucaaaga

SEQ ID NO: 3184675 - RNA, 17 nt, Human
cucaucuggaguucuca

SEQ ID NO: 3184676 - RNA, 23 nt, Human
cuccacuuggucugugagaugcu

SEQ ID NO: 3184677 - RNA, 16 nt, Human
cuccacuuucuagcca

SEQ ID NO: 3184678 - RNA, 19 nt, Human
cuccacuuucuagccagag

SEQ ID NO: 3184679 - RNA, 15 nt, Human
cucccaccuuuaauc

SEQ ID NO: 3184680 - RNA, 21 nt, Human
cuccagggcucaacacuguga

SEQ ID NO: 3184681 - RNA, 10 nt, Human
cuccagggcu

SEQ ID NO: 3184682 - RNA, 21 nt, Human
cuaauucuuugaccuguuggg

SEQ ID NO: 3184683 - RNA, 22 nt, Human
cuaauucuuugaccuguuggga

SEQ ID NO: 3184684 - RNA, 15 nt, Human
cuaauucuaugccug

SEQ ID NO: 3184685 - RNA, 14 nt, Human
cuaauucuuugcaa

SEQ ID NO: 3184686 - RNA, 12 nt, Human
cuaauucuuugc

SEQ ID NO: 3184687 - RNA, 18 nt, Human
cuaauucuuugcaaaaau

SEQ ID NO: 3184688 - RNA, 17 nt, Human
cuaauucuuugcaaaaa

SEQ ID NO: 3184689 - RNA, 16 nt, Human
cuaauucuuugcaaaa

SEQ ID NO: 3184690 - RNA, 15 nt, Human
cuaauucuuugcaaa

SEQ ID NO: 3184691 - RNA, 23 nt, Human
cuaaguaaaaccacagcaguuga

SEQ ID NO: 3184692 - RNA, 22 nt, Human
cuaaguaaaaccacagcaguug

SEQ ID NO: 3184693 - RNA, 23 nt, Human
cuaagugauccucccaccucagc

SEQ ID NO: 3184694 - RNA, 17 nt, Human
cuaaguaaaucucuucu

SEQ ID NO: 3184695 - RNA, 17 nt, Human
cuaagugcuaagugcuu

SEQ ID NO: 3184696 - RNA, 17 nt, Human
cuaagugcuuauuacau

SEQ ID NO: 3184697 - RNA, 21 nt, Human
cuaagugcuuauuacauuuua

SEQ ID NO: 3184698 - RNA, 21 nt, Human
cuaagugguacuaacuuuccu

SEQ ID NO: 3184699 - RNA, 19 nt, Human
cguguguagauaguaugca

SEQ ID NO: 3184700 - RNA, 11 nt, Human
cgugugugugu

SEQ ID NO: 3184701 - RNA, 20 nt, Human
cuaaguaaaaccacagcagu

SEQ ID NO: 3184702 - RNA, 18 nt, Human
cuacauacuauggaauuu

SEQ ID NO: 3184703 - RNA, 18 nt, Human
cuacauacaauuccaaac

SEQ ID NO: 3184704 - RNA, 22 nt, Human
cuacaguugaaaaacagcugag

SEQ ID NO: 3184705 - RNA, 19 nt, Human
cuacaguugaaaaacagcu

SEQ ID NO: 3184706 - RNA, 21 nt, Human
cuacaguugaaaaacagcuga

SEQ ID NO: 3184707 - RNA, 20 nt, Human
cuacaguccucccaucucac

SEQ ID NO: 3184708 - RNA, 18 nt, Human
cuacaguccucccaucuc

SEQ ID NO: 3184709 - RNA, 15 nt, Human
cuacaaaaacacagc

SEQ ID NO: 3184710 - RNA, 17 nt, Human
cuacaaaaacacagcaa

SEQ ID NO: 3184711 - RNA, 16 nt, Human
cuacaaaaacacagca

SEQ ID NO: 3184712 - RNA, 18 nt, Human
cuacaaaaacacagcaag

SEQ ID NO: 3184713 - RNA, 19 nt, Human
cuacaguccucccaucuca

SEQ ID NO: 3184714 - RNA, 20 nt, Human
cuacaugagguacugagagu

SEQ ID NO: 3184715 - RNA, 18 nt, Human
cuacaugagguacugaga

SEQ ID NO: 3184716 - RNA, 14 nt, Human
cuacauauugaaua

SEQ ID NO: 3184717 - RNA, 12 nt, Human
cuacauauugaa

SEQ ID NO: 3184718 - RNA, 23 nt, Human
cuacgaguaauugcauuugcuuu

SEQ ID NO: 3184719 - RNA, 21 nt, Human
cuacguuuacucacagccagc

SEQ ID NO: 3184720 - RNA, 17 nt, Human
cuacguuaccaggcagg

SEQ ID NO: 3184721 - RNA, 12 nt, Human
cuagaacucccu

SEQ ID NO: 3184722 - RNA, 22 nt, Human
cuagaagauuuugaaauuuuua

SEQ ID NO: 3184723 - RNA, 22 nt, Human
cuagaaguaacuggugauauau

SEQ ID NO: 3184724 - RNA, 14 nt, Human
cuagacacacaaag

SEQ ID NO: 3184725 - RNA, 13 nt, Human
cuagacacacaaa

SEQ ID NO: 3184726 - RNA, 15 nt, Human
cuagcauauaugugu

SEQ ID NO: 3184727 - RNA, 17 nt, Human
cuagacacacaaagcag

SEQ ID NO: 3184728 - RNA, 12 nt, Human
cuagacacacaa

SEQ ID NO: 3184729 - RNA, 16 nt, Human
cuagaauuuuaagccu

SEQ ID NO: 3184730 - RNA, 15 nt, Human
cuagaauuuuaagcc

SEQ ID NO: 3184731 - RNA, 14 nt, Human
cuagaauuuuaagc

SEQ ID NO: 3184732 - RNA, 12 nt, Human
cuagaauuuuaa

SEQ ID NO: 3184733 - RNA, 14 nt, Human
cuaucuaaauguug

SEQ ID NO: 3184734 - RNA, 15 nt, Human
cuaucucccccagcc

SEQ ID NO: 3184735 - RNA, 14 nt, Human
cuaucucccccagc

SEQ ID NO: 3184736 - RNA, 18 nt, Human
cuaucaugucaaacguga

SEQ ID NO: 3184737 - RNA, 19 nt, Human
cuagccaccgccuccuaca

SEQ ID NO: 3184738 - RNA, 12 nt, Human
cuagccagagga

SEQ ID NO: 3184739 - RNA, 13 nt, Human
cuagccagaggag

SEQ ID NO: 3184740 - RNA, 15 nt, Human
cuagccagaggagag

SEQ ID NO: 3184741 - RNA, 22 nt, Human
cuaguuguuugauucagacagc

SEQ ID NO: 3184742 - RNA, 23 nt, Human
cuaguuguuugauucagacagcu

SEQ ID NO: 3184743 - RNA, 17 nt, Human
cucaaaacugcacuguc

SEQ ID NO: 3184744 - RNA, 13 nt, Human
cuauuuuuuuaga

SEQ ID NO: 3184745 - RNA, 17 nt, Human
cuauuuuuuuagauuga

SEQ ID NO: 3184746 - RNA, 22 nt, Human
cuauuuuuuuagauugagaaau

SEQ ID NO: 3184747 - RNA, 23 nt, Human
cucaaaauaccaugccauuuaaa

SEQ ID NO: 3184748 - RNA, 18 nt, Human
cucaaaagcugggcaggu

SEQ ID NO: 3184749 - RNA, 13 nt, Human
cucaaaauuagau

SEQ ID NO: 3184750 - RNA, 11 nt, Human
cucaaaauuau

SEQ ID NO: 3184751 - RNA, 16 nt, Human
cuaucucccccagccc

SEQ ID NO: 3184752 - RNA, 17 nt, Human
cuaucucccccagcccc

SEQ ID NO: 3184753 - RNA, 19 nt, Human
cuauuaacaauuaauuguc

SEQ ID NO: 3184754 - RNA, 20 nt, Human
cuauuaacaauuaauugucu

SEQ ID NO: 3184755 - RNA, 21 nt, Human
cuauuaacaauuaauugucuu

SEQ ID NO: 3184756 - RNA, 15 nt, Human
cucaaugcacugaca

SEQ ID NO: 3184757 - RNA, 13 nt, Human
cucaaugcacuga

SEQ ID NO: 3184758 - RNA, 14 nt, Human
cucaaugcuguuug

SEQ ID NO: 3184759 - RNA, 12 nt, Human
cucaauuucaau

SEQ ID NO: 3184760 - RNA, 17 nt, Human
cucaaugcuguuugggu

SEQ ID NO: 3184761 - RNA, 14 nt, Human
cucaauuucucuau

SEQ ID NO: 3184762 - RNA, 11 nt, Human
cucacaaaaga

SEQ ID NO: 3184763 - RNA, 21 nt, Human
cucaauuuuugguugaauaaa

SEQ ID NO: 3184764 - RNA, 12 nt, Human
cucaauuuuugg

SEQ ID NO: 3184765 - RNA, 20 nt, Human
cucaaacucuugaccucagg

SEQ ID NO: 3184766 - RNA, 17 nt, Human
cucaaacuccauucucc

SEQ ID NO: 3184767 - RNA, 12 nt, Human
cucaaaccccug

SEQ ID NO: 3184768 - RNA, 16 nt, Human
cucaaaccccugaccu

SEQ ID NO: 3184769 - RNA, 14 nt, Human
cucaauaaaguaca

SEQ ID NO: 3184770 - RNA, 17 nt, Human
cguaaaaacugaaguuc

SEQ ID NO: 3184771 - RNA, 16 nt, Human
cgguuuuacugcagcu

SEQ ID NO: 3184772 - RNA, 16 nt, Human
cguaaaaacugaaguu

SEQ ID NO: 3184773 - RNA, 19 nt, Human
cgguuaacaaauaacaacu

SEQ ID NO: 3184774 - RNA, 14 nt, Human
cgguuaacaaauaa

SEQ ID NO: 3184775 - RNA, 23 nt, Human
cgguguuuaagacauuuuuggaa

SEQ ID NO: 3184776 - RNA, 22 nt, Human
cgguuuaucgcccuggcaggca

SEQ ID NO: 3184777 - RNA, 20 nt, Human
cgguuuaucgcccuggcagg

SEQ ID NO: 3184778 - RNA, 21 nt, Human
cgugguugggaacacagcauu

SEQ ID NO: 3184779 - RNA, 20 nt, Human
cguguaaccauggacccaau

SEQ ID NO: 3184780 - RNA, 14 nt, Human
cgugugcuguguuu

SEQ ID NO: 3184781 - RNA, 12 nt, Human
cgugugcugugu

SEQ ID NO: 3184782 - RNA, 17 nt, Human
cgugaggccagagacac

SEQ ID NO: 3184783 - RNA, 16 nt, Human
cgugaguccuggcaug

SEQ ID NO: 3184784 - RNA, 17 nt, Human
cgugaguccuggcaugg

SEQ ID NO: 3184785 - RNA, 16 nt, Human
cgugaggccagagaca

SEQ ID NO: 3184786 - RNA, 15 nt, Human
cgugaggcccguggg

SEQ ID NO: 3184787 - RNA, 23 nt, Human
cgccuggugaugcgcaguugcug

SEQ ID NO: 3184788 - RNA, 13 nt, Human
cgcugauguucac

SEQ ID NO: 3184789 - RNA, 16 nt, Human
cggagucccaccuugg

SEQ ID NO: 3184790 - RNA, 15 nt, Human
cggaggaccagggcu

SEQ ID NO: 3184791 - RNA, 13 nt, Human
cggaggaccaggg

SEQ ID NO: 3184792 - RNA, 11 nt, Human
cgggcucagca

SEQ ID NO: 3184793 - RNA, 14 nt, Human
cgggcucugccucc

SEQ ID NO: 3184794 - RNA, 16 nt, Human
cgggcucugccuccca

SEQ ID NO: 3184795 - RNA, 15 nt, Human
cgggcucagcaaaag

SEQ ID NO: 3184796 - RNA, 13 nt, Human
cgggcucugccuc

SEQ ID NO: 3184797 - RNA, 17 nt, Human
cgggcucugccucccau

SEQ ID NO: 3184798 - RNA, 14 nt, Human
cggggacagcuccu

SEQ ID NO: 3184799 - RNA, 18 nt, Human
cgguguggagaagcggcu

SEQ ID NO: 3184800 - RNA, 23 nt, Human
cggugugggggccccgucucagg

SEQ ID NO: 3184801 - RNA, 20 nt, Human
cggugugggggccccgucuc

SEQ ID NO: 3184802 - RNA, 13 nt, Human
cggugugggggcc

SEQ ID NO: 3184803 - RNA, 13 nt, Human
cgguguggagaag

SEQ ID NO: 3184804 - RNA, 15 nt, Human
cggggacagcuccuu

SEQ ID NO: 3184805 - RNA, 14 nt, Human
cggcucacugcagc

SEQ ID NO: 3184806 - RNA, 15 nt, Human
cggcucacugcagcc

SEQ ID NO: 3184807 - RNA, 20 nt, Human
cggagucccaccuuggcugc

SEQ ID NO: 3184808 - RNA, 18 nt, Human
cggagucccaccuuggcu

SEQ ID NO: 3184809 - RNA, 16 nt, Human
cggcucacugcagccu

SEQ ID NO: 3184810 - RNA, 21 nt, Human
cggcucacugcauccuccgcc

SEQ ID NO: 3184811 - RNA, 14 nt, Human
cggagucccaccuu

SEQ ID NO: 3184812 - RNA, 12 nt, Human
cggcuccaggcu

SEQ ID NO: 3184813 - RNA, 16 nt, Human
cggcuccaggcuccuu

SEQ ID NO: 3184814 - RNA, 15 nt, Human
cggcuccaggcuccu

SEQ ID NO: 3184815 - RNA, 14 nt, Human
cggcuccaggcucc

SEQ ID NO: 3184816 - RNA, 13 nt, Human
cggcuccaggcuc

SEQ ID NO: 3184817 - RNA, 14 nt, Human
cgggccacagagaa

SEQ ID NO: 3184818 - RNA, 12 nt, Human
cgggccacagag

SEQ ID NO: 3184819 - RNA, 19 nt, Human
cggcuccaguccccagaac

SEQ ID NO: 3184820 - RNA, 20 nt, Human
cggcuccaguccccagaacu

SEQ ID NO: 3184821 - RNA, 18 nt, Human
cgacagagcaguugagag

SEQ ID NO: 3184822 - RNA, 11 nt, Human
cgacagagcag

SEQ ID NO: 3184823 - RNA, 13 nt, Human
cgacagccuggca

SEQ ID NO: 3184824 - RNA, 12 nt, Human
cgacagccuggc

SEQ ID NO: 3184825 - RNA, 14 nt, Human
cgacagccuggcac

SEQ ID NO: 3184826 - RNA, 12 nt, Human
cgacaaugcaaa

SEQ ID NO: 3184827 - RNA, 15 nt, Human
cgacaaaucugucug

SEQ ID NO: 3184828 - RNA, 14 nt, Human
cgacaaaucugucu

SEQ ID NO: 3184829 - RNA, 20 nt, Human
cgacaacagauuggauuuua

SEQ ID NO: 3184830 - RNA, 17 nt, Human
cgacaacagauuggauu

SEQ ID NO: 3184831 - RNA, 16 nt, Human
cgacaaaucugucugc

SEQ ID NO: 3184832 - RNA, 13 nt, Human
cgacaaugcaaac

SEQ ID NO: 3184833 - RNA, 16 nt, Human
cgacaagcacagucag

SEQ ID NO: 3184834 - RNA, 18 nt, Human
cgacacggucucggauca

SEQ ID NO: 3184835 - RNA, 16 nt, Human
cgaauuuuaaaagaug

SEQ ID NO: 3184836 - RNA, 13 nt, Human
ccuuuuuauuuau

SEQ ID NO: 3184837 - RNA, 12 nt, Human
ccuuuuuauuua

SEQ ID NO: 3184838 - RNA, 16 nt, Human
ccuuuuuauuuauaug

SEQ ID NO: 3184839 - RNA, 18 nt, Human
ccuuuuuauuuauaugua

SEQ ID NO: 3184840 - RNA, 20 nt, Human
ccuuuuuauuuauauguaug

SEQ ID NO: 3184841 - RNA, 22 nt, Human
ccuuuuuauuuauauguaugug

SEQ ID NO: 3184842 - RNA, 13 nt, Human
ccuuuuugcuuga

SEQ ID NO: 3184843 - RNA, 19 nt, Human
cgacccuugccgucuaccu

SEQ ID NO: 3184844 - RNA, 20 nt, Human
cgacccuugccgucuaccug

SEQ ID NO: 3184845 - RNA, 20 nt, Human
cgacuagacacacaaagcag

SEQ ID NO: 3184846 - RNA, 15 nt, Human
cgacuagacacacaa

SEQ ID NO: 3184847 - RNA, 17 nt, Human
cgacuagacacacaaag

SEQ ID NO: 3184848 - RNA, 16 nt, Human
cgacuagacacacaaa

SEQ ID NO: 3184849 - RNA, 17 nt, Human
cgacugcccggcagggu

SEQ ID NO: 3184850 - RNA, 15 nt, Human
ccuuucauuuugcuu

SEQ ID NO: 3184851 - RNA, 19 nt, Human
ccuuucauuugcuaucucu

SEQ ID NO: 3184852 - RNA, 17 nt, Human
ccuuucagcaggcagcc

SEQ ID NO: 3184853 - RNA, 15 nt, Human
ccuuuugagugccuu

SEQ ID NO: 3184854 - RNA, 17 nt, Human
ccuuuugagugccuuac

SEQ ID NO: 3184855 - RNA, 21 nt, Human
ccuuucaauaggaaaaacuga

SEQ ID NO: 3184856 - RNA, 18 nt, Human
ccuuuacuugucuuucug

SEQ ID NO: 3184857 - RNA, 17 nt, Human
ccuuuacuugucuuucu

SEQ ID NO: 3184858 - RNA, 18 nt, Human
ccuuucaauaggaaaaac

SEQ ID NO: 3184859 - RNA, 15 nt, Human
ccuuucacaaccuuc

SEQ ID NO: 3184860 - RNA, 22 nt, Human
ccuuucacuucuuucccuuccu

SEQ ID NO: 3184861 - RNA, 18 nt, Human
ccuuucacuucuuucccu

SEQ ID NO: 3184862 - RNA, 17 nt, Human
ccuuucacuucuuuccc

SEQ ID NO: 3184863 - RNA, 15 nt, Human
ccuuucacuucuuuc

SEQ ID NO: 3184864 - RNA, 16 nt, Human
ccuuucagcaggcagc

SEQ ID NO: 3184865 - RNA, 20 nt, Human
ccuugccccaacccuucuuc

SEQ ID NO: 3184866 - RNA, 14 nt, Human
ccuuuaagagaaau

SEQ ID NO: 3184867 - RNA, 19 nt, Human
ccuuuaaucagguccugcu

SEQ ID NO: 3184868 - RNA, 21 nt, Human
ccuuuaaucagguccugcuca

SEQ ID NO: 3184869 - RNA, 20 nt, Human
ccuuuaaucagguccugcuc

SEQ ID NO: 3184870 - RNA, 16 nt, Human
ccuugccgucuaccug

SEQ ID NO: 3184871 - RNA, 14 nt, Human
cgccuacaggagug

SEQ ID NO: 3184872 - RNA, 21 nt, Human
cgccuccaaccccucgcccag

SEQ ID NO: 3184873 - RNA, 19 nt, Human
cgccuccaaccccucgccc

SEQ ID NO: 3184874 - RNA, 13 nt, Human
cgccucugcauuc

SEQ ID NO: 3184875 - RNA, 22 nt, Human
cgccuccaaccccucgcccagu

SEQ ID NO: 3184876 - RNA, 18 nt, Human
cgcaggcccccaggugcc

SEQ ID NO: 3184877 - RNA, 22 nt, Human
cgcaggauucuuccucccuccc

SEQ ID NO: 3184878 - RNA, 13 nt, Human
cgcaggcuggccc

SEQ ID NO: 3184879 - RNA, 19 nt, Human
cgcaggccucccugccagu

SEQ ID NO: 3184880 - RNA, 18 nt, Human
cgcaggccucccugccag

SEQ ID NO: 3184881 - RNA, 16 nt, Human
cgcaggccucccugcc

SEQ ID NO: 3184882 - RNA, 14 nt, Human
cgauagugguggug

SEQ ID NO: 3184883 - RNA, 16 nt, Human
cgauaguuuacugaga

SEQ ID NO: 3184884 - RNA, 14 nt, Human
cgaucacaaaugac

SEQ ID NO: 3184885 - RNA, 15 nt, Human
cgaucacaaaugacu

SEQ ID NO: 3184886 - RNA, 17 nt, Human
cgaucacaaaugacuuu

SEQ ID NO: 3184887 - RNA, 18 nt, Human
cgaucacaaaugacuuua

SEQ ID NO: 3184888 - RNA, 19 nt, Human
cgaucacaaaugacuuuau

SEQ ID NO: 3184889 - RNA, 21 nt, Human
cgaucacaaaugacuuuauua

SEQ ID NO: 3184890 - RNA, 16 nt, Human
cgaguagcugggacua

SEQ ID NO: 3184891 - RNA, 17 nt, Human
cgagucauccagaaugu

SEQ ID NO: 3184892 - RNA, 22 nt, Human
ccagggggccagucccugaggc

SEQ ID NO: 3184893 - RNA, 12 nt, Human
ccagucaccccg

SEQ ID NO: 3184894 - RNA, 20 nt, Human
ccagucaccccggccaccug

SEQ ID NO: 3184895 - RNA, 21 nt, Human
ccagucaccccggccaccugc

SEQ ID NO: 3184896 - RNA, 19 nt, Human
ccagucaccccggccaccu

SEQ ID NO: 3184897 - RNA, 14 nt, Human
ccaguauuuuuaaa

SEQ ID NO: 3184898 - RNA, 14 nt, Human
ccagucccagcagc

SEQ ID NO: 3184899 - RNA, 13 nt, Human
ccagucccagcag

SEQ ID NO: 3184900 - RNA, 20 nt, Human
ccagucccagcagccagcca

SEQ ID NO: 3184901 - RNA, 18 nt, Human
ccagucccagcagccagc

SEQ ID NO: 3184902 - RNA, 17 nt, Human
ccagucccagcagccag

SEQ ID NO: 3184903 - RNA, 15 nt, Human
ccagucccagcagcc

SEQ ID NO: 3184904 - RNA, 21 nt, Human
ccaguccccagaacucugccu

SEQ ID NO: 3184905 - RNA, 16 nt, Human
ccaguccccagaacuc

SEQ ID NO: 3184906 - RNA, 15 nt, Human
ccaguccccagaacu

SEQ ID NO: 3184907 - RNA, 19 nt, Human
ccaggcuggcgugcagugg

SEQ ID NO: 3184908 - RNA, 22 nt, Human
ccaggcugggagagccuuccag

SEQ ID NO: 3184909 - RNA, 23 nt, Human
ccaggggccuuugggugcuguuu

SEQ ID NO: 3184910 - RNA, 16 nt, Human
ccaggggccuuugggu

SEQ ID NO: 3184911 - RNA, 15 nt, Human
ccaggcugggagagc

SEQ ID NO: 3184912 - RNA, 17 nt, Human
ccaggcugggagagccu

SEQ ID NO: 3184913 - RNA, 18 nt, Human
ccaggcugggagagccuu

SEQ ID NO: 3184914 - RNA, 21 nt, Human
ccaggcugggagagccuucca

SEQ ID NO: 3184915 - RNA, 13 nt, Human
ccaggcugggaga

SEQ ID NO: 3184916 - RNA, 14 nt, Human
ccaggcugggagag

SEQ ID NO: 3184917 - RNA, 17 nt, Human
ccaggcaacuugggaac

SEQ ID NO: 3184918 - RNA, 16 nt, Human
ccaggcaaauaaaauu

SEQ ID NO: 3184919 - RNA, 18 nt, Human
ccaggcaaauaaaauucc

SEQ ID NO: 3184920 - RNA, 19 nt, Human
ccaggcaaauaaaauuccc

SEQ ID NO: 3184921 - RNA, 22 nt, Human
ccaggauguacaaggacagccc

SEQ ID NO: 3184922 - RNA, 23 nt, Human
ccaggagucccacuccaagccag

SEQ ID NO: 3184923 - RNA, 19 nt, Human
ccaggagucccacuccaag

SEQ ID NO: 3184924 - RNA, 17 nt, Human
ccaggagggagcagagg

SEQ ID NO: 3184925 - RNA, 21 nt, Human
ccagccccuggaugcagccuc

SEQ ID NO: 3184926 - RNA, 10 nt, Human
ccagccccuu

SEQ ID NO: 3184927 - RNA, 19 nt, Human
ccagcagccuggacccugu

SEQ ID NO: 3184928 - RNA, 18 nt, Human
ccagccccuggaugcagc

SEQ ID NO: 3184929 - RNA, 15 nt, Human
ccagcagccuggacc

SEQ ID NO: 3184930 - RNA, 14 nt, Human
ccagcagccuggac

SEQ ID NO: 3184931 - RNA, 22 nt, Human
ccaggaaaggcuccaggagcag

SEQ ID NO: 3184932 - RNA, 23 nt, Human
ccaggaaaggcuccaggagcagc

SEQ ID NO: 3184933 - RNA, 21 nt, Human
ccaggaaaggcuccaggagca

SEQ ID NO: 3184934 - RNA, 18 nt, Human
ccagcuugaaaccuucac

SEQ ID NO: 3184935 - RNA, 20 nt, Human
ccaggaaaggcuccaggagc

SEQ ID NO: 3184936 - RNA, 16 nt, Human
ccagcuuaucucaggg

SEQ ID NO: 3184937 - RNA, 19 nt, Human
ccagcuucacuucugacuc

SEQ ID NO: 3184938 - RNA, 16 nt, Human
ccagcuucacuucuga

SEQ ID NO: 3184939 - RNA, 15 nt, Human
ccagcuucacuucug

SEQ ID NO: 3184940 - RNA, 14 nt, Human
ccagcuucacuucu

SEQ ID NO: 3184941 - RNA, 15 nt, Human
ccagcuuccagcagg

SEQ ID NO: 3184942 - RNA, 14 nt, Human
ccagcuuccagcag

SEQ ID NO: 3184943 - RNA, 20 nt, Human
ccagcuucacuucugacucu

SEQ ID NO: 3184944 - RNA, 13 nt, Human
ccagcuuccagca

SEQ ID NO: 3184945 - RNA, 17 nt, Human
ccagcuuccagcaggag

SEQ ID NO: 3184946 - RNA, 16 nt, Human
ccagcuuccagcagga

SEQ ID NO: 3184947 - RNA, 23 nt, Human
ccagcagagcaccuuagacaguc

SEQ ID NO: 3184948 - RNA, 19 nt, Human
ccagcagagcaccuuagac

SEQ ID NO: 3184949 - RNA, 22 nt, Human
ccacucucucuuguucuuacuu

SEQ ID NO: 3184950 - RNA, 21 nt, Human
ccacucucucuuguucuuacu

SEQ ID NO: 3184951 - RNA, 22 nt, Human
ccauuuaaagcuuauuaaaacu

SEQ ID NO: 3184952 - RNA, 23 nt, Human
ccauuuacugcauucuucugauc

SEQ ID NO: 3184953 - RNA, 16 nt, Human
ccauuuacugcauucu

SEQ ID NO: 3184954 - RNA, 20 nt, Human
ccauuuaauggggaggacaa

SEQ ID NO: 3184955 - RNA, 13 nt, Human
ccauuuaaagcuu

SEQ ID NO: 3184956 - RNA, 22 nt, Human
ccauugagaccgugaagauacu

SEQ ID NO: 3184957 - RNA, 22 nt, Human
ccauuuagaauggugauuuuaa

SEQ ID NO: 3184958 - RNA, 13 nt, Human
ccauuuagaaugg

SEQ ID NO: 3184959 - RNA, 16 nt, Human
ccauuuccccagggca

SEQ ID NO: 3184960 - RNA, 15 nt, Human
ccauuuccccagggc

SEQ ID NO: 3184961 - RNA, 13 nt, Human
ccauuuccuuaug

SEQ ID NO: 3184962 - RNA, 17 nt, Human
ccauuuccccagggcac

SEQ ID NO: 3184963 - RNA, 17 nt, Human
ccauuuccuuaugcugu

SEQ ID NO: 3184964 - RNA, 15 nt, Human
ccauugaacucugag

SEQ ID NO: 3184965 - RNA, 15 nt, Human
ccaugggccuccugu

SEQ ID NO: 3184966 - RNA, 14 nt, Human
ccaugggccuccug

SEQ ID NO: 3184967 - RNA, 14 nt, Human
ccaugggcaggaga

SEQ ID NO: 3184968 - RNA, 13 nt, Human
ccaugggcaggag

SEQ ID NO: 3184969 - RNA, 20 nt, Human
ccaucccaaacccuucagug

SEQ ID NO: 3184970 - RNA, 20 nt, Human
ccauacacacgcugccuucg

SEQ ID NO: 3184971 - RNA, 18 nt, Human
ccauacacacgcugccuu

SEQ ID NO: 3184972 - RNA, 14 nt, Human
ccauacacacgcug

SEQ ID NO: 3184973 - RNA, 12 nt, Human
ccauacacacgc

SEQ ID NO: 3184974 - RNA, 19 nt, Human
ccauaagcaacaauuuuca

SEQ ID NO: 3184975 - RNA, 20 nt, Human
ccauaauuuuuuuuuuccuu

SEQ ID NO: 3184976 - RNA, 12 nt, Human
ccaucccagccc

SEQ ID NO: 3184977 - RNA, 23 nt, Human
ccaucccaaacccuucagugcca

SEQ ID NO: 3184978 - RNA, 13 nt, Human
ccaugagccucag

SEQ ID NO: 3184979 - RNA, 20 nt, Human
ccaucccugaaggccccgcc

SEQ ID NO: 3184980 - RNA, 16 nt, Human
ccauccccuguagagu

SEQ ID NO: 3184981 - RNA, 11 nt, Human
ccauccccucc

SEQ ID NO: 3184982 - RNA, 14 nt, Human
ccaugaguccccug

SEQ ID NO: 3184983 - RNA, 15 nt, Human
ccaugaguccccugu

SEQ ID NO: 3184984 - RNA, 16 nt, Human
ccaugaguccccuguu

SEQ ID NO: 3184985 - RNA, 13 nt, Human
ccaugggccuccu

SEQ ID NO: 3184986 - RNA, 13 nt, Human
ccaugaguccccu

SEQ ID NO: 3184987 - RNA, 19 nt, Human
ccaugagccucagcauccu

SEQ ID NO: 3184988 - RNA, 18 nt, Human
ccaugagccucagcaucc

SEQ ID NO: 3184989 - RNA, 14 nt, Human
ccaugagccucagc

SEQ ID NO: 3184990 - RNA, 18 nt, Human
ccccugcacuccagccug

SEQ ID NO: 3184991 - RNA, 16 nt, Human
ccccugcaaagcccag

SEQ ID NO: 3184992 - RNA, 13 nt, Human
ccccugcacucca

SEQ ID NO: 3184993 - RNA, 13 nt, Human
ccccugcagcccu

SEQ ID NO: 3184994 - RNA, 14 nt, Human
ccccugcagcccug

SEQ ID NO: 3184995 - RNA, 15 nt, Human
ccccugagcccacug

SEQ ID NO: 3184996 - RNA, 15 nt, Human
ccccugcaaagccca

SEQ ID NO: 3184997 - RNA, 14 nt, Human
ccccugagcccacu

SEQ ID NO: 3184998 - RNA, 13 nt, Human
ccccugagcccac

SEQ ID NO: 3184999 - RNA, 12 nt, Human
ccccugagccca

SEQ ID NO: 3185000 - RNA, 11 nt, Human
ccccugagccc

SEQ ID NO: 3185001 - RNA, 17 nt, Human
ccccuucgcuccugugu

SEQ ID NO: 3185002 - RNA, 15 nt, Human
ccccuucgcuccugu

SEQ ID NO: 3185003 - RNA, 14 nt, Human
ccccuucgcuccug

SEQ ID NO: 3185004 - RNA, 20 nt, Human
ccccugcaguuccccuggaa

SEQ ID NO: 3185005 - RNA, 19 nt, Human
ccccuucgcuccugugucu

SEQ ID NO: 3185006 - RNA, 14 nt, Human
ccccuuccugggca

SEQ ID NO: 3185007 - RNA, 19 nt, Human
ccccuuccuguguccaugu

SEQ ID NO: 3185008 - RNA, 14 nt, Human
ccccauucugccug

SEQ ID NO: 3185009 - RNA, 13 nt, Human
ccccauucugccu

SEQ ID NO: 3185010 - RNA, 15 nt, Human
ccccauucugccugc

SEQ ID NO: 3185011 - RNA, 14 nt, Human
ccccaucugugaau

SEQ ID NO: 3185012 - RNA, 13 nt, Human
ccccaucugugaa

SEQ ID NO: 3185013 - RNA, 12 nt, Human
cccggcugcgga

SEQ ID NO: 3185014 - RNA, 12 nt, Human
cccggcugcccu

SEQ ID NO: 3185015 - RNA, 13 nt, Human
cccggcugcccuu

SEQ ID NO: 3185016 - RNA, 14 nt, Human
ccccuugccagcug

SEQ ID NO: 3185017 - RNA, 22 nt, Human
cccuauccuacuuccccuuccu

SEQ ID NO: 3185018 - RNA, 15 nt, Human
cccgggaagcaaaug

SEQ ID NO: 3185019 - RNA, 12 nt, Human
cccgggaagcaa

SEQ ID NO: 3185020 - RNA, 16 nt, Human
ccccuucugacccaug

SEQ ID NO: 3185021 - RNA, 17 nt, Human
ccccuucugacccaugc

SEQ ID NO: 3185022 - RNA, 12 nt, Human
ccccuugccagc

SEQ ID NO: 3185023 - RNA, 20 nt, Human
cccucaacucuccuccagag

SEQ ID NO: 3185024 - RNA, 21 nt, Human
cccucagaaggucuguuuuga

SEQ ID NO: 3185025 - RNA, 20 nt, Human
cccucagaaaaugaguaaca

SEQ ID NO: 3185026 - RNA, 13 nt, Human
cccucagagccac

SEQ ID NO: 3185027 - RNA, 13 nt, Human
cccaguuguauuu

SEQ ID NO: 3185028 - RNA, 23 nt, Human
cccauaauuuuuuuuuuccuuuu

SEQ ID NO: 3185029 - RNA, 22 nt, Human
cccauaauuuuuuuuuuccuuu

SEQ ID NO: 3185030 - RNA, 22 nt, Human
cccauucugccugcccaggccc

SEQ ID NO: 3185031 - RNA, 21 nt, Human
cccauucugccugcccaggcc

SEQ ID NO: 3185032 - RNA, 20 nt, Human
cccauucugccugcccaggc

SEQ ID NO: 3185033 - RNA, 19 nt, Human
ccccauccucuguacagag

SEQ ID NO: 3185034 - RNA, 21 nt, Human
ccccauccucuguacagagcc

SEQ ID NO: 3185035 - RNA, 22 nt, Human
ccccauccucuguacagagccc

SEQ ID NO: 3185036 - RNA, 12 nt, Human
ccccaucuguga

SEQ ID NO: 3185037 - RNA, 17 nt, Human
ccccauccucuguacag

SEQ ID NO: 3185038 - RNA, 20 nt, Human
ccccagcaagugagagcugg

SEQ ID NO: 3185039 - RNA, 19 nt, Human
ccccagcaagugagagcug

SEQ ID NO: 3185040 - RNA, 17 nt, Human
ccccagcaagugagagc

SEQ ID NO: 3185041 - RNA, 23 nt, Human
ccccagauugcaacaggcugggc

SEQ ID NO: 3185042 - RNA, 22 nt, Human
ccccagauugcaacaggcuggg

SEQ ID NO: 3185043 - RNA, 21 nt, Human
ccccagauugcaacaggcugg

SEQ ID NO: 3185044 - RNA, 14 nt, Human
cccauuucaaugug

SEQ ID NO: 3185045 - RNA, 22 nt, Human
cccauuuagaauggugauuuua

SEQ ID NO: 3185046 - RNA, 12 nt, Human
cccauuuagaau

SEQ ID NO: 3185047 - RNA, 15 nt, Human
cccaggcuuagucac

SEQ ID NO: 3185048 - RNA, 21 nt, Human
cccaggcuggcgugcaguggu

SEQ ID NO: 3185049 - RNA, 19 nt, Human
cccaggaaaggcuccagga

SEQ ID NO: 3185050 - RNA, 23 nt, Human
cccagcugugcucuggacaggca

SEQ ID NO: 3185051 - RNA, 21 nt, Human
cccagcugugcucuggacagg

SEQ ID NO: 3185052 - RNA, 21 nt, Human
cccaggaaaggcuccaggagc

SEQ ID NO: 3185053 - RNA, 22 nt, Human
cccaggaaaggcuccaggagca

SEQ ID NO: 3185054 - RNA, 23 nt, Human
cccaggaaaggcuccaggagcag

SEQ ID NO: 3185055 - RNA, 14 nt, Human
cccagcccacuucu

SEQ ID NO: 3185056 - RNA, 16 nt, Human
cccagcccaccccaug

SEQ ID NO: 3185057 - RNA, 12 nt, Human
cccagcagccag

SEQ ID NO: 3185058 - RNA, 15 nt, Human
cccagcagccagcca

SEQ ID NO: 3185059 - RNA, 14 nt, Human
cccagcagccagcc

SEQ ID NO: 3185060 - RNA, 15 nt, Human
ccugggggcuggagc

SEQ ID NO: 3185061 - RNA, 15 nt, Human
ccugguuuccugccc

SEQ ID NO: 3185062 - RNA, 13 nt, Human
ccugguuuccugc

SEQ ID NO: 3185063 - RNA, 14 nt, Human
ccugguuuccugcc

SEQ ID NO: 3185064 - RNA, 16 nt, Human
ccugguuguguguccc

SEQ ID NO: 3185065 - RNA, 19 nt, Human
ccuguccugccuaaggcug

SEQ ID NO: 3185066 - RNA, 15 nt, Human
ccuguaaucacagcu

SEQ ID NO: 3185067 - RNA, 17 nt, Human
ccuguccugccuaaggc

SEQ ID NO: 3185068 - RNA, 17 nt, Human
ccuggggcgcgugaggc

SEQ ID NO: 3185069 - RNA, 18 nt, Human
ccuggggcgcgugaggcc

SEQ ID NO: 3185070 - RNA, 21 nt, Human
ccugguggcagugggagcugc

SEQ ID NO: 3185071 - RNA, 20 nt, Human
ccugguggcagugggagcug

SEQ ID NO: 3185072 - RNA, 16 nt, Human
ccuggggcccaaaugc

SEQ ID NO: 3185073 - RNA, 21 nt, Human
ccuggggcauccauggggucu

SEQ ID NO: 3185074 - RNA, 18 nt, Human
ccuggggcauccaugggg

SEQ ID NO: 3185075 - RNA, 17 nt, Human
ccuggggcauccauggg

SEQ ID NO: 3185076 - RNA, 12 nt, Human
ccuggggcaucc

SEQ ID NO: 3185077 - RNA, 14 nt, Human
ccugggccuggcuc

SEQ ID NO: 3185078 - RNA, 13 nt, Human
ccugggccuggcu

SEQ ID NO: 3185079 - RNA, 12 nt, Human
ccugggccuggc

SEQ ID NO: 3185080 - RNA, 16 nt, Human
ccugggccuggcuccc

SEQ ID NO: 3185081 - RNA, 15 nt, Human
ccugggccuggcucc

SEQ ID NO: 3185082 - RNA, 19 nt, Human
ccugggccuggcucccuca

SEQ ID NO: 3185083 - RNA, 19 nt, Human
ccugucugaauguaccugu

SEQ ID NO: 3185084 - RNA, 15 nt, Human
ccugucuaaugaaac

SEQ ID NO: 3185085 - RNA, 22 nt, Human
ccugucuaaugaaaccuguguc

SEQ ID NO: 3185086 - RNA, 13 nt, Human
ccugucugcucca

SEQ ID NO: 3185087 - RNA, 14 nt, Human
ccugucugcuccag

SEQ ID NO: 3185088 - RNA, 18 nt, Human
ccugucugcuccagcucu

SEQ ID NO: 3185089 - RNA, 15 nt, Human
ccugucugcuccagc

SEQ ID NO: 3185090 - RNA, 19 nt, Human
ccugucugugaagagcaag

SEQ ID NO: 3185091 - RNA, 17 nt, Human
ccugucuucugcuuugu

SEQ ID NO: 3185092 - RNA, 16 nt, Human
ccugucuucugcuuug

SEQ ID NO: 3185093 - RNA, 15 nt, Human
ccugucuucugcuuu

SEQ ID NO: 3185094 - RNA, 14 nt, Human
ccugucuucugcuu

SEQ ID NO: 3185095 - RNA, 13 nt, Human
ccugucuucugcu

SEQ ID NO: 3185096 - RNA, 21 nt, Human
ccugucuucugcuuuguugug

SEQ ID NO: 3185097 - RNA, 16 nt, Human
ccugugaacugaacuc

SEQ ID NO: 3185098 - RNA, 17 nt, Human
ccugugaacugaacucu

SEQ ID NO: 3185099 - RNA, 21 nt, Human
ccugugaagaaaggaccugca

SEQ ID NO: 3185100 - RNA, 16 nt, Human
ccuggccucugcacuc

SEQ ID NO: 3185101 - RNA, 20 nt, Human
ccuggccucugcacuccccu

SEQ ID NO: 3185102 - RNA, 21 nt, Human
ccuggccucugcacuccccug

SEQ ID NO: 3185103 - RNA, 22 nt, Human
ccuggccucugcacuccccugc

SEQ ID NO: 3185104 - RNA, 22 nt, Human
ccuggccggugugggggccccg

SEQ ID NO: 3185105 - RNA, 21 nt, Human
ccuggccggugugggggcccc

SEQ ID NO: 3185106 - RNA, 23 nt, Human
ccuggccggugugggggccccgu

SEQ ID NO: 3185107 - RNA, 20 nt, Human
ccugggccccaguuguauuu

SEQ ID NO: 3185108 - RNA, 18 nt, Human
ccuggccggugugggggc

SEQ ID NO: 3185109 - RNA, 13 nt, Human
ccugcccaggccc

SEQ ID NO: 3185110 - RNA, 14 nt, Human
ccugcccagaucag

SEQ ID NO: 3185111 - RNA, 19 nt, Human
ccugcccaccuggccucug

SEQ ID NO: 3185112 - RNA, 18 nt, Human
ccugcccagcccccuggu

SEQ ID NO: 3185113 - RNA, 22 nt, Human
ccugcccagaucagccagaagc

SEQ ID NO: 3185114 - RNA, 19 nt, Human
ccugcccagaucagccaga

SEQ ID NO: 3185115 - RNA, 17 nt, Human
ccugccccagggcuccc

SEQ ID NO: 3185116 - RNA, 13 nt, Human
ccugccccagcgc

SEQ ID NO: 3185117 - RNA, 12 nt, Human
ccugccccagcg

SEQ ID NO: 3185118 - RNA, 14 nt, Human
ccugccccagcgcu

SEQ ID NO: 3185119 - RNA, 12 nt, Human
ccugcccaccug

SEQ ID NO: 3185120 - RNA, 14 nt, Human
ccugcccaccuggc

SEQ ID NO: 3185121 - RNA, 20 nt, Human
ccugcccaccuggccucugc

SEQ ID NO: 3185122 - RNA, 13 nt, Human
ccugcccaccugg

SEQ ID NO: 3185123 - RNA, 18 nt, Human
ccugcccacaccuccugg

SEQ ID NO: 3185124 - RNA, 19 nt, Human
ccugcccacaccuccuggg

SEQ ID NO: 3185125 - RNA, 17 nt, Human
ccugcugcaguugccag

SEQ ID NO: 3185126 - RNA, 19 nt, Human
ccugcugcaguugccaguc

SEQ ID NO: 3185127 - RNA, 23 nt, Human
ccugccucgaacuggcugcaaag

SEQ ID NO: 3185128 - RNA, 21 nt, Human
ccugccucgaacuggcugcaa

SEQ ID NO: 3185129 - RNA, 19 nt, Human
ccugccucgaacuggcugc

SEQ ID NO: 3185130 - RNA, 20 nt, Human
ccugcugcaguugccaguca

SEQ ID NO: 3185131 - RNA, 13 nt, Human
ccucuuucccucc

SEQ ID NO: 3185132 - RNA, 11 nt, Human
ccucuuucagu

SEQ ID NO: 3185133 - RNA, 21 nt, Human
ccugaguagcugggauuacag

SEQ ID NO: 3185134 - RNA, 17 nt, Human
ccugcacuugcagacuc

SEQ ID NO: 3185135 - RNA, 16 nt, Human
ccugcacuugcagacu

SEQ ID NO: 3185136 - RNA, 14 nt, Human
ccugcagagggcac

SEQ ID NO: 3185137 - RNA, 18 nt, Human
ccugcacuugcagacucu

SEQ ID NO: 3185138 - RNA, 13 nt, Human
ccugcagcccugg

SEQ ID NO: 3185139 - RNA, 17 nt, Human
ccugcagcccuggccca

SEQ ID NO: 3185140 - RNA, 12 nt, Human
ccugcagccucc

SEQ ID NO: 3185141 - RNA, 14 nt, Human
ccugcagccucccu

SEQ ID NO: 3185142 - RNA, 16 nt, Human
ccugcagccucccucc

SEQ ID NO: 3185143 - RNA, 17 nt, Human
ccugcagccucccuccg

SEQ ID NO: 3185144 - RNA, 23 nt, Human
ccugcagccucccuccgcggcgg

SEQ ID NO: 3185145 - RNA, 11 nt, Human
ccucuuucccu

SEQ ID NO: 3185146 - RNA, 17 nt, Human
cccugugauggggcccu

SEQ ID NO: 3185147 - RNA, 18 nt, Human
cccugugauggggcccug

SEQ ID NO: 3185148 - RNA, 19 nt, Human
cccugugauggggcccugc

SEQ ID NO: 3185149 - RNA, 13 nt, Human
cccuucgcuccug

SEQ ID NO: 3185150 - RNA, 20 nt, Human
cccugucucaaaaaaagaaa

SEQ ID NO: 3185151 - RNA, 23 nt, Human
cccugucucaaaaaaagaaaaag

SEQ ID NO: 3185152 - RNA, 16 nt, Human
cccugucuaaugaaac

SEQ ID NO: 3185153 - RNA, 13 nt, Human
cccugucuaauga

SEQ ID NO: 3185154 - RNA, 13 nt, Human
ccggccccugcug

SEQ ID NO: 3185155 - RNA, 22 nt, Human
cccuucucuccagccccuggau

SEQ ID NO: 3185156 - RNA, 23 nt, Human
ccgcagcccugcagagggcacag

SEQ ID NO: 3185157 - RNA, 21 nt, Human
cccuucucuccagccccugga

SEQ ID NO: 3185158 - RNA, 19 nt, Human
cccuucucuccagccccug

SEQ ID NO: 3185159 - RNA, 15 nt, Human
cccuucgcuccugug

SEQ ID NO: 3185160 - RNA, 14 nt, Human
cccuucgcuccugu

SEQ ID NO: 3185161 - RNA, 19 nt, Human
ccgcaucagcugcucagau

SEQ ID NO: 3185162 - RNA, 16 nt, Human
ccgcaguguuugugug

SEQ ID NO: 3185163 - RNA, 11 nt, Human
ccgcaguguuu

SEQ ID NO: 3185164 - RNA, 14 nt, Human
ccgcaucucacagc

SEQ ID NO: 3185165 - RNA, 13 nt, Human
ccucaaagcuuuu

SEQ ID NO: 3185166 - RNA, 14 nt, Human
ccucaaagaggcag

SEQ ID NO: 3185167 - RNA, 23 nt, Human
ccuauuuuuuuagauugagaaau

SEQ ID NO: 3185168 - RNA, 14 nt, Human
ccucaaaacaaagg

SEQ ID NO: 3185169 - RNA, 23 nt, Human
ccuauuuuugacauggaaaugaa

SEQ ID NO: 3185170 - RNA, 18 nt, Human
ccucagcuuccccaguag

SEQ ID NO: 3185171 - RNA, 15 nt, Human
ccucagcuuccccag

SEQ ID NO: 3185172 - RNA, 21 nt, Human
ccucagcuuccccaguagcug

SEQ ID NO: 3185173 - RNA, 13 nt, Human
ccucaggaccagg

SEQ ID NO: 3185174 - RNA, 11 nt, Human
ccucaggacca

SEQ ID NO: 3185175 - RNA, 13 nt, Human
ccucagcuucccc

SEQ ID NO: 3185176 - RNA, 23 nt, Human
ccucauuuuugaauacaggcaua

SEQ ID NO: 3185177 - RNA, 20 nt, Human
ccuccaaccccucgcccagu

SEQ ID NO: 3185178 - RNA, 16 nt, Human
ccuccaaccccucgcc

SEQ ID NO: 3185179 - RNA, 15 nt, Human
ccucccaccucagcc

SEQ ID NO: 3185180 - RNA, 21 nt, Human
ccuccccaaggcccccugccu

SEQ ID NO: 3185181 - RNA, 20 nt, Human
ccuccccaaggcccccugcc

SEQ ID NO: 3185182 - RNA, 22 nt, Human
ccuccccaaggcccccugccug

SEQ ID NO: 3185183 - RNA, 13 nt, Human
ccucccaucucac

SEQ ID NO: 3185184 - RNA, 16 nt, Human
ccucccaucucacaca

SEQ ID NO: 3185185 - RNA, 14 nt, Human
ccggccccugcugg

SEQ ID NO: 3185186 - RNA, 19 nt, Human
auucuuugaccuguuggga

SEQ ID NO: 3185187 - RNA, 13 nt, Human
auucuuuccugag

SEQ ID NO: 3185188 - RNA, 14 nt, Human
auucuuucuccuuu

SEQ ID NO: 3185189 - RNA, 17 nt, Human
auucuuuccugaggcug

SEQ ID NO: 3185190 - RNA, 22 nt, Human
auucuuuccugaggcugggcuc

SEQ ID NO: 3185191 - RNA, 17 nt, Human
auucuugguauuuggau

SEQ ID NO: 3185192 - RNA, 14 nt, Human
auucugagagcugu

SEQ ID NO: 3185193 - RNA, 13 nt, Human
auucugagagcug

SEQ ID NO: 3185194 - RNA, 18 nt, Human
auucugaccuuaaaugca

SEQ ID NO: 3185195 - RNA, 14 nt, Human
auucugaccuuaaa

SEQ ID NO: 3185196 - RNA, 23 nt, Human
auucugauuauugaguuccaguu

SEQ ID NO: 3185197 - RNA, 21 nt, Human
auuccugaugcuucuucagag

SEQ ID NO: 3185198 - RNA, 22 nt, Human
auuccugacgagauaagcaguu

SEQ ID NO: 3185199 - RNA, 22 nt, Human
auugagccuaaaaauaaagcac

SEQ ID NO: 3185200 - RNA, 14 nt, Human
auugauauucuaag

SEQ ID NO: 3185201 - RNA, 16 nt, Human
auugauauucuaagaa

SEQ ID NO: 3185202 - RNA, 23 nt, Human
auugauauucuaagaaauaucug

SEQ ID NO: 3185203 - RNA, 23 nt, Human
auugagaccgugaagauacuuug

SEQ ID NO: 3185204 - RNA, 21 nt, Human
auugagaccgugaagauacuu

SEQ ID NO: 3185205 - RNA, 22 nt, Human
auugagaccgugaagauacuuu

SEQ ID NO: 3185206 - RNA, 19 nt, Human
auugagagagauguguaau

SEQ ID NO: 3185207 - RNA, 17 nt, Human
auugagagagaugugua

SEQ ID NO: 3185208 - RNA, 17 nt, Human
auugagaccgugaagau

SEQ ID NO: 3185209 - RNA, 20 nt, Human
auugagaccgugaagauacu

SEQ ID NO: 3185210 - RNA, 15 nt, Human
auugagccuaaaaau

SEQ ID NO: 3185211 - RNA, 21 nt, Human
auugagccuaaaaauaaagca

SEQ ID NO: 3185212 - RNA, 17 nt, Human
auugagccuaaaaauaa

SEQ ID NO: 3185213 - RNA, 18 nt, Human
auugagcagaauucauuc

SEQ ID NO: 3185214 - RNA, 20 nt, Human
auugagcagaauucauucau

SEQ ID NO: 3185215 - RNA, 21 nt, Human
auugagcagaauucauucaua

SEQ ID NO: 3185216 - RNA, 21 nt, Human
auugagagagauguguaauuu

SEQ ID NO: 3185217 - RNA, 20 nt, Human
auugagagagauguguaauu

SEQ ID NO: 3185218 - RNA, 13 nt, Human
auugagaaaugug

SEQ ID NO: 3185219 - RNA, 15 nt, Human
auuaaauuguaaaac

SEQ ID NO: 3185220 - RNA, 21 nt, Human
auucaacuuuccaaauaaaag

SEQ ID NO: 3185221 - RNA, 16 nt, Human
auucaacuuuccaaau

SEQ ID NO: 3185222 - RNA, 12 nt, Human
auucaagaacau

SEQ ID NO: 3185223 - RNA, 18 nt, Human
auucacaagacccaaaag

SEQ ID NO: 3185224 - RNA, 22 nt, Human
auucauuuuugaaacugcauuu

SEQ ID NO: 3185225 - RNA, 15 nt, Human
auucauuuucucuuu

SEQ ID NO: 3185226 - RNA, 16 nt, Human
auucauuuucucuuua

SEQ ID NO: 3185227 - RNA, 14 nt, Human
auuccaaacauggu

SEQ ID NO: 3185228 - RNA, 14 nt, Human
auuccaaaccaaau

SEQ ID NO: 3185229 - RNA, 18 nt, Human
auuccaaaccaaauuuua

SEQ ID NO: 3185230 - RNA, 21 nt, Human
auuccaaaccaaauuuuaauu

SEQ ID NO: 3185231 - RNA, 12 nt, Human
auuccaaaauau

SEQ ID NO: 3185232 - RNA, 13 nt, Human
auuccaaaauauu

SEQ ID NO: 3185233 - RNA, 14 nt, Human
auuccaaaauauua

SEQ ID NO: 3185234 - RNA, 15 nt, Human
auuccaaaauauuau

SEQ ID NO: 3185235 - RNA, 20 nt, Human
auucauggcaugcuuaaauu

SEQ ID NO: 3185236 - RNA, 19 nt, Human
auucauauuuacuucuuau

SEQ ID NO: 3185237 - RNA, 18 nt, Human
auucauauuuacuucuua

SEQ ID NO: 3185238 - RNA, 20 nt, Human
auucauauuuacuucuuaua

SEQ ID NO: 3185239 - RNA, 13 nt, Human
auucauauuugua

SEQ ID NO: 3185240 - RNA, 12 nt, Human
auucauauuugu

SEQ ID NO: 3185241 - RNA, 23 nt, Human
auucauauuuguacuuucuguua

SEQ ID NO: 3185242 - RNA, 22 nt, Human
auucauauuuguacuuucuguu

SEQ ID NO: 3185243 - RNA, 21 nt, Human
auucauauuuguacuuucugu

SEQ ID NO: 3185244 - RNA, 19 nt, Human
auucauauuuguacuuucu

SEQ ID NO: 3185245 - RNA, 17 nt, Human
auucauauuuguacuuu

SEQ ID NO: 3185246 - RNA, 15 nt, Human
auucauauuuguacu

SEQ ID NO: 3185247 - RNA, 23 nt, Human
auuguaaaagcauuuuguaauaa

SEQ ID NO: 3185248 - RNA, 21 nt, Human
auuguaaaagcauuuuguaau

SEQ ID NO: 3185249 - RNA, 20 nt, Human
auuguaaaagcauuuuguaa

SEQ ID NO: 3185250 - RNA, 19 nt, Human
auuguaaaagcauuuugua

SEQ ID NO: 3185251 - RNA, 13 nt, Human
auuguaaaagcau

SEQ ID NO: 3185252 - RNA, 20 nt, Human
auugaugcaugcuauucaca

SEQ ID NO: 3185253 - RNA, 17 nt, Human
auuguaagcguauggcu

SEQ ID NO: 3185254 - RNA, 15 nt, Human
auuguaaggaaugau

SEQ ID NO: 3185255 - RNA, 16 nt, Human
auuguaaggaaugauu

SEQ ID NO: 3185256 - RNA, 17 nt, Human
auuguaaaugugcuuuu

SEQ ID NO: 3185257 - RNA, 15 nt, Human
auuguaaaugugcuu

SEQ ID NO: 3185258 - RNA, 14 nt, Human
auuguaaaugugcu

SEQ ID NO: 3185259 - RNA, 19 nt, Human
auuguuuaaaaucauuucu

SEQ ID NO: 3185260 - RNA, 13 nt, Human
auuguuuagauuu

SEQ ID NO: 3185261 - RNA, 22 nt, Human
auuguuuaucuagauguaaauu

SEQ ID NO: 3185262 - RNA, 21 nt, Human
auuguuuaucuagauguaaau

SEQ ID NO: 3185263 - RNA, 20 nt, Human
auuguuuaucuagauguaaa

SEQ ID NO: 3185264 - RNA, 19 nt, Human
auuguuuaucuagauguaa

SEQ ID NO: 3185265 - RNA, 17 nt, Human
auuguuuaucuagaugu

SEQ ID NO: 3185266 - RNA, 16 nt, Human
auuguuuaucuagaug

SEQ ID NO: 3185267 - RNA, 16 nt, Human
auuguuuagauuuugu

SEQ ID NO: 3185268 - RNA, 16 nt, Human
auuguuuaguggaaaa

SEQ ID NO: 3185269 - RNA, 15 nt, Human
auuguuuaaaaucau

SEQ ID NO: 3185270 - RNA, 14 nt, Human
auuguucuuuucaa

SEQ ID NO: 3185271 - RNA, 19 nt, Human
auuguucuuaguuugcagu

SEQ ID NO: 3185272 - RNA, 16 nt, Human
auuguuccagagacaa

SEQ ID NO: 3185273 - RNA, 18 nt, Human
auuguaagcguauggcuu

SEQ ID NO: 3185274 - RNA, 19 nt, Human
auuguaagcguauggcuuu

SEQ ID NO: 3185275 - RNA, 14 nt, Human
auuuaaugaaagac

SEQ ID NO: 3185276 - RNA, 19 nt, Human
auuuaaucuuuucuuauuu

SEQ ID NO: 3185277 - RNA, 14 nt, Human
auuuaauguugaac

SEQ ID NO: 3185278 - RNA, 12 nt, Human
auuuaauguuga

SEQ ID NO: 3185279 - RNA, 17 nt, Human
auuuaauggggaggaca

SEQ ID NO: 3185280 - RNA, 19 nt, Human
auuuaauguugaacaaaau

SEQ ID NO: 3185281 - RNA, 15 nt, Human
auuuaauguugaaca

SEQ ID NO: 3185282 - RNA, 15 nt, Human
auuuauauuuauuga

SEQ ID NO: 3185283 - RNA, 16 nt, Human
auuuauauuuauugac

SEQ ID NO: 3185284 - RNA, 20 nt, Human
auuuauauuuauugacucuu

SEQ ID NO: 3185285 - RNA, 22 nt, Human
auuuauauuuauugacucuuga

SEQ ID NO: 3185286 - RNA, 22 nt, Human
auuucaagcuuauuuuggagag

SEQ ID NO: 3185287 - RNA, 21 nt, Human
auuucaagcuuauuuuggaga

SEQ ID NO: 3185288 - RNA, 14 nt, Human
auuucaagcuuauu

SEQ ID NO: 3185289 - RNA, 12 nt, Human
auuucaagcuua

SEQ ID NO: 3185290 - RNA, 15 nt, Human
auuuaucagauugcu

SEQ ID NO: 3185291 - RNA, 14 nt, Human
auuucauccagaag

SEQ ID NO: 3185292 - RNA, 20 nt, Human
auuucaucauauuauacaga

SEQ ID NO: 3185293 - RNA, 18 nt, Human
auuucaucauauuauaca

SEQ ID NO: 3185294 - RNA, 19 nt, Human
auuucaucagaacagcugu

SEQ ID NO: 3185295 - RNA, 17 nt, Human
auuucaucagaacagcu

SEQ ID NO: 3185296 - RNA, 22 nt, Human
auuucauccuuucacuucuuuc

SEQ ID NO: 3185297 - RNA, 20 nt, Human
auuucauccuuucacuucuu

SEQ ID NO: 3185298 - RNA, 19 nt, Human
auuucauccuuucacuucu

SEQ ID NO: 3185299 - RNA, 17 nt, Human
auuucaaguacacugaa

SEQ ID NO: 3185300 - RNA, 13 nt, Human
auuucaauguaau

SEQ ID NO: 3185301 - RNA, 16 nt, Human
auuucaauguaauuaa

SEQ ID NO: 3185302 - RNA, 20 nt, Human
auuucaauguaauuaaacug

SEQ ID NO: 3185303 - RNA, 22 nt, Human
auuucaauguaauuaaacuguu

SEQ ID NO: 3185304 - RNA, 23 nt, Human
auuucaauguaauuaaacuguua

SEQ ID NO: 3185305 - RNA, 14 nt, Human
auuucaauguguau

SEQ ID NO: 3185306 - RNA, 15 nt, Human
auuucaauguguaua

SEQ ID NO: 3185307 - RNA, 20 nt, Human
auuucaauguguauaaauug

SEQ ID NO: 3185308 - RNA, 22 nt, Human
auuucaauguguauaaauuguc

SEQ ID NO: 3185309 - RNA, 19 nt, Human
auuucagagagaaucaaga

SEQ ID NO: 3185310 - RNA, 23 nt, Human
auuucucacacucuaacuguaua

SEQ ID NO: 3185311 - RNA, 20 nt, Human
auuucuccugcguguucuca

SEQ ID NO: 3185312 - RNA, 11 nt, Human
auuucuccuuu

SEQ ID NO: 3185313 - RNA, 10 nt, Human
auuucuccuu

SEQ ID NO: 3185314 - RNA, 13 nt, Human
auuucuguucagc

SEQ ID NO: 3185315 - RNA, 22 nt, Human
caaaccaccagaagcccagaau

SEQ ID NO: 3185316 - RNA, 20 nt, Human
caaaccaccagaagcccaga

SEQ ID NO: 3185317 - RNA, 16 nt, Human
caaaccaccagaagcc

SEQ ID NO: 3185318 - RNA, 15 nt, Human
caaaccaccagaagc

SEQ ID NO: 3185319 - RNA, 13 nt, Human
caaaaguggucag

SEQ ID NO: 3185320 - RNA, 17 nt, Human
caaaccaaauuuuaauu

SEQ ID NO: 3185321 - RNA, 15 nt, Human
caaaagcugggcagg

SEQ ID NO: 3185322 - RNA, 14 nt, Human
caaaaguagaacuu

SEQ ID NO: 3185323 - RNA, 21 nt, Human
caaaagcugaacacauuucuu

SEQ ID NO: 3185324 - RNA, 18 nt, Human
caaaaguagaacuuugua

SEQ ID NO: 3185325 - RNA, 19 nt, Human
caaaaguagaacuuuguau

SEQ ID NO: 3185326 - RNA, 20 nt, Human
caaaaguagaacuuuguaua

SEQ ID NO: 3185327 - RNA, 21 nt, Human
caaaaguagaacuuuguauag

SEQ ID NO: 3185328 - RNA, 22 nt, Human
caaaaguagaacuuuguauagu

SEQ ID NO: 3185329 - RNA, 22 nt, Human
caaaaaaaguuguaugaucugu

SEQ ID NO: 3185330 - RNA, 12 nt, Human
caaaaaaaguug

SEQ ID NO: 3185331 - RNA, 14 nt, Human
caaaaaaaguugua

SEQ ID NO: 3185332 - RNA, 13 nt, Human
caaaaaaaguugu

SEQ ID NO: 3185333 - RNA, 21 nt, Human
caaaaaaaguuguaugaucug

SEQ ID NO: 3185334 - RNA, 18 nt, Human
caaaaaaaguuguaugau

SEQ ID NO: 3185335 - RNA, 16 nt, Human
caaaaaaaguuguaug

SEQ ID NO: 3185336 - RNA, 15 nt, Human
caaaaaaaguuguau

SEQ ID NO: 3185337 - RNA, 20 nt, Human
caaaagcugaacacauuucu

SEQ ID NO: 3185338 - RNA, 16 nt, Human
caaaagcugaacacau

SEQ ID NO: 3185339 - RNA, 16 nt, Human
auuuuuacaaguuaua

SEQ ID NO: 3185340 - RNA, 16 nt, Human
auuuuuacaguuauag

SEQ ID NO: 3185341 - RNA, 13 nt, Human
auuuuuuuuuccu

SEQ ID NO: 3185342 - RNA, 16 nt, Human
auuuuuuuuuccuuca

SEQ ID NO: 3185343 - RNA, 12 nt, Human
auuuuuuuuucc

SEQ ID NO: 3185344 - RNA, 14 nt, Human
auuuuuacauuuaa

SEQ ID NO: 3185345 - RNA, 21 nt, Human
auuuuuacauuuaaaccuuuu

SEQ ID NO: 3185346 - RNA, 18 nt, Human
auuuguuucuuucucuga

SEQ ID NO: 3185347 - RNA, 20 nt, Human
auuuguuucuuucucugagg

SEQ ID NO: 3185348 - RNA, 20 nt, Human
auuuuauaaggacuuccuga

SEQ ID NO: 3185349 - RNA, 18 nt, Human
auuuuauaaggacuuccu

SEQ ID NO: 3185350 - RNA, 15 nt, Human
auuuuauaaauguau

SEQ ID NO: 3185351 - RNA, 16 nt, Human
auuuugacacugaaau

SEQ ID NO: 3185352 - RNA, 18 nt, Human
auuuugacacugaaauaa

SEQ ID NO: 3185353 - RNA, 14 nt, Human
auuuugauaguggg

SEQ ID NO: 3185354 - RNA, 15 nt, Human
auuuuuaaaggcauu

SEQ ID NO: 3185355 - RNA, 11 nt, Human
auuuuuaaaug

SEQ ID NO: 3185356 - RNA, 20 nt, Human
auuuuuaaaugcaguuacaa

SEQ ID NO: 3185357 - RNA, 19 nt, Human
auuuuuaaaugcaguuaca

SEQ ID NO: 3185358 - RNA, 20 nt, Human
caacaccucugcacaagcug

SEQ ID NO: 3185359 - RNA, 13 nt, Human
caacacaaagauu

SEQ ID NO: 3185360 - RNA, 22 nt, Human
caacaccucugcacaagcugca

SEQ ID NO: 3185361 - RNA, 20 nt, Human
caacaccuuguuucccucuc

SEQ ID NO: 3185362 - RNA, 22 nt, Human
caaaugagggucuugguuccag

SEQ ID NO: 3185363 - RNA, 20 nt, Human
caaaucugcaaagcauguuu

SEQ ID NO: 3185364 - RNA, 18 nt, Human
caaaucugcaaagcaugu

SEQ ID NO: 3185365 - RNA, 20 nt, Human
caaauccaggacccugccag

SEQ ID NO: 3185366 - RNA, 18 nt, Human
caaauccaggacccugcc

SEQ ID NO: 3185367 - RNA, 17 nt, Human
caaauccaggacccugc

SEQ ID NO: 3185368 - RNA, 13 nt, Human
caaaugcagcuuu

SEQ ID NO: 3185369 - RNA, 23 nt, Human
caaaugauugcuuuuaaaauuuu

SEQ ID NO: 3185370 - RNA, 22 nt, Human
caaaugauugcuuuuaaaauuu

SEQ ID NO: 3185371 - RNA, 17 nt, Human
caaaugaugugccugcu

SEQ ID NO: 3185372 - RNA, 21 nt, Human
caaaugaugugccugcuucag

SEQ ID NO: 3185373 - RNA, 20 nt, Human
caaaugaugugccugcuuca

SEQ ID NO: 3185374 - RNA, 21 nt, Human
caaaugauugcuuuuaaaauu

SEQ ID NO: 3185375 - RNA, 20 nt, Human
caaaugauugcuuuuaaaau

SEQ ID NO: 3185376 - RNA, 19 nt, Human
caaaugauugcuuuuaaaa

SEQ ID NO: 3185377 - RNA, 18 nt, Human
caaaugauugcuuuuaaa

SEQ ID NO: 3185378 - RNA, 17 nt, Human
caaaugauugcuuuuaa

SEQ ID NO: 3185379 - RNA, 15 nt, Human
caaaugauugcuuuu

SEQ ID NO: 3185380 - RNA, 14 nt, Human
caaaugauugcuuu

SEQ ID NO: 3185381 - RNA, 12 nt, Human
caaaugauugcu

SEQ ID NO: 3185382 - RNA, 23 nt, Human
caacaaaccuguuucugcagcca

SEQ ID NO: 3185383 - RNA, 23 nt, Human
caacaauucucccgggacucugc

SEQ ID NO: 3185384 - RNA, 22 nt, Human
caacaaacugcacaugauuuca

SEQ ID NO: 3185385 - RNA, 21 nt, Human
caacaaacugcacaugauuuc

SEQ ID NO: 3185386 - RNA, 17 nt, Human
caacaaacugcacauga

SEQ ID NO: 3185387 - RNA, 16 nt, Human
caacaaacugcacaug

SEQ ID NO: 3185388 - RNA, 14 nt, Human
caacaaaauacauu

SEQ ID NO: 3185389 - RNA, 13 nt, Human
caacaaaauacau

SEQ ID NO: 3185390 - RNA, 21 nt, Human
caaauuuuggcgaaucucaaa

SEQ ID NO: 3185391 - RNA, 12 nt, Human
caacaaaauaca

SEQ ID NO: 3185392 - RNA, 12 nt, Human
caacaauuuuca

SEQ ID NO: 3185393 - RNA, 20 nt, Human
caacaauuuagaaggaaaac

SEQ ID NO: 3185394 - RNA, 19 nt, Human
caacaauuuucagauuugc

SEQ ID NO: 3185395 - RNA, 18 nt, Human
caacaauuuucagauuug

SEQ ID NO: 3185396 - RNA, 15 nt, Human
caacaauuuucagau

SEQ ID NO: 3185397 - RNA, 13 nt, Human
caacaauuuucag

SEQ ID NO: 3185398 - RNA, 23 nt, Human
caacaauuuucagauuugcacaa

SEQ ID NO: 3185399 - RNA, 20 nt, Human
caaauccuugugggaaaaga

SEQ ID NO: 3185400 - RNA, 14 nt, Human
caaauccaggaccc

SEQ ID NO: 3185401 - RNA, 17 nt, Human
caaaucagcugcuacua

SEQ ID NO: 3185402 - RNA, 13 nt, Human
caaagaugcagcc

SEQ ID NO: 3185403 - RNA, 19 nt, Human
caacuaugauuuggaaaau

SEQ ID NO: 3185404 - RNA, 18 nt, Human
caacuaugauuuggaaaa

SEQ ID NO: 3185405 - RNA, 14 nt, Human
caacccccagcucc

SEQ ID NO: 3185406 - RNA, 14 nt, Human
caacccccagccug

SEQ ID NO: 3185407 - RNA, 17 nt, Human
caacuaugauuuggaaa

SEQ ID NO: 3185408 - RNA, 17 nt, Human
caacccccagccugcua

SEQ ID NO: 3185409 - RNA, 16 nt, Human
caacccccagccugcu

SEQ ID NO: 3185410 - RNA, 15 nt, Human
caacccccagccugc

SEQ ID NO: 3185411 - RNA, 19 nt, Human
caacccaaauguucaucaa

SEQ ID NO: 3185412 - RNA, 14 nt, Human
caaccauuccccau

SEQ ID NO: 3185413 - RNA, 22 nt, Human
caaccauuuaucuugaaggaaa

SEQ ID NO: 3185414 - RNA, 17 nt, Human
caaccauuuaucuugaa

SEQ ID NO: 3185415 - RNA, 16 nt, Human
caaccauuuaucuuga

SEQ ID NO: 3185416 - RNA, 13 nt, Human
caaccauuuaucu

SEQ ID NO: 3185417 - RNA, 14 nt, Human
caaccauuugaaac

SEQ ID NO: 3185418 - RNA, 14 nt, Human
caaccauuaaaguc

SEQ ID NO: 3185419 - RNA, 17 nt, Human
caaccauuaaagucaga

SEQ ID NO: 3185420 - RNA, 21 nt, Human
caaccacguugggacagggag

SEQ ID NO: 3185421 - RNA, 18 nt, Human
caagacccuugugguccc

SEQ ID NO: 3185422 - RNA, 19 nt, Human
caagacccuugugguccca

SEQ ID NO: 3185423 - RNA, 22 nt, Human
caagacccuuguggucccaccc

SEQ ID NO: 3185424 - RNA, 13 nt, Human
caagacacaguga

SEQ ID NO: 3185425 - RNA, 16 nt, Human
caagacaacauuguaa

SEQ ID NO: 3185426 - RNA, 22 nt, Human
caagaauaaaggcagcuguugu

SEQ ID NO: 3185427 - RNA, 16 nt, Human
caacucaccccagccc

SEQ ID NO: 3185428 - RNA, 16 nt, Human
caacccccagcucccg

SEQ ID NO: 3185429 - RNA, 15 nt, Human
caacccccagcuccc

SEQ ID NO: 3185430 - RNA, 13 nt, Human
caacucaccccag

SEQ ID NO: 3185431 - RNA, 15 nt, Human
caacucaccccagcc

SEQ ID NO: 3185432 - RNA, 21 nt, Human
caagaauaaaggcagcuguug

SEQ ID NO: 3185433 - RNA, 19 nt, Human
caagaauaaaggcagcugu

SEQ ID NO: 3185434 - RNA, 15 nt, Human
caagaauaaaggcag

SEQ ID NO: 3185435 - RNA, 18 nt, Human
caagaauaaaggcagcug

SEQ ID NO: 3185436 - RNA, 17 nt, Human
caagaauaaaggcagcu

SEQ ID NO: 3185437 - RNA, 15 nt, Human
caagaaguuuaagga

SEQ ID NO: 3185438 - RNA, 21 nt, Human
caagaaguucuuugauucugu

SEQ ID NO: 3185439 - RNA, 18 nt, Human
caaccacugcgaccacaa

SEQ ID NO: 3185440 - RNA, 21 nt, Human
cagaauaaacuggcagcucag

SEQ ID NO: 3185441 - RNA, 23 nt, Human
cagaaguuugagaucagccuggg

SEQ ID NO: 3185442 - RNA, 22 nt, Human
cagaaguuuaaauauuaagcau

SEQ ID NO: 3185443 - RNA, 16 nt, Human
cagaaguuuaaauauu

SEQ ID NO: 3185444 - RNA, 22 nt, Human
cagaaguuucugccgcagcccu

SEQ ID NO: 3185445 - RNA, 20 nt, Human
cagaaguuucugccgcagcc

SEQ ID NO: 3185446 - RNA, 21 nt, Human
cagaaguuucugccgcagccc

SEQ ID NO: 3185447 - RNA, 15 nt, Human
cagaauacugaugga

SEQ ID NO: 3185448 - RNA, 22 nt, Human
cagaauauuagugaccucagcu

SEQ ID NO: 3185449 - RNA, 22 nt, Human
cagaaauucuguuuuuaaaaau

SEQ ID NO: 3185450 - RNA, 20 nt, Human
cagaaauucuguuuuuaaaa

SEQ ID NO: 3185451 - RNA, 19 nt, Human
cagaaauucuguuuuuaaa

SEQ ID NO: 3185452 - RNA, 14 nt, Human
cagaaauucuguuu

SEQ ID NO: 3185453 - RNA, 18 nt, Human
cagaaauucuguuuuuaa

SEQ ID NO: 3185454 - RNA, 17 nt, Human
cagaaauucuguuuuua

SEQ ID NO: 3185455 - RNA, 15 nt, Human
cagaaauugguaccu

SEQ ID NO: 3185456 - RNA, 11 nt, Human
cagaaauuggu

SEQ ID NO: 3185457 - RNA, 21 nt, Human
cagaaauugguaccuugcaca

SEQ ID NO: 3185458 - RNA, 20 nt, Human
cagaaauugguaccuugcac

SEQ ID NO: 3185459 - RNA, 19 nt, Human
cagaaauugguaccuugca

SEQ ID NO: 3185460 - RNA, 17 nt, Human
cagaaauugguaccuug

SEQ ID NO: 3185461 - RNA, 23 nt, Human
cagaaauugguaccuugcacaca

SEQ ID NO: 3185462 - RNA, 19 nt, Human
cagaaguuucugccgcagc

SEQ ID NO: 3185463 - RNA, 14 nt, Human
cagaaguuuaaaua

SEQ ID NO: 3185464 - RNA, 13 nt, Human
cagaagugacuga

SEQ ID NO: 3185465 - RNA, 16 nt, Human
cagaaguccagagucu

SEQ ID NO: 3185466 - RNA, 15 nt, Human
cagaacacauaauuc

SEQ ID NO: 3185467 - RNA, 18 nt, Human
cacuggggauugggcccc

SEQ ID NO: 3185468 - RNA, 17 nt, Human
cacuggggauugggccc

SEQ ID NO: 3185469 - RNA, 16 nt, Human
cacuggggauugggcc

SEQ ID NO: 3185470 - RNA, 15 nt, Human
cacuggggauugggc

SEQ ID NO: 3185471 - RNA, 23 nt, Human
cacugggcuuggggaccagagcu

SEQ ID NO: 3185472 - RNA, 22 nt, Human
cacugggcuuggggaccagagc

SEQ ID NO: 3185473 - RNA, 20 nt, Human
cacugggcuuggggaccaga

SEQ ID NO: 3185474 - RNA, 23 nt, Human
cacuggggauugggccccugcca

SEQ ID NO: 3185475 - RNA, 17 nt, Human
cacuggugacaugucuu

SEQ ID NO: 3185476 - RNA, 16 nt, Human
cacuguugcccaggcu

SEQ ID NO: 3185477 - RNA, 15 nt, Human
cacuguugcccaggc

SEQ ID NO: 3185478 - RNA, 14 nt, Human
cacuguugcccagg

SEQ ID NO: 3185479 - RNA, 22 nt, Human
cacugguggcccgacagccugg

SEQ ID NO: 3185480 - RNA, 21 nt, Human
cacugguggcccgacagccug

SEQ ID NO: 3185481 - RNA, 13 nt, Human
cacugguggcccg

SEQ ID NO: 3185482 - RNA, 17 nt, Human
cacuuggucugugagau

SEQ ID NO: 3185483 - RNA, 20 nt, Human
cacuuggucugugagaugcu

SEQ ID NO: 3185484 - RNA, 20 nt, Human
cacuuagaaauugcauuucc

SEQ ID NO: 3185485 - RNA, 17 nt, Human
cacuugucggcuccagu

SEQ ID NO: 3185486 - RNA, 16 nt, Human
cacuuguccaugugaa

SEQ ID NO: 3185487 - RNA, 13 nt, Human
cacuugugacuuu

SEQ ID NO: 3185488 - RNA, 21 nt, Human
cacuugucggcuccagucccc

SEQ ID NO: 3185489 - RNA, 20 nt, Human
cacuugugacuuuugcuuua

SEQ ID NO: 3185490 - RNA, 18 nt, Human
cacuugugacuuuugcuu

SEQ ID NO: 3185491 - RNA, 17 nt, Human
cacuugugacuuuugcu

SEQ ID NO: 3185492 - RNA, 14 nt, Human
cacuugugacuuuu

SEQ ID NO: 3185493 - RNA, 21 nt, Human
cacuugugacuuuugcuuuaa

SEQ ID NO: 3185494 - RNA, 23 nt, Human
cacuguuuagauuugccauagag

SEQ ID NO: 3185495 - RNA, 15 nt, Human
cacuguuuagauuug

SEQ ID NO: 3185496 - RNA, 20 nt, Human
cacuguuuagauuugccaua

SEQ ID NO: 3185497 - RNA, 17 nt, Human
cacuggugccaugucag

SEQ ID NO: 3185498 - RNA, 12 nt, Human
cacuguuuagau

SEQ ID NO: 3185499 - RNA, 19 nt, Human
cacuuagaaauugcauuuc

SEQ ID NO: 3185500 - RNA, 17 nt, Human
cacuuagaaauugcauu

SEQ ID NO: 3185501 - RNA, 13 nt, Human
cacuuuauugcca

SEQ ID NO: 3185502 - RNA, 20 nt, Human
cacuuuauugccaaaaccca

SEQ ID NO: 3185503 - RNA, 14 nt, Human
cacuuuccaaguca

SEQ ID NO: 3185504 - RNA, 15 nt, Human
cacuuucauaaucuu

SEQ ID NO: 3185505 - RNA, 19 nt, Human
cacucuuggagccugcaga

SEQ ID NO: 3185506 - RNA, 17 nt, Human
cacucuuggagccugca

SEQ ID NO: 3185507 - RNA, 23 nt, Human
cacugaaauaaccguaaagguuu

SEQ ID NO: 3185508 - RNA, 20 nt, Human
cacugaaccugggaaagaga

SEQ ID NO: 3185509 - RNA, 14 nt, Human
cacucuuggagccu

SEQ ID NO: 3185510 - RNA, 16 nt, Human
cacucuuggagccugc

SEQ ID NO: 3185511 - RNA, 15 nt, Human
cacucuuggagccug

SEQ ID NO: 3185512 - RNA, 22 nt, Human
cacucuuagcccaugcuguuuu

SEQ ID NO: 3185513 - RNA, 20 nt, Human
cacuccccgccguacaguuc

SEQ ID NO: 3185514 - RNA, 17 nt, Human
cacucuuauugcccacg

SEQ ID NO: 3185515 - RNA, 18 nt, Human
cacucuuauugcccacgc

SEQ ID NO: 3185516 - RNA, 12 nt, Human
cacucccagcau

SEQ ID NO: 3185517 - RNA, 22 nt, Human
cacuccccagccagccuggcug

SEQ ID NO: 3185518 - RNA, 21 nt, Human
cacuccccagccagccuggcu

SEQ ID NO: 3185519 - RNA, 16 nt, Human
cacuccccagccagcc

SEQ ID NO: 3185520 - RNA, 14 nt, Human
cacuccccagccag

SEQ ID NO: 3185521 - RNA, 23 nt, Human
cacuacggaauaguuggcuagga

SEQ ID NO: 3185522 - RNA, 13 nt, Human
cacuaccuggcug

SEQ ID NO: 3185523 - RNA, 13 nt, Human
cacggccaggcca

SEQ ID NO: 3185524 - RNA, 16 nt, Human
cacggccaggccagag

SEQ ID NO: 3185525 - RNA, 15 nt, Human
cacggccaggccaga

SEQ ID NO: 3185526 - RNA, 14 nt, Human
cacggccaggccag

SEQ ID NO: 3185527 - RNA, 20 nt, Human
cacggagggugacgggggug

SEQ ID NO: 3185528 - RNA, 22 nt, Human
cacggagcggauugcaaagcaa

SEQ ID NO: 3185529 - RNA, 18 nt, Human
caccuugacagggcacac

SEQ ID NO: 3185530 - RNA, 17 nt, Human
caccugccagggacaga

SEQ ID NO: 3185531 - RNA, 19 nt, Human
caccuugacagggcacacc

SEQ ID NO: 3185532 - RNA, 13 nt, Human
caccuuggcucaa

SEQ ID NO: 3185533 - RNA, 14 nt, Human
caccuuugucccca

SEQ ID NO: 3185534 - RNA, 15 nt, Human
caccuuuguccccac

SEQ ID NO: 3185535 - RNA, 14 nt, Human
caccuuugaagaag

SEQ ID NO: 3185536 - RNA, 22 nt, Human
caccuugguuccuggggcaucc

SEQ ID NO: 3185537 - RNA, 14 nt, Human
caccuugguuccug

SEQ ID NO: 3185538 - RNA, 21 nt, Human
caccuacaugagguacugaga

SEQ ID NO: 3185539 - RNA, 23 nt, Human
caccucaaaauaccaugccauuu

SEQ ID NO: 3185540 - RNA, 13 nt, Human
caccugccaggga

SEQ ID NO: 3185541 - RNA, 14 nt, Human
caccucacacuccu

SEQ ID NO: 3185542 - RNA, 17 nt, Human
caccucacacuccuuua

SEQ ID NO: 3185543 - RNA, 14 nt, Human
caccugccagggac

SEQ ID NO: 3185544 - RNA, 16 nt, Human
caccugccagggacag

SEQ ID NO: 3185545 - RNA, 16 nt, Human
caccuaccccugacuu

SEQ ID NO: 3185546 - RNA, 20 nt, Human
caccuaccaccacgcccggc

SEQ ID NO: 3185547 - RNA, 17 nt, Human
caccaggccccccuguc

SEQ ID NO: 3185548 - RNA, 17 nt, Human
cacccagcccacuucug

SEQ ID NO: 3185549 - RNA, 16 nt, Human
cacccagcccacuucu

SEQ ID NO: 3185550 - RNA, 14 nt, Human
caccagcugugucc

SEQ ID NO: 3185551 - RNA, 16 nt, Human
caccaggccccccugu

SEQ ID NO: 3185552 - RNA, 23 nt, Human
caccaacauacucccaucuguga

SEQ ID NO: 3185553 - RNA, 17 nt, Human
caccaaaaaauaucuag

SEQ ID NO: 3185554 - RNA, 14 nt, Human
caccaaaaaauauc

SEQ ID NO: 3185555 - RNA, 13 nt, Human
caccaaaaaauau

SEQ ID NO: 3185556 - RNA, 12 nt, Human
caccaaaaaaua

SEQ ID NO: 3185557 - RNA, 20 nt, Human
caccaaaaaaauccagaaac

SEQ ID NO: 3185558 - RNA, 19 nt, Human
caccaaaaaaauccagaaa

SEQ ID NO: 3185559 - RNA, 14 nt, Human
caccagcagccugg

SEQ ID NO: 3185560 - RNA, 12 nt, Human
caccagcagccu

SEQ ID NO: 3185561 - RNA, 15 nt, Human
caccagcagccugga

SEQ ID NO: 3185562 - RNA, 21 nt, Human
caccagcccuuagcagggaaa

SEQ ID NO: 3185563 - RNA, 23 nt, Human
cacccaggagccccgaggccuuc

SEQ ID NO: 3185564 - RNA, 20 nt, Human
cacccaggagccccgaggcc

SEQ ID NO: 3185565 - RNA, 19 nt, Human
cacccagcccacuucugcc

SEQ ID NO: 3185566 - RNA, 24 nt, Human
cacccaggagccccgaggccuucu

SEQ ID NO: 3185567 - RNA, 20 nt, Human
caccaacauacucccaucug

SEQ ID NO: 3185568 - RNA, 21 nt, Human
caccaacauacucccaucugu

SEQ ID NO: 3185569 - RNA, 17 nt, Human
caccaacauacucccau

SEQ ID NO: 3185570 - RNA, 14 nt, Human
cacauuuuuuucua

SEQ ID NO: 3185571 - RNA, 19 nt, Human
cacauuuuaaaaaauuugu

SEQ ID NO: 3185572 - RNA, 17 nt, Human
cacauuuuuauaccugu

SEQ ID NO: 3185573 - RNA, 23 nt, Human
cacauuuuuauaccuguuuaaau

SEQ ID NO: 3185574 - RNA, 21 nt, Human
cacauuuuuauaccuguuuaa

SEQ ID NO: 3185575 - RNA, 21 nt, Human
cacauuuucuuaauccagucu

SEQ ID NO: 3185576 - RNA, 18 nt, Human
cacaucuugcucugcuga

SEQ ID NO: 3185577 - RNA, 13 nt, Human
cacauuucuuuuu

SEQ ID NO: 3185578 - RNA, 18 nt, Human
cacauuucucaacaaggc

SEQ ID NO: 3185579 - RNA, 21 nt, Human
cacauuucuuuuuaaaaaaag

SEQ ID NO: 3185580 - RNA, 20 nt, Human
cacauuugguaauguuuuua

SEQ ID NO: 3185581 - RNA, 18 nt, Human
cacauuugguaauguuuu

SEQ ID NO: 3185582 - RNA, 20 nt, Human
cacauccggggccagcuccg

SEQ ID NO: 3185583 - RNA, 19 nt, Human
cacauccggggccagcucc

SEQ ID NO: 3185584 - RNA, 17 nt, Human
cacaucuugcucugcug

SEQ ID NO: 3185585 - RNA, 16 nt, Human
cacaucuugcucugcu

SEQ ID NO: 3185586 - RNA, 21 nt, Human
cacauccuugacuuuuuagau

SEQ ID NO: 3185587 - RNA, 19 nt, Human
cacauccuugacuuuuuag

SEQ ID NO: 3185588 - RNA, 18 nt, Human
cacaguauuacuucugcu

SEQ ID NO: 3185589 - RNA, 16 nt, Human
cacaguauuacuucug

SEQ ID NO: 3185590 - RNA, 13 nt, Human
cacaguauauuuu

SEQ ID NO: 3185591 - RNA, 16 nt, Human
cacaguauauuuuauu

SEQ ID NO: 3185592 - RNA, 19 nt, Human
cacaguauauuuuauuuca

SEQ ID NO: 3185593 - RNA, 20 nt, Human
cacagacccugcccuguggg

SEQ ID NO: 3185594 - RNA, 21 nt, Human
cacagacccugcccugugggc

SEQ ID NO: 3185595 - RNA, 19 nt, Human
cacagacccugcccugugg

SEQ ID NO: 3185596 - RNA, 22 nt, Human
cacagacaggaccccugcaguu

SEQ ID NO: 3185597 - RNA, 17 nt, Human
cacagacaggaccccug

SEQ ID NO: 3185598 - RNA, 15 nt, Human
cacagacaggacccc

SEQ ID NO: 3185599 - RNA, 14 nt, Human
cacagacaggaccc

SEQ ID NO: 3185600 - RNA, 13 nt, Human
cacagacaggacc

SEQ ID NO: 3185601 - RNA, 10 nt, Human
cacagacagg

SEQ ID NO: 3185602 - RNA, 15 nt, Human
cacagcuaacaugga

SEQ ID NO: 3185603 - RNA, 16 nt, Human
cacagcuaacauggaa

SEQ ID NO: 3185604 - RNA, 18 nt, Human
cacagacccugcccugug

SEQ ID NO: 3185605 - RNA, 23 nt, Human
cacagaaggggacugccaccucc

SEQ ID NO: 3185606 - RNA, 22 nt, Human
cacagaaggggacugccaccuc

SEQ ID NO: 3185607 - RNA, 19 nt, Human
cacagaaggggacugccac

SEQ ID NO: 3185608 - RNA, 18 nt, Human
cacagaaggggacugcca

SEQ ID NO: 3185609 - RNA, 19 nt, Human
cacagcucuguccugggag

SEQ ID NO: 3185610 - RNA, 17 nt, Human
cacagcucccuucuguu

SEQ ID NO: 3185611 - RNA, 16 nt, Human
cacagcucccuucugu

SEQ ID NO: 3185612 - RNA, 23 nt, Human
cacagcucuguccugggagugag

SEQ ID NO: 3185613 - RNA, 20 nt, Human
cacagcucuguccugggagu

SEQ ID NO: 3185614 - RNA, 22 nt, Human
cacagcuaacauggaaguacua

SEQ ID NO: 3185615 - RNA, 22 nt, Human
cacagcguuaugugucugccac

SEQ ID NO: 3185616 - RNA, 13 nt, Human
cacagcucccuuc

SEQ ID NO: 3185617 - RNA, 17 nt, Human
cacagggcaugaaauga

SEQ ID NO: 3185618 - RNA, 18 nt, Human
cacagggccuggcccaug

SEQ ID NO: 3185619 - RNA, 17 nt, Human
cacagggccuggcccau

SEQ ID NO: 3185620 - RNA, 16 nt, Human
cacagggccuggccca

SEQ ID NO: 3185621 - RNA, 15 nt, Human
cacagggccuggccc

SEQ ID NO: 3185622 - RNA, 14 nt, Human
cacagggccuggcc

SEQ ID NO: 3185623 - RNA, 13 nt, Human
cacagggccuggc

SEQ ID NO: 3185624 - RNA, 14 nt, Human
cacaggucaggcua

SEQ ID NO: 3185625 - RNA, 13 nt, Human
cacaggucaggcu

SEQ ID NO: 3185626 - RNA, 19 nt, Human
cacagggccuggcccaugu

SEQ ID NO: 3185627 - RNA, 23 nt, Human
cacaagacccaaaaggcagaagc

SEQ ID NO: 3185628 - RNA, 12 nt, Human
caauuuaaaaaa

SEQ ID NO: 3185629 - RNA, 17 nt, Human
caauuuaaaauauagau

SEQ ID NO: 3185630 - RNA, 14 nt, Human
cacaagacccuugu

SEQ ID NO: 3185631 - RNA, 16 nt, Human
cacaagacccuugugg

SEQ ID NO: 3185632 - RNA, 14 nt, Human
cacaagccuucggc

SEQ ID NO: 3185633 - RNA, 23 nt, Human
caaugcuggcuguuggcuggggg

SEQ ID NO: 3185634 - RNA, 22 nt, Human
caaugcuggcuguuggcugggg

SEQ ID NO: 3185635 - RNA, 17 nt, Human
caauucuccugccucag

SEQ ID NO: 3185636 - RNA, 16 nt, Human
caauucuccugccuca

SEQ ID NO: 3185637 - RNA, 19 nt, Human
caauggacaagcaguggau

SEQ ID NO: 3185638 - RNA, 19 nt, Human
caauucuccugccucagcc

SEQ ID NO: 3185639 - RNA, 13 nt, Human
caauucuccuuua

SEQ ID NO: 3185640 - RNA, 17 nt, Human
caaguauuacuaaauug

SEQ ID NO: 3185641 - RNA, 19 nt, Human
caaguauuacuaaauugac

SEQ ID NO: 3185642 - RNA, 23 nt, Human
caaguauuacuaaauugaccuuu

SEQ ID NO: 3185643 - RNA, 24 nt, Human
caaguauuacuaaauugaccuuua

SEQ ID NO: 3185644 - RNA, 22 nt, Human
caaguauuauaaacaagaauga

SEQ ID NO: 3185645 - RNA, 12 nt, Human
caaguauuauaa

SEQ ID NO: 3185646 - RNA, 22 nt, Human
caaguuuugugaaauuuuucau

SEQ ID NO: 3185647 - RNA, 21 nt, Human
caaguuuugugaaauuuuuca

SEQ ID NO: 3185648 - RNA, 20 nt, Human
caaguuuugugaaauuuuuc

SEQ ID NO: 3185649 - RNA, 19 nt, Human
caaguuuugugaaauuuuu

SEQ ID NO: 3185650 - RNA, 18 nt, Human
caaguuuugugaaauuuu

SEQ ID NO: 3185651 - RNA, 17 nt, Human
caaguuuugugaaauuu

SEQ ID NO: 3185652 - RNA, 16 nt, Human
caaguuuugugaaauu

SEQ ID NO: 3185653 - RNA, 14 nt, Human
caaguuuugugaaa

SEQ ID NO: 3185654 - RNA, 13 nt, Human
caaguuuugugaa

SEQ ID NO: 3185655 - RNA, 11 nt, Human
caaguuuugug

SEQ ID NO: 3185656 - RNA, 19 nt, Human
caaguugagcuaugacuua

SEQ ID NO: 3185657 - RNA, 17 nt, Human
caaguagacuacuguuc

SEQ ID NO: 3185658 - RNA, 16 nt, Human
caaguagaccaugguc

SEQ ID NO: 3185659 - RNA, 14 nt, Human
caaguaauuucagu

SEQ ID NO: 3185660 - RNA, 23 nt, Human
caaguaauuucaguguaaagugu

SEQ ID NO: 3185661 - RNA, 15 nt, Human
caaguacacugagag

SEQ ID NO: 3185662 - RNA, 16 nt, Human
caaguacaguacuuug

SEQ ID NO: 3185663 - RNA, 15 nt, Human
cagugggccuggcca

SEQ ID NO: 3185664 - RNA, 14 nt, Human
cagugggccuggcc

SEQ ID NO: 3185665 - RNA, 21 nt, Human
cagugggccuggccagcaggu

SEQ ID NO: 3185666 - RNA, 21 nt, Human
caguggugcgaucuggguuca

SEQ ID NO: 3185667 - RNA, 20 nt, Human
caguggugcgaucuggguuc

SEQ ID NO: 3185668 - RNA, 21 nt, Human
caguggggccugaggcuccuu

SEQ ID NO: 3185669 - RNA, 20 nt, Human
caguggggccugaggcuccu

SEQ ID NO: 3185670 - RNA, 20 nt, Human
caguggggaggggcuguggg

SEQ ID NO: 3185671 - RNA, 23 nt, Human
cagugggagcugccuguucagcu

SEQ ID NO: 3185672 - RNA, 20 nt, Human
cagugggagcugccuguuca

SEQ ID NO: 3185673 - RNA, 17 nt, Human
cagugcccacaggauca

SEQ ID NO: 3185674 - RNA, 16 nt, Human
cagugcaugcuguccc

SEQ ID NO: 3185675 - RNA, 17 nt, Human
cagugcaugcugucccu

SEQ ID NO: 3185676 - RNA, 15 nt, Human
cagugcccacaggau

SEQ ID NO: 3185677 - RNA, 13 nt, Human
cagugcccacagg

SEQ ID NO: 3185678 - RNA, 17 nt, Human
cagucuggaaugcagug

SEQ ID NO: 3185679 - RNA, 12 nt, Human
cagugcaucuca

SEQ ID NO: 3185680 - RNA, 21 nt, Human
cagugcauaguuguagacaaa

SEQ ID NO: 3185681 - RNA, 22 nt, Human
cagugcauaguuguagacaaag

SEQ ID NO: 3185682 - RNA, 23 nt, Human
cagugcauaguuguagacaaagu

SEQ ID NO: 3185683 - RNA, 15 nt, Human
cagucuggaaugcag

SEQ ID NO: 3185684 - RNA, 13 nt, Human
cagugcaugcugu

SEQ ID NO: 3185685 - RNA, 14 nt, Human
cagugcaugcuguc

SEQ ID NO: 3185686 - RNA, 18 nt, Human
cagugcaucucagcccac

SEQ ID NO: 3185687 - RNA, 17 nt, Human
cagugcaucucagccca

SEQ ID NO: 3185688 - RNA, 16 nt, Human
cagugcaucucagccc

SEQ ID NO: 3185689 - RNA, 15 nt, Human
cagugcaucucagcc

SEQ ID NO: 3185690 - RNA, 21 nt, Human
caguaaacacuguguauuguu

SEQ ID NO: 3185691 - RNA, 15 nt, Human
caguaaacacugugu

SEQ ID NO: 3185692 - RNA, 14 nt, Human
caguaaacacugug

SEQ ID NO: 3185693 - RNA, 12 nt, Human
caguaaacacug

SEQ ID NO: 3185694 - RNA, 14 nt, Human
cagguuuugcacuc

SEQ ID NO: 3185695 - RNA, 23 nt, Human
cagguuugggaccccuggugguu

SEQ ID NO: 3185696 - RNA, 17 nt, Human
cagguuuuaaaagccuu

SEQ ID NO: 3185697 - RNA, 16 nt, Human
cagguuuuccugaaga

SEQ ID NO: 3185698 - RNA, 14 nt, Human
cagguuuaagcugu

SEQ ID NO: 3185699 - RNA, 12 nt, Human
cagguuuuccug

SEQ ID NO: 3185700 - RNA, 19 nt, Human
caggugccaguuauggcua

SEQ ID NO: 3185701 - RNA, 21 nt, Human
caggugcacaagcuccaagcu

SEQ ID NO: 3185702 - RNA, 18 nt, Human
caggugcccgccaccaca

SEQ ID NO: 3185703 - RNA, 14 nt, Human
caggugcccgccac

SEQ ID NO: 3185704 - RNA, 21 nt, Human
cagguuggugggggccucggu

SEQ ID NO: 3185705 - RNA, 23 nt, Human
cagguugucugaagucacugcac

SEQ ID NO: 3185706 - RNA, 20 nt, Human
cagguuguuagaaaaaugga

SEQ ID NO: 3185707 - RNA, 15 nt, Human
caggugccuccugac

SEQ ID NO: 3185708 - RNA, 22 nt, Human
cagguugucugaagucacugca

SEQ ID NO: 3185709 - RNA, 20 nt, Human
caggugauccacccaccuca

SEQ ID NO: 3185710 - RNA, 21 nt, Human
caggugauccacccaccucag

SEQ ID NO: 3185711 - RNA, 17 nt, Human
caggugcacaagcucca

SEQ ID NO: 3185712 - RNA, 18 nt, Human
caggugcacaagcuccaa

SEQ ID NO: 3185713 - RNA, 19 nt, Human
caggugcacaagcuccaag

SEQ ID NO: 3185714 - RNA, 20 nt, Human
caggugcacaagcuccaagc

SEQ ID NO: 3185715 - RNA, 23 nt, Human
caggugauccacccaccucagcc

SEQ ID NO: 3185716 - RNA, 22 nt, Human
caggugauccacccaccucagc

SEQ ID NO: 3185717 - RNA, 15 nt, Human
caggugcacaagcuc

SEQ ID NO: 3185718 - RNA, 23 nt, Human
caggugaucugcugcagagcagu

SEQ ID NO: 3185719 - RNA, 16 nt, Human
cagucacaaauuucuc

SEQ ID NO: 3185720 - RNA, 15 nt, Human
cagucacauuccaag

SEQ ID NO: 3185721 - RNA, 14 nt, Human
cagucaauuacaug

SEQ ID NO: 3185722 - RNA, 17 nt, Human
caguaaacuuagaguuu

SEQ ID NO: 3185723 - RNA, 16 nt, Human
caguaaaccugucuga

SEQ ID NO: 3185724 - RNA, 13 nt, Human
caguaaaccuguc

SEQ ID NO: 3185725 - RNA, 16 nt, Human
cagggaugguguucaa

SEQ ID NO: 3185726 - RNA, 20 nt, Human
cagggcucagcggggacagc

SEQ ID NO: 3185727 - RNA, 23 nt, Human
cagggcucagcggggacagcucc

SEQ ID NO: 3185728 - RNA, 21 nt, Human
cagggcucagcggggacagcu

SEQ ID NO: 3185729 - RNA, 18 nt, Human
cagggauaacaaagaacc

SEQ ID NO: 3185730 - RNA, 16 nt, Human
cagggcugaggccucu

SEQ ID NO: 3185731 - RNA, 18 nt, Human
cagggcugaggccucuca

SEQ ID NO: 3185732 - RNA, 19 nt, Human
caggggaaaaucagccugc

SEQ ID NO: 3185733 - RNA, 17 nt, Human
caggggaaaaucagccu

SEQ ID NO: 3185734 - RNA, 20 nt, Human
caggggaaaaucagccugcu

SEQ ID NO: 3185735 - RNA, 12 nt, Human
caggcugggaga

SEQ ID NO: 3185736 - RNA, 14 nt, Human
caggcugggagagc

SEQ ID NO: 3185737 - RNA, 20 nt, Human
caggcugggcuucaguggca

SEQ ID NO: 3185738 - RNA, 19 nt, Human
caggcugggcuucaguggc

SEQ ID NO: 3185739 - RNA, 22 nt, Human
caggcugggcuucaguggcagc

SEQ ID NO: 3185740 - RNA, 21 nt, Human
caggcugggcuucaguggcag

SEQ ID NO: 3185741 - RNA, 16 nt, Human
caggggacacccagaa

SEQ ID NO: 3185742 - RNA, 13 nt, Human
caggcacaggcag

SEQ ID NO: 3185743 - RNA, 12 nt, Human
caggcacaggca

SEQ ID NO: 3185744 - RNA, 17 nt, Human
caggcacaggcagggca

SEQ ID NO: 3185745 - RNA, 16 nt, Human
caggcacaggcagggc

SEQ ID NO: 3185746 - RNA, 15 nt, Human
caggcacaggcaggg

SEQ ID NO: 3185747 - RNA, 14 nt, Human
caggcacaggcagg

SEQ ID NO: 3185748 - RNA, 15 nt, Human
caggccagagggagu

SEQ ID NO: 3185749 - RNA, 13 nt, Human
caggccagaggga

SEQ ID NO: 3185750 - RNA, 18 nt, Human
caggcagauacaggaaaa

SEQ ID NO: 3185751 - RNA, 15 nt, Human
caggccacuugauga

SEQ ID NO: 3185752 - RNA, 19 nt, Human
caggcacaggcagggcagg

SEQ ID NO: 3185753 - RNA, 18 nt, Human
caggcacaggcagggcag

SEQ ID NO: 3185754 - RNA, 14 nt, Human
caggcagagcccag

SEQ ID NO: 3185755 - RNA, 19 nt, Human
caggccaggcccucugccc

SEQ ID NO: 3185756 - RNA, 17 nt, Human
caggccaggcccucugc

SEQ ID NO: 3185757 - RNA, 18 nt, Human
caggccaggcccucugcc

SEQ ID NO: 3185758 - RNA, 17 nt, Human
caggccagcugcuuggg

SEQ ID NO: 3185759 - RNA, 19 nt, Human
caggccagcugcuugggcu

SEQ ID NO: 3185760 - RNA, 21 nt, Human
caggccagcugcuugggcuuc

SEQ ID NO: 3185761 - RNA, 22 nt, Human
cagaggggguggccucccaacu

SEQ ID NO: 3185762 - RNA, 23 nt, Human
cagaggggguggccucccaacuc

SEQ ID NO: 3185763 - RNA, 19 nt, Human
cagaucaagggccuaucuu

SEQ ID NO: 3185764 - RNA, 17 nt, Human
cagagguugcagugagc

SEQ ID NO: 3185765 - RNA, 16 nt, Human
cagagguugcagugag

SEQ ID NO: 3185766 - RNA, 15 nt, Human
cagagguccacaaca

SEQ ID NO: 3185767 - RNA, 20 nt, Human
cagagguccacaacacacag

SEQ ID NO: 3185768 - RNA, 19 nt, Human
cagauccccaagccuggca

SEQ ID NO: 3185769 - RNA, 15 nt, Human
cagauccccaagccu

SEQ ID NO: 3185770 - RNA, 15 nt, Human
cagaucagccagaag

SEQ ID NO: 3185771 - RNA, 13 nt, Human
cagaucagccaga

SEQ ID NO: 3185772 - RNA, 15 nt, Human
cagauucuuuccuga

SEQ ID NO: 3185773 - RNA, 17 nt, Human
cagauucuuuccugagg

SEQ ID NO: 3185774 - RNA, 18 nt, Human
cagauucuuuccugaggc

SEQ ID NO: 3185775 - RNA, 19 nt, Human
cagauucuuuccugaggcu

SEQ ID NO: 3185776 - RNA, 20 nt, Human
cagcaguugcugguaaaaug

SEQ ID NO: 3185777 - RNA, 21 nt, Human
cagcaguugcugguaaaauga

SEQ ID NO: 3185778 - RNA, 22 nt, Human
cagcaguugcugguaaaaugaa

SEQ ID NO: 3185779 - RNA, 23 nt, Human
cagcaguugcugguaaaaugaag

SEQ ID NO: 3185780 - RNA, 21 nt, Human
cagcaguuuucuuuuaauuuu

SEQ ID NO: 3185781 - RNA, 12 nt, Human
cagcauaaagaa

SEQ ID NO: 3185782 - RNA, 22 nt, Human
cagcaguugaaaagacuccaaa

SEQ ID NO: 3185783 - RNA, 17 nt, Human
cagcaguugcugguaaa

SEQ ID NO: 3185784 - RNA, 16 nt, Human
cagcagugagagcaga

SEQ ID NO: 3185785 - RNA, 18 nt, Human
cagauucuuuuaugugau

SEQ ID NO: 3185786 - RNA, 12 nt, Human
cagauucuuuua

SEQ ID NO: 3185787 - RNA, 20 nt, Human
cagauucuuuccugaggcug

SEQ ID NO: 3185788 - RNA, 22 nt, Human
cagauucuuuccugaggcuggg

SEQ ID NO: 3185789 - RNA, 16 nt, Human
cagccagccuggcugg

SEQ ID NO: 3185790 - RNA, 15 nt, Human
cagccagccuggcug

SEQ ID NO: 3185791 - RNA, 14 nt, Human
cagccagccuggcu

SEQ ID NO: 3185792 - RNA, 23 nt, Human
cagccagggaaagacuggcaaga

SEQ ID NO: 3185793 - RNA, 22 nt, Human
cagccagggaaagacuggcaag

SEQ ID NO: 3185794 - RNA, 15 nt, Human
cagccaggagagcuu

SEQ ID NO: 3185795 - RNA, 18 nt, Human
cagccaggagagcuuagg

SEQ ID NO: 3185796 - RNA, 23 nt, Human
cagccaggagagcuuagggucuc

SEQ ID NO: 3185797 - RNA, 20 nt, Human
cagcaucauggagguuugaa

SEQ ID NO: 3185798 - RNA, 13 nt, Human
cagccagccuggc

SEQ ID NO: 3185799 - RNA, 19 nt, Human
cagccgagauagccaaggc

SEQ ID NO: 3185800 - RNA, 17 nt, Human
cagccucugaaaaccaa

SEQ ID NO: 3185801 - RNA, 12 nt, Human
cagccugcucca

SEQ ID NO: 3185802 - RNA, 19 nt, Human
cagccugcuaauuccccag

SEQ ID NO: 3185803 - RNA, 21 nt, Human
cagccucugggcccacauccg

SEQ ID NO: 3185804 - RNA, 13 nt, Human
cagccucugggcc

SEQ ID NO: 3185805 - RNA, 21 nt, Human
cagcggggacagcuccuucug

SEQ ID NO: 3185806 - RNA, 19 nt, Human
cagcggggacagcuccuuc

SEQ ID NO: 3185807 - RNA, 18 nt, Human
cagcggggacagcuccuu

SEQ ID NO: 3185808 - RNA, 20 nt, Human
cagcuccccucggagaagag

SEQ ID NO: 3185809 - RNA, 20 nt, Human
cagcucccgcuccgggcucc

SEQ ID NO: 3185810 - RNA, 21 nt, Human
cagcucccucaaagaggcagu

SEQ ID NO: 3185811 - RNA, 23 nt, Human
cagcucccgcuccgggcuccgac

SEQ ID NO: 3185812 - RNA, 22 nt, Human
cagcuccccucggagaagagcu

SEQ ID NO: 3185813 - RNA, 21 nt, Human
cagcuccccucggagaagagc

SEQ ID NO: 3185814 - RNA, 22 nt, Human
cagcuccggcguguguucagug

SEQ ID NO: 3185815 - RNA, 17 nt, Human
cagcucccuucuguuga

SEQ ID NO: 3185816 - RNA, 15 nt, Human
cagcucccuucuguu

SEQ ID NO: 3185817 - RNA, 14 nt, Human
cagcucccuucugu

SEQ ID NO: 3185818 - RNA, 13 nt, Human
cagcucccuucug

SEQ ID NO: 3185819 - RNA, 12 nt, Human
cagcucccuucu

SEQ ID NO: 3185820 - RNA, 14 nt, Human
cagcucccccagcu

SEQ ID NO: 3185821 - RNA, 16 nt, Human
cagcucccccagcucc

SEQ ID NO: 3185822 - RNA, 15 nt, Human
cagcucccccagcuc

SEQ ID NO: 3185823 - RNA, 23 nt, Human
cagcuguugacucuaguacugug

SEQ ID NO: 3185824 - RNA, 19 nt, Human
cagcuguugacucuaguac

SEQ ID NO: 3185825 - RNA, 14 nt, Human
cagcuguugacucu

SEQ ID NO: 3185826 - RNA, 21 nt, Human
cagcuguugucucuucuccuu

SEQ ID NO: 3185827 - RNA, 19 nt, Human
cagcuguugucucuucucc

SEQ ID NO: 3185828 - RNA, 17 nt, Human
cagcuguugucucuucu

SEQ ID NO: 3185829 - RNA, 14 nt, Human
cagcuguugucucu

SEQ ID NO: 3185830 - RNA, 23 nt, Human
cagcuguuucuagaguuccuacc

SEQ ID NO: 3185831 - RNA, 22 nt, Human
cagcuguugucucuucuccuua

SEQ ID NO: 3185832 - RNA, 24 nt, Human
cagcuguuucuagaguuccuacca

SEQ ID NO: 3185833 - RNA, 19 nt, Human
cagcuguucagcugguuga

SEQ ID NO: 3185834 - RNA, 24 nt, Human
cagcugugcucuggacaggcaugu

SEQ ID NO: 3185835 - RNA, 20 nt, Human
cagcugugcucuggacaggc

SEQ ID NO: 3185836 - RNA, 19 nt, Human
cagcugugcucuggacagg

SEQ ID NO: 3185837 - RNA, 13 nt, Human
cagcugccuggga

SEQ ID NO: 3185838 - RNA, 14 nt, Human
cagcugccugggau

SEQ ID NO: 3185839 - RNA, 12 nt, Human
cagcugccuggg

SEQ ID NO: 3185840 - RNA, 12 nt, Human
cagcugccugca

SEQ ID NO: 3185841 - RNA, 19 nt, Human
cagcugagggugagugggu

SEQ ID NO: 3185842 - RNA, 16 nt, Human
caggaaaagcugcuga

SEQ ID NO: 3185843 - RNA, 15 nt, Human
caggaaaagcugcug

SEQ ID NO: 3185844 - RNA, 18 nt, Human
caggaaaagcugcugaca

SEQ ID NO: 3185845 - RNA, 14 nt, Human
ccacuccuccuagc

SEQ ID NO: 3185846 - RNA, 18 nt, Human
ccacucucagaggcccca

SEQ ID NO: 3185847 - RNA, 11 nt, Human
ccacucucaga

SEQ ID NO: 3185848 - RNA, 17 nt, Human
ccacucucagaggcccc

SEQ ID NO: 3185849 - RNA, 16 nt, Human
ccacucucagaggccc

SEQ ID NO: 3185850 - RNA, 15 nt, Human
ccacucucagaggcc

SEQ ID NO: 3185851 - RNA, 13 nt, Human
ccacucucagagg

SEQ ID NO: 3185852 - RNA, 17 nt, Human
ccacucccugcaaccug

SEQ ID NO: 3185853 - RNA, 13 nt, Human
ccaccgccuccua

SEQ ID NO: 3185854 - RNA, 21 nt, Human
ccaccuuugaagaaguaagga

SEQ ID NO: 3185855 - RNA, 22 nt, Human
ccaccgcagacaggaccaggga

SEQ ID NO: 3185856 - RNA, 19 nt, Human
ccaccgcagacaggaccag

SEQ ID NO: 3185857 - RNA, 12 nt, Human
ccacccuuucua

SEQ ID NO: 3185858 - RNA, 16 nt, Human
ccacgcccccacuggu

SEQ ID NO: 3185859 - RNA, 17 nt, Human
ccacgcccccacuggug

SEQ ID NO: 3185860 - RNA, 18 nt, Human
ccacgcccccacugguga

SEQ ID NO: 3185861 - RNA, 19 nt, Human
ccacgcccccacuggugac

SEQ ID NO: 3185862 - RNA, 13 nt, Human
ccacgcccccacu

SEQ ID NO: 3185863 - RNA, 13 nt, Human
ccacgcccggcua

SEQ ID NO: 3185864 - RNA, 21 nt, Human
ccaccacacugauccagcccu

SEQ ID NO: 3185865 - RNA, 17 nt, Human
ccaccacacccagccca

SEQ ID NO: 3185866 - RNA, 14 nt, Human
ccacagcuccuuuu

SEQ ID NO: 3185867 - RNA, 16 nt, Human
ccacagcuccuuuucc

SEQ ID NO: 3185868 - RNA, 15 nt, Human
ccacagcuccuuuuc

SEQ ID NO: 3185869 - RNA, 20 nt, Human
ccaccacaguccccagagug

SEQ ID NO: 3185870 - RNA, 13 nt, Human
ccaccaucaagcc

SEQ ID NO: 3185871 - RNA, 14 nt, Human
ccaccaucaagcca

SEQ ID NO: 3185872 - RNA, 15 nt, Human
ccacccuuguuccag

SEQ ID NO: 3185873 - RNA, 15 nt, Human
ccacccugugcagaa

SEQ ID NO: 3185874 - RNA, 23 nt, Human
ccacagcaguugaaaagacucca

SEQ ID NO: 3185875 - RNA, 18 nt, Human
ccacagcaguugaaaaga

SEQ ID NO: 3185876 - RNA, 17 nt, Human
ccacagcaguugaaaag

SEQ ID NO: 3185877 - RNA, 12 nt, Human
ccacagcaguug

SEQ ID NO: 3185878 - RNA, 22 nt, Human
ccacagcaacgaucacaaauga

SEQ ID NO: 3185879 - RNA, 17 nt, Human
ccaaauguucaucaaug

SEQ ID NO: 3185880 - RNA, 14 nt, Human
ccaacucaccccag

SEQ ID NO: 3185881 - RNA, 23 nt, Human
ccaaauggaaaugggcagagcag

SEQ ID NO: 3185882 - RNA, 14 nt, Human
ccaaaugguacaaa

SEQ ID NO: 3185883 - RNA, 19 nt, Human
ccaaauggauuccuguuuc

SEQ ID NO: 3185884 - RNA, 15 nt, Human
ccaacugaucuguua

SEQ ID NO: 3185885 - RNA, 16 nt, Human
ccaacucaccccagcc

SEQ ID NO: 3185886 - RNA, 17 nt, Human
ccaacucaccccagccc

SEQ ID NO: 3185887 - RNA, 18 nt, Human
ccaacucaccccagcccc

SEQ ID NO: 3185888 - RNA, 20 nt, Human
ccaaaugugugcccagcuua

SEQ ID NO: 3185889 - RNA, 19 nt, Human
ccaaaugugugcccagcuu

SEQ ID NO: 3185890 - RNA, 17 nt, Human
ccaagcucugcuccucu

SEQ ID NO: 3185891 - RNA, 12 nt, Human
ccaagcucugcu

SEQ ID NO: 3185892 - RNA, 18 nt, Human
ccaagcucugcuccucuc

SEQ ID NO: 3185893 - RNA, 14 nt, Human
ccaaugcacuuugu

SEQ ID NO: 3185894 - RNA, 15 nt, Human
ccaaugauggucacc

SEQ ID NO: 3185895 - RNA, 17 nt, Human
ccaauauuuaccagacc

SEQ ID NO: 3185896 - RNA, 22 nt, Human
ccaaucaguagcuuaagaaaaa

SEQ ID NO: 3185897 - RNA, 12 nt, Human
ccaaugaauaau

SEQ ID NO: 3185898 - RNA, 23 nt, Human
ccaaugaauaauggaaaaugcca

SEQ ID NO: 3185899 - RNA, 18 nt, Human
ccaaugaauuauuauaua

SEQ ID NO: 3185900 - RNA, 17 nt, Human
ccaaugggagcucaugg

SEQ ID NO: 3185901 - RNA, 14 nt, Human
ccaaugggagcuca

SEQ ID NO: 3185902 - RNA, 16 nt, Human
cauuugugcguaugca

SEQ ID NO: 3185903 - RNA, 16 nt, Human
cauuugugaaaugaug

SEQ ID NO: 3185904 - RNA, 19 nt, Human
cauuuguaugucaaagcuu

SEQ ID NO: 3185905 - RNA, 20 nt, Human
cauuuguaugucaaagcuuu

SEQ ID NO: 3185906 - RNA, 22 nt, Human
cauuuuuuauggcugcauagua

SEQ ID NO: 3185907 - RNA, 20 nt, Human
cauuuuuuauauauaugcau

SEQ ID NO: 3185908 - RNA, 16 nt, Human
cauuuuuuccuguuug

SEQ ID NO: 3185909 - RNA, 20 nt, Human
cauuuuuugaaaugcugaaa

SEQ ID NO: 3185910 - RNA, 14 nt, Human
cauuuuuugaaaug

SEQ ID NO: 3185911 - RNA, 16 nt, Human
cauuuuuuucuaccua

SEQ ID NO: 3185912 - RNA, 18 nt, Human
cauuuuuuucuaccuaua

SEQ ID NO: 3185913 - RNA, 23 nt, Human
cauuuuuuucuaccuauaacacu

SEQ ID NO: 3185914 - RNA, 12 nt, Human
ccaaaagaaaaa

SEQ ID NO: 3185915 - RNA, 11 nt, Human
ccaaaagaaaa

SEQ ID NO: 3185916 - RNA, 21 nt, Human
ccaaaacucuccucugcugcu

SEQ ID NO: 3185917 - RNA, 20 nt, Human
ccaaaacucuccucugcugc

SEQ ID NO: 3185918 - RNA, 15 nt, Human
cauaugcuucuuuaa

SEQ ID NO: 3185919 - RNA, 15 nt, Human
cauauuacaauauuu

SEQ ID NO: 3185920 - RNA, 17 nt, Human
cauauuacaauauuugu

SEQ ID NO: 3185921 - RNA, 16 nt, Human
cauauuacaauauuug

SEQ ID NO: 3185922 - RNA, 21 nt, Human
cauauuaaguaagucucaagg

SEQ ID NO: 3185923 - RNA, 17 nt, Human
cauauucuguuggccag

SEQ ID NO: 3185924 - RNA, 22 nt, Human
cauauucaggaagcucagggcc

SEQ ID NO: 3185925 - RNA, 22 nt, Human
cauauuacaauauuugugugcu

SEQ ID NO: 3185926 - RNA, 19 nt, Human
cauauuacaauauuugugu

SEQ ID NO: 3185927 - RNA, 14 nt, Human
caucacuggcaugg

SEQ ID NO: 3185928 - RNA, 13 nt, Human
caucacuuaaaac

SEQ ID NO: 3185929 - RNA, 14 nt, Human
caucacuuaaaaca

SEQ ID NO: 3185930 - RNA, 15 nt, Human
cauccuggcacccgg

SEQ ID NO: 3185931 - RNA, 14 nt, Human
caucacuucccuac

SEQ ID NO: 3185932 - RNA, 12 nt, Human
caucacuucccu

SEQ ID NO: 3185933 - RNA, 21 nt, Human
cauccccuguagagugggagc

SEQ ID NO: 3185934 - RNA, 15 nt, Human
caucacuuaaaacac

SEQ ID NO: 3185935 - RNA, 22 nt, Human
cauccuggcacccggccccugc

SEQ ID NO: 3185936 - RNA, 12 nt, Human
caucgcaaugua

SEQ ID NO: 3185937 - RNA, 12 nt, Human
caucugcugucu

SEQ ID NO: 3185938 - RNA, 21 nt, Human
caucugcugucuuuucuuugc

SEQ ID NO: 3185939 - RNA, 14 nt, Human
caucugcugucuuu

SEQ ID NO: 3185940 - RNA, 22 nt, Human
caucuggaaguuaaagugaggc

SEQ ID NO: 3185941 - RNA, 13 nt, Human
caucugugaauaa

SEQ ID NO: 3185942 - RNA, 14 nt, Human
caucugugaauaag

SEQ ID NO: 3185943 - RNA, 22 nt, Human
caucuggaagagcuaggcaggg

SEQ ID NO: 3185944 - RNA, 17 nt, Human
cauggcucccccuccac

SEQ ID NO: 3185945 - RNA, 18 nt, Human
cauggcuacuugcuuuga

SEQ ID NO: 3185946 - RNA, 14 nt, Human
caugggaaugaaug

SEQ ID NO: 3185947 - RNA, 15 nt, Human
caugggaaugaaugu

SEQ ID NO: 3185948 - RNA, 16 nt, Human
caugggaaugaauguc

SEQ ID NO: 3185949 - RNA, 17 nt, Human
caugggaaugaauguca

SEQ ID NO: 3185950 - RNA, 20 nt, Human
caugcuccuggcccacugca

SEQ ID NO: 3185951 - RNA, 13 nt, Human
caugcuccuuaau

SEQ ID NO: 3185952 - RNA, 22 nt, Human
caugcuccuuaauggcgccaug

SEQ ID NO: 3185953 - RNA, 13 nt, Human
caugauguuuucc

SEQ ID NO: 3185954 - RNA, 12 nt, Human
caugauuucaca

SEQ ID NO: 3185955 - RNA, 17 nt, Human
caugauuucacaaauau

SEQ ID NO: 3185956 - RNA, 16 nt, Human
caugauuucacaaaua

SEQ ID NO: 3185957 - RNA, 15 nt, Human
caugauuucacaaau

SEQ ID NO: 3185958 - RNA, 14 nt, Human
caugauuucacaaa

SEQ ID NO: 3185959 - RNA, 19 nt, Human
caugauuucacaaauauua

SEQ ID NO: 3185960 - RNA, 18 nt, Human
caugauuucacaaauauu

SEQ ID NO: 3185961 - RNA, 22 nt, Human
caugauuucacaaauauuaaaa

SEQ ID NO: 3185962 - RNA, 23 nt, Human
caugucccuaccgagucucuucu

SEQ ID NO: 3185963 - RNA, 17 nt, Human
cauguuacuggauaaau

SEQ ID NO: 3185964 - RNA, 21 nt, Human
cauguuacuggauaaauuguu

SEQ ID NO: 3185965 - RNA, 22 nt, Human
caugucccuaccgagucucuuc

SEQ ID NO: 3185966 - RNA, 16 nt, Human
caugucccuaccgagu

SEQ ID NO: 3185967 - RNA, 19 nt, Human
caugucaaacgugaaaaug

SEQ ID NO: 3185968 - RNA, 14 nt, Human
caugucaaacguga

SEQ ID NO: 3185969 - RNA, 13 nt, Human
cauguuggccagg

SEQ ID NO: 3185970 - RNA, 15 nt, Human
cauguuggccaggcu

SEQ ID NO: 3185971 - RNA, 14 nt, Human
cauguuggccaggc

SEQ ID NO: 3185972 - RNA, 16 nt, Human
cauguuggccaggcug

SEQ ID NO: 3185973 - RNA, 19 nt, Human
cauguuggccaggcugguc

SEQ ID NO: 3185974 - RNA, 23 nt, Human
cauguuguagauacaaucagcug

SEQ ID NO: 3185975 - RNA, 14 nt, Human
cauucuccaccugc

SEQ ID NO: 3185976 - RNA, 16 nt, Human
cauucuccaccugcca

SEQ ID NO: 3185977 - RNA, 13 nt, Human
cauucuccaccug

SEQ ID NO: 3185978 - RNA, 18 nt, Human
cauuauaaucaccagggc

SEQ ID NO: 3185979 - RNA, 23 nt, Human
cauucgggccccaccugcagcuc

SEQ ID NO: 3185980 - RNA, 17 nt, Human
cauucguacauaauacu

SEQ ID NO: 3185981 - RNA, 19 nt, Human
cauucguacauaauacuga

SEQ ID NO: 3185982 - RNA, 17 nt, Human
ugugauggggcccugcc

SEQ ID NO: 3185983 - RNA, 11 nt, Human
ugugauguguc

SEQ ID NO: 3185984 - RNA, 18 nt, Human
ugugaugugacauuuguc

SEQ ID NO: 3185985 - RNA, 17 nt, Human
ugugaugugacauuugu

SEQ ID NO: 3185986 - RNA, 16 nt, Human
ugugaugugacauuug

SEQ ID NO: 3185987 - RNA, 15 nt, Human
ugugaugugacauuu

SEQ ID NO: 3185988 - RNA, 19 nt, Human
ugugaugugacauuuguca

SEQ ID NO: 3185989 - RNA, 16 nt, Human
agugagccgagauugu

SEQ ID NO: 3185990 - RNA, 15 nt, Human
ugugauggggcccug

SEQ ID NO: 3185991 - RNA, 16 nt, Human
ugugauggggcccugc

SEQ ID NO: 3185992 - RNA, 22 nt, Human
agugagcacuaaggugugcucu

SEQ ID NO: 3185993 - RNA, 14 nt, Human
agugagagcagaug

SEQ ID NO: 3185994 - RNA, 12 nt, Human
agugagagcaga

SEQ ID NO: 3185995 - RNA, 16 nt, Human
agugaaagaggcagcu

SEQ ID NO: 3185996 - RNA, 14 nt, Human
agugagacagcucu

SEQ ID NO: 3185997 - RNA, 22 nt, Human
agugaaagaggcagcuugaaac

SEQ ID NO: 3185998 - RNA, 17 nt, Human
agucuuuuuuuuuuaag

SEQ ID NO: 3185999 - RNA, 18 nt, Human
agucuuuuuuuuuuaagu

SEQ ID NO: 3186000 - RNA, 20 nt, Human
agugaaaaauguuaggacau

SEQ ID NO: 3186001 - RNA, 16 nt, Human
agugaaaacuuuguag

SEQ ID NO: 3186002 - RNA, 15 nt, Human
agugaaaacuuugua

SEQ ID NO: 3186003 - RNA, 14 nt, Human
agugaaaauauagc

SEQ ID NO: 3186004 - RNA, 18 nt, Human
agugaaacaucauagaaa

SEQ ID NO: 3186005 - RNA, 17 nt, Human
agugagacucugucuca

SEQ ID NO: 3186006 - RNA, 16 nt, Human
agugagacucugucuc

SEQ ID NO: 3186007 - RNA, 22 nt, Human
agugagacucugucucaaaaaa

SEQ ID NO: 3186008 - RNA, 17 nt, Human
agugagacccugucuca

SEQ ID NO: 3186009 - RNA, 13 nt, Human
agugagacagacu

SEQ ID NO: 3186010 - RNA, 21 nt, Human
agugagacccugucucaaaaa

SEQ ID NO: 3186011 - RNA, 13 nt, Human
agugagacucugu

SEQ ID NO: 3186012 - RNA, 15 nt, Human
ugugagcagcaccca

SEQ ID NO: 3186013 - RNA, 23 nt, Human
agucucccccacccuuguuccag

SEQ ID NO: 3186014 - RNA, 14 nt, Human
agucucccucccuu

SEQ ID NO: 3186015 - RNA, 22 nt, Human
ugugagaugcuagaacucccuu

SEQ ID NO: 3186016 - RNA, 19 nt, Human
ugugagcacaaagguagcu

SEQ ID NO: 3186017 - RNA, 13 nt, Human
ugugagaugugua

SEQ ID NO: 3186018 - RNA, 18 nt, Human
ugugagauguguaucagu

SEQ ID NO: 3186019 - RNA, 14 nt, Human
ugugaagagaacca

SEQ ID NO: 3186020 - RNA, 14 nt, Human
ugugaacugaacuc

SEQ ID NO: 3186021 - RNA, 23 nt, Human
ugugaacugaacucugacaacag

SEQ ID NO: 3186022 - RNA, 11 nt, Human
agugaaaaagg

SEQ ID NO: 3186023 - RNA, 17 nt, Human
agugaaaaaggaggaag

SEQ ID NO: 3186024 - RNA, 20 nt, Human
agugaaaaaggaggaagaga

SEQ ID NO: 3186025 - RNA, 23 nt, Human
agugaaaaaggaggaagagaaaa

SEQ ID NO: 3186026 - RNA, 18 nt, Human
agucuuuuaaaaaguauu

SEQ ID NO: 3186027 - RNA, 13 nt, Human
agucuuuuaaaaa

SEQ ID NO: 3186028 - RNA, 11 nt, Human
agucuuuuguc

SEQ ID NO: 3186029 - RNA, 20 nt, Human
agucuuuuaaaaaguauugc

SEQ ID NO: 3186030 - RNA, 19 nt, Human
agucuuuuaaaaaguauug

SEQ ID NO: 3186031 - RNA, 19 nt, Human
agucuuagaucauaguuuu

SEQ ID NO: 3186032 - RNA, 20 nt, Human
agucuuagaucauaguuuua

SEQ ID NO: 3186033 - RNA, 13 nt, Human
agucuuagaucau

SEQ ID NO: 3186034 - RNA, 18 nt, Human
agucuuagaucauaguuu

SEQ ID NO: 3186035 - RNA, 22 nt, Human
agucuuacauaaaccauuuuug

SEQ ID NO: 3186036 - RNA, 12 nt, Human
agucucugugag

SEQ ID NO: 3186037 - RNA, 13 nt, Human
agucuuaagaacu

SEQ ID NO: 3186038 - RNA, 12 nt, Human
agucccugccaa

SEQ ID NO: 3186039 - RNA, 16 nt, Human
ugucuccuacugagga

SEQ ID NO: 3186040 - RNA, 17 nt, Human
ugucuccuacugaggau

SEQ ID NO: 3186041 - RNA, 17 nt, Human
ugucuccucuucuuugu

SEQ ID NO: 3186042 - RNA, 21 nt, Human
ugucuccucuauccugggcuu

SEQ ID NO: 3186043 - RNA, 17 nt, Human
ugucuccuugguuauau

SEQ ID NO: 3186044 - RNA, 23 nt, Human
aguccccuguuuguuucugaaag

SEQ ID NO: 3186045 - RNA, 13 nt, Human
agucccugccaau

SEQ ID NO: 3186046 - RNA, 14 nt, Human
agucccugccaaug

SEQ ID NO: 3186047 - RNA, 16 nt, Human
agucccugccaaugga

SEQ ID NO: 3186048 - RNA, 13 nt, Human
ugucucugagagu

SEQ ID NO: 3186049 - RNA, 17 nt, Human
ugucucuacuaaaaaua

SEQ ID NO: 3186050 - RNA, 19 nt, Human
ugucucggaaccugugagc

SEQ ID NO: 3186051 - RNA, 12 nt, Human
ugucuuaauuaa

SEQ ID NO: 3186052 - RNA, 13 nt, Human
ugucugaaacauu

SEQ ID NO: 3186053 - RNA, 19 nt, Human
ugucugaaacauuucauaa

SEQ ID NO: 3186054 - RNA, 14 nt, Human
ugucuuaauuaaaa

SEQ ID NO: 3186055 - RNA, 18 nt, Human
ugucuuaauuuucuuuca

SEQ ID NO: 3186056 - RNA, 14 nt, Human
ugucuuauugacag

SEQ ID NO: 3186057 - RNA, 22 nt, Human
ugucucuugguccugcugcagu

SEQ ID NO: 3186058 - RNA, 21 nt, Human
ugucucuuuaaugucacaggc

SEQ ID NO: 3186059 - RNA, 22 nt, Human
ugucucuuuaaugucacaggca

SEQ ID NO: 3186060 - RNA, 17 nt, Human
ugucucuuuuuuaaguu

SEQ ID NO: 3186061 - RNA, 16 nt, Human
ugucucuuuuuuaagu

SEQ ID NO: 3186062 - RNA, 18 nt, Human
ugucucuugguccugcug

SEQ ID NO: 3186063 - RNA, 19 nt, Human
ugucucuugguccugcugc

SEQ ID NO: 3186064 - RNA, 20 nt, Human
ugucucuugguccugcugca

SEQ ID NO: 3186065 - RNA, 21 nt, Human
ugucucuugguccugcugcag

SEQ ID NO: 3186066 - RNA, 12 nt, Human
ugucucuucugg

SEQ ID NO: 3186067 - RNA, 14 nt, Human
ugucucuucuccuu

SEQ ID NO: 3186068 - RNA, 13 nt, Human
ugucucuucuccu

SEQ ID NO: 3186069 - RNA, 14 nt, Human
ugucuucacaacag

SEQ ID NO: 3186070 - RNA, 19 nt, Human
ugucuuauugacaguugug

SEQ ID NO: 3186071 - RNA, 17 nt, Human
ugucuuccuuugcuucc

SEQ ID NO: 3186072 - RNA, 20 nt, Human
ugucuuccuauuucagaagu

SEQ ID NO: 3186073 - RNA, 19 nt, Human
ugucuuccuauuucagaag

SEQ ID NO: 3186074 - RNA, 22 nt, Human
ugucuuccuaucaaaaagauau

SEQ ID NO: 3186075 - RNA, 17 nt, Human
ugucuuccuauuucaga

SEQ ID NO: 3186076 - RNA, 16 nt, Human
ugucuuccuauuucag

SEQ ID NO: 3186077 - RNA, 21 nt, Human
ugucuugcaauggcagccuug

SEQ ID NO: 3186078 - RNA, 20 nt, Human
ugucuugcaauggcagccuu

SEQ ID NO: 3186079 - RNA, 18 nt, Human
ugucuugcaauggcagcc

SEQ ID NO: 3186080 - RNA, 17 nt, Human
ugucuugcaauggcagc

SEQ ID NO: 3186081 - RNA, 15 nt, Human
ugucuugcaauggca

SEQ ID NO: 3186082 - RNA, 23 nt, Human
ugucuucugcuuuguugugugcc

SEQ ID NO: 3186083 - RNA, 15 nt, Human
ugucuucugcuuugu

SEQ ID NO: 3186084 - RNA, 11 nt, Human
ugucuucugcu

SEQ ID NO: 3186085 - RNA, 14 nt, Human
ugucuucugcuuug

SEQ ID NO: 3186086 - RNA, 13 nt, Human
ugucuucugcuuu

SEQ ID NO: 3186087 - RNA, 14 nt, Human
ugucuugcugucau

SEQ ID NO: 3186088 - RNA, 19 nt, Human
ugucuugcacuggccuucu

SEQ ID NO: 3186089 - RNA, 22 nt, Human
ugucuugcacuggccuucugau

SEQ ID NO: 3186090 - RNA, 14 nt, Human
ugucuuuaaaaacu

SEQ ID NO: 3186091 - RNA, 22 nt, Human
ugucuuuaaaaacuguuuuaga

SEQ ID NO: 3186092 - RNA, 15 nt, Human
ugugaaccaccacac

SEQ ID NO: 3186093 - RNA, 23 nt, Human
ugugaaccaccacacccagccca

SEQ ID NO: 3186094 - RNA, 22 nt, Human
ugugaaccaccacacccagccc

SEQ ID NO: 3186095 - RNA, 21 nt, Human
ugugaaccaccacacccagcc

SEQ ID NO: 3186096 - RNA, 16 nt, Human
ugugaaccaccacacc

SEQ ID NO: 3186097 - RNA, 14 nt, Human
ugugaacuauguuu

SEQ ID NO: 3186098 - RNA, 20 nt, Human
agucccaccuuggcugcagg

SEQ ID NO: 3186099 - RNA, 23 nt, Human
agucccaccuuggcugcagggag

SEQ ID NO: 3186100 - RNA, 21 nt, Human
agucccaccuuggcugcaggg

SEQ ID NO: 3186101 - RNA, 15 nt, Human
aguccauaccuuaua

SEQ ID NO: 3186102 - RNA, 14 nt, Human
aguccccuguuugu

SEQ ID NO: 3186103 - RNA, 19 nt, Human
aguccccuguuuguuucug

SEQ ID NO: 3186104 - RNA, 14 nt, Human
aguccccagaacuc

SEQ ID NO: 3186105 - RNA, 13 nt, Human
aguccccagaacu

SEQ ID NO: 3186106 - RNA, 14 nt, Human
agucccacuccaag

SEQ ID NO: 3186107 - RNA, 20 nt, Human
agucccaggcugagccucag

SEQ ID NO: 3186108 - RNA, 19 nt, Human
agucccacuccaagccagc

SEQ ID NO: 3186109 - RNA, 18 nt, Human
agucccacuccaagccag

SEQ ID NO: 3186110 - RNA, 14 nt, Human
ugucuaagaaacau

SEQ ID NO: 3186111 - RNA, 16 nt, Human
ugucuaagaaacauug

SEQ ID NO: 3186112 - RNA, 15 nt, Human
ugucuaagaaacauu

SEQ ID NO: 3186113 - RNA, 19 nt, Human
ugucuaagaaacauuggaa

SEQ ID NO: 3186114 - RNA, 12 nt, Human
agucagauguuu

SEQ ID NO: 3186115 - RNA, 21 nt, Human
agucagauguuugagcagugg

SEQ ID NO: 3186116 - RNA, 19 nt, Human
agucagggguucccuuuuu

SEQ ID NO: 3186117 - RNA, 23 nt, Human
agucagucgccuuucagcaggca

SEQ ID NO: 3186118 - RNA, 22 nt, Human
agucagucgccuuucagcaggc

SEQ ID NO: 3186119 - RNA, 17 nt, Human
agucaucgaguggccca

SEQ ID NO: 3186120 - RNA, 20 nt, Human
ugucccuaccgagucucuuc

SEQ ID NO: 3186121 - RNA, 22 nt, Human
ugucccuaccgagucucuucuc

SEQ ID NO: 3186122 - RNA, 21 nt, Human
ugucccuaccgagucucuucu

SEQ ID NO: 3186123 - RNA, 21 nt, Human
uguccaggcacugcugcccag

SEQ ID NO: 3186124 - RNA, 20 nt, Human
uguccaggcacugcugccca

SEQ ID NO: 3186125 - RNA, 19 nt, Human
uguccaggcacugcugccc

SEQ ID NO: 3186126 - RNA, 23 nt, Human
ugucagcuccccucggagaagag

SEQ ID NO: 3186127 - RNA, 21 nt, Human
ugucagcuccccucggagaag

SEQ ID NO: 3186128 - RNA, 20 nt, Human
ugucagcuccccucggagaa

SEQ ID NO: 3186129 - RNA, 16 nt, Human
ugucagccauuccugu

SEQ ID NO: 3186130 - RNA, 22 nt, Human
ugucagcgcucuggugcugcag

SEQ ID NO: 3186131 - RNA, 12 nt, Human
ugucccuuuucc

SEQ ID NO: 3186132 - RNA, 15 nt, Human
uguccuguaaacacu

SEQ ID NO: 3186133 - RNA, 20 nt, Human
uguccuguaaacacucagcu

SEQ ID NO: 3186134 - RNA, 22 nt, Human
uguccuguaaacacucagcugu

SEQ ID NO: 3186135 - RNA, 23 nt, Human
uguccuguaaacacucagcuguu

SEQ ID NO: 3186136 - RNA, 16 nt, Human
uguccuguaacuguua

SEQ ID NO: 3186137 - RNA, 18 nt, Human
uguccuguaacuguuaca

SEQ ID NO: 3186138 - RNA, 20 nt, Human
uguccuguaacuguuacagu

SEQ ID NO: 3186139 - RNA, 19 nt, Human
uguccugugucaguuuaug

SEQ ID NO: 3186140 - RNA, 21 nt, Human
uguccugugucaguuuauguu

SEQ ID NO: 3186141 - RNA, 15 nt, Human
uguccuguugauuaa

SEQ ID NO: 3186142 - RNA, 19 nt, Human
uguccuguugauuaauuuc

SEQ ID NO: 3186143 - RNA, 18 nt, Human
uguccugugucaguuuau

SEQ ID NO: 3186144 - RNA, 17 nt, Human
uguccugugucaguuua

SEQ ID NO: 3186145 - RNA, 16 nt, Human
uguccugugucaguuu

SEQ ID NO: 3186146 - RNA, 15 nt, Human
uguccugugagaugu

SEQ ID NO: 3186147 - RNA, 18 nt, Human
uguccugugagaugugua

SEQ ID NO: 3186148 - RNA, 20 nt, Human
uguccugugagauguguauc

SEQ ID NO: 3186149 - RNA, 23 nt, Human
uguccugugagauguguaucagu

SEQ ID NO: 3186150 - RNA, 12 nt, Human
ugucccuuucuu

SEQ ID NO: 3186151 - RNA, 17 nt, Human
ugucccuuucuucuccc

SEQ ID NO: 3186152 - RNA, 16 nt, Human
ugucccuuucuucucc

SEQ ID NO: 3186153 - RNA, 15 nt, Human
ugucccuuucuucuc

SEQ ID NO: 3186154 - RNA, 14 nt, Human
ugucccuuucuucu

SEQ ID NO: 3186155 - RNA, 22 nt, Human
uguauuaagcccacaguauauu

SEQ ID NO: 3186156 - RNA, 15 nt, Human
uguauuagucacaga

SEQ ID NO: 3186157 - RNA, 14 nt, Human
ugucaaagugguga

SEQ ID NO: 3186158 - RNA, 15 nt, Human
ugucaaaguggugag

SEQ ID NO: 3186159 - RNA, 19 nt, Human
uguauuauacuuagucaaa

SEQ ID NO: 3186160 - RNA, 17 nt, Human
uguauuauauguaacua

SEQ ID NO: 3186161 - RNA, 15 nt, Human
uguauuauguccugu

SEQ ID NO: 3186162 - RNA, 20 nt, Human
uguauuauguccugugagau

SEQ ID NO: 3186163 - RNA, 14 nt, Human
aguagcugggacua

SEQ ID NO: 3186164 - RNA, 13 nt, Human
aguagcugggacu

SEQ ID NO: 3186165 - RNA, 22 nt, Human
aguagcucugccuuugcucugg

SEQ ID NO: 3186166 - RNA, 14 nt, Human
aguagcucugccuu

SEQ ID NO: 3186167 - RNA, 16 nt, Human
ugucaaaguggugaga

SEQ ID NO: 3186168 - RNA, 19 nt, Human
ugucaaaguggugagaggc

SEQ ID NO: 3186169 - RNA, 19 nt, Human
ugucaaauauuuagaugua

SEQ ID NO: 3186170 - RNA, 13 nt, Human
ugucaaagcuuug

SEQ ID NO: 3186171 - RNA, 20 nt, Human
uguaugugggggucugugug

SEQ ID NO: 3186172 - RNA, 15 nt, Human
uguaucccaugagcc

SEQ ID NO: 3186173 - RNA, 21 nt, Human
uguaugugggggucugugugu

SEQ ID NO: 3186174 - RNA, 22 nt, Human
uguaugugggggucuguguguu

SEQ ID NO: 3186175 - RNA, 14 nt, Human
uguauguguaagua

SEQ ID NO: 3186176 - RNA, 23 nt, Human
uguauuaaauuacauuuguaauu

SEQ ID NO: 3186177 - RNA, 21 nt, Human
uguauuaaauuacauuuguaa

SEQ ID NO: 3186178 - RNA, 19 nt, Human
uguauuaaauuacauuugu

SEQ ID NO: 3186179 - RNA, 18 nt, Human
uguauuaaauuacauuug

SEQ ID NO: 3186180 - RNA, 17 nt, Human
uguauuaaauuacauuu

SEQ ID NO: 3186181 - RNA, 14 nt, Human
uguauuaaauuaca

SEQ ID NO: 3186182 - RNA, 22 nt, Human
uguauuaacacuacucaaagca

SEQ ID NO: 3186183 - RNA, 21 nt, Human
uguauuaacacuacucaaagc

SEQ ID NO: 3186184 - RNA, 21 nt, Human
agguuugggaccccugguggu

SEQ ID NO: 3186185 - RNA, 19 nt, Human
agguuuggugcaaaguauu

SEQ ID NO: 3186186 - RNA, 16 nt, Human
agguuugggaccccug

SEQ ID NO: 3186187 - RNA, 20 nt, Human
agguuuggcuccugcccacu

SEQ ID NO: 3186188 - RNA, 18 nt, Human
agguuuggcuccugccca

SEQ ID NO: 3186189 - RNA, 16 nt, Human
agguuuggcuccugcc

SEQ ID NO: 3186190 - RNA, 14 nt, Human
agguuuggcuccug

SEQ ID NO: 3186191 - RNA, 22 nt, Human
uguauccauccauggggcugau

SEQ ID NO: 3186192 - RNA, 15 nt, Human
uguagagccaggguc

SEQ ID NO: 3186193 - RNA, 12 nt, Human
uguagagccagg

SEQ ID NO: 3186194 - RNA, 12 nt, Human
agguuugaaucu

SEQ ID NO: 3186195 - RNA, 22 nt, Human
aguagcugggacuacaggcacc

SEQ ID NO: 3186196 - RNA, 21 nt, Human
aguagcugggacuacaggcac

SEQ ID NO: 3186197 - RNA, 19 nt, Human
aguagcugggacuacaggc

SEQ ID NO: 3186198 - RNA, 11 nt, Human
aguauuguaca

SEQ ID NO: 3186199 - RNA, 16 nt, Human
aguauuguaaugagug

SEQ ID NO: 3186200 - RNA, 14 nt, Human
aguauugccaaaca

SEQ ID NO: 3186201 - RNA, 18 nt, Human
aguauugccaaacauuaa

SEQ ID NO: 3186202 - RNA, 17 nt, Human
aguauugccaaacauua

SEQ ID NO: 3186203 - RNA, 16 nt, Human
aguauugccaaacauu

SEQ ID NO: 3186204 - RNA, 15 nt, Human
aguauugccaaacau

SEQ ID NO: 3186205 - RNA, 13 nt, Human
aguauuauaaaca

SEQ ID NO: 3186206 - RNA, 22 nt, Human
agucacagagauaauucuagcu

SEQ ID NO: 3186207 - RNA, 20 nt, Human
aguauuuaagccuaaagauu

SEQ ID NO: 3186208 - RNA, 19 nt, Human
aguauuuaagccuaaagau

SEQ ID NO: 3186209 - RNA, 18 nt, Human
aguauuuaagccuaaaga

SEQ ID NO: 3186210 - RNA, 14 nt, Human
aguauuuaagccua

SEQ ID NO: 3186211 - RNA, 22 nt, Human
aguauugccaaacauuaauguu

SEQ ID NO: 3186212 - RNA, 20 nt, Human
agucacauuccaagccucau

SEQ ID NO: 3186213 - RNA, 21 nt, Human
aguauuuaagccuaaagauuu

SEQ ID NO: 3186214 - RNA, 15 nt, Human
ugucagcauagaagu

SEQ ID NO: 3186215 - RNA, 17 nt, Human
agucacugagacagccc

SEQ ID NO: 3186216 - RNA, 15 nt, Human
agucacugagacagc

SEQ ID NO: 3186217 - RNA, 16 nt, Human
agucacugagacagcc

SEQ ID NO: 3186218 - RNA, 23 nt, Human
ugggaauaagugccaggauggaa

SEQ ID NO: 3186219 - RNA, 20 nt, Human
ugggaauauaauauugucuc

SEQ ID NO: 3186220 - RNA, 12 nt, Human
aggggaggccaa

SEQ ID NO: 3186221 - RNA, 13 nt, Human
agggggcugggac

SEQ ID NO: 3186222 - RNA, 17 nt, Human
aggggagggggcaaagg

SEQ ID NO: 3186223 - RNA, 20 nt, Human
aggggaggccaucuggagag

SEQ ID NO: 3186224 - RNA, 16 nt, Human
aggggaggccaucugg

SEQ ID NO: 3186225 - RNA, 15 nt, Human
aggggaggccaucug

SEQ ID NO: 3186226 - RNA, 21 nt, Human
agggucuugguuccagccugc

SEQ ID NO: 3186227 - RNA, 22 nt, Human
agggucuugguuccagccugcc

SEQ ID NO: 3186228 - RNA, 16 nt, Human
aggguaucaggugcug

SEQ ID NO: 3186229 - RNA, 12 nt, Human
aggguagggugg

SEQ ID NO: 3186230 - RNA, 18 nt, Human
aggguaggcagccugaga

SEQ ID NO: 3186231 - RNA, 21 nt, Human
aggguacaaaaaauucaguga

SEQ ID NO: 3186232 - RNA, 22 nt, Human
aggguaauaaccagacacaaac

SEQ ID NO: 3186233 - RNA, 12 nt, Human
aggguacaugug

SEQ ID NO: 3186234 - RNA, 19 nt, Human
aggguacuaaggaaucuuu

SEQ ID NO: 3186235 - RNA, 20 nt, Human
agggguccccuccaggagua

SEQ ID NO: 3186236 - RNA, 22 nt, Human
aggggucuugcaaaauuccuga

SEQ ID NO: 3186237 - RNA, 12 nt, Human
aggguaaguauu

SEQ ID NO: 3186238 - RNA, 12 nt, Human
agggggcuuccu

SEQ ID NO: 3186239 - RNA, 15 nt, Human
ugggucugugugugu

SEQ ID NO: 3186240 - RNA, 13 nt, Human
ugggucugugugu

SEQ ID NO: 3186241 - RNA, 21 nt, Human
agggugaguccuccagaacuc

SEQ ID NO: 3186242 - RNA, 18 nt, Human
agggugaguccuccagaa

SEQ ID NO: 3186243 - RNA, 12 nt, Human
agggugagccca

SEQ ID NO: 3186244 - RNA, 22 nt, Human
agggugaugggaaagcauugua

SEQ ID NO: 3186245 - RNA, 21 nt, Human
agggugaugggaaagcauugu

SEQ ID NO: 3186246 - RNA, 14 nt, Human
uggguggaugccug

SEQ ID NO: 3186247 - RNA, 22 nt, Human
ugggucuuguuuuuuuuuucca

SEQ ID NO: 3186248 - RNA, 23 nt, Human
uggguggaugccugguggcagcu

SEQ ID NO: 3186249 - RNA, 15 nt, Human
ugguaaaaugaagaa

SEQ ID NO: 3186250 - RNA, 18 nt, Human
ugguaaaaugaagaauuu

SEQ ID NO: 3186251 - RNA, 16 nt, Human
uggguuuuguucuugu

SEQ ID NO: 3186252 - RNA, 15 nt, Human
ugguccauagagagc

SEQ ID NO: 3186253 - RNA, 16 nt, Human
ugguccauagagagca

SEQ ID NO: 3186254 - RNA, 16 nt, Human
ugguccacuuuuccag

SEQ ID NO: 3186255 - RNA, 15 nt, Human
ugguccacuuuucca

SEQ ID NO: 3186256 - RNA, 14 nt, Human
ugguccacuuuucc

SEQ ID NO: 3186257 - RNA, 11 nt, Human
ugguccaaaua

SEQ ID NO: 3186258 - RNA, 15 nt, Human
ugguccaaauaggca

SEQ ID NO: 3186259 - RNA, 21 nt, Human
uggucaccaaaucagcugcua

SEQ ID NO: 3186260 - RNA, 23 nt, Human
uggucaccaaaucagcugcuacu

SEQ ID NO: 3186261 - RNA, 20 nt, Human
uggucaccaaaucagcugcu

SEQ ID NO: 3186262 - RNA, 22 nt, Human
ugguaauuuaagauuccagaga

SEQ ID NO: 3186263 - RNA, 19 nt, Human
ugguaaaaugaagaauuua

SEQ ID NO: 3186264 - RNA, 19 nt, Human
ugguccauagagagcaaga

SEQ ID NO: 3186265 - RNA, 20 nt, Human
ugguccaucugguuuucucu

SEQ ID NO: 3186266 - RNA, 20 nt, Human
uggucucgaacuccugaccu

SEQ ID NO: 3186267 - RNA, 21 nt, Human
uggucucgaacuccugaccuu

SEQ ID NO: 3186268 - RNA, 15 nt, Human
uggucucgaacuccu

SEQ ID NO: 3186269 - RNA, 19 nt, Human
uggucucgaacuccugacc

SEQ ID NO: 3186270 - RNA, 16 nt, Human
uggucugggacucucu

SEQ ID NO: 3186271 - RNA, 18 nt, Human
uggucugacccacugcuu

SEQ ID NO: 3186272 - RNA, 22 nt, Human
uggucugugagaugcuagaacu

SEQ ID NO: 3186273 - RNA, 12 nt, Human
uggucuguguga

SEQ ID NO: 3186274 - RNA, 15 nt, Human
aggguugggcuggug

SEQ ID NO: 3186275 - RNA, 13 nt, Human
aggguugggcugg

SEQ ID NO: 3186276 - RNA, 14 nt, Human
aggguuggccccug

SEQ ID NO: 3186277 - RNA, 13 nt, Human
aggguuggccccu

SEQ ID NO: 3186278 - RNA, 19 nt, Human
aggguggugaccucugccu

SEQ ID NO: 3186279 - RNA, 18 nt, Human
aggguggugaccucugcc

SEQ ID NO: 3186280 - RNA, 17 nt, Human
aggguggugaccucugc

SEQ ID NO: 3186281 - RNA, 19 nt, Human
uggugaacagaacaaaagg

SEQ ID NO: 3186282 - RNA, 20 nt, Human
uggucuuuuccucgcuucuu

SEQ ID NO: 3186283 - RNA, 19 nt, Human
uggucuuuuccucgcuucu

SEQ ID NO: 3186284 - RNA, 17 nt, Human
uggucuuuuccucgcuu

SEQ ID NO: 3186285 - RNA, 14 nt, Human
uggucuuuugguua

SEQ ID NO: 3186286 - RNA, 12 nt, Human
uggucuuuuccu

SEQ ID NO: 3186287 - RNA, 13 nt, Human
uggucuuauauuu

SEQ ID NO: 3186288 - RNA, 23 nt, Human
agguagcuuugagguggaagagg

SEQ ID NO: 3186289 - RNA, 20 nt, Human
agguaggaauauuauauuug

SEQ ID NO: 3186290 - RNA, 23 nt, Human
agguagcugcagauaaguggccu

SEQ ID NO: 3186291 - RNA, 17 nt, Human
agguauacuuuaguaga

SEQ ID NO: 3186292 - RNA, 21 nt, Human
agguauacuuuaguagacauu

SEQ ID NO: 3186293 - RNA, 19 nt, Human
agguauaucauucuaaaga

SEQ ID NO: 3186294 - RNA, 18 nt, Human
agguauaucauucuaaag

SEQ ID NO: 3186295 - RNA, 15 nt, Human
agguauaucauucua

SEQ ID NO: 3186296 - RNA, 21 nt, Human
agguauaucauucuaaagaua

SEQ ID NO: 3186297 - RNA, 20 nt, Human
agguauaucauucuaaagau

SEQ ID NO: 3186298 - RNA, 22 nt, Human
agguauaucauucuaaagauag

SEQ ID NO: 3186299 - RNA, 20 nt, Human
aggguuuauguuuaggaugu

SEQ ID NO: 3186300 - RNA, 17 nt, Human
aggguugggcugguguc

SEQ ID NO: 3186301 - RNA, 20 nt, Human
aggguuggcaccuucccccu

SEQ ID NO: 3186302 - RNA, 17 nt, Human
aggguuggcaccuuccc

SEQ ID NO: 3186303 - RNA, 15 nt, Human
agguagagucugagg

SEQ ID NO: 3186304 - RNA, 19 nt, Human
agguagacuuuuaugagaa

SEQ ID NO: 3186305 - RNA, 20 nt, Human
agguagacuuuuaugagaac

SEQ ID NO: 3186306 - RNA, 18 nt, Human
agguagcccccucuuccc

SEQ ID NO: 3186307 - RNA, 20 nt, Human
agguagcauucuuuggaguu

SEQ ID NO: 3186308 - RNA, 17 nt, Human
agguagcccccucuucc

SEQ ID NO: 3186309 - RNA, 22 nt, Human
aggguuugagagagcagccagg

SEQ ID NO: 3186310 - RNA, 11 nt, Human
aggguuucuga

SEQ ID NO: 3186311 - RNA, 17 nt, Human
aggguuucagagagccu

SEQ ID NO: 3186312 - RNA, 21 nt, Human
aggucaaggcugcagugagcc

SEQ ID NO: 3186313 - RNA, 19 nt, Human
aggucaguuguguuuuuua

SEQ ID NO: 3186314 - RNA, 21 nt, Human
aggucuugaacuccuggccuc

SEQ ID NO: 3186315 - RNA, 20 nt, Human
aggucuugaacuccuggccu

SEQ ID NO: 3186316 - RNA, 17 nt, Human
agguccacaacacacag

SEQ ID NO: 3186317 - RNA, 18 nt, Human
aggucuugaacuccuggc

SEQ ID NO: 3186318 - RNA, 22 nt, Human
aggugaaacuccagaugccaca

SEQ ID NO: 3186319 - RNA, 21 nt, Human
aggugaaacuccagaugccac

SEQ ID NO: 3186320 - RNA, 20 nt, Human
aggugaaacuccagaugcca

SEQ ID NO: 3186321 - RNA, 19 nt, Human
aggugaaacuccagaugcc

SEQ ID NO: 3186322 - RNA, 12 nt, Human
ugguuuuaugau

SEQ ID NO: 3186323 - RNA, 23 nt, Human
ugguuugaaaauauuuucauuau

SEQ ID NO: 3186324 - RNA, 15 nt, Human
ugguuucuuuuugaa

SEQ ID NO: 3186325 - RNA, 21 nt, Human
ugguuuuaaaauacuguagau

SEQ ID NO: 3186326 - RNA, 16 nt, Human
ugguuuuaaaauacug

SEQ ID NO: 3186327 - RNA, 14 nt, Human
ugguuuuaaaauac

SEQ ID NO: 3186328 - RNA, 13 nt, Human
ugguuuuaaaaua

SEQ ID NO: 3186329 - RNA, 12 nt, Human
ugguuuuaaaau

SEQ ID NO: 3186330 - RNA, 20 nt, Human
ugguuuccugcccugggagg

SEQ ID NO: 3186331 - RNA, 19 nt, Human
ugguuucucuucuccccuu

SEQ ID NO: 3186332 - RNA, 15 nt, Human
ugguuucucuucucc

SEQ ID NO: 3186333 - RNA, 14 nt, Human
ugguuucucuucuc

SEQ ID NO: 3186334 - RNA, 13 nt, Human
ugguuucucuucu

SEQ ID NO: 3186335 - RNA, 22 nt, Human
ugguuuauuggugaguuaggaa

SEQ ID NO: 3186336 - RNA, 13 nt, Human
uguaaauauuaaa

SEQ ID NO: 3186337 - RNA, 23 nt, Human
aggugauccacccaccucagccu

SEQ ID NO: 3186338 - RNA, 21 nt, Human
aggugauccacccaccucagc

SEQ ID NO: 3186339 - RNA, 19 nt, Human
uguaaagauuucuguucag

SEQ ID NO: 3186340 - RNA, 15 nt, Human
uguaaagauuucugu

SEQ ID NO: 3186341 - RNA, 18 nt, Human
uguaaagauuucuguuca

SEQ ID NO: 3186342 - RNA, 16 nt, Human
uguaaagauuucuguu

SEQ ID NO: 3186343 - RNA, 17 nt, Human
ugguucacucuuggagc

SEQ ID NO: 3186344 - RNA, 14 nt, Human
ugguuauggagagg

SEQ ID NO: 3186345 - RNA, 19 nt, Human
ugguguuuuggauuuggag

SEQ ID NO: 3186346 - RNA, 15 nt, Human
ugguguuuccuggca

SEQ ID NO: 3186347 - RNA, 17 nt, Human
ugguguuuccuggcacu

SEQ ID NO: 3186348 - RNA, 18 nt, Human
ugguguuuuggauuugga

SEQ ID NO: 3186349 - RNA, 22 nt, Human
ugguucacucuuggagccugca

SEQ ID NO: 3186350 - RNA, 21 nt, Human
ugguucaaauguguuuugguc

SEQ ID NO: 3186351 - RNA, 21 nt, Human
ugguucacucuuggagccugc

SEQ ID NO: 3186352 - RNA, 20 nt, Human
ugguucacucuuggagccug

SEQ ID NO: 3186353 - RNA, 22 nt, Human
ugguucaggguuggccccugcc

SEQ ID NO: 3186354 - RNA, 20 nt, Human
ugguucaggguuggccccug

SEQ ID NO: 3186355 - RNA, 15 nt, Human
ugguuuaaaagaaaa

SEQ ID NO: 3186356 - RNA, 18 nt, Human
ugguuuaaaagaaaaaau

SEQ ID NO: 3186357 - RNA, 21 nt, Human
ugguguucaaaaaacuuguaa

SEQ ID NO: 3186358 - RNA, 22 nt, Human
ugguguucaaaaaacuuguaaa

SEQ ID NO: 3186359 - RNA, 15 nt, Human
ugguguguguaugcg

SEQ ID NO: 3186360 - RNA, 23 nt, Human
uggugugaccacugcagaagaca

SEQ ID NO: 3186361 - RNA, 12 nt, Human
ugguggcagcug

SEQ ID NO: 3186362 - RNA, 15 nt, Human
ugguggcagagugga

SEQ ID NO: 3186363 - RNA, 12 nt, Human
ugguggcagcuc

SEQ ID NO: 3186364 - RNA, 21 nt, Human
aggugaaggaggcuccaggca

SEQ ID NO: 3186365 - RNA, 19 nt, Human
aggugaaggaggcuccagg

SEQ ID NO: 3186366 - RNA, 18 nt, Human
aggugaaggaggcuccag

SEQ ID NO: 3186367 - RNA, 13 nt, Human
aggugaaggaggc

SEQ ID NO: 3186368 - RNA, 21 nt, Human
aggugaacauugguucuuuca

SEQ ID NO: 3186369 - RNA, 16 nt, Human
aggugaacaaucaacu

SEQ ID NO: 3186370 - RNA, 14 nt, Human
aggugaacauuggu

SEQ ID NO: 3186371 - RNA, 16 nt, Human
ugguggcagcucaccu

SEQ ID NO: 3186372 - RNA, 19 nt, Human
ugguggcagcucaccucuc

SEQ ID NO: 3186373 - RNA, 20 nt, Human
ugguggcagcucaccucucc

SEQ ID NO: 3186374 - RNA, 23 nt, Human
ugguggcagcucaccucucccuu

SEQ ID NO: 3186375 - RNA, 16 nt, Human
uguacuucuugaauau

SEQ ID NO: 3186376 - RNA, 23 nt, Human
uguacuugcccugaccaugcauu

SEQ ID NO: 3186377 - RNA, 16 nt, Human
uguagacaaaguacau

SEQ ID NO: 3186378 - RNA, 19 nt, Human
uguagacaaaguacauucu

SEQ ID NO: 3186379 - RNA, 19 nt, Human
uguacauuucuaagucaaa

SEQ ID NO: 3186380 - RNA, 15 nt, Human
uguacauuucuaagu

SEQ ID NO: 3186381 - RNA, 12 nt, Human
uguacauuucua

SEQ ID NO: 3186382 - RNA, 18 nt, Human
uguaaggaaugauuaauu

SEQ ID NO: 3186383 - RNA, 16 nt, Human
uguaagcuguguccua

SEQ ID NO: 3186384 - RNA, 23 nt, Human
uguaagcuguuugguuuuaaaau

SEQ ID NO: 3186385 - RNA, 17 nt, Human
uguaauuuuauuuuaaa

SEQ ID NO: 3186386 - RNA, 20 nt, Human
uguaauuuuauuuuaaaauu

SEQ ID NO: 3186387 - RNA, 23 nt, Human
uguaauuuuauuuuaaaauuuca

SEQ ID NO: 3186388 - RNA, 15 nt, Human
uguaaggcaugaagg

SEQ ID NO: 3186389 - RNA, 14 nt, Human
uguaaggcaugaag

SEQ ID NO: 3186390 - RNA, 23 nt, Human
uguacaaaguagaagucuuagau

SEQ ID NO: 3186391 - RNA, 19 nt, Human
uguacaaaguagaagucuu

SEQ ID NO: 3186392 - RNA, 22 nt, Human
uguacauauuagcgacaacaga

SEQ ID NO: 3186393 - RNA, 21 nt, Human
uguacauauuagcgacaacag

SEQ ID NO: 3186394 - RNA, 22 nt, Human
uguaagcucuacugaggugcua

SEQ ID NO: 3186395 - RNA, 18 nt, Human
uguaagaaauacuguaca

SEQ ID NO: 3186396 - RNA, 17 nt, Human
uguaagaaauacagacu

SEQ ID NO: 3186397 - RNA, 12 nt, Human
uguaagaaauac

SEQ ID NO: 3186398 - RNA, 15 nt, Human
uguaagaaauacaga

SEQ ID NO: 3186399 - RNA, 14 nt, Human
uguaaggaaugauu

SEQ ID NO: 3186400 - RNA, 15 nt, Human
uguaaggaaugauua

SEQ ID NO: 3186401 - RNA, 13 nt, Human
uguaaggaaugau

SEQ ID NO: 3186402 - RNA, 20 nt, Human
agguugucugaagucacugc

SEQ ID NO: 3186403 - RNA, 16 nt, Human
agguugucugaaguca

SEQ ID NO: 3186404 - RNA, 16 nt, Human
agguuguuagaaaaau

SEQ ID NO: 3186405 - RNA, 13 nt, Human
agguuuaaaacua

SEQ ID NO: 3186406 - RNA, 17 nt, Human
agguugucacugagaag

SEQ ID NO: 3186407 - RNA, 17 nt, Human
aggugugaggcaggaga

SEQ ID NO: 3186408 - RNA, 15 nt, Human
aggugugaggcagga

SEQ ID NO: 3186409 - RNA, 14 nt, Human
aggugugagucacc

SEQ ID NO: 3186410 - RNA, 20 nt, Human
aggugugagccaccacgccc

SEQ ID NO: 3186411 - RNA, 22 nt, Human
aggugugaaccaccacacccag

SEQ ID NO: 3186412 - RNA, 23 nt, Human
aggugugaaccaccacacccagc

SEQ ID NO: 3186413 - RNA, 13 nt, Human
agguggggcagcu

SEQ ID NO: 3186414 - RNA, 22 nt, Human
aggugauccacucgccuucauc

SEQ ID NO: 3186415 - RNA, 16 nt, Human
aggugauuaacuugga

SEQ ID NO: 3186416 - RNA, 22 nt, Human
aggugaucugcugcagagcagu

SEQ ID NO: 3186417 - RNA, 16 nt, Human
aggugaugaagacagc

SEQ ID NO: 3186418 - RNA, 23 nt, Human
agguggggucacucuggcagcuc

SEQ ID NO: 3186419 - RNA, 14 nt, Human
agguggggcagcuu

SEQ ID NO: 3186420 - RNA, 15 nt, Human
aggugggugucugcg

SEQ ID NO: 3186421 - RNA, 14 nt, Human
uuaucaugaauuuu

SEQ ID NO: 3186422 - RNA, 18 nt, Human
uuaucaugaauuuuaaag

SEQ ID NO: 3186423 - RNA, 19 nt, Human
uuaucaugaauuuuaaagu

SEQ ID NO: 3186424 - RNA, 19 nt, Human
uuaucaguuugcuaauguu

SEQ ID NO: 3186425 - RNA, 20 nt, Human
uuaucaguuugcuaauguuu

SEQ ID NO: 3186426 - RNA, 14 nt, Human
uuaucaacauuugu

SEQ ID NO: 3186427 - RNA, 21 nt, Human
uuaucagauugcuuuugugca

SEQ ID NO: 3186428 - RNA, 15 nt, Human
uuaucagagucauga

SEQ ID NO: 3186429 - RNA, 14 nt, Human
uuaucagcaaagaa

SEQ ID NO: 3186430 - RNA, 18 nt, Human
auacaucacguuaaagua

SEQ ID NO: 3186431 - RNA, 22 nt, Human
auacuagauuugggagaagggc

SEQ ID NO: 3186432 - RNA, 15 nt, Human
auacuagauuuggga

SEQ ID NO: 3186433 - RNA, 21 nt, Human
auacauucuuuuugcucuaaa

SEQ ID NO: 3186434 - RNA, 21 nt, Human
auacauuuaaaacauuaaaau

SEQ ID NO: 3186435 - RNA, 16 nt, Human
auacauuuaaaacauu

SEQ ID NO: 3186436 - RNA, 16 nt, Human
auacauuugauaaagu

SEQ ID NO: 3186437 - RNA, 17 nt, Human
auaccaagcauguggau

SEQ ID NO: 3186438 - RNA, 17 nt, Human
auaccaaauuaaaaaaa

SEQ ID NO: 3186439 - RNA, 16 nt, Human
auacauucuuuuugcu

SEQ ID NO: 3186440 - RNA, 12 nt, Human
auacauucuuuu

SEQ ID NO: 3186441 - RNA, 16 nt, Human
auacagggaugguguu

SEQ ID NO: 3186442 - RNA, 20 nt, Human
auacaggaaaagcugcugac

SEQ ID NO: 3186443 - RNA, 19 nt, Human
auacaggaaaagcugcuga

SEQ ID NO: 3186444 - RNA, 14 nt, Human
auacaggaaaagcu

SEQ ID NO: 3186445 - RNA, 23 nt, Human
auacagcaaaccuaauugcacaa

SEQ ID NO: 3186446 - RNA, 15 nt, Human
auacaaaugcaucuu

SEQ ID NO: 3186447 - RNA, 19 nt, Human
auacaaaguuagagaacua

SEQ ID NO: 3186448 - RNA, 16 nt, Human
auacaaacaagcauau

SEQ ID NO: 3186449 - RNA, 21 nt, Human
auacaaaugcaucuuugaugu

SEQ ID NO: 3186450 - RNA, 22 nt, Human
auacaaaugcaucuuugaugug

SEQ ID NO: 3186451 - RNA, 17 nt, Human
auacaaaugcaucuuug

SEQ ID NO: 3186452 - RNA, 18 nt, Human
auacaaaugcaucuuuga

SEQ ID NO: 3186453 - RNA, 19 nt, Human
auacaaaugcaucuuugau

SEQ ID NO: 3186454 - RNA, 20 nt, Human
auacaaaugcaucuuugaug

SEQ ID NO: 3186455 - RNA, 23 nt, Human
uuauagagcagaaauucuguuuu

SEQ ID NO: 3186456 - RNA, 22 nt, Human
uuauagagcagaaauucuguuu

SEQ ID NO: 3186457 - RNA, 17 nt, Human
uuauagagcagaaauuc

SEQ ID NO: 3186458 - RNA, 15 nt, Human
uuauagagcagaaau

SEQ ID NO: 3186459 - RNA, 15 nt, Human
uuauagaagaaugca

SEQ ID NO: 3186460 - RNA, 12 nt, Human
uuauagaagaau

SEQ ID NO: 3186461 - RNA, 22 nt, Human
uuauagaagaaugcaugcuuuc

SEQ ID NO: 3186462 - RNA, 19 nt, Human
uuauagaagaaugcaugcu

SEQ ID NO: 3186463 - RNA, 17 nt, Human
uuauagaagaaugcaug

SEQ ID NO: 3186464 - RNA, 15 nt, Human
uuauaccuguuuaaa

SEQ ID NO: 3186465 - RNA, 14 nt, Human
uuauaccuguuuaa

SEQ ID NO: 3186466 - RNA, 12 nt, Human
uuauaccuguuu

SEQ ID NO: 3186467 - RNA, 14 nt, Human
uuauaccuguugcu

SEQ ID NO: 3186468 - RNA, 24 nt, Human
uuauacugggacaccauuaccaaa

SEQ ID NO: 3186469 - RNA, 17 nt, Human
uuauaguacuagagaua

SEQ ID NO: 3186470 - RNA, 18 nt, Human
uuauaguacugacagaua

SEQ ID NO: 3186471 - RNA, 16 nt, Human
uuauaguacugacaga

SEQ ID NO: 3186472 - RNA, 18 nt, Human
uuauagguccuuuagaaa

SEQ ID NO: 3186473 - RNA, 13 nt, Human
uuauaguuaaucu

SEQ ID NO: 3186474 - RNA, 22 nt, Human
uuauagugcaauauauuuugua

SEQ ID NO: 3186475 - RNA, 19 nt, Human
uuauagugcaauauauuuu

SEQ ID NO: 3186476 - RNA, 17 nt, Human
uuauagugcaauauauu

SEQ ID NO: 3186477 - RNA, 15 nt, Human
uuauagugcaauaua

SEQ ID NO: 3186478 - RNA, 14 nt, Human
uuauagugcaauau

SEQ ID NO: 3186479 - RNA, 13 nt, Human
uuauagugcaaua

SEQ ID NO: 3186480 - RNA, 18 nt, Human
uuauacccccugcaaagc

SEQ ID NO: 3186481 - RNA, 23 nt, Human
uuauaaccuaguuaaagaaagga

SEQ ID NO: 3186482 - RNA, 21 nt, Human
uuauaaauuggugaugcuugu

SEQ ID NO: 3186483 - RNA, 12 nt, Human
uuauaaauuucg

SEQ ID NO: 3186484 - RNA, 14 nt, Human
uuagccccauaauu

SEQ ID NO: 3186485 - RNA, 19 nt, Human
uuagccuaagauauacuug

SEQ ID NO: 3186486 - RNA, 16 nt, Human
uuagccuaagauauac

SEQ ID NO: 3186487 - RNA, 15 nt, Human
uuagccuaagauaua

SEQ ID NO: 3186488 - RNA, 14 nt, Human
uuagccggagaucc

SEQ ID NO: 3186489 - RNA, 19 nt, Human
uuauauauauauauauuuc

SEQ ID NO: 3186490 - RNA, 19 nt, Human
uuauauaucccugauaaau

SEQ ID NO: 3186491 - RNA, 18 nt, Human
uuauauaucccugauaaa

SEQ ID NO: 3186492 - RNA, 13 nt, Human
uuauauaucccug

SEQ ID NO: 3186493 - RNA, 14 nt, Human
uuauauauauaucu

SEQ ID NO: 3186494 - RNA, 22 nt, Human
auaauuuuccuuuaauaugaaa

SEQ ID NO: 3186495 - RNA, 12 nt, Human
auaauuuuacaa

SEQ ID NO: 3186496 - RNA, 12 nt, Human
auaauuuuccuu

SEQ ID NO: 3186497 - RNA, 19 nt, Human
auaauuuuccuuuaauaug

SEQ ID NO: 3186498 - RNA, 13 nt, Human
auaauuuuccuuu

SEQ ID NO: 3186499 - RNA, 17 nt, Human
uuauaguuaaucuauaa

SEQ ID NO: 3186500 - RNA, 14 nt, Human
uuauaguuaaucua

SEQ ID NO: 3186501 - RNA, 14 nt, Human
uuauauaaaguauu

SEQ ID NO: 3186502 - RNA, 16 nt, Human
uuauauaaaguauucu

SEQ ID NO: 3186503 - RNA, 18 nt, Human
uuauauaaaguauucuuu

SEQ ID NO: 3186504 - RNA, 22 nt, Human
uuauauaaaguauucuuuuucu

SEQ ID NO: 3186505 - RNA, 13 nt, Human
auaauuuugauag

SEQ ID NO: 3186506 - RNA, 23 nt, Human
auaauuuuguaauguaucaaaua

SEQ ID NO: 3186507 - RNA, 13 nt, Human
auaauuuuguaau

SEQ ID NO: 3186508 - RNA, 12 nt, Human
auaauuuuguaa
